United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 27

SEQ ID NO: 991697 - RNA, 14 nt, Mycobacterium avium subsp. paratuberculosis
ccgcccgggcccgg

SEQ ID NO: 991698 - RNA, 16 nt, Mycobacterium avium subsp. paratuberculosis
ccgcccgggcggcccg

SEQ ID NO: 991699 - RNA, 15 nt, Mycobacterium avium subsp. paratuberculosis
ccgccaucggcaucg

SEQ ID NO: 991700 - RNA, 15 nt, Mycobacterium avium subsp. paratuberculosis
ccgccaucuccuccg

SEQ ID NO: 991701 - RNA, 18 nt, Mycobacterium avium subsp. paratuberculosis
ccgccaucuccuccgggc

SEQ ID NO: 991702 - RNA, 21 nt, Mycobacterium avium subsp. paratuberculosis
ccgcccagcaucgccgcgacc

SEQ ID NO: 991703 - RNA, 17 nt, Mycobacterium avium subsp. paratuberculosis
ccgcccacgccgcccag

SEQ ID NO: 991704 - RNA, 21 nt, Mycobacterium avium subsp. paratuberculosis
ccgcccacgccgcccaggccc

SEQ ID NO: 991705 - RNA, 20 nt, Mycobacterium avium subsp. paratuberculosis
ccgcccagacgcgggcgccc

SEQ ID NO: 991706 - RNA, 20 nt, Mycobacterium avium subsp. paratuberculosis
ccgcccacguaggggcccgg

SEQ ID NO: 991707 - RNA, 13 nt, Mycobacterium avium subsp. paratuberculosis
ccgcccaccaccg

SEQ ID NO: 991708 - RNA, 15 nt, Mycobacterium avium subsp. paratuberculosis
ccgcccaccaccggc

SEQ ID NO: 991709 - RNA, 17 nt, Mycobacterium avium subsp. paratuberculosis
ccgcccaccaccggcuu

SEQ ID NO: 991710 - RNA, 12 nt, Mycobacterium avium subsp. paratuberculosis
ccgcccaccacg

SEQ ID NO: 991711 - RNA, 22 nt, Mycobacterium avium subsp. paratuberculosis
ccgcccaccacgaaccaggcgc

SEQ ID NO: 991712 - RNA, 12 nt, Mycobacterium avium subsp. paratuberculosis
ccgcccacagca

SEQ ID NO: 991713 - RNA, 13 nt, Mycobacterium avium subsp. paratuberculosis
ccgcccacagcaa

SEQ ID NO: 991714 - RNA, 12 nt, Mycobacterium avium subsp. paratuberculosis
ccgcccaggccg

SEQ ID NO: 991715 - RNA, 17 nt, Mycobacterium avium subsp. paratuberculosis
ccgcccaggccgccagc

SEQ ID NO: 991716 - RNA, 15 nt, Mycobacterium avium subsp. paratuberculosis
ccgcccaggacccgu

SEQ ID NO: 991717 - RNA, 12 nt, Mycobacterium avium subsp. paratuberculosis
ccgcccagcggc

SEQ ID NO: 991718 - RNA, 19 nt, Mycobacterium avium subsp. paratuberculosis
ccgcccagcgcauccacca

SEQ ID NO: 991719 - RNA, 16 nt, Mycobacterium avium subsp. paratuberculosis
ccgccgcgucgugccg

SEQ ID NO: 991720 - RNA, 14 nt, Mycobacterium avium subsp. paratuberculosis
ccgccgcucaccgc

SEQ ID NO: 991721 - RNA, 17 nt, Mycobacterium avium subsp. paratuberculosis
ccgccgcucaccgccga

SEQ ID NO: 991722 - RNA, 12 nt, Mycobacterium avium subsp. paratuberculosis
ccgccgcgggcu

SEQ ID NO: 991723 - RNA, 15 nt, Mycobacterium avium subsp. paratuberculosis
ccgccgcgggucggc

SEQ ID NO: 991724 - RNA, 20 nt, Mycobacterium avium subsp. paratuberculosis
ccgccgcguacagccagccc

SEQ ID NO: 991725 - RNA, 20 nt, Mycobacterium avium subsp. paratuberculosis
ccgccgcguaggccaggacc

SEQ ID NO: 991726 - RNA, 17 nt, Mycobacterium avium subsp. paratuberculosis
ccgccgcggcgaccacg

SEQ ID NO: 991727 - RNA, 16 nt, Mycobacterium avium subsp. paratuberculosis
ccgccgcggcgaccgg

SEQ ID NO: 991728 - RNA, 18 nt, Mycobacterium avium subsp. paratuberculosis
ccgccgcggcgagccggc

SEQ ID NO: 991729 - RNA, 12 nt, Mycobacterium avium subsp. paratuberculosis
ccgccgcggcgc

SEQ ID NO: 991730 - RNA, 13 nt, Mycobacterium avium subsp. paratuberculosis
ccgccgcggcggc

SEQ ID NO: 991731 - RNA, 20 nt, Mycobacterium avium subsp. paratuberculosis
ccgccgcggcgguggccugc

SEQ ID NO: 991732 - RNA, 15 nt, Mycobacterium avium subsp. paratuberculosis
ccgccgcggcuccag

SEQ ID NO: 991733 - RNA, 17 nt, Mycobacterium avium subsp. paratuberculosis
ccgccgcggcuccagca

SEQ ID NO: 991734 - RNA, 20 nt, Mycobacterium avium subsp. paratuberculosis
ccgccgcggcuccagcagcg

SEQ ID NO: 991735 - RNA, 12 nt, Mycobacterium avium subsp. paratuberculosis
ccgccgcggcac

SEQ ID NO: 991736 - RNA, 23 nt, Mycobacterium avium subsp. paratuberculosis
ccgccgcggcaccuucaccgacc

SEQ ID NO: 991737 - RNA, 14 nt, Mycobacterium avium subsp. paratuberculosis
ccgccgcggccagg

SEQ ID NO: 991738 - RNA, 14 nt, Mycobacterium avium subsp. paratuberculosis
ccgccgcggccgcg

SEQ ID NO: 991739 - RNA, 15 nt, Mycobacterium avium subsp. paratuberculosis
ccgccgcggccgcga

SEQ ID NO: 991740 - RNA, 18 nt, Mycobacterium avium subsp. paratuberculosis
ccgccgcgcgcggccacc

SEQ ID NO: 991741 - RNA, 22 nt, Mycobacterium avium subsp. paratuberculosis
ccgccgcgcggccgggcucccg

SEQ ID NO: 991742 - RNA, 14 nt, Mycobacterium avium subsp. paratuberculosis
ccgccgcgcccggc

SEQ ID NO: 991743 - RNA, 16 nt, Mycobacterium avium subsp. paratuberculosis
ccgccgcgcauccgca

SEQ ID NO: 991744 - RNA, 18 nt, Mycobacterium avium subsp. paratuberculosis
ccgccgcgcccggcuucg

SEQ ID NO: 991745 - RNA, 16 nt, Mycobacterium avium subsp. paratuberculosis
ccgccggaacucggcc

SEQ ID NO: 991746 - RNA, 18 nt, Mycobacterium avium subsp. paratuberculosis
ccgccggaacucggccgg

SEQ ID NO: 991747 - RNA, 18 nt, Mycobacterium avium subsp. paratuberculosis
ccgccggagaccagcagc

SEQ ID NO: 991748 - RNA, 21 nt, Mycobacterium avium subsp. paratuberculosis
ccgccggagacgacucuucca

SEQ ID NO: 991749 - RNA, 14 nt, Mycobacterium avium subsp. paratuberculosis
ccgccggagaugau

SEQ ID NO: 991750 - RNA, 13 nt, Mycobacterium avium subsp. paratuberculosis
ccgccggagccga

SEQ ID NO: 991751 - RNA, 14 nt, Mycobacterium avium subsp. paratuberculosis
ccgccggcaguccg

SEQ ID NO: 991752 - RNA, 18 nt, Mycobacterium avium subsp. paratuberculosis
ccgccggcagcggcugcu

SEQ ID NO: 991753 - RNA, 15 nt, Mycobacterium avium subsp. paratuberculosis
ccgccggcccaggca

SEQ ID NO: 991754 - RNA, 16 nt, Mycobacterium avium subsp. paratuberculosis
ccgccggcccaggcag

SEQ ID NO: 991755 - RNA, 19 nt, Mycobacterium avium subsp. paratuberculosis
ccgccggccgcggcgugca

SEQ ID NO: 991756 - RNA, 14 nt, Mycobacterium avium subsp. paratuberculosis
ccgccggcccggcg

SEQ ID NO: 991757 - RNA, 23 nt, Mycobacterium avium subsp. paratuberculosis
ccgccgccgagcucggccaccag

SEQ ID NO: 991758 - RNA, 15 nt, Mycobacterium avium subsp. paratuberculosis
ccgccgccggcgucg

SEQ ID NO: 991759 - RNA, 18 nt, Mycobacterium avium subsp. paratuberculosis
ccgccgcgagccgcccag

SEQ ID NO: 991760 - RNA, 19 nt, Mycobacterium avium subsp. paratuberculosis
ccgccgcgaucagggccca

SEQ ID NO: 991761 - RNA, 20 nt, Mycobacterium avium subsp. paratuberculosis
ccgccgcgaucuugccgccg

SEQ ID NO: 991762 - RNA, 21 nt, Mycobacterium avium subsp. paratuberculosis
ccgccgcgaucuugccgccgc

SEQ ID NO: 991763 - RNA, 19 nt, Mycobacterium avium subsp. paratuberculosis
ccgccgcgaccgucagcag

SEQ ID NO: 991764 - RNA, 21 nt, Mycobacterium avium subsp. paratuberculosis
ccgccgccgugcauccagccg

SEQ ID NO: 991765 - RNA, 17 nt, Mycobacterium avium subsp. paratuberculosis
ccgccgcgaacucaggc

SEQ ID NO: 991766 - RNA, 20 nt, Mycobacterium avium subsp. paratuberculosis
ccgccgcgaacucaggcgcg

SEQ ID NO: 991767 - RNA, 17 nt, Mycobacterium avium subsp. paratuberculosis
ccgccgcgaccacagcg

SEQ ID NO: 991768 - RNA, 20 nt, Mycobacterium avium subsp. paratuberculosis
ccgccgcgaccacagcgccu

SEQ ID NO: 991769 - RNA, 14 nt, Mycobacterium avium subsp. paratuberculosis
ccgccgccagcgcc

SEQ ID NO: 991770 - RNA, 22 nt, Mycobacterium avium subsp. paratuberculosis
ccgccgccagcgcggggucggc

SEQ ID NO: 991771 - RNA, 18 nt, Mycobacterium avium subsp. paratuberculosis
ccgccgccagccagccgg

SEQ ID NO: 991772 - RNA, 17 nt, Mycobacterium avium subsp. paratuberculosis
ccgccgcauaccgcccg

SEQ ID NO: 991773 - RNA, 14 nt, Mycobacterium avium subsp. paratuberculosis
ccgccgccagcacc

SEQ ID NO: 991774 - RNA, 15 nt, Mycobacterium avium subsp. paratuberculosis
ccgccgcccaggccg

SEQ ID NO: 991775 - RNA, 12 nt, Mycobacterium avium subsp. paratuberculosis
ccgccgccacca

SEQ ID NO: 991776 - RNA, 15 nt, Mycobacterium avium subsp. paratuberculosis
ccgccgcaccggccg

SEQ ID NO: 991777 - RNA, 17 nt, Mycobacterium avium subsp. paratuberculosis
ccgccgcaccucgccgg

SEQ ID NO: 991778 - RNA, 20 nt, Mycobacterium avium subsp. paratuberculosis
ccgccggugaucucccgugc

SEQ ID NO: 991779 - RNA, 14 nt, Mycobacterium avium subsp. paratuberculosis
ccgccgguggcggc

SEQ ID NO: 991780 - RNA, 19 nt, Mycobacterium avium subsp. paratuberculosis
ccgccgguggcgucgguga

SEQ ID NO: 991781 - RNA, 15 nt, Mycobacterium avium subsp. paratuberculosis
ccgccggugcgcagc

SEQ ID NO: 991782 - RNA, 22 nt, Mycobacterium avium subsp. paratuberculosis
ccgccggugcgcagcuugcucu

SEQ ID NO: 991783 - RNA, 13 nt, Mycobacterium avium subsp. paratuberculosis
ccgccgguggaga

SEQ ID NO: 991784 - RNA, 18 nt, Mycobacterium avium subsp. paratuberculosis
ccgccggguggccgccac

SEQ ID NO: 991785 - RNA, 19 nt, Mycobacterium avium subsp. paratuberculosis
ccgccggguggccgccacg

SEQ ID NO: 991786 - RNA, 19 nt, Mycobacterium avium subsp. paratuberculosis
ccgccggggacccgcaccg

SEQ ID NO: 991787 - RNA, 19 nt, Mycobacterium avium subsp. paratuberculosis
ccgccggggugcaccgugg

SEQ ID NO: 991788 - RNA, 21 nt, Mycobacterium avium subsp. paratuberculosis
ccgccgggcugagcugugccg

SEQ ID NO: 991789 - RNA, 21 nt, Mycobacterium avium subsp. paratuberculosis
ccgccggggccccaacccccc

SEQ ID NO: 991790 - RNA, 12 nt, Mycobacterium avium subsp. paratuberculosis
ccgccggggccg

SEQ ID NO: 991791 - RNA, 14 nt, Mycobacterium avium subsp. paratuberculosis
ccgccggggcgggc

SEQ ID NO: 991792 - RNA, 17 nt, Mycobacterium avium subsp. paratuberculosis
ccgccggggcgggcagc

SEQ ID NO: 991793 - RNA, 15 nt, Mycobacterium avium subsp. paratuberculosis
ccgccggcggccucc

SEQ ID NO: 991794 - RNA, 16 nt, Mycobacterium avium subsp. paratuberculosis
ccgccggcggccuccg

SEQ ID NO: 991795 - RNA, 20 nt, Mycobacterium avium subsp. paratuberculosis
ccgccggcgguggcguagcg

SEQ ID NO: 991796 - RNA, 12 nt, Mycobacterium avium subsp. paratuberculosis
ccgccggcgucu

SEQ ID NO: 991797 - RNA, 14 nt, Mycobacterium avium subsp. paratuberculosis
ccgccggcucagcg

SEQ ID NO: 991798 - RNA, 15 nt, Mycobacterium avium subsp. paratuberculosis
ccgccggcucagcgg

SEQ ID NO: 991799 - RNA, 13 nt, Mycobacterium avium subsp. paratuberculosis
ccgccgggcggcg

SEQ ID NO: 991800 - RNA, 13 nt, Mycobacterium avium subsp. paratuberculosis
ccgccgggcgggc

SEQ ID NO: 991801 - RNA, 14 nt, Mycobacterium avium subsp. paratuberculosis
ccgccgggcgggcc

SEQ ID NO: 991802 - RNA, 12 nt, Mycobacterium avium subsp. paratuberculosis
ccgccgggcggc

SEQ ID NO: 991803 - RNA, 15 nt, Mycobacterium avium subsp. paratuberculosis
ccgccgggcggcagc

SEQ ID NO: 991804 - RNA, 12 nt, Mycobacterium avium subsp. paratuberculosis
ccgccgggcgcg

SEQ ID NO: 991805 - RNA, 12 nt, Mycobacterium avium subsp. paratuberculosis
ccgccgggccgg

SEQ ID NO: 991806 - RNA, 14 nt, Mycobacterium avium subsp. paratuberculosis
ccgccgggccaggu

SEQ ID NO: 991807 - RNA, 21 nt, Mycobacterium avium subsp. paratuberculosis
ccgccgggcauccgggccgcc

SEQ ID NO: 991808 - RNA, 23 nt, Mycobacterium avium subsp. paratuberculosis
ccgccgggcauccgggccgccgc

SEQ ID NO: 991809 - RNA, 16 nt, Mycobacterium avium subsp. paratuberculosis
ccgccguagccggcgg

SEQ ID NO: 991810 - RNA, 19 nt, Mycobacterium avium subsp. paratuberculosis
ccgccgucgccaccaccgc

SEQ ID NO: 991811 - RNA, 20 nt, Mycobacterium avium subsp. paratuberculosis
ccgccguggcagggccagca

SEQ ID NO: 991812 - RNA, 23 nt, Mycobacterium avium subsp. paratuberculosis
ccgccguggcagggccagcagcc

SEQ ID NO: 991813 - RNA, 16 nt, Mycobacterium avium subsp. paratuberculosis
ccgccguguaggccgc

SEQ ID NO: 991814 - RNA, 23 nt, Mycobacterium avium subsp. paratuberculosis
ccgccguguaggccgcgcuggcc

SEQ ID NO: 991815 - RNA, 21 nt, Mycobacterium avium subsp. paratuberculosis
ccgccuccgacagccgcaccg

SEQ ID NO: 991816 - RNA, 18 nt, Mycobacterium avium subsp. paratuberculosis
ccgccguucucgcgcagg

SEQ ID NO: 991817 - RNA, 21 nt, Mycobacterium avium subsp. paratuberculosis
aaaccaccugccgcaacgggc

SEQ ID NO: 991818 - RNA, 12 nt, Mycobacterium avium subsp. paratuberculosis
ccgacagcagcu

SEQ ID NO: 991819 - RNA, 19 nt, Mycobacterium avium subsp. paratuberculosis
ccgacagcccccgcagccc

SEQ ID NO: 991820 - RNA, 14 nt, Mycobacterium avium subsp. paratuberculosis
ccgacagcccgccc

SEQ ID NO: 991821 - RNA, 22 nt, Mycobacterium avium subsp. paratuberculosis
ccgacagaugcggcaccagccc

SEQ ID NO: 991822 - RNA, 19 nt, Mycobacterium avium subsp. paratuberculosis
ccgacagcacgccgggcau

SEQ ID NO: 991823 - RNA, 20 nt, Mycobacterium avium subsp. paratuberculosis
ccgacacguaggccgccugc

SEQ ID NO: 991824 - RNA, 14 nt, Mycobacterium avium subsp. paratuberculosis
ccgacagggccagc

SEQ ID NO: 991825 - RNA, 18 nt, Mycobacterium avium subsp. paratuberculosis
ccgacagucgcgggcgag

SEQ ID NO: 991826 - RNA, 15 nt, Mycobacterium avium subsp. paratuberculosis
ccgacaguucggcgc

SEQ ID NO: 991827 - RNA, 18 nt, Mycobacterium avium subsp. paratuberculosis
ccgacaguucggcgcgca

SEQ ID NO: 991828 - RNA, 12 nt, Mycobacterium avium subsp. paratuberculosis
ccgacaggaugc

SEQ ID NO: 991829 - RNA, 14 nt, Mycobacterium avium subsp. paratuberculosis
ccgacagcgccugc

SEQ ID NO: 991830 - RNA, 20 nt, Mycobacterium avium subsp. paratuberculosis
ccgacauggacgcggccuca

SEQ ID NO: 991831 - RNA, 21 nt, Mycobacterium avium subsp. paratuberculosis
ccgacaucgaaugcagcggcu

SEQ ID NO: 991832 - RNA, 21 nt, Mycobacterium avium subsp. paratuberculosis
ccgacaucgccaucagcagcg

SEQ ID NO: 991833 - RNA, 16 nt, Mycobacterium avium subsp. paratuberculosis
ccgacaucgucggcuc

SEQ ID NO: 991834 - RNA, 21 nt, Mycobacterium avium subsp. paratuberculosis
ccgaccaccuugcgcagcagc

SEQ ID NO: 991835 - RNA, 16 nt, Mycobacterium avium subsp. paratuberculosis
ccgaccacggccccag

SEQ ID NO: 991836 - RNA, 23 nt, Mycobacterium avium subsp. paratuberculosis
ccgaccacaccggcgcugcccgc

SEQ ID NO: 991837 - RNA, 20 nt, Mycobacterium avium subsp. paratuberculosis
ccgaccacccccagcccgcc

SEQ ID NO: 991838 - RNA, 19 nt, Mycobacterium avium subsp. paratuberculosis
ccgaccagcggcccaccgc

SEQ ID NO: 991839 - RNA, 14 nt, Mycobacterium avium subsp. paratuberculosis
ccgaccagccgaag

SEQ ID NO: 991840 - RNA, 20 nt, Mycobacterium avium subsp. paratuberculosis
ccgaccagccggucuuggac

SEQ ID NO: 991841 - RNA, 21 nt, Mycobacterium avium subsp. paratuberculosis
ccgaccgcguacagggcgucg

SEQ ID NO: 991842 - RNA, 13 nt, Mycobacterium avium subsp. paratuberculosis
ccgaccgccgcca

SEQ ID NO: 991843 - RNA, 13 nt, Mycobacterium avium subsp. paratuberculosis
ccgaccgccgcgg

SEQ ID NO: 991844 - RNA, 15 nt, Mycobacterium avium subsp. paratuberculosis
ccgaccgcgccgaac

SEQ ID NO: 991845 - RNA, 17 nt, Mycobacterium avium subsp. paratuberculosis
ccgaccgccaccacccg

SEQ ID NO: 991846 - RNA, 19 nt, Mycobacterium avium subsp. paratuberculosis
ccgacccugcguccggccc

SEQ ID NO: 991847 - RNA, 22 nt, Mycobacterium avium subsp. paratuberculosis
ccgacccugcguccggcccggc

SEQ ID NO: 991848 - RNA, 16 nt, Mycobacterium avium subsp. paratuberculosis
ccgacccggucagcuc

SEQ ID NO: 991849 - RNA, 15 nt, Mycobacterium avium subsp. paratuberculosis
ccgacccgcugcagc

SEQ ID NO: 991850 - RNA, 12 nt, Mycobacterium avium subsp. paratuberculosis
ccgaccccgcca

SEQ ID NO: 991851 - RNA, 13 nt, Mycobacterium avium subsp. paratuberculosis
ccgacccgcccgc

SEQ ID NO: 991852 - RNA, 21 nt, Mycobacterium avium subsp. paratuberculosis
ccgaccaggaacacggcucgg

SEQ ID NO: 991853 - RNA, 14 nt, Mycobacterium avium subsp. paratuberculosis
ccgacccaauacga

SEQ ID NO: 991854 - RNA, 17 nt, Mycobacterium avium subsp. paratuberculosis
ccgagcaccaccaggcc

SEQ ID NO: 991855 - RNA, 16 nt, Mycobacterium avium subsp. paratuberculosis
ccgagcaacagcccga

SEQ ID NO: 991856 - RNA, 12 nt, Mycobacterium avium subsp. paratuberculosis
ccgagcaaccgg

SEQ ID NO: 991857 - RNA, 14 nt, Mycobacterium avium subsp. paratuberculosis
ccgagcaccgggcc

SEQ ID NO: 991858 - RNA, 19 nt, Mycobacterium avium subsp. paratuberculosis
ccgagcaccgggcugucgg

SEQ ID NO: 991859 - RNA, 22 nt, Mycobacterium avium subsp. paratuberculosis
ccgagcaccucgucgccgucgg

SEQ ID NO: 991860 - RNA, 23 nt, Mycobacterium avium subsp. paratuberculosis
ccgagcaccugaacggccgcgca

SEQ ID NO: 991861 - RNA, 18 nt, Mycobacterium avium subsp. paratuberculosis
ccgagcacgaacgcggcc

SEQ ID NO: 991862 - RNA, 21 nt, Mycobacterium avium subsp. paratuberculosis
ccgagcacgaacgcggccgcc

SEQ ID NO: 991863 - RNA, 23 nt, Mycobacterium avium subsp. paratuberculosis
ccgagcacgaacgcggccgccau

SEQ ID NO: 991864 - RNA, 20 nt, Mycobacterium avium subsp. paratuberculosis
ccgagcacgcagccgcgccc

SEQ ID NO: 991865 - RNA, 21 nt, Mycobacterium avium subsp. paratuberculosis
ccgagcacgcagccgcgcccg

SEQ ID NO: 991866 - RNA, 18 nt, Mycobacterium avium subsp. paratuberculosis
ccgagcccgccggcggcg

SEQ ID NO: 991867 - RNA, 20 nt, Mycobacterium avium subsp. paratuberculosis
ccgagcccgccggcggcgau

SEQ ID NO: 991868 - RNA, 15 nt, Mycobacterium avium subsp. paratuberculosis
ccgagccgcaccgcc

SEQ ID NO: 991869 - RNA, 14 nt, Mycobacterium avium subsp. paratuberculosis
ccgagccgcgcgcc

SEQ ID NO: 991870 - RNA, 20 nt, Mycobacterium avium subsp. paratuberculosis
ccgagccgcuugguggcgcc

SEQ ID NO: 991871 - RNA, 17 nt, Mycobacterium avium subsp. paratuberculosis
ccgagccgaugcccagc

SEQ ID NO: 991872 - RNA, 13 nt, Mycobacterium avium subsp. paratuberculosis
ccgagcaccagcg

SEQ ID NO: 991873 - RNA, 14 nt, Mycobacterium avium subsp. paratuberculosis
ccgagcaccagcgg

SEQ ID NO: 991874 - RNA, 21 nt, Mycobacterium avium subsp. paratuberculosis
ccgagcaccaggcgcaccagc

SEQ ID NO: 991875 - RNA, 15 nt, Mycobacterium avium subsp. paratuberculosis
ccgagcaccggcagc

SEQ ID NO: 991876 - RNA, 20 nt, Mycobacterium avium subsp. paratuberculosis
ccgagcagaucgggucccag

SEQ ID NO: 991877 - RNA, 14 nt, Mycobacterium avium subsp. paratuberculosis
ccgagcagcaccgc

SEQ ID NO: 991878 - RNA, 17 nt, Mycobacterium avium subsp. paratuberculosis
ccgagcagccgguccau

SEQ ID NO: 991879 - RNA, 21 nt, Mycobacterium avium subsp. paratuberculosis
ccgagcagcgggucgucgggc

SEQ ID NO: 991880 - RNA, 18 nt, Mycobacterium avium subsp. paratuberculosis
ccgagcagcucggcggcc

SEQ ID NO: 991881 - RNA, 11 nt, Mycobacterium avium subsp. paratuberculosis
ccgagcaggcg

SEQ ID NO: 991882 - RNA, 16 nt, Mycobacterium avium subsp. paratuberculosis
ccgagcaucgccgagc

SEQ ID NO: 991883 - RNA, 22 nt, Mycobacterium avium subsp. paratuberculosis
ccgagcaucggguugccggcgg

SEQ ID NO: 991884 - RNA, 15 nt, Mycobacterium avium subsp. paratuberculosis
ccgacgagucgacgc

SEQ ID NO: 991885 - RNA, 19 nt, Mycobacterium avium subsp. paratuberculosis
ccgacgauccgggccgguc

SEQ ID NO: 991886 - RNA, 22 nt, Mycobacterium avium subsp. paratuberculosis
ccgacgauccgggcgcccuuga

SEQ ID NO: 991887 - RNA, 14 nt, Mycobacterium avium subsp. paratuberculosis
ccgacgccagcggg

SEQ ID NO: 991888 - RNA, 20 nt, Mycobacterium avium subsp. paratuberculosis
ccgacgccagcgggccgugc

SEQ ID NO: 991889 - RNA, 15 nt, Mycobacterium avium subsp. paratuberculosis
ccgacgcccacagcg

SEQ ID NO: 991890 - RNA, 20 nt, Mycobacterium avium subsp. paratuberculosis
ccgacgcccacagcgccagc

SEQ ID NO: 991891 - RNA, 14 nt, Mycobacterium avium subsp. paratuberculosis
ccgacgcccagcac

SEQ ID NO: 991892 - RNA, 19 nt, Mycobacterium avium subsp. paratuberculosis
ccgacgcccagcaccgagu

SEQ ID NO: 991893 - RNA, 13 nt, Mycobacterium avium subsp. paratuberculosis
ccgacgcccagcg

SEQ ID NO: 991894 - RNA, 18 nt, Mycobacterium avium subsp. paratuberculosis
ccgacgcggcgcgacacc

SEQ ID NO: 991895 - RNA, 16 nt, Mycobacterium avium subsp. paratuberculosis
ccgacgccggccacca

SEQ ID NO: 991896 - RNA, 14 nt, Mycobacterium avium subsp. paratuberculosis
ccgacgccagcacg

SEQ ID NO: 991897 - RNA, 17 nt, Mycobacterium avium subsp. paratuberculosis
ccgacgccgacaccagc

SEQ ID NO: 991898 - RNA, 22 nt, Mycobacterium avium subsp. paratuberculosis
ccgacgagaucagcaccaggug

SEQ ID NO: 991899 - RNA, 13 nt, Mycobacterium avium subsp. paratuberculosis
ccgacgaccucgg

SEQ ID NO: 991900 - RNA, 21 nt, Mycobacterium avium subsp. paratuberculosis
ccgacgaccaucagcgcccgg

SEQ ID NO: 991901 - RNA, 17 nt, Mycobacterium avium subsp. paratuberculosis
ccgaccuucugcugcac

SEQ ID NO: 991902 - RNA, 22 nt, Mycobacterium avium subsp. paratuberculosis
ccgacgaaaucgucgggcacca

SEQ ID NO: 991903 - RNA, 14 nt, Mycobacterium avium subsp. paratuberculosis
ccgaccggucucga

SEQ ID NO: 991904 - RNA, 19 nt, Mycobacterium avium subsp. paratuberculosis
ccgaccggccgguuguugc

SEQ ID NO: 991905 - RNA, 18 nt, Mycobacterium avium subsp. paratuberculosis
ccgaccgguccgccgccg

SEQ ID NO: 991906 - RNA, 20 nt, Mycobacterium avium subsp. paratuberculosis
ccgaacggaccgggcgggcu

SEQ ID NO: 991907 - RNA, 16 nt, Mycobacterium avium subsp. paratuberculosis
ccgaacuccgccgaac

SEQ ID NO: 991908 - RNA, 19 nt, Mycobacterium avium subsp. paratuberculosis
ccgaaaagcaccaggcucg

SEQ ID NO: 991909 - RNA, 18 nt, Mycobacterium avium subsp. paratuberculosis
ccgaaaagcccgccgccu

SEQ ID NO: 991910 - RNA, 13 nt, Mycobacterium avium subsp. paratuberculosis
ccgaaacaccggc

SEQ ID NO: 991911 - RNA, 13 nt, Mycobacterium avium subsp. paratuberculosis
ccgaaacaucaaa

SEQ ID NO: 991912 - RNA, 17 nt, Mycobacterium avium subsp. paratuberculosis
ccgaaacgucgcagccc

SEQ ID NO: 991913 - RNA, 21 nt, Mycobacterium avium subsp. paratuberculosis
ccgaaagccguagcgcaacac

SEQ ID NO: 991914 - RNA, 23 nt, Mycobacterium avium subsp. paratuberculosis
ccgaaagguuuucccggccgccg

SEQ ID NO: 991915 - RNA, 16 nt, Mycobacterium avium subsp. paratuberculosis
ccgaaaguccccgggu

SEQ ID NO: 991916 - RNA, 17 nt, Mycobacterium avium subsp. paratuberculosis
ccgaauccagcgcgccg

SEQ ID NO: 991917 - RNA, 15 nt, Mycobacterium avium subsp. paratuberculosis
ccgaagaucaccgcg

SEQ ID NO: 991918 - RNA, 17 nt, Mycobacterium avium subsp. paratuberculosis
ccgaagauggccagcgc

SEQ ID NO: 991919 - RNA, 16 nt, Mycobacterium avium subsp. paratuberculosis
ccgaagaugucggugc

SEQ ID NO: 991920 - RNA, 19 nt, Mycobacterium avium subsp. paratuberculosis
ccgaagcccgcagcgaacg

SEQ ID NO: 991921 - RNA, 18 nt, Mycobacterium avium subsp. paratuberculosis
ccgaagccgucgaccccg

SEQ ID NO: 991922 - RNA, 16 nt, Mycobacterium avium subsp. paratuberculosis
ccgaagcgccgcaugc

SEQ ID NO: 991923 - RNA, 18 nt, Mycobacterium avium subsp. paratuberculosis
ccgaagcgccgcaugccc

SEQ ID NO: 991924 - RNA, 17 nt, Mycobacterium avium subsp. paratuberculosis
cccugguugagcaccgc

SEQ ID NO: 991925 - RNA, 13 nt, Mycobacterium avium subsp. paratuberculosis
cccuggucggcca

SEQ ID NO: 991926 - RNA, 16 nt, Mycobacterium avium subsp. paratuberculosis
cccuggucggccaggg

SEQ ID NO: 991927 - RNA, 15 nt, Mycobacterium avium subsp. paratuberculosis
cccuucaccucggcc

SEQ ID NO: 991928 - RNA, 16 nt, Mycobacterium avium subsp. paratuberculosis
cccuucaccucggccu

SEQ ID NO: 991929 - RNA, 14 nt, Mycobacterium avium subsp. paratuberculosis
cccuagcgggccag

SEQ ID NO: 991930 - RNA, 22 nt, Mycobacterium avium subsp. paratuberculosis
cccuagcgugccguccagcucc

SEQ ID NO: 991931 - RNA, 23 nt, Mycobacterium avium subsp. paratuberculosis
cccuagcucggccggggcgacca

SEQ ID NO: 991932 - RNA, 16 nt, Mycobacterium avium subsp. paratuberculosis
cccuacgggcgcaccg

SEQ ID NO: 991933 - RNA, 24 nt, Mycobacterium avium subsp. paratuberculosis
cccuacgggcgcaccgcgcgccag

SEQ ID NO: 991934 - RNA, 15 nt, Mycobacterium avium subsp. paratuberculosis
cccuacgccguggcc

SEQ ID NO: 991935 - RNA, 14 nt, Mycobacterium avium subsp. paratuberculosis
cccguugcgcccca

SEQ ID NO: 991936 - RNA, 23 nt, Mycobacterium avium subsp. paratuberculosis
cccguugcugcguucggcgauca

SEQ ID NO: 991937 - RNA, 19 nt, Mycobacterium avium subsp. paratuberculosis
cccguugucgagcaccgcg

SEQ ID NO: 991938 - RNA, 13 nt, Mycobacterium avium subsp. paratuberculosis
cccguuccacauc

SEQ ID NO: 991939 - RNA, 22 nt, Mycobacterium avium subsp. paratuberculosis
cccguucguuuuucguaccugc

SEQ ID NO: 991940 - RNA, 21 nt, Mycobacterium avium subsp. paratuberculosis
cccgugggccgaccggccggu

SEQ ID NO: 991941 - RNA, 19 nt, Mycobacterium avium subsp. paratuberculosis
cccguguuguggucugacc

SEQ ID NO: 991942 - RNA, 17 nt, Mycobacterium avium subsp. paratuberculosis
cccguggccagcgccag

SEQ ID NO: 991943 - RNA, 22 nt, Mycobacterium avium subsp. paratuberculosis
cccgugcggggccucgucgccg

SEQ ID NO: 991944 - RNA, 13 nt, Mycobacterium avium subsp. paratuberculosis
cccgugcgccgcc

SEQ ID NO: 991945 - RNA, 15 nt, Mycobacterium avium subsp. paratuberculosis
cccgugcgccgccca

SEQ ID NO: 991946 - RNA, 13 nt, Mycobacterium avium subsp. paratuberculosis
cccgucgggugug

SEQ ID NO: 991947 - RNA, 15 nt, Mycobacterium avium subsp. paratuberculosis
cccgucggucgggca

SEQ ID NO: 991948 - RNA, 22 nt, Mycobacterium avium subsp. paratuberculosis
cccgucguccuugagcccccac

SEQ ID NO: 991949 - RNA, 21 nt, Mycobacterium avium subsp. paratuberculosis
cccgucgucgaugcgcagcag

SEQ ID NO: 991950 - RNA, 16 nt, Mycobacterium avium subsp. paratuberculosis
cccgucgucggcgccg

SEQ ID NO: 991951 - RNA, 20 nt, Mycobacterium avium subsp. paratuberculosis
cccgucgucggcgccgcgcc

SEQ ID NO: 991952 - RNA, 22 nt, Mycobacterium avium subsp. paratuberculosis
cccgucgucuagcggccuagga

SEQ ID NO: 991953 - RNA, 19 nt, Mycobacterium avium subsp. paratuberculosis
cccgucgggcgcggcggca

SEQ ID NO: 991954 - RNA, 13 nt, Mycobacterium avium subsp. paratuberculosis
cccguccagccca

SEQ ID NO: 991955 - RNA, 16 nt, Mycobacterium avium subsp. paratuberculosis
cccguccaucgccgcg

SEQ ID NO: 991956 - RNA, 17 nt, Mycobacterium avium subsp. paratuberculosis
cccguccaucgccgcgc

SEQ ID NO: 991957 - RNA, 21 nt, Mycobacterium avium subsp. paratuberculosis
cccgucacggccguccaggcg

SEQ ID NO: 991958 - RNA, 22 nt, Mycobacterium avium subsp. paratuberculosis
cccggugggacugggcgccgcc

SEQ ID NO: 991959 - RNA, 16 nt, Mycobacterium avium subsp. paratuberculosis
cccguagguugcccca

SEQ ID NO: 991960 - RNA, 14 nt, Mycobacterium avium subsp. paratuberculosis
cccggugccacgau

SEQ ID NO: 991961 - RNA, 20 nt, Mycobacterium avium subsp. paratuberculosis
cccggugagccucagggcgc

SEQ ID NO: 991962 - RNA, 15 nt, Mycobacterium avium subsp. paratuberculosis
cccggugcgacgccg

SEQ ID NO: 991963 - RNA, 22 nt, Mycobacterium avium subsp. paratuberculosis
cccggugcgacgccgcgcagcg

SEQ ID NO: 991964 - RNA, 16 nt, Mycobacterium avium subsp. paratuberculosis
cccgguggaugggcuc

SEQ ID NO: 991965 - RNA, 21 nt, Mycobacterium avium subsp. paratuberculosis
cccgguggccgaggguuccag

SEQ ID NO: 991966 - RNA, 17 nt, Mycobacterium avium subsp. paratuberculosis
cccggguguuggcgcac

SEQ ID NO: 991967 - RNA, 21 nt, Mycobacterium avium subsp. paratuberculosis
cccgggugggugcucaccccg

SEQ ID NO: 991968 - RNA, 19 nt, Mycobacterium avium subsp. paratuberculosis
cccgggcaggcggcgcgcc

SEQ ID NO: 991969 - RNA, 16 nt, Mycobacterium avium subsp. paratuberculosis
cccgggcaucccgccg

SEQ ID NO: 991970 - RNA, 14 nt, Mycobacterium avium subsp. paratuberculosis
cccgggccagcagg

SEQ ID NO: 991971 - RNA, 13 nt, Mycobacterium avium subsp. paratuberculosis
cccgggccaggac

SEQ ID NO: 991972 - RNA, 12 nt, Mycobacterium avium subsp. paratuberculosis
cccgggccaggc

SEQ ID NO: 991973 - RNA, 12 nt, Mycobacterium avium subsp. paratuberculosis
cccgggccaggu

SEQ ID NO: 991974 - RNA, 17 nt, Mycobacterium avium subsp. paratuberculosis
cccgggcccgcugcagc

SEQ ID NO: 991975 - RNA, 16 nt, Mycobacterium avium subsp. paratuberculosis
cccgggccgcagcucg

SEQ ID NO: 991976 - RNA, 13 nt, Mycobacterium avium subsp. paratuberculosis
cccgggccgccac

SEQ ID NO: 991977 - RNA, 12 nt, Mycobacterium avium subsp. paratuberculosis
cccgggugcagg

SEQ ID NO: 991978 - RNA, 21 nt, Mycobacterium avium subsp. paratuberculosis
cccgggugcaggcccagcugc

SEQ ID NO: 991979 - RNA, 19 nt, Mycobacterium avium subsp. paratuberculosis
cccgguagccagcaccgcc

SEQ ID NO: 991980 - RNA, 20 nt, Mycobacterium avium subsp. paratuberculosis
cccgguagccagcaccgccc

SEQ ID NO: 991981 - RNA, 22 nt, Mycobacterium avium subsp. paratuberculosis
cccgguagccagcaccgccccg

SEQ ID NO: 991982 - RNA, 13 nt, Mycobacterium avium subsp. paratuberculosis
cccgguagcgcag

SEQ ID NO: 991983 - RNA, 13 nt, Mycobacterium avium subsp. paratuberculosis
cccgguaggccgc

SEQ ID NO: 991984 - RNA, 16 nt, Mycobacterium avium subsp. paratuberculosis
cccgguaggccgccgc

SEQ ID NO: 991985 - RNA, 20 nt, Mycobacterium avium subsp. paratuberculosis
cccgccgccgucgguguagc

SEQ ID NO: 991986 - RNA, 12 nt, Mycobacterium avium subsp. paratuberculosis
cccgccggcccg

SEQ ID NO: 991987 - RNA, 13 nt, Mycobacterium avium subsp. paratuberculosis
cccgccggcccgg

SEQ ID NO: 991988 - RNA, 13 nt, Mycobacterium avium subsp. paratuberculosis
cccgccggggccg

SEQ ID NO: 991989 - RNA, 14 nt, Mycobacterium avium subsp. paratuberculosis
cccgccgggcaccc

SEQ ID NO: 991990 - RNA, 24 nt, Mycobacterium avium subsp. paratuberculosis
cccggcucaaaccguugaccacca

SEQ ID NO: 991991 - RNA, 16 nt, Mycobacterium avium subsp. paratuberculosis
cccgccgugcgccccg

SEQ ID NO: 991992 - RNA, 17 nt, Mycobacterium avium subsp. paratuberculosis
cccgccgugcgccccgc

SEQ ID NO: 991993 - RNA, 20 nt, Mycobacterium avium subsp. paratuberculosis
cccgccggguggccgccacg

SEQ ID NO: 991994 - RNA, 20 nt, Mycobacterium avium subsp. paratuberculosis
cccgccgguggcggcgagga

SEQ ID NO: 991995 - RNA, 18 nt, Mycobacterium avium subsp. paratuberculosis
cccgggaagccgcagcag

SEQ ID NO: 991996 - RNA, 16 nt, Mycobacterium avium subsp. paratuberculosis
cccgggaugccugccc

SEQ ID NO: 991997 - RNA, 17 nt, Mycobacterium avium subsp. paratuberculosis
cccgggaugggccugga

SEQ ID NO: 991998 - RNA, 12 nt, Mycobacterium avium subsp. paratuberculosis
cccgggcacgcg

SEQ ID NO: 991999 - RNA, 16 nt, Mycobacterium avium subsp. paratuberculosis
cccggcuucgccgccg

SEQ ID NO: 992000 - RNA, 17 nt, Mycobacterium avium subsp. paratuberculosis
cccggcuucgccgccgc

SEQ ID NO: 992001 - RNA, 15 nt, Mycobacterium avium subsp. paratuberculosis
cccggcuucgccgcg

SEQ ID NO: 992002 - RNA, 16 nt, Mycobacterium avium subsp. paratuberculosis
cccggcuucgccgcgc

SEQ ID NO: 992003 - RNA, 21 nt, Mycobacterium avium subsp. paratuberculosis
cccggcuucgcugcgccggcg

SEQ ID NO: 992004 - RNA, 21 nt, Mycobacterium avium subsp. paratuberculosis
cccggcuaauucgggccgccg

SEQ ID NO: 992005 - RNA, 23 nt, Mycobacterium avium subsp. paratuberculosis
cccggcuacucggacgccggcag

SEQ ID NO: 992006 - RNA, 20 nt, Mycobacterium avium subsp. paratuberculosis
cccggcucgaaguggcagcg

SEQ ID NO: 992007 - RNA, 13 nt, Mycobacterium avium subsp. paratuberculosis
cccggcugcgcag

SEQ ID NO: 992008 - RNA, 16 nt, Mycobacterium avium subsp. paratuberculosis
cccggcugggcgcgca

SEQ ID NO: 992009 - RNA, 19 nt, Mycobacterium avium subsp. paratuberculosis
cccucgaaguagagccgcu

SEQ ID NO: 992010 - RNA, 23 nt, Mycobacterium avium subsp. paratuberculosis
cccuccgggcggcaccgcugccg

SEQ ID NO: 992011 - RNA, 21 nt, Mycobacterium avium subsp. paratuberculosis
cccucgacaccgguggcguug

SEQ ID NO: 992012 - RNA, 18 nt, Mycobacterium avium subsp. paratuberculosis
cccucgacguccaggccg

SEQ ID NO: 992013 - RNA, 20 nt, Mycobacterium avium subsp. paratuberculosis
cccucgacguccaggccggc

SEQ ID NO: 992014 - RNA, 22 nt, Mycobacterium avium subsp. paratuberculosis
cccucgacguccaggccggcgc

SEQ ID NO: 992015 - RNA, 23 nt, Mycobacterium avium subsp. paratuberculosis
cccucgauaauggcggccgccgc

SEQ ID NO: 992016 - RNA, 23 nt, Mycobacterium avium subsp. paratuberculosis
cccucgcugccgcccccgcuggc

SEQ ID NO: 992017 - RNA, 13 nt, Mycobacterium avium subsp. paratuberculosis
cccucggccagcc

SEQ ID NO: 992018 - RNA, 15 nt, Mycobacterium avium subsp. paratuberculosis
cccucgccgccgccg

SEQ ID NO: 992019 - RNA, 20 nt, Mycobacterium avium subsp. paratuberculosis
cccucgccggcggcgcccgc

SEQ ID NO: 992020 - RNA, 23 nt, Mycobacterium avium subsp. paratuberculosis
cccucgccggucagcgcauccuc

SEQ ID NO: 992021 - RNA, 18 nt, Mycobacterium avium subsp. paratuberculosis
cccucggggcucaccaca

SEQ ID NO: 992022 - RNA, 17 nt, Mycobacterium avium subsp. paratuberculosis
cccucgggguagccggc

SEQ ID NO: 992023 - RNA, 20 nt, Mycobacterium avium subsp. paratuberculosis
cccucgggguagccggcccg

SEQ ID NO: 992024 - RNA, 21 nt, Mycobacterium avium subsp. paratuberculosis
cccucgggguagccggcccgc

SEQ ID NO: 992025 - RNA, 12 nt, Mycobacterium avium subsp. paratuberculosis
cccucggccggu

SEQ ID NO: 992026 - RNA, 19 nt, Mycobacterium avium subsp. paratuberculosis
cccucggccguaccggcgu

SEQ ID NO: 992027 - RNA, 19 nt, Mycobacterium avium subsp. paratuberculosis
cccucgcgcagggccagcg

SEQ ID NO: 992028 - RNA, 18 nt, Mycobacterium avium subsp. paratuberculosis
cccucggcuuccgagccg

SEQ ID NO: 992029 - RNA, 20 nt, Mycobacterium avium subsp. paratuberculosis
cccucggcuuccgagccggu

SEQ ID NO: 992030 - RNA, 22 nt, Mycobacterium avium subsp. paratuberculosis
cccucguucgaauuguggcggc

SEQ ID NO: 992031 - RNA, 21 nt, Mycobacterium avium subsp. paratuberculosis
cccucgugcguagcggcccga

SEQ ID NO: 992032 - RNA, 16 nt, Mycobacterium avium subsp. paratuberculosis
cccucgucgcuaccuc

SEQ ID NO: 992033 - RNA, 18 nt, Mycobacterium avium subsp. paratuberculosis
cccucggugcucuugacg

SEQ ID NO: 992034 - RNA, 21 nt, Mycobacterium avium subsp. paratuberculosis
cccucggugcucuugacggcc

SEQ ID NO: 992035 - RNA, 14 nt, Mycobacterium avium subsp. paratuberculosis
cccucguccaggug

SEQ ID NO: 992036 - RNA, 15 nt, Mycobacterium avium subsp. paratuberculosis
cccucguccgacagc

SEQ ID NO: 992037 - RNA, 13 nt, Mycobacterium avium subsp. paratuberculosis
cccucgucgacca

SEQ ID NO: 992038 - RNA, 22 nt, Mycobacterium avium subsp. paratuberculosis
cccucgucgaccagggcgauca

SEQ ID NO: 992039 - RNA, 14 nt, Mycobacterium avium subsp. paratuberculosis
cccucagggagcug

SEQ ID NO: 992040 - RNA, 15 nt, Mycobacterium avium subsp. paratuberculosis
cccuccaacggccgc

SEQ ID NO: 992041 - RNA, 19 nt, Mycobacterium avium subsp. paratuberculosis
cccuccacacggcaggcgg

SEQ ID NO: 992042 - RNA, 15 nt, Mycobacterium avium subsp. paratuberculosis
cccuccagccgccgg

SEQ ID NO: 992043 - RNA, 23 nt, Mycobacterium avium subsp. paratuberculosis
cccuccagcuggagaggcccggc

SEQ ID NO: 992044 - RNA, 22 nt, Mycobacterium avium subsp. paratuberculosis
cccuccaggaagaacccggcgu

SEQ ID NO: 992045 - RNA, 15 nt, Mycobacterium avium subsp. paratuberculosis
cccuccccggccagc

SEQ ID NO: 992046 - RNA, 18 nt, Mycobacterium avium subsp. paratuberculosis
cccuccccggccagcacg

SEQ ID NO: 992047 - RNA, 15 nt, Mycobacterium avium subsp. paratuberculosis
cccucccaccacggc

SEQ ID NO: 992048 - RNA, 15 nt, Mycobacterium avium subsp. paratuberculosis
cccuccggcaggccg

SEQ ID NO: 992049 - RNA, 17 nt, Mycobacterium avium subsp. paratuberculosis
cccucaccccgcccagc

SEQ ID NO: 992050 - RNA, 15 nt, Mycobacterium avium subsp. paratuberculosis
cccucagaccauggc

SEQ ID NO: 992051 - RNA, 15 nt, Mycobacterium avium subsp. paratuberculosis
cccucacuccagcgg

SEQ ID NO: 992052 - RNA, 16 nt, Mycobacterium avium subsp. paratuberculosis
cccucacuccagcggc

SEQ ID NO: 992053 - RNA, 12 nt, Mycobacterium avium subsp. paratuberculosis
cccucagccgga

SEQ ID NO: 992054 - RNA, 19 nt, Mycobacterium avium subsp. paratuberculosis
cccugccagcgcccgcugc

SEQ ID NO: 992055 - RNA, 14 nt, Mycobacterium avium subsp. paratuberculosis
cccugccccacggc

SEQ ID NO: 992056 - RNA, 19 nt, Mycobacterium avium subsp. paratuberculosis
cccugccgucaccggccau

SEQ ID NO: 992057 - RNA, 12 nt, Mycobacterium avium subsp. paratuberculosis
cccugccgccac

SEQ ID NO: 992058 - RNA, 16 nt, Mycobacterium avium subsp. paratuberculosis
cccugcucuucgcgcg

SEQ ID NO: 992059 - RNA, 17 nt, Mycobacterium avium subsp. paratuberculosis
cccugcugcagcgcgaa

SEQ ID NO: 992060 - RNA, 23 nt, Mycobacterium avium subsp. paratuberculosis
cccugggcggcgacacgccgacg

SEQ ID NO: 992061 - RNA, 15 nt, Mycobacterium avium subsp. paratuberculosis
cccugcggcugcauc

SEQ ID NO: 992062 - RNA, 15 nt, Mycobacterium avium subsp. paratuberculosis
cccugcguccggccc

SEQ ID NO: 992063 - RNA, 16 nt, Mycobacterium avium subsp. paratuberculosis
cccugcguccggcccg

SEQ ID NO: 992064 - RNA, 17 nt, Mycobacterium avium subsp. paratuberculosis
cccugcguccggcccgg

SEQ ID NO: 992065 - RNA, 17 nt, Mycobacterium avium subsp. paratuberculosis
cccugcucggccagcgg

SEQ ID NO: 992066 - RNA, 14 nt, Mycobacterium avium subsp. paratuberculosis
cccucugccacggc

SEQ ID NO: 992067 - RNA, 16 nt, Mycobacterium avium subsp. paratuberculosis
cccucuucgaucaggc

SEQ ID NO: 992068 - RNA, 12 nt, Mycobacterium avium subsp. paratuberculosis
cccugaagcugg

SEQ ID NO: 992069 - RNA, 13 nt, Mycobacterium avium subsp. paratuberculosis
cccugacacagca

SEQ ID NO: 992070 - RNA, 18 nt, Mycobacterium avium subsp. paratuberculosis
cccugacacagcaccggc

SEQ ID NO: 992071 - RNA, 18 nt, Mycobacterium avium subsp. paratuberculosis
cccugacacgaccgccug

SEQ ID NO: 992072 - RNA, 23 nt, Mycobacterium avium subsp. paratuberculosis
cccugagcugguuucgggucgag

SEQ ID NO: 992073 - RNA, 17 nt, Mycobacterium avium subsp. paratuberculosis
cccgcaacuccacaacc

SEQ ID NO: 992074 - RNA, 19 nt, Mycobacterium avium subsp. paratuberculosis
cccgcaacuguucgcggcu

SEQ ID NO: 992075 - RNA, 16 nt, Mycobacterium avium subsp. paratuberculosis
cccgcaauugcgccag

SEQ ID NO: 992076 - RNA, 17 nt, Mycobacterium avium subsp. paratuberculosis
cccgcaauugcgccagc

SEQ ID NO: 992077 - RNA, 16 nt, Mycobacterium avium subsp. paratuberculosis
cccgcacccgccgccc

SEQ ID NO: 992078 - RNA, 23 nt, Mycobacterium avium subsp. paratuberculosis
cccgaggugaauaccacugcgcg

SEQ ID NO: 992079 - RNA, 20 nt, Mycobacterium avium subsp. paratuberculosis
cccgagucggagacccgccc

SEQ ID NO: 992080 - RNA, 13 nt, Mycobacterium avium subsp. paratuberculosis
cccgcagcacgcc

SEQ ID NO: 992081 - RNA, 20 nt, Mycobacterium avium subsp. paratuberculosis
cccgcagcacgcccguagcg

SEQ ID NO: 992082 - RNA, 20 nt, Mycobacterium avium subsp. paratuberculosis
cccgcaccgccccgcaaccg

SEQ ID NO: 992083 - RNA, 22 nt, Mycobacterium avium subsp. paratuberculosis
cccgcaccguguagccgaccga

SEQ ID NO: 992084 - RNA, 15 nt, Mycobacterium avium subsp. paratuberculosis
cccgcacccguucgg

SEQ ID NO: 992085 - RNA, 17 nt, Mycobacterium avium subsp. paratuberculosis
cccgcaccugcgcgccg

SEQ ID NO: 992086 - RNA, 14 nt, Mycobacterium avium subsp. paratuberculosis
cccgcacgccagca

SEQ ID NO: 992087 - RNA, 21 nt, Mycobacterium avium subsp. paratuberculosis
cccgcauguccggggugagca

SEQ ID NO: 992088 - RNA, 20 nt, Mycobacterium avium subsp. paratuberculosis
cccgcagccagcgcagcacu

SEQ ID NO: 992089 - RNA, 14 nt, Mycobacterium avium subsp. paratuberculosis
cccgcagccgcugg

SEQ ID NO: 992090 - RNA, 13 nt, Mycobacterium avium subsp. paratuberculosis
cccgcagcgccag

SEQ ID NO: 992091 - RNA, 20 nt, Mycobacterium avium subsp. paratuberculosis
cccgcagcgccagcgcgccc

SEQ ID NO: 992092 - RNA, 17 nt, Mycobacterium avium subsp. paratuberculosis
cccgccgaccgguccgc

SEQ ID NO: 992093 - RNA, 14 nt, Mycobacterium avium subsp. paratuberculosis
cccgccgaccaccu

SEQ ID NO: 992094 - RNA, 22 nt, Mycobacterium avium subsp. paratuberculosis
cccgccgaccaccuugcgcagc

SEQ ID NO: 992095 - RNA, 15 nt, Mycobacterium avium subsp. paratuberculosis
cccgccgacgccugc

SEQ ID NO: 992096 - RNA, 18 nt, Mycobacterium avium subsp. paratuberculosis
cccgccgagauccaccgc

SEQ ID NO: 992097 - RNA, 13 nt, Mycobacterium avium subsp. paratuberculosis
cccgccgcagccc

SEQ ID NO: 992098 - RNA, 17 nt, Mycobacterium avium subsp. paratuberculosis
cccgccgccaccacggc

SEQ ID NO: 992099 - RNA, 22 nt, Mycobacterium avium subsp. paratuberculosis
cccgccgcaacagccggcccga

SEQ ID NO: 992100 - RNA, 20 nt, Mycobacterium avium subsp. paratuberculosis
cccgccagauagggcagcgu

SEQ ID NO: 992101 - RNA, 13 nt, Mycobacterium avium subsp. paratuberculosis
cccgccacgugcg

SEQ ID NO: 992102 - RNA, 18 nt, Mycobacterium avium subsp. paratuberculosis
cccgccacgugcggcugc

SEQ ID NO: 992103 - RNA, 20 nt, Mycobacterium avium subsp. paratuberculosis
cccgccagcagaugccgccc

SEQ ID NO: 992104 - RNA, 15 nt, Mycobacterium avium subsp. paratuberculosis
cccgccagcaccgac

SEQ ID NO: 992105 - RNA, 12 nt, Mycobacterium avium subsp. paratuberculosis
cccgccagcccg

SEQ ID NO: 992106 - RNA, 14 nt, Mycobacterium avium subsp. paratuberculosis
ccccgcgcugccca

SEQ ID NO: 992107 - RNA, 18 nt, Mycobacterium avium subsp. paratuberculosis
ccccggugaccucccgga

SEQ ID NO: 992108 - RNA, 21 nt, Mycobacterium avium subsp. paratuberculosis
ccccggugacgauccggucga

SEQ ID NO: 992109 - RNA, 15 nt, Mycobacterium avium subsp. paratuberculosis
ccccgcuccuccucg

SEQ ID NO: 992110 - RNA, 14 nt, Mycobacterium avium subsp. paratuberculosis
ccccgcucggccag

SEQ ID NO: 992111 - RNA, 15 nt, Mycobacterium avium subsp. paratuberculosis
ccccgcucggccagc

SEQ ID NO: 992112 - RNA, 22 nt, Mycobacterium avium subsp. paratuberculosis
ccccgcucggccagcgcgccgc

SEQ ID NO: 992113 - RNA, 13 nt, Mycobacterium avium subsp. paratuberculosis
ccccgcggccacc

SEQ ID NO: 992114 - RNA, 16 nt, Mycobacterium avium subsp. paratuberculosis
ccccgcguuggccagc

SEQ ID NO: 992115 - RNA, 23 nt, Mycobacterium avium subsp. paratuberculosis
ccccggugccgcagugccggcgc

SEQ ID NO: 992116 - RNA, 17 nt, Mycobacterium avium subsp. paratuberculosis
ccccguagucacccggc

SEQ ID NO: 992117 - RNA, 19 nt, Mycobacterium avium subsp. paratuberculosis
ccccguagucacccggccc

SEQ ID NO: 992118 - RNA, 21 nt, Mycobacterium avium subsp. paratuberculosis
ccccguagucacccggccccc

SEQ ID NO: 992119 - RNA, 13 nt, Mycobacterium avium subsp. paratuberculosis
ccccguccagccc

SEQ ID NO: 992120 - RNA, 19 nt, Mycobacterium avium subsp. paratuberculosis
ccccgucgaaaccgucucc

SEQ ID NO: 992121 - RNA, 15 nt, Mycobacterium avium subsp. paratuberculosis
ccccguccagcccag

SEQ ID NO: 992122 - RNA, 11 nt, Mycobacterium avium subsp. paratuberculosis
ccccuccagcc

SEQ ID NO: 992123 - RNA, 13 nt, Mycobacterium avium subsp. paratuberculosis
ccccucccaccac

SEQ ID NO: 992124 - RNA, 20 nt, Mycobacterium avium subsp. paratuberculosis
ccccucggcgccgguggugu

SEQ ID NO: 992125 - RNA, 15 nt, Mycobacterium avium subsp. paratuberculosis
ccccucggcggccgu

SEQ ID NO: 992126 - RNA, 18 nt, Mycobacterium avium subsp. paratuberculosis
ccccucggggcugcgcgg

SEQ ID NO: 992127 - RNA, 15 nt, Mycobacterium avium subsp. paratuberculosis
ccccugcacuacccc

SEQ ID NO: 992128 - RNA, 15 nt, Mycobacterium avium subsp. paratuberculosis
cccgacccgaagccc

SEQ ID NO: 992129 - RNA, 16 nt, Mycobacterium avium subsp. paratuberculosis
cccgacccgcaccacc

SEQ ID NO: 992130 - RNA, 15 nt, Mycobacterium avium subsp. paratuberculosis
cccgaccagcaccgc

SEQ ID NO: 992131 - RNA, 16 nt, Mycobacterium avium subsp. paratuberculosis
cccgaccagcaccgcg

SEQ ID NO: 992132 - RNA, 19 nt, Mycobacterium avium subsp. paratuberculosis
cccgacgaagccgccgccc

SEQ ID NO: 992133 - RNA, 21 nt, Mycobacterium avium subsp. paratuberculosis
cccgacgaagccgccgcccuc

SEQ ID NO: 992134 - RNA, 14 nt, Mycobacterium avium subsp. paratuberculosis
cccgaccgacgccc

SEQ ID NO: 992135 - RNA, 16 nt, Mycobacterium avium subsp. paratuberculosis
cccgacgaucgcgccg

SEQ ID NO: 992136 - RNA, 22 nt, Mycobacterium avium subsp. paratuberculosis
cccgagccgcggauggccucgg

SEQ ID NO: 992137 - RNA, 15 nt, Mycobacterium avium subsp. paratuberculosis
cccgagcgucacgcc

SEQ ID NO: 992138 - RNA, 19 nt, Mycobacterium avium subsp. paratuberculosis
cccgagcgugggggccaug

SEQ ID NO: 992139 - RNA, 21 nt, Mycobacterium avium subsp. paratuberculosis
cccgaggaugccgcccaccac

SEQ ID NO: 992140 - RNA, 19 nt, Mycobacterium avium subsp. paratuberculosis
cccgagcugaucgcggccg

SEQ ID NO: 992141 - RNA, 18 nt, Mycobacterium avium subsp. paratuberculosis
cccgaaacgucgcagccc

SEQ ID NO: 992142 - RNA, 15 nt, Mycobacterium avium subsp. paratuberculosis
cccgaaagcccccag

SEQ ID NO: 992143 - RNA, 21 nt, Mycobacterium avium subsp. paratuberculosis
cccgaaagcccccagcucuuc

SEQ ID NO: 992144 - RNA, 18 nt, Mycobacterium avium subsp. paratuberculosis
cccgaaaccauugcaccg

SEQ ID NO: 992145 - RNA, 20 nt, Mycobacterium avium subsp. paratuberculosis
cccgaaaccauugcaccgca

SEQ ID NO: 992146 - RNA, 13 nt, Mycobacterium avium subsp. paratuberculosis
cccgacaccgugg

SEQ ID NO: 992147 - RNA, 18 nt, Mycobacterium avium subsp. paratuberculosis
cccgacauccaggaccgc

SEQ ID NO: 992148 - RNA, 18 nt, Mycobacterium avium subsp. paratuberculosis
cccgaccacaccggcgcu

SEQ ID NO: 992149 - RNA, 15 nt, Mycobacterium avium subsp. paratuberculosis
cccaucugcacagcu

SEQ ID NO: 992150 - RNA, 17 nt, Mycobacterium avium subsp. paratuberculosis
cccaucucgagcaggaa

SEQ ID NO: 992151 - RNA, 19 nt, Mycobacterium avium subsp. paratuberculosis
cccaugggggaacccccuc

SEQ ID NO: 992152 - RNA, 14 nt, Mycobacterium avium subsp. paratuberculosis
ccccacccaggugu

SEQ ID NO: 992153 - RNA, 17 nt, Mycobacterium avium subsp. paratuberculosis
ccccaccccggacggcc

SEQ ID NO: 992154 - RNA, 20 nt, Mycobacterium avium subsp. paratuberculosis
ccccagccaccguggcccca

SEQ ID NO: 992155 - RNA, 15 nt, Mycobacterium avium subsp. paratuberculosis
ccccaaaacccggca

SEQ ID NO: 992156 - RNA, 23 nt, Mycobacterium avium subsp. paratuberculosis
ccccaccaccgacagcacccggc

SEQ ID NO: 992157 - RNA, 12 nt, Mycobacterium avium subsp. paratuberculosis
ccccaccaggcg

SEQ ID NO: 992158 - RNA, 19 nt, Mycobacterium avium subsp. paratuberculosis
ccccauacacgggccgucc

SEQ ID NO: 992159 - RNA, 20 nt, Mycobacterium avium subsp. paratuberculosis
ccccauccgcggccaccggg

SEQ ID NO: 992160 - RNA, 13 nt, Mycobacterium avium subsp. paratuberculosis
ccccagugcaggc

SEQ ID NO: 992161 - RNA, 12 nt, Mycobacterium avium subsp. paratuberculosis
ccccagcccgga

SEQ ID NO: 992162 - RNA, 12 nt, Mycobacterium avium subsp. paratuberculosis
ccccagcccggg

SEQ ID NO: 992163 - RNA, 12 nt, Mycobacterium avium subsp. paratuberculosis
ccccagcccgcc

SEQ ID NO: 992164 - RNA, 19 nt, Mycobacterium avium subsp. paratuberculosis
ccccaucggccaggaacca

SEQ ID NO: 992165 - RNA, 22 nt, Mycobacterium avium subsp. paratuberculosis
cccccacgcagcggugcagccc

SEQ ID NO: 992166 - RNA, 13 nt, Mycobacterium avium subsp. paratuberculosis
cccccagcagcgg

SEQ ID NO: 992167 - RNA, 21 nt, Mycobacterium avium subsp. paratuberculosis
cccccauacacgggccgucca

SEQ ID NO: 992168 - RNA, 18 nt, Mycobacterium avium subsp. paratuberculosis
cccccgggaugccugccc

SEQ ID NO: 992169 - RNA, 13 nt, Mycobacterium avium subsp. paratuberculosis
cccccgggcacca

SEQ ID NO: 992170 - RNA, 12 nt, Mycobacterium avium subsp. paratuberculosis
ccccgaugcgcu

SEQ ID NO: 992171 - RNA, 18 nt, Mycobacterium avium subsp. paratuberculosis
ccccgcaaacacgagcag

SEQ ID NO: 992172 - RNA, 16 nt, Mycobacterium avium subsp. paratuberculosis
ccccgcacaccggcca

SEQ ID NO: 992173 - RNA, 22 nt, Mycobacterium avium subsp. paratuberculosis
ccccgaucgcgaucaccgcggc

SEQ ID NO: 992174 - RNA, 21 nt, Mycobacterium avium subsp. paratuberculosis
ccccgaucggauccgccugcc

SEQ ID NO: 992175 - RNA, 20 nt, Mycobacterium avium subsp. paratuberculosis
ccccgaggagacgucggccg

SEQ ID NO: 992176 - RNA, 13 nt, Mycobacterium avium subsp. paratuberculosis
ccccgaguucggc

SEQ ID NO: 992177 - RNA, 22 nt, Mycobacterium avium subsp. paratuberculosis
ccccgccgggguccgcaacgcc

SEQ ID NO: 992178 - RNA, 19 nt, Mycobacterium avium subsp. paratuberculosis
cccccuugagccgguccga

SEQ ID NO: 992179 - RNA, 15 nt, Mycobacterium avium subsp. paratuberculosis
cccccugcucagcgg

SEQ ID NO: 992180 - RNA, 17 nt, Mycobacterium avium subsp. paratuberculosis
ccccgagaucgcgggcu

SEQ ID NO: 992181 - RNA, 14 nt, Mycobacterium avium subsp. paratuberculosis
cccccucggcgccg

SEQ ID NO: 992182 - RNA, 14 nt, Mycobacterium avium subsp. paratuberculosis
cccccgggcccgaa

SEQ ID NO: 992183 - RNA, 17 nt, Mycobacterium avium subsp. paratuberculosis
cccccggggccuccagc

SEQ ID NO: 992184 - RNA, 23 nt, Mycobacterium avium subsp. paratuberculosis
cccagaaccgcucggcggcgccg

SEQ ID NO: 992185 - RNA, 18 nt, Mycobacterium avium subsp. paratuberculosis
cccagcaccccgguccag

SEQ ID NO: 992186 - RNA, 20 nt, Mycobacterium avium subsp. paratuberculosis
cccagcaccccgguccaggc

SEQ ID NO: 992187 - RNA, 13 nt, Mycobacterium avium subsp. paratuberculosis
cccagcaccacca

SEQ ID NO: 992188 - RNA, 19 nt, Mycobacterium avium subsp. paratuberculosis
cccagcaccaccacgcugg

SEQ ID NO: 992189 - RNA, 21 nt, Mycobacterium avium subsp. paratuberculosis
cccagcaccaccacguugcgc

SEQ ID NO: 992190 - RNA, 13 nt, Mycobacterium avium subsp. paratuberculosis
cccagcaccaaca

SEQ ID NO: 992191 - RNA, 13 nt, Mycobacterium avium subsp. paratuberculosis
cccagcacagccg

SEQ ID NO: 992192 - RNA, 13 nt, Mycobacterium avium subsp. paratuberculosis
cccagcaccaccu

SEQ ID NO: 992193 - RNA, 19 nt, Mycobacterium avium subsp. paratuberculosis
cccagcacgacgccgcugg

SEQ ID NO: 992194 - RNA, 13 nt, Mycobacterium avium subsp. paratuberculosis
cccagcaccgccg

SEQ ID NO: 992195 - RNA, 12 nt, Mycobacterium avium subsp. paratuberculosis
cccagcaccgcg

SEQ ID NO: 992196 - RNA, 14 nt, Mycobacterium avium subsp. paratuberculosis
cccagcacccgcuc

SEQ ID NO: 992197 - RNA, 19 nt, Mycobacterium avium subsp. paratuberculosis
cccagcaaacccagcacca

SEQ ID NO: 992198 - RNA, 21 nt, Mycobacterium avium subsp. paratuberculosis
cccagcaaacccagcaccaac

SEQ ID NO: 992199 - RNA, 14 nt, Mycobacterium avium subsp. paratuberculosis
cccagaugcccagc

SEQ ID NO: 992200 - RNA, 17 nt, Mycobacterium avium subsp. paratuberculosis
cccagaugcccagcggc

SEQ ID NO: 992201 - RNA, 14 nt, Mycobacterium avium subsp. paratuberculosis
cccagcagcaccgc

SEQ ID NO: 992202 - RNA, 15 nt, Mycobacterium avium subsp. paratuberculosis
cccagcagcccggcc

SEQ ID NO: 992203 - RNA, 21 nt, Mycobacterium avium subsp. paratuberculosis
cccagcagcccggccagccgg

SEQ ID NO: 992204 - RNA, 18 nt, Mycobacterium avium subsp. paratuberculosis
cccagcagccugcccccc

SEQ ID NO: 992205 - RNA, 20 nt, Mycobacterium avium subsp. paratuberculosis
cccagcagcgcaccggcgau

SEQ ID NO: 992206 - RNA, 12 nt, Mycobacterium avium subsp. paratuberculosis
cccagcagcggc

SEQ ID NO: 992207 - RNA, 18 nt, Mycobacterium avium subsp. paratuberculosis
cccagcagcggggugugc

SEQ ID NO: 992208 - RNA, 18 nt, Mycobacterium avium subsp. paratuberculosis
cccagcccgcgccgagca

SEQ ID NO: 992209 - RNA, 13 nt, Mycobacterium avium subsp. paratuberculosis
cccagcccggcca

SEQ ID NO: 992210 - RNA, 16 nt, Mycobacterium avium subsp. paratuberculosis
cccagccccucgccgg

SEQ ID NO: 992211 - RNA, 14 nt, Mycobacterium avium subsp. paratuberculosis
cccagccccagcac

SEQ ID NO: 992212 - RNA, 16 nt, Mycobacterium avium subsp. paratuberculosis
cccagccgugccccag

SEQ ID NO: 992213 - RNA, 20 nt, Mycobacterium avium subsp. paratuberculosis
cccagccggugcgagccgcu

SEQ ID NO: 992214 - RNA, 16 nt, Mycobacterium avium subsp. paratuberculosis
cccagccgucgcaccg

SEQ ID NO: 992215 - RNA, 15 nt, Mycobacterium avium subsp. paratuberculosis
cccagcgacucggcc

SEQ ID NO: 992216 - RNA, 22 nt, Mycobacterium avium subsp. paratuberculosis
cccagccgcaggugcagcuccu

SEQ ID NO: 992217 - RNA, 20 nt, Mycobacterium avium subsp. paratuberculosis
cccagccgcauucggugagc

SEQ ID NO: 992218 - RNA, 15 nt, Mycobacterium avium subsp. paratuberculosis
cccagccggacagcg

SEQ ID NO: 992219 - RNA, 20 nt, Mycobacterium avium subsp. paratuberculosis
cccagccgcgucacgucggc

SEQ ID NO: 992220 - RNA, 16 nt, Mycobacterium avium subsp. paratuberculosis
cccagccgccagccgg

SEQ ID NO: 992221 - RNA, 22 nt, Mycobacterium avium subsp. paratuberculosis
cccagcggcgaugcccacagcc

SEQ ID NO: 992222 - RNA, 18 nt, Mycobacterium avium subsp. paratuberculosis
cccagcgggacagcacca

SEQ ID NO: 992223 - RNA, 16 nt, Mycobacterium avium subsp. paratuberculosis
cccagcgucaggaugu

SEQ ID NO: 992224 - RNA, 15 nt, Mycobacterium avium subsp. paratuberculosis
cccagcgugaaacua

SEQ ID NO: 992225 - RNA, 18 nt, Mycobacterium avium subsp. paratuberculosis
cccagcguggucacccgc

SEQ ID NO: 992226 - RNA, 23 nt, Mycobacterium avium subsp. paratuberculosis
cccagcguggucacccgcagccc

SEQ ID NO: 992227 - RNA, 20 nt, Mycobacterium avium subsp. paratuberculosis
cccagcuccacgcguagccg

SEQ ID NO: 992228 - RNA, 19 nt, Mycobacterium avium subsp. paratuberculosis
cccagcuccucggccagca

SEQ ID NO: 992229 - RNA, 14 nt, Mycobacterium avium subsp. paratuberculosis
cccagcugggccgc

SEQ ID NO: 992230 - RNA, 21 nt, Mycobacterium avium subsp. paratuberculosis
cccagcugcacccaccggccc

SEQ ID NO: 992231 - RNA, 19 nt, Mycobacterium avium subsp. paratuberculosis
cccagcugcauggacagcg

SEQ ID NO: 992232 - RNA, 15 nt, Mycobacterium avium subsp. paratuberculosis
cccagcucggugcgc

SEQ ID NO: 992233 - RNA, 22 nt, Mycobacterium avium subsp. paratuberculosis
cccagcucguugccggcggcca

SEQ ID NO: 992234 - RNA, 19 nt, Mycobacterium avium subsp. paratuberculosis
cccaggccacccgggcgcc

SEQ ID NO: 992235 - RNA, 13 nt, Mycobacterium avium subsp. paratuberculosis
cccaggcccagca

SEQ ID NO: 992236 - RNA, 14 nt, Mycobacterium avium subsp. paratuberculosis
cccaggcccagcag

SEQ ID NO: 992237 - RNA, 14 nt, Mycobacterium avium subsp. paratuberculosis
cccaggcccggcac

SEQ ID NO: 992238 - RNA, 15 nt, Mycobacterium avium subsp. paratuberculosis
cccaggaccacuccu

SEQ ID NO: 992239 - RNA, 13 nt, Mycobacterium avium subsp. paratuberculosis
cccaggacggcgc

SEQ ID NO: 992240 - RNA, 15 nt, Mycobacterium avium subsp. paratuberculosis
cccaggauggccgcu

SEQ ID NO: 992241 - RNA, 20 nt, Mycobacterium avium subsp. paratuberculosis
cccaggaugaucuucuccag

SEQ ID NO: 992242 - RNA, 15 nt, Mycobacterium avium subsp. paratuberculosis
cccaggaacgcgccg

SEQ ID NO: 992243 - RNA, 22 nt, Mycobacterium avium subsp. paratuberculosis
cccagcggaaccgggggccguc

SEQ ID NO: 992244 - RNA, 22 nt, Mycobacterium avium subsp. paratuberculosis
cccagcggcuguagcacccggc

SEQ ID NO: 992245 - RNA, 16 nt, Mycobacterium avium subsp. paratuberculosis
cccagcggcgcggccg

SEQ ID NO: 992246 - RNA, 18 nt, Mycobacterium avium subsp. paratuberculosis
cccagcggcgcggccgau

SEQ ID NO: 992247 - RNA, 15 nt, Mycobacterium avium subsp. paratuberculosis
cccagcggccccggc

SEQ ID NO: 992248 - RNA, 22 nt, Mycobacterium avium subsp. paratuberculosis
cccagcgcgaccagugcaccuc

SEQ ID NO: 992249 - RNA, 16 nt, Mycobacterium avium subsp. paratuberculosis
cccagcgcggcggcca

SEQ ID NO: 992250 - RNA, 12 nt, Mycobacterium avium subsp. paratuberculosis
cccagcgccgcg

SEQ ID NO: 992251 - RNA, 17 nt, Mycobacterium avium subsp. paratuberculosis
cccagcgcccguagccg

SEQ ID NO: 992252 - RNA, 14 nt, Mycobacterium avium subsp. paratuberculosis
cccagcgccccgaa

SEQ ID NO: 992253 - RNA, 22 nt, Mycobacterium avium subsp. paratuberculosis
cccagcgcauccaccagggcgg

SEQ ID NO: 992254 - RNA, 19 nt, Mycobacterium avium subsp. paratuberculosis
cccagcgacucggccagga

SEQ ID NO: 992255 - RNA, 20 nt, Mycobacterium avium subsp. paratuberculosis
cccagcgaggcggccagcgg

SEQ ID NO: 992256 - RNA, 14 nt, Mycobacterium avium subsp. paratuberculosis
cccagcgcagcgcc

SEQ ID NO: 992257 - RNA, 18 nt, Mycobacterium avium subsp. paratuberculosis
cccagcgcagcgccucgg

SEQ ID NO: 992258 - RNA, 14 nt, Mycobacterium avium subsp. paratuberculosis
cccauccgcggcca

SEQ ID NO: 992259 - RNA, 17 nt, Mycobacterium avium subsp. paratuberculosis
cccauccggcgccgcgc

SEQ ID NO: 992260 - RNA, 13 nt, Mycobacterium avium subsp. paratuberculosis
cccaucgcggccg

SEQ ID NO: 992261 - RNA, 18 nt, Mycobacterium avium subsp. paratuberculosis
cccaucgcggccgcccgg

SEQ ID NO: 992262 - RNA, 18 nt, Mycobacterium avium subsp. paratuberculosis
cccaucgccacgccgugg

SEQ ID NO: 992263 - RNA, 15 nt, Mycobacterium avium subsp. paratuberculosis
cccauccaggccagc

SEQ ID NO: 992264 - RNA, 14 nt, Mycobacterium avium subsp. paratuberculosis
cccaucaccagcgg

SEQ ID NO: 992265 - RNA, 17 nt, Mycobacterium avium subsp. paratuberculosis
cccaucaccagcggcug

SEQ ID NO: 992266 - RNA, 19 nt, Mycobacterium avium subsp. paratuberculosis
cccaucagcaggaccaggc

SEQ ID NO: 992267 - RNA, 13 nt, Mycobacterium avium subsp. paratuberculosis
aaacacagcagca

SEQ ID NO: 992268 - RNA, 22 nt, Mycobacterium avium subsp. paratuberculosis
cccaguuguuuccccagcccgg

SEQ ID NO: 992269 - RNA, 13 nt, Mycobacterium avium subsp. paratuberculosis
cccagucccagca

SEQ ID NO: 992270 - RNA, 14 nt, Mycobacterium avium subsp. paratuberculosis
cccagucccagcac

SEQ ID NO: 992271 - RNA, 14 nt, Mycobacterium avium subsp. paratuberculosis
cccagugcucgacc

SEQ ID NO: 992272 - RNA, 16 nt, Mycobacterium avium subsp. paratuberculosis
cccagugcucgaccag

SEQ ID NO: 992273 - RNA, 21 nt, Mycobacterium avium subsp. paratuberculosis
cccaggcgucgucgucgagcc

SEQ ID NO: 992274 - RNA, 13 nt, Mycobacterium avium subsp. paratuberculosis
cccaggccgccag

SEQ ID NO: 992275 - RNA, 20 nt, Mycobacterium avium subsp. paratuberculosis
cccaggccgcggucgccccg

SEQ ID NO: 992276 - RNA, 22 nt, Mycobacterium avium subsp. paratuberculosis
cccagggcaacgaacgcggcgc

SEQ ID NO: 992277 - RNA, 18 nt, Mycobacterium avium subsp. paratuberculosis
cccagggugcgccgcucg

SEQ ID NO: 992278 - RNA, 18 nt, Mycobacterium avium subsp. paratuberculosis
cccaggguuggucggagc

SEQ ID NO: 992279 - RNA, 22 nt, Mycobacterium avium subsp. paratuberculosis
cccagguaaucgaaggccaggu

SEQ ID NO: 992280 - RNA, 20 nt, Mycobacterium avium subsp. paratuberculosis
cccagguauucguugcccug

SEQ ID NO: 992281 - RNA, 19 nt, Mycobacterium avium subsp. paratuberculosis
cccaggucaugguggcggc

SEQ ID NO: 992282 - RNA, 21 nt, Mycobacterium avium subsp. paratuberculosis
cccaggucaugguggcggcgc

SEQ ID NO: 992283 - RNA, 23 nt, Mycobacterium avium subsp. paratuberculosis
cccaggucaugguggcggcgccg

SEQ ID NO: 992284 - RNA, 20 nt, Mycobacterium avium subsp. paratuberculosis
cccaggucgugaaacauggc

SEQ ID NO: 992285 - RNA, 18 nt, Mycobacterium avium subsp. paratuberculosis
cccaggugacgccgcacg

SEQ ID NO: 992286 - RNA, 16 nt, Mycobacterium avium subsp. paratuberculosis
ccauucgguuuccccu

SEQ ID NO: 992287 - RNA, 18 nt, Mycobacterium avium subsp. paratuberculosis
cccaacgcagcgcauccg

SEQ ID NO: 992288 - RNA, 16 nt, Mycobacterium avium subsp. paratuberculosis
cccaagccggccaggc

SEQ ID NO: 992289 - RNA, 20 nt, Mycobacterium avium subsp. paratuberculosis
cccaagccggccaggcccag

SEQ ID NO: 992290 - RNA, 18 nt, Mycobacterium avium subsp. paratuberculosis
cccaacggcgugcagccg

SEQ ID NO: 992291 - RNA, 15 nt, Mycobacterium avium subsp. paratuberculosis
ccauggucgcggccg

SEQ ID NO: 992292 - RNA, 22 nt, Mycobacterium avium subsp. paratuberculosis
ccaugggguugaccuugaccag

SEQ ID NO: 992293 - RNA, 18 nt, Mycobacterium avium subsp. paratuberculosis
ccauggccuugacgucgg

SEQ ID NO: 992294 - RNA, 14 nt, Mycobacterium avium subsp. paratuberculosis
ccauggcggcccgc

SEQ ID NO: 992295 - RNA, 18 nt, Mycobacterium avium subsp. paratuberculosis
ccauggcggcccgcgccg

SEQ ID NO: 992296 - RNA, 15 nt, Mycobacterium avium subsp. paratuberculosis
ccauguccccgacca

SEQ ID NO: 992297 - RNA, 14 nt, Mycobacterium avium subsp. paratuberculosis
ccauguccccgccg

SEQ ID NO: 992298 - RNA, 16 nt, Mycobacterium avium subsp. paratuberculosis
ccauguccggcaggcu

SEQ ID NO: 992299 - RNA, 19 nt, Mycobacterium avium subsp. paratuberculosis
ccauguaguucagcagccg

SEQ ID NO: 992300 - RNA, 17 nt, Mycobacterium avium subsp. paratuberculosis
ccaugucggcgucgccg

SEQ ID NO: 992301 - RNA, 16 nt, Mycobacterium avium subsp. paratuberculosis
ccaucagugcggcccg

SEQ ID NO: 992302 - RNA, 15 nt, Mycobacterium avium subsp. paratuberculosis
ccauccgcugcgcgu

SEQ ID NO: 992303 - RNA, 14 nt, Mycobacterium avium subsp. paratuberculosis
ccauccagcgccgc

SEQ ID NO: 992304 - RNA, 14 nt, Mycobacterium avium subsp. paratuberculosis
ccauccgggcggcc

SEQ ID NO: 992305 - RNA, 18 nt, Mycobacterium avium subsp. paratuberculosis
ccauccgggcggccagcc

SEQ ID NO: 992306 - RNA, 23 nt, Mycobacterium avium subsp. paratuberculosis
ccauccgguccagaucggcgcgc

SEQ ID NO: 992307 - RNA, 15 nt, Mycobacterium avium subsp. paratuberculosis
ccaucgccucggcca

SEQ ID NO: 992308 - RNA, 12 nt, Mycobacterium avium subsp. paratuberculosis
ccaucgccgcgc

SEQ ID NO: 992309 - RNA, 17 nt, Mycobacterium avium subsp. paratuberculosis
ccauggcgcaccgcggc

SEQ ID NO: 992310 - RNA, 22 nt, Mycobacterium avium subsp. paratuberculosis
ccaugcccagcaguccggcggu

SEQ ID NO: 992311 - RNA, 13 nt, Mycobacterium avium subsp. paratuberculosis
ccaugacccgguu

SEQ ID NO: 992312 - RNA, 17 nt, Mycobacterium avium subsp. paratuberculosis
ccaucgggcccagcagc

SEQ ID NO: 992313 - RNA, 18 nt, Mycobacterium avium subsp. paratuberculosis
ccaucgggcccagcagcc

SEQ ID NO: 992314 - RNA, 16 nt, Mycobacterium avium subsp. paratuberculosis
ccaucgucuuccccgu

SEQ ID NO: 992315 - RNA, 21 nt, Mycobacterium avium subsp. paratuberculosis
ccagguugucgucgggcacca

SEQ ID NO: 992316 - RNA, 23 nt, Mycobacterium avium subsp. paratuberculosis
ccagguuggucagcagcagcgcc

SEQ ID NO: 992317 - RNA, 17 nt, Mycobacterium avium subsp. paratuberculosis
ccagguugucgccgcgc

SEQ ID NO: 992318 - RNA, 13 nt, Mycobacterium avium subsp. paratuberculosis
ccagguugcgccg

SEQ ID NO: 992319 - RNA, 21 nt, Mycobacterium avium subsp. paratuberculosis
ccagguugccacgcggauagc

SEQ ID NO: 992320 - RNA, 19 nt, Mycobacterium avium subsp. paratuberculosis
ccaguaccagcggccgucg

SEQ ID NO: 992321 - RNA, 14 nt, Mycobacterium avium subsp. paratuberculosis
ccaguaggccagca

SEQ ID NO: 992322 - RNA, 16 nt, Mycobacterium avium subsp. paratuberculosis
ccaguaggccagcauc

SEQ ID NO: 992323 - RNA, 17 nt, Mycobacterium avium subsp. paratuberculosis
ccagucaagcgcuuuga

SEQ ID NO: 992324 - RNA, 13 nt, Mycobacterium avium subsp. paratuberculosis
ccaguccaggccg

SEQ ID NO: 992325 - RNA, 16 nt, Mycobacterium avium subsp. paratuberculosis
ccaguccaggccgccg

SEQ ID NO: 992326 - RNA, 19 nt, Mycobacterium avium subsp. paratuberculosis
ccagguagcccaugucgcc

SEQ ID NO: 992327 - RNA, 18 nt, Mycobacterium avium subsp. paratuberculosis
ccagguacugggcguggu

SEQ ID NO: 992328 - RNA, 20 nt, Mycobacterium avium subsp. paratuberculosis
ccagguaggcgcccugcgag

SEQ ID NO: 992329 - RNA, 14 nt, Mycobacterium avium subsp. paratuberculosis
ccaggugacgccgc

SEQ ID NO: 992330 - RNA, 20 nt, Mycobacterium avium subsp. paratuberculosis
ccagguacugaucaccgcgc

SEQ ID NO: 992331 - RNA, 21 nt, Mycobacterium avium subsp. paratuberculosis
ccagguagacgaugcccagcc

SEQ ID NO: 992332 - RNA, 22 nt, Mycobacterium avium subsp. paratuberculosis
ccagguagacgaugcccagccc

SEQ ID NO: 992333 - RNA, 22 nt, Mycobacterium avium subsp. paratuberculosis
ccaggugcagaccggacagcug

SEQ ID NO: 992334 - RNA, 13 nt, Mycobacterium avium subsp. paratuberculosis
ccaggugcugccc

SEQ ID NO: 992335 - RNA, 23 nt, Mycobacterium avium subsp. paratuberculosis
ccagguaguuguucgacugcagg

SEQ ID NO: 992336 - RNA, 14 nt, Mycobacterium avium subsp. paratuberculosis
ccaggugcgccgcc

SEQ ID NO: 992337 - RNA, 15 nt, Mycobacterium avium subsp. paratuberculosis
ccaggugcgccgccg

SEQ ID NO: 992338 - RNA, 16 nt, Mycobacterium avium subsp. paratuberculosis
ccaggugcgccgccgc

SEQ ID NO: 992339 - RNA, 18 nt, Mycobacterium avium subsp. paratuberculosis
ccaggugcgccgccgcgu

SEQ ID NO: 992340 - RNA, 17 nt, Mycobacterium avium subsp. paratuberculosis
ccagguucaggcccgcg

SEQ ID NO: 992341 - RNA, 20 nt, Mycobacterium avium subsp. paratuberculosis
ccagguucaggcccgcgccg

SEQ ID NO: 992342 - RNA, 13 nt, Mycobacterium avium subsp. paratuberculosis
ccagguucaggcu

SEQ ID NO: 992343 - RNA, 15 nt, Mycobacterium avium subsp. paratuberculosis
ccagguucaggcuga

SEQ ID NO: 992344 - RNA, 23 nt, Mycobacterium avium subsp. paratuberculosis
ccagguuccggugucgagccggu

SEQ ID NO: 992345 - RNA, 14 nt, Mycobacterium avium subsp. paratuberculosis
ccagguucgcgcag

SEQ ID NO: 992346 - RNA, 19 nt, Mycobacterium avium subsp. paratuberculosis
ccagguuccaguacccgcg

SEQ ID NO: 992347 - RNA, 17 nt, Mycobacterium avium subsp. paratuberculosis
ccagguugaccaccagc

SEQ ID NO: 992348 - RNA, 18 nt, Mycobacterium avium subsp. paratuberculosis
ccagguugaccaccagcg

SEQ ID NO: 992349 - RNA, 19 nt, Mycobacterium avium subsp. paratuberculosis
ccaggugggcggccaccac

SEQ ID NO: 992350 - RNA, 19 nt, Mycobacterium avium subsp. paratuberculosis
ccaggugggugaacgccug

SEQ ID NO: 992351 - RNA, 13 nt, Mycobacterium avium subsp. paratuberculosis
ccagguggccgcu

SEQ ID NO: 992352 - RNA, 21 nt, Mycobacterium avium subsp. paratuberculosis
ccagguguaggcguggcaggc

SEQ ID NO: 992353 - RNA, 15 nt, Mycobacterium avium subsp. paratuberculosis
ccaggugugcccgcc

SEQ ID NO: 992354 - RNA, 15 nt, Mycobacterium avium subsp. paratuberculosis
ccagccgcgucacgu

SEQ ID NO: 992355 - RNA, 22 nt, Mycobacterium avium subsp. paratuberculosis
ccagccgcgucacgucggccug

SEQ ID NO: 992356 - RNA, 23 nt, Mycobacterium avium subsp. paratuberculosis
ccagccgcgucacgucggccugc

SEQ ID NO: 992357 - RNA, 13 nt, Mycobacterium avium subsp. paratuberculosis
ccagccgcgcggc

SEQ ID NO: 992358 - RNA, 14 nt, Mycobacterium avium subsp. paratuberculosis
ccagccgcgcggcc

SEQ ID NO: 992359 - RNA, 16 nt, Mycobacterium avium subsp. paratuberculosis
ccagccgcgcggccgc

SEQ ID NO: 992360 - RNA, 15 nt, Mycobacterium avium subsp. paratuberculosis
ccagccgcggacggc

SEQ ID NO: 992361 - RNA, 18 nt, Mycobacterium avium subsp. paratuberculosis
ccagccgcggacggccag

SEQ ID NO: 992362 - RNA, 13 nt, Mycobacterium avium subsp. paratuberculosis
ccagccggacagc

SEQ ID NO: 992363 - RNA, 14 nt, Mycobacterium avium subsp. paratuberculosis
ccagccgcuccucg

SEQ ID NO: 992364 - RNA, 20 nt, Mycobacterium avium subsp. paratuberculosis
ccagccgaugcgcccgcgcc

SEQ ID NO: 992365 - RNA, 21 nt, Mycobacterium avium subsp. paratuberculosis
ccagccgcccagcaucgccgc

SEQ ID NO: 992366 - RNA, 13 nt, Mycobacterium avium subsp. paratuberculosis
ccagccgccgccg

SEQ ID NO: 992367 - RNA, 13 nt, Mycobacterium avium subsp. paratuberculosis
ccagccgccggcc

SEQ ID NO: 992368 - RNA, 21 nt, Mycobacterium avium subsp. paratuberculosis
ccagccgccgguccagugccg

SEQ ID NO: 992369 - RNA, 19 nt, Mycobacterium avium subsp. paratuberculosis
ccagggugucgucgcgcac

SEQ ID NO: 992370 - RNA, 14 nt, Mycobacterium avium subsp. paratuberculosis
ccaggguggucagc

SEQ ID NO: 992371 - RNA, 15 nt, Mycobacterium avium subsp. paratuberculosis
ccaggguggucagcg

SEQ ID NO: 992372 - RNA, 20 nt, Mycobacterium avium subsp. paratuberculosis
ccagggucucgcgcagcacg

SEQ ID NO: 992373 - RNA, 21 nt, Mycobacterium avium subsp. paratuberculosis
ccagggucucgcgcagcacga

SEQ ID NO: 992374 - RNA, 22 nt, Mycobacterium avium subsp. paratuberculosis
ccagggucucgggcagcagcac

SEQ ID NO: 992375 - RNA, 18 nt, Mycobacterium avium subsp. paratuberculosis
ccaggguggccccagccc

SEQ ID NO: 992376 - RNA, 14 nt, Mycobacterium avium subsp. paratuberculosis
ccagggugccccgc

SEQ ID NO: 992377 - RNA, 14 nt, Mycobacterium avium subsp. paratuberculosis
ccagggugccgccg

SEQ ID NO: 992378 - RNA, 21 nt, Mycobacterium avium subsp. paratuberculosis
ccagggugcgcacgaucugca

SEQ ID NO: 992379 - RNA, 16 nt, Mycobacterium avium subsp. paratuberculosis
ccagggugcgccgcuc

SEQ ID NO: 992380 - RNA, 14 nt, Mycobacterium avium subsp. paratuberculosis
ccaggguggccagc

SEQ ID NO: 992381 - RNA, 16 nt, Mycobacterium avium subsp. paratuberculosis
ccagggucuggcccgg

SEQ ID NO: 992382 - RNA, 19 nt, Mycobacterium avium subsp. paratuberculosis
ccagggucuucagcccgcg

SEQ ID NO: 992383 - RNA, 20 nt, Mycobacterium avium subsp. paratuberculosis
ccaguugucgaucuccucgc

SEQ ID NO: 992384 - RNA, 14 nt, Mycobacterium avium subsp. paratuberculosis
ccaguuccaccagu

SEQ ID NO: 992385 - RNA, 18 nt, Mycobacterium avium subsp. paratuberculosis
ccagucugagcccgggca

SEQ ID NO: 992386 - RNA, 13 nt, Mycobacterium avium subsp. paratuberculosis
ccagucggcgccg

SEQ ID NO: 992387 - RNA, 23 nt, Mycobacterium avium subsp. paratuberculosis
ccagucccaguuguuuccccagc

SEQ ID NO: 992388 - RNA, 17 nt, Mycobacterium avium subsp. paratuberculosis
ccagucccagcacagcc

SEQ ID NO: 992389 - RNA, 16 nt, Mycobacterium avium subsp. paratuberculosis
ccaguccggcgcccgg

SEQ ID NO: 992390 - RNA, 18 nt, Mycobacterium avium subsp. paratuberculosis
ccaguccggcgcccggcu

SEQ ID NO: 992391 - RNA, 22 nt, Mycobacterium avium subsp. paratuberculosis
ccaguccggcgccgacccccgc

SEQ ID NO: 992392 - RNA, 16 nt, Mycobacterium avium subsp. paratuberculosis
ccaguccugggccaga

SEQ ID NO: 992393 - RNA, 13 nt, Mycobacterium avium subsp. paratuberculosis
ccagucgccggcc

SEQ ID NO: 992394 - RNA, 14 nt, Mycobacterium avium subsp. paratuberculosis
ccagucgccgcgca

SEQ ID NO: 992395 - RNA, 15 nt, Mycobacterium avium subsp. paratuberculosis
ccagugcccggccau

SEQ ID NO: 992396 - RNA, 22 nt, Mycobacterium avium subsp. paratuberculosis
ccagugccgcagguggugggcg

SEQ ID NO: 992397 - RNA, 20 nt, Mycobacterium avium subsp. paratuberculosis
ccagugccgcgcggacgcgg

SEQ ID NO: 992398 - RNA, 13 nt, Mycobacterium avium subsp. paratuberculosis
ccagugccgggcc

SEQ ID NO: 992399 - RNA, 19 nt, Mycobacterium avium subsp. paratuberculosis
ccagugcagguuccggauc

SEQ ID NO: 992400 - RNA, 17 nt, Mycobacterium avium subsp. paratuberculosis
ccagugcaugccggccu

SEQ ID NO: 992401 - RNA, 16 nt, Mycobacterium avium subsp. paratuberculosis
cgcagcuggccgugca

SEQ ID NO: 992402 - RNA, 22 nt, Mycobacterium avium subsp. paratuberculosis
cgcagcugcgccgcgucgacgc

SEQ ID NO: 992403 - RNA, 16 nt, Mycobacterium avium subsp. paratuberculosis
cgcagcugaucggggc

SEQ ID NO: 992404 - RNA, 18 nt, Mycobacterium avium subsp. paratuberculosis
cgcagcugaucggggccc

SEQ ID NO: 992405 - RNA, 22 nt, Mycobacterium avium subsp. paratuberculosis
cgcagcugaucggggcccaccc

SEQ ID NO: 992406 - RNA, 21 nt, Mycobacterium avium subsp. paratuberculosis
cgcagcuucugcagcucgcug

SEQ ID NO: 992407 - RNA, 17 nt, Mycobacterium avium subsp. paratuberculosis
cgcaggguggccagcac

SEQ ID NO: 992408 - RNA, 21 nt, Mycobacterium avium subsp. paratuberculosis
cgcaggguggccagcaccgcg

SEQ ID NO: 992409 - RNA, 15 nt, Mycobacterium avium subsp. paratuberculosis
cgcagguagccgccg

SEQ ID NO: 992410 - RNA, 15 nt, Mycobacterium avium subsp. paratuberculosis
cgcagguccacccgc

SEQ ID NO: 992411 - RNA, 16 nt, Mycobacterium avium subsp. paratuberculosis
cgcagguccacccgcc

SEQ ID NO: 992412 - RNA, 21 nt, Mycobacterium avium subsp. paratuberculosis
cgcagguccggcagcgcgccc

SEQ ID NO: 992413 - RNA, 18 nt, Mycobacterium avium subsp. paratuberculosis
cgcagguguccagcccua

SEQ ID NO: 992414 - RNA, 21 nt, Mycobacterium avium subsp. paratuberculosis
cgcaggugaucuugcccagcc

SEQ ID NO: 992415 - RNA, 21 nt, Mycobacterium avium subsp. paratuberculosis
cgcaggugaugcggcccgacc

SEQ ID NO: 992416 - RNA, 12 nt, Mycobacterium avium subsp. paratuberculosis
cgcaggucgggc

SEQ ID NO: 992417 - RNA, 20 nt, Mycobacterium avium subsp. paratuberculosis
cgcagguuguccagccggug

SEQ ID NO: 992418 - RNA, 15 nt, Mycobacterium avium subsp. paratuberculosis
cgcagguugucggcc

SEQ ID NO: 992419 - RNA, 22 nt, Mycobacterium avium subsp. paratuberculosis
cgcagguuucucgaccaagaac

SEQ ID NO: 992420 - RNA, 18 nt, Mycobacterium avium subsp. paratuberculosis
cgcaguagccgacgugcc

SEQ ID NO: 992421 - RNA, 13 nt, Mycobacterium avium subsp. paratuberculosis
cgcagucgaucac

SEQ ID NO: 992422 - RNA, 19 nt, Mycobacterium avium subsp. paratuberculosis
cgcagucguucggccagca

SEQ ID NO: 992423 - RNA, 20 nt, Mycobacterium avium subsp. paratuberculosis
cgcagucguucggccagcac

SEQ ID NO: 992424 - RNA, 14 nt, Mycobacterium avium subsp. paratuberculosis
cgcaguccagggug

SEQ ID NO: 992425 - RNA, 16 nt, Mycobacterium avium subsp. paratuberculosis
cgcaguucggccgccg

SEQ ID NO: 992426 - RNA, 14 nt, Mycobacterium avium subsp. paratuberculosis
cgcaguucgggauc

SEQ ID NO: 992427 - RNA, 21 nt, Mycobacterium avium subsp. paratuberculosis
cgcagugcggacgccacaaca

SEQ ID NO: 992428 - RNA, 21 nt, Mycobacterium avium subsp. paratuberculosis
cgcagugccgcaccagcaccc

SEQ ID NO: 992429 - RNA, 15 nt, Mycobacterium avium subsp. paratuberculosis
cgcagugccggcgca

SEQ ID NO: 992430 - RNA, 16 nt, Mycobacterium avium subsp. paratuberculosis
cgcagcaucuccgagu

SEQ ID NO: 992431 - RNA, 14 nt, Mycobacterium avium subsp. paratuberculosis
cgcagcaucggcag

SEQ ID NO: 992432 - RNA, 14 nt, Mycobacterium avium subsp. paratuberculosis
cgcagccaccgccc

SEQ ID NO: 992433 - RNA, 16 nt, Mycobacterium avium subsp. paratuberculosis
cgcagccaccgcccga

SEQ ID NO: 992434 - RNA, 16 nt, Mycobacterium avium subsp. paratuberculosis
cgcagccagcgcagca

SEQ ID NO: 992435 - RNA, 17 nt, Mycobacterium avium subsp. paratuberculosis
cgcagccagcgcagcac

SEQ ID NO: 992436 - RNA, 16 nt, Mycobacterium avium subsp. paratuberculosis
cgcagccagaccucgc

SEQ ID NO: 992437 - RNA, 20 nt, Mycobacterium avium subsp. paratuberculosis
cgcagcccaggcccagcagc

SEQ ID NO: 992438 - RNA, 17 nt, Mycobacterium avium subsp. paratuberculosis
cgcagccagcucggcgu

SEQ ID NO: 992439 - RNA, 19 nt, Mycobacterium avium subsp. paratuberculosis
cgcagccagucgccggcca

SEQ ID NO: 992440 - RNA, 13 nt, Mycobacterium avium subsp. paratuberculosis
cgcagcaccaccu

SEQ ID NO: 992441 - RNA, 16 nt, Mycobacterium avium subsp. paratuberculosis
cgcagcaccaggcccu

SEQ ID NO: 992442 - RNA, 16 nt, Mycobacterium avium subsp. paratuberculosis
cgcagcaccagggucu

SEQ ID NO: 992443 - RNA, 14 nt, Mycobacterium avium subsp. paratuberculosis
cgcagcaccuccga

SEQ ID NO: 992444 - RNA, 23 nt, Mycobacterium avium subsp. paratuberculosis
cgcagcaccuccgacagcccccg

SEQ ID NO: 992445 - RNA, 14 nt, Mycobacterium avium subsp. paratuberculosis
cgcagcagcagccc

SEQ ID NO: 992446 - RNA, 22 nt, Mycobacterium avium subsp. paratuberculosis
cgcagcagcaggucggccagcu

SEQ ID NO: 992447 - RNA, 13 nt, Mycobacterium avium subsp. paratuberculosis
cgcagcagccagg

SEQ ID NO: 992448 - RNA, 14 nt, Mycobacterium avium subsp. paratuberculosis
cgcagcagccagga

SEQ ID NO: 992449 - RNA, 17 nt, Mycobacterium avium subsp. paratuberculosis
cgcagcagccaggacag

SEQ ID NO: 992450 - RNA, 19 nt, Mycobacterium avium subsp. paratuberculosis
cgcagcgcaucgccggcga

SEQ ID NO: 992451 - RNA, 18 nt, Mycobacterium avium subsp. paratuberculosis
cgcagcgccagcgcgccc

SEQ ID NO: 992452 - RNA, 14 nt, Mycobacterium avium subsp. paratuberculosis
cgcagcgcgcgacc

SEQ ID NO: 992453 - RNA, 12 nt, Mycobacterium avium subsp. paratuberculosis
cgcagcgcggcg

SEQ ID NO: 992454 - RNA, 15 nt, Mycobacterium avium subsp. paratuberculosis
cgcagcgcgucgggc

SEQ ID NO: 992455 - RNA, 21 nt, Mycobacterium avium subsp. paratuberculosis
cgcagcgcgucgggcucggcc

SEQ ID NO: 992456 - RNA, 14 nt, Mycobacterium avium subsp. paratuberculosis
cgcagcucgcccag

SEQ ID NO: 992457 - RNA, 12 nt, Mycobacterium avium subsp. paratuberculosis
cgcagcucgccg

SEQ ID NO: 992458 - RNA, 13 nt, Mycobacterium avium subsp. paratuberculosis
cgcagcucgccgg

SEQ ID NO: 992459 - RNA, 14 nt, Mycobacterium avium subsp. paratuberculosis
cgcagccggaucac

SEQ ID NO: 992460 - RNA, 14 nt, Mycobacterium avium subsp. paratuberculosis
cgcagccggcagca

SEQ ID NO: 992461 - RNA, 18 nt, Mycobacterium avium subsp. paratuberculosis
cgcagccggccaccgccc

SEQ ID NO: 992462 - RNA, 16 nt, Mycobacterium avium subsp. paratuberculosis
cgcagcccgaccuucu

SEQ ID NO: 992463 - RNA, 15 nt, Mycobacterium avium subsp. paratuberculosis
cgcagcccgccagga

SEQ ID NO: 992464 - RNA, 12 nt, Mycobacterium avium subsp. paratuberculosis
cgcagccgucga

SEQ ID NO: 992465 - RNA, 13 nt, Mycobacterium avium subsp. paratuberculosis
cgcagccggccgu

SEQ ID NO: 992466 - RNA, 16 nt, Mycobacterium avium subsp. paratuberculosis
cgcagccgggcggcgc

SEQ ID NO: 992467 - RNA, 21 nt, Mycobacterium avium subsp. paratuberculosis
cgcagcgaccugguccaccgc

SEQ ID NO: 992468 - RNA, 21 nt, Mycobacterium avium subsp. paratuberculosis
cgcaauacccgaccagcaccg

SEQ ID NO: 992469 - RNA, 14 nt, Mycobacterium avium subsp. paratuberculosis
cgauuucgcggccg

SEQ ID NO: 992470 - RNA, 19 nt, Mycobacterium avium subsp. paratuberculosis
cgauuuccgguuccucggc

SEQ ID NO: 992471 - RNA, 15 nt, Mycobacterium avium subsp. paratuberculosis
cgcaaggccgccagc

SEQ ID NO: 992472 - RNA, 22 nt, Mycobacterium avium subsp. paratuberculosis
cgcaaugcgucgcggcggcgcu

SEQ ID NO: 992473 - RNA, 14 nt, Mycobacterium avium subsp. paratuberculosis
cgcaauggcgaaca

SEQ ID NO: 992474 - RNA, 12 nt, Mycobacterium avium subsp. paratuberculosis
cgcaccagcucg

SEQ ID NO: 992475 - RNA, 21 nt, Mycobacterium avium subsp. paratuberculosis
cgcaccagcucgaggccgcgg

SEQ ID NO: 992476 - RNA, 18 nt, Mycobacterium avium subsp. paratuberculosis
cgcaccaggcgccacagc

SEQ ID NO: 992477 - RNA, 18 nt, Mycobacterium avium subsp. paratuberculosis
cgcaccagggccgcgagc

SEQ ID NO: 992478 - RNA, 14 nt, Mycobacterium avium subsp. paratuberculosis
cgcaccccacccgc

SEQ ID NO: 992479 - RNA, 15 nt, Mycobacterium avium subsp. paratuberculosis
cgcacccccagcucg

SEQ ID NO: 992480 - RNA, 14 nt, Mycobacterium avium subsp. paratuberculosis
cgcaccccggcaua

SEQ ID NO: 992481 - RNA, 15 nt, Mycobacterium avium subsp. paratuberculosis
cgcaccccguccagg

SEQ ID NO: 992482 - RNA, 18 nt, Mycobacterium avium subsp. paratuberculosis
cgcaccccgucgcggacc

SEQ ID NO: 992483 - RNA, 14 nt, Mycobacterium avium subsp. paratuberculosis
cgcacccgccgccc

SEQ ID NO: 992484 - RNA, 23 nt, Mycobacterium avium subsp. paratuberculosis
cgcagcaacgguacgugcgccgg

SEQ ID NO: 992485 - RNA, 21 nt, Mycobacterium avium subsp. paratuberculosis
cgcacuggagugcugcagacc

SEQ ID NO: 992486 - RNA, 21 nt, Mycobacterium avium subsp. paratuberculosis
cgcacguauccgcggucgacc

SEQ ID NO: 992487 - RNA, 14 nt, Mycobacterium avium subsp. paratuberculosis
cgcacugcacggcc

SEQ ID NO: 992488 - RNA, 21 nt, Mycobacterium avium subsp. paratuberculosis
cgcacugcaucucgaccuggg

SEQ ID NO: 992489 - RNA, 14 nt, Mycobacterium avium subsp. paratuberculosis
cgcaccggucuccg

SEQ ID NO: 992490 - RNA, 18 nt, Mycobacterium avium subsp. paratuberculosis
cgcaccguguagccgacc

SEQ ID NO: 992491 - RNA, 14 nt, Mycobacterium avium subsp. paratuberculosis
cgcaccgggcccgc

SEQ ID NO: 992492 - RNA, 16 nt, Mycobacterium avium subsp. paratuberculosis
cgcaccgggcccgccc

SEQ ID NO: 992493 - RNA, 17 nt, Mycobacterium avium subsp. paratuberculosis
cgcacggugcagcagcg

SEQ ID NO: 992494 - RNA, 13 nt, Mycobacterium avium subsp. paratuberculosis
cgcacgggcggcg

SEQ ID NO: 992495 - RNA, 15 nt, Mycobacterium avium subsp. paratuberculosis
cgcacgggcggcggg

SEQ ID NO: 992496 - RNA, 16 nt, Mycobacterium avium subsp. paratuberculosis
cgcaccggagccuugg

SEQ ID NO: 992497 - RNA, 15 nt, Mycobacterium avium subsp. paratuberculosis
cgcaccgcgggcagc

SEQ ID NO: 992498 - RNA, 20 nt, Mycobacterium avium subsp. paratuberculosis
cgcaccgcgucgaccaccgc

SEQ ID NO: 992499 - RNA, 22 nt, Mycobacterium avium subsp. paratuberculosis
cgcaccgcgucgaugcgggccc

SEQ ID NO: 992500 - RNA, 15 nt, Mycobacterium avium subsp. paratuberculosis
cgcaccggccggccc

SEQ ID NO: 992501 - RNA, 16 nt, Mycobacterium avium subsp. paratuberculosis
cgcaccgcgcgccagg

SEQ ID NO: 992502 - RNA, 15 nt, Mycobacterium avium subsp. paratuberculosis
cgcaccgccccgccc

SEQ ID NO: 992503 - RNA, 13 nt, Mycobacterium avium subsp. paratuberculosis
cgcaccgcggccu

SEQ ID NO: 992504 - RNA, 17 nt, Mycobacterium avium subsp. paratuberculosis
cgcaccgcggccucggc

SEQ ID NO: 992505 - RNA, 20 nt, Mycobacterium avium subsp. paratuberculosis
cgcaccgccaggcuggccag

SEQ ID NO: 992506 - RNA, 13 nt, Mycobacterium avium subsp. paratuberculosis
cgcaccgccccgc

SEQ ID NO: 992507 - RNA, 14 nt, Mycobacterium avium subsp. paratuberculosis
cgcaccgccgggca

SEQ ID NO: 992508 - RNA, 20 nt, Mycobacterium avium subsp. paratuberculosis
cgcaccgccgggcauccggg

SEQ ID NO: 992509 - RNA, 14 nt, Mycobacterium avium subsp. paratuberculosis
cgcaccgccgucgg

SEQ ID NO: 992510 - RNA, 12 nt, Mycobacterium avium subsp. paratuberculosis
cgcacccgggca

SEQ ID NO: 992511 - RNA, 14 nt, Mycobacterium avium subsp. paratuberculosis
cgcaccgaccagcg

SEQ ID NO: 992512 - RNA, 22 nt, Mycobacterium avium subsp. paratuberculosis
cgcacccuugacuaccgcgccc

SEQ ID NO: 992513 - RNA, 13 nt, Mycobacterium avium subsp. paratuberculosis
cgcaccgccaccg

SEQ ID NO: 992514 - RNA, 16 nt, Mycobacterium avium subsp. paratuberculosis
cgcaccgccaccgccc

SEQ ID NO: 992515 - RNA, 19 nt, Mycobacterium avium subsp. paratuberculosis
cgcaccgccaccgcccgcu

SEQ ID NO: 992516 - RNA, 16 nt, Mycobacterium avium subsp. paratuberculosis
cgcaccgccaccgcgc

SEQ ID NO: 992517 - RNA, 23 nt, Mycobacterium avium subsp. paratuberculosis
cgcaccgcauagcgggagccggc

SEQ ID NO: 992518 - RNA, 21 nt, Mycobacterium avium subsp. paratuberculosis
cgcaccgagaccaugccgccg

SEQ ID NO: 992519 - RNA, 22 nt, Mycobacterium avium subsp. paratuberculosis
cgcaccgagaccaugccgccga

SEQ ID NO: 992520 - RNA, 15 nt, Mycobacterium avium subsp. paratuberculosis
cgauuaggugggcuu

SEQ ID NO: 992521 - RNA, 14 nt, Mycobacterium avium subsp. paratuberculosis
cgauguuggccuca

SEQ ID NO: 992522 - RNA, 15 nt, Mycobacterium avium subsp. paratuberculosis
cgauguagccgggcu

SEQ ID NO: 992523 - RNA, 13 nt, Mycobacterium avium subsp. paratuberculosis
cgauucaucgccg

SEQ ID NO: 992524 - RNA, 17 nt, Mycobacterium avium subsp. paratuberculosis
cgauucgcggccaccac

SEQ ID NO: 992525 - RNA, 20 nt, Mycobacterium avium subsp. paratuberculosis
cgauucggcgccgcgacccc

SEQ ID NO: 992526 - RNA, 22 nt, Mycobacterium avium subsp. paratuberculosis
cgaugccgaccaacacccccgc

SEQ ID NO: 992527 - RNA, 23 nt, Mycobacterium avium subsp. paratuberculosis
cgaugcccuuggccagcagugcc

SEQ ID NO: 992528 - RNA, 19 nt, Mycobacterium avium subsp. paratuberculosis
cgaugccgaacuccgccga

SEQ ID NO: 992529 - RNA, 21 nt, Mycobacterium avium subsp. paratuberculosis
cgaugccgaucggggcgcagc

SEQ ID NO: 992530 - RNA, 16 nt, Mycobacterium avium subsp. paratuberculosis
cgaugcccagccccuc

SEQ ID NO: 992531 - RNA, 15 nt, Mycobacterium avium subsp. paratuberculosis
cgaugcccagcgcgc

SEQ ID NO: 992532 - RNA, 16 nt, Mycobacterium avium subsp. paratuberculosis
cgauggccaccagguc

SEQ ID NO: 992533 - RNA, 13 nt, Mycobacterium avium subsp. paratuberculosis
cgauggcccaggc

SEQ ID NO: 992534 - RNA, 16 nt, Mycobacterium avium subsp. paratuberculosis
cgauggcccggaccgc

SEQ ID NO: 992535 - RNA, 15 nt, Mycobacterium avium subsp. paratuberculosis
cgauggaaggugcug

SEQ ID NO: 992536 - RNA, 15 nt, Mycobacterium avium subsp. paratuberculosis
cgauggacaggcacu

SEQ ID NO: 992537 - RNA, 19 nt, Mycobacterium avium subsp. paratuberculosis
cgauggaccgggugguggg

SEQ ID NO: 992538 - RNA, 18 nt, Mycobacterium avium subsp. paratuberculosis
cgauggcggccugcagga

SEQ ID NO: 992539 - RNA, 19 nt, Mycobacterium avium subsp. paratuberculosis
cgauggcggcggcccgccg

SEQ ID NO: 992540 - RNA, 14 nt, Mycobacterium avium subsp. paratuberculosis
cgauggcggcggcu

SEQ ID NO: 992541 - RNA, 15 nt, Mycobacterium avium subsp. paratuberculosis
cgauggcggcgugca

SEQ ID NO: 992542 - RNA, 15 nt, Mycobacterium avium subsp. paratuberculosis
cgauggugccgucgg

SEQ ID NO: 992543 - RNA, 13 nt, Mycobacterium avium subsp. paratuberculosis
cgauggcgcggcg

SEQ ID NO: 992544 - RNA, 22 nt, Mycobacterium avium subsp. paratuberculosis
cgauggcgccgaucgcgcgcag

SEQ ID NO: 992545 - RNA, 14 nt, Mycobacterium avium subsp. paratuberculosis
cgauguccccgcgg

SEQ ID NO: 992546 - RNA, 20 nt, Mycobacterium avium subsp. paratuberculosis
cgaugguguagccgugcccc

SEQ ID NO: 992547 - RNA, 21 nt, Mycobacterium avium subsp. paratuberculosis
cgaugguguaguccugcuuca

SEQ ID NO: 992548 - RNA, 15 nt, Mycobacterium avium subsp. paratuberculosis
cgauggugugcagca

SEQ ID NO: 992549 - RNA, 21 nt, Mycobacterium avium subsp. paratuberculosis
cgaucuggguuugggucaucg

SEQ ID NO: 992550 - RNA, 22 nt, Mycobacterium avium subsp. paratuberculosis
cgaucuggcgguuggacaggcc

SEQ ID NO: 992551 - RNA, 19 nt, Mycobacterium avium subsp. paratuberculosis
cgaucucggucaccgagcg

SEQ ID NO: 992552 - RNA, 20 nt, Mycobacterium avium subsp. paratuberculosis
cgaucucggugagccgcugg

SEQ ID NO: 992553 - RNA, 20 nt, Mycobacterium avium subsp. paratuberculosis
cgaucucuucgccggacagc

SEQ ID NO: 992554 - RNA, 18 nt, Mycobacterium avium subsp. paratuberculosis
cgaucucguagcccaccu

SEQ ID NO: 992555 - RNA, 22 nt, Mycobacterium avium subsp. paratuberculosis
cgaucuccaccguguucaccag

SEQ ID NO: 992556 - RNA, 16 nt, Mycobacterium avium subsp. paratuberculosis
cgaucggcuccagcgc

SEQ ID NO: 992557 - RNA, 21 nt, Mycobacterium avium subsp. paratuberculosis
cgaucggcucggcgccccacg

SEQ ID NO: 992558 - RNA, 21 nt, Mycobacterium avium subsp. paratuberculosis
cgaucgggaacagcccgcccu

SEQ ID NO: 992559 - RNA, 13 nt, Mycobacterium avium subsp. paratuberculosis
cgaucgucaugcc

SEQ ID NO: 992560 - RNA, 16 nt, Mycobacterium avium subsp. paratuberculosis
cgaucggugaacccgc

SEQ ID NO: 992561 - RNA, 14 nt, Mycobacterium avium subsp. paratuberculosis
cgaucggcgcgccg

SEQ ID NO: 992562 - RNA, 19 nt, Mycobacterium avium subsp. paratuberculosis
cgaucggcacgucgagcag

SEQ ID NO: 992563 - RNA, 23 nt, Mycobacterium avium subsp. paratuberculosis
cgaucuuggcgagcugaccggcc

SEQ ID NO: 992564 - RNA, 18 nt, Mycobacterium avium subsp. paratuberculosis
cgaucuugacguggaaau

SEQ ID NO: 992565 - RNA, 14 nt, Mycobacterium avium subsp. paratuberculosis
cgaugaacuccucg

SEQ ID NO: 992566 - RNA, 18 nt, Mycobacterium avium subsp. paratuberculosis
cgaugaagccgugcccgc

SEQ ID NO: 992567 - RNA, 19 nt, Mycobacterium avium subsp. paratuberculosis
cgaugaauccgcgcagcag

SEQ ID NO: 992568 - RNA, 21 nt, Mycobacterium avium subsp. paratuberculosis
cgaugaauccgcgcagcagcg

SEQ ID NO: 992569 - RNA, 16 nt, Mycobacterium avium subsp. paratuberculosis
cgaugacccagcccag

SEQ ID NO: 992570 - RNA, 20 nt, Mycobacterium avium subsp. paratuberculosis
cgaugaccgcggcgggcagg

SEQ ID NO: 992571 - RNA, 18 nt, Mycobacterium avium subsp. paratuberculosis
cgaugaccggcccggcgg

SEQ ID NO: 992572 - RNA, 19 nt, Mycobacterium avium subsp. paratuberculosis
cgaugacggcggcgcccug

SEQ ID NO: 992573 - RNA, 12 nt, Mycobacterium avium subsp. paratuberculosis
cgaugacggccg

SEQ ID NO: 992574 - RNA, 16 nt, Mycobacterium avium subsp. paratuberculosis
cgaugaccucgcgcag

SEQ ID NO: 992575 - RNA, 15 nt, Mycobacterium avium subsp. paratuberculosis
cgaugacgagcagcg

SEQ ID NO: 992576 - RNA, 19 nt, Mycobacterium avium subsp. paratuberculosis
cgaugcauuggugcacgcc

SEQ ID NO: 992577 - RNA, 16 nt, Mycobacterium avium subsp. paratuberculosis
cgaugagggccagcag

SEQ ID NO: 992578 - RNA, 18 nt, Mycobacterium avium subsp. paratuberculosis
cgaugagcuggugcagcg

SEQ ID NO: 992579 - RNA, 10 nt, Mycobacterium avium subsp. paratuberculosis
cgaucagccc

SEQ ID NO: 992580 - RNA, 21 nt, Mycobacterium avium subsp. paratuberculosis
cgaucagccccagggugcgcc

SEQ ID NO: 992581 - RNA, 13 nt, Mycobacterium avium subsp. paratuberculosis
cgaucagcccgcc

SEQ ID NO: 992582 - RNA, 13 nt, Mycobacterium avium subsp. paratuberculosis
cgaucagcaugac

SEQ ID NO: 992583 - RNA, 19 nt, Mycobacterium avium subsp. paratuberculosis
cgaucagcagccgggccug

SEQ ID NO: 992584 - RNA, 20 nt, Mycobacterium avium subsp. paratuberculosis
cgaucagcacgucgcggccc

SEQ ID NO: 992585 - RNA, 16 nt, Mycobacterium avium subsp. paratuberculosis
cgaucagcagcacccg

SEQ ID NO: 992586 - RNA, 16 nt, Mycobacterium avium subsp. paratuberculosis
cgaucagcagcaccug

SEQ ID NO: 992587 - RNA, 22 nt, Mycobacterium avium subsp. paratuberculosis
cgaucagcgacggcccgccgga

SEQ ID NO: 992588 - RNA, 12 nt, Mycobacterium avium subsp. paratuberculosis
cgaucaggcugg

SEQ ID NO: 992589 - RNA, 15 nt, Mycobacterium avium subsp. paratuberculosis
cgaucaggcuggaca

SEQ ID NO: 992590 - RNA, 24 nt, Mycobacterium avium subsp. paratuberculosis
cgaucagggccgcggccgccgcga

SEQ ID NO: 992591 - RNA, 23 nt, Mycobacterium avium subsp. paratuberculosis
cgaucagguggggcaggaacgcc

SEQ ID NO: 992592 - RNA, 17 nt, Mycobacterium avium subsp. paratuberculosis
cgaucagcuggcugaca

SEQ ID NO: 992593 - RNA, 15 nt, Mycobacterium avium subsp. paratuberculosis
cgaucagcuccuccu

SEQ ID NO: 992594 - RNA, 14 nt, Mycobacterium avium subsp. paratuberculosis
cgaucagcgcgucg

SEQ ID NO: 992595 - RNA, 13 nt, Mycobacterium avium subsp. paratuberculosis
cgaucagcccggc

SEQ ID NO: 992596 - RNA, 18 nt, Mycobacterium avium subsp. paratuberculosis
cgaucagcggcgggccca

SEQ ID NO: 992597 - RNA, 19 nt, Mycobacterium avium subsp. paratuberculosis
cgauccaaccgagucgcug

SEQ ID NO: 992598 - RNA, 15 nt, Mycobacterium avium subsp. paratuberculosis
cgaucaucuccaccc

SEQ ID NO: 992599 - RNA, 16 nt, Mycobacterium avium subsp. paratuberculosis
cgaucaucgccccgga

SEQ ID NO: 992600 - RNA, 13 nt, Mycobacterium avium subsp. paratuberculosis
cgaucaucagggc

SEQ ID NO: 992601 - RNA, 16 nt, Mycobacterium avium subsp. paratuberculosis
cgaucaucaccaccgc

SEQ ID NO: 992602 - RNA, 17 nt, Mycobacterium avium subsp. paratuberculosis
cgaucaguauggagaaa

SEQ ID NO: 992603 - RNA, 17 nt, Mycobacterium avium subsp. paratuberculosis
cgaucgcgguccaggau

SEQ ID NO: 992604 - RNA, 16 nt, Mycobacterium avium subsp. paratuberculosis
cgaucgcgccggccgc

SEQ ID NO: 992605 - RNA, 12 nt, Mycobacterium avium subsp. paratuberculosis
cgaucgcggccc

SEQ ID NO: 992606 - RNA, 16 nt, Mycobacterium avium subsp. paratuberculosis
cgaucgcggcccccug

SEQ ID NO: 992607 - RNA, 14 nt, Mycobacterium avium subsp. paratuberculosis
cgaucgccgcgcau

SEQ ID NO: 992608 - RNA, 21 nt, Mycobacterium avium subsp. paratuberculosis
cgaucgccgcgcauucaccag

SEQ ID NO: 992609 - RNA, 17 nt, Mycobacterium avium subsp. paratuberculosis
cgaucgccgcgcccagc

SEQ ID NO: 992610 - RNA, 13 nt, Mycobacterium avium subsp. paratuberculosis
cgaucgccaacgc

SEQ ID NO: 992611 - RNA, 15 nt, Mycobacterium avium subsp. paratuberculosis
cgaucgcgaucgccg

SEQ ID NO: 992612 - RNA, 24 nt, Mycobacterium avium subsp. paratuberculosis
cgaucgaucagccgcgacagccgc

SEQ ID NO: 992613 - RNA, 16 nt, Mycobacterium avium subsp. paratuberculosis
cgaucgaggacaccgc

SEQ ID NO: 992614 - RNA, 14 nt, Mycobacterium avium subsp. paratuberculosis
cgauccgggccggu

SEQ ID NO: 992615 - RNA, 22 nt, Mycobacterium avium subsp. paratuberculosis
cgauccgcgcccuggugcaaca

SEQ ID NO: 992616 - RNA, 16 nt, Mycobacterium avium subsp. paratuberculosis
cgauccgcgccgccgc

SEQ ID NO: 992617 - RNA, 22 nt, Mycobacterium avium subsp. paratuberculosis
cgauccgcgccgcgaugcaaca

SEQ ID NO: 992618 - RNA, 15 nt, Mycobacterium avium subsp. paratuberculosis
cgaucccgucggcca

SEQ ID NO: 992619 - RNA, 16 nt, Mycobacterium avium subsp. paratuberculosis
cgaucccgucggccau

SEQ ID NO: 992620 - RNA, 18 nt, Mycobacterium avium subsp. paratuberculosis
cgaucccggcgagcacgc

SEQ ID NO: 992621 - RNA, 18 nt, Mycobacterium avium subsp. paratuberculosis
cgauccccgcagcucccc

SEQ ID NO: 992622 - RNA, 20 nt, Mycobacterium avium subsp. paratuberculosis
cgacguccucgaugccgacc

SEQ ID NO: 992623 - RNA, 20 nt, Mycobacterium avium subsp. paratuberculosis
cgacguccuggaucgcgcag

SEQ ID NO: 992624 - RNA, 21 nt, Mycobacterium avium subsp. paratuberculosis
cgacguccuggaucgcgcagg

SEQ ID NO: 992625 - RNA, 17 nt, Mycobacterium avium subsp. paratuberculosis
cgacguccaggccggcg

SEQ ID NO: 992626 - RNA, 19 nt, Mycobacterium avium subsp. paratuberculosis
cgacguccuugaucagcau

SEQ ID NO: 992627 - RNA, 19 nt, Mycobacterium avium subsp. paratuberculosis
cgacgucgaccgcgacgac

SEQ ID NO: 992628 - RNA, 21 nt, Mycobacterium avium subsp. paratuberculosis
cgacgucgaccgcgacgaccu

SEQ ID NO: 992629 - RNA, 15 nt, Mycobacterium avium subsp. paratuberculosis
cgacgucgaccgcgc

SEQ ID NO: 992630 - RNA, 21 nt, Mycobacterium avium subsp. paratuberculosis
cgacgucgagaaaggccagca

SEQ ID NO: 992631 - RNA, 18 nt, Mycobacterium avium subsp. paratuberculosis
cgacgucaggucgaccgg

SEQ ID NO: 992632 - RNA, 18 nt, Mycobacterium avium subsp. paratuberculosis
cgacgucauccggcugcc

SEQ ID NO: 992633 - RNA, 21 nt, Mycobacterium avium subsp. paratuberculosis
cgacgucaacaccguggugga

SEQ ID NO: 992634 - RNA, 16 nt, Mycobacterium avium subsp. paratuberculosis
cgacguagucgcgcac

SEQ ID NO: 992635 - RNA, 14 nt, Mycobacterium avium subsp. paratuberculosis
cgacgucaccaccg

SEQ ID NO: 992636 - RNA, 15 nt, Mycobacterium avium subsp. paratuberculosis
cgaucaccgcggcca

SEQ ID NO: 992637 - RNA, 14 nt, Mycobacterium avium subsp. paratuberculosis
cgaucaccgcugcc

SEQ ID NO: 992638 - RNA, 18 nt, Mycobacterium avium subsp. paratuberculosis
cgaucacggugaucgccg

SEQ ID NO: 992639 - RNA, 15 nt, Mycobacterium avium subsp. paratuberculosis
cgaucagaugcucgu

SEQ ID NO: 992640 - RNA, 23 nt, Mycobacterium avium subsp. paratuberculosis
cgauagugaacgccucgggccgg

SEQ ID NO: 992641 - RNA, 17 nt, Mycobacterium avium subsp. paratuberculosis
cgccaccuucaccgcgc

SEQ ID NO: 992642 - RNA, 13 nt, Mycobacterium avium subsp. paratuberculosis
cgccaccuccucc

SEQ ID NO: 992643 - RNA, 21 nt, Mycobacterium avium subsp. paratuberculosis
cgccacgacugcgcggccggc

SEQ ID NO: 992644 - RNA, 15 nt, Mycobacterium avium subsp. paratuberculosis
cgccacgaucaccac

SEQ ID NO: 992645 - RNA, 17 nt, Mycobacterium avium subsp. paratuberculosis
cgccacgaucaccacca

SEQ ID NO: 992646 - RNA, 16 nt, Mycobacterium avium subsp. paratuberculosis
cgccacgcacaccgcg

SEQ ID NO: 992647 - RNA, 14 nt, Mycobacterium avium subsp. paratuberculosis
cgccacgcccaggg

SEQ ID NO: 992648 - RNA, 15 nt, Mycobacterium avium subsp. paratuberculosis
cgccacgccccggcg

SEQ ID NO: 992649 - RNA, 18 nt, Mycobacterium avium subsp. paratuberculosis
cgccacgccccggcgccg

SEQ ID NO: 992650 - RNA, 19 nt, Mycobacterium avium subsp. paratuberculosis
cgccacggggcccgcgacc

SEQ ID NO: 992651 - RNA, 14 nt, Mycobacterium avium subsp. paratuberculosis
cgccacggggcgcc

SEQ ID NO: 992652 - RNA, 14 nt, Mycobacterium avium subsp. paratuberculosis
cgccacggggcugc

SEQ ID NO: 992653 - RNA, 23 nt, Mycobacterium avium subsp. paratuberculosis
cgccacggggcugcgggccaggc

SEQ ID NO: 992654 - RNA, 21 nt, Mycobacterium avium subsp. paratuberculosis
cgccacucauguucagggugc

SEQ ID NO: 992655 - RNA, 16 nt, Mycobacterium avium subsp. paratuberculosis
cgccacguagcagcag

SEQ ID NO: 992656 - RNA, 20 nt, Mycobacterium avium subsp. paratuberculosis
cgccacucgggcggccgcgg

SEQ ID NO: 992657 - RNA, 22 nt, Mycobacterium avium subsp. paratuberculosis
cgccacucgggcggccgcggau

SEQ ID NO: 992658 - RNA, 17 nt, Mycobacterium avium subsp. paratuberculosis
cgccacugccgccgccc

SEQ ID NO: 992659 - RNA, 16 nt, Mycobacterium avium subsp. paratuberculosis
cgcauaccagcgcugg

SEQ ID NO: 992660 - RNA, 13 nt, Mycobacterium avium subsp. paratuberculosis
cgcauccagcgcc

SEQ ID NO: 992661 - RNA, 19 nt, Mycobacterium avium subsp. paratuberculosis
cgcauccagcgccgccaac

SEQ ID NO: 992662 - RNA, 20 nt, Mycobacterium avium subsp. paratuberculosis
cgcauccucauagccggccg

SEQ ID NO: 992663 - RNA, 13 nt, Mycobacterium avium subsp. paratuberculosis
cgccaccagcagg

SEQ ID NO: 992664 - RNA, 16 nt, Mycobacterium avium subsp. paratuberculosis
cgcaucgaaccgccgc

SEQ ID NO: 992665 - RNA, 14 nt, Mycobacterium avium subsp. paratuberculosis
cgccaccacggcgu

SEQ ID NO: 992666 - RNA, 13 nt, Mycobacterium avium subsp. paratuberculosis
cgccaccaggcgg

SEQ ID NO: 992667 - RNA, 16 nt, Mycobacterium avium subsp. paratuberculosis
cgccaccagcaggccc

SEQ ID NO: 992668 - RNA, 20 nt, Mycobacterium avium subsp. paratuberculosis
cgccaccagccacaccgccg

SEQ ID NO: 992669 - RNA, 21 nt, Mycobacterium avium subsp. paratuberculosis
cgccaccagccacaccgccgc

SEQ ID NO: 992670 - RNA, 19 nt, Mycobacterium avium subsp. paratuberculosis
cgccagacguccagcgccg

SEQ ID NO: 992671 - RNA, 21 nt, Mycobacterium avium subsp. paratuberculosis
cgccagacguccagcgccgcc

SEQ ID NO: 992672 - RNA, 16 nt, Mycobacterium avium subsp. paratuberculosis
cgccagacucacggcg

SEQ ID NO: 992673 - RNA, 15 nt, Mycobacterium avium subsp. paratuberculosis
cgccagaucccgcag

SEQ ID NO: 992674 - RNA, 22 nt, Mycobacterium avium subsp. paratuberculosis
cgccagaucgccaucagggucu

SEQ ID NO: 992675 - RNA, 18 nt, Mycobacterium avium subsp. paratuberculosis
cgccagcaacgacccggc

SEQ ID NO: 992676 - RNA, 22 nt, Mycobacterium avium subsp. paratuberculosis
cgccagcaacgacccggccacc

SEQ ID NO: 992677 - RNA, 19 nt, Mycobacterium avium subsp. paratuberculosis
cgccagcaccaccucgcgc

SEQ ID NO: 992678 - RNA, 14 nt, Mycobacterium avium subsp. paratuberculosis
cgccagcaccgcca

SEQ ID NO: 992679 - RNA, 15 nt, Mycobacterium avium subsp. paratuberculosis
cgccagcaccggcgc

SEQ ID NO: 992680 - RNA, 19 nt, Mycobacterium avium subsp. paratuberculosis
cgccagcaccggcgcgccg

SEQ ID NO: 992681 - RNA, 17 nt, Mycobacterium avium subsp. paratuberculosis
cgccagcaccucgcggc

SEQ ID NO: 992682 - RNA, 19 nt, Mycobacterium avium subsp. paratuberculosis
cgccagcaccucgcggcag

SEQ ID NO: 992683 - RNA, 20 nt, Mycobacterium avium subsp. paratuberculosis
cgccagcaccucgcggcagc

SEQ ID NO: 992684 - RNA, 17 nt, Mycobacterium avium subsp. paratuberculosis
cgccagcacgugaugca

SEQ ID NO: 992685 - RNA, 11 nt, Mycobacterium avium subsp. paratuberculosis
cgccagcagca

SEQ ID NO: 992686 - RNA, 14 nt, Mycobacterium avium subsp. paratuberculosis
cgccagcagcaccu

SEQ ID NO: 992687 - RNA, 15 nt, Mycobacterium avium subsp. paratuberculosis
cgccagcagcacggc

SEQ ID NO: 992688 - RNA, 18 nt, Mycobacterium avium subsp. paratuberculosis
cgccagcagcagccgcgc

SEQ ID NO: 992689 - RNA, 22 nt, Mycobacterium avium subsp. paratuberculosis
cgccagcagcagccgcgccgcc

SEQ ID NO: 992690 - RNA, 14 nt, Mycobacterium avium subsp. paratuberculosis
cgccagcacggcca

SEQ ID NO: 992691 - RNA, 20 nt, Mycobacterium avium subsp. paratuberculosis
cgccagcagcggcacccggu

SEQ ID NO: 992692 - RNA, 14 nt, Mycobacterium avium subsp. paratuberculosis
cgccagcagcgccg

SEQ ID NO: 992693 - RNA, 15 nt, Mycobacterium avium subsp. paratuberculosis
cgccagcagcgccgc

SEQ ID NO: 992694 - RNA, 17 nt, Mycobacterium avium subsp. paratuberculosis
cgccagcagcagcgccg

SEQ ID NO: 992695 - RNA, 19 nt, Mycobacterium avium subsp. paratuberculosis
cgccagcagcagcgccgcc

SEQ ID NO: 992696 - RNA, 22 nt, Mycobacterium avium subsp. paratuberculosis
cgccagcagcagcgccgccacc

SEQ ID NO: 992697 - RNA, 13 nt, Mycobacterium avium subsp. paratuberculosis
cgccagcagcgcc

SEQ ID NO: 992698 - RNA, 19 nt, Mycobacterium avium subsp. paratuberculosis
cgccagcagggcaucuccc

SEQ ID NO: 992699 - RNA, 16 nt, Mycobacterium avium subsp. paratuberculosis
cgccagcaugaucacc

SEQ ID NO: 992700 - RNA, 22 nt, Mycobacterium avium subsp. paratuberculosis
cgccagcaugaucaccgccagc

SEQ ID NO: 992701 - RNA, 22 nt, Mycobacterium avium subsp. paratuberculosis
cgccagcaugcgaugaccaccc

SEQ ID NO: 992702 - RNA, 16 nt, Mycobacterium avium subsp. paratuberculosis
cgccagccccaccggc

SEQ ID NO: 992703 - RNA, 14 nt, Mycobacterium avium subsp. paratuberculosis
cgccagccaggcga

SEQ ID NO: 992704 - RNA, 13 nt, Mycobacterium avium subsp. paratuberculosis
cgccagcccgccc

SEQ ID NO: 992705 - RNA, 20 nt, Mycobacterium avium subsp. paratuberculosis
cgccagcccgcccagcgcca

SEQ ID NO: 992706 - RNA, 12 nt, Mycobacterium avium subsp. paratuberculosis
cgccagcccgcg

SEQ ID NO: 992707 - RNA, 12 nt, Mycobacterium avium subsp. paratuberculosis
cgccagcccggc

SEQ ID NO: 992708 - RNA, 19 nt, Mycobacterium avium subsp. paratuberculosis
cgccagcccggcguacagc

SEQ ID NO: 992709 - RNA, 14 nt, Mycobacterium avium subsp. paratuberculosis
cgccagcugccgcg

SEQ ID NO: 992710 - RNA, 14 nt, Mycobacterium avium subsp. paratuberculosis
cgccagcugggcag

SEQ ID NO: 992711 - RNA, 23 nt, Mycobacterium avium subsp. paratuberculosis
cgccagcuggguggucaccagcg

SEQ ID NO: 992712 - RNA, 16 nt, Mycobacterium avium subsp. paratuberculosis
cgccaggaccacccac

SEQ ID NO: 992713 - RNA, 22 nt, Mycobacterium avium subsp. paratuberculosis
cgccaggaccacccacucccag

SEQ ID NO: 992714 - RNA, 17 nt, Mycobacterium avium subsp. paratuberculosis
cgccaggauccgcccgc

SEQ ID NO: 992715 - RNA, 20 nt, Mycobacterium avium subsp. paratuberculosis
cgccaggaucugcucggcgu

SEQ ID NO: 992716 - RNA, 17 nt, Mycobacterium avium subsp. paratuberculosis
cgccaggccggcgacgc

SEQ ID NO: 992717 - RNA, 18 nt, Mycobacterium avium subsp. paratuberculosis
cgccaggcagaagcucca

SEQ ID NO: 992718 - RNA, 23 nt, Mycobacterium avium subsp. paratuberculosis
cgccagcgugaacagcgcccggc

SEQ ID NO: 992719 - RNA, 20 nt, Mycobacterium avium subsp. paratuberculosis
cgccagcgugacgccgggcc

SEQ ID NO: 992720 - RNA, 15 nt, Mycobacterium avium subsp. paratuberculosis
cgccagcgugacgcu

SEQ ID NO: 992721 - RNA, 20 nt, Mycobacterium avium subsp. paratuberculosis
cgccagcgucccguccuggg

SEQ ID NO: 992722 - RNA, 22 nt, Mycobacterium avium subsp. paratuberculosis
cgccagcgggccgugccgccau

SEQ ID NO: 992723 - RNA, 14 nt, Mycobacterium avium subsp. paratuberculosis
cgccagcuccagca

SEQ ID NO: 992724 - RNA, 12 nt, Mycobacterium avium subsp. paratuberculosis
cgccagcgcggc

SEQ ID NO: 992725 - RNA, 14 nt, Mycobacterium avium subsp. paratuberculosis
cgccagcgcggugu

SEQ ID NO: 992726 - RNA, 15 nt, Mycobacterium avium subsp. paratuberculosis
cgccagcgcggcggc

SEQ ID NO: 992727 - RNA, 22 nt, Mycobacterium avium subsp. paratuberculosis
cgccagcgcggcgaucagcagc

SEQ ID NO: 992728 - RNA, 13 nt, Mycobacterium avium subsp. paratuberculosis
cgccagcggcagc

SEQ ID NO: 992729 - RNA, 14 nt, Mycobacterium avium subsp. paratuberculosis
cgccagcggccgau

SEQ ID NO: 992730 - RNA, 23 nt, Mycobacterium avium subsp. paratuberculosis
cgccagcggguguguuugggcag

SEQ ID NO: 992731 - RNA, 20 nt, Mycobacterium avium subsp. paratuberculosis
cgccagccgucgccgcgccc

SEQ ID NO: 992732 - RNA, 20 nt, Mycobacterium avium subsp. paratuberculosis
cgccagccguucccggcaga

SEQ ID NO: 992733 - RNA, 15 nt, Mycobacterium avium subsp. paratuberculosis
cgccagccgcagcag

SEQ ID NO: 992734 - RNA, 16 nt, Mycobacterium avium subsp. paratuberculosis
cgccagccgccgccga

SEQ ID NO: 992735 - RNA, 22 nt, Mycobacterium avium subsp. paratuberculosis
cgccagccgccgccgaccacau

SEQ ID NO: 992736 - RNA, 22 nt, Mycobacterium avium subsp. paratuberculosis
cgccagccgccggcucagcggc

SEQ ID NO: 992737 - RNA, 17 nt, Mycobacterium avium subsp. paratuberculosis
cgccagcgcccgcgcgu

SEQ ID NO: 992738 - RNA, 18 nt, Mycobacterium avium subsp. paratuberculosis
cgccagcgccgcaacggc

SEQ ID NO: 992739 - RNA, 21 nt, Mycobacterium avium subsp. paratuberculosis
cgccagcgccggguugcaggc

SEQ ID NO: 992740 - RNA, 16 nt, Mycobacterium avium subsp. paratuberculosis
cgccaguucgucggcc

SEQ ID NO: 992741 - RNA, 22 nt, Mycobacterium avium subsp. paratuberculosis
cgccaguugcacuuucggcagc

SEQ ID NO: 992742 - RNA, 20 nt, Mycobacterium avium subsp. paratuberculosis
cgccaguguggccgcggcgg

SEQ ID NO: 992743 - RNA, 21 nt, Mycobacterium avium subsp. paratuberculosis
cgccaguguggccgcggcggc

SEQ ID NO: 992744 - RNA, 20 nt, Mycobacterium avium subsp. paratuberculosis
cgccaguccggcgccgaccc

SEQ ID NO: 992745 - RNA, 15 nt, Mycobacterium avium subsp. paratuberculosis
cgccaggugggugaa

SEQ ID NO: 992746 - RNA, 15 nt, Mycobacterium avium subsp. paratuberculosis
cgccagguuggcggc

SEQ ID NO: 992747 - RNA, 18 nt, Mycobacterium avium subsp. paratuberculosis
cgccagguuggcggcggc

SEQ ID NO: 992748 - RNA, 19 nt, Mycobacterium avium subsp. paratuberculosis
cgccagguuggcggcggcc

SEQ ID NO: 992749 - RNA, 17 nt, Mycobacterium avium subsp. paratuberculosis
cgccaggucggggcccg

SEQ ID NO: 992750 - RNA, 19 nt, Mycobacterium avium subsp. paratuberculosis
cgccaggucggggcccguc

SEQ ID NO: 992751 - RNA, 17 nt, Mycobacterium avium subsp. paratuberculosis
cgccagggcgacgccgc

SEQ ID NO: 992752 - RNA, 16 nt, Mycobacterium avium subsp. paratuberculosis
cgccagggcgcggcgc

SEQ ID NO: 992753 - RNA, 17 nt, Mycobacterium avium subsp. paratuberculosis
cgccagggcgcggcgca

SEQ ID NO: 992754 - RNA, 16 nt, Mycobacterium avium subsp. paratuberculosis
cgccagggugccccgc

SEQ ID NO: 992755 - RNA, 19 nt, Mycobacterium avium subsp. paratuberculosis
cgccagggugccccgcacc

SEQ ID NO: 992756 - RNA, 14 nt, Mycobacterium avium subsp. paratuberculosis
cgccaggcggcgac

SEQ ID NO: 992757 - RNA, 17 nt, Mycobacterium avium subsp. paratuberculosis
cgccaggcggcgacgaa

SEQ ID NO: 992758 - RNA, 21 nt, Mycobacterium avium subsp. paratuberculosis
cgccaucgcggcguuguggcc

SEQ ID NO: 992759 - RNA, 17 nt, Mycobacterium avium subsp. paratuberculosis
cgccaucgaucgggcgu

SEQ ID NO: 992760 - RNA, 17 nt, Mycobacterium avium subsp. paratuberculosis
cgccauccgccacccgc

SEQ ID NO: 992761 - RNA, 14 nt, Mycobacterium avium subsp. paratuberculosis
cgccaucaccgcgc

SEQ ID NO: 992762 - RNA, 15 nt, Mycobacterium avium subsp. paratuberculosis
cgccaucaccagcgc

SEQ ID NO: 992763 - RNA, 22 nt, Mycobacterium avium subsp. paratuberculosis
cgccaucaaccgauuucggcca

SEQ ID NO: 992764 - RNA, 20 nt, Mycobacterium avium subsp. paratuberculosis
cgccaucagggucuucucga

SEQ ID NO: 992765 - RNA, 16 nt, Mycobacterium avium subsp. paratuberculosis
cgccaucagcagcgcc

SEQ ID NO: 992766 - RNA, 18 nt, Mycobacterium avium subsp. paratuberculosis
cgccaucagcagcgccuc

SEQ ID NO: 992767 - RNA, 18 nt, Mycobacterium avium subsp. paratuberculosis
cgcccaacuacccgccga

SEQ ID NO: 992768 - RNA, 20 nt, Mycobacterium avium subsp. paratuberculosis
cgcccaacuacccgccgacg

SEQ ID NO: 992769 - RNA, 19 nt, Mycobacterium avium subsp. paratuberculosis
cgcccaacgacgucggcgu

SEQ ID NO: 992770 - RNA, 19 nt, Mycobacterium avium subsp. paratuberculosis
cgcccagacgcgggcgccc

SEQ ID NO: 992771 - RNA, 22 nt, Mycobacterium avium subsp. paratuberculosis
cgcccagaacgacgcgcucagc

SEQ ID NO: 992772 - RNA, 17 nt, Mycobacterium avium subsp. paratuberculosis
cgcccacggccaccacg

SEQ ID NO: 992773 - RNA, 20 nt, Mycobacterium avium subsp. paratuberculosis
cgcccacguaggggcccggg

SEQ ID NO: 992774 - RNA, 14 nt, Mycobacterium avium subsp. paratuberculosis
cgcccacagcaggu

SEQ ID NO: 992775 - RNA, 20 nt, Mycobacterium avium subsp. paratuberculosis
cgcccccgcggcggccaucu

SEQ ID NO: 992776 - RNA, 14 nt, Mycobacterium avium subsp. paratuberculosis
cgcccccgcggcgu

SEQ ID NO: 992777 - RNA, 12 nt, Mycobacterium avium subsp. paratuberculosis
cgcccccgccca

SEQ ID NO: 992778 - RNA, 21 nt, Mycobacterium avium subsp. paratuberculosis
cgccccagugcaggcaggccc

SEQ ID NO: 992779 - RNA, 18 nt, Mycobacterium avium subsp. paratuberculosis
cgccccauugccgcgccg

SEQ ID NO: 992780 - RNA, 12 nt, Mycobacterium avium subsp. paratuberculosis
cgccccggcggg

SEQ ID NO: 992781 - RNA, 18 nt, Mycobacterium avium subsp. paratuberculosis
cgccccggucaccccggc

SEQ ID NO: 992782 - RNA, 17 nt, Mycobacterium avium subsp. paratuberculosis
cgccccggucccgccgg

SEQ ID NO: 992783 - RNA, 23 nt, Mycobacterium avium subsp. paratuberculosis
cgccccggcgcagcgccgcgccg

SEQ ID NO: 992784 - RNA, 17 nt, Mycobacterium avium subsp. paratuberculosis
cgccccggcggccacgc

SEQ ID NO: 992785 - RNA, 15 nt, Mycobacterium avium subsp. paratuberculosis
cgcccccgcuggccc

SEQ ID NO: 992786 - RNA, 22 nt, Mycobacterium avium subsp. paratuberculosis
cgccccggcgacgucgccggcc

SEQ ID NO: 992787 - RNA, 21 nt, Mycobacterium avium subsp. paratuberculosis
cgcccgcggccuccagccgcu

SEQ ID NO: 992788 - RNA, 12 nt, Mycobacterium avium subsp. paratuberculosis
cgcccgcggcgc

SEQ ID NO: 992789 - RNA, 14 nt, Mycobacterium avium subsp. paratuberculosis
cgcccgcgcggcgg

SEQ ID NO: 992790 - RNA, 15 nt, Mycobacterium avium subsp. paratuberculosis
cgcccgcgcggcggc

SEQ ID NO: 992791 - RNA, 12 nt, Mycobacterium avium subsp. paratuberculosis
cgcccgcggcca

SEQ ID NO: 992792 - RNA, 21 nt, Mycobacterium avium subsp. paratuberculosis
cgcccagcugcacccaccggc

SEQ ID NO: 992793 - RNA, 19 nt, Mycobacterium avium subsp. paratuberculosis
cgcccaggaacuggucgaa

SEQ ID NO: 992794 - RNA, 15 nt, Mycobacterium avium subsp. paratuberculosis
cgcccaggccccggc

SEQ ID NO: 992795 - RNA, 15 nt, Mycobacterium avium subsp. paratuberculosis
cgcccaggccgagcg

SEQ ID NO: 992796 - RNA, 18 nt, Mycobacterium avium subsp. paratuberculosis
cgcccagcggcuugagcc

SEQ ID NO: 992797 - RNA, 22 nt, Mycobacterium avium subsp. paratuberculosis
cgcccagcgucucggcggccga

SEQ ID NO: 992798 - RNA, 13 nt, Mycobacterium avium subsp. paratuberculosis
cgcccagcgcggc

SEQ ID NO: 992799 - RNA, 15 nt, Mycobacterium avium subsp. paratuberculosis
cgcccagcgccgcgu

SEQ ID NO: 992800 - RNA, 22 nt, Mycobacterium avium subsp. paratuberculosis
cgcccagcgccgcguaggucuu

SEQ ID NO: 992801 - RNA, 20 nt, Mycobacterium avium subsp. paratuberculosis
cgcccagcgcauccaccagg

SEQ ID NO: 992802 - RNA, 12 nt, Mycobacterium avium subsp. paratuberculosis
cgcccagcgccg

SEQ ID NO: 992803 - RNA, 21 nt, Mycobacterium avium subsp. paratuberculosis
cgcccagaugccgccgccagc

SEQ ID NO: 992804 - RNA, 17 nt, Mycobacterium avium subsp. paratuberculosis
cgcccagaugccggcgu

SEQ ID NO: 992805 - RNA, 23 nt, Mycobacterium avium subsp. paratuberculosis
cgcccagcacccgguuccaccgg

SEQ ID NO: 992806 - RNA, 12 nt, Mycobacterium avium subsp. paratuberculosis
cgcccagcaccg

SEQ ID NO: 992807 - RNA, 22 nt, Mycobacterium avium subsp. paratuberculosis
cgcccagaucgacgccgaccgc

SEQ ID NO: 992808 - RNA, 14 nt, Mycobacterium avium subsp. paratuberculosis
cgcccaucggcagc

SEQ ID NO: 992809 - RNA, 15 nt, Mycobacterium avium subsp. paratuberculosis
cgcccaucggcagcc

SEQ ID NO: 992810 - RNA, 21 nt, Mycobacterium avium subsp. paratuberculosis
cgcccauccggcgccgcgcaa

SEQ ID NO: 992811 - RNA, 22 nt, Mycobacterium avium subsp. paratuberculosis
cgcccaucagcaggaccaggcc

SEQ ID NO: 992812 - RNA, 22 nt, Mycobacterium avium subsp. paratuberculosis
cgccccagacguuuccguccgg

SEQ ID NO: 992813 - RNA, 12 nt, Mycobacterium avium subsp. paratuberculosis
cgccccagcccc

SEQ ID NO: 992814 - RNA, 14 nt, Mycobacterium avium subsp. paratuberculosis
cgccccagcccggc

SEQ ID NO: 992815 - RNA, 16 nt, Mycobacterium avium subsp. paratuberculosis
cgcccuugcucgcggc

SEQ ID NO: 992816 - RNA, 19 nt, Mycobacterium avium subsp. paratuberculosis
cgcccuuggcgcccagcgu

SEQ ID NO: 992817 - RNA, 17 nt, Mycobacterium avium subsp. paratuberculosis
cgccgaaagccuccgcg

SEQ ID NO: 992818 - RNA, 22 nt, Mycobacterium avium subsp. paratuberculosis
cgccgaaccgaucaccggcagc

SEQ ID NO: 992819 - RNA, 19 nt, Mycobacterium avium subsp. paratuberculosis
cgccgaaccgggcgcgcag

SEQ ID NO: 992820 - RNA, 19 nt, Mycobacterium avium subsp. paratuberculosis
cgccgaaccggggccgcac

SEQ ID NO: 992821 - RNA, 13 nt, Mycobacterium avium subsp. paratuberculosis
cgccgaacccgcc

SEQ ID NO: 992822 - RNA, 15 nt, Mycobacterium avium subsp. paratuberculosis
cgccgaacccgcccu

SEQ ID NO: 992823 - RNA, 20 nt, Mycobacterium avium subsp. paratuberculosis
cgccgaacagaugccugccc

SEQ ID NO: 992824 - RNA, 18 nt, Mycobacterium avium subsp. paratuberculosis
cgccgaacaccggcagcg

SEQ ID NO: 992825 - RNA, 19 nt, Mycobacterium avium subsp. paratuberculosis
cgccgacaccagcgcgcac

SEQ ID NO: 992826 - RNA, 18 nt, Mycobacterium avium subsp. paratuberculosis
cgccgaacgcaccaccgc

SEQ ID NO: 992827 - RNA, 22 nt, Mycobacterium avium subsp. paratuberculosis
cgccgacagaugcggcaccagc

SEQ ID NO: 992828 - RNA, 14 nt, Mycobacterium avium subsp. paratuberculosis
cgccgacagcagcu

SEQ ID NO: 992829 - RNA, 15 nt, Mycobacterium avium subsp. paratuberculosis
cgccgacagcagcuc

SEQ ID NO: 992830 - RNA, 15 nt, Mycobacterium avium subsp. paratuberculosis
cgcccugcagccggg

SEQ ID NO: 992831 - RNA, 22 nt, Mycobacterium avium subsp. paratuberculosis
cgcccuugagcuucccggcggu

SEQ ID NO: 992832 - RNA, 15 nt, Mycobacterium avium subsp. paratuberculosis
cgcccuucggcgccc

SEQ ID NO: 992833 - RNA, 18 nt, Mycobacterium avium subsp. paratuberculosis
cgcccuucggcgcccgcu

SEQ ID NO: 992834 - RNA, 23 nt, Mycobacterium avium subsp. paratuberculosis
cgcccuugaacggcaccagcgga

SEQ ID NO: 992835 - RNA, 23 nt, Mycobacterium avium subsp. paratuberculosis
cgcccguucgagcgccggacgcu

SEQ ID NO: 992836 - RNA, 20 nt, Mycobacterium avium subsp. paratuberculosis
cgcccugacacagcaccggc

SEQ ID NO: 992837 - RNA, 21 nt, Mycobacterium avium subsp. paratuberculosis
cgcccugacacagcaccggcg

SEQ ID NO: 992838 - RNA, 19 nt, Mycobacterium avium subsp. paratuberculosis
cgcccgucucggcgugcuc

SEQ ID NO: 992839 - RNA, 14 nt, Mycobacterium avium subsp. paratuberculosis
cgcccgucagcccc

SEQ ID NO: 992840 - RNA, 14 nt, Mycobacterium avium subsp. paratuberculosis
cgcccgucgcgcaa

SEQ ID NO: 992841 - RNA, 14 nt, Mycobacterium avium subsp. paratuberculosis
cgcccguagccgcg

SEQ ID NO: 992842 - RNA, 20 nt, Mycobacterium avium subsp. paratuberculosis
cgcccguagcggugggcgcg

SEQ ID NO: 992843 - RNA, 11 nt, Mycobacterium avium subsp. paratuberculosis
cgcccggcggc

SEQ ID NO: 992844 - RNA, 14 nt, Mycobacterium avium subsp. paratuberculosis
cgcccggcggcgcu

SEQ ID NO: 992845 - RNA, 15 nt, Mycobacterium avium subsp. paratuberculosis
cgcccggcgccggcc

SEQ ID NO: 992846 - RNA, 17 nt, Mycobacterium avium subsp. paratuberculosis
cgcccggcgccggccga

SEQ ID NO: 992847 - RNA, 14 nt, Mycobacterium avium subsp. paratuberculosis
cgcccggcgcgcca

SEQ ID NO: 992848 - RNA, 18 nt, Mycobacterium avium subsp. paratuberculosis
cgcccggcgauacccggg

SEQ ID NO: 992849 - RNA, 18 nt, Mycobacterium avium subsp. paratuberculosis
cgcccggcgaccaccagc

SEQ ID NO: 992850 - RNA, 21 nt, Mycobacterium avium subsp. paratuberculosis
cgcccggccggucgccgaugg

SEQ ID NO: 992851 - RNA, 15 nt, Mycobacterium avium subsp. paratuberculosis
cgcccggccaucugc

SEQ ID NO: 992852 - RNA, 23 nt, Mycobacterium avium subsp. paratuberculosis
cgcccggccaucugcgcgacgaa

SEQ ID NO: 992853 - RNA, 21 nt, Mycobacterium avium subsp. paratuberculosis
cgcccggcccaagacccgcgu

SEQ ID NO: 992854 - RNA, 14 nt, Mycobacterium avium subsp. paratuberculosis
cgcccggcccagcc

SEQ ID NO: 992855 - RNA, 17 nt, Mycobacterium avium subsp. paratuberculosis
cgcccggcccagccgcu

SEQ ID NO: 992856 - RNA, 14 nt, Mycobacterium avium subsp. paratuberculosis
cgcccggcccgcau

SEQ ID NO: 992857 - RNA, 16 nt, Mycobacterium avium subsp. paratuberculosis
cgcccggcccggcgcg

SEQ ID NO: 992858 - RNA, 22 nt, Mycobacterium avium subsp. paratuberculosis
cgcccggcccggcgcggccggu

SEQ ID NO: 992859 - RNA, 13 nt, Mycobacterium avium subsp. paratuberculosis
cgcccggccaccu

SEQ ID NO: 992860 - RNA, 19 nt, Mycobacterium avium subsp. paratuberculosis
cgcccggccagccggccgc

SEQ ID NO: 992861 - RNA, 20 nt, Mycobacterium avium subsp. paratuberculosis
cgcccgcuccugcaggccga

SEQ ID NO: 992862 - RNA, 17 nt, Mycobacterium avium subsp. paratuberculosis
cgcccgcucgacggccg

SEQ ID NO: 992863 - RNA, 19 nt, Mycobacterium avium subsp. paratuberculosis
cgcccgcucgaggggcuug

SEQ ID NO: 992864 - RNA, 16 nt, Mycobacterium avium subsp. paratuberculosis
cgcccgcgggugcagc

SEQ ID NO: 992865 - RNA, 21 nt, Mycobacterium avium subsp. paratuberculosis
cgcccgcggugugcuggccag

SEQ ID NO: 992866 - RNA, 20 nt, Mycobacterium avium subsp. paratuberculosis
cgcccgcgucguggcccugc

SEQ ID NO: 992867 - RNA, 20 nt, Mycobacterium avium subsp. paratuberculosis
cgcccgcguugcggcgcagc

SEQ ID NO: 992868 - RNA, 17 nt, Mycobacterium avium subsp. paratuberculosis
cgccgagaacaggccga

SEQ ID NO: 992869 - RNA, 16 nt, Mycobacterium avium subsp. paratuberculosis
cgccgagauccaccgc

SEQ ID NO: 992870 - RNA, 21 nt, Mycobacterium avium subsp. paratuberculosis
cgccgagauccaccgcgcggc

SEQ ID NO: 992871 - RNA, 20 nt, Mycobacterium avium subsp. paratuberculosis
cgccgaugacguugcgcgcc

SEQ ID NO: 992872 - RNA, 14 nt, Mycobacterium avium subsp. paratuberculosis
cgccgaugaucugg

SEQ ID NO: 992873 - RNA, 19 nt, Mycobacterium avium subsp. paratuberculosis
cgccgaugaugguggcggc

SEQ ID NO: 992874 - RNA, 15 nt, Mycobacterium avium subsp. paratuberculosis
cgccgaugcccgccc

SEQ ID NO: 992875 - RNA, 14 nt, Mycobacterium avium subsp. paratuberculosis
cgccgaugcgccgc

SEQ ID NO: 992876 - RNA, 15 nt, Mycobacterium avium subsp. paratuberculosis
cgccgaugcgccgca

SEQ ID NO: 992877 - RNA, 17 nt, Mycobacterium avium subsp. paratuberculosis
cgccgaucucgaccagc

SEQ ID NO: 992878 - RNA, 21 nt, Mycobacterium avium subsp. paratuberculosis
cgccgaucucggccaaccggg

SEQ ID NO: 992879 - RNA, 18 nt, Mycobacterium avium subsp. paratuberculosis
cgccgauccgcagccgcu

SEQ ID NO: 992880 - RNA, 20 nt, Mycobacterium avium subsp. paratuberculosis
cgccgauccgcugcggaucc

SEQ ID NO: 992881 - RNA, 17 nt, Mycobacterium avium subsp. paratuberculosis
cgccgacgucccagcac

SEQ ID NO: 992882 - RNA, 19 nt, Mycobacterium avium subsp. paratuberculosis
cgccgacgguggcccccac

SEQ ID NO: 992883 - RNA, 18 nt, Mycobacterium avium subsp. paratuberculosis
cgccgacgguguccgcgg

SEQ ID NO: 992884 - RNA, 23 nt, Mycobacterium avium subsp. paratuberculosis
cgccgacguaggacagcaccaca

SEQ ID NO: 992885 - RNA, 21 nt, Mycobacterium avium subsp. paratuberculosis
cgccgacuagcgcggcggccu

SEQ ID NO: 992886 - RNA, 14 nt, Mycobacterium avium subsp. paratuberculosis
cgccgacuccccgc

SEQ ID NO: 992887 - RNA, 15 nt, Mycobacterium avium subsp. paratuberculosis
cgccgacuccccgcc

SEQ ID NO: 992888 - RNA, 19 nt, Mycobacterium avium subsp. paratuberculosis
cgccgacuccccgcccggc

SEQ ID NO: 992889 - RNA, 21 nt, Mycobacterium avium subsp. paratuberculosis
cgccgacggcugcccggcccg

SEQ ID NO: 992890 - RNA, 15 nt, Mycobacterium avium subsp. paratuberculosis
cgccgacgggcccag

SEQ ID NO: 992891 - RNA, 18 nt, Mycobacterium avium subsp. paratuberculosis
cgccgacgggcccagcgc

SEQ ID NO: 992892 - RNA, 15 nt, Mycobacterium avium subsp. paratuberculosis
cgccgacgggcccgc

SEQ ID NO: 992893 - RNA, 17 nt, Mycobacterium avium subsp. paratuberculosis
cgccgacgggcccgcgc

SEQ ID NO: 992894 - RNA, 19 nt, Mycobacterium avium subsp. paratuberculosis
cgccgacgggcccgcgccu

SEQ ID NO: 992895 - RNA, 20 nt, Mycobacterium avium subsp. paratuberculosis
cgccgaccagcaggacgcgc

SEQ ID NO: 992896 - RNA, 20 nt, Mycobacterium avium subsp. paratuberculosis
cgccgaccagccgaggcgcu

SEQ ID NO: 992897 - RNA, 14 nt, Mycobacterium avium subsp. paratuberculosis
cgccgaccagcgcg

SEQ ID NO: 992898 - RNA, 12 nt, Mycobacterium avium subsp. paratuberculosis
cgccgacccgcc

SEQ ID NO: 992899 - RNA, 15 nt, Mycobacterium avium subsp. paratuberculosis
cgccgacccgcccgc

SEQ ID NO: 992900 - RNA, 19 nt, Mycobacterium avium subsp. paratuberculosis
cgccgaccaccuugcgcag

SEQ ID NO: 992901 - RNA, 18 nt, Mycobacterium avium subsp. paratuberculosis
cgccgauguggccggcga

SEQ ID NO: 992902 - RNA, 18 nt, Mycobacterium avium subsp. paratuberculosis
cgccgauguggcgggcgu

SEQ ID NO: 992903 - RNA, 18 nt, Mycobacterium avium subsp. paratuberculosis
cgccgauguccccgcggg

SEQ ID NO: 992904 - RNA, 17 nt, Mycobacterium avium subsp. paratuberculosis
cgccgaugucggccggu

SEQ ID NO: 992905 - RNA, 13 nt, Mycobacterium avium subsp. paratuberculosis
cgccgauggugac

SEQ ID NO: 992906 - RNA, 18 nt, Mycobacterium avium subsp. paratuberculosis
cgccgauggugacggugc

SEQ ID NO: 992907 - RNA, 18 nt, Mycobacterium avium subsp. paratuberculosis
cgccgauucaaccccgcg

SEQ ID NO: 992908 - RNA, 22 nt, Mycobacterium avium subsp. paratuberculosis
cgccgauucaaccccgcgcgcg

SEQ ID NO: 992909 - RNA, 15 nt, Mycobacterium avium subsp. paratuberculosis
cgccgauuccggccg

SEQ ID NO: 992910 - RNA, 21 nt, Mycobacterium avium subsp. paratuberculosis
cgccgauuccggccggccgcc

SEQ ID NO: 992911 - RNA, 18 nt, Mycobacterium avium subsp. paratuberculosis
cgccgcaacagccggccc

SEQ ID NO: 992912 - RNA, 20 nt, Mycobacterium avium subsp. paratuberculosis
cgccgcaacagccggcccga

SEQ ID NO: 992913 - RNA, 14 nt, Mycobacterium avium subsp. paratuberculosis
cgccgcacccagcg

SEQ ID NO: 992914 - RNA, 17 nt, Mycobacterium avium subsp. paratuberculosis
cgccgcacagccggcgg

SEQ ID NO: 992915 - RNA, 16 nt, Mycobacterium avium subsp. paratuberculosis
cgccgccacggccacc

SEQ ID NO: 992916 - RNA, 14 nt, Mycobacterium avium subsp. paratuberculosis
cgccgccacgcggc

SEQ ID NO: 992917 - RNA, 18 nt, Mycobacterium avium subsp. paratuberculosis
cgccgccaccgucgccgg

SEQ ID NO: 992918 - RNA, 22 nt, Mycobacterium avium subsp. paratuberculosis
cgccgccaccgucgccggcuga

SEQ ID NO: 992919 - RNA, 12 nt, Mycobacterium avium subsp. paratuberculosis
cgccgccagcac

SEQ ID NO: 992920 - RNA, 14 nt, Mycobacterium avium subsp. paratuberculosis
cgccgccagcacca

SEQ ID NO: 992921 - RNA, 17 nt, Mycobacterium avium subsp. paratuberculosis
cgccgccagcaccaccg

SEQ ID NO: 992922 - RNA, 23 nt, Mycobacterium avium subsp. paratuberculosis
cgccgccagcgcggggucggcca

SEQ ID NO: 992923 - RNA, 14 nt, Mycobacterium avium subsp. paratuberculosis
cgccgccagcgcca

SEQ ID NO: 992924 - RNA, 18 nt, Mycobacterium avium subsp. paratuberculosis
cgccgccagcgccacccc

SEQ ID NO: 992925 - RNA, 21 nt, Mycobacterium avium subsp. paratuberculosis
cgccgcccggagguucgccgg

SEQ ID NO: 992926 - RNA, 15 nt, Mycobacterium avium subsp. paratuberculosis
cgccgcccgggccgc

SEQ ID NO: 992927 - RNA, 20 nt, Mycobacterium avium subsp. paratuberculosis
cgccgcccgggccgcgccca

SEQ ID NO: 992928 - RNA, 19 nt, Mycobacterium avium subsp. paratuberculosis
cgccgcccgggcggcccgg

SEQ ID NO: 992929 - RNA, 15 nt, Mycobacterium avium subsp. paratuberculosis
cgccgcccguccagc

SEQ ID NO: 992930 - RNA, 21 nt, Mycobacterium avium subsp. paratuberculosis
cgcgagcugcuucgucgccgg

SEQ ID NO: 992931 - RNA, 15 nt, Mycobacterium avium subsp. paratuberculosis
cgcgaggcgcaguag

SEQ ID NO: 992932 - RNA, 19 nt, Mycobacterium avium subsp. paratuberculosis
cgcgaggcgcggggcgcga

SEQ ID NO: 992933 - RNA, 18 nt, Mycobacterium avium subsp. paratuberculosis
cgcgagggccguugcggc

SEQ ID NO: 992934 - RNA, 15 nt, Mycobacterium avium subsp. paratuberculosis
cgcgagggcgggcca

SEQ ID NO: 992935 - RNA, 18 nt, Mycobacterium avium subsp. paratuberculosis
cgcgcaaugccgccgcga

SEQ ID NO: 992936 - RNA, 18 nt, Mycobacterium avium subsp. paratuberculosis
cgcgcacacggccucgcc

SEQ ID NO: 992937 - RNA, 21 nt, Mycobacterium avium subsp. paratuberculosis
cgcgcaccacgguggcgccgc

SEQ ID NO: 992938 - RNA, 13 nt, Mycobacterium avium subsp. paratuberculosis
cgcgcacccagcc

SEQ ID NO: 992939 - RNA, 17 nt, Mycobacterium avium subsp. paratuberculosis
cgcgcaccaggccgacg

SEQ ID NO: 992940 - RNA, 20 nt, Mycobacterium avium subsp. paratuberculosis
cgcgcagcaauugacgccga

SEQ ID NO: 992941 - RNA, 12 nt, Mycobacterium avium subsp. paratuberculosis
cgcgcagcagcg

SEQ ID NO: 992942 - RNA, 14 nt, Mycobacterium avium subsp. paratuberculosis
cgcgcagaucgcca

SEQ ID NO: 992943 - RNA, 19 nt, Mycobacterium avium subsp. paratuberculosis
cgcgcagaucgccagcacc

SEQ ID NO: 992944 - RNA, 20 nt, Mycobacterium avium subsp. paratuberculosis
cgcgcagccagucgccggcc

SEQ ID NO: 992945 - RNA, 14 nt, Mycobacterium avium subsp. paratuberculosis
cgcgcagccgccgg

SEQ ID NO: 992946 - RNA, 16 nt, Mycobacterium avium subsp. paratuberculosis
cgcgcagccgccgggc

SEQ ID NO: 992947 - RNA, 14 nt, Mycobacterium avium subsp. paratuberculosis
cgcgcagcaccgcg

SEQ ID NO: 992948 - RNA, 15 nt, Mycobacterium avium subsp. paratuberculosis
cgcgcagccacgagc

SEQ ID NO: 992949 - RNA, 19 nt, Mycobacterium avium subsp. paratuberculosis
cgcgcagccacgagcccag

SEQ ID NO: 992950 - RNA, 11 nt, Mycobacterium avium subsp. paratuberculosis
cgcgccaccgc

SEQ ID NO: 992951 - RNA, 16 nt, Mycobacterium avium subsp. paratuberculosis
cgcgccacgccccggc

SEQ ID NO: 992952 - RNA, 16 nt, Mycobacterium avium subsp. paratuberculosis
cgcgccacgccgcccc

SEQ ID NO: 992953 - RNA, 15 nt, Mycobacterium avium subsp. paratuberculosis
cgcgccacgcgcagg

SEQ ID NO: 992954 - RNA, 17 nt, Mycobacterium avium subsp. paratuberculosis
cgcgccacgcgcagggc

SEQ ID NO: 992955 - RNA, 21 nt, Mycobacterium avium subsp. paratuberculosis
cgcgccacgacguacccccgc

SEQ ID NO: 992956 - RNA, 22 nt, Mycobacterium avium subsp. paratuberculosis
cgcgcagcucgcgcagccggcc

SEQ ID NO: 992957 - RNA, 13 nt, Mycobacterium avium subsp. paratuberculosis
cgcgcagcggggc

SEQ ID NO: 992958 - RNA, 18 nt, Mycobacterium avium subsp. paratuberculosis
cgcgcagccggccgaccg

SEQ ID NO: 992959 - RNA, 19 nt, Mycobacterium avium subsp. paratuberculosis
cgcgcagccgggcggcgcu

SEQ ID NO: 992960 - RNA, 15 nt, Mycobacterium avium subsp. paratuberculosis
cgcgcagcgcuucca

SEQ ID NO: 992961 - RNA, 19 nt, Mycobacterium avium subsp. paratuberculosis
cgcgcaucgcgggccaccg

SEQ ID NO: 992962 - RNA, 13 nt, Mycobacterium avium subsp. paratuberculosis
cgcgcaucgguca

SEQ ID NO: 992963 - RNA, 20 nt, Mycobacterium avium subsp. paratuberculosis
cgcgcaucggucagcaacag

SEQ ID NO: 992964 - RNA, 19 nt, Mycobacterium avium subsp. paratuberculosis
cgcgcaucgucgcggcgcu

SEQ ID NO: 992965 - RNA, 14 nt, Mycobacterium avium subsp. paratuberculosis
cgcgcaucuugauc

SEQ ID NO: 992966 - RNA, 22 nt, Mycobacterium avium subsp. paratuberculosis
cgcgcaucucgaaugcggcugc

SEQ ID NO: 992967 - RNA, 18 nt, Mycobacterium avium subsp. paratuberculosis
cgcgcaucugcucggcgu

SEQ ID NO: 992968 - RNA, 14 nt, Mycobacterium avium subsp. paratuberculosis
cgcgcaucacccgg

SEQ ID NO: 992969 - RNA, 15 nt, Mycobacterium avium subsp. paratuberculosis
cgcgcaucacccggc

SEQ ID NO: 992970 - RNA, 20 nt, Mycobacterium avium subsp. paratuberculosis
cgcgcaucacccggcgcgcg

SEQ ID NO: 992971 - RNA, 16 nt, Mycobacterium avium subsp. paratuberculosis
cgcgcauccgcaccga

SEQ ID NO: 992972 - RNA, 22 nt, Mycobacterium avium subsp. paratuberculosis
cgcgcggaugcccaggccggcg

SEQ ID NO: 992973 - RNA, 13 nt, Mycobacterium avium subsp. paratuberculosis
cgcgcggccacca

SEQ ID NO: 992974 - RNA, 17 nt, Mycobacterium avium subsp. paratuberculosis
cgcgcggccaccagcgc

SEQ ID NO: 992975 - RNA, 19 nt, Mycobacterium avium subsp. paratuberculosis
cgcgcggccaccgcgcgcu

SEQ ID NO: 992976 - RNA, 22 nt, Mycobacterium avium subsp. paratuberculosis
cgcgcggauuucucagcggcgc

SEQ ID NO: 992977 - RNA, 22 nt, Mycobacterium avium subsp. paratuberculosis
cgcgcggcgaguucugguaggc

SEQ ID NO: 992978 - RNA, 13 nt, Mycobacterium avium subsp. paratuberculosis
cgcgcggccgcca

SEQ ID NO: 992979 - RNA, 13 nt, Mycobacterium avium subsp. paratuberculosis
cgcgcggccggcc

SEQ ID NO: 992980 - RNA, 14 nt, Mycobacterium avium subsp. paratuberculosis
cgcgcgcaucucga

SEQ ID NO: 992981 - RNA, 21 nt, Mycobacterium avium subsp. paratuberculosis
cgcgcgcaggcacucgcgcag

SEQ ID NO: 992982 - RNA, 19 nt, Mycobacterium avium subsp. paratuberculosis
cgcgcgauggacagcagcc

SEQ ID NO: 992983 - RNA, 14 nt, Mycobacterium avium subsp. paratuberculosis
cgcgcgaucgccgg

SEQ ID NO: 992984 - RNA, 23 nt, Mycobacterium avium subsp. paratuberculosis
cgcgcgaucgccggugcggccgc

SEQ ID NO: 992985 - RNA, 17 nt, Mycobacterium avium subsp. paratuberculosis
cgcgcgaugcgggcgcc

SEQ ID NO: 992986 - RNA, 21 nt, Mycobacterium avium subsp. paratuberculosis
cgcgcgaugcgggcgccgaac

SEQ ID NO: 992987 - RNA, 20 nt, Mycobacterium avium subsp. paratuberculosis
cgcgccgggcagcccgccgc

SEQ ID NO: 992988 - RNA, 22 nt, Mycobacterium avium subsp. paratuberculosis
cgcgccgggcagcccgccgcgg

SEQ ID NO: 992989 - RNA, 13 nt, Mycobacterium avium subsp. paratuberculosis
cgcgccggggucc

SEQ ID NO: 992990 - RNA, 17 nt, Mycobacterium avium subsp. paratuberculosis
cgcgccgggguccucuc

SEQ ID NO: 992991 - RNA, 14 nt, Mycobacterium avium subsp. paratuberculosis
cgcgccuggcgcag

SEQ ID NO: 992992 - RNA, 22 nt, Mycobacterium avium subsp. paratuberculosis
cgcgccuucgacccgguggccc

SEQ ID NO: 992993 - RNA, 23 nt, Mycobacterium avium subsp. paratuberculosis
cgcgccuucuugcugcccgcggc

SEQ ID NO: 992994 - RNA, 19 nt, Mycobacterium avium subsp. paratuberculosis
cgcgccgaucgcccagugc

SEQ ID NO: 992995 - RNA, 22 nt, Mycobacterium avium subsp. paratuberculosis
cgcgccgaucugaccgagcagc

SEQ ID NO: 992996 - RNA, 19 nt, Mycobacterium avium subsp. paratuberculosis
cgcgccgaugccgcgcugc

SEQ ID NO: 992997 - RNA, 13 nt, Mycobacterium avium subsp. paratuberculosis
cgcgccgaggaac

SEQ ID NO: 992998 - RNA, 16 nt, Mycobacterium avium subsp. paratuberculosis
cgcgccgaggaacugc

SEQ ID NO: 992999 - RNA, 13 nt, Mycobacterium avium subsp. paratuberculosis
cgcgccgaggcgc

SEQ ID NO: 993000 - RNA, 22 nt, Mycobacterium avium subsp. paratuberculosis
cgcgccgaggcgcucggcccgc

SEQ ID NO: 993001 - RNA, 21 nt, Mycobacterium avium subsp. paratuberculosis
cgcgccgagguggcccgccac

SEQ ID NO: 993002 - RNA, 20 nt, Mycobacterium avium subsp. paratuberculosis
cgcgccgagguggccgccag

SEQ ID NO: 993003 - RNA, 21 nt, Mycobacterium avium subsp. paratuberculosis
cgcgccgagguggccgccagc

SEQ ID NO: 993004 - RNA, 18 nt, Mycobacterium avium subsp. paratuberculosis
cgcgccgccaccccaggc

SEQ ID NO: 993005 - RNA, 18 nt, Mycobacterium avium subsp. paratuberculosis
cgcgccgccacgcggcgc

SEQ ID NO: 993006 - RNA, 15 nt, Mycobacterium avium subsp. paratuberculosis
cgcgccggccagcag

SEQ ID NO: 993007 - RNA, 16 nt, Mycobacterium avium subsp. paratuberculosis
cgcgccggccagccgg

SEQ ID NO: 993008 - RNA, 12 nt, Mycobacterium avium subsp. paratuberculosis
cgcgccgggcgu

SEQ ID NO: 993009 - RNA, 22 nt, Mycobacterium avium subsp. paratuberculosis
cgcgccgggcguugcccgccgc

SEQ ID NO: 993010 - RNA, 19 nt, Mycobacterium avium subsp. paratuberculosis
cgcgccgggcggccucggc

SEQ ID NO: 993011 - RNA, 21 nt, Mycobacterium avium subsp. paratuberculosis
cgcgccgggcgaagucgccgg

SEQ ID NO: 993012 - RNA, 23 nt, Mycobacterium avium subsp. paratuberculosis
cgcgccgggcgaagucgccggcc

SEQ ID NO: 993013 - RNA, 15 nt, Mycobacterium avium subsp. paratuberculosis
cgcgccggcggccgc

SEQ ID NO: 993014 - RNA, 20 nt, Mycobacterium avium subsp. paratuberculosis
cgcgccggcggccgccgccc

SEQ ID NO: 993015 - RNA, 20 nt, Mycobacterium avium subsp. paratuberculosis
cgcgccgggcaacagcgcgc

SEQ ID NO: 993016 - RNA, 17 nt, Mycobacterium avium subsp. paratuberculosis
cgcgccgggcaccacca

SEQ ID NO: 993017 - RNA, 12 nt, Mycobacterium avium subsp. paratuberculosis
cgcgccggccgg

SEQ ID NO: 993018 - RNA, 15 nt, Mycobacterium avium subsp. paratuberculosis
cgcgccggcgcagcg

SEQ ID NO: 993019 - RNA, 19 nt, Mycobacterium avium subsp. paratuberculosis
cgcgccggcgcagcggccc

SEQ ID NO: 993020 - RNA, 15 nt, Mycobacterium avium subsp. paratuberculosis
cgcgccggcgcgggc

SEQ ID NO: 993021 - RNA, 23 nt, Mycobacterium avium subsp. paratuberculosis
cgcgccggcgauaggcggccagc

SEQ ID NO: 993022 - RNA, 15 nt, Mycobacterium avium subsp. paratuberculosis
cgcgccggccgccgc

SEQ ID NO: 993023 - RNA, 16 nt, Mycobacterium avium subsp. paratuberculosis
cgcgccgaacaccacg

SEQ ID NO: 993024 - RNA, 22 nt, Mycobacterium avium subsp. paratuberculosis
cgcgccgaacaccugcggcggc

SEQ ID NO: 993025 - RNA, 15 nt, Mycobacterium avium subsp. paratuberculosis
cgcgccgacccgccc

SEQ ID NO: 993026 - RNA, 19 nt, Mycobacterium avium subsp. paratuberculosis
cgcgccgaccacggcccca

SEQ ID NO: 993027 - RNA, 19 nt, Mycobacterium avium subsp. paratuberculosis
cgcgccgacgcccacagcg

SEQ ID NO: 993028 - RNA, 14 nt, Mycobacterium avium subsp. paratuberculosis
cgcgccgagagcgc

SEQ ID NO: 993029 - RNA, 13 nt, Mycobacterium avium subsp. paratuberculosis
cgcgccgagcagc

SEQ ID NO: 993030 - RNA, 17 nt, Mycobacterium avium subsp. paratuberculosis
cgcggcgcagcucgcgc

SEQ ID NO: 993031 - RNA, 17 nt, Mycobacterium avium subsp. paratuberculosis
cgcggccgcgacugcag

SEQ ID NO: 993032 - RNA, 19 nt, Mycobacterium avium subsp. paratuberculosis
cgcggcgcacccgggcagc

SEQ ID NO: 993033 - RNA, 18 nt, Mycobacterium avium subsp. paratuberculosis
cgcggcgcaccgcccgcg

SEQ ID NO: 993034 - RNA, 24 nt, Mycobacterium avium subsp. paratuberculosis
cgcggcgccggaugggcgcacgau

SEQ ID NO: 993035 - RNA, 15 nt, Mycobacterium avium subsp. paratuberculosis
cgcggcgcccagggg

SEQ ID NO: 993036 - RNA, 14 nt, Mycobacterium avium subsp. paratuberculosis
cgcggcgcccggcg

SEQ ID NO: 993037 - RNA, 15 nt, Mycobacterium avium subsp. paratuberculosis
cgcggcggaggccug

SEQ ID NO: 993038 - RNA, 16 nt, Mycobacterium avium subsp. paratuberculosis
cgcggcggaggccugc

SEQ ID NO: 993039 - RNA, 21 nt, Mycobacterium avium subsp. paratuberculosis
cgcggcggaggucagcggccc

SEQ ID NO: 993040 - RNA, 21 nt, Mycobacterium avium subsp. paratuberculosis
cgcggcgcuaaagccaccagc

SEQ ID NO: 993041 - RNA, 16 nt, Mycobacterium avium subsp. paratuberculosis
cgcggcgccgggcggc

SEQ ID NO: 993042 - RNA, 13 nt, Mycobacterium avium subsp. paratuberculosis
cgcgggcagccgg

SEQ ID NO: 993043 - RNA, 19 nt, Mycobacterium avium subsp. paratuberculosis
cgcgggcagcgagcacagc

SEQ ID NO: 993044 - RNA, 22 nt, Mycobacterium avium subsp. paratuberculosis
cgcgggcaucgccgucauggug

SEQ ID NO: 993045 - RNA, 20 nt, Mycobacterium avium subsp. paratuberculosis
cgcgggccacagcggcgaca

SEQ ID NO: 993046 - RNA, 18 nt, Mycobacterium avium subsp. paratuberculosis
cgcggcucgcgacgcggc

SEQ ID NO: 993047 - RNA, 15 nt, Mycobacterium avium subsp. paratuberculosis
cgcggcucgcgcggu

SEQ ID NO: 993048 - RNA, 15 nt, Mycobacterium avium subsp. paratuberculosis
cgcggcuccagcagc

SEQ ID NO: 993049 - RNA, 16 nt, Mycobacterium avium subsp. paratuberculosis
cgcggcuccagcagcg

SEQ ID NO: 993050 - RNA, 16 nt, Mycobacterium avium subsp. paratuberculosis
cgcggcuccggccgcg

SEQ ID NO: 993051 - RNA, 22 nt, Mycobacterium avium subsp. paratuberculosis
cgcggcuccggccgcgccggcc

SEQ ID NO: 993052 - RNA, 19 nt, Mycobacterium avium subsp. paratuberculosis
cgcggcguucuccagcacc

SEQ ID NO: 993053 - RNA, 20 nt, Mycobacterium avium subsp. paratuberculosis
cgcggcguucuccagcaccc

SEQ ID NO: 993054 - RNA, 16 nt, Mycobacterium avium subsp. paratuberculosis
cgcggcguugcccgcu

SEQ ID NO: 993055 - RNA, 22 nt, Mycobacterium avium subsp. paratuberculosis
cgcggcguugcccgcugcggca

SEQ ID NO: 993056 - RNA, 16 nt, Mycobacterium avium subsp. paratuberculosis
cgcggcguugcccggg

SEQ ID NO: 993057 - RNA, 20 nt, Mycobacterium avium subsp. paratuberculosis
cgcggcguugccgccggcgc

SEQ ID NO: 993058 - RNA, 20 nt, Mycobacterium avium subsp. paratuberculosis
cgcggcgucaggggugccag

SEQ ID NO: 993059 - RNA, 16 nt, Mycobacterium avium subsp. paratuberculosis
cgcggcgucauccccc

SEQ ID NO: 993060 - RNA, 16 nt, Mycobacterium avium subsp. paratuberculosis
cgcggcguccaccagc

SEQ ID NO: 993061 - RNA, 20 nt, Mycobacterium avium subsp. paratuberculosis
cgcggcgucggccgggcugc

SEQ ID NO: 993062 - RNA, 14 nt, Mycobacterium avium subsp. paratuberculosis
cgcggcgugcgcca

SEQ ID NO: 993063 - RNA, 16 nt, Mycobacterium avium subsp. paratuberculosis
cgcggcggccaaucgc

SEQ ID NO: 993064 - RNA, 14 nt, Mycobacterium avium subsp. paratuberculosis
cgcggcggccaccg

SEQ ID NO: 993065 - RNA, 15 nt, Mycobacterium avium subsp. paratuberculosis
cgcggcggccaccgc

SEQ ID NO: 993066 - RNA, 17 nt, Mycobacterium avium subsp. paratuberculosis
cgcggcggcagcagccc

SEQ ID NO: 993067 - RNA, 19 nt, Mycobacterium avium subsp. paratuberculosis
cgcggcggcaaccagcucc

SEQ ID NO: 993068 - RNA, 13 nt, Mycobacterium avium subsp. paratuberculosis
cgcggcggcaagu

SEQ ID NO: 993069 - RNA, 18 nt, Mycobacterium avium subsp. paratuberculosis
cgcggcgaucagcagcac

SEQ ID NO: 993070 - RNA, 17 nt, Mycobacterium avium subsp. paratuberculosis
cgcggcgaucagcccgg

SEQ ID NO: 993071 - RNA, 23 nt, Mycobacterium avium subsp. paratuberculosis
cgcggcgaucagcccggcccgca

SEQ ID NO: 993072 - RNA, 20 nt, Mycobacterium avium subsp. paratuberculosis
cgcggcgaucgggucaccgg

SEQ ID NO: 993073 - RNA, 13 nt, Mycobacterium avium subsp. paratuberculosis
cgcggcgagcgcu

SEQ ID NO: 993074 - RNA, 15 nt, Mycobacterium avium subsp. paratuberculosis
cgcggcgagcagcgc

SEQ ID NO: 993075 - RNA, 23 nt, Mycobacterium avium subsp. paratuberculosis
cgcggcgacgucgugcacgccgu

SEQ ID NO: 993076 - RNA, 16 nt, Mycobacterium avium subsp. paratuberculosis
cgcggccggccacgcu

SEQ ID NO: 993077 - RNA, 15 nt, Mycobacterium avium subsp. paratuberculosis
cgcggcgaccaccac

SEQ ID NO: 993078 - RNA, 13 nt, Mycobacterium avium subsp. paratuberculosis
cgcggcgacccgc

SEQ ID NO: 993079 - RNA, 20 nt, Mycobacterium avium subsp. paratuberculosis
cgcggcgacccgcuucgccc

SEQ ID NO: 993080 - RNA, 15 nt, Mycobacterium avium subsp. paratuberculosis
cgcggccgcgcgccc

SEQ ID NO: 993081 - RNA, 18 nt, Mycobacterium avium subsp. paratuberculosis
cgcggccgccucccgcag

SEQ ID NO: 993082 - RNA, 15 nt, Mycobacterium avium subsp. paratuberculosis
cgcggccgccgccgc

SEQ ID NO: 993083 - RNA, 21 nt, Mycobacterium avium subsp. paratuberculosis
cgcggccgccgcgacggccgc

SEQ ID NO: 993084 - RNA, 16 nt, Mycobacterium avium subsp. paratuberculosis
cgcggccgccggggcc

SEQ ID NO: 993085 - RNA, 13 nt, Mycobacterium avium subsp. paratuberculosis
cgcggcccauggg

SEQ ID NO: 993086 - RNA, 17 nt, Mycobacterium avium subsp. paratuberculosis
cgcggcccuggauguca

SEQ ID NO: 993087 - RNA, 18 nt, Mycobacterium avium subsp. paratuberculosis
cgcggccgcccagcccgc

SEQ ID NO: 993088 - RNA, 21 nt, Mycobacterium avium subsp. paratuberculosis
cgcggccgcccgucggggccc

SEQ ID NO: 993089 - RNA, 14 nt, Mycobacterium avium subsp. paratuberculosis
cgcggccgccgccg

SEQ ID NO: 993090 - RNA, 14 nt, Mycobacterium avium subsp. paratuberculosis
cgcggccgaaccgc

SEQ ID NO: 993091 - RNA, 21 nt, Mycobacterium avium subsp. paratuberculosis
cgcggcccguugagcaccgcg

SEQ ID NO: 993092 - RNA, 18 nt, Mycobacterium avium subsp. paratuberculosis
cgcggcccgccgcucacc

SEQ ID NO: 993093 - RNA, 14 nt, Mycobacterium avium subsp. paratuberculosis
cgcggcccgcuucc

SEQ ID NO: 993094 - RNA, 16 nt, Mycobacterium avium subsp. paratuberculosis
cgcggcccggccacca

SEQ ID NO: 993095 - RNA, 13 nt, Mycobacterium avium subsp. paratuberculosis
cgcggcccggccc

SEQ ID NO: 993096 - RNA, 14 nt, Mycobacterium avium subsp. paratuberculosis
cgcggcccggcccg

SEQ ID NO: 993097 - RNA, 15 nt, Mycobacterium avium subsp. paratuberculosis
cgcggcccggcccgc

SEQ ID NO: 993098 - RNA, 21 nt, Mycobacterium avium subsp. paratuberculosis
cgcggauguggaggcgagcaa

SEQ ID NO: 993099 - RNA, 19 nt, Mycobacterium avium subsp. paratuberculosis
cgcggauuccagcgcgacc

SEQ ID NO: 993100 - RNA, 20 nt, Mycobacterium avium subsp. paratuberculosis
cgcggcccacccgcagggcg

SEQ ID NO: 993101 - RNA, 21 nt, Mycobacterium avium subsp. paratuberculosis
cgcggauuucucagcggcgcu

SEQ ID NO: 993102 - RNA, 17 nt, Mycobacterium avium subsp. paratuberculosis
cgcggcccccacgcagc

SEQ ID NO: 993103 - RNA, 16 nt, Mycobacterium avium subsp. paratuberculosis
cgcggcccagcaccac

SEQ ID NO: 993104 - RNA, 16 nt, Mycobacterium avium subsp. paratuberculosis
cgcggaucucgcgcag

SEQ ID NO: 993105 - RNA, 20 nt, Mycobacterium avium subsp. paratuberculosis
cgcggaucucgucgggccac

SEQ ID NO: 993106 - RNA, 17 nt, Mycobacterium avium subsp. paratuberculosis
cgcggaucuucuccgcc

SEQ ID NO: 993107 - RNA, 22 nt, Mycobacterium avium subsp. paratuberculosis
cgcggaucgguuucuccacccc

SEQ ID NO: 993108 - RNA, 13 nt, Mycobacterium avium subsp. paratuberculosis
cgcggauccgcag

SEQ ID NO: 993109 - RNA, 21 nt, Mycobacterium avium subsp. paratuberculosis
cgcggauccgggccggcgucg

SEQ ID NO: 993110 - RNA, 21 nt, Mycobacterium avium subsp. paratuberculosis
cgcggaucgaacagggcggcg

SEQ ID NO: 993111 - RNA, 23 nt, Mycobacterium avium subsp. paratuberculosis
cgcggaucgaacagggcggcggg

SEQ ID NO: 993112 - RNA, 17 nt, Mycobacterium avium subsp. paratuberculosis
cgcggaucgcgcugacc

SEQ ID NO: 993113 - RNA, 18 nt, Mycobacterium avium subsp. paratuberculosis
cgcggaucgcgcugacca

SEQ ID NO: 993114 - RNA, 21 nt, Mycobacterium avium subsp. paratuberculosis
cgcggacacgaacgacgcggc

SEQ ID NO: 993115 - RNA, 22 nt, Mycobacterium avium subsp. paratuberculosis
cgcggacacgaacgacgcggca

SEQ ID NO: 993116 - RNA, 13 nt, Mycobacterium avium subsp. paratuberculosis
cgcggacacggcc

SEQ ID NO: 993117 - RNA, 23 nt, Mycobacterium avium subsp. paratuberculosis
cgcgcuuguacaggucgaccauc

SEQ ID NO: 993118 - RNA, 14 nt, Mycobacterium avium subsp. paratuberculosis
cgcggaacagccgg

SEQ ID NO: 993119 - RNA, 18 nt, Mycobacterium avium subsp. paratuberculosis
cgcggaacugcucccagg

SEQ ID NO: 993120 - RNA, 15 nt, Mycobacterium avium subsp. paratuberculosis
cgcggaaccggccgg

SEQ ID NO: 993121 - RNA, 22 nt, Mycobacterium avium subsp. paratuberculosis
cgcggaaccggccggggcgcca

SEQ ID NO: 993122 - RNA, 12 nt, Mycobacterium avium subsp. paratuberculosis
cgcggaaugcuc

SEQ ID NO: 993123 - RNA, 18 nt, Mycobacterium avium subsp. paratuberculosis
cgcggaagccccaggccc

SEQ ID NO: 993124 - RNA, 16 nt, Mycobacterium avium subsp. paratuberculosis
cgcgcucuaacuccgc

SEQ ID NO: 993125 - RNA, 20 nt, Mycobacterium avium subsp. paratuberculosis
cgcgcucuaacuccgcucgg

SEQ ID NO: 993126 - RNA, 14 nt, Mycobacterium avium subsp. paratuberculosis
cgcgcugaccagcg

SEQ ID NO: 993127 - RNA, 15 nt, Mycobacterium avium subsp. paratuberculosis
cgcgcugcaggcccg

SEQ ID NO: 993128 - RNA, 16 nt, Mycobacterium avium subsp. paratuberculosis
cgcgcugaucgccgcu

SEQ ID NO: 993129 - RNA, 14 nt, Mycobacterium avium subsp. paratuberculosis
cgcgcugcgcgccg

SEQ ID NO: 993130 - RNA, 15 nt, Mycobacterium avium subsp. paratuberculosis
cgcgcugcgcgccgc

SEQ ID NO: 993131 - RNA, 17 nt, Mycobacterium avium subsp. paratuberculosis
cgcgcugcgcgccgccc

SEQ ID NO: 993132 - RNA, 14 nt, Mycobacterium avium subsp. paratuberculosis
cgcgcugcgcgcgu

SEQ ID NO: 993133 - RNA, 15 nt, Mycobacterium avium subsp. paratuberculosis
cgcgcugccgcgccc

SEQ ID NO: 993134 - RNA, 21 nt, Mycobacterium avium subsp. paratuberculosis
cgcgcugccgcgcgccgacag

SEQ ID NO: 993135 - RNA, 15 nt, Mycobacterium avium subsp. paratuberculosis
cgcgcugccggcccg

SEQ ID NO: 993136 - RNA, 16 nt, Mycobacterium avium subsp. paratuberculosis
cgcgcugccggcccga

SEQ ID NO: 993137 - RNA, 18 nt, Mycobacterium avium subsp. paratuberculosis
cgcgcgucucccccgauc

SEQ ID NO: 993138 - RNA, 13 nt, Mycobacterium avium subsp. paratuberculosis
cgcgcgugcagcc

SEQ ID NO: 993139 - RNA, 15 nt, Mycobacterium avium subsp. paratuberculosis
cgcgcgucgcgcagc

SEQ ID NO: 993140 - RNA, 20 nt, Mycobacterium avium subsp. paratuberculosis
cgcgcgucgggggugccgcu

SEQ ID NO: 993141 - RNA, 21 nt, Mycobacterium avium subsp. paratuberculosis
cgcgcguauuccagcgccagc

SEQ ID NO: 993142 - RNA, 22 nt, Mycobacterium avium subsp. paratuberculosis
cgcgcgucgacguucgccgcca

SEQ ID NO: 993143 - RNA, 16 nt, Mycobacterium avium subsp. paratuberculosis
cgcgcguagcgcagcu

SEQ ID NO: 993144 - RNA, 19 nt, Mycobacterium avium subsp. paratuberculosis
cgcgcggggugucgcggcu

SEQ ID NO: 993145 - RNA, 20 nt, Mycobacterium avium subsp. paratuberculosis
cgcgcguagugcucgcgcag

SEQ ID NO: 993146 - RNA, 19 nt, Mycobacterium avium subsp. paratuberculosis
cgcgcggugcgccagcgcc

SEQ ID NO: 993147 - RNA, 21 nt, Mycobacterium avium subsp. paratuberculosis
cgcgcgguuccggcgugcagc

SEQ ID NO: 993148 - RNA, 18 nt, Mycobacterium avium subsp. paratuberculosis
cgcgcgggucgagcagca

SEQ ID NO: 993149 - RNA, 20 nt, Mycobacterium avium subsp. paratuberculosis
cgcgcgggucgagcagcagc

SEQ ID NO: 993150 - RNA, 14 nt, Mycobacterium avium subsp. paratuberculosis
cgcgcggggcggcc

SEQ ID NO: 993151 - RNA, 17 nt, Mycobacterium avium subsp. paratuberculosis
cgcgcgggugcgggcgu

SEQ ID NO: 993152 - RNA, 22 nt, Mycobacterium avium subsp. paratuberculosis
cgcgcgggcgaccugcgggccc

SEQ ID NO: 993153 - RNA, 19 nt, Mycobacterium avium subsp. paratuberculosis
cgcgcggcucgcgggcgau

SEQ ID NO: 993154 - RNA, 15 nt, Mycobacterium avium subsp. paratuberculosis
cgcgcgggcgcgcgc

SEQ ID NO: 993155 - RNA, 13 nt, Mycobacterium avium subsp. paratuberculosis
cgcgcggcggcca

SEQ ID NO: 993156 - RNA, 14 nt, Mycobacterium avium subsp. paratuberculosis
cgcgcggcgggccc

SEQ ID NO: 993157 - RNA, 15 nt, Mycobacterium avium subsp. paratuberculosis
cgcgcggcgcagggc

SEQ ID NO: 993158 - RNA, 17 nt, Mycobacterium avium subsp. paratuberculosis
cgcgcggcgcagguccg

SEQ ID NO: 993159 - RNA, 13 nt, Mycobacterium avium subsp. paratuberculosis
cgcgcggcgcccc

SEQ ID NO: 993160 - RNA, 14 nt, Mycobacterium avium subsp. paratuberculosis
cgcgcggcgccgcg

SEQ ID NO: 993161 - RNA, 15 nt, Mycobacterium avium subsp. paratuberculosis
cgcgcggcgcggagc

SEQ ID NO: 993162 - RNA, 19 nt, Mycobacterium avium subsp. paratuberculosis
cgcgcuaggacgcgggccu

SEQ ID NO: 993163 - RNA, 19 nt, Mycobacterium avium subsp. paratuberculosis
cgcgcguuccagcacgccc

SEQ ID NO: 993164 - RNA, 17 nt, Mycobacterium avium subsp. paratuberculosis
cgcgcucagccccagcg

SEQ ID NO: 993165 - RNA, 16 nt, Mycobacterium avium subsp. paratuberculosis
cgcgcucaacccgggc

SEQ ID NO: 993166 - RNA, 18 nt, Mycobacterium avium subsp. paratuberculosis
cgcgcucaaccgcccagc

SEQ ID NO: 993167 - RNA, 19 nt, Mycobacterium avium subsp. paratuberculosis
cgcgcucaaccgcccagcg

SEQ ID NO: 993168 - RNA, 19 nt, Mycobacterium avium subsp. paratuberculosis
cgcgcucccggcgccgccg

SEQ ID NO: 993169 - RNA, 20 nt, Mycobacterium avium subsp. paratuberculosis
cgccucgagcaacggccgca

SEQ ID NO: 993170 - RNA, 23 nt, Mycobacterium avium subsp. paratuberculosis
cgccucgagcaacggccgcagcg

SEQ ID NO: 993171 - RNA, 19 nt, Mycobacterium avium subsp. paratuberculosis
cgccucgagcaccacggcc

SEQ ID NO: 993172 - RNA, 14 nt, Mycobacterium avium subsp. paratuberculosis
cgccucgagcgccc

SEQ ID NO: 993173 - RNA, 17 nt, Mycobacterium avium subsp. paratuberculosis
cgccucgagcgcccggg

SEQ ID NO: 993174 - RNA, 16 nt, Mycobacterium avium subsp. paratuberculosis
cgccucgauggcccgc

SEQ ID NO: 993175 - RNA, 22 nt, Mycobacterium avium subsp. paratuberculosis
cgccucgaucagagcgggccga

SEQ ID NO: 993176 - RNA, 15 nt, Mycobacterium avium subsp. paratuberculosis
cgccucgccgaccuu

SEQ ID NO: 993177 - RNA, 17 nt, Mycobacterium avium subsp. paratuberculosis
cgccucgaccagcaccg

SEQ ID NO: 993178 - RNA, 19 nt, Mycobacterium avium subsp. paratuberculosis
cgccucgaccagcaccgca

SEQ ID NO: 993179 - RNA, 19 nt, Mycobacterium avium subsp. paratuberculosis
cgccuccgggaaggcggcc

SEQ ID NO: 993180 - RNA, 22 nt, Mycobacterium avium subsp. paratuberculosis
cgccuccgguuugcgccggcuc

SEQ ID NO: 993181 - RNA, 23 nt, Mycobacterium avium subsp. paratuberculosis
cgccuccgagauggacagcaccu

SEQ ID NO: 993182 - RNA, 13 nt, Mycobacterium avium subsp. paratuberculosis
cgccuccagcagg

SEQ ID NO: 993183 - RNA, 18 nt, Mycobacterium avium subsp. paratuberculosis
cgccuccagccgcuccuc

SEQ ID NO: 993184 - RNA, 18 nt, Mycobacterium avium subsp. paratuberculosis
cgccucccccacccgcac

SEQ ID NO: 993185 - RNA, 14 nt, Mycobacterium avium subsp. paratuberculosis
cgccucccgcagcg

SEQ ID NO: 993186 - RNA, 19 nt, Mycobacterium avium subsp. paratuberculosis
cgccucccgcagcgccagc

SEQ ID NO: 993187 - RNA, 23 nt, Mycobacterium avium subsp. paratuberculosis
cgccuccgaauccagcgcgccgc

SEQ ID NO: 993188 - RNA, 12 nt, Mycobacterium avium subsp. paratuberculosis
cgccuccgccgc

SEQ ID NO: 993189 - RNA, 16 nt, Mycobacterium avium subsp. paratuberculosis
cgccuccgccgccccg

SEQ ID NO: 993190 - RNA, 18 nt, Mycobacterium avium subsp. paratuberculosis
cgccuccgccgccccguc

SEQ ID NO: 993191 - RNA, 15 nt, Mycobacterium avium subsp. paratuberculosis
cgccucacgcagggc

SEQ ID NO: 993192 - RNA, 17 nt, Mycobacterium avium subsp. paratuberculosis
cgccucacgcagggcca

SEQ ID NO: 993193 - RNA, 21 nt, Mycobacterium avium subsp. paratuberculosis
cgccuccacauacgcggcggc

SEQ ID NO: 993194 - RNA, 20 nt, Mycobacterium avium subsp. paratuberculosis
cgccuaccggguggccagca

SEQ ID NO: 993195 - RNA, 20 nt, Mycobacterium avium subsp. paratuberculosis
cgccguuuugccgccgagcg

SEQ ID NO: 993196 - RNA, 15 nt, Mycobacterium avium subsp. paratuberculosis
cgccguuucggaucc

SEQ ID NO: 993197 - RNA, 15 nt, Mycobacterium avium subsp. paratuberculosis
cgccguuguugagga

SEQ ID NO: 993198 - RNA, 22 nt, Mycobacterium avium subsp. paratuberculosis
cgccguuguugaggaugacgac

SEQ ID NO: 993199 - RNA, 15 nt, Mycobacterium avium subsp. paratuberculosis
cgccguuucagcagc

SEQ ID NO: 993200 - RNA, 23 nt, Mycobacterium avium subsp. paratuberculosis
cgccguuccgaugaagaacaccc

SEQ ID NO: 993201 - RNA, 22 nt, Mycobacterium avium subsp. paratuberculosis
cgccguggcggcccgaccagcg

SEQ ID NO: 993202 - RNA, 14 nt, Mycobacterium avium subsp. paratuberculosis
cgccguugcggccc

SEQ ID NO: 993203 - RNA, 14 nt, Mycobacterium avium subsp. paratuberculosis
cgccguugccggcc

SEQ ID NO: 993204 - RNA, 20 nt, Mycobacterium avium subsp. paratuberculosis
cgccguugccggcccgcagc

SEQ ID NO: 993205 - RNA, 17 nt, Mycobacterium avium subsp. paratuberculosis
cgccguugaccggccgg

SEQ ID NO: 993206 - RNA, 18 nt, Mycobacterium avium subsp. paratuberculosis
cgccguugaccggccggu

SEQ ID NO: 993207 - RNA, 18 nt, Mycobacterium avium subsp. paratuberculosis
cgccgucaucaccgccga

SEQ ID NO: 993208 - RNA, 16 nt, Mycobacterium avium subsp. paratuberculosis
cgccguccagcucgcg

SEQ ID NO: 993209 - RNA, 14 nt, Mycobacterium avium subsp. paratuberculosis
cgccguccccgcgc

SEQ ID NO: 993210 - RNA, 17 nt, Mycobacterium avium subsp. paratuberculosis
cgccguccccgcgcggc

SEQ ID NO: 993211 - RNA, 17 nt, Mycobacterium avium subsp. paratuberculosis
cgccgucccgucacggc

SEQ ID NO: 993212 - RNA, 15 nt, Mycobacterium avium subsp. paratuberculosis
cgccgucccguccga

SEQ ID NO: 993213 - RNA, 18 nt, Mycobacterium avium subsp. paratuberculosis
cgccgucccguccgacgg

SEQ ID NO: 993214 - RNA, 17 nt, Mycobacterium avium subsp. paratuberculosis
cgccguccgcggcggcc

SEQ ID NO: 993215 - RNA, 18 nt, Mycobacterium avium subsp. paratuberculosis
cgccguccgcggcggcca

SEQ ID NO: 993216 - RNA, 22 nt, Mycobacterium avium subsp. paratuberculosis
cgccguggaagauguugccgcc

SEQ ID NO: 993217 - RNA, 15 nt, Mycobacterium avium subsp. paratuberculosis
cgccgugcgcggcga

SEQ ID NO: 993218 - RNA, 22 nt, Mycobacterium avium subsp. paratuberculosis
cgccgugccggaccgcgcgggc

SEQ ID NO: 993219 - RNA, 19 nt, Mycobacterium avium subsp. paratuberculosis
cgccgugagauccagcagc

SEQ ID NO: 993220 - RNA, 13 nt, Mycobacterium avium subsp. paratuberculosis
cgccgugcagcac

SEQ ID NO: 993221 - RNA, 18 nt, Mycobacterium avium subsp. paratuberculosis
cgccgugcagcacgccgc

SEQ ID NO: 993222 - RNA, 14 nt, Mycobacterium avium subsp. paratuberculosis
cgccgugacgccga

SEQ ID NO: 993223 - RNA, 14 nt, Mycobacterium avium subsp. paratuberculosis
cgccgguucgcugg

SEQ ID NO: 993224 - RNA, 22 nt, Mycobacterium avium subsp. paratuberculosis
cgccgguucgcuggcggccagc

SEQ ID NO: 993225 - RNA, 18 nt, Mycobacterium avium subsp. paratuberculosis
cgccgguggugcaccggu

SEQ ID NO: 993226 - RNA, 15 nt, Mycobacterium avium subsp. paratuberculosis
cgccggugcggccgc

SEQ ID NO: 993227 - RNA, 20 nt, Mycobacterium avium subsp. paratuberculosis
cgccgguggagauggccagc

SEQ ID NO: 993228 - RNA, 22 nt, Mycobacterium avium subsp. paratuberculosis
cgccgguggagauggccagcac

SEQ ID NO: 993229 - RNA, 18 nt, Mycobacterium avium subsp. paratuberculosis
cgccggugccgcagccgu

SEQ ID NO: 993230 - RNA, 21 nt, Mycobacterium avium subsp. paratuberculosis
cgccgguagccgcucgcccag

SEQ ID NO: 993231 - RNA, 21 nt, Mycobacterium avium subsp. paratuberculosis
cgccggugccguugaucaggg

SEQ ID NO: 993232 - RNA, 18 nt, Mycobacterium avium subsp. paratuberculosis
cgccgccgaacagccggg

SEQ ID NO: 993233 - RNA, 21 nt, Mycobacterium avium subsp. paratuberculosis
cgccgccgaaccccagcuccg

SEQ ID NO: 993234 - RNA, 21 nt, Mycobacterium avium subsp. paratuberculosis
cgccgccgaccacgccgcgcu

SEQ ID NO: 993235 - RNA, 17 nt, Mycobacterium avium subsp. paratuberculosis
cgccgccgaccgcccgc

SEQ ID NO: 993236 - RNA, 18 nt, Mycobacterium avium subsp. paratuberculosis
cgccgccgaccgcccgcu

SEQ ID NO: 993237 - RNA, 12 nt, Mycobacterium avium subsp. paratuberculosis
cgccgccgccga

SEQ ID NO: 993238 - RNA, 14 nt, Mycobacterium avium subsp. paratuberculosis
cgccgcccugcggg

SEQ ID NO: 993239 - RNA, 23 nt, Mycobacterium avium subsp. paratuberculosis
cgccgccgaugcugauccgcagg

SEQ ID NO: 993240 - RNA, 15 nt, Mycobacterium avium subsp. paratuberculosis
cgccgccgagccgcg

SEQ ID NO: 993241 - RNA, 16 nt, Mycobacterium avium subsp. paratuberculosis
cgccgccgagccgcgg

SEQ ID NO: 993242 - RNA, 17 nt, Mycobacterium avium subsp. paratuberculosis
cgccgccgcggccgcgg

SEQ ID NO: 993243 - RNA, 18 nt, Mycobacterium avium subsp. paratuberculosis
cgccgguaccgccggcca

SEQ ID NO: 993244 - RNA, 19 nt, Mycobacterium avium subsp. paratuberculosis
cgccggguugggcggcggc

SEQ ID NO: 993245 - RNA, 20 nt, Mycobacterium avium subsp. paratuberculosis
cgccggguugggcggcggcc

SEQ ID NO: 993246 - RNA, 18 nt, Mycobacterium avium subsp. paratuberculosis
cgccggguuguagcaggc

SEQ ID NO: 993247 - RNA, 15 nt, Mycobacterium avium subsp. paratuberculosis
cgccgggucgcacgc

SEQ ID NO: 993248 - RNA, 19 nt, Mycobacterium avium subsp. paratuberculosis
cgccggguccuugcgcccc

SEQ ID NO: 993249 - RNA, 22 nt, Mycobacterium avium subsp. paratuberculosis
cgccgggucauccccgugcggg

SEQ ID NO: 993250 - RNA, 13 nt, Mycobacterium avium subsp. paratuberculosis
cgccggggcacca

SEQ ID NO: 993251 - RNA, 22 nt, Mycobacterium avium subsp. paratuberculosis
cgccgggguccgcaacgccggc

SEQ ID NO: 993252 - RNA, 13 nt, Mycobacterium avium subsp. paratuberculosis
cgccgggguccuc

SEQ ID NO: 993253 - RNA, 18 nt, Mycobacterium avium subsp. paratuberculosis
cgccggggucgacagccu

SEQ ID NO: 993254 - RNA, 14 nt, Mycobacterium avium subsp. paratuberculosis
cgccggggccuucu

SEQ ID NO: 993255 - RNA, 17 nt, Mycobacterium avium subsp. paratuberculosis
cgccggggcgggcagca

SEQ ID NO: 993256 - RNA, 16 nt, Mycobacterium avium subsp. paratuberculosis
cgccggggcgggcggc

SEQ ID NO: 993257 - RNA, 15 nt, Mycobacterium avium subsp. paratuberculosis
cgccgccgcgucgcc

SEQ ID NO: 993258 - RNA, 20 nt, Mycobacterium avium subsp. paratuberculosis
cgccgccgcgucgccgccgg

SEQ ID NO: 993259 - RNA, 19 nt, Mycobacterium avium subsp. paratuberculosis
cgccuggucaaggugcuga

SEQ ID NO: 993260 - RNA, 13 nt, Mycobacterium avium subsp. paratuberculosis
cgccuggccaccu

SEQ ID NO: 993261 - RNA, 14 nt, Mycobacterium avium subsp. paratuberculosis
cgccugccggcgcc

SEQ ID NO: 993262 - RNA, 16 nt, Mycobacterium avium subsp. paratuberculosis
cgccugcagccgccgc

SEQ ID NO: 993263 - RNA, 21 nt, Mycobacterium avium subsp. paratuberculosis
cgccugcagccgccgcgccac

SEQ ID NO: 993264 - RNA, 19 nt, Mycobacterium avium subsp. paratuberculosis
cgccugcaccuugcccguc

SEQ ID NO: 993265 - RNA, 22 nt, Mycobacterium avium subsp. paratuberculosis
cgccugcacgaaauaaccgcgc

SEQ ID NO: 993266 - RNA, 23 nt, Mycobacterium avium subsp. paratuberculosis
cgccugcacgaaauaaccgcgcg

SEQ ID NO: 993267 - RNA, 12 nt, Mycobacterium avium subsp. paratuberculosis
cgccugagcccg

SEQ ID NO: 993268 - RNA, 15 nt, Mycobacterium avium subsp. paratuberculosis
cgccucgucgggaac

SEQ ID NO: 993269 - RNA, 19 nt, Mycobacterium avium subsp. paratuberculosis
cgccucggugaagccgcgg

SEQ ID NO: 993270 - RNA, 18 nt, Mycobacterium avium subsp. paratuberculosis
cgccucgggccggcagcc

SEQ ID NO: 993271 - RNA, 18 nt, Mycobacterium avium subsp. paratuberculosis
cgccucggugagcagcuc

SEQ ID NO: 993272 - RNA, 17 nt, Mycobacterium avium subsp. paratuberculosis
cgccucgucgaccgcgg

SEQ ID NO: 993273 - RNA, 21 nt, Mycobacterium avium subsp. paratuberculosis
cgccucgucgaccgcggccug

SEQ ID NO: 993274 - RNA, 14 nt, Mycobacterium avium subsp. paratuberculosis
cgccucggcggccc

SEQ ID NO: 993275 - RNA, 15 nt, Mycobacterium avium subsp. paratuberculosis
cgccucggcggcccc

SEQ ID NO: 993276 - RNA, 16 nt, Mycobacterium avium subsp. paratuberculosis
cgccucggcggccgcc

SEQ ID NO: 993277 - RNA, 17 nt, Mycobacterium avium subsp. paratuberculosis
cgccucggcggccgccc

SEQ ID NO: 993278 - RNA, 16 nt, Mycobacterium avium subsp. paratuberculosis
cgccucggaggccacc

SEQ ID NO: 993279 - RNA, 18 nt, Mycobacterium avium subsp. paratuberculosis
cgccucggaggccaccgc

SEQ ID NO: 993280 - RNA, 13 nt, Mycobacterium avium subsp. paratuberculosis
cgccucggccacc

SEQ ID NO: 993281 - RNA, 14 nt, Mycobacterium avium subsp. paratuberculosis
cgccucggccacca

SEQ ID NO: 993282 - RNA, 14 nt, Mycobacterium avium subsp. paratuberculosis
cgccucggccgcgg

SEQ ID NO: 993283 - RNA, 20 nt, Mycobacterium avium subsp. paratuberculosis
cgccucggccuuggccaccg

SEQ ID NO: 993284 - RNA, 17 nt, Mycobacterium avium subsp. paratuberculosis
cgccucggcgagccgcu

SEQ ID NO: 993285 - RNA, 12 nt, Mycobacterium avium subsp. paratuberculosis
cgccucgcgcag

SEQ ID NO: 993286 - RNA, 20 nt, Mycobacterium avium subsp. paratuberculosis
cgccucgaagucgccggccu

SEQ ID NO: 993287 - RNA, 13 nt, Mycobacterium avium subsp. paratuberculosis
cgccucgccgggc

SEQ ID NO: 993288 - RNA, 14 nt, Mycobacterium avium subsp. paratuberculosis
cgccucgccgggcc

SEQ ID NO: 993289 - RNA, 20 nt, Mycobacterium avium subsp. paratuberculosis
cgcgaauuccucagcgcccc

SEQ ID NO: 993290 - RNA, 21 nt, Mycobacterium avium subsp. paratuberculosis
cgcgaauuccucagcgcccca

SEQ ID NO: 993291 - RNA, 13 nt, Mycobacterium avium subsp. paratuberculosis
cgcgaacggcccg

SEQ ID NO: 993292 - RNA, 17 nt, Mycobacterium avium subsp. paratuberculosis
cgcgaacucaggcgcgc

SEQ ID NO: 993293 - RNA, 18 nt, Mycobacterium avium subsp. paratuberculosis
cgcgaacucaggcgcgca

SEQ ID NO: 993294 - RNA, 19 nt, Mycobacterium avium subsp. paratuberculosis
cgcgaacucaggcgcgcac

SEQ ID NO: 993295 - RNA, 17 nt, Mycobacterium avium subsp. paratuberculosis
cgcgaaucccggccucg

SEQ ID NO: 993296 - RNA, 22 nt, Mycobacterium avium subsp. paratuberculosis
cgcgaacgcaacagggccaccg

SEQ ID NO: 993297 - RNA, 14 nt, Mycobacterium avium subsp. paratuberculosis
cgcgaacgcgcccc

SEQ ID NO: 993298 - RNA, 15 nt, Mycobacterium avium subsp. paratuberculosis
cgcgaacgcgccccg

SEQ ID NO: 993299 - RNA, 19 nt, Mycobacterium avium subsp. paratuberculosis
cgcgaacgggugcggcgcu

SEQ ID NO: 993300 - RNA, 20 nt, Mycobacterium avium subsp. paratuberculosis
cgccuucacgaccggcagca

SEQ ID NO: 993301 - RNA, 22 nt, Mycobacterium avium subsp. paratuberculosis
cgccugguagggguccuccagc

SEQ ID NO: 993302 - RNA, 15 nt, Mycobacterium avium subsp. paratuberculosis
cgccuuccgccacgc

SEQ ID NO: 993303 - RNA, 20 nt, Mycobacterium avium subsp. paratuberculosis
cgcgaccaaacgcagcgucu

SEQ ID NO: 993304 - RNA, 16 nt, Mycobacterium avium subsp. paratuberculosis
cgcgaccacgccgcgg

SEQ ID NO: 993305 - RNA, 12 nt, Mycobacterium avium subsp. paratuberculosis
cgcgaccacagc

SEQ ID NO: 993306 - RNA, 14 nt, Mycobacterium avium subsp. paratuberculosis
cgcgacaucgccgg

SEQ ID NO: 993307 - RNA, 20 nt, Mycobacterium avium subsp. paratuberculosis
cgcgacaucgccggcgaccg

SEQ ID NO: 993308 - RNA, 22 nt, Mycobacterium avium subsp. paratuberculosis
cgcgacaaggucgaccgcgcac

SEQ ID NO: 993309 - RNA, 15 nt, Mycobacterium avium subsp. paratuberculosis
cgcgacacgccgcgc

SEQ ID NO: 993310 - RNA, 18 nt, Mycobacterium avium subsp. paratuberculosis
cgcgacacgccgcgcauc

SEQ ID NO: 993311 - RNA, 20 nt, Mycobacterium avium subsp. paratuberculosis
cgcgacacgugcaucugcga

SEQ ID NO: 993312 - RNA, 11 nt, Mycobacterium avium subsp. paratuberculosis
cgcgacacugc

SEQ ID NO: 993313 - RNA, 14 nt, Mycobacterium avium subsp. paratuberculosis
cgcgagcgcagcag

SEQ ID NO: 993314 - RNA, 17 nt, Mycobacterium avium subsp. paratuberculosis
cgcgagcgcagcaggua

SEQ ID NO: 993315 - RNA, 23 nt, Mycobacterium avium subsp. paratuberculosis
cgcgacgggcguccgagaagggc

SEQ ID NO: 993316 - RNA, 14 nt, Mycobacterium avium subsp. paratuberculosis
cgcgacgggcugcu

SEQ ID NO: 993317 - RNA, 17 nt, Mycobacterium avium subsp. paratuberculosis
cgcgacgugccggcgau

SEQ ID NO: 993318 - RNA, 11 nt, Mycobacterium avium subsp. paratuberculosis
cgcgacgccga

SEQ ID NO: 993319 - RNA, 22 nt, Mycobacterium avium subsp. paratuberculosis
cgcgacggccggggccagcacc

SEQ ID NO: 993320 - RNA, 15 nt, Mycobacterium avium subsp. paratuberculosis
cgcgacggccucgcc

SEQ ID NO: 993321 - RNA, 19 nt, Mycobacterium avium subsp. paratuberculosis
cgcgacggcgagccgggcc

SEQ ID NO: 993322 - RNA, 13 nt, Mycobacterium avium subsp. paratuberculosis
cgcgacggcgccc

SEQ ID NO: 993323 - RNA, 15 nt, Mycobacterium avium subsp. paratuberculosis
cgcgacgccagcacc

SEQ ID NO: 993324 - RNA, 14 nt, Mycobacterium avium subsp. paratuberculosis
cgcgacgcccaggu

SEQ ID NO: 993325 - RNA, 20 nt, Mycobacterium avium subsp. paratuberculosis
cgcgaccagcccggccgccg

SEQ ID NO: 993326 - RNA, 16 nt, Mycobacterium avium subsp. paratuberculosis
cgcgaccagcggcagc

SEQ ID NO: 993327 - RNA, 16 nt, Mycobacterium avium subsp. paratuberculosis
cgcgaccaggcccagc

SEQ ID NO: 993328 - RNA, 18 nt, Mycobacterium avium subsp. paratuberculosis
cgcgaccaggcccagcgg

SEQ ID NO: 993329 - RNA, 19 nt, Mycobacterium avium subsp. paratuberculosis
cgcgacgaucagcagccgg

SEQ ID NO: 993330 - RNA, 22 nt, Mycobacterium avium subsp. paratuberculosis
cgcgacgaucagcagccgggcc

SEQ ID NO: 993331 - RNA, 15 nt, Mycobacterium avium subsp. paratuberculosis
cgcuucggccagcgc

SEQ ID NO: 993332 - RNA, 15 nt, Mycobacterium avium subsp. paratuberculosis
cgcuucuccgccuuc

SEQ ID NO: 993333 - RNA, 23 nt, Mycobacterium avium subsp. paratuberculosis
cgcuucccacagucgcugggugu

SEQ ID NO: 993334 - RNA, 14 nt, Mycobacterium avium subsp. paratuberculosis
cgcuuccagcgcgg

SEQ ID NO: 993335 - RNA, 22 nt, Mycobacterium avium subsp. paratuberculosis
cgcugugcgccauguccggcag

SEQ ID NO: 993336 - RNA, 18 nt, Mycobacterium avium subsp. paratuberculosis
cgcuguuagccucgccag

SEQ ID NO: 993337 - RNA, 17 nt, Mycobacterium avium subsp. paratuberculosis
cgcuguuggaaccggcc

SEQ ID NO: 993338 - RNA, 18 nt, Mycobacterium avium subsp. paratuberculosis
cgcugucaauccccgcgg

SEQ ID NO: 993339 - RNA, 18 nt, Mycobacterium avium subsp. paratuberculosis
cgcuguaggccagcccgg

SEQ ID NO: 993340 - RNA, 18 nt, Mycobacterium avium subsp. paratuberculosis
cgcuguggugacggcccc

SEQ ID NO: 993341 - RNA, 22 nt, Mycobacterium avium subsp. paratuberculosis
cgcugugcgggugaggccaggc

SEQ ID NO: 993342 - RNA, 23 nt, Mycobacterium avium subsp. paratuberculosis
cgcugugcgggugaggccaggcg

SEQ ID NO: 993343 - RNA, 19 nt, Mycobacterium avium subsp. paratuberculosis
cgcugugcgaacuccggug

SEQ ID NO: 993344 - RNA, 16 nt, Mycobacterium avium subsp. paratuberculosis
cgcuguccugccgggc

SEQ ID NO: 993345 - RNA, 18 nt, Mycobacterium avium subsp. paratuberculosis
cgcugucgcgggcccgcg

SEQ ID NO: 993346 - RNA, 13 nt, Mycobacterium avium subsp. paratuberculosis
cgcugguggccug

SEQ ID NO: 993347 - RNA, 17 nt, Mycobacterium avium subsp. paratuberculosis
cgcuggugcgggccagc

SEQ ID NO: 993348 - RNA, 20 nt, Mycobacterium avium subsp. paratuberculosis
cgcuggugcgggccagcacg

SEQ ID NO: 993349 - RNA, 20 nt, Mycobacterium avium subsp. paratuberculosis
cgcugguggugaucacccag

SEQ ID NO: 993350 - RNA, 23 nt, Mycobacterium avium subsp. paratuberculosis
cgcugguggugaucacccagccg

SEQ ID NO: 993351 - RNA, 20 nt, Mycobacterium avium subsp. paratuberculosis
cgcuggguguuccccgggcg

SEQ ID NO: 993352 - RNA, 20 nt, Mycobacterium avium subsp. paratuberculosis
cgcugggugaacaccccgcg

SEQ ID NO: 993353 - RNA, 15 nt, Mycobacterium avium subsp. paratuberculosis
cgcuggucggcgggc

SEQ ID NO: 993354 - RNA, 18 nt, Mycobacterium avium subsp. paratuberculosis
cgcuggucggcgggcagc

SEQ ID NO: 993355 - RNA, 19 nt, Mycobacterium avium subsp. paratuberculosis
cgcuggugaggucgcgcag

SEQ ID NO: 993356 - RNA, 13 nt, Mycobacterium avium subsp. paratuberculosis
cgcuggugcaccc

SEQ ID NO: 993357 - RNA, 15 nt, Mycobacterium avium subsp. paratuberculosis
cgcuggugcacccga

SEQ ID NO: 993358 - RNA, 13 nt, Mycobacterium avium subsp. paratuberculosis
cgcuggugcagca

SEQ ID NO: 993359 - RNA, 21 nt, Mycobacterium avium subsp. paratuberculosis
cgcuggccgcggccagcugcc

SEQ ID NO: 993360 - RNA, 21 nt, Mycobacterium avium subsp. paratuberculosis
cgcuggccgcgaacggcccgc

SEQ ID NO: 993361 - RNA, 14 nt, Mycobacterium avium subsp. paratuberculosis
cgcuggccuccagc

SEQ ID NO: 993362 - RNA, 20 nt, Mycobacterium avium subsp. paratuberculosis
cgcuggccuccagcuuugcc

SEQ ID NO: 993363 - RNA, 14 nt, Mycobacterium avium subsp. paratuberculosis
cgcuggccgacccc

SEQ ID NO: 993364 - RNA, 13 nt, Mycobacterium avium subsp. paratuberculosis
cgcuggccggcca

SEQ ID NO: 993365 - RNA, 19 nt, Mycobacterium avium subsp. paratuberculosis
cgcuggccggccaccagcg

SEQ ID NO: 993366 - RNA, 22 nt, Mycobacterium avium subsp. paratuberculosis
cgcuggcgaccaucagccugcg

SEQ ID NO: 993367 - RNA, 13 nt, Mycobacterium avium subsp. paratuberculosis
cgcuggcgcgccg

SEQ ID NO: 993368 - RNA, 17 nt, Mycobacterium avium subsp. paratuberculosis
cgcuggcgcgccguacc

SEQ ID NO: 993369 - RNA, 12 nt, Mycobacterium avium subsp. paratuberculosis
cgcuggcgcgcu

SEQ ID NO: 993370 - RNA, 15 nt, Mycobacterium avium subsp. paratuberculosis
cgcuggcggccagcg

SEQ ID NO: 993371 - RNA, 21 nt, Mycobacterium avium subsp. paratuberculosis
cgcuggcgugacgcucgccgg

SEQ ID NO: 993372 - RNA, 22 nt, Mycobacterium avium subsp. paratuberculosis
cgcuggcguggcacccgggcgc

SEQ ID NO: 993373 - RNA, 21 nt, Mycobacterium avium subsp. paratuberculosis
cgcuggcguggcucggcccgc

SEQ ID NO: 993374 - RNA, 19 nt, Mycobacterium avium subsp. paratuberculosis
cgcuggcguugagcacgcg

SEQ ID NO: 993375 - RNA, 17 nt, Mycobacterium avium subsp. paratuberculosis
cgcuggcggggcgugcc

SEQ ID NO: 993376 - RNA, 15 nt, Mycobacterium avium subsp. paratuberculosis
cgcugggcuaacgcu

SEQ ID NO: 993377 - RNA, 17 nt, Mycobacterium avium subsp. paratuberculosis
cgcuggggcccagcucc

SEQ ID NO: 993378 - RNA, 19 nt, Mycobacterium avium subsp. paratuberculosis
cgcuggggcgcaccgccug

SEQ ID NO: 993379 - RNA, 14 nt, Mycobacterium avium subsp. paratuberculosis
cgcugaucaugaag

SEQ ID NO: 993380 - RNA, 15 nt, Mycobacterium avium subsp. paratuberculosis
cgcugauccagcagc

SEQ ID NO: 993381 - RNA, 18 nt, Mycobacterium avium subsp. paratuberculosis
cgcugauccagcagcgcc

SEQ ID NO: 993382 - RNA, 21 nt, Mycobacterium avium subsp. paratuberculosis
cgcugagguagucccgcgccu

SEQ ID NO: 993383 - RNA, 19 nt, Mycobacterium avium subsp. paratuberculosis
cgcugagcgggacgcgcag

SEQ ID NO: 993384 - RNA, 23 nt, Mycobacterium avium subsp. paratuberculosis
cgcugagcggguaaccgcagccg

SEQ ID NO: 993385 - RNA, 17 nt, Mycobacterium avium subsp. paratuberculosis
cgcugagcacccgcccg

SEQ ID NO: 993386 - RNA, 18 nt, Mycobacterium avium subsp. paratuberculosis
cgcugagcacccgcccgg

SEQ ID NO: 993387 - RNA, 18 nt, Mycobacterium avium subsp. paratuberculosis
cgcugagcagguccucga

SEQ ID NO: 993388 - RNA, 18 nt, Mycobacterium avium subsp. paratuberculosis
cgcugacgaugcggccgg

SEQ ID NO: 993389 - RNA, 23 nt, Mycobacterium avium subsp. paratuberculosis
cgcugacgaugcggccggcgggc

SEQ ID NO: 993390 - RNA, 22 nt, Mycobacterium avium subsp. paratuberculosis
cgcugaccucgacacgggccgc

SEQ ID NO: 993391 - RNA, 15 nt, Mycobacterium avium subsp. paratuberculosis
cgcugacgcggcggg

SEQ ID NO: 993392 - RNA, 14 nt, Mycobacterium avium subsp. paratuberculosis
cgcugacccgccgc

SEQ ID NO: 993393 - RNA, 17 nt, Mycobacterium avium subsp. paratuberculosis
cgcugaccgcaggaaag

SEQ ID NO: 993394 - RNA, 13 nt, Mycobacterium avium subsp. paratuberculosis
cgcugaccgccau

SEQ ID NO: 993395 - RNA, 16 nt, Mycobacterium avium subsp. paratuberculosis
cgcugaccgccgcgcu

SEQ ID NO: 993396 - RNA, 23 nt, Mycobacterium avium subsp. paratuberculosis
cgcugcagcuucgugucaccgcc

SEQ ID NO: 993397 - RNA, 21 nt, Mycobacterium avium subsp. paratuberculosis
cgcugcagcggcggccaguug

SEQ ID NO: 993398 - RNA, 13 nt, Mycobacterium avium subsp. paratuberculosis
cgcugcagcugcu

SEQ ID NO: 993399 - RNA, 20 nt, Mycobacterium avium subsp. paratuberculosis
cgcugcagcgagaccucccg

SEQ ID NO: 993400 - RNA, 18 nt, Mycobacterium avium subsp. paratuberculosis
cgcugcaccgcagucuug

SEQ ID NO: 993401 - RNA, 15 nt, Mycobacterium avium subsp. paratuberculosis
cgcugcagcgccgcc

SEQ ID NO: 993402 - RNA, 15 nt, Mycobacterium avium subsp. paratuberculosis
cgcugcaguagccgg

SEQ ID NO: 993403 - RNA, 17 nt, Mycobacterium avium subsp. paratuberculosis
cgcugcaguagccggcc

SEQ ID NO: 993404 - RNA, 22 nt, Mycobacterium avium subsp. paratuberculosis
cgcugcauagucggcccgaucg

SEQ ID NO: 993405 - RNA, 14 nt, Mycobacterium avium subsp. paratuberculosis
cgcugcauccgcag

SEQ ID NO: 993406 - RNA, 13 nt, Mycobacterium avium subsp. paratuberculosis
cgcugcccgccgc

SEQ ID NO: 993407 - RNA, 14 nt, Mycobacterium avium subsp. paratuberculosis
cgcugcccgauggu

SEQ ID NO: 993408 - RNA, 12 nt, Mycobacterium avium subsp. paratuberculosis
cgcugcccgccg

SEQ ID NO: 993409 - RNA, 12 nt, Mycobacterium avium subsp. paratuberculosis
cgcugccccggc

SEQ ID NO: 993410 - RNA, 14 nt, Mycobacterium avium subsp. paratuberculosis
cgcugccccggcga

SEQ ID NO: 993411 - RNA, 21 nt, Mycobacterium avium subsp. paratuberculosis
cgcugccccggcgaggccagg

SEQ ID NO: 993412 - RNA, 19 nt, Mycobacterium avium subsp. paratuberculosis
cgcugccagggccgggcgu

SEQ ID NO: 993413 - RNA, 15 nt, Mycobacterium avium subsp. paratuberculosis
cgcugcccagcgcgg

SEQ ID NO: 993414 - RNA, 19 nt, Mycobacterium avium subsp. paratuberculosis
cgcuggaacagcgggccgg

SEQ ID NO: 993415 - RNA, 23 nt, Mycobacterium avium subsp. paratuberculosis
cgcuggaacagcgggccggcguc

SEQ ID NO: 993416 - RNA, 19 nt, Mycobacterium avium subsp. paratuberculosis
cgcugcuguugcucggggc

SEQ ID NO: 993417 - RNA, 22 nt, Mycobacterium avium subsp. paratuberculosis
cgcugcgguacacguggccgau

SEQ ID NO: 993418 - RNA, 14 nt, Mycobacterium avium subsp. paratuberculosis
cgcugcggcuggga

SEQ ID NO: 993419 - RNA, 21 nt, Mycobacterium avium subsp. paratuberculosis
cgcugcgggcgggccgccagg

SEQ ID NO: 993420 - RNA, 13 nt, Mycobacterium avium subsp. paratuberculosis
cgcugcugggugc

SEQ ID NO: 993421 - RNA, 17 nt, Mycobacterium avium subsp. paratuberculosis
cgcugcugcugcccgcc

SEQ ID NO: 993422 - RNA, 18 nt, Mycobacterium avium subsp. paratuberculosis
cgcugcugcucggccgca

SEQ ID NO: 993423 - RNA, 13 nt, Mycobacterium avium subsp. paratuberculosis
cgcugcgcggccg

SEQ ID NO: 993424 - RNA, 14 nt, Mycobacterium avium subsp. paratuberculosis
cgcugcgcgccgcc

SEQ ID NO: 993425 - RNA, 15 nt, Mycobacterium avium subsp. paratuberculosis
cgcugcgcgccgccc

SEQ ID NO: 993426 - RNA, 22 nt, Mycobacterium avium subsp. paratuberculosis
cgcugcgccgaacgugcacuca

SEQ ID NO: 993427 - RNA, 15 nt, Mycobacterium avium subsp. paratuberculosis
cgcugcgccagccgu

SEQ ID NO: 993428 - RNA, 18 nt, Mycobacterium avium subsp. paratuberculosis
cgcugcgcccgccgccac

SEQ ID NO: 993429 - RNA, 16 nt, Mycobacterium avium subsp. paratuberculosis
cgcugccguccacccg

SEQ ID NO: 993430 - RNA, 19 nt, Mycobacterium avium subsp. paratuberculosis
cgcugccguccacccggcc

SEQ ID NO: 993431 - RNA, 20 nt, Mycobacterium avium subsp. paratuberculosis
cgcugccguccacccggccc

SEQ ID NO: 993432 - RNA, 23 nt, Mycobacterium avium subsp. paratuberculosis
cgcugccguucgccgguaccgcc

SEQ ID NO: 993433 - RNA, 14 nt, Mycobacterium avium subsp. paratuberculosis
cgcugccgcgccgc

SEQ ID NO: 993434 - RNA, 13 nt, Mycobacterium avium subsp. paratuberculosis
cgcugccggcccg

SEQ ID NO: 993435 - RNA, 22 nt, Mycobacterium avium subsp. paratuberculosis
cgcugcccgucgaccuccucga

SEQ ID NO: 993436 - RNA, 16 nt, Mycobacterium avium subsp. paratuberculosis
cgcugcccgugccgca

SEQ ID NO: 993437 - RNA, 14 nt, Mycobacterium avium subsp. paratuberculosis
cgcugccgacgaug

SEQ ID NO: 993438 - RNA, 15 nt, Mycobacterium avium subsp. paratuberculosis
cgcugccgagcaccu

SEQ ID NO: 993439 - RNA, 12 nt, Mycobacterium avium subsp. paratuberculosis
cgcugccgcccc

SEQ ID NO: 993440 - RNA, 14 nt, Mycobacterium avium subsp. paratuberculosis
cgcugccgccgccg

SEQ ID NO: 993441 - RNA, 18 nt, Mycobacterium avium subsp. paratuberculosis
cgcugccgccgccggcgg

SEQ ID NO: 993442 - RNA, 18 nt, Mycobacterium avium subsp. paratuberculosis
cgcugccgccggccucgg

SEQ ID NO: 993443 - RNA, 17 nt, Mycobacterium avium subsp. paratuberculosis
cgcguugaaagccgcga

SEQ ID NO: 993444 - RNA, 14 nt, Mycobacterium avium subsp. paratuberculosis
cgcguucugcacca

SEQ ID NO: 993445 - RNA, 17 nt, Mycobacterium avium subsp. paratuberculosis
cgcguugcagcgccgcg

SEQ ID NO: 993446 - RNA, 19 nt, Mycobacterium avium subsp. paratuberculosis
cgcguugucgaccaccagg

SEQ ID NO: 993447 - RNA, 19 nt, Mycobacterium avium subsp. paratuberculosis
cgcguuggccgaggggucc

SEQ ID NO: 993448 - RNA, 17 nt, Mycobacterium avium subsp. paratuberculosis
cgcguucggcgccaccc

SEQ ID NO: 993449 - RNA, 15 nt, Mycobacterium avium subsp. paratuberculosis
cgcguucgucggcgc

SEQ ID NO: 993450 - RNA, 16 nt, Mycobacterium avium subsp. paratuberculosis
cgcgugacggcggggc

SEQ ID NO: 993451 - RNA, 20 nt, Mycobacterium avium subsp. paratuberculosis
cgcgugcacgaacgcggcca

SEQ ID NO: 993452 - RNA, 15 nt, Mycobacterium avium subsp. paratuberculosis
cgcgucggcccagac

SEQ ID NO: 993453 - RNA, 13 nt, Mycobacterium avium subsp. paratuberculosis
cgcgucggccgca

SEQ ID NO: 993454 - RNA, 22 nt, Mycobacterium avium subsp. paratuberculosis
cgcgucggccagcaccaccaac

SEQ ID NO: 993455 - RNA, 20 nt, Mycobacterium avium subsp. paratuberculosis
cgcgucggaggccaugagcu

SEQ ID NO: 993456 - RNA, 13 nt, Mycobacterium avium subsp. paratuberculosis
cgcgggccagcgu

SEQ ID NO: 993457 - RNA, 15 nt, Mycobacterium avium subsp. paratuberculosis
cgcgggccagcagcc

SEQ ID NO: 993458 - RNA, 16 nt, Mycobacterium avium subsp. paratuberculosis
cgcgggccagccaggu

SEQ ID NO: 993459 - RNA, 13 nt, Mycobacterium avium subsp. paratuberculosis
cgcgggcaagggc

SEQ ID NO: 993460 - RNA, 22 nt, Mycobacterium avium subsp. paratuberculosis
cgcgggcgaugcggcccggcca

SEQ ID NO: 993461 - RNA, 18 nt, Mycobacterium avium subsp. paratuberculosis
cgcgggcgcauaccagcg

SEQ ID NO: 993462 - RNA, 16 nt, Mycobacterium avium subsp. paratuberculosis
cgcgggcccgggccac

SEQ ID NO: 993463 - RNA, 17 nt, Mycobacterium avium subsp. paratuberculosis
cgcgggccggcacccgg

SEQ ID NO: 993464 - RNA, 15 nt, Mycobacterium avium subsp. paratuberculosis
cgcgucaucgggccc

SEQ ID NO: 993465 - RNA, 15 nt, Mycobacterium avium subsp. paratuberculosis
cgcguccaaccgcgg

SEQ ID NO: 993466 - RNA, 16 nt, Mycobacterium avium subsp. paratuberculosis
cgcgucacgucggccu

SEQ ID NO: 993467 - RNA, 16 nt, Mycobacterium avium subsp. paratuberculosis
cgcgggcgcgcgccgc

SEQ ID NO: 993468 - RNA, 18 nt, Mycobacterium avium subsp. paratuberculosis
cgcgggcgcgcgccgccc

SEQ ID NO: 993469 - RNA, 13 nt, Mycobacterium avium subsp. paratuberculosis
cgcgggcgcggcc

SEQ ID NO: 993470 - RNA, 13 nt, Mycobacterium avium subsp. paratuberculosis
cgcgggcgcgccg

SEQ ID NO: 993471 - RNA, 18 nt, Mycobacterium avium subsp. paratuberculosis
cgcgucggagaucaccgg

SEQ ID NO: 993472 - RNA, 23 nt, Mycobacterium avium subsp. paratuberculosis
cgcgucgcgggcccgggccaccc

SEQ ID NO: 993473 - RNA, 21 nt, Mycobacterium avium subsp. paratuberculosis
cgcgucgcugccguagcgcug

SEQ ID NO: 993474 - RNA, 16 nt, Mycobacterium avium subsp. paratuberculosis
cgcgucgccgaccagc

SEQ ID NO: 993475 - RNA, 18 nt, Mycobacterium avium subsp. paratuberculosis
cgcgucgccgaccagcag

SEQ ID NO: 993476 - RNA, 14 nt, Mycobacterium avium subsp. paratuberculosis
cgcgucgcgccagc

SEQ ID NO: 993477 - RNA, 19 nt, Mycobacterium avium subsp. paratuberculosis
cgcgucgcacagcgccgcg

SEQ ID NO: 993478 - RNA, 17 nt, Mycobacterium avium subsp. paratuberculosis
cgcgucgagcgugggcc

SEQ ID NO: 993479 - RNA, 13 nt, Mycobacterium avium subsp. paratuberculosis
cgcguccccgcgc

SEQ ID NO: 993480 - RNA, 20 nt, Mycobacterium avium subsp. paratuberculosis
cgcgucgaccaccgccggcc

SEQ ID NO: 993481 - RNA, 15 nt, Mycobacterium avium subsp. paratuberculosis
cgcgucgaccgccgc

SEQ ID NO: 993482 - RNA, 17 nt, Mycobacterium avium subsp. paratuberculosis
cgcgucgaccgccgcga

SEQ ID NO: 993483 - RNA, 15 nt, Mycobacterium avium subsp. paratuberculosis
cgcgucgagcagcac

SEQ ID NO: 993484 - RNA, 14 nt, Mycobacterium avium subsp. paratuberculosis
cgcguccagcagca

SEQ ID NO: 993485 - RNA, 20 nt, Mycobacterium avium subsp. paratuberculosis
cgcguccagcaugcccacgc

SEQ ID NO: 993486 - RNA, 17 nt, Mycobacterium avium subsp. paratuberculosis
cgcuagcugcgccggcu

SEQ ID NO: 993487 - RNA, 18 nt, Mycobacterium avium subsp. paratuberculosis
cgcuacgcgagcugcuuc

SEQ ID NO: 993488 - RNA, 18 nt, Mycobacterium avium subsp. paratuberculosis
cgcuauaucgcaccggcg

SEQ ID NO: 993489 - RNA, 22 nt, Mycobacterium avium subsp. paratuberculosis
cgcuaguuggugcugggcaccc

SEQ ID NO: 993490 - RNA, 23 nt, Mycobacterium avium subsp. paratuberculosis
cgcuagguuuggccagcaccgcg

SEQ ID NO: 993491 - RNA, 18 nt, Mycobacterium avium subsp. paratuberculosis
cgcuagucgcccagcagc

SEQ ID NO: 993492 - RNA, 17 nt, Mycobacterium avium subsp. paratuberculosis
cgcucaacccgggccgg

SEQ ID NO: 993493 - RNA, 14 nt, Mycobacterium avium subsp. paratuberculosis
cgcucaaccgccca

SEQ ID NO: 993494 - RNA, 16 nt, Mycobacterium avium subsp. paratuberculosis
cgcucaaccgcccagc

SEQ ID NO: 993495 - RNA, 17 nt, Mycobacterium avium subsp. paratuberculosis
cgcucaaggcaacucag

SEQ ID NO: 993496 - RNA, 19 nt, Mycobacterium avium subsp. paratuberculosis
cgcucagagcugcaccggg

SEQ ID NO: 993497 - RNA, 23 nt, Mycobacterium avium subsp. paratuberculosis
cgcucacucgucuugcagccggg

SEQ ID NO: 993498 - RNA, 14 nt, Mycobacterium avium subsp. paratuberculosis
cgcucacccggccc

SEQ ID NO: 993499 - RNA, 13 nt, Mycobacterium avium subsp. paratuberculosis
cgcucaccgccga

SEQ ID NO: 993500 - RNA, 15 nt, Mycobacterium avium subsp. paratuberculosis
cgcucaccgccgagc

SEQ ID NO: 993501 - RNA, 13 nt, Mycobacterium avium subsp. paratuberculosis
cgcucaccggcgu

SEQ ID NO: 993502 - RNA, 19 nt, Mycobacterium avium subsp. paratuberculosis
cgcucagcgggcggccagc

SEQ ID NO: 993503 - RNA, 14 nt, Mycobacterium avium subsp. paratuberculosis
cgcucagccccagc

SEQ ID NO: 993504 - RNA, 20 nt, Mycobacterium avium subsp. paratuberculosis
cgcucagcgauugcggccgc

SEQ ID NO: 993505 - RNA, 21 nt, Mycobacterium avium subsp. paratuberculosis
cgcucagcgauugcggccgcc

SEQ ID NO: 993506 - RNA, 19 nt, Mycobacterium avium subsp. paratuberculosis
cgcucaggucggccgcggc

SEQ ID NO: 993507 - RNA, 16 nt, Mycobacterium avium subsp. paratuberculosis
cgcuccagcgggcggc

SEQ ID NO: 993508 - RNA, 12 nt, Mycobacterium avium subsp. paratuberculosis
cgcuccagccac

SEQ ID NO: 993509 - RNA, 16 nt, Mycobacterium avium subsp. paratuberculosis
cgcuccaccagcgcgg

SEQ ID NO: 993510 - RNA, 17 nt, Mycobacterium avium subsp. paratuberculosis
cgcuccacaucugccgg

SEQ ID NO: 993511 - RNA, 21 nt, Mycobacterium avium subsp. paratuberculosis
cgcucgaggggcuuggcgacg

SEQ ID NO: 993512 - RNA, 22 nt, Mycobacterium avium subsp. paratuberculosis
cgcucgccaccccgcgccacgc

SEQ ID NO: 993513 - RNA, 14 nt, Mycobacterium avium subsp. paratuberculosis
cgcucgccagaccg

SEQ ID NO: 993514 - RNA, 19 nt, Mycobacterium avium subsp. paratuberculosis
cgcucgacgcgcacccggg

SEQ ID NO: 993515 - RNA, 17 nt, Mycobacterium avium subsp. paratuberculosis
cgcucgacggccggcgu

SEQ ID NO: 993516 - RNA, 12 nt, Mycobacterium avium subsp. paratuberculosis
cgcucgaccccu

SEQ ID NO: 993517 - RNA, 14 nt, Mycobacterium avium subsp. paratuberculosis
cgcucgaccccucg

SEQ ID NO: 993518 - RNA, 16 nt, Mycobacterium avium subsp. paratuberculosis
cgcucgaacacccggc

SEQ ID NO: 993519 - RNA, 12 nt, Mycobacterium avium subsp. paratuberculosis
cgcuccucguug

SEQ ID NO: 993520 - RNA, 14 nt, Mycobacterium avium subsp. paratuberculosis
cgcuccugcagcgc

SEQ ID NO: 993521 - RNA, 19 nt, Mycobacterium avium subsp. paratuberculosis
cgcuccugcagcgcggcga

SEQ ID NO: 993522 - RNA, 13 nt, Mycobacterium avium subsp. paratuberculosis
cgcuccugcaggc

SEQ ID NO: 993523 - RNA, 15 nt, Mycobacterium avium subsp. paratuberculosis
cgcucccggcgcagc

SEQ ID NO: 993524 - RNA, 15 nt, Mycobacterium avium subsp. paratuberculosis
cgcucccggcgccgc

SEQ ID NO: 993525 - RNA, 20 nt, Mycobacterium avium subsp. paratuberculosis
cgcucccgguagagcggcac

SEQ ID NO: 993526 - RNA, 14 nt, Mycobacterium avium subsp. paratuberculosis
cgcuccccgauccg

SEQ ID NO: 993527 - RNA, 13 nt, Mycobacterium avium subsp. paratuberculosis
cgcuccggcccga

SEQ ID NO: 993528 - RNA, 13 nt, Mycobacterium avium subsp. paratuberculosis
cgcuccgcggcgg

SEQ ID NO: 993529 - RNA, 21 nt, Mycobacterium avium subsp. paratuberculosis
cgcuccggcggacccagcucc

SEQ ID NO: 993530 - RNA, 18 nt, Mycobacterium avium subsp. paratuberculosis
cgcuccuccucgcgccgc

SEQ ID NO: 993531 - RNA, 19 nt, Mycobacterium avium subsp. paratuberculosis
cgcuccuccucgcgccgcc

SEQ ID NO: 993532 - RNA, 18 nt, Mycobacterium avium subsp. paratuberculosis
cgcugaagugcagcgcau

SEQ ID NO: 993533 - RNA, 13 nt, Mycobacterium avium subsp. paratuberculosis
cgcugaaauccgg

SEQ ID NO: 993534 - RNA, 15 nt, Mycobacterium avium subsp. paratuberculosis
cgcugaagaucgaaa

SEQ ID NO: 993535 - RNA, 16 nt, Mycobacterium avium subsp. paratuberculosis
cgcugaagcccaccgc

SEQ ID NO: 993536 - RNA, 17 nt, Mycobacterium avium subsp. paratuberculosis
cgcugaagcccaccgcc

SEQ ID NO: 993537 - RNA, 13 nt, Mycobacterium avium subsp. paratuberculosis
cgcucgcgggccc

SEQ ID NO: 993538 - RNA, 21 nt, Mycobacterium avium subsp. paratuberculosis
cgcucgcggugcgcgcgcgcu

SEQ ID NO: 993539 - RNA, 22 nt, Mycobacterium avium subsp. paratuberculosis
cgcucgcgguugggccggcgcc

SEQ ID NO: 993540 - RNA, 20 nt, Mycobacterium avium subsp. paratuberculosis
cgcucggccagcgcgccgca

SEQ ID NO: 993541 - RNA, 21 nt, Mycobacterium avium subsp. paratuberculosis
cgcucggccagcgcgccgcac

SEQ ID NO: 993542 - RNA, 21 nt, Mycobacterium avium subsp. paratuberculosis
cgcucggaguucgcccgcagc

SEQ ID NO: 993543 - RNA, 22 nt, Mycobacterium avium subsp. paratuberculosis
cgcucggaaugaacugccgcgg

SEQ ID NO: 993544 - RNA, 17 nt, Mycobacterium avium subsp. paratuberculosis
cgcucgccgcgcggccc

SEQ ID NO: 993545 - RNA, 19 nt, Mycobacterium avium subsp. paratuberculosis
cgcucgccgcgcggcccgc

SEQ ID NO: 993546 - RNA, 15 nt, Mycobacterium avium subsp. paratuberculosis
cgcucgccggcggcc

SEQ ID NO: 993547 - RNA, 18 nt, Mycobacterium avium subsp. paratuberculosis
cgcucgccggcggccgcc

SEQ ID NO: 993548 - RNA, 13 nt, Mycobacterium avium subsp. paratuberculosis
cgcucgccgucgg

SEQ ID NO: 993549 - RNA, 22 nt, Mycobacterium avium subsp. paratuberculosis
cgcucgccgucggccagcagcg

SEQ ID NO: 993550 - RNA, 12 nt, Mycobacterium avium subsp. paratuberculosis
cgcucgcgcacc

SEQ ID NO: 993551 - RNA, 15 nt, Mycobacterium avium subsp. paratuberculosis
cgcucggucgccacg

SEQ ID NO: 993552 - RNA, 20 nt, Mycobacterium avium subsp. paratuberculosis
cgcucguaguuggggccggc

SEQ ID NO: 993553 - RNA, 21 nt, Mycobacterium avium subsp. paratuberculosis
cgcucguaguuggggccggcc

SEQ ID NO: 993554 - RNA, 20 nt, Mycobacterium avium subsp. paratuberculosis
cgcucgucggcgcgggccag

SEQ ID NO: 993555 - RNA, 21 nt, Mycobacterium avium subsp. paratuberculosis
cgcucgucggcgcgggccagc

SEQ ID NO: 993556 - RNA, 22 nt, Mycobacterium avium subsp. paratuberculosis
cgcucgucggcgcgggccagca

SEQ ID NO: 993557 - RNA, 14 nt, Mycobacterium avium subsp. paratuberculosis
cgcucggggccggu

SEQ ID NO: 993558 - RNA, 19 nt, Mycobacterium avium subsp. paratuberculosis
cgcucgggggugcccggcc

SEQ ID NO: 993559 - RNA, 14 nt, Mycobacterium avium subsp. paratuberculosis
cgcucgggccggcg

SEQ ID NO: 993560 - RNA, 15 nt, Mycobacterium avium subsp. paratuberculosis
cgcucggccagcagc

SEQ ID NO: 993561 - RNA, 22 nt, Mycobacterium avium subsp. paratuberculosis
cgcucggccggguuguccuggc

SEQ ID NO: 993562 - RNA, 12 nt, Mycobacterium avium subsp. paratuberculosis
cgcucggccuca

SEQ ID NO: 993563 - RNA, 15 nt, Mycobacterium avium subsp. paratuberculosis
cgcucggcgcgacgu

SEQ ID NO: 993564 - RNA, 22 nt, Mycobacterium avium subsp. paratuberculosis
cgcucggcgcgcggggccggcg

SEQ ID NO: 993565 - RNA, 14 nt, Mycobacterium avium subsp. paratuberculosis
cgcucggcgcgucg

SEQ ID NO: 993566 - RNA, 14 nt, Mycobacterium avium subsp. paratuberculosis
cgcucggcgacgaa

SEQ ID NO: 993567 - RNA, 20 nt, Mycobacterium avium subsp. paratuberculosis
cgcucggcggcgcgcaggcg

SEQ ID NO: 993568 - RNA, 15 nt, Mycobacterium avium subsp. paratuberculosis
cggcaugaccggcca

SEQ ID NO: 993569 - RNA, 18 nt, Mycobacterium avium subsp. paratuberculosis
cggcaugaccggccagca

SEQ ID NO: 993570 - RNA, 22 nt, Mycobacterium avium subsp. paratuberculosis
cggcauggcgaacacgucggcc

SEQ ID NO: 993571 - RNA, 14 nt, Mycobacterium avium subsp. paratuberculosis
cggcaugccgggcc

SEQ ID NO: 993572 - RNA, 17 nt, Mycobacterium avium subsp. paratuberculosis
cggcaugccgggccagc

SEQ ID NO: 993573 - RNA, 17 nt, Mycobacterium avium subsp. paratuberculosis
cggccaccagcgcggcc

SEQ ID NO: 993574 - RNA, 17 nt, Mycobacterium avium subsp. paratuberculosis
cggccaauuccucagcc

SEQ ID NO: 993575 - RNA, 21 nt, Mycobacterium avium subsp. paratuberculosis
cggccaauuccucagcccggc

SEQ ID NO: 993576 - RNA, 15 nt, Mycobacterium avium subsp. paratuberculosis
cggccaccagcagcg

SEQ ID NO: 993577 - RNA, 22 nt, Mycobacterium avium subsp. paratuberculosis
cggccaccagccggccggccga

SEQ ID NO: 993578 - RNA, 22 nt, Mycobacterium avium subsp. paratuberculosis
cggccaaugaaccauccauuuc

SEQ ID NO: 993579 - RNA, 22 nt, Mycobacterium avium subsp. paratuberculosis
cggccaaucccaccaugagcag

SEQ ID NO: 993580 - RNA, 15 nt, Mycobacterium avium subsp. paratuberculosis
cggccaacccgggcg

SEQ ID NO: 993581 - RNA, 17 nt, Mycobacterium avium subsp. paratuberculosis
cggccaacccgggcgcc

SEQ ID NO: 993582 - RNA, 16 nt, Mycobacterium avium subsp. paratuberculosis
cggccaaccgcccggc

SEQ ID NO: 993583 - RNA, 14 nt, Mycobacterium avium subsp. paratuberculosis
cggcauagcgccgc

SEQ ID NO: 993584 - RNA, 21 nt, Mycobacterium avium subsp. paratuberculosis
cggcaucccuggugaccgacg

SEQ ID NO: 993585 - RNA, 23 nt, Mycobacterium avium subsp. paratuberculosis
cggcaucagcgagacgaccagga

SEQ ID NO: 993586 - RNA, 17 nt, Mycobacterium avium subsp. paratuberculosis
cggcaucgaccgcccgc

SEQ ID NO: 993587 - RNA, 18 nt, Mycobacterium avium subsp. paratuberculosis
cggcaucgccgccaaggg

SEQ ID NO: 993588 - RNA, 14 nt, Mycobacterium avium subsp. paratuberculosis
cggcaucgcgcgcg

SEQ ID NO: 993589 - RNA, 20 nt, Mycobacterium avium subsp. paratuberculosis
cggcaucgcgcgcggcgacg

SEQ ID NO: 993590 - RNA, 21 nt, Mycobacterium avium subsp. paratuberculosis
cggcaucgcgcgcggcgacgg

SEQ ID NO: 993591 - RNA, 14 nt, Mycobacterium avium subsp. paratuberculosis
cggcaucggcgccc

SEQ ID NO: 993592 - RNA, 23 nt, Mycobacterium avium subsp. paratuberculosis
cggcaucgucggggacgaagacc

SEQ ID NO: 993593 - RNA, 22 nt, Mycobacterium avium subsp. paratuberculosis
cggcaucgguggcaccccgcgc

SEQ ID NO: 993594 - RNA, 19 nt, Mycobacterium avium subsp. paratuberculosis
cggccagcgucuccggcgg

SEQ ID NO: 993595 - RNA, 21 nt, Mycobacterium avium subsp. paratuberculosis
cggccagcgucuccggcgggc

SEQ ID NO: 993596 - RNA, 19 nt, Mycobacterium avium subsp. paratuberculosis
cggccagcgugaacaccgc

SEQ ID NO: 993597 - RNA, 20 nt, Mycobacterium avium subsp. paratuberculosis
cggccagcgugaacaccgcg

SEQ ID NO: 993598 - RNA, 22 nt, Mycobacterium avium subsp. paratuberculosis
cggccagcgugaacaccgcguu

SEQ ID NO: 993599 - RNA, 14 nt, Mycobacterium avium subsp. paratuberculosis
cggccagcggcauc

SEQ ID NO: 993600 - RNA, 14 nt, Mycobacterium avium subsp. paratuberculosis
cggccagcggcagc

SEQ ID NO: 993601 - RNA, 14 nt, Mycobacterium avium subsp. paratuberculosis
cggccagccggggg

SEQ ID NO: 993602 - RNA, 15 nt, Mycobacterium avium subsp. paratuberculosis
cggccagcgcggugu

SEQ ID NO: 993603 - RNA, 20 nt, Mycobacterium avium subsp. paratuberculosis
cggccagcgcggugugcggc

SEQ ID NO: 993604 - RNA, 16 nt, Mycobacterium avium subsp. paratuberculosis
cggccagccggccgcu

SEQ ID NO: 993605 - RNA, 13 nt, Mycobacterium avium subsp. paratuberculosis
cggccagccccac

SEQ ID NO: 993606 - RNA, 18 nt, Mycobacterium avium subsp. paratuberculosis
cggccagccgcucccggc

SEQ ID NO: 993607 - RNA, 14 nt, Mycobacterium avium subsp. paratuberculosis
cggccagccccggg

SEQ ID NO: 993608 - RNA, 15 nt, Mycobacterium avium subsp. paratuberculosis
cggccagcucggccc

SEQ ID NO: 993609 - RNA, 22 nt, Mycobacterium avium subsp. paratuberculosis
cggccagcugauagccgcccug

SEQ ID NO: 993610 - RNA, 14 nt, Mycobacterium avium subsp. paratuberculosis
cggccagcugcggg

SEQ ID NO: 993611 - RNA, 15 nt, Mycobacterium avium subsp. paratuberculosis
cggccagcguggcgc

SEQ ID NO: 993612 - RNA, 18 nt, Mycobacterium avium subsp. paratuberculosis
cggccagcguggcgcgcc

SEQ ID NO: 993613 - RNA, 21 nt, Mycobacterium avium subsp. paratuberculosis
cggccagcguggcgcgccccg

SEQ ID NO: 993614 - RNA, 15 nt, Mycobacterium avium subsp. paratuberculosis
cggccagcucccggg

SEQ ID NO: 993615 - RNA, 21 nt, Mycobacterium avium subsp. paratuberculosis
cggccagcucccgggcggcgc

SEQ ID NO: 993616 - RNA, 17 nt, Mycobacterium avium subsp. paratuberculosis
cggccagcucgagcauc

SEQ ID NO: 993617 - RNA, 12 nt, Mycobacterium avium subsp. paratuberculosis
cggccaccccgc

SEQ ID NO: 993618 - RNA, 23 nt, Mycobacterium avium subsp. paratuberculosis
cggccaccccgcagaacaccagc

SEQ ID NO: 993619 - RNA, 14 nt, Mycobacterium avium subsp. paratuberculosis
cggccaccagggcg

SEQ ID NO: 993620 - RNA, 15 nt, Mycobacterium avium subsp. paratuberculosis
cggccaccaugggcg

SEQ ID NO: 993621 - RNA, 18 nt, Mycobacterium avium subsp. paratuberculosis
cggccagcagcaccaggg

SEQ ID NO: 993622 - RNA, 16 nt, Mycobacterium avium subsp. paratuberculosis
cggccaccgccccagc

SEQ ID NO: 993623 - RNA, 21 nt, Mycobacterium avium subsp. paratuberculosis
cggccaccgccccagccgacc

SEQ ID NO: 993624 - RNA, 17 nt, Mycobacterium avium subsp. paratuberculosis
cggccaccgccgccagc

SEQ ID NO: 993625 - RNA, 18 nt, Mycobacterium avium subsp. paratuberculosis
cggccagcccgcggcagc

SEQ ID NO: 993626 - RNA, 16 nt, Mycobacterium avium subsp. paratuberculosis
cggccagcccgucggg

SEQ ID NO: 993627 - RNA, 15 nt, Mycobacterium avium subsp. paratuberculosis
cggccagccagccgc

SEQ ID NO: 993628 - RNA, 17 nt, Mycobacterium avium subsp. paratuberculosis
cggccagccagccgccc

SEQ ID NO: 993629 - RNA, 18 nt, Mycobacterium avium subsp. paratuberculosis
cggccagccagccgccca

SEQ ID NO: 993630 - RNA, 12 nt, Mycobacterium avium subsp. paratuberculosis
cggccagcagcc

SEQ ID NO: 993631 - RNA, 16 nt, Mycobacterium avium subsp. paratuberculosis
cggccagccacgccga

SEQ ID NO: 993632 - RNA, 14 nt, Mycobacterium avium subsp. paratuberculosis
cggccagcaggucg

SEQ ID NO: 993633 - RNA, 20 nt, Mycobacterium avium subsp. paratuberculosis
cggccagcagugccaacacg

SEQ ID NO: 993634 - RNA, 21 nt, Mycobacterium avium subsp. paratuberculosis
cggccagcagcagguagcggc

SEQ ID NO: 993635 - RNA, 20 nt, Mycobacterium avium subsp. paratuberculosis
cggccaguugacguugaucg

SEQ ID NO: 993636 - RNA, 23 nt, Mycobacterium avium subsp. paratuberculosis
cggccaguugacguugaucgcgc

SEQ ID NO: 993637 - RNA, 19 nt, Mycobacterium avium subsp. paratuberculosis
cggccagggcucgugcagc

SEQ ID NO: 993638 - RNA, 16 nt, Mycobacterium avium subsp. paratuberculosis
cggccaggcgcccagc

SEQ ID NO: 993639 - RNA, 19 nt, Mycobacterium avium subsp. paratuberculosis
cggccaggcgcccagcacc

SEQ ID NO: 993640 - RNA, 20 nt, Mycobacterium avium subsp. paratuberculosis
cggccaggaugaacacccgg

SEQ ID NO: 993641 - RNA, 20 nt, Mycobacterium avium subsp. paratuberculosis
cggccaggcacagcagggca

SEQ ID NO: 993642 - RNA, 14 nt, Mycobacterium avium subsp. paratuberculosis
cggccaucgccuga

SEQ ID NO: 993643 - RNA, 20 nt, Mycobacterium avium subsp. paratuberculosis
cggccaucucgugcccgggc

SEQ ID NO: 993644 - RNA, 22 nt, Mycobacterium avium subsp. paratuberculosis
cggccaucucgugcccgggccc

SEQ ID NO: 993645 - RNA, 19 nt, Mycobacterium avium subsp. paratuberculosis
cggccauggucgcggccgu

SEQ ID NO: 993646 - RNA, 17 nt, Mycobacterium avium subsp. paratuberculosis
cggccaucgccgccauc

SEQ ID NO: 993647 - RNA, 19 nt, Mycobacterium avium subsp. paratuberculosis
cggccaucgccgcgguggc

SEQ ID NO: 993648 - RNA, 18 nt, Mycobacterium avium subsp. paratuberculosis
cggccaucagccgccguc

SEQ ID NO: 993649 - RNA, 21 nt, Mycobacterium avium subsp. paratuberculosis
cggccagggcggcgccggcac

SEQ ID NO: 993650 - RNA, 17 nt, Mycobacterium avium subsp. paratuberculosis
cgcuugccgaaguccuu

SEQ ID NO: 993651 - RNA, 15 nt, Mycobacterium avium subsp. paratuberculosis
cgcuugcgccgcagc

SEQ ID NO: 993652 - RNA, 14 nt, Mycobacterium avium subsp. paratuberculosis
cgcuugccagccgg

SEQ ID NO: 993653 - RNA, 18 nt, Mycobacterium avium subsp. paratuberculosis
cgcuugacggccgggccc

SEQ ID NO: 993654 - RNA, 13 nt, Mycobacterium avium subsp. paratuberculosis
cgcuugaccucgc

SEQ ID NO: 993655 - RNA, 14 nt, Mycobacterium avium subsp. paratuberculosis
cgcuuggcgcgccg

SEQ ID NO: 993656 - RNA, 17 nt, Mycobacterium avium subsp. paratuberculosis
cggcacgccgaccaccc

SEQ ID NO: 993657 - RNA, 18 nt, Mycobacterium avium subsp. paratuberculosis
cggcacgccgcucgucgg

SEQ ID NO: 993658 - RNA, 20 nt, Mycobacterium avium subsp. paratuberculosis
cggcacgccgcucgucgggc

SEQ ID NO: 993659 - RNA, 18 nt, Mycobacterium avium subsp. paratuberculosis
cggcacgaacgcgacgau

SEQ ID NO: 993660 - RNA, 19 nt, Mycobacterium avium subsp. paratuberculosis
cggcacgauggcgcggcgc

SEQ ID NO: 993661 - RNA, 19 nt, Mycobacterium avium subsp. paratuberculosis
cggcacgaucggcagcgcc

SEQ ID NO: 993662 - RNA, 17 nt, Mycobacterium avium subsp. paratuberculosis
cggcagccagguacucc

SEQ ID NO: 993663 - RNA, 16 nt, Mycobacterium avium subsp. paratuberculosis
cggcagccgcucggau

SEQ ID NO: 993664 - RNA, 16 nt, Mycobacterium avium subsp. paratuberculosis
cggcagccggccaccu

SEQ ID NO: 993665 - RNA, 12 nt, Mycobacterium avium subsp. paratuberculosis
cggcagccccgu

SEQ ID NO: 993666 - RNA, 15 nt, Mycobacterium avium subsp. paratuberculosis
cggcagccccgucgg

SEQ ID NO: 993667 - RNA, 20 nt, Mycobacterium avium subsp. paratuberculosis
cggcagcgacagcgcgucgg

SEQ ID NO: 993668 - RNA, 22 nt, Mycobacterium avium subsp. paratuberculosis
cggcagcgacagcgcgucggcc

SEQ ID NO: 993669 - RNA, 14 nt, Mycobacterium avium subsp. paratuberculosis
cggcagccgcgccc

SEQ ID NO: 993670 - RNA, 15 nt, Mycobacterium avium subsp. paratuberculosis
cggcagccgcgccca

SEQ ID NO: 993671 - RNA, 17 nt, Mycobacterium avium subsp. paratuberculosis
cggcagccacggcagcu

SEQ ID NO: 993672 - RNA, 15 nt, Mycobacterium avium subsp. paratuberculosis
cggcagcgaggcgcg

SEQ ID NO: 993673 - RNA, 16 nt, Mycobacterium avium subsp. paratuberculosis
cggcagacccagcagc

SEQ ID NO: 993674 - RNA, 22 nt, Mycobacterium avium subsp. paratuberculosis
cggcagacccagcagcggccgg

SEQ ID NO: 993675 - RNA, 21 nt, Mycobacterium avium subsp. paratuberculosis
cggcagacgaauucggagacc

SEQ ID NO: 993676 - RNA, 17 nt, Mycobacterium avium subsp. paratuberculosis
cggcacgggcaccgacg

SEQ ID NO: 993677 - RNA, 16 nt, Mycobacterium avium subsp. paratuberculosis
cggcacggccggccgg

SEQ ID NO: 993678 - RNA, 15 nt, Mycobacterium avium subsp. paratuberculosis
cggcacggcaccgcg

SEQ ID NO: 993679 - RNA, 23 nt, Mycobacterium avium subsp. paratuberculosis
cggcacgcugcgccagccgucgc

SEQ ID NO: 993680 - RNA, 14 nt, Mycobacterium avium subsp. paratuberculosis
cggcacgcgcgccg

SEQ ID NO: 993681 - RNA, 15 nt, Mycobacterium avium subsp. paratuberculosis
cggcauaacgcaacc

SEQ ID NO: 993682 - RNA, 18 nt, Mycobacterium avium subsp. paratuberculosis
cggcagugagggaacgcc

SEQ ID NO: 993683 - RNA, 19 nt, Mycobacterium avium subsp. paratuberculosis
cggcaguacgcgccggccu

SEQ ID NO: 993684 - RNA, 15 nt, Mycobacterium avium subsp. paratuberculosis
cggcagucgcagcag

SEQ ID NO: 993685 - RNA, 17 nt, Mycobacterium avium subsp. paratuberculosis
cggcaggucgucgucgc

SEQ ID NO: 993686 - RNA, 20 nt, Mycobacterium avium subsp. paratuberculosis
cggcagguggauugucggcc

SEQ ID NO: 993687 - RNA, 19 nt, Mycobacterium avium subsp. paratuberculosis
cggcaggucggccagcgcc

SEQ ID NO: 993688 - RNA, 23 nt, Mycobacterium avium subsp. paratuberculosis
cggcaggucggccagcgccgccc

SEQ ID NO: 993689 - RNA, 14 nt, Mycobacterium avium subsp. paratuberculosis
cggcaggucggcgg

SEQ ID NO: 993690 - RNA, 14 nt, Mycobacterium avium subsp. paratuberculosis
cggcagguaggcgc

SEQ ID NO: 993691 - RNA, 13 nt, Mycobacterium avium subsp. paratuberculosis
cggcagggccagc

SEQ ID NO: 993692 - RNA, 18 nt, Mycobacterium avium subsp. paratuberculosis
cggcagggccagcaccau

SEQ ID NO: 993693 - RNA, 17 nt, Mycobacterium avium subsp. paratuberculosis
cggcaggcucagcagca

SEQ ID NO: 993694 - RNA, 20 nt, Mycobacterium avium subsp. paratuberculosis
cggcaggcucagcagcaccg

SEQ ID NO: 993695 - RNA, 14 nt, Mycobacterium avium subsp. paratuberculosis
cggcagggccaccg

SEQ ID NO: 993696 - RNA, 16 nt, Mycobacterium avium subsp. paratuberculosis
cggcagggccaggccg

SEQ ID NO: 993697 - RNA, 19 nt, Mycobacterium avium subsp. paratuberculosis
cggcagcgcgauccggggg

SEQ ID NO: 993698 - RNA, 17 nt, Mycobacterium avium subsp. paratuberculosis
cggcagcggcugcugca

SEQ ID NO: 993699 - RNA, 22 nt, Mycobacterium avium subsp. paratuberculosis
cggcagcggcugcugcagcgcc

SEQ ID NO: 993700 - RNA, 23 nt, Mycobacterium avium subsp. paratuberculosis
cggcagcggcugcugcagcgccc

SEQ ID NO: 993701 - RNA, 12 nt, Mycobacterium avium subsp. paratuberculosis
cggcagcgcgcc

SEQ ID NO: 993702 - RNA, 20 nt, Mycobacterium avium subsp. paratuberculosis
cggcagcgcgcccugaggcc

SEQ ID NO: 993703 - RNA, 16 nt, Mycobacterium avium subsp. paratuberculosis
cggcagcgccaccagc

SEQ ID NO: 993704 - RNA, 16 nt, Mycobacterium avium subsp. paratuberculosis
cggcagcgccagcggg

SEQ ID NO: 993705 - RNA, 13 nt, Mycobacterium avium subsp. paratuberculosis
cggcagcggugcc

SEQ ID NO: 993706 - RNA, 17 nt, Mycobacterium avium subsp. paratuberculosis
cggcagcggugccgccc

SEQ ID NO: 993707 - RNA, 19 nt, Mycobacterium avium subsp. paratuberculosis
cggcagcggugccgcccgg

SEQ ID NO: 993708 - RNA, 14 nt, Mycobacterium avium subsp. paratuberculosis
cggcagcgucgggc

SEQ ID NO: 993709 - RNA, 16 nt, Mycobacterium avium subsp. paratuberculosis
cggcagcucggcggcc

SEQ ID NO: 993710 - RNA, 17 nt, Mycobacterium avium subsp. paratuberculosis
cggcagcucggcggccc

SEQ ID NO: 993711 - RNA, 14 nt, Mycobacterium avium subsp. paratuberculosis
cggcaggaaccggg

SEQ ID NO: 993712 - RNA, 19 nt, Mycobacterium avium subsp. paratuberculosis
cggcaggauccggacgacc

SEQ ID NO: 993713 - RNA, 21 nt, Mycobacterium avium subsp. paratuberculosis
cggcaggauccggucgaucac

SEQ ID NO: 993714 - RNA, 17 nt, Mycobacterium avium subsp. paratuberculosis
cggcaggacgggggccg

SEQ ID NO: 993715 - RNA, 13 nt, Mycobacterium avium subsp. paratuberculosis
cggcaggcggccc

SEQ ID NO: 993716 - RNA, 15 nt, Mycobacterium avium subsp. paratuberculosis
cggcaggcggcccgc

SEQ ID NO: 993717 - RNA, 15 nt, Mycobacterium avium subsp. paratuberculosis
cggcaggccgcccga

SEQ ID NO: 993718 - RNA, 12 nt, Mycobacterium avium subsp. paratuberculosis
cggcaggcgccc

SEQ ID NO: 993719 - RNA, 14 nt, Mycobacterium avium subsp. paratuberculosis
cggcaggcgcccca

SEQ ID NO: 993720 - RNA, 17 nt, Mycobacterium avium subsp. paratuberculosis
cggcgagauuggccucg

SEQ ID NO: 993721 - RNA, 21 nt, Mycobacterium avium subsp. paratuberculosis
cggcgagauuggccucggcgc

SEQ ID NO: 993722 - RNA, 12 nt, Mycobacterium avium subsp. paratuberculosis
cggcgagcagcc

SEQ ID NO: 993723 - RNA, 21 nt, Mycobacterium avium subsp. paratuberculosis
cggcgagcagccgcgccgggc

SEQ ID NO: 993724 - RNA, 14 nt, Mycobacterium avium subsp. paratuberculosis
cggcgaccgcgcgc

SEQ ID NO: 993725 - RNA, 13 nt, Mycobacterium avium subsp. paratuberculosis
cggcgaccgccgg

SEQ ID NO: 993726 - RNA, 17 nt, Mycobacterium avium subsp. paratuberculosis
cggcgaccgcgcgcggc

SEQ ID NO: 993727 - RNA, 13 nt, Mycobacterium avium subsp. paratuberculosis
cggcgaccggggc

SEQ ID NO: 993728 - RNA, 17 nt, Mycobacterium avium subsp. paratuberculosis
cggcgacgguggcgccc

SEQ ID NO: 993729 - RNA, 23 nt, Mycobacterium avium subsp. paratuberculosis
cggcgacgguggcgggccgccgg

SEQ ID NO: 993730 - RNA, 20 nt, Mycobacterium avium subsp. paratuberculosis
cggcgacuccagcagcgcca

SEQ ID NO: 993731 - RNA, 22 nt, Mycobacterium avium subsp. paratuberculosis
cggcgacuccagcagcgccagc

SEQ ID NO: 993732 - RNA, 21 nt, Mycobacterium avium subsp. paratuberculosis
cggcgacgucgugcacgccgu

SEQ ID NO: 993733 - RNA, 12 nt, Mycobacterium avium subsp. paratuberculosis
cggcgacgugau

SEQ ID NO: 993734 - RNA, 14 nt, Mycobacterium avium subsp. paratuberculosis
cggcgaccacccuc

SEQ ID NO: 993735 - RNA, 22 nt, Mycobacterium avium subsp. paratuberculosis
cggcgacaucgccgagacgauc

SEQ ID NO: 993736 - RNA, 16 nt, Mycobacterium avium subsp. paratuberculosis
cggcgacaugcgcagc

SEQ ID NO: 993737 - RNA, 20 nt, Mycobacterium avium subsp. paratuberculosis
cggcgacaugcgcagcgccc

SEQ ID NO: 993738 - RNA, 20 nt, Mycobacterium avium subsp. paratuberculosis
cggcgacauuggccgcgcgc

SEQ ID NO: 993739 - RNA, 22 nt, Mycobacterium avium subsp. paratuberculosis
cggcgacauuggccgcgcgcag

SEQ ID NO: 993740 - RNA, 12 nt, Mycobacterium avium subsp. paratuberculosis
cggcgaccacca

SEQ ID NO: 993741 - RNA, 13 nt, Mycobacterium avium subsp. paratuberculosis
cggcgaccaccac

SEQ ID NO: 993742 - RNA, 14 nt, Mycobacterium avium subsp. paratuberculosis
cggcgaccaccacc

SEQ ID NO: 993743 - RNA, 17 nt, Mycobacterium avium subsp. paratuberculosis
cggcgaccaccagccgc

SEQ ID NO: 993744 - RNA, 21 nt, Mycobacterium avium subsp. paratuberculosis
cggcgacccgcuucgcccggc

SEQ ID NO: 993745 - RNA, 13 nt, Mycobacterium avium subsp. paratuberculosis
cggcgaccagccc

SEQ ID NO: 993746 - RNA, 20 nt, Mycobacterium avium subsp. paratuberculosis
cggcgaaccgggacagccgc

SEQ ID NO: 993747 - RNA, 21 nt, Mycobacterium avium subsp. paratuberculosis
cggcgaacgcgucccgggccu

SEQ ID NO: 993748 - RNA, 14 nt, Mycobacterium avium subsp. paratuberculosis
cggcgaaccagcau

SEQ ID NO: 993749 - RNA, 17 nt, Mycobacterium avium subsp. paratuberculosis
cggcgaacaccagcacc

SEQ ID NO: 993750 - RNA, 18 nt, Mycobacterium avium subsp. paratuberculosis
cggcgaacaccagcaccc

SEQ ID NO: 993751 - RNA, 16 nt, Mycobacterium avium subsp. paratuberculosis
cggcgaaacacagcag

SEQ ID NO: 993752 - RNA, 18 nt, Mycobacterium avium subsp. paratuberculosis
cggcgaaacacagcagca

SEQ ID NO: 993753 - RNA, 19 nt, Mycobacterium avium subsp. paratuberculosis
cggcgaaaacgccugcgcc

SEQ ID NO: 993754 - RNA, 23 nt, Mycobacterium avium subsp. paratuberculosis
cggccugccggaugccgcgcggc

SEQ ID NO: 993755 - RNA, 15 nt, Mycobacterium avium subsp. paratuberculosis
cggccugccggccgc

SEQ ID NO: 993756 - RNA, 15 nt, Mycobacterium avium subsp. paratuberculosis
cggccugcccgccgc

SEQ ID NO: 993757 - RNA, 11 nt, Mycobacterium avium subsp. paratuberculosis
cggccugcagc

SEQ ID NO: 993758 - RNA, 13 nt, Mycobacterium avium subsp. paratuberculosis
cggccugcagcac

SEQ ID NO: 993759 - RNA, 15 nt, Mycobacterium avium subsp. paratuberculosis
cggccugcagcaccg

SEQ ID NO: 993760 - RNA, 23 nt, Mycobacterium avium subsp. paratuberculosis
cggccugcacgucggcgcgcagg

SEQ ID NO: 993761 - RNA, 14 nt, Mycobacterium avium subsp. paratuberculosis
cggccucgcccagc

SEQ ID NO: 993762 - RNA, 17 nt, Mycobacterium avium subsp. paratuberculosis
cggccucgcccagcgcc

SEQ ID NO: 993763 - RNA, 19 nt, Mycobacterium avium subsp. paratuberculosis
cggccucgcccagcgccgc

SEQ ID NO: 993764 - RNA, 19 nt, Mycobacterium avium subsp. paratuberculosis
cggccguggucgaugaacu

SEQ ID NO: 993765 - RNA, 15 nt, Mycobacterium avium subsp. paratuberculosis
cggccguucucggga

SEQ ID NO: 993766 - RNA, 21 nt, Mycobacterium avium subsp. paratuberculosis
cggccucggcgguggccucgg

SEQ ID NO: 993767 - RNA, 23 nt, Mycobacterium avium subsp. paratuberculosis
cggccgucgucgggcaggauguc

SEQ ID NO: 993768 - RNA, 20 nt, Mycobacterium avium subsp. paratuberculosis
cggccucgucggcgagcagc

SEQ ID NO: 993769 - RNA, 13 nt, Mycobacterium avium subsp. paratuberculosis
cggccugcaccuc

SEQ ID NO: 993770 - RNA, 23 nt, Mycobacterium avium subsp. paratuberculosis
cggccugcacaggggcgcguagc

SEQ ID NO: 993771 - RNA, 14 nt, Mycobacterium avium subsp. paratuberculosis
cggccugcaccacc

SEQ ID NO: 993772 - RNA, 19 nt, Mycobacterium avium subsp. paratuberculosis
cggccugcacccaggucau

SEQ ID NO: 993773 - RNA, 23 nt, Mycobacterium avium subsp. paratuberculosis
cggccauucaucgcgcaccaggg

SEQ ID NO: 993774 - RNA, 23 nt, Mycobacterium avium subsp. paratuberculosis
cggccauguccccgccgguggcg

SEQ ID NO: 993775 - RNA, 18 nt, Mycobacterium avium subsp. paratuberculosis
cggcccaucaccagcggc

SEQ ID NO: 993776 - RNA, 21 nt, Mycobacterium avium subsp. paratuberculosis
cggcccaucaccagcggcugc

SEQ ID NO: 993777 - RNA, 14 nt, Mycobacterium avium subsp. paratuberculosis
cggccccagacgaa

SEQ ID NO: 993778 - RNA, 14 nt, Mycobacterium avium subsp. paratuberculosis
cggccccaccgccg

SEQ ID NO: 993779 - RNA, 19 nt, Mycobacterium avium subsp. paratuberculosis
cggccccaccgccgcugcg

SEQ ID NO: 993780 - RNA, 14 nt, Mycobacterium avium subsp. paratuberculosis
cggccgccgcccgc

SEQ ID NO: 993781 - RNA, 13 nt, Mycobacterium avium subsp. paratuberculosis
cggccgccgaggc

SEQ ID NO: 993782 - RNA, 20 nt, Mycobacterium avium subsp. paratuberculosis
cggccgccgauuccggccgg

SEQ ID NO: 993783 - RNA, 23 nt, Mycobacterium avium subsp. paratuberculosis
cggccgccggaucgugucccggc

SEQ ID NO: 993784 - RNA, 16 nt, Mycobacterium avium subsp. paratuberculosis
cggccgccggccagcu

SEQ ID NO: 993785 - RNA, 17 nt, Mycobacterium avium subsp. paratuberculosis
cggccgccggccagcuc

SEQ ID NO: 993786 - RNA, 11 nt, Mycobacterium avium subsp. paratuberculosis
cggccgcccgc

SEQ ID NO: 993787 - RNA, 18 nt, Mycobacterium avium subsp. paratuberculosis
cggccgcccgcaccagca

SEQ ID NO: 993788 - RNA, 19 nt, Mycobacterium avium subsp. paratuberculosis
cggccgccgaagccggcuc

SEQ ID NO: 993789 - RNA, 21 nt, Mycobacterium avium subsp. paratuberculosis
cggccgccgaagccggcucga

SEQ ID NO: 993790 - RNA, 13 nt, Mycobacterium avium subsp. paratuberculosis
cggccgcccaguc

SEQ ID NO: 993791 - RNA, 18 nt, Mycobacterium avium subsp. paratuberculosis
cggccgcccagucgccgc

SEQ ID NO: 993792 - RNA, 12 nt, Mycobacterium avium subsp. paratuberculosis
cggccgcccagc

SEQ ID NO: 993793 - RNA, 14 nt, Mycobacterium avium subsp. paratuberculosis
cggccgccagcagu

SEQ ID NO: 993794 - RNA, 16 nt, Mycobacterium avium subsp. paratuberculosis
cggccgcccagcccgc

SEQ ID NO: 993795 - RNA, 14 nt, Mycobacterium avium subsp. paratuberculosis
cggccgccagcgcc

SEQ ID NO: 993796 - RNA, 15 nt, Mycobacterium avium subsp. paratuberculosis
cggccgccagcgccc

SEQ ID NO: 993797 - RNA, 21 nt, Mycobacterium avium subsp. paratuberculosis
cggccgccagcgcccgcgcgu

SEQ ID NO: 993798 - RNA, 15 nt, Mycobacterium avium subsp. paratuberculosis
cggcccccacgcagc

SEQ ID NO: 993799 - RNA, 22 nt, Mycobacterium avium subsp. paratuberculosis
cggccggagcggauggcgccgu

SEQ ID NO: 993800 - RNA, 19 nt, Mycobacterium avium subsp. paratuberculosis
cggccgccguggcccacgc

SEQ ID NO: 993801 - RNA, 16 nt, Mycobacterium avium subsp. paratuberculosis
cggccgcugaggaugg

SEQ ID NO: 993802 - RNA, 18 nt, Mycobacterium avium subsp. paratuberculosis
cggccgcugcgggcgggc

SEQ ID NO: 993803 - RNA, 16 nt, Mycobacterium avium subsp. paratuberculosis
cggccgcgccggccgg

SEQ ID NO: 993804 - RNA, 15 nt, Mycobacterium avium subsp. paratuberculosis
cggccgcgccggccu

SEQ ID NO: 993805 - RNA, 14 nt, Mycobacterium avium subsp. paratuberculosis
cggccgcucgcggg

SEQ ID NO: 993806 - RNA, 14 nt, Mycobacterium avium subsp. paratuberculosis
cggccgcgccggcc

SEQ ID NO: 993807 - RNA, 17 nt, Mycobacterium avium subsp. paratuberculosis
cggccgcgcaccgcccc

SEQ ID NO: 993808 - RNA, 21 nt, Mycobacterium avium subsp. paratuberculosis
cggccgcgcagaucgccagca

SEQ ID NO: 993809 - RNA, 12 nt, Mycobacterium avium subsp. paratuberculosis
cggccgcgcagc

SEQ ID NO: 993810 - RNA, 18 nt, Mycobacterium avium subsp. paratuberculosis
cggccgcgacgaccgccu

SEQ ID NO: 993811 - RNA, 22 nt, Mycobacterium avium subsp. paratuberculosis
cggccgcgacgaccgccugcuu

SEQ ID NO: 993812 - RNA, 22 nt, Mycobacterium avium subsp. paratuberculosis
cggccgcgacgguuuccggcuu

SEQ ID NO: 993813 - RNA, 16 nt, Mycobacterium avium subsp. paratuberculosis
cggccgcgacugcacc

SEQ ID NO: 993814 - RNA, 18 nt, Mycobacterium avium subsp. paratuberculosis
cggccgcgacugcacccg

SEQ ID NO: 993815 - RNA, 18 nt, Mycobacterium avium subsp. paratuberculosis
cggccgcgagcccggcga

SEQ ID NO: 993816 - RNA, 15 nt, Mycobacterium avium subsp. paratuberculosis
cggccgccuccagca

SEQ ID NO: 993817 - RNA, 16 nt, Mycobacterium avium subsp. paratuberculosis
cggccgccgggacggg

SEQ ID NO: 993818 - RNA, 12 nt, Mycobacterium avium subsp. paratuberculosis
cggccgccugga

SEQ ID NO: 993819 - RNA, 14 nt, Mycobacterium avium subsp. paratuberculosis
cggccgccuggacg

SEQ ID NO: 993820 - RNA, 19 nt, Mycobacterium avium subsp. paratuberculosis
cggccgccuuggugauccg

SEQ ID NO: 993821 - RNA, 21 nt, Mycobacterium avium subsp. paratuberculosis
cggccgccuuggugauccggg

SEQ ID NO: 993822 - RNA, 16 nt, Mycobacterium avium subsp. paratuberculosis
cggccguggacccgcc

SEQ ID NO: 993823 - RNA, 18 nt, Mycobacterium avium subsp. paratuberculosis
cggccguggacccgcccc

SEQ ID NO: 993824 - RNA, 20 nt, Mycobacterium avium subsp. paratuberculosis
cggccgucuugcccggcgag

SEQ ID NO: 993825 - RNA, 15 nt, Mycobacterium avium subsp. paratuberculosis
cggccgucgcgcagc

SEQ ID NO: 993826 - RNA, 17 nt, Mycobacterium avium subsp. paratuberculosis
cggccgucaggaacgcc

SEQ ID NO: 993827 - RNA, 16 nt, Mycobacterium avium subsp. paratuberculosis
cggccguagccggacc

SEQ ID NO: 993828 - RNA, 20 nt, Mycobacterium avium subsp. paratuberculosis
cggccguccggucgcugggc

SEQ ID NO: 993829 - RNA, 15 nt, Mycobacterium avium subsp. paratuberculosis
cggccgguuggcggc

SEQ ID NO: 993830 - RNA, 18 nt, Mycobacterium avium subsp. paratuberculosis
cggccggugcgcgucagc

SEQ ID NO: 993831 - RNA, 23 nt, Mycobacterium avium subsp. paratuberculosis
cggccgguugccuuuccgcgcgg

SEQ ID NO: 993832 - RNA, 14 nt, Mycobacterium avium subsp. paratuberculosis
cggccggcaggccg

SEQ ID NO: 993833 - RNA, 17 nt, Mycobacterium avium subsp. paratuberculosis
cggccggcaggccgccc

SEQ ID NO: 993834 - RNA, 20 nt, Mycobacterium avium subsp. paratuberculosis
cggccggcaguugcggccgc

SEQ ID NO: 993835 - RNA, 21 nt, Mycobacterium avium subsp. paratuberculosis
cggccggcaguugcggccgcu

SEQ ID NO: 993836 - RNA, 23 nt, Mycobacterium avium subsp. paratuberculosis
cggccggcaguugcggccgcuuc

SEQ ID NO: 993837 - RNA, 22 nt, Mycobacterium avium subsp. paratuberculosis
cggccggcaacgacccgucggg

SEQ ID NO: 993838 - RNA, 20 nt, Mycobacterium avium subsp. paratuberculosis
cggccggcacuaccgccucg

SEQ ID NO: 993839 - RNA, 12 nt, Mycobacterium avium subsp. paratuberculosis
cggccggcagcg

SEQ ID NO: 993840 - RNA, 21 nt, Mycobacterium avium subsp. paratuberculosis
cggccggaucgaauccggcgg

SEQ ID NO: 993841 - RNA, 23 nt, Mycobacterium avium subsp. paratuberculosis
cggccggaucgaauccggcggcg

SEQ ID NO: 993842 - RNA, 23 nt, Mycobacterium avium subsp. paratuberculosis
cggcgcgaucgucgaccaccacg

SEQ ID NO: 993843 - RNA, 13 nt, Mycobacterium avium subsp. paratuberculosis
cggcgcgcaacag

SEQ ID NO: 993844 - RNA, 16 nt, Mycobacterium avium subsp. paratuberculosis
cggcgcgaaccgggcc

SEQ ID NO: 993845 - RNA, 20 nt, Mycobacterium avium subsp. paratuberculosis
cggcgcgaaccgggccagga

SEQ ID NO: 993846 - RNA, 23 nt, Mycobacterium avium subsp. paratuberculosis
cggcgcgcccgacgaugcggggc

SEQ ID NO: 993847 - RNA, 15 nt, Mycobacterium avium subsp. paratuberculosis
cggcgcgcaucccga

SEQ ID NO: 993848 - RNA, 15 nt, Mycobacterium avium subsp. paratuberculosis
cggcgcgcaggcugg

SEQ ID NO: 993849 - RNA, 16 nt, Mycobacterium avium subsp. paratuberculosis
cggcgcgcaggcuggc

SEQ ID NO: 993850 - RNA, 21 nt, Mycobacterium avium subsp. paratuberculosis
cggcgcgcaccgcgggcagca

SEQ ID NO: 993851 - RNA, 14 nt, Mycobacterium avium subsp. paratuberculosis
cggcgcgcagccgg

SEQ ID NO: 993852 - RNA, 12 nt, Mycobacterium avium subsp. paratuberculosis
cggcgcgcaccc

SEQ ID NO: 993853 - RNA, 16 nt, Mycobacterium avium subsp. paratuberculosis
cggcgcgcaccccggc

SEQ ID NO: 993854 - RNA, 16 nt, Mycobacterium avium subsp. paratuberculosis
cggcgcgcacggcagc

SEQ ID NO: 993855 - RNA, 11 nt, Mycobacterium avium subsp. paratuberculosis
cggcgcgcagc

SEQ ID NO: 993856 - RNA, 14 nt, Mycobacterium avium subsp. paratuberculosis
cggcgcgcagccag

SEQ ID NO: 993857 - RNA, 19 nt, Mycobacterium avium subsp. paratuberculosis
cggcgcgcagcccagccag

SEQ ID NO: 993858 - RNA, 13 nt, Mycobacterium avium subsp. paratuberculosis
cggcgcgcugcag

SEQ ID NO: 993859 - RNA, 16 nt, Mycobacterium avium subsp. paratuberculosis
cggcgcgcugaagcgc

SEQ ID NO: 993860 - RNA, 22 nt, Mycobacterium avium subsp. paratuberculosis
cggcgcgcugaagcgcgacccc

SEQ ID NO: 993861 - RNA, 19 nt, Mycobacterium avium subsp. paratuberculosis
cggcgcgcggggccggcgc

SEQ ID NO: 993862 - RNA, 13 nt, Mycobacterium avium subsp. paratuberculosis
cggcgcgcggggu

SEQ ID NO: 993863 - RNA, 19 nt, Mycobacterium avium subsp. paratuberculosis
cggcgcggaucucgcgcag

SEQ ID NO: 993864 - RNA, 14 nt, Mycobacterium avium subsp. paratuberculosis
cggcgcggaugacg

SEQ ID NO: 993865 - RNA, 20 nt, Mycobacterium avium subsp. paratuberculosis
cggcgcggaacgcgccgggc

SEQ ID NO: 993866 - RNA, 14 nt, Mycobacterium avium subsp. paratuberculosis
cggcgcggaacgcg

SEQ ID NO: 993867 - RNA, 18 nt, Mycobacterium avium subsp. paratuberculosis
cggcgcgcgcgccccagc

SEQ ID NO: 993868 - RNA, 14 nt, Mycobacterium avium subsp. paratuberculosis
cggcgcgcgccagc

SEQ ID NO: 993869 - RNA, 15 nt, Mycobacterium avium subsp. paratuberculosis
cggcgcgccugcgcg

SEQ ID NO: 993870 - RNA, 21 nt, Mycobacterium avium subsp. paratuberculosis
cggcgcgccugcgcggcggcg

SEQ ID NO: 993871 - RNA, 14 nt, Mycobacterium avium subsp. paratuberculosis
cggcgcgccggccg

SEQ ID NO: 993872 - RNA, 13 nt, Mycobacterium avium subsp. paratuberculosis
cggcgcgccgcag

SEQ ID NO: 993873 - RNA, 20 nt, Mycobacterium avium subsp. paratuberculosis
cggcgccuugaaccggcugg

SEQ ID NO: 993874 - RNA, 16 nt, Mycobacterium avium subsp. paratuberculosis
cggcgccguccuccuc

SEQ ID NO: 993875 - RNA, 12 nt, Mycobacterium avium subsp. paratuberculosis
cggcgccgucga

SEQ ID NO: 993876 - RNA, 19 nt, Mycobacterium avium subsp. paratuberculosis
cggcgccgggaucggcagc

SEQ ID NO: 993877 - RNA, 21 nt, Mycobacterium avium subsp. paratuberculosis
cggcgccgggaucggcagcgc

SEQ ID NO: 993878 - RNA, 16 nt, Mycobacterium avium subsp. paratuberculosis
cggcgccggugcccac

SEQ ID NO: 993879 - RNA, 17 nt, Mycobacterium avium subsp. paratuberculosis
cggcgccggugccgcag

SEQ ID NO: 993880 - RNA, 20 nt, Mycobacterium avium subsp. paratuberculosis
cggcgccggugccgcagccg

SEQ ID NO: 993881 - RNA, 17 nt, Mycobacterium avium subsp. paratuberculosis
cggcgccggcggucagc

SEQ ID NO: 993882 - RNA, 19 nt, Mycobacterium avium subsp. paratuberculosis
cggcgccggaucggccccc

SEQ ID NO: 993883 - RNA, 15 nt, Mycobacterium avium subsp. paratuberculosis
cggcgccggcgcgca

SEQ ID NO: 993884 - RNA, 23 nt, Mycobacterium avium subsp. paratuberculosis
cggcgccggccgggcugcgcagc

SEQ ID NO: 993885 - RNA, 13 nt, Mycobacterium avium subsp. paratuberculosis
cggcgccggccgu

SEQ ID NO: 993886 - RNA, 13 nt, Mycobacterium avium subsp. paratuberculosis
cggcgccggccgc

SEQ ID NO: 993887 - RNA, 19 nt, Mycobacterium avium subsp. paratuberculosis
cggcgccggaggggcgacg

SEQ ID NO: 993888 - RNA, 15 nt, Mycobacterium avium subsp. paratuberculosis
cggcgccgcgggugc

SEQ ID NO: 993889 - RNA, 20 nt, Mycobacterium avium subsp. paratuberculosis
cggcgccgcgggugcggcac

SEQ ID NO: 993890 - RNA, 15 nt, Mycobacterium avium subsp. paratuberculosis
cggcgccgcgcgcca

SEQ ID NO: 993891 - RNA, 15 nt, Mycobacterium avium subsp. paratuberculosis
cggcgccgcggcggc

SEQ ID NO: 993892 - RNA, 16 nt, Mycobacterium avium subsp. paratuberculosis
cggcgccgcggcggca

SEQ ID NO: 993893 - RNA, 18 nt, Mycobacterium avium subsp. paratuberculosis
cggcgccggacggcccgc

SEQ ID NO: 993894 - RNA, 14 nt, Mycobacterium avium subsp. paratuberculosis
cggcgccgcggccg

SEQ ID NO: 993895 - RNA, 15 nt, Mycobacterium avium subsp. paratuberculosis
cggcgccgcgccggc

SEQ ID NO: 993896 - RNA, 19 nt, Mycobacterium avium subsp. paratuberculosis
cggcgcccggcccagccgc

SEQ ID NO: 993897 - RNA, 20 nt, Mycobacterium avium subsp. paratuberculosis
cggcgcccggcccagccgcu

SEQ ID NO: 993898 - RNA, 17 nt, Mycobacterium avium subsp. paratuberculosis
cggcgcccggcgcgcca

SEQ ID NO: 993899 - RNA, 16 nt, Mycobacterium avium subsp. paratuberculosis
cggcgcccgcggccuc

SEQ ID NO: 993900 - RNA, 14 nt, Mycobacterium avium subsp. paratuberculosis
cggcgcccgccccg

SEQ ID NO: 993901 - RNA, 16 nt, Mycobacterium avium subsp. paratuberculosis
cggcgcccgccccgac

SEQ ID NO: 993902 - RNA, 15 nt, Mycobacterium avium subsp. paratuberculosis
cggcgccaccccggg

SEQ ID NO: 993903 - RNA, 12 nt, Mycobacterium avium subsp. paratuberculosis
cggcgccccggg

SEQ ID NO: 993904 - RNA, 16 nt, Mycobacterium avium subsp. paratuberculosis
cggcgccccgggcagc

SEQ ID NO: 993905 - RNA, 17 nt, Mycobacterium avium subsp. paratuberculosis
cggcgccccgggcagcg

SEQ ID NO: 993906 - RNA, 14 nt, Mycobacterium avium subsp. paratuberculosis
cggcgccccgcccg

SEQ ID NO: 993907 - RNA, 15 nt, Mycobacterium avium subsp. paratuberculosis
cggcgccccgcccgc

SEQ ID NO: 993908 - RNA, 19 nt, Mycobacterium avium subsp. paratuberculosis
cggcgccccacgccuggcg

SEQ ID NO: 993909 - RNA, 12 nt, Mycobacterium avium subsp. paratuberculosis
cggcgcccagga

SEQ ID NO: 993910 - RNA, 18 nt, Mycobacterium avium subsp. paratuberculosis
cggcgcccagguccacca

SEQ ID NO: 993911 - RNA, 23 nt, Mycobacterium avium subsp. paratuberculosis
cggcgcccagguccaccagguga

SEQ ID NO: 993912 - RNA, 22 nt, Mycobacterium avium subsp. paratuberculosis
cggcgcaugaccgauccgccgg

SEQ ID NO: 993913 - RNA, 14 nt, Mycobacterium avium subsp. paratuberculosis
cggcgcagucggcc

SEQ ID NO: 993914 - RNA, 16 nt, Mycobacterium avium subsp. paratuberculosis
cggcgcagucggccgg

SEQ ID NO: 993915 - RNA, 18 nt, Mycobacterium avium subsp. paratuberculosis
cggcgcagguccggcagc

SEQ ID NO: 993916 - RNA, 22 nt, Mycobacterium avium subsp. paratuberculosis
cggcgcaggcauuuccaggucc

SEQ ID NO: 993917 - RNA, 21 nt, Mycobacterium avium subsp. paratuberculosis
cggcgcagcgcacgucgccgc

SEQ ID NO: 993918 - RNA, 16 nt, Mycobacterium avium subsp. paratuberculosis
cggcgcagcggcccga

SEQ ID NO: 993919 - RNA, 17 nt, Mycobacterium avium subsp. paratuberculosis
cggcgcagcucgcgcag

SEQ ID NO: 993920 - RNA, 13 nt, Mycobacterium avium subsp. paratuberculosis
cggcgcccacagc

SEQ ID NO: 993921 - RNA, 14 nt, Mycobacterium avium subsp. paratuberculosis
cggcgcccacagca

SEQ ID NO: 993922 - RNA, 15 nt, Mycobacterium avium subsp. paratuberculosis
cggcgcccacagcag

SEQ ID NO: 993923 - RNA, 13 nt, Mycobacterium avium subsp. paratuberculosis
cggcgcccaccgc

SEQ ID NO: 993924 - RNA, 18 nt, Mycobacterium avium subsp. paratuberculosis
cggcgcccaccgcggcgc

SEQ ID NO: 993925 - RNA, 23 nt, Mycobacterium avium subsp. paratuberculosis
cggcgcccaccgcggcgcgcggc

SEQ ID NO: 993926 - RNA, 17 nt, Mycobacterium avium subsp. paratuberculosis
cggcgccaacaacucag

SEQ ID NO: 993927 - RNA, 21 nt, Mycobacterium avium subsp. paratuberculosis
cggcgccaacaacucagaaca

SEQ ID NO: 993928 - RNA, 14 nt, Mycobacterium avium subsp. paratuberculosis
cggcgcagccggcc

SEQ ID NO: 993929 - RNA, 17 nt, Mycobacterium avium subsp. paratuberculosis
cggcgcagccggccacc

SEQ ID NO: 993930 - RNA, 15 nt, Mycobacterium avium subsp. paratuberculosis
cggcgcagcgcgucg

SEQ ID NO: 993931 - RNA, 23 nt, Mycobacterium avium subsp. paratuberculosis
cggcgcagcgcgucgcgcccggc

SEQ ID NO: 993932 - RNA, 16 nt, Mycobacterium avium subsp. paratuberculosis
cggcgcagcacggcca

SEQ ID NO: 993933 - RNA, 15 nt, Mycobacterium avium subsp. paratuberculosis
cggcgcaccgcccgc

SEQ ID NO: 993934 - RNA, 21 nt, Mycobacterium avium subsp. paratuberculosis
cggcgcaccccguccaggaug

SEQ ID NO: 993935 - RNA, 17 nt, Mycobacterium avium subsp. paratuberculosis
cggcgcacccgggcagc

SEQ ID NO: 993936 - RNA, 13 nt, Mycobacterium avium subsp. paratuberculosis
cggcgcaccuggc

SEQ ID NO: 993937 - RNA, 14 nt, Mycobacterium avium subsp. paratuberculosis
cggcgcaccuggcg

SEQ ID NO: 993938 - RNA, 15 nt, Mycobacterium avium subsp. paratuberculosis
cggcgcacuccauca

SEQ ID NO: 993939 - RNA, 19 nt, Mycobacterium avium subsp. paratuberculosis
cggcgcagaugaccggccu

SEQ ID NO: 993940 - RNA, 11 nt, Mycobacterium avium subsp. paratuberculosis
cggcgcagcaa

SEQ ID NO: 993941 - RNA, 22 nt, Mycobacterium avium subsp. paratuberculosis
cggcgcaaucggggccgacccg

SEQ ID NO: 993942 - RNA, 20 nt, Mycobacterium avium subsp. paratuberculosis
cggcgcaccaaccggccccg

SEQ ID NO: 993943 - RNA, 15 nt, Mycobacterium avium subsp. paratuberculosis
cggcgaugcgcgccu

SEQ ID NO: 993944 - RNA, 22 nt, Mycobacterium avium subsp. paratuberculosis
cggcgaugcgcggcccguugag

SEQ ID NO: 993945 - RNA, 22 nt, Mycobacterium avium subsp. paratuberculosis
cggcgaugccuuccucggcgcu

SEQ ID NO: 993946 - RNA, 13 nt, Mycobacterium avium subsp. paratuberculosis
cggcgaugccagc

SEQ ID NO: 993947 - RNA, 20 nt, Mycobacterium avium subsp. paratuberculosis
cggcgaugcccacagccagg

SEQ ID NO: 993948 - RNA, 21 nt, Mycobacterium avium subsp. paratuberculosis
cggcgaugcccacagccaggu

SEQ ID NO: 993949 - RNA, 20 nt, Mycobacterium avium subsp. paratuberculosis
cggcgagucccggcgcacca

SEQ ID NO: 993950 - RNA, 21 nt, Mycobacterium avium subsp. paratuberculosis
cggcgagucccggcgcaccag

SEQ ID NO: 993951 - RNA, 17 nt, Mycobacterium avium subsp. paratuberculosis
cggcgaguccgcggagg

SEQ ID NO: 993952 - RNA, 20 nt, Mycobacterium avium subsp. paratuberculosis
cggcgaguccggccaggucg

SEQ ID NO: 993953 - RNA, 18 nt, Mycobacterium avium subsp. paratuberculosis
cggcgaggugaaccgcga

SEQ ID NO: 993954 - RNA, 14 nt, Mycobacterium avium subsp. paratuberculosis
cggcgaggugcgcc

SEQ ID NO: 993955 - RNA, 17 nt, Mycobacterium avium subsp. paratuberculosis
cggcgaggugggcacca

SEQ ID NO: 993956 - RNA, 12 nt, Mycobacterium avium subsp. paratuberculosis
cggcgagcgcgc

SEQ ID NO: 993957 - RNA, 18 nt, Mycobacterium avium subsp. paratuberculosis
cggcgagcugcgggugcu

SEQ ID NO: 993958 - RNA, 15 nt, Mycobacterium avium subsp. paratuberculosis
cggcgaggcggucgg

SEQ ID NO: 993959 - RNA, 22 nt, Mycobacterium avium subsp. paratuberculosis
cggcgagcuugccuugcgccca

SEQ ID NO: 993960 - RNA, 17 nt, Mycobacterium avium subsp. paratuberculosis
cggcgagcuuggcgggc

SEQ ID NO: 993961 - RNA, 21 nt, Mycobacterium avium subsp. paratuberculosis
cggcgaggaacucagcgccca

SEQ ID NO: 993962 - RNA, 13 nt, Mycobacterium avium subsp. paratuberculosis
cggcgagccgcuc

SEQ ID NO: 993963 - RNA, 16 nt, Mycobacterium avium subsp. paratuberculosis
cggcgagccgggaccg

SEQ ID NO: 993964 - RNA, 16 nt, Mycobacterium avium subsp. paratuberculosis
cggcgagccgggccgg

SEQ ID NO: 993965 - RNA, 15 nt, Mycobacterium avium subsp. paratuberculosis
cggcgagcagcugca

SEQ ID NO: 993966 - RNA, 18 nt, Mycobacterium avium subsp. paratuberculosis
cggcgauccggccggcgg

SEQ ID NO: 993967 - RNA, 20 nt, Mycobacterium avium subsp. paratuberculosis
cggcgauccgggcacgcagc

SEQ ID NO: 993968 - RNA, 16 nt, Mycobacterium avium subsp. paratuberculosis
cggcgaucaccgccgc

SEQ ID NO: 993969 - RNA, 15 nt, Mycobacterium avium subsp. paratuberculosis
cggcgaucagcagca

SEQ ID NO: 993970 - RNA, 16 nt, Mycobacterium avium subsp. paratuberculosis
cggcgaucagcugccc

SEQ ID NO: 993971 - RNA, 20 nt, Mycobacterium avium subsp. paratuberculosis
cggcgaucagcugcccggag

SEQ ID NO: 993972 - RNA, 18 nt, Mycobacterium avium subsp. paratuberculosis
cggcgaugaacacgccga

SEQ ID NO: 993973 - RNA, 15 nt, Mycobacterium avium subsp. paratuberculosis
cggcgaugaagcccc

SEQ ID NO: 993974 - RNA, 16 nt, Mycobacterium avium subsp. paratuberculosis
cggcgaucucggucac

SEQ ID NO: 993975 - RNA, 19 nt, Mycobacterium avium subsp. paratuberculosis
cggcgaucucgucgcgcag

SEQ ID NO: 993976 - RNA, 22 nt, Mycobacterium avium subsp. paratuberculosis
cggcgaugcagaucaccacggu

SEQ ID NO: 993977 - RNA, 14 nt, Mycobacterium avium subsp. paratuberculosis
cggcgaugaccgga

SEQ ID NO: 993978 - RNA, 15 nt, Mycobacterium avium subsp. paratuberculosis
cggcgaugaccggga

SEQ ID NO: 993979 - RNA, 19 nt, Mycobacterium avium subsp. paratuberculosis
cggcgaugauccgcggcgc

SEQ ID NO: 993980 - RNA, 16 nt, Mycobacterium avium subsp. paratuberculosis
cggcgaucggcgugcc

SEQ ID NO: 993981 - RNA, 16 nt, Mycobacterium avium subsp. paratuberculosis
cggcgaucgccgggga

SEQ ID NO: 993982 - RNA, 16 nt, Mycobacterium avium subsp. paratuberculosis
cggcgaucgcgagcag

SEQ ID NO: 993983 - RNA, 16 nt, Mycobacterium avium subsp. paratuberculosis
cggcgaucgcgcgcac

SEQ ID NO: 993984 - RNA, 19 nt, Mycobacterium avium subsp. paratuberculosis
cggcggguugcugagccgc

SEQ ID NO: 993985 - RNA, 20 nt, Mycobacterium avium subsp. paratuberculosis
cggcggguugcugagccgcc

SEQ ID NO: 993986 - RNA, 13 nt, Mycobacterium avium subsp. paratuberculosis
cggcgggucagca

SEQ ID NO: 993987 - RNA, 15 nt, Mycobacterium avium subsp. paratuberculosis
cggcgggugagccgg

SEQ ID NO: 993988 - RNA, 17 nt, Mycobacterium avium subsp. paratuberculosis
cggcgggugcgggcgcu

SEQ ID NO: 993989 - RNA, 18 nt, Mycobacterium avium subsp. paratuberculosis
cggcggggugcgcggcga

SEQ ID NO: 993990 - RNA, 20 nt, Mycobacterium avium subsp. paratuberculosis
cggcggguagaaccagcccg

SEQ ID NO: 993991 - RNA, 14 nt, Mycobacterium avium subsp. paratuberculosis
cggcggucaggccg

SEQ ID NO: 993992 - RNA, 20 nt, Mycobacterium avium subsp. paratuberculosis
cggcggucuuggcggccagc

SEQ ID NO: 993993 - RNA, 16 nt, Mycobacterium avium subsp. paratuberculosis
cggcggucgugcggcu

SEQ ID NO: 993994 - RNA, 16 nt, Mycobacterium avium subsp. paratuberculosis
cggcggucuucuuggc

SEQ ID NO: 993995 - RNA, 20 nt, Mycobacterium avium subsp. paratuberculosis
cggcggucuucuuggcgggc

SEQ ID NO: 993996 - RNA, 22 nt, Mycobacterium avium subsp. paratuberculosis
cggcggucuucuuggcgggcga

SEQ ID NO: 993997 - RNA, 22 nt, Mycobacterium avium subsp. paratuberculosis
cggcggucgccacucgggcggc

SEQ ID NO: 993998 - RNA, 14 nt, Mycobacterium avium subsp. paratuberculosis
cggcggucgcgcgc

SEQ ID NO: 993999 - RNA, 15 nt, Mycobacterium avium subsp. paratuberculosis
cggcggucgcgcgcc

SEQ ID NO: 994000 - RNA, 21 nt, Mycobacterium avium subsp. paratuberculosis
cggcggucgcgcgccggcgca

SEQ ID NO: 994001 - RNA, 13 nt, Mycobacterium avium subsp. paratuberculosis
cggcggucggcgc

SEQ ID NO: 994002 - RNA, 18 nt, Mycobacterium avium subsp. paratuberculosis
cggcgguccagcgagccc

SEQ ID NO: 994003 - RNA, 17 nt, Mycobacterium avium subsp. paratuberculosis
cggcggucacgcccggg

SEQ ID NO: 994004 - RNA, 21 nt, Mycobacterium avium subsp. paratuberculosis
cggcggucccgugcgccgccc

SEQ ID NO: 994005 - RNA, 16 nt, Mycobacterium avium subsp. paratuberculosis
cggcgguccgccgcag

SEQ ID NO: 994006 - RNA, 18 nt, Mycobacterium avium subsp. paratuberculosis
cggcggugccgcaggcga

SEQ ID NO: 994007 - RNA, 17 nt, Mycobacterium avium subsp. paratuberculosis
cggcggugucgcccagc

SEQ ID NO: 994008 - RNA, 22 nt, Mycobacterium avium subsp. paratuberculosis
cggcggugguuaccagcucacc

SEQ ID NO: 994009 - RNA, 20 nt, Mycobacterium avium subsp. paratuberculosis
cggcggugucgaaggccggg

SEQ ID NO: 994010 - RNA, 17 nt, Mycobacterium avium subsp. paratuberculosis
cggcggugucggcgccc

SEQ ID NO: 994011 - RNA, 15 nt, Mycobacterium avium subsp. paratuberculosis
cggcggugucggcgg

SEQ ID NO: 994012 - RNA, 17 nt, Mycobacterium avium subsp. paratuberculosis
cggcggugucggcggca

SEQ ID NO: 994013 - RNA, 21 nt, Mycobacterium avium subsp. paratuberculosis
cggcgguuucggugccggccc

SEQ ID NO: 994014 - RNA, 14 nt, Mycobacterium avium subsp. paratuberculosis
cggcggugagccgc

SEQ ID NO: 994015 - RNA, 20 nt, Mycobacterium avium subsp. paratuberculosis
cggcggugagccgccacagc

SEQ ID NO: 994016 - RNA, 21 nt, Mycobacterium avium subsp. paratuberculosis
cggcggugaucucgucggcgg

SEQ ID NO: 994017 - RNA, 16 nt, Mycobacterium avium subsp. paratuberculosis
cggcggugaugcgcgc

SEQ ID NO: 994018 - RNA, 15 nt, Mycobacterium avium subsp. paratuberculosis
cggcggugccggcca

SEQ ID NO: 994019 - RNA, 15 nt, Mycobacterium avium subsp. paratuberculosis
cggcgguggccugcc

SEQ ID NO: 994020 - RNA, 16 nt, Mycobacterium avium subsp. paratuberculosis
cggcgguggccugccc

SEQ ID NO: 994021 - RNA, 16 nt, Mycobacterium avium subsp. paratuberculosis
cggcgguggcgaugac

SEQ ID NO: 994022 - RNA, 14 nt, Mycobacterium avium subsp. paratuberculosis
cggcggugggcgca

SEQ ID NO: 994023 - RNA, 21 nt, Mycobacterium avium subsp. paratuberculosis
cggcggugguccgcgcgacca

SEQ ID NO: 994024 - RNA, 14 nt, Mycobacterium avium subsp. paratuberculosis
cggcgguggugaac

SEQ ID NO: 994025 - RNA, 12 nt, Mycobacterium avium subsp. paratuberculosis
cggcguacagca

SEQ ID NO: 994026 - RNA, 18 nt, Mycobacterium avium subsp. paratuberculosis
cggcguacaggccgucgg

SEQ ID NO: 994027 - RNA, 19 nt, Mycobacterium avium subsp. paratuberculosis
cggcguacaggccgucggg

SEQ ID NO: 994028 - RNA, 18 nt, Mycobacterium avium subsp. paratuberculosis
cggcguacccgcccaugc

SEQ ID NO: 994029 - RNA, 23 nt, Mycobacterium avium subsp. paratuberculosis
cggcggcgaguucggcggcccgc

SEQ ID NO: 994030 - RNA, 18 nt, Mycobacterium avium subsp. paratuberculosis
cggcggcgauccggccgg

SEQ ID NO: 994031 - RNA, 16 nt, Mycobacterium avium subsp. paratuberculosis
cggcggcgccgacggg

SEQ ID NO: 994032 - RNA, 13 nt, Mycobacterium avium subsp. paratuberculosis
cggcggcgccgca

SEQ ID NO: 994033 - RNA, 15 nt, Mycobacterium avium subsp. paratuberculosis
cggcggcgccgcagc

SEQ ID NO: 994034 - RNA, 16 nt, Mycobacterium avium subsp. paratuberculosis
cggcggcgccgcagca

SEQ ID NO: 994035 - RNA, 12 nt, Mycobacterium avium subsp. paratuberculosis
cggcggcgacgg

SEQ ID NO: 994036 - RNA, 19 nt, Mycobacterium avium subsp. paratuberculosis
cggcggccuuuuccggcga

SEQ ID NO: 994037 - RNA, 16 nt, Mycobacterium avium subsp. paratuberculosis
cggcggcgaacgccgc

SEQ ID NO: 994038 - RNA, 21 nt, Mycobacterium avium subsp. paratuberculosis
cggcggcgaagccggccccgc

SEQ ID NO: 994039 - RNA, 20 nt, Mycobacterium avium subsp. paratuberculosis
cggcggcgcuggucggcggg

SEQ ID NO: 994040 - RNA, 15 nt, Mycobacterium avium subsp. paratuberculosis
cggcggcggaaucgc

SEQ ID NO: 994041 - RNA, 18 nt, Mycobacterium avium subsp. paratuberculosis
cggcggcgcucagcgcgg

SEQ ID NO: 994042 - RNA, 18 nt, Mycobacterium avium subsp. paratuberculosis
cggcggcgcgugcgccgc

SEQ ID NO: 994043 - RNA, 14 nt, Mycobacterium avium subsp. paratuberculosis
cggcggcgcgggcg

SEQ ID NO: 994044 - RNA, 18 nt, Mycobacterium avium subsp. paratuberculosis
cggcggcgcgccggccgg

SEQ ID NO: 994045 - RNA, 14 nt, Mycobacterium avium subsp. paratuberculosis
cggcggcgcgcagg

SEQ ID NO: 994046 - RNA, 13 nt, Mycobacterium avium subsp. paratuberculosis
cggcggcgcgcag

SEQ ID NO: 994047 - RNA, 17 nt, Mycobacterium avium subsp. paratuberculosis
cggcggccugcuugacc

SEQ ID NO: 994048 - RNA, 23 nt, Mycobacterium avium subsp. paratuberculosis
cggcggccucgguggucgcguag

SEQ ID NO: 994049 - RNA, 13 nt, Mycobacterium avium subsp. paratuberculosis
cggcggccugcuc

SEQ ID NO: 994050 - RNA, 13 nt, Mycobacterium avium subsp. paratuberculosis
cggcggccggggg

SEQ ID NO: 994051 - RNA, 13 nt, Mycobacterium avium subsp. paratuberculosis
cggcggccgggug

SEQ ID NO: 994052 - RNA, 14 nt, Mycobacterium avium subsp. paratuberculosis
cggcggccgccagc

SEQ ID NO: 994053 - RNA, 13 nt, Mycobacterium avium subsp. paratuberculosis
cggcggccggcca

SEQ ID NO: 994054 - RNA, 22 nt, Mycobacterium avium subsp. paratuberculosis
cggcggccggccagcgcgcggc

SEQ ID NO: 994055 - RNA, 14 nt, Mycobacterium avium subsp. paratuberculosis
cggcggccggcccc

SEQ ID NO: 994056 - RNA, 18 nt, Mycobacterium avium subsp. paratuberculosis
cggcggccggccccggcc

SEQ ID NO: 994057 - RNA, 13 nt, Mycobacterium avium subsp. paratuberculosis
cggcggccggcgc

SEQ ID NO: 994058 - RNA, 18 nt, Mycobacterium avium subsp. paratuberculosis
cggcggccaugucggagc

SEQ ID NO: 994059 - RNA, 21 nt, Mycobacterium avium subsp. paratuberculosis
cggcggccauucaucgcgcac

SEQ ID NO: 994060 - RNA, 15 nt, Mycobacterium avium subsp. paratuberculosis
cggcggccccgguag

SEQ ID NO: 994061 - RNA, 16 nt, Mycobacterium avium subsp. paratuberculosis
cggcggcccgcgcggg

SEQ ID NO: 994062 - RNA, 13 nt, Mycobacterium avium subsp. paratuberculosis
cggcggccgagcg

SEQ ID NO: 994063 - RNA, 13 nt, Mycobacterium avium subsp. paratuberculosis
cggcggcgcugcc

SEQ ID NO: 994064 - RNA, 12 nt, Mycobacterium avium subsp. paratuberculosis
cggcggcugggc

SEQ ID NO: 994065 - RNA, 15 nt, Mycobacterium avium subsp. paratuberculosis
cggcggcugggcagc

SEQ ID NO: 994066 - RNA, 22 nt, Mycobacterium avium subsp. paratuberculosis
cggcggcugggcagccgcgcgu

SEQ ID NO: 994067 - RNA, 18 nt, Mycobacterium avium subsp. paratuberculosis
cggcggcugggccgcggc

SEQ ID NO: 994068 - RNA, 20 nt, Mycobacterium avium subsp. paratuberculosis
cggcggcugggccgcggcgc

SEQ ID NO: 994069 - RNA, 22 nt, Mycobacterium avium subsp. paratuberculosis
cggcggcgugccgcccggaccg

SEQ ID NO: 994070 - RNA, 14 nt, Mycobacterium avium subsp. paratuberculosis
cggcggcucgccgg

SEQ ID NO: 994071 - RNA, 15 nt, Mycobacterium avium subsp. paratuberculosis
cggcggcugaagcgc

SEQ ID NO: 994072 - RNA, 18 nt, Mycobacterium avium subsp. paratuberculosis
cggcgggaaguagugcau

SEQ ID NO: 994073 - RNA, 20 nt, Mycobacterium avium subsp. paratuberculosis
cggcggcguuggccgccgcc

SEQ ID NO: 994074 - RNA, 22 nt, Mycobacterium avium subsp. paratuberculosis
cggcggcgucccagugcucgac

SEQ ID NO: 994075 - RNA, 15 nt, Mycobacterium avium subsp. paratuberculosis
cggcggcguccgcgg

SEQ ID NO: 994076 - RNA, 19 nt, Mycobacterium avium subsp. paratuberculosis
cggcggcguccgcggccgc

SEQ ID NO: 994077 - RNA, 14 nt, Mycobacterium avium subsp. paratuberculosis
cggcggcgguccgc

SEQ ID NO: 994078 - RNA, 17 nt, Mycobacterium avium subsp. paratuberculosis
cggcggcggugccuggu

SEQ ID NO: 994079 - RNA, 22 nt, Mycobacterium avium subsp. paratuberculosis
cggcggcguacgcgauggcggc

SEQ ID NO: 994080 - RNA, 12 nt, Mycobacterium avium subsp. paratuberculosis
cggcggcggcca

SEQ ID NO: 994081 - RNA, 15 nt, Mycobacterium avium subsp. paratuberculosis
cggcggcggcgcgcc

SEQ ID NO: 994082 - RNA, 16 nt, Mycobacterium avium subsp. paratuberculosis
cggcgggagccggcgg

SEQ ID NO: 994083 - RNA, 17 nt, Mycobacterium avium subsp. paratuberculosis
cggcgggaucggaccgc

SEQ ID NO: 994084 - RNA, 13 nt, Mycobacterium avium subsp. paratuberculosis
cggcgggccagau

SEQ ID NO: 994085 - RNA, 20 nt, Mycobacterium avium subsp. paratuberculosis
cggcgggccagggcgaggac

SEQ ID NO: 994086 - RNA, 14 nt, Mycobacterium avium subsp. paratuberculosis
cggcgggcccggcg

SEQ ID NO: 994087 - RNA, 13 nt, Mycobacterium avium subsp. paratuberculosis
cggcgggccgccc

SEQ ID NO: 994088 - RNA, 22 nt, Mycobacterium avium subsp. paratuberculosis
cggcgggccgcccggcgcgccg

SEQ ID NO: 994089 - RNA, 12 nt, Mycobacterium avium subsp. paratuberculosis
cggcgggccggc

SEQ ID NO: 994090 - RNA, 13 nt, Mycobacterium avium subsp. paratuberculosis
cggcgggccggcg

SEQ ID NO: 994091 - RNA, 14 nt, Mycobacterium avium subsp. paratuberculosis
cggcgggccggcgc

SEQ ID NO: 994092 - RNA, 13 nt, Mycobacterium avium subsp. paratuberculosis
cggcgggcgggcg

SEQ ID NO: 994093 - RNA, 14 nt, Mycobacterium avium subsp. paratuberculosis
cggcgggcgggcgg

SEQ ID NO: 994094 - RNA, 15 nt, Mycobacterium avium subsp. paratuberculosis
cggcgggcgggcggg

SEQ ID NO: 994095 - RNA, 13 nt, Mycobacterium avium subsp. paratuberculosis
cggcgggcggcgg

SEQ ID NO: 994096 - RNA, 22 nt, Mycobacterium avium subsp. paratuberculosis
cggcgggcuggugcgcagccgu

SEQ ID NO: 994097 - RNA, 13 nt, Mycobacterium avium subsp. paratuberculosis
cggcggggaaggg

SEQ ID NO: 994098 - RNA, 18 nt, Mycobacterium avium subsp. paratuberculosis
cggcggggccuccaccag

SEQ ID NO: 994099 - RNA, 16 nt, Mycobacterium avium subsp. paratuberculosis
cggcggggcgucgccc

SEQ ID NO: 994100 - RNA, 16 nt, Mycobacterium avium subsp. paratuberculosis
cggcgggggcgggccc

SEQ ID NO: 994101 - RNA, 16 nt, Mycobacterium avium subsp. paratuberculosis
cggcgggggucggagc

SEQ ID NO: 994102 - RNA, 14 nt, Mycobacterium avium subsp. paratuberculosis
cggcgcugcccguc

SEQ ID NO: 994103 - RNA, 20 nt, Mycobacterium avium subsp. paratuberculosis
cggcgcugaacugcucgacc

SEQ ID NO: 994104 - RNA, 24 nt, Mycobacterium avium subsp. paratuberculosis
cggcgcucgcgggugcgcugcagc

SEQ ID NO: 994105 - RNA, 17 nt, Mycobacterium avium subsp. paratuberculosis
cggcgcuccagcgggcg

SEQ ID NO: 994106 - RNA, 16 nt, Mycobacterium avium subsp. paratuberculosis
cggcgcucgccgcgcg

SEQ ID NO: 994107 - RNA, 18 nt, Mycobacterium avium subsp. paratuberculosis
cggcgcucgccgcgcggc

SEQ ID NO: 994108 - RNA, 14 nt, Mycobacterium avium subsp. paratuberculosis
cggcgcgucggcgu

SEQ ID NO: 994109 - RNA, 17 nt, Mycobacterium avium subsp. paratuberculosis
cggcgcgugccaaccac

SEQ ID NO: 994110 - RNA, 16 nt, Mycobacterium avium subsp. paratuberculosis
cggcgcgugcgccgcg

SEQ ID NO: 994111 - RNA, 23 nt, Mycobacterium avium subsp. paratuberculosis
cggcgcguuccaucagcgcccgc

SEQ ID NO: 994112 - RNA, 18 nt, Mycobacterium avium subsp. paratuberculosis
cggcgcuaaagccaccag

SEQ ID NO: 994113 - RNA, 23 nt, Mycobacterium avium subsp. paratuberculosis
cggcgcuaaagccgaccgccccg

SEQ ID NO: 994114 - RNA, 17 nt, Mycobacterium avium subsp. paratuberculosis
cggcgcuacgccggcuc

SEQ ID NO: 994115 - RNA, 13 nt, Mycobacterium avium subsp. paratuberculosis
cggcgcucaccgg

SEQ ID NO: 994116 - RNA, 14 nt, Mycobacterium avium subsp. paratuberculosis
cggcgcggcccagg

SEQ ID NO: 994117 - RNA, 16 nt, Mycobacterium avium subsp. paratuberculosis
cggcgcggcccggccc

SEQ ID NO: 994118 - RNA, 21 nt, Mycobacterium avium subsp. paratuberculosis
cggcgcggcaguccgccggag

SEQ ID NO: 994119 - RNA, 16 nt, Mycobacterium avium subsp. paratuberculosis
cggcgcggagccggcc

SEQ ID NO: 994120 - RNA, 15 nt, Mycobacterium avium subsp. paratuberculosis
cggcgcggccacccc

SEQ ID NO: 994121 - RNA, 16 nt, Mycobacterium avium subsp. paratuberculosis
cggcgcggccaccccg

SEQ ID NO: 994122 - RNA, 14 nt, Mycobacterium avium subsp. paratuberculosis
cggcgcggccgccc

SEQ ID NO: 994123 - RNA, 15 nt, Mycobacterium avium subsp. paratuberculosis
cggcgcggcgcagcg

SEQ ID NO: 994124 - RNA, 16 nt, Mycobacterium avium subsp. paratuberculosis
cggcgcggcggcgccg

SEQ ID NO: 994125 - RNA, 18 nt, Mycobacterium avium subsp. paratuberculosis
cggcgcggcggcgccgcg

SEQ ID NO: 994126 - RNA, 13 nt, Mycobacterium avium subsp. paratuberculosis
cggcgcggggcca

SEQ ID NO: 994127 - RNA, 16 nt, Mycobacterium avium subsp. paratuberculosis
cggcgcgggccagcag

SEQ ID NO: 994128 - RNA, 16 nt, Mycobacterium avium subsp. paratuberculosis
cggcgcgggccgcagc

SEQ ID NO: 994129 - RNA, 17 nt, Mycobacterium avium subsp. paratuberculosis
cggcgcgggccgcagcg

SEQ ID NO: 994130 - RNA, 14 nt, Mycobacterium avium subsp. paratuberculosis
cggcgcggcucacg

SEQ ID NO: 994131 - RNA, 16 nt, Mycobacterium avium subsp. paratuberculosis
cggcgcgucgcugggc

SEQ ID NO: 994132 - RNA, 22 nt, Mycobacterium avium subsp. paratuberculosis
cggcgcggucgcaggccgcccg

SEQ ID NO: 994133 - RNA, 19 nt, Mycobacterium avium subsp. paratuberculosis
cggcgcgguugaccgccga

SEQ ID NO: 994134 - RNA, 14 nt, Mycobacterium avium subsp. paratuberculosis
cggcgcgguugacg

SEQ ID NO: 994135 - RNA, 15 nt, Mycobacterium avium subsp. paratuberculosis
cggcggaaguagccc

SEQ ID NO: 994136 - RNA, 19 nt, Mycobacterium avium subsp. paratuberculosis
cggcggaaguagcccggag

SEQ ID NO: 994137 - RNA, 18 nt, Mycobacterium avium subsp. paratuberculosis
cggcggagaugacgugga

SEQ ID NO: 994138 - RNA, 22 nt, Mycobacterium avium subsp. paratuberculosis
cggcggacuggcugagcagcac

SEQ ID NO: 994139 - RNA, 16 nt, Mycobacterium avium subsp. paratuberculosis
cggcggaccggcggcc

SEQ ID NO: 994140 - RNA, 18 nt, Mycobacterium avium subsp. paratuberculosis
cggcggaccggcggccgc

SEQ ID NO: 994141 - RNA, 14 nt, Mycobacterium avium subsp. paratuberculosis
cggcgcuugacgaa

SEQ ID NO: 994142 - RNA, 17 nt, Mycobacterium avium subsp. paratuberculosis
cggcggcaguccggcga

SEQ ID NO: 994143 - RNA, 18 nt, Mycobacterium avium subsp. paratuberculosis
cggcggcagucgcagcag

SEQ ID NO: 994144 - RNA, 21 nt, Mycobacterium avium subsp. paratuberculosis
cggcggcagauagaucagcag

SEQ ID NO: 994145 - RNA, 17 nt, Mycobacterium avium subsp. paratuberculosis
cggcggcagcagcccgu

SEQ ID NO: 994146 - RNA, 21 nt, Mycobacterium avium subsp. paratuberculosis
cggcggcagcgaggcgcgcag

SEQ ID NO: 994147 - RNA, 22 nt, Mycobacterium avium subsp. paratuberculosis
cggcggcagcgaggcgcgcagg

SEQ ID NO: 994148 - RNA, 20 nt, Mycobacterium avium subsp. paratuberculosis
cggcggccagcgcgacgcgc

SEQ ID NO: 994149 - RNA, 24 nt, Mycobacterium avium subsp. paratuberculosis
cggcggccagcgcgacgcgcaugc

SEQ ID NO: 994150 - RNA, 16 nt, Mycobacterium avium subsp. paratuberculosis
cggcggccaccucgcc

SEQ ID NO: 994151 - RNA, 20 nt, Mycobacterium avium subsp. paratuberculosis
cggcggccaccucgccgcag

SEQ ID NO: 994152 - RNA, 20 nt, Mycobacterium avium subsp. paratuberculosis
cggcggccaccucggcggca

SEQ ID NO: 994153 - RNA, 14 nt, Mycobacterium avium subsp. paratuberculosis
cggcggccacgcag

SEQ ID NO: 994154 - RNA, 19 nt, Mycobacterium avium subsp. paratuberculosis
cggcggccaacgcgacgaa

SEQ ID NO: 994155 - RNA, 12 nt, Mycobacterium avium subsp. paratuberculosis
cggcggccacca

SEQ ID NO: 994156 - RNA, 14 nt, Mycobacterium avium subsp. paratuberculosis
cggcggcaccgccg

SEQ ID NO: 994157 - RNA, 22 nt, Mycobacterium avium subsp. paratuberculosis
cggcggaggucagcggcccgau

SEQ ID NO: 994158 - RNA, 22 nt, Mycobacterium avium subsp. paratuberculosis
cggcggauccucaguccgcccc

SEQ ID NO: 994159 - RNA, 18 nt, Mycobacterium avium subsp. paratuberculosis
uuuucggugugccgcugc

SEQ ID NO: 994160 - RNA, 17 nt, Mycobacterium avium subsp. paratuberculosis
uuuggccugaaccagcu

SEQ ID NO: 994161 - RNA, 21 nt, Mycobacterium avium subsp. paratuberculosis
uuugcugccaagauugggcca

SEQ ID NO: 994162 - RNA, 16 nt, Mycobacterium avium subsp. paratuberculosis
uuugcgggucugcuca

SEQ ID NO: 994163 - RNA, 22 nt, Mycobacterium avium subsp. paratuberculosis
uuuguccggcucugccugcagg

SEQ ID NO: 994164 - RNA, 17 nt, Mycobacterium avium subsp. paratuberculosis
uucuacggcgggccggc

SEQ ID NO: 994165 - RNA, 17 nt, Mycobacterium avium subsp. paratuberculosis
uucggggugguggaagg

SEQ ID NO: 994166 - RNA, 22 nt, Mycobacterium avium subsp. paratuberculosis
uucggggguaaaccgccagcag

SEQ ID NO: 994167 - RNA, 21 nt, Mycobacterium avium subsp. paratuberculosis
uucgggccugaccaaggacaa

SEQ ID NO: 994168 - RNA, 12 nt, Mycobacterium avium subsp. paratuberculosis
uucggcgcggcu

SEQ ID NO: 994169 - RNA, 15 nt, Mycobacterium avium subsp. paratuberculosis
uucggccuugucgug

SEQ ID NO: 994170 - RNA, 21 nt, Mycobacterium avium subsp. paratuberculosis
uucugcacgacgaacaccacc

SEQ ID NO: 994171 - RNA, 16 nt, Mycobacterium avium subsp. paratuberculosis
uucugcccggccagca

SEQ ID NO: 994172 - RNA, 21 nt, Mycobacterium avium subsp. paratuberculosis
uucuccauggugaacugguug

SEQ ID NO: 994173 - RNA, 11 nt, Mycobacterium avium subsp. paratuberculosis
uucuccagcac

SEQ ID NO: 994174 - RNA, 24 nt, Mycobacterium avium subsp. paratuberculosis
uucuucgcgaagaacgacgccacc

SEQ ID NO: 994175 - RNA, 20 nt, Mycobacterium avium subsp. paratuberculosis
uucuucgccgcaaccuucuu

SEQ ID NO: 994176 - RNA, 20 nt, Mycobacterium avium subsp. paratuberculosis
uucuucgccggcgcuuugcc

SEQ ID NO: 994177 - RNA, 18 nt, Mycobacterium avium subsp. paratuberculosis
uucuucgcgggugccuuc

SEQ ID NO: 994178 - RNA, 13 nt, Mycobacterium avium subsp. paratuberculosis
uucugcugcacgu

SEQ ID NO: 994179 - RNA, 15 nt, Mycobacterium avium subsp. paratuberculosis
uugaucaguuccuug

SEQ ID NO: 994180 - RNA, 21 nt, Mycobacterium avium subsp. paratuberculosis
uugaucagcccgacccggcuc

SEQ ID NO: 994181 - RNA, 15 nt, Mycobacterium avium subsp. paratuberculosis
uugaucaccgugauc

SEQ ID NO: 994182 - RNA, 17 nt, Mycobacterium avium subsp. paratuberculosis
uugcacggcagcaacug

SEQ ID NO: 994183 - RNA, 22 nt, Mycobacterium avium subsp. paratuberculosis
uugaggcggcggcgggccaggg

SEQ ID NO: 994184 - RNA, 19 nt, Mycobacterium avium subsp. paratuberculosis
uugagcacggugaucagca

SEQ ID NO: 994185 - RNA, 22 nt, Mycobacterium avium subsp. paratuberculosis
uugagcacggugaucagcagca

SEQ ID NO: 994186 - RNA, 23 nt, Mycobacterium avium subsp. paratuberculosis
uugagcacggugaucagcagcag

SEQ ID NO: 994187 - RNA, 22 nt, Mycobacterium avium subsp. paratuberculosis
uugagcaccacgaggcuguggg

SEQ ID NO: 994188 - RNA, 23 nt, Mycobacterium avium subsp. paratuberculosis
uugagcaccagcccggccagcgg

SEQ ID NO: 994189 - RNA, 21 nt, Mycobacterium avium subsp. paratuberculosis
uugaccagcgugaauugcccc

SEQ ID NO: 994190 - RNA, 13 nt, Mycobacterium avium subsp. paratuberculosis
uugaccagcagcu

SEQ ID NO: 994191 - RNA, 12 nt, Mycobacterium avium subsp. paratuberculosis
uugaagcgcaga

SEQ ID NO: 994192 - RNA, 14 nt, Mycobacterium avium subsp. paratuberculosis
uuguccgaccagga

SEQ ID NO: 994193 - RNA, 19 nt, Mycobacterium avium subsp. paratuberculosis
uugucgcggcccagcacca

SEQ ID NO: 994194 - RNA, 22 nt, Mycobacterium avium subsp. paratuberculosis
uugucgcuguuagccucgccag

SEQ ID NO: 994195 - RNA, 13 nt, Mycobacterium avium subsp. paratuberculosis
uugucggcguggc

SEQ ID NO: 994196 - RNA, 15 nt, Mycobacterium avium subsp. paratuberculosis
uuguccggccagguc

SEQ ID NO: 994197 - RNA, 15 nt, Mycobacterium avium subsp. paratuberculosis
uugugcccgacggcg

SEQ ID NO: 994198 - RNA, 22 nt, Mycobacterium avium subsp. paratuberculosis
uuguggccacccucgccgccgc

SEQ ID NO: 994199 - RNA, 21 nt, Mycobacterium avium subsp. paratuberculosis
uuguuuuggccgugaaauauc

SEQ ID NO: 994200 - RNA, 23 nt, Mycobacterium avium subsp. paratuberculosis
uugguguaggcgaucgggaacag

SEQ ID NO: 994201 - RNA, 14 nt, Mycobacterium avium subsp. paratuberculosis
uuggugguggucgu

SEQ ID NO: 994202 - RNA, 14 nt, Mycobacterium avium subsp. paratuberculosis
uuggucaccagguc

SEQ ID NO: 994203 - RNA, 23 nt, Mycobacterium avium subsp. paratuberculosis
uugggcgugcggccgcagcgccc

SEQ ID NO: 994204 - RNA, 20 nt, Mycobacterium avium subsp. paratuberculosis
uugggcucggcgcgggagga

SEQ ID NO: 994205 - RNA, 13 nt, Mycobacterium avium subsp. paratuberculosis
uugggcagcagcu

SEQ ID NO: 994206 - RNA, 15 nt, Mycobacterium avium subsp. paratuberculosis
uugggcagcucggcg

SEQ ID NO: 994207 - RNA, 17 nt, Mycobacterium avium subsp. paratuberculosis
uugggcgccagcagcac

SEQ ID NO: 994208 - RNA, 12 nt, Mycobacterium avium subsp. paratuberculosis
uuggcguccaug

SEQ ID NO: 994209 - RNA, 17 nt, Mycobacterium avium subsp. paratuberculosis
uuggcggcgcacuccau

SEQ ID NO: 994210 - RNA, 19 nt, Mycobacterium avium subsp. paratuberculosis
uuggcggcggugaucucgu

SEQ ID NO: 994211 - RNA, 14 nt, Mycobacterium avium subsp. paratuberculosis
uuggcggccagcgc

SEQ ID NO: 994212 - RNA, 22 nt, Mycobacterium avium subsp. paratuberculosis
uuggcggccagcgcgccgccga

SEQ ID NO: 994213 - RNA, 15 nt, Mycobacterium avium subsp. paratuberculosis
uuggcgacgacggcg

SEQ ID NO: 994214 - RNA, 22 nt, Mycobacterium avium subsp. paratuberculosis
uuggcgacgcugaacagcagca

SEQ ID NO: 994215 - RNA, 23 nt, Mycobacterium avium subsp. paratuberculosis
uuggcgacgcugaacagcagcag

SEQ ID NO: 994216 - RNA, 13 nt, Mycobacterium avium subsp. paratuberculosis
uuggcgaucucga

SEQ ID NO: 994217 - RNA, 11 nt, Mycobacterium avium subsp. paratuberculosis
uuggccaggcg

SEQ ID NO: 994218 - RNA, 15 nt, Mycobacterium avium subsp. paratuberculosis
uuggccagcaccgcg

SEQ ID NO: 994219 - RNA, 13 nt, Mycobacterium avium subsp. paratuberculosis
uuggacagcagca

SEQ ID NO: 994220 - RNA, 13 nt, Mycobacterium avium subsp. paratuberculosis
uuggacagcggcg

SEQ ID NO: 994221 - RNA, 15 nt, Mycobacterium avium subsp. paratuberculosis
uuggacaggccggcg

SEQ ID NO: 994222 - RNA, 13 nt, Mycobacterium avium subsp. paratuberculosis
uuggacgacacca

SEQ ID NO: 994223 - RNA, 15 nt, Mycobacterium avium subsp. paratuberculosis
uugcugagccgccga

SEQ ID NO: 994224 - RNA, 14 nt, Mycobacterium avium subsp. paratuberculosis
uugcugcccagggc

SEQ ID NO: 994225 - RNA, 22 nt, Mycobacterium avium subsp. paratuberculosis
uugcugacgccgcggugcagca

SEQ ID NO: 994226 - RNA, 18 nt, Mycobacterium avium subsp. paratuberculosis
uugcuccacacuggcucu

SEQ ID NO: 994227 - RNA, 12 nt, Mycobacterium avium subsp. paratuberculosis
uugccaacacca

SEQ ID NO: 994228 - RNA, 16 nt, Mycobacterium avium subsp. paratuberculosis
uugcgccgcgagcgca

SEQ ID NO: 994229 - RNA, 14 nt, Mycobacterium avium subsp. paratuberculosis
uugcguucccagcc

SEQ ID NO: 994230 - RNA, 11 nt, Mycobacterium avium subsp. paratuberculosis
uugcgugcagc

SEQ ID NO: 994231 - RNA, 21 nt, Mycobacterium avium subsp. paratuberculosis
uugcgcgaaucgcaagcagag

SEQ ID NO: 994232 - RNA, 16 nt, Mycobacterium avium subsp. paratuberculosis
uuucacagcucaccug

SEQ ID NO: 994233 - RNA, 16 nt, Mycobacterium avium subsp. paratuberculosis
uuugagcauguugaac

SEQ ID NO: 994234 - RNA, 14 nt, Mycobacterium avium subsp. paratuberculosis
uuugcauacagcag

SEQ ID NO: 994235 - RNA, 10 nt, Mycobacterium avium subsp. paratuberculosis
uuugcccagc

SEQ ID NO: 994236 - RNA, 16 nt, Mycobacterium avium subsp. paratuberculosis
uuugccgucggugcgg

SEQ ID NO: 994237 - RNA, 14 nt, Mycobacterium avium subsp. paratuberculosis
uuuccccaccaggc

SEQ ID NO: 994238 - RNA, 15 nt, Mycobacterium avium subsp. paratuberculosis
uuucccgacuccuca

SEQ ID NO: 994239 - RNA, 16 nt, Mycobacterium avium subsp. paratuberculosis
uuucccgaguggcgcc

SEQ ID NO: 994240 - RNA, 13 nt, Mycobacterium avium subsp. paratuberculosis
uuuccacugccaa

SEQ ID NO: 994241 - RNA, 12 nt, Mycobacterium avium subsp. paratuberculosis
uuucggccgcgg

SEQ ID NO: 994242 - RNA, 13 nt, Mycobacterium avium subsp. paratuberculosis
uuucguggucucg

SEQ ID NO: 994243 - RNA, 13 nt, Mycobacterium avium subsp. paratuberculosis
uuucucagcggcg

SEQ ID NO: 994244 - RNA, 17 nt, Mycobacterium avium subsp. paratuberculosis
uuucugccggccgccgu

SEQ ID NO: 994245 - RNA, 24 nt, Mycobacterium avium subsp. paratuberculosis
ucaugucgaagaagcggccgacga

SEQ ID NO: 994246 - RNA, 13 nt, Mycobacterium avium subsp. paratuberculosis
ucauggacagcca

SEQ ID NO: 994247 - RNA, 15 nt, Mycobacterium avium subsp. paratuberculosis
ucauggucgucgucg

SEQ ID NO: 994248 - RNA, 16 nt, Mycobacterium avium subsp. paratuberculosis
ucauuccgccgcgccc

SEQ ID NO: 994249 - RNA, 18 nt, Mycobacterium avium subsp. paratuberculosis
uccaaccaccguggcccc

SEQ ID NO: 994250 - RNA, 18 nt, Mycobacterium avium subsp. paratuberculosis
uccaacguggguggcccc

SEQ ID NO: 994251 - RNA, 18 nt, Mycobacterium avium subsp. paratuberculosis
ucaugccgcccaucaccc

SEQ ID NO: 994252 - RNA, 20 nt, Mycobacterium avium subsp. paratuberculosis
ucaugccauagauguuggcg

SEQ ID NO: 994253 - RNA, 14 nt, Mycobacterium avium subsp. paratuberculosis
ucaugcccaccauc

SEQ ID NO: 994254 - RNA, 15 nt, Mycobacterium avium subsp. paratuberculosis
ucaugagcccuccag

SEQ ID NO: 994255 - RNA, 19 nt, Mycobacterium avium subsp. paratuberculosis
ucaugaucggcaggauccg

SEQ ID NO: 994256 - RNA, 16 nt, Mycobacterium avium subsp. paratuberculosis
ucaucuugguguugau

SEQ ID NO: 994257 - RNA, 17 nt, Mycobacterium avium subsp. paratuberculosis
ucaucucggcgaaguag

SEQ ID NO: 994258 - RNA, 12 nt, Mycobacterium avium subsp. paratuberculosis
ucaucguggcgc

SEQ ID NO: 994259 - RNA, 20 nt, Mycobacterium avium subsp. paratuberculosis
ucauccacucggccaccaug

SEQ ID NO: 994260 - RNA, 18 nt, Mycobacterium avium subsp. paratuberculosis
ucaucacgugcuggcgcu

SEQ ID NO: 994261 - RNA, 23 nt, Mycobacterium avium subsp. paratuberculosis
ucauccgggccaccaccacggcc

SEQ ID NO: 994262 - RNA, 21 nt, Mycobacterium avium subsp. paratuberculosis
ucauccggcugcccugggagg

SEQ ID NO: 994263 - RNA, 23 nt, Mycobacterium avium subsp. paratuberculosis
ucaucccggccaccccgcagaac

SEQ ID NO: 994264 - RNA, 16 nt, Mycobacterium avium subsp. paratuberculosis
ucaucccuagcgugcc

SEQ ID NO: 994265 - RNA, 12 nt, Mycobacterium avium subsp. paratuberculosis
ucauccagguga

SEQ ID NO: 994266 - RNA, 21 nt, Mycobacterium avium subsp. paratuberculosis
ucauccaggugaacagcagcc

SEQ ID NO: 994267 - RNA, 18 nt, Mycobacterium avium subsp. paratuberculosis
ucaucccccgcagcuucu

SEQ ID NO: 994268 - RNA, 15 nt, Mycobacterium avium subsp. paratuberculosis
ucaucgacuugccgc

SEQ ID NO: 994269 - RNA, 17 nt, Mycobacterium avium subsp. paratuberculosis
ucaucgcgcuggggugc

SEQ ID NO: 994270 - RNA, 21 nt, Mycobacterium avium subsp. paratuberculosis
ucaucgcgcuggggugcucga

SEQ ID NO: 994271 - RNA, 15 nt, Mycobacterium avium subsp. paratuberculosis
ucauaccagugcccg

SEQ ID NO: 994272 - RNA, 14 nt, Mycobacterium avium subsp. paratuberculosis
ucaguccagcuccc

SEQ ID NO: 994273 - RNA, 15 nt, Mycobacterium avium subsp. paratuberculosis
ucagguugcgcagca

SEQ ID NO: 994274 - RNA, 18 nt, Mycobacterium avium subsp. paratuberculosis
ucagguugcgcagcagcc

SEQ ID NO: 994275 - RNA, 17 nt, Mycobacterium avium subsp. paratuberculosis
ucaguaccggcgaugcc

SEQ ID NO: 994276 - RNA, 20 nt, Mycobacterium avium subsp. paratuberculosis
ucagcugaacggugcccgcc

SEQ ID NO: 994277 - RNA, 23 nt, Mycobacterium avium subsp. paratuberculosis
ucagcucuucgacgauguuggcg

SEQ ID NO: 994278 - RNA, 15 nt, Mycobacterium avium subsp. paratuberculosis
ucagcuucaugcccu

SEQ ID NO: 994279 - RNA, 21 nt, Mycobacterium avium subsp. paratuberculosis
ucagcuucaugcccuuggccc

SEQ ID NO: 994280 - RNA, 22 nt, Mycobacterium avium subsp. paratuberculosis
ucagcuucaugcccuuggcccg

SEQ ID NO: 994281 - RNA, 14 nt, Mycobacterium avium subsp. paratuberculosis
ucagcuggugcaga

SEQ ID NO: 994282 - RNA, 17 nt, Mycobacterium avium subsp. paratuberculosis
ucagcuccucgcggaac

SEQ ID NO: 994283 - RNA, 15 nt, Mycobacterium avium subsp. paratuberculosis
ucagcucguggcggg

SEQ ID NO: 994284 - RNA, 15 nt, Mycobacterium avium subsp. paratuberculosis
ucagcucggcggccu

SEQ ID NO: 994285 - RNA, 17 nt, Mycobacterium avium subsp. paratuberculosis
ucagcucgucagcgcgg

SEQ ID NO: 994286 - RNA, 20 nt, Mycobacterium avium subsp. paratuberculosis
ucagcucgcgcccggccagg

SEQ ID NO: 994287 - RNA, 23 nt, Mycobacterium avium subsp. paratuberculosis
ucaggaccucgaagcagccuucu

SEQ ID NO: 994288 - RNA, 20 nt, Mycobacterium avium subsp. paratuberculosis
ucaggaacccggcccggaac

SEQ ID NO: 994289 - RNA, 22 nt, Mycobacterium avium subsp. paratuberculosis
ucaggaacggccggauggccag

SEQ ID NO: 994290 - RNA, 14 nt, Mycobacterium avium subsp. paratuberculosis
ucagcgccaccagc

SEQ ID NO: 994291 - RNA, 15 nt, Mycobacterium avium subsp. paratuberculosis
ucagcgccaccagca

SEQ ID NO: 994292 - RNA, 16 nt, Mycobacterium avium subsp. paratuberculosis
ucagcgccagcaugcc

SEQ ID NO: 994293 - RNA, 21 nt, Mycobacterium avium subsp. paratuberculosis
ucagcgcgccgcccagcggug

SEQ ID NO: 994294 - RNA, 18 nt, Mycobacterium avium subsp. paratuberculosis
ucagcgcccgcccggccc

SEQ ID NO: 994295 - RNA, 19 nt, Mycobacterium avium subsp. paratuberculosis
ucagcgccgcccgcaguuc

SEQ ID NO: 994296 - RNA, 12 nt, Mycobacterium avium subsp. paratuberculosis
ucagcgucagca

SEQ ID NO: 994297 - RNA, 18 nt, Mycobacterium avium subsp. paratuberculosis
ucagcggguuugacgucg

SEQ ID NO: 994298 - RNA, 19 nt, Mycobacterium avium subsp. paratuberculosis
ucagcggccucggaagggc

SEQ ID NO: 994299 - RNA, 16 nt, Mycobacterium avium subsp. paratuberculosis
ucagcgggcggccagc

SEQ ID NO: 994300 - RNA, 14 nt, Mycobacterium avium subsp. paratuberculosis
ucagcggccagccc

SEQ ID NO: 994301 - RNA, 17 nt, Mycobacterium avium subsp. paratuberculosis
ucagcggccagcccauc

SEQ ID NO: 994302 - RNA, 21 nt, Mycobacterium avium subsp. paratuberculosis
ucagcgcguccaaccgcggac

SEQ ID NO: 994303 - RNA, 15 nt, Mycobacterium avium subsp. paratuberculosis
ucagcgcgggccagc

SEQ ID NO: 994304 - RNA, 20 nt, Mycobacterium avium subsp. paratuberculosis
ucagcggcaacacgccggcg

SEQ ID NO: 994305 - RNA, 18 nt, Mycobacterium avium subsp. paratuberculosis
ucaggagugcucggcguu

SEQ ID NO: 994306 - RNA, 20 nt, Mycobacterium avium subsp. paratuberculosis
ucaggaucgacgucgacuga

SEQ ID NO: 994307 - RNA, 19 nt, Mycobacterium avium subsp. paratuberculosis
ucaggaucgacuccgggug

SEQ ID NO: 994308 - RNA, 15 nt, Mycobacterium avium subsp. paratuberculosis
ucaggaucagcagcc

SEQ ID NO: 994309 - RNA, 15 nt, Mycobacterium avium subsp. paratuberculosis
ucaggccggucagcg

SEQ ID NO: 994310 - RNA, 15 nt, Mycobacterium avium subsp. paratuberculosis
ucaggccggccacca

SEQ ID NO: 994311 - RNA, 17 nt, Mycobacterium avium subsp. paratuberculosis
ucaggccguagcggcuc

SEQ ID NO: 994312 - RNA, 17 nt, Mycobacterium avium subsp. paratuberculosis
ucaggcgcagccagcgg

SEQ ID NO: 994313 - RNA, 19 nt, Mycobacterium avium subsp. paratuberculosis
ucaggcggucgaacgcggc

SEQ ID NO: 994314 - RNA, 14 nt, Mycobacterium avium subsp. paratuberculosis
ucaggcguccagca

SEQ ID NO: 994315 - RNA, 20 nt, Mycobacterium avium subsp. paratuberculosis
ucaggcccuugccccaccac

SEQ ID NO: 994316 - RNA, 12 nt, Mycobacterium avium subsp. paratuberculosis
ucaggcccagcg

SEQ ID NO: 994317 - RNA, 20 nt, Mycobacterium avium subsp. paratuberculosis
ucaggccccacccgcagugc

SEQ ID NO: 994318 - RNA, 19 nt, Mycobacterium avium subsp. paratuberculosis
ucaggcguccgcaagcacc

SEQ ID NO: 994319 - RNA, 15 nt, Mycobacterium avium subsp. paratuberculosis
ucagggcgcucauca

SEQ ID NO: 994320 - RNA, 22 nt, Mycobacterium avium subsp. paratuberculosis
ucagggcggcgccgcggcccug

SEQ ID NO: 994321 - RNA, 21 nt, Mycobacterium avium subsp. paratuberculosis
ucagggagcugcccgcacugg

SEQ ID NO: 994322 - RNA, 17 nt, Mycobacterium avium subsp. paratuberculosis
ucagggcccacagcagc

SEQ ID NO: 994323 - RNA, 21 nt, Mycobacterium avium subsp. paratuberculosis
ucagggccagcaacaccagcu

SEQ ID NO: 994324 - RNA, 15 nt, Mycobacterium avium subsp. paratuberculosis
ucagggccgcggccg

SEQ ID NO: 994325 - RNA, 18 nt, Mycobacterium avium subsp. paratuberculosis
ucaggucaguucagguug

SEQ ID NO: 994326 - RNA, 13 nt, Mycobacterium avium subsp. paratuberculosis
ucaggucgaagcc

SEQ ID NO: 994327 - RNA, 15 nt, Mycobacterium avium subsp. paratuberculosis
ucaggucggccgcgg

SEQ ID NO: 994328 - RNA, 16 nt, Mycobacterium avium subsp. paratuberculosis
ucaggggugccagccg

SEQ ID NO: 994329 - RNA, 21 nt, Mycobacterium avium subsp. paratuberculosis
ucagggugucgaacagcaggc

SEQ ID NO: 994330 - RNA, 18 nt, Mycobacterium avium subsp. paratuberculosis
ucagggugugacggaucc

SEQ ID NO: 994331 - RNA, 14 nt, Mycobacterium avium subsp. paratuberculosis
ucagggugcucagc

SEQ ID NO: 994332 - RNA, 18 nt, Mycobacterium avium subsp. paratuberculosis
ucagguagccgaggucgc

SEQ ID NO: 994333 - RNA, 14 nt, Mycobacterium avium subsp. paratuberculosis
ucagguaucucuga

SEQ ID NO: 994334 - RNA, 16 nt, Mycobacterium avium subsp. paratuberculosis
uccaaugcgcccuggu

SEQ ID NO: 994335 - RNA, 17 nt, Mycobacterium avium subsp. paratuberculosis
uccaaggagaaggccgc

SEQ ID NO: 994336 - RNA, 12 nt, Mycobacterium avium subsp. paratuberculosis
uccacagcgcga

SEQ ID NO: 994337 - RNA, 10 nt, Mycobacterium avium subsp. paratuberculosis
uccacagcag

SEQ ID NO: 994338 - RNA, 22 nt, Mycobacterium avium subsp. paratuberculosis
uccaccaaacgaagugaugcug

SEQ ID NO: 994339 - RNA, 20 nt, Mycobacterium avium subsp. paratuberculosis
uccaccaaggucuccgggcu

SEQ ID NO: 994340 - RNA, 18 nt, Mycobacterium avium subsp. paratuberculosis
uccaccaauucgcgcugc

SEQ ID NO: 994341 - RNA, 12 nt, Mycobacterium avium subsp. paratuberculosis
uccaccaccggc

SEQ ID NO: 994342 - RNA, 15 nt, Mycobacterium avium subsp. paratuberculosis
uccaccaccuggccg

SEQ ID NO: 994343 - RNA, 18 nt, Mycobacterium avium subsp. paratuberculosis
uccaccagcggccgucgc

SEQ ID NO: 994344 - RNA, 19 nt, Mycobacterium avium subsp. paratuberculosis
uccaccagcgcggugaugu

SEQ ID NO: 994345 - RNA, 18 nt, Mycobacterium avium subsp. paratuberculosis
uccaccagaucgccccgc

SEQ ID NO: 994346 - RNA, 21 nt, Mycobacterium avium subsp. paratuberculosis
uccacccgccccuccaggcau

SEQ ID NO: 994347 - RNA, 22 nt, Mycobacterium avium subsp. paratuberculosis
uccacccgccccuccaggcaug

SEQ ID NO: 994348 - RNA, 14 nt, Mycobacterium avium subsp. paratuberculosis
uccacccggcccac

SEQ ID NO: 994349 - RNA, 17 nt, Mycobacterium avium subsp. paratuberculosis
uccacccggcccaccac

SEQ ID NO: 994350 - RNA, 13 nt, Mycobacterium avium subsp. paratuberculosis
uccaccagggugg

SEQ ID NO: 994351 - RNA, 19 nt, Mycobacterium avium subsp. paratuberculosis
uccaccaggguggccgcca

SEQ ID NO: 994352 - RNA, 19 nt, Mycobacterium avium subsp. paratuberculosis
uccaccaggugaccggccu

SEQ ID NO: 994353 - RNA, 20 nt, Mycobacterium avium subsp. paratuberculosis
uccaccaguguccgggcgcc

SEQ ID NO: 994354 - RNA, 18 nt, Mycobacterium avium subsp. paratuberculosis
uccaccggcacggcaccg

SEQ ID NO: 994355 - RNA, 22 nt, Mycobacterium avium subsp. paratuberculosis
uccaccggccgauggcccaggc

SEQ ID NO: 994356 - RNA, 14 nt, Mycobacterium avium subsp. paratuberculosis
uccaccgggccgcc

SEQ ID NO: 994357 - RNA, 15 nt, Mycobacterium avium subsp. paratuberculosis
uccaccguugucucg

SEQ ID NO: 994358 - RNA, 22 nt, Mycobacterium avium subsp. paratuberculosis
uccaccggaaccguuugucccu

SEQ ID NO: 994359 - RNA, 13 nt, Mycobacterium avium subsp. paratuberculosis
uccaccgacgcca

SEQ ID NO: 994360 - RNA, 15 nt, Mycobacterium avium subsp. paratuberculosis
uccaccgccgcgccg

SEQ ID NO: 994361 - RNA, 16 nt, Mycobacterium avium subsp. paratuberculosis
uccacgucgcccagcg

SEQ ID NO: 994362 - RNA, 19 nt, Mycobacterium avium subsp. paratuberculosis
uccacggcauggugaugau

SEQ ID NO: 994363 - RNA, 17 nt, Mycobacterium avium subsp. paratuberculosis
uccacgcggugauccag

SEQ ID NO: 994364 - RNA, 17 nt, Mycobacterium avium subsp. paratuberculosis
uccacgccguguugacg

SEQ ID NO: 994365 - RNA, 19 nt, Mycobacterium avium subsp. paratuberculosis
uccacgccgccgggaacag

SEQ ID NO: 994366 - RNA, 22 nt, Mycobacterium avium subsp. paratuberculosis
uccacgucgucggacagcagca

SEQ ID NO: 994367 - RNA, 14 nt, Mycobacterium avium subsp. paratuberculosis
uccacgugucggcg

SEQ ID NO: 994368 - RNA, 15 nt, Mycobacterium avium subsp. paratuberculosis
uccacuccagcaccg

SEQ ID NO: 994369 - RNA, 22 nt, Mycobacterium avium subsp. paratuberculosis
uccacucccgcgcgcuguccuc

SEQ ID NO: 994370 - RNA, 14 nt, Mycobacterium avium subsp. paratuberculosis
uccacucgaugucc

SEQ ID NO: 994371 - RNA, 13 nt, Mycobacterium avium subsp. paratuberculosis
uccagaccggccg

SEQ ID NO: 994372 - RNA, 21 nt, Mycobacterium avium subsp. paratuberculosis
uccagaccggccggggcgggc

SEQ ID NO: 994373 - RNA, 15 nt, Mycobacterium avium subsp. paratuberculosis
uccagacguugaucu

SEQ ID NO: 994374 - RNA, 18 nt, Mycobacterium avium subsp. paratuberculosis
uccagagcaucagggcgu

SEQ ID NO: 994375 - RNA, 17 nt, Mycobacterium avium subsp. paratuberculosis
uccagaucggccagcgc

SEQ ID NO: 994376 - RNA, 23 nt, Mycobacterium avium subsp. paratuberculosis
uccagaucugucuucgcggucuc

SEQ ID NO: 994377 - RNA, 20 nt, Mycobacterium avium subsp. paratuberculosis
uccagcacggccgccaggau

SEQ ID NO: 994378 - RNA, 16 nt, Mycobacterium avium subsp. paratuberculosis
uccagcacgugcccag

SEQ ID NO: 994379 - RNA, 18 nt, Mycobacterium avium subsp. paratuberculosis
uccagcacgugcccagcc

SEQ ID NO: 994380 - RNA, 22 nt, Mycobacterium avium subsp. paratuberculosis
uccagcacccggcccacgccgu

SEQ ID NO: 994381 - RNA, 18 nt, Mycobacterium avium subsp. paratuberculosis
uccagcaccagcacggcg

SEQ ID NO: 994382 - RNA, 22 nt, Mycobacterium avium subsp. paratuberculosis
uccagcaacugcucgaccagcc

SEQ ID NO: 994383 - RNA, 12 nt, Mycobacterium avium subsp. paratuberculosis
uccagcggcgca

SEQ ID NO: 994384 - RNA, 19 nt, Mycobacterium avium subsp. paratuberculosis
uccagcuguugacgggccg

SEQ ID NO: 994385 - RNA, 13 nt, Mycobacterium avium subsp. paratuberculosis
uccagcuccucgg

SEQ ID NO: 994386 - RNA, 21 nt, Mycobacterium avium subsp. paratuberculosis
uccagcuccguccaccggcac

SEQ ID NO: 994387 - RNA, 18 nt, Mycobacterium avium subsp. paratuberculosis
uccagcuccgcggccagc

SEQ ID NO: 994388 - RNA, 23 nt, Mycobacterium avium subsp. paratuberculosis
uccaggaaacggcccaucacguc

SEQ ID NO: 994389 - RNA, 12 nt, Mycobacterium avium subsp. paratuberculosis
uccagcuuugcc

SEQ ID NO: 994390 - RNA, 18 nt, Mycobacterium avium subsp. paratuberculosis
uccaggauggggaagucc

SEQ ID NO: 994391 - RNA, 22 nt, Mycobacterium avium subsp. paratuberculosis
uccaggauccgcaccgggcagc

SEQ ID NO: 994392 - RNA, 20 nt, Mycobacterium avium subsp. paratuberculosis
uccaggaucugcagcacgcc

SEQ ID NO: 994393 - RNA, 16 nt, Mycobacterium avium subsp. paratuberculosis
uccaggcgaccggccc

SEQ ID NO: 994394 - RNA, 19 nt, Mycobacterium avium subsp. paratuberculosis
uccaggccggcgccgcggg

SEQ ID NO: 994395 - RNA, 16 nt, Mycobacterium avium subsp. paratuberculosis
uccaggcgcaccgcca

SEQ ID NO: 994396 - RNA, 16 nt, Mycobacterium avium subsp. paratuberculosis
uccagcgccagcgagu

SEQ ID NO: 994397 - RNA, 16 nt, Mycobacterium avium subsp. paratuberculosis
uccagccggugcacca

SEQ ID NO: 994398 - RNA, 15 nt, Mycobacterium avium subsp. paratuberculosis
uccagccgugcuggg

SEQ ID NO: 994399 - RNA, 19 nt, Mycobacterium avium subsp. paratuberculosis
uccagccuugcagccgcug

SEQ ID NO: 994400 - RNA, 21 nt, Mycobacterium avium subsp. paratuberculosis
uccagccuugcagccgcugcc

SEQ ID NO: 994401 - RNA, 13 nt, Mycobacterium avium subsp. paratuberculosis
uccagcgcccgcc

SEQ ID NO: 994402 - RNA, 22 nt, Mycobacterium avium subsp. paratuberculosis
uccagcgcccgccgcaacgcgu

SEQ ID NO: 994403 - RNA, 13 nt, Mycobacterium avium subsp. paratuberculosis
uccagcgcacaca

SEQ ID NO: 994404 - RNA, 19 nt, Mycobacterium avium subsp. paratuberculosis
uccagcgccggcaccagca

SEQ ID NO: 994405 - RNA, 17 nt, Mycobacterium avium subsp. paratuberculosis
uccagcggccacaccgg

SEQ ID NO: 994406 - RNA, 23 nt, Mycobacterium avium subsp. paratuberculosis
uccagcggccacaccggggccag

SEQ ID NO: 994407 - RNA, 15 nt, Mycobacterium avium subsp. paratuberculosis
uccagcgcggugagc

SEQ ID NO: 994408 - RNA, 18 nt, Mycobacterium avium subsp. paratuberculosis
uccagcgcggugagcagc

SEQ ID NO: 994409 - RNA, 23 nt, Mycobacterium avium subsp. paratuberculosis
uccagcgcggugagcagcaugcc

SEQ ID NO: 994410 - RNA, 20 nt, Mycobacterium avium subsp. paratuberculosis
uccagcccagcgcccguagc

SEQ ID NO: 994411 - RNA, 12 nt, Mycobacterium avium subsp. paratuberculosis
uccagccagcgc

SEQ ID NO: 994412 - RNA, 22 nt, Mycobacterium avium subsp. paratuberculosis
uccagccgaucgcggugcugca

SEQ ID NO: 994413 - RNA, 15 nt, Mycobacterium avium subsp. paratuberculosis
uccagccgcgcggcc

SEQ ID NO: 994414 - RNA, 22 nt, Mycobacterium avium subsp. paratuberculosis
uccagccgcgcggccgccuccg

SEQ ID NO: 994415 - RNA, 21 nt, Mycobacterium avium subsp. paratuberculosis
uccagcagcgccagcaccgcc

SEQ ID NO: 994416 - RNA, 22 nt, Mycobacterium avium subsp. paratuberculosis
uccagcagcgccagcaccgccu

SEQ ID NO: 994417 - RNA, 13 nt, Mycobacterium avium subsp. paratuberculosis
uccagcagcgccg

SEQ ID NO: 994418 - RNA, 23 nt, Mycobacterium avium subsp. paratuberculosis
uccagcagcccgggcugcagcag

SEQ ID NO: 994419 - RNA, 11 nt, Mycobacterium avium subsp. paratuberculosis
uccagcaggcg

SEQ ID NO: 994420 - RNA, 16 nt, Mycobacterium avium subsp. paratuberculosis
uccagcaggcgcgccg

SEQ ID NO: 994421 - RNA, 15 nt, Mycobacterium avium subsp. paratuberculosis
uccaguucggccagc

SEQ ID NO: 994422 - RNA, 18 nt, Mycobacterium avium subsp. paratuberculosis
uccaguugcgaccccgcc

SEQ ID NO: 994423 - RNA, 13 nt, Mycobacterium avium subsp. paratuberculosis
uccaguccggccg

SEQ ID NO: 994424 - RNA, 21 nt, Mycobacterium avium subsp. paratuberculosis
uccagguagcccaugucgccg

SEQ ID NO: 994425 - RNA, 20 nt, Mycobacterium avium subsp. paratuberculosis
uccaggguggccagcacgcu

SEQ ID NO: 994426 - RNA, 23 nt, Mycobacterium avium subsp. paratuberculosis
uccaggguggccagcacgcugcg

SEQ ID NO: 994427 - RNA, 16 nt, Mycobacterium avium subsp. paratuberculosis
uccagguacacguagc

SEQ ID NO: 994428 - RNA, 14 nt, Mycobacterium avium subsp. paratuberculosis
uccagguccgggaa

SEQ ID NO: 994429 - RNA, 20 nt, Mycobacterium avium subsp. paratuberculosis
uccagguggggugguggaau

SEQ ID NO: 994430 - RNA, 15 nt, Mycobacterium avium subsp. paratuberculosis
uccaggugaaugcuc

SEQ ID NO: 994431 - RNA, 15 nt, Mycobacterium avium subsp. paratuberculosis
uccaucauggcgcug

SEQ ID NO: 994432 - RNA, 20 nt, Mycobacterium avium subsp. paratuberculosis
uccaucgggcccagcagccu

SEQ ID NO: 994433 - RNA, 17 nt, Mycobacterium avium subsp. paratuberculosis
uccauccagcgccgcag

SEQ ID NO: 994434 - RNA, 13 nt, Mycobacterium avium subsp. paratuberculosis
uccauccgggaga

SEQ ID NO: 994435 - RNA, 18 nt, Mycobacterium avium subsp. paratuberculosis
uccauccgggcggccagc

SEQ ID NO: 994436 - RNA, 21 nt, Mycobacterium avium subsp. paratuberculosis
ucccacaccaccaccgagccg

SEQ ID NO: 994437 - RNA, 14 nt, Mycobacterium avium subsp. paratuberculosis
ucccaccacggccg

SEQ ID NO: 994438 - RNA, 17 nt, Mycobacterium avium subsp. paratuberculosis
ucccacccgcaacgcug

SEQ ID NO: 994439 - RNA, 17 nt, Mycobacterium avium subsp. paratuberculosis
ucccacugcccguaguc

SEQ ID NO: 994440 - RNA, 17 nt, Mycobacterium avium subsp. paratuberculosis
ucccagacccagcaucg

SEQ ID NO: 994441 - RNA, 14 nt, Mycobacterium avium subsp. paratuberculosis
uccauugggccgcg

SEQ ID NO: 994442 - RNA, 19 nt, Mycobacterium avium subsp. paratuberculosis
uccaugucgucgagcucga

SEQ ID NO: 994443 - RNA, 22 nt, Mycobacterium avium subsp. paratuberculosis
uccaugucgacgacguugcggg

SEQ ID NO: 994444 - RNA, 12 nt, Mycobacterium avium subsp. paratuberculosis
uccaugucgucg

SEQ ID NO: 994445 - RNA, 20 nt, Mycobacterium avium subsp. paratuberculosis
uccauggugaacugguugac

SEQ ID NO: 994446 - RNA, 20 nt, Mycobacterium avium subsp. paratuberculosis
uccauguaguucagcagccg

SEQ ID NO: 994447 - RNA, 16 nt, Mycobacterium avium subsp. paratuberculosis
uccaucuccagcuccg

SEQ ID NO: 994448 - RNA, 16 nt, Mycobacterium avium subsp. paratuberculosis
uccaugaacggcagcu

SEQ ID NO: 994449 - RNA, 23 nt, Mycobacterium avium subsp. paratuberculosis
uccaugcccgcccacgggucgcc

SEQ ID NO: 994450 - RNA, 18 nt, Mycobacterium avium subsp. paratuberculosis
ucccaucggggcuacaaa

SEQ ID NO: 994451 - RNA, 15 nt, Mycobacterium avium subsp. paratuberculosis
ucccagcacagccgu

SEQ ID NO: 994452 - RNA, 19 nt, Mycobacterium avium subsp. paratuberculosis
ucccagccggacagcgggu

SEQ ID NO: 994453 - RNA, 14 nt, Mycobacterium avium subsp. paratuberculosis
ucccaggaccacuc

SEQ ID NO: 994454 - RNA, 16 nt, Mycobacterium avium subsp. paratuberculosis
ucccaggaccacuccu

SEQ ID NO: 994455 - RNA, 16 nt, Mycobacterium avium subsp. paratuberculosis
ucccagcggccgaggg

SEQ ID NO: 994456 - RNA, 17 nt, Mycobacterium avium subsp. paratuberculosis
ucccagucccagcacag

SEQ ID NO: 994457 - RNA, 20 nt, Mycobacterium avium subsp. paratuberculosis
ucccaguuguuuccccagcc

SEQ ID NO: 994458 - RNA, 18 nt, Mycobacterium avium subsp. paratuberculosis
ucccccaaaacccggcau

SEQ ID NO: 994459 - RNA, 17 nt, Mycobacterium avium subsp. paratuberculosis
uccccaucucgagcagg

SEQ ID NO: 994460 - RNA, 20 nt, Mycobacterium avium subsp. paratuberculosis
uccccauccgcggccaccgg

SEQ ID NO: 994461 - RNA, 18 nt, Mycobacterium avium subsp. paratuberculosis
uccccgaagcgcuaacaa

SEQ ID NO: 994462 - RNA, 17 nt, Mycobacterium avium subsp. paratuberculosis
ucccccuugccggugaa

SEQ ID NO: 994463 - RNA, 14 nt, Mycobacterium avium subsp. paratuberculosis
uccccgaccacacc

SEQ ID NO: 994464 - RNA, 15 nt, Mycobacterium avium subsp. paratuberculosis
ucccccgucgggccg

SEQ ID NO: 994465 - RNA, 19 nt, Mycobacterium avium subsp. paratuberculosis
uccccccauacacgggccg

SEQ ID NO: 994466 - RNA, 14 nt, Mycobacterium avium subsp. paratuberculosis
ucccccgccgaccg

SEQ ID NO: 994467 - RNA, 15 nt, Mycobacterium avium subsp. paratuberculosis
uccccggacagccac

SEQ ID NO: 994468 - RNA, 16 nt, Mycobacterium avium subsp. paratuberculosis
uccccgcguuggccag

SEQ ID NO: 994469 - RNA, 12 nt, Mycobacterium avium subsp. paratuberculosis
uccccgcggcca

SEQ ID NO: 994470 - RNA, 19 nt, Mycobacterium avium subsp. paratuberculosis
uccccgcggccaccccgga

SEQ ID NO: 994471 - RNA, 21 nt, Mycobacterium avium subsp. paratuberculosis
uccccgcgggugacgcugacc

SEQ ID NO: 994472 - RNA, 23 nt, Mycobacterium avium subsp. paratuberculosis
uccccgcaaacacgagcagaccc

SEQ ID NO: 994473 - RNA, 22 nt, Mycobacterium avium subsp. paratuberculosis
uccccgccgguggcggcgagga

SEQ ID NO: 994474 - RNA, 17 nt, Mycobacterium avium subsp. paratuberculosis
uccccgccucgguugau

SEQ ID NO: 994475 - RNA, 15 nt, Mycobacterium avium subsp. paratuberculosis
uccccgcgcggcucg

SEQ ID NO: 994476 - RNA, 16 nt, Mycobacterium avium subsp. paratuberculosis
uccgacggcugggugg

SEQ ID NO: 994477 - RNA, 14 nt, Mycobacterium avium subsp. paratuberculosis
uccgacggcuucca

SEQ ID NO: 994478 - RNA, 16 nt, Mycobacterium avium subsp. paratuberculosis
uccgacuccagcagcg

SEQ ID NO: 994479 - RNA, 14 nt, Mycobacterium avium subsp. paratuberculosis
uccgaccagcaccc

SEQ ID NO: 994480 - RNA, 16 nt, Mycobacterium avium subsp. paratuberculosis
uccgaccgccaccacc

SEQ ID NO: 994481 - RNA, 19 nt, Mycobacterium avium subsp. paratuberculosis
uccgaccgccaccacccgg

SEQ ID NO: 994482 - RNA, 20 nt, Mycobacterium avium subsp. paratuberculosis
uccgaccgccaccacccggc

SEQ ID NO: 994483 - RNA, 22 nt, Mycobacterium avium subsp. paratuberculosis
uccgaccgugaagcuaguuuca

SEQ ID NO: 994484 - RNA, 23 nt, Mycobacterium avium subsp. paratuberculosis
uccgaccgugaagcuaguuucac

SEQ ID NO: 994485 - RNA, 16 nt, Mycobacterium avium subsp. paratuberculosis
uccgaauccagcgcgc

SEQ ID NO: 994486 - RNA, 20 nt, Mycobacterium avium subsp. paratuberculosis
uccgaauccagcgcgccgcu

SEQ ID NO: 994487 - RNA, 12 nt, Mycobacterium avium subsp. paratuberculosis
uccgacaccacc

SEQ ID NO: 994488 - RNA, 14 nt, Mycobacterium avium subsp. paratuberculosis
uccgacagcgccug

SEQ ID NO: 994489 - RNA, 18 nt, Mycobacterium avium subsp. paratuberculosis
uccgaucgcggcccccug

SEQ ID NO: 994490 - RNA, 15 nt, Mycobacterium avium subsp. paratuberculosis
uccgauugcggcgca

SEQ ID NO: 994491 - RNA, 20 nt, Mycobacterium avium subsp. paratuberculosis
uccgcaaccgccggcagcgg

SEQ ID NO: 994492 - RNA, 23 nt, Mycobacterium avium subsp. paratuberculosis
uccgaguugauaggucacgccgg

SEQ ID NO: 994493 - RNA, 16 nt, Mycobacterium avium subsp. paratuberculosis
uccgaggucagcgcgu

SEQ ID NO: 994494 - RNA, 13 nt, Mycobacterium avium subsp. paratuberculosis
uccgaucagcagc

SEQ ID NO: 994495 - RNA, 18 nt, Mycobacterium avium subsp. paratuberculosis
uccgaucaucagggcaaa

SEQ ID NO: 994496 - RNA, 21 nt, Mycobacterium avium subsp. paratuberculosis
uccgagcaucggguugccggc

SEQ ID NO: 994497 - RNA, 17 nt, Mycobacterium avium subsp. paratuberculosis
uccgagauggacagcac

SEQ ID NO: 994498 - RNA, 23 nt, Mycobacterium avium subsp. paratuberculosis
uccgagcagcagccgcagcggcg

SEQ ID NO: 994499 - RNA, 18 nt, Mycobacterium avium subsp. paratuberculosis
uccgagcgggccguggca

SEQ ID NO: 994500 - RNA, 18 nt, Mycobacterium avium subsp. paratuberculosis
uccgaggcguccuccucg

SEQ ID NO: 994501 - RNA, 16 nt, Mycobacterium avium subsp. paratuberculosis
ucccuugccgccgaaa

SEQ ID NO: 994502 - RNA, 21 nt, Mycobacterium avium subsp. paratuberculosis
ucccugcggcugcaucaugcc

SEQ ID NO: 994503 - RNA, 12 nt, Mycobacterium avium subsp. paratuberculosis
ucccguugcggu

SEQ ID NO: 994504 - RNA, 22 nt, Mycobacterium avium subsp. paratuberculosis
ucccggggcucgacaggcagcc

SEQ ID NO: 994505 - RNA, 15 nt, Mycobacterium avium subsp. paratuberculosis
ucccgggugggcagc

SEQ ID NO: 994506 - RNA, 17 nt, Mycobacterium avium subsp. paratuberculosis
ucccgguagagcggcac

SEQ ID NO: 994507 - RNA, 22 nt, Mycobacterium avium subsp. paratuberculosis
ucccggucguagucggcccgcc

SEQ ID NO: 994508 - RNA, 16 nt, Mycobacterium avium subsp. paratuberculosis
ucccguccugggccug

SEQ ID NO: 994509 - RNA, 24 nt, Mycobacterium avium subsp. paratuberculosis
ucccgucgaccaggacgucggccg

SEQ ID NO: 994510 - RNA, 18 nt, Mycobacterium avium subsp. paratuberculosis
ucccgugcgccgcccaca

SEQ ID NO: 994511 - RNA, 21 nt, Mycobacterium avium subsp. paratuberculosis
ucccgugcgccgcccacaccg

SEQ ID NO: 994512 - RNA, 22 nt, Mycobacterium avium subsp. paratuberculosis
ucccgucgcgacgagcgggccg

SEQ ID NO: 994513 - RNA, 12 nt, Mycobacterium avium subsp. paratuberculosis
ucccgucggcca

SEQ ID NO: 994514 - RNA, 16 nt, Mycobacterium avium subsp. paratuberculosis
ucccgucggccaucag

SEQ ID NO: 994515 - RNA, 22 nt, Mycobacterium avium subsp. paratuberculosis
ucccgucgucggcgccgcgccg

SEQ ID NO: 994516 - RNA, 14 nt, Mycobacterium avium subsp. paratuberculosis
ucccggaacagcuu

SEQ ID NO: 994517 - RNA, 22 nt, Mycobacterium avium subsp. paratuberculosis
ucccggacuccucgguggccuc

SEQ ID NO: 994518 - RNA, 18 nt, Mycobacterium avium subsp. paratuberculosis
ucccggagaacaucagcc

SEQ ID NO: 994519 - RNA, 19 nt, Mycobacterium avium subsp. paratuberculosis
ucccgcguauugcacggcg

SEQ ID NO: 994520 - RNA, 21 nt, Mycobacterium avium subsp. paratuberculosis
ucccgcgccgcggccagcgcc

SEQ ID NO: 994521 - RNA, 18 nt, Mycobacterium avium subsp. paratuberculosis
ucccgcgcgcuguccucg

SEQ ID NO: 994522 - RNA, 14 nt, Mycobacterium avium subsp. paratuberculosis
ucccgcgcggcgca

SEQ ID NO: 994523 - RNA, 23 nt, Mycobacterium avium subsp. paratuberculosis
ucccgcgcggcgcagggcggccg

SEQ ID NO: 994524 - RNA, 13 nt, Mycobacterium avium subsp. paratuberculosis
ucccggcaccacc

SEQ ID NO: 994525 - RNA, 13 nt, Mycobacterium avium subsp. paratuberculosis
ucccggcccaugg

SEQ ID NO: 994526 - RNA, 17 nt, Mycobacterium avium subsp. paratuberculosis
ucccggcgagcacgccg

SEQ ID NO: 994527 - RNA, 20 nt, Mycobacterium avium subsp. paratuberculosis
ucccggcgagcacgccgccg

SEQ ID NO: 994528 - RNA, 22 nt, Mycobacterium avium subsp. paratuberculosis
ucccggcggacccggaggcggc

SEQ ID NO: 994529 - RNA, 21 nt, Mycobacterium avium subsp. paratuberculosis
ucccgggcccgcugcagcgcc

SEQ ID NO: 994530 - RNA, 22 nt, Mycobacterium avium subsp. paratuberculosis
ucccgggacagcccgaacagcu

SEQ ID NO: 994531 - RNA, 21 nt, Mycobacterium avium subsp. paratuberculosis
ucccgggcggucgcgucgucg

SEQ ID NO: 994532 - RNA, 15 nt, Mycobacterium avium subsp. paratuberculosis
ucccggggacaccgg

SEQ ID NO: 994533 - RNA, 19 nt, Mycobacterium avium subsp. paratuberculosis
ucccggggacaccgggcac

SEQ ID NO: 994534 - RNA, 22 nt, Mycobacterium avium subsp. paratuberculosis
ucccgaacagggcgacggcggc

SEQ ID NO: 994535 - RNA, 13 nt, Mycobacterium avium subsp. paratuberculosis
uccccgugcagcc

SEQ ID NO: 994536 - RNA, 19 nt, Mycobacterium avium subsp. paratuberculosis
uccccgugcagccgggccu

SEQ ID NO: 994537 - RNA, 16 nt, Mycobacterium avium subsp. paratuberculosis
uccccgggcccagcac

SEQ ID NO: 994538 - RNA, 21 nt, Mycobacterium avium subsp. paratuberculosis
ucccgcagcuucuggucauga

SEQ ID NO: 994539 - RNA, 19 nt, Mycobacterium avium subsp. paratuberculosis
ucccgcccggcgccggccg

SEQ ID NO: 994540 - RNA, 16 nt, Mycobacterium avium subsp. paratuberculosis
ucccgcagcgccagcg

SEQ ID NO: 994541 - RNA, 17 nt, Mycobacterium avium subsp. paratuberculosis
ucccgcaccgccccgca

SEQ ID NO: 994542 - RNA, 23 nt, Mycobacterium avium subsp. paratuberculosis
ucccgccgagauccaccgcgcgg

SEQ ID NO: 994543 - RNA, 22 nt, Mycobacterium avium subsp. paratuberculosis
ucccgccggaugcggcucccac

SEQ ID NO: 994544 - RNA, 20 nt, Mycobacterium avium subsp. paratuberculosis
ucccgaggaugccgcccacc

SEQ ID NO: 994545 - RNA, 22 nt, Mycobacterium avium subsp. paratuberculosis
ucccgaggaugccgcccaccac

SEQ ID NO: 994546 - RNA, 20 nt, Mycobacterium avium subsp. paratuberculosis
ucccgacgcggcgcgacacc

SEQ ID NO: 994547 - RNA, 23 nt, Mycobacterium avium subsp. paratuberculosis
ucccgacgcugacgaugcggccg

SEQ ID NO: 994548 - RNA, 21 nt, Mycobacterium avium subsp. paratuberculosis
ucccgcaauugcgccagcagc

SEQ ID NO: 994549 - RNA, 21 nt, Mycobacterium avium subsp. paratuberculosis
ucccgaucgacgucagcuccc

SEQ ID NO: 994550 - RNA, 15 nt, Mycobacterium avium subsp. paratuberculosis
ucccgauccgcgccg

SEQ ID NO: 994551 - RNA, 14 nt, Mycobacterium avium subsp. paratuberculosis
uccguuggagguga

SEQ ID NO: 994552 - RNA, 15 nt, Mycobacterium avium subsp. paratuberculosis
uccgucuuggccagg

SEQ ID NO: 994553 - RNA, 16 nt, Mycobacterium avium subsp. paratuberculosis
uccgucuuggccaggc

SEQ ID NO: 994554 - RNA, 17 nt, Mycobacterium avium subsp. paratuberculosis
uccgucuuggccaggcc

SEQ ID NO: 994555 - RNA, 21 nt, Mycobacterium avium subsp. paratuberculosis
uccgugagggaccuccagcgg

SEQ ID NO: 994556 - RNA, 22 nt, Mycobacterium avium subsp. paratuberculosis
uccgugcacggccaacugcauc

SEQ ID NO: 994557 - RNA, 19 nt, Mycobacterium avium subsp. paratuberculosis
uccguccaccggcacggca

SEQ ID NO: 994558 - RNA, 21 nt, Mycobacterium avium subsp. paratuberculosis
uccuccugcgacggcagcacc

SEQ ID NO: 994559 - RNA, 23 nt, Mycobacterium avium subsp. paratuberculosis
uccuccucggccagccccaccac

SEQ ID NO: 994560 - RNA, 23 nt, Mycobacterium avium subsp. paratuberculosis
uccuccugcgccggcaacuggcc

SEQ ID NO: 994561 - RNA, 17 nt, Mycobacterium avium subsp. paratuberculosis
uccucauagccggccgc

SEQ ID NO: 994562 - RNA, 16 nt, Mycobacterium avium subsp. paratuberculosis
uccucagcacggccgc

SEQ ID NO: 994563 - RNA, 19 nt, Mycobacterium avium subsp. paratuberculosis
uccucggcggccucggugc

SEQ ID NO: 994564 - RNA, 18 nt, Mycobacterium avium subsp. paratuberculosis
uccucggcgauguugacc

SEQ ID NO: 994565 - RNA, 14 nt, Mycobacterium avium subsp. paratuberculosis
uccucggccagcgg

SEQ ID NO: 994566 - RNA, 14 nt, Mycobacterium avium subsp. paratuberculosis
uccucgguggccuc

SEQ ID NO: 994567 - RNA, 22 nt, Mycobacterium avium subsp. paratuberculosis
uccucggugguaaacgcuucuc

SEQ ID NO: 994568 - RNA, 22 nt, Mycobacterium avium subsp. paratuberculosis
uccucgguguacagcgccaugu

SEQ ID NO: 994569 - RNA, 20 nt, Mycobacterium avium subsp. paratuberculosis
uccucgcgggcgaucuccag

SEQ ID NO: 994570 - RNA, 22 nt, Mycobacterium avium subsp. paratuberculosis
uccucgauggcggcggcugccu

SEQ ID NO: 994571 - RNA, 14 nt, Mycobacterium avium subsp. paratuberculosis
uccucgccgcgcca

SEQ ID NO: 994572 - RNA, 20 nt, Mycobacterium avium subsp. paratuberculosis
uccucgccgcgccagcaccu

SEQ ID NO: 994573 - RNA, 19 nt, Mycobacterium avium subsp. paratuberculosis
uccucgccgcgggccagcc

SEQ ID NO: 994574 - RNA, 18 nt, Mycobacterium avium subsp. paratuberculosis
uccucgccguacgcgccg

SEQ ID NO: 994575 - RNA, 16 nt, Mycobacterium avium subsp. paratuberculosis
uccucgagcuggccgu

SEQ ID NO: 994576 - RNA, 21 nt, Mycobacterium avium subsp. paratuberculosis
uccucgagccguuugaugccg

SEQ ID NO: 994577 - RNA, 22 nt, Mycobacterium avium subsp. paratuberculosis
uccucgaagaacgcgucccaca

SEQ ID NO: 994578 - RNA, 16 nt, Mycobacterium avium subsp. paratuberculosis
uccucgaaccgcuugc

SEQ ID NO: 994579 - RNA, 21 nt, Mycobacterium avium subsp. paratuberculosis
uccucgaccagcgcgccgccc

SEQ ID NO: 994580 - RNA, 16 nt, Mycobacterium avium subsp. paratuberculosis
uccucgacgccgcgca

SEQ ID NO: 994581 - RNA, 16 nt, Mycobacterium avium subsp. paratuberculosis
uccugcgacggcagca

SEQ ID NO: 994582 - RNA, 19 nt, Mycobacterium avium subsp. paratuberculosis
uccuggugcaccagguaga

SEQ ID NO: 994583 - RNA, 16 nt, Mycobacterium avium subsp. paratuberculosis
uccugggccuggcgcu

SEQ ID NO: 994584 - RNA, 17 nt, Mycobacterium avium subsp. paratuberculosis
uccugguaccccagcaa

SEQ ID NO: 994585 - RNA, 10 nt, Mycobacterium avium subsp. paratuberculosis
uccuggguga

SEQ ID NO: 994586 - RNA, 18 nt, Mycobacterium avium subsp. paratuberculosis
uccugggugaguucgucg

SEQ ID NO: 994587 - RNA, 17 nt, Mycobacterium avium subsp. paratuberculosis
uccugagguauucgucg

SEQ ID NO: 994588 - RNA, 21 nt, Mycobacterium avium subsp. paratuberculosis
uccgcgaacgggugcggcgcu

SEQ ID NO: 994589 - RNA, 20 nt, Mycobacterium avium subsp. paratuberculosis
uccgcgacgccagcaccuuc

SEQ ID NO: 994590 - RNA, 23 nt, Mycobacterium avium subsp. paratuberculosis
uccgcgauggccuccgacccguc

SEQ ID NO: 994591 - RNA, 20 nt, Mycobacterium avium subsp. paratuberculosis
uccgcgaggaaucgcggcag

SEQ ID NO: 994592 - RNA, 20 nt, Mycobacterium avium subsp. paratuberculosis
uccgccuucgaguuuggccu

SEQ ID NO: 994593 - RNA, 16 nt, Mycobacterium avium subsp. paratuberculosis
uccgccugcgcgggcg

SEQ ID NO: 994594 - RNA, 14 nt, Mycobacterium avium subsp. paratuberculosis
uccgcggaacccgu

SEQ ID NO: 994595 - RNA, 20 nt, Mycobacterium avium subsp. paratuberculosis
uccgcggaggcgagcagccg

SEQ ID NO: 994596 - RNA, 19 nt, Mycobacterium avium subsp. paratuberculosis
uccgcggccaccgggaccg

SEQ ID NO: 994597 - RNA, 22 nt, Mycobacterium avium subsp. paratuberculosis
uccgcgcgagaguaucgccacg

SEQ ID NO: 994598 - RNA, 18 nt, Mycobacterium avium subsp. paratuberculosis
uccgcgcgcggcacggug

SEQ ID NO: 994599 - RNA, 22 nt, Mycobacterium avium subsp. paratuberculosis
uccgcgcggccaccagcgcggc

SEQ ID NO: 994600 - RNA, 22 nt, Mycobacterium avium subsp. paratuberculosis
uccgcgcggcgggcccgcagcu

SEQ ID NO: 994601 - RNA, 15 nt, Mycobacterium avium subsp. paratuberculosis
uccgcgcguagugcu

SEQ ID NO: 994602 - RNA, 23 nt, Mycobacterium avium subsp. paratuberculosis
uccgcgcgucgggcucgcggucg

SEQ ID NO: 994603 - RNA, 14 nt, Mycobacterium avium subsp. paratuberculosis
uccgcgcagcagcg

SEQ ID NO: 994604 - RNA, 16 nt, Mycobacterium avium subsp. paratuberculosis
uccgcguggccgagga

SEQ ID NO: 994605 - RNA, 23 nt, Mycobacterium avium subsp. paratuberculosis
uccgcguucgaccuccacgagcc

SEQ ID NO: 994606 - RNA, 21 nt, Mycobacterium avium subsp. paratuberculosis
uccgccagggugccgcugccc

SEQ ID NO: 994607 - RNA, 17 nt, Mycobacterium avium subsp. paratuberculosis
uccgccgagucgcgccg

SEQ ID NO: 994608 - RNA, 21 nt, Mycobacterium avium subsp. paratuberculosis
uccgccgcagcggcgccgcag

SEQ ID NO: 994609 - RNA, 15 nt, Mycobacterium avium subsp. paratuberculosis
uccgccgcgcccguc

SEQ ID NO: 994610 - RNA, 19 nt, Mycobacterium avium subsp. paratuberculosis
uccgccgacaccagggugc

SEQ ID NO: 994611 - RNA, 18 nt, Mycobacterium avium subsp. paratuberculosis
uccgccccgagaucccag

SEQ ID NO: 994612 - RNA, 15 nt, Mycobacterium avium subsp. paratuberculosis
uccgccccgcugccg

SEQ ID NO: 994613 - RNA, 15 nt, Mycobacterium avium subsp. paratuberculosis
uccgccgguucgucg

SEQ ID NO: 994614 - RNA, 18 nt, Mycobacterium avium subsp. paratuberculosis
uccgccguugcggcccac

SEQ ID NO: 994615 - RNA, 19 nt, Mycobacterium avium subsp. paratuberculosis
uccgccacccugcgcaccg

SEQ ID NO: 994616 - RNA, 20 nt, Mycobacterium avium subsp. paratuberculosis
uccgccaccuccuccggucc

SEQ ID NO: 994617 - RNA, 15 nt, Mycobacterium avium subsp. paratuberculosis
uccgguuggccaggu

SEQ ID NO: 994618 - RNA, 12 nt, Mycobacterium avium subsp. paratuberculosis
uccgguugcggc

SEQ ID NO: 994619 - RNA, 15 nt, Mycobacterium avium subsp. paratuberculosis
uccggugccacgcgg

SEQ ID NO: 994620 - RNA, 14 nt, Mycobacterium avium subsp. paratuberculosis
uccggucacgcccg

SEQ ID NO: 994621 - RNA, 16 nt, Mycobacterium avium subsp. paratuberculosis
uccggucagcaccgcg

SEQ ID NO: 994622 - RNA, 14 nt, Mycobacterium avium subsp. paratuberculosis
uccggucagcgcca

SEQ ID NO: 994623 - RNA, 15 nt, Mycobacterium avium subsp. paratuberculosis
uccggucagcgccag

SEQ ID NO: 994624 - RNA, 14 nt, Mycobacterium avium subsp. paratuberculosis
uccgguccagcccg

SEQ ID NO: 994625 - RNA, 23 nt, Mycobacterium avium subsp. paratuberculosis
uccggggaaccgcccuuccagca

SEQ ID NO: 994626 - RNA, 22 nt, Mycobacterium avium subsp. paratuberculosis
uccgggcugugggcgcagggcc

SEQ ID NO: 994627 - RNA, 21 nt, Mycobacterium avium subsp. paratuberculosis
uccgggcgaccccggccagga

SEQ ID NO: 994628 - RNA, 23 nt, Mycobacterium avium subsp. paratuberculosis
uccgggcggccagccgcgcggcg

SEQ ID NO: 994629 - RNA, 14 nt, Mycobacterium avium subsp. paratuberculosis
uccggggucagggc

SEQ ID NO: 994630 - RNA, 22 nt, Mycobacterium avium subsp. paratuberculosis
uccggggugagcagggccagcg

SEQ ID NO: 994631 - RNA, 21 nt, Mycobacterium avium subsp. paratuberculosis
uccggguucgacgccucggug

SEQ ID NO: 994632 - RNA, 18 nt, Mycobacterium avium subsp. paratuberculosis
uccggcugcccugggagg

SEQ ID NO: 994633 - RNA, 17 nt, Mycobacterium avium subsp. paratuberculosis
uccgggaggccagcacc

SEQ ID NO: 994634 - RNA, 12 nt, Mycobacterium avium subsp. paratuberculosis
uccgggaaggcg

SEQ ID NO: 994635 - RNA, 17 nt, Mycobacterium avium subsp. paratuberculosis
uccgggcaugcucagga

SEQ ID NO: 994636 - RNA, 20 nt, Mycobacterium avium subsp. paratuberculosis
uccgggcaugcucaggauga

SEQ ID NO: 994637 - RNA, 15 nt, Mycobacterium avium subsp. paratuberculosis
uccggaugcggcgcc

SEQ ID NO: 994638 - RNA, 20 nt, Mycobacterium avium subsp. paratuberculosis
uccggaucaaccacaccagc

SEQ ID NO: 994639 - RNA, 19 nt, Mycobacterium avium subsp. paratuberculosis
uccggacgaccugggcgcc

SEQ ID NO: 994640 - RNA, 19 nt, Mycobacterium avium subsp. paratuberculosis
uccggcaacgaggccaggg

SEQ ID NO: 994641 - RNA, 21 nt, Mycobacterium avium subsp. paratuberculosis
uccggcaacgaggccagggcc

SEQ ID NO: 994642 - RNA, 16 nt, Mycobacterium avium subsp. paratuberculosis
uccggcagcgcgccca

SEQ ID NO: 994643 - RNA, 20 nt, Mycobacterium avium subsp. paratuberculosis
uccggcagcgcucgucgucg

SEQ ID NO: 994644 - RNA, 15 nt, Mycobacterium avium subsp. paratuberculosis
uccggcaggccgcgg

SEQ ID NO: 994645 - RNA, 18 nt, Mycobacterium avium subsp. paratuberculosis
uccggcucagaaggcguc

SEQ ID NO: 994646 - RNA, 16 nt, Mycobacterium avium subsp. paratuberculosis
uccggcuccacagcag

SEQ ID NO: 994647 - RNA, 18 nt, Mycobacterium avium subsp. paratuberculosis
uccggcugaacgccagca

SEQ ID NO: 994648 - RNA, 22 nt, Mycobacterium avium subsp. paratuberculosis
uccggcucugccugcaggaugg

SEQ ID NO: 994649 - RNA, 23 nt, Mycobacterium avium subsp. paratuberculosis
uccggcggcaaaacgcugggcgc

SEQ ID NO: 994650 - RNA, 15 nt, Mycobacterium avium subsp. paratuberculosis
uccggcggcagccag

SEQ ID NO: 994651 - RNA, 15 nt, Mycobacterium avium subsp. paratuberculosis
uccggcggccggcgg

SEQ ID NO: 994652 - RNA, 17 nt, Mycobacterium avium subsp. paratuberculosis
uccggcgccggucagcg

SEQ ID NO: 994653 - RNA, 23 nt, Mycobacterium avium subsp. paratuberculosis
uccggcgcguuccaucagcgccc

SEQ ID NO: 994654 - RNA, 19 nt, Mycobacterium avium subsp. paratuberculosis
uccggcggacccagcuccu

SEQ ID NO: 994655 - RNA, 14 nt, Mycobacterium avium subsp. paratuberculosis
uccggcgcacggcg

SEQ ID NO: 994656 - RNA, 21 nt, Mycobacterium avium subsp. paratuberculosis
uccggccgugaugcgccggcg

SEQ ID NO: 994657 - RNA, 18 nt, Mycobacterium avium subsp. paratuberculosis
uccggccgcgccggccuu

SEQ ID NO: 994658 - RNA, 17 nt, Mycobacterium avium subsp. paratuberculosis
uccggccggagaccgcc

SEQ ID NO: 994659 - RNA, 18 nt, Mycobacterium avium subsp. paratuberculosis
uccggccggccgccggcg

SEQ ID NO: 994660 - RNA, 19 nt, Mycobacterium avium subsp. paratuberculosis
uccggccggccgccggcgg

SEQ ID NO: 994661 - RNA, 18 nt, Mycobacterium avium subsp. paratuberculosis
uccggccggcgaggaacu

SEQ ID NO: 994662 - RNA, 12 nt, Mycobacterium avium subsp. paratuberculosis
uccggccagcgu

SEQ ID NO: 994663 - RNA, 14 nt, Mycobacterium avium subsp. paratuberculosis
ucgauggucgccuu

SEQ ID NO: 994664 - RNA, 12 nt, Mycobacterium avium subsp. paratuberculosis
ucgauggucugc

SEQ ID NO: 994665 - RNA, 20 nt, Mycobacterium avium subsp. paratuberculosis
ucgaugucggcgaaccaggg

SEQ ID NO: 994666 - RNA, 15 nt, Mycobacterium avium subsp. paratuberculosis
ucgaugcccugcccc

SEQ ID NO: 994667 - RNA, 14 nt, Mycobacterium avium subsp. paratuberculosis
ucgauggaaggugc

SEQ ID NO: 994668 - RNA, 15 nt, Mycobacterium avium subsp. paratuberculosis
ucgauggaaggugcu

SEQ ID NO: 994669 - RNA, 14 nt, Mycobacterium avium subsp. paratuberculosis
ucgauggacagggc

SEQ ID NO: 994670 - RNA, 21 nt, Mycobacterium avium subsp. paratuberculosis
ucgauggaccggguggugggc

SEQ ID NO: 994671 - RNA, 12 nt, Mycobacterium avium subsp. paratuberculosis
ucgauggccggg

SEQ ID NO: 994672 - RNA, 16 nt, Mycobacterium avium subsp. paratuberculosis
ucgauggccaccaggu

SEQ ID NO: 994673 - RNA, 16 nt, Mycobacterium avium subsp. paratuberculosis
ucgaugccguugugca

SEQ ID NO: 994674 - RNA, 19 nt, Mycobacterium avium subsp. paratuberculosis
ucgaugccguagaccagca

SEQ ID NO: 994675 - RNA, 12 nt, Mycobacterium avium subsp. paratuberculosis
ucgaugcgcgcc

SEQ ID NO: 994676 - RNA, 14 nt, Mycobacterium avium subsp. paratuberculosis
ucgaucagcgcgcc

SEQ ID NO: 994677 - RNA, 23 nt, Mycobacterium avium subsp. paratuberculosis
ucgaucagucgucccggcuuucc

SEQ ID NO: 994678 - RNA, 18 nt, Mycobacterium avium subsp. paratuberculosis
ucgauccacccaccggca

SEQ ID NO: 994679 - RNA, 13 nt, Mycobacterium avium subsp. paratuberculosis
ucgagcuccuccg

SEQ ID NO: 994680 - RNA, 18 nt, Mycobacterium avium subsp. paratuberculosis
ucgagcuccucggccagc

SEQ ID NO: 994681 - RNA, 19 nt, Mycobacterium avium subsp. paratuberculosis
ucgagcgccgcggccaccg

SEQ ID NO: 994682 - RNA, 15 nt, Mycobacterium avium subsp. paratuberculosis
ucgagcgcggcccgc

SEQ ID NO: 994683 - RNA, 15 nt, Mycobacterium avium subsp. paratuberculosis
ucgagcgucacgcug

SEQ ID NO: 994684 - RNA, 16 nt, Mycobacterium avium subsp. paratuberculosis
ucgagcgucacgcugg

SEQ ID NO: 994685 - RNA, 14 nt, Mycobacterium avium subsp. paratuberculosis
ucgagcgggcgggc

SEQ ID NO: 994686 - RNA, 18 nt, Mycobacterium avium subsp. paratuberculosis
ucgccacgaucaccacca

SEQ ID NO: 994687 - RNA, 15 nt, Mycobacterium avium subsp. paratuberculosis
ucgccacgccgacca

SEQ ID NO: 994688 - RNA, 21 nt, Mycobacterium avium subsp. paratuberculosis
ucgccacggccggcagcaucg

SEQ ID NO: 994689 - RNA, 22 nt, Mycobacterium avium subsp. paratuberculosis
ucgccaccaccgcgccgucguc

SEQ ID NO: 994690 - RNA, 14 nt, Mycobacterium avium subsp. paratuberculosis
ucgccaccagaccg

SEQ ID NO: 994691 - RNA, 21 nt, Mycobacterium avium subsp. paratuberculosis
ucgccaccgaugcgggccagg

SEQ ID NO: 994692 - RNA, 19 nt, Mycobacterium avium subsp. paratuberculosis
ucgccagcgcgcagaacac

SEQ ID NO: 994693 - RNA, 23 nt, Mycobacterium avium subsp. paratuberculosis
ucgccagcgcgcagaacaccacc

SEQ ID NO: 994694 - RNA, 12 nt, Mycobacterium avium subsp. paratuberculosis
ucgccagcgccc

SEQ ID NO: 994695 - RNA, 15 nt, Mycobacterium avium subsp. paratuberculosis
ucgccagcgccccca

SEQ ID NO: 994696 - RNA, 13 nt, Mycobacterium avium subsp. paratuberculosis
ucgccagccgucc

SEQ ID NO: 994697 - RNA, 15 nt, Mycobacterium avium subsp. paratuberculosis
ucgccagcgccacgc

SEQ ID NO: 994698 - RNA, 12 nt, Mycobacterium avium subsp. paratuberculosis
ucgccaggaugu

SEQ ID NO: 994699 - RNA, 15 nt, Mycobacterium avium subsp. paratuberculosis
ucgccaggccaccgc

SEQ ID NO: 994700 - RNA, 12 nt, Mycobacterium avium subsp. paratuberculosis
ucgcagcagcag

SEQ ID NO: 994701 - RNA, 17 nt, Mycobacterium avium subsp. paratuberculosis
ucgcagcgcgcggcgca

SEQ ID NO: 994702 - RNA, 23 nt, Mycobacterium avium subsp. paratuberculosis
ucgcaaacgaaucgagccgccug

SEQ ID NO: 994703 - RNA, 12 nt, Mycobacterium avium subsp. paratuberculosis
ucgaagaaguag

SEQ ID NO: 994704 - RNA, 15 nt, Mycobacterium avium subsp. paratuberculosis
ucgaagauggccagg

SEQ ID NO: 994705 - RNA, 16 nt, Mycobacterium avium subsp. paratuberculosis
ucgaagauggccaggu

SEQ ID NO: 994706 - RNA, 17 nt, Mycobacterium avium subsp. paratuberculosis
ucgaagaucgccugcag

SEQ ID NO: 994707 - RNA, 18 nt, Mycobacterium avium subsp. paratuberculosis
ucgaagcggugcaccacc

SEQ ID NO: 994708 - RNA, 13 nt, Mycobacterium avium subsp. paratuberculosis
ucgaagcgcagca

SEQ ID NO: 994709 - RNA, 14 nt, Mycobacterium avium subsp. paratuberculosis
ucgaagcgcaugcc

SEQ ID NO: 994710 - RNA, 16 nt, Mycobacterium avium subsp. paratuberculosis
ucgaagcugcgccaca

SEQ ID NO: 994711 - RNA, 15 nt, Mycobacterium avium subsp. paratuberculosis
ucgaaggaggccagc

SEQ ID NO: 994712 - RNA, 17 nt, Mycobacterium avium subsp. paratuberculosis
ucgaagggcaucggguc

SEQ ID NO: 994713 - RNA, 17 nt, Mycobacterium avium subsp. paratuberculosis
ucgaccugcccgggccc

SEQ ID NO: 994714 - RNA, 20 nt, Mycobacterium avium subsp. paratuberculosis
ucgaccaggcucacgcugcc

SEQ ID NO: 994715 - RNA, 15 nt, Mycobacterium avium subsp. paratuberculosis
ucgaccagccggguc

SEQ ID NO: 994716 - RNA, 15 nt, Mycobacterium avium subsp. paratuberculosis
ucgaccagcgccgag

SEQ ID NO: 994717 - RNA, 16 nt, Mycobacterium avium subsp. paratuberculosis
ucgaccacccgcagcu

SEQ ID NO: 994718 - RNA, 15 nt, Mycobacterium avium subsp. paratuberculosis
ucgaccacccgcugg

SEQ ID NO: 994719 - RNA, 21 nt, Mycobacterium avium subsp. paratuberculosis
ucgacgguugccucggccagc

SEQ ID NO: 994720 - RNA, 15 nt, Mycobacterium avium subsp. paratuberculosis
ucgacguaggccaga

SEQ ID NO: 994721 - RNA, 20 nt, Mycobacterium avium subsp. paratuberculosis
ucgacgucaccaccgggucg

SEQ ID NO: 994722 - RNA, 21 nt, Mycobacterium avium subsp. paratuberculosis
ucgacgucgagaaaggccagc

SEQ ID NO: 994723 - RNA, 22 nt, Mycobacterium avium subsp. paratuberculosis
ucgacgucgagaaaggccagca

SEQ ID NO: 994724 - RNA, 15 nt, Mycobacterium avium subsp. paratuberculosis
ucgacugggccaggu

SEQ ID NO: 994725 - RNA, 22 nt, Mycobacterium avium subsp. paratuberculosis
ucgacggggucggacagagucg

SEQ ID NO: 994726 - RNA, 22 nt, Mycobacterium avium subsp. paratuberculosis
ucgacgguggagcggcccagcu

SEQ ID NO: 994727 - RNA, 19 nt, Mycobacterium avium subsp. paratuberculosis
ucgacgauggucuggauga

SEQ ID NO: 994728 - RNA, 16 nt, Mycobacterium avium subsp. paratuberculosis
ucgacgauggcccgga

SEQ ID NO: 994729 - RNA, 19 nt, Mycobacterium avium subsp. paratuberculosis
ucgacgauggcccggaccg

SEQ ID NO: 994730 - RNA, 20 nt, Mycobacterium avium subsp. paratuberculosis
ucgacggccggcgucacucu

SEQ ID NO: 994731 - RNA, 21 nt, Mycobacterium avium subsp. paratuberculosis
ucgacgaucucgugggucagc

SEQ ID NO: 994732 - RNA, 15 nt, Mycobacterium avium subsp. paratuberculosis
ucgacgaugcgcugc

SEQ ID NO: 994733 - RNA, 20 nt, Mycobacterium avium subsp. paratuberculosis
ucgaccugcucgucggugac

SEQ ID NO: 994734 - RNA, 19 nt, Mycobacterium avium subsp. paratuberculosis
ucgacgacgggugggugga

SEQ ID NO: 994735 - RNA, 16 nt, Mycobacterium avium subsp. paratuberculosis
ucgacgagccgggcca

SEQ ID NO: 994736 - RNA, 21 nt, Mycobacterium avium subsp. paratuberculosis
ucgagacaccgucgcgcaccc

SEQ ID NO: 994737 - RNA, 22 nt, Mycobacterium avium subsp. paratuberculosis
ucgagacaccgucgcgcaccca

SEQ ID NO: 994738 - RNA, 20 nt, Mycobacterium avium subsp. paratuberculosis
ucgagaccaugucggccagg

SEQ ID NO: 994739 - RNA, 14 nt, Mycobacterium avium subsp. paratuberculosis
ucgagaucagcacc

SEQ ID NO: 994740 - RNA, 20 nt, Mycobacterium avium subsp. paratuberculosis
ucgagaucagggcgcgcacc

SEQ ID NO: 994741 - RNA, 17 nt, Mycobacterium avium subsp. paratuberculosis
ucgagagccgcaucgca

SEQ ID NO: 994742 - RNA, 12 nt, Mycobacterium avium subsp. paratuberculosis
ucgagccagcgg

SEQ ID NO: 994743 - RNA, 15 nt, Mycobacterium avium subsp. paratuberculosis
ucgagcccaccgcgc

SEQ ID NO: 994744 - RNA, 20 nt, Mycobacterium avium subsp. paratuberculosis
ucgagcagugcaucgcugcc

SEQ ID NO: 994745 - RNA, 23 nt, Mycobacterium avium subsp. paratuberculosis
ucgagcaucacgaacccguggau

SEQ ID NO: 994746 - RNA, 18 nt, Mycobacterium avium subsp. paratuberculosis
ucgagccuggcgcgcaac

SEQ ID NO: 994747 - RNA, 18 nt, Mycobacterium avium subsp. paratuberculosis
ucgagccgccugcgcgcc

SEQ ID NO: 994748 - RNA, 20 nt, Mycobacterium avium subsp. paratuberculosis
ucgagccgagcaccggcagc

SEQ ID NO: 994749 - RNA, 21 nt, Mycobacterium avium subsp. paratuberculosis
ucgagccgagcaccggcagca

SEQ ID NO: 994750 - RNA, 14 nt, Mycobacterium avium subsp. paratuberculosis
ucgagccgcggccc

SEQ ID NO: 994751 - RNA, 16 nt, Mycobacterium avium subsp. paratuberculosis
ucgagcaccacggccc

SEQ ID NO: 994752 - RNA, 21 nt, Mycobacterium avium subsp. paratuberculosis
ucgagcaccagcaacaccagg

SEQ ID NO: 994753 - RNA, 19 nt, Mycobacterium avium subsp. paratuberculosis
ucgagcaccagcgucgacg

SEQ ID NO: 994754 - RNA, 14 nt, Mycobacterium avium subsp. paratuberculosis
ucgagcacaucggc

SEQ ID NO: 994755 - RNA, 13 nt, Mycobacterium avium subsp. paratuberculosis
ucgagcaccaccc

SEQ ID NO: 994756 - RNA, 22 nt, Mycobacterium avium subsp. paratuberculosis
ucgagcaccggcuggugcagca

SEQ ID NO: 994757 - RNA, 12 nt, Mycobacterium avium subsp. paratuberculosis
ucgagcacgccc

SEQ ID NO: 994758 - RNA, 13 nt, Mycobacterium avium subsp. paratuberculosis
ucgagcacgcccu

SEQ ID NO: 994759 - RNA, 17 nt, Mycobacterium avium subsp. paratuberculosis
ucgagcacucgcgggac

SEQ ID NO: 994760 - RNA, 21 nt, Mycobacterium avium subsp. paratuberculosis
ucgagcacucgcgggacggcg

SEQ ID NO: 994761 - RNA, 16 nt, Mycobacterium avium subsp. paratuberculosis
ucgagcagcaccaccc

SEQ ID NO: 994762 - RNA, 13 nt, Mycobacterium avium subsp. paratuberculosis
ucgagcagcgcgc

SEQ ID NO: 994763 - RNA, 14 nt, Mycobacterium avium subsp. paratuberculosis
ucgcggauccgcag

SEQ ID NO: 994764 - RNA, 16 nt, Mycobacterium avium subsp. paratuberculosis
ucgcggauccgggccg

SEQ ID NO: 994765 - RNA, 13 nt, Mycobacterium avium subsp. paratuberculosis
ucgcggccagcgu

SEQ ID NO: 994766 - RNA, 21 nt, Mycobacterium avium subsp. paratuberculosis
ucgcggcccacccgcagggcg

SEQ ID NO: 994767 - RNA, 21 nt, Mycobacterium avium subsp. paratuberculosis
ucgcggacccuggccagcacc

SEQ ID NO: 994768 - RNA, 16 nt, Mycobacterium avium subsp. paratuberculosis
ucgcggaaccgcuuga

SEQ ID NO: 994769 - RNA, 20 nt, Mycobacterium avium subsp. paratuberculosis
ucgcgcugccagggccgggc

SEQ ID NO: 994770 - RNA, 17 nt, Mycobacterium avium subsp. paratuberculosis
ucgcgggcccgcguaac

SEQ ID NO: 994771 - RNA, 18 nt, Mycobacterium avium subsp. paratuberculosis
ucgcgggccugcucgucg

SEQ ID NO: 994772 - RNA, 16 nt, Mycobacterium avium subsp. paratuberculosis
ucgcgggcccgcgccg

SEQ ID NO: 994773 - RNA, 23 nt, Mycobacterium avium subsp. paratuberculosis
ucgcgggacaacaccaccucuug

SEQ ID NO: 994774 - RNA, 19 nt, Mycobacterium avium subsp. paratuberculosis
ucgcggcguuguggccacc

SEQ ID NO: 994775 - RNA, 20 nt, Mycobacterium avium subsp. paratuberculosis
ucgcggccguguacagcagg

SEQ ID NO: 994776 - RNA, 23 nt, Mycobacterium avium subsp. paratuberculosis
ucgcggccguguacagcaggguc

SEQ ID NO: 994777 - RNA, 23 nt, Mycobacterium avium subsp. paratuberculosis
ucgcggcccgccgcucaccgccg

SEQ ID NO: 994778 - RNA, 21 nt, Mycobacterium avium subsp. paratuberculosis
ucgcggcagccuuuccacauc

SEQ ID NO: 994779 - RNA, 15 nt, Mycobacterium avium subsp. paratuberculosis
ucgcggcgacccgcu

SEQ ID NO: 994780 - RNA, 22 nt, Mycobacterium avium subsp. paratuberculosis
ucgcggcgcacccgggcagcuu

SEQ ID NO: 994781 - RNA, 22 nt, Mycobacterium avium subsp. paratuberculosis
ucgcggcgcuaaagccaccagc

SEQ ID NO: 994782 - RNA, 13 nt, Mycobacterium avium subsp. paratuberculosis
ucgcggcgcugcc

SEQ ID NO: 994783 - RNA, 15 nt, Mycobacterium avium subsp. paratuberculosis
ucgcggcggccggcg

SEQ ID NO: 994784 - RNA, 22 nt, Mycobacterium avium subsp. paratuberculosis
ucgcgcaucgccucggcggccg

SEQ ID NO: 994785 - RNA, 17 nt, Mycobacterium avium subsp. paratuberculosis
ucgcgcaggucgggccg

SEQ ID NO: 994786 - RNA, 18 nt, Mycobacterium avium subsp. paratuberculosis
ucgcgaucgacagcucca

SEQ ID NO: 994787 - RNA, 19 nt, Mycobacterium avium subsp. paratuberculosis
ucgcgaugcccaagccggc

SEQ ID NO: 994788 - RNA, 15 nt, Mycobacterium avium subsp. paratuberculosis
ucgcgaucacaccac

SEQ ID NO: 994789 - RNA, 22 nt, Mycobacterium avium subsp. paratuberculosis
ucgcgaucaccgcggccaccac

SEQ ID NO: 994790 - RNA, 20 nt, Mycobacterium avium subsp. paratuberculosis
ucgcgcgaaacccccgggau

SEQ ID NO: 994791 - RNA, 15 nt, Mycobacterium avium subsp. paratuberculosis
ucgcgccgacccgcc

SEQ ID NO: 994792 - RNA, 23 nt, Mycobacterium avium subsp. paratuberculosis
ucgcgccgaucugaccgagcagc

SEQ ID NO: 994793 - RNA, 13 nt, Mycobacterium avium subsp. paratuberculosis
ucgcgcccggcgu

SEQ ID NO: 994794 - RNA, 16 nt, Mycobacterium avium subsp. paratuberculosis
ucgcgcggggcggccg

SEQ ID NO: 994795 - RNA, 14 nt, Mycobacterium avium subsp. paratuberculosis
ucgcgcggcaccac

SEQ ID NO: 994796 - RNA, 21 nt, Mycobacterium avium subsp. paratuberculosis
ucgcgcgccggcgcagcggcc

SEQ ID NO: 994797 - RNA, 17 nt, Mycobacterium avium subsp. paratuberculosis
ucgcgcucccggcgccg

SEQ ID NO: 994798 - RNA, 13 nt, Mycobacterium avium subsp. paratuberculosis
ucgccgccgccag

SEQ ID NO: 994799 - RNA, 15 nt, Mycobacterium avium subsp. paratuberculosis
ucgccggcgcggaac

SEQ ID NO: 994800 - RNA, 21 nt, Mycobacterium avium subsp. paratuberculosis
ucgccgggauggugagcccga

SEQ ID NO: 994801 - RNA, 15 nt, Mycobacterium avium subsp. paratuberculosis
ucgccggcgccggag

SEQ ID NO: 994802 - RNA, 16 nt, Mycobacterium avium subsp. paratuberculosis
ucgccggcgccgggcg

SEQ ID NO: 994803 - RNA, 17 nt, Mycobacterium avium subsp. paratuberculosis
ucgccggcgaccgccuu

SEQ ID NO: 994804 - RNA, 18 nt, Mycobacterium avium subsp. paratuberculosis
ucgccggcgacggccagc

SEQ ID NO: 994805 - RNA, 16 nt, Mycobacterium avium subsp. paratuberculosis
ucgccggggccuucuu

SEQ ID NO: 994806 - RNA, 19 nt, Mycobacterium avium subsp. paratuberculosis
ucgccgggucuuccacgcc

SEQ ID NO: 994807 - RNA, 17 nt, Mycobacterium avium subsp. paratuberculosis
ucgccgggcgucacucu

SEQ ID NO: 994808 - RNA, 16 nt, Mycobacterium avium subsp. paratuberculosis
ucgccgcgcagcaccg

SEQ ID NO: 994809 - RNA, 18 nt, Mycobacterium avium subsp. paratuberculosis
ucgccgcgcagcaccgcg

SEQ ID NO: 994810 - RNA, 19 nt, Mycobacterium avium subsp. paratuberculosis
ucgccgcgcagcaccgcgu

SEQ ID NO: 994811 - RNA, 15 nt, Mycobacterium avium subsp. paratuberculosis
ucgccgccggugccg

SEQ ID NO: 994812 - RNA, 14 nt, Mycobacterium avium subsp. paratuberculosis
ucgccggccaggcc

SEQ ID NO: 994813 - RNA, 15 nt, Mycobacterium avium subsp. paratuberculosis
ucgccggccaggccg

SEQ ID NO: 994814 - RNA, 21 nt, Mycobacterium avium subsp. paratuberculosis
ucgccggcccgaccggagccg

SEQ ID NO: 994815 - RNA, 22 nt, Mycobacterium avium subsp. paratuberculosis
ucgccggccgccguggcccacg

SEQ ID NO: 994816 - RNA, 16 nt, Mycobacterium avium subsp. paratuberculosis
ucgccgcgcacccggc

SEQ ID NO: 994817 - RNA, 16 nt, Mycobacterium avium subsp. paratuberculosis
ucgccggucagcacgu

SEQ ID NO: 994818 - RNA, 16 nt, Mycobacterium avium subsp. paratuberculosis
ucgccucggccaccag

SEQ ID NO: 994819 - RNA, 18 nt, Mycobacterium avium subsp. paratuberculosis
ucgccucggcggccgccc

SEQ ID NO: 994820 - RNA, 22 nt, Mycobacterium avium subsp. paratuberculosis
ucgccucggcggccgcccgggc

SEQ ID NO: 994821 - RNA, 21 nt, Mycobacterium avium subsp. paratuberculosis
ucgccucggggaucgccaggc

SEQ ID NO: 994822 - RNA, 14 nt, Mycobacterium avium subsp. paratuberculosis
ucgccuuguuggcc

SEQ ID NO: 994823 - RNA, 16 nt, Mycobacterium avium subsp. paratuberculosis
ucgccuuugaugacga

SEQ ID NO: 994824 - RNA, 16 nt, Mycobacterium avium subsp. paratuberculosis
ucgcgaccaccggccg

SEQ ID NO: 994825 - RNA, 14 nt, Mycobacterium avium subsp. paratuberculosis
ucgcgagggcgggc

SEQ ID NO: 994826 - RNA, 23 nt, Mycobacterium avium subsp. paratuberculosis
ucggacgacucguucgacgccgg

SEQ ID NO: 994827 - RNA, 15 nt, Mycobacterium avium subsp. paratuberculosis
ucggacaugccggcg

SEQ ID NO: 994828 - RNA, 15 nt, Mycobacterium avium subsp. paratuberculosis
ucggacucgucgcug

SEQ ID NO: 994829 - RNA, 13 nt, Mycobacterium avium subsp. paratuberculosis
ucggacgcggccg

SEQ ID NO: 994830 - RNA, 18 nt, Mycobacterium avium subsp. paratuberculosis
ucggacgcggggaaguag

SEQ ID NO: 994831 - RNA, 22 nt, Mycobacterium avium subsp. paratuberculosis
ucggacgccucccccacccgca

SEQ ID NO: 994832 - RNA, 16 nt, Mycobacterium avium subsp. paratuberculosis
ucggcacaccagguag

SEQ ID NO: 994833 - RNA, 17 nt, Mycobacterium avium subsp. paratuberculosis
ucggcacaccagguagg

SEQ ID NO: 994834 - RNA, 18 nt, Mycobacterium avium subsp. paratuberculosis
ucggcacaccagguaggc

SEQ ID NO: 994835 - RNA, 19 nt, Mycobacterium avium subsp. paratuberculosis
ucggcaaugaccggcacca

SEQ ID NO: 994836 - RNA, 15 nt, Mycobacterium avium subsp. paratuberculosis
ucggcacgaagccga

SEQ ID NO: 994837 - RNA, 15 nt, Mycobacterium avium subsp. paratuberculosis
ucggcagacccagca

SEQ ID NO: 994838 - RNA, 22 nt, Mycobacterium avium subsp. paratuberculosis
ucgcugccguagcgcuggguga

SEQ ID NO: 994839 - RNA, 20 nt, Mycobacterium avium subsp. paratuberculosis
ucgcucagaggcgggcacuu

SEQ ID NO: 994840 - RNA, 21 nt, Mycobacterium avium subsp. paratuberculosis
ucgcucaacggcuccagguag

SEQ ID NO: 994841 - RNA, 23 nt, Mycobacterium avium subsp. paratuberculosis
ucgcucgucggcgcgggccagca

SEQ ID NO: 994842 - RNA, 15 nt, Mycobacterium avium subsp. paratuberculosis
ucgcugacccgggcg

SEQ ID NO: 994843 - RNA, 22 nt, Mycobacterium avium subsp. paratuberculosis
ucgcugaccucgacacgggccg

SEQ ID NO: 994844 - RNA, 12 nt, Mycobacterium avium subsp. paratuberculosis
ucgcugaccuuc

SEQ ID NO: 994845 - RNA, 14 nt, Mycobacterium avium subsp. paratuberculosis
ucgcugaccuucuu

SEQ ID NO: 994846 - RNA, 22 nt, Mycobacterium avium subsp. paratuberculosis
ucgcugaccuucuuggucagcg

SEQ ID NO: 994847 - RNA, 15 nt, Mycobacterium avium subsp. paratuberculosis
ucgcucugccgggcc

SEQ ID NO: 994848 - RNA, 13 nt, Mycobacterium avium subsp. paratuberculosis
ucgcugacuccau

SEQ ID NO: 994849 - RNA, 18 nt, Mycobacterium avium subsp. paratuberculosis
ucgcuacgcgagcugcuu

SEQ ID NO: 994850 - RNA, 19 nt, Mycobacterium avium subsp. paratuberculosis
ucgcguugaaagccgcgaa

SEQ ID NO: 994851 - RNA, 15 nt, Mycobacterium avium subsp. paratuberculosis
ucgcgggugccuucu

SEQ ID NO: 994852 - RNA, 19 nt, Mycobacterium avium subsp. paratuberculosis
ucgcgggugaccggcgccg

SEQ ID NO: 994853 - RNA, 19 nt, Mycobacterium avium subsp. paratuberculosis
ucgcgguccaucuccagcu

SEQ ID NO: 994854 - RNA, 19 nt, Mycobacterium avium subsp. paratuberculosis
ucgcggugaaguugccgcc

SEQ ID NO: 994855 - RNA, 16 nt, Mycobacterium avium subsp. paratuberculosis
ucgcggugcggggccg

SEQ ID NO: 994856 - RNA, 21 nt, Mycobacterium avium subsp. paratuberculosis
ucgcggugcugcagauccgcu

SEQ ID NO: 994857 - RNA, 19 nt, Mycobacterium avium subsp. paratuberculosis
ucgcguagcgaggugugag

SEQ ID NO: 994858 - RNA, 23 nt, Mycobacterium avium subsp. paratuberculosis
ucgcgguugaugaucuuggugaa

SEQ ID NO: 994859 - RNA, 16 nt, Mycobacterium avium subsp. paratuberculosis
ucgcguucccgggccc

SEQ ID NO: 994860 - RNA, 22 nt, Mycobacterium avium subsp. paratuberculosis
ucgcguucccgggcccgcugca

SEQ ID NO: 994861 - RNA, 12 nt, Mycobacterium avium subsp. paratuberculosis
ucgcguggccug

SEQ ID NO: 994862 - RNA, 16 nt, Mycobacterium avium subsp. paratuberculosis
ucucacggcgaauauu

SEQ ID NO: 994863 - RNA, 21 nt, Mycobacterium avium subsp. paratuberculosis
ucucaggaauuugcggcccgg

SEQ ID NO: 994864 - RNA, 21 nt, Mycobacterium avium subsp. paratuberculosis
ucuccacgccgacgaacaggu

SEQ ID NO: 994865 - RNA, 23 nt, Mycobacterium avium subsp. paratuberculosis
ucuccacccgccccuccaggcau

SEQ ID NO: 994866 - RNA, 18 nt, Mycobacterium avium subsp. paratuberculosis
ucuccauggugaacuggu

SEQ ID NO: 994867 - RNA, 14 nt, Mycobacterium avium subsp. paratuberculosis
ucuacuuggccagc

SEQ ID NO: 994868 - RNA, 22 nt, Mycobacterium avium subsp. paratuberculosis
ucguugcccugccugcugccca

SEQ ID NO: 994869 - RNA, 19 nt, Mycobacterium avium subsp. paratuberculosis
ucguugcgccgccagggcg

SEQ ID NO: 994870 - RNA, 19 nt, Mycobacterium avium subsp. paratuberculosis
ucguugcacaccaccagcg

SEQ ID NO: 994871 - RNA, 13 nt, Mycobacterium avium subsp. paratuberculosis
ucguugagcacca

SEQ ID NO: 994872 - RNA, 15 nt, Mycobacterium avium subsp. paratuberculosis
ucguugagcaucacc

SEQ ID NO: 994873 - RNA, 17 nt, Mycobacterium avium subsp. paratuberculosis
ucggccaacagugcgca

SEQ ID NO: 994874 - RNA, 21 nt, Mycobacterium avium subsp. paratuberculosis
ucguagacgaagcggccgggg

SEQ ID NO: 994875 - RNA, 17 nt, Mycobacterium avium subsp. paratuberculosis
ucggcaggucgucgacg

SEQ ID NO: 994876 - RNA, 13 nt, Mycobacterium avium subsp. paratuberculosis
ucggcagcgcgcc

SEQ ID NO: 994877 - RNA, 15 nt, Mycobacterium avium subsp. paratuberculosis
ucguaguaggugcgc

SEQ ID NO: 994878 - RNA, 19 nt, Mycobacterium avium subsp. paratuberculosis
ucguagagcgcgaagcccu

SEQ ID NO: 994879 - RNA, 13 nt, Mycobacterium avium subsp. paratuberculosis
ucguaggacacca

SEQ ID NO: 994880 - RNA, 17 nt, Mycobacterium avium subsp. paratuberculosis
ucguagcggcgccaccg

SEQ ID NO: 994881 - RNA, 18 nt, Mycobacterium avium subsp. paratuberculosis
ucgucaccgugccgucgc

SEQ ID NO: 994882 - RNA, 15 nt, Mycobacterium avium subsp. paratuberculosis
ucgucagccgggcca

SEQ ID NO: 994883 - RNA, 12 nt, Mycobacterium avium subsp. paratuberculosis
ucgucagcagcg

SEQ ID NO: 994884 - RNA, 12 nt, Mycobacterium avium subsp. paratuberculosis
ucgucuuggccu

SEQ ID NO: 994885 - RNA, 15 nt, Mycobacterium avium subsp. paratuberculosis
ucgucuucuuggccg

SEQ ID NO: 994886 - RNA, 14 nt, Mycobacterium avium subsp. paratuberculosis
ucgugaaacauggc

SEQ ID NO: 994887 - RNA, 19 nt, Mycobacterium avium subsp. paratuberculosis
ucgugcaaccuuggucugc

SEQ ID NO: 994888 - RNA, 19 nt, Mycobacterium avium subsp. paratuberculosis
ucgucgcacaaccgggcca

SEQ ID NO: 994889 - RNA, 15 nt, Mycobacterium avium subsp. paratuberculosis
ucgucgaugucggcg

SEQ ID NO: 994890 - RNA, 18 nt, Mycobacterium avium subsp. paratuberculosis
ucguccuugagcccccac

SEQ ID NO: 994891 - RNA, 18 nt, Mycobacterium avium subsp. paratuberculosis
ucguccucgaacaggcuc

SEQ ID NO: 994892 - RNA, 17 nt, Mycobacterium avium subsp. paratuberculosis
ucguccucgaucaccga

SEQ ID NO: 994893 - RNA, 15 nt, Mycobacterium avium subsp. paratuberculosis
ucgucgagccggccg

SEQ ID NO: 994894 - RNA, 14 nt, Mycobacterium avium subsp. paratuberculosis
ucgucgagggccac

SEQ ID NO: 994895 - RNA, 15 nt, Mycobacterium avium subsp. paratuberculosis
ucgucgagugcucga

SEQ ID NO: 994896 - RNA, 15 nt, Mycobacterium avium subsp. paratuberculosis
ucgucgaucagggcg

SEQ ID NO: 994897 - RNA, 16 nt, Mycobacterium avium subsp. paratuberculosis
ucgucgaccaacgcca

SEQ ID NO: 994898 - RNA, 18 nt, Mycobacterium avium subsp. paratuberculosis
ucguggacaggaggacaa

SEQ ID NO: 994899 - RNA, 15 nt, Mycobacterium avium subsp. paratuberculosis
ucguggauguugucg

SEQ ID NO: 994900 - RNA, 21 nt, Mycobacterium avium subsp. paratuberculosis
ucgugggcgauccgcaggccg

SEQ ID NO: 994901 - RNA, 13 nt, Mycobacterium avium subsp. paratuberculosis
ucgugggcgugcc

SEQ ID NO: 994902 - RNA, 20 nt, Mycobacterium avium subsp. paratuberculosis
ucgugcucgucggcgggcac

SEQ ID NO: 994903 - RNA, 22 nt, Mycobacterium avium subsp. paratuberculosis
ucgugccgcacccgauccacgg

SEQ ID NO: 994904 - RNA, 18 nt, Mycobacterium avium subsp. paratuberculosis
ucgugccgggugaugcag

SEQ ID NO: 994905 - RNA, 14 nt, Mycobacterium avium subsp. paratuberculosis
ucgugcggccggcg

SEQ ID NO: 994906 - RNA, 22 nt, Mycobacterium avium subsp. paratuberculosis
ucgugcggcgccgcccggcgau

SEQ ID NO: 994907 - RNA, 19 nt, Mycobacterium avium subsp. paratuberculosis
ucgugcaccuuggucagcu

SEQ ID NO: 994908 - RNA, 15 nt, Mycobacterium avium subsp. paratuberculosis
ucgugcagcuguucc

SEQ ID NO: 994909 - RNA, 16 nt, Mycobacterium avium subsp. paratuberculosis
ucgugcaucggcgccu

SEQ ID NO: 994910 - RNA, 14 nt, Mycobacterium avium subsp. paratuberculosis
ucugcaggccccag

SEQ ID NO: 994911 - RNA, 15 nt, Mycobacterium avium subsp. paratuberculosis
ucugccagaacggcg

SEQ ID NO: 994912 - RNA, 16 nt, Mycobacterium avium subsp. paratuberculosis
ucugccggugccgccg

SEQ ID NO: 994913 - RNA, 19 nt, Mycobacterium avium subsp. paratuberculosis
ucugccggugccgccggcg

SEQ ID NO: 994914 - RNA, 14 nt, Mycobacterium avium subsp. paratuberculosis
ucugccggccgccg

SEQ ID NO: 994915 - RNA, 14 nt, Mycobacterium avium subsp. paratuberculosis
ucucgcggcggccg

SEQ ID NO: 994916 - RNA, 14 nt, Mycobacterium avium subsp. paratuberculosis
ucucgccccggccg

SEQ ID NO: 994917 - RNA, 13 nt, Mycobacterium avium subsp. paratuberculosis
ucucgcccaccuu

SEQ ID NO: 994918 - RNA, 14 nt, Mycobacterium avium subsp. paratuberculosis
ucucgcgcaccgcg

SEQ ID NO: 994919 - RNA, 20 nt, Mycobacterium avium subsp. paratuberculosis
ucucgccggucagcacgucg

SEQ ID NO: 994920 - RNA, 19 nt, Mycobacterium avium subsp. paratuberculosis
ucucgaagcgcagcagcuc

SEQ ID NO: 994921 - RNA, 15 nt, Mycobacterium avium subsp. paratuberculosis
ucugaccgagcagcg

SEQ ID NO: 994922 - RNA, 18 nt, Mycobacterium avium subsp. paratuberculosis
ucugagcccgggcaggcg

SEQ ID NO: 994923 - RNA, 15 nt, Mycobacterium avium subsp. paratuberculosis
ucuguucggcggcga

SEQ ID NO: 994924 - RNA, 22 nt, Mycobacterium avium subsp. paratuberculosis
ucugucuucgcggucucucuaa

SEQ ID NO: 994925 - RNA, 22 nt, Mycobacterium avium subsp. paratuberculosis
ucuggaugaucgucucggccgc

SEQ ID NO: 994926 - RNA, 22 nt, Mycobacterium avium subsp. paratuberculosis
ucugcgccagcuccagcagccc

SEQ ID NO: 994927 - RNA, 19 nt, Mycobacterium avium subsp. paratuberculosis
ucugggcgggcucgagccc

SEQ ID NO: 994928 - RNA, 20 nt, Mycobacterium avium subsp. paratuberculosis
ucugggaucggugcgcggcg

SEQ ID NO: 994929 - RNA, 16 nt, Mycobacterium avium subsp. paratuberculosis
ucugggccgccaacgg

SEQ ID NO: 994930 - RNA, 14 nt, Mycobacterium avium subsp. paratuberculosis
ucugggugccgcgg

SEQ ID NO: 994931 - RNA, 12 nt, Mycobacterium avium subsp. paratuberculosis
ucuggcccuggc

SEQ ID NO: 994932 - RNA, 14 nt, Mycobacterium avium subsp. paratuberculosis
ucuggcccuggcag

SEQ ID NO: 994933 - RNA, 12 nt, Mycobacterium avium subsp. paratuberculosis
ucuggccgaccg

SEQ ID NO: 994934 - RNA, 17 nt, Mycobacterium avium subsp. paratuberculosis
ucuggccgaucuugucg

SEQ ID NO: 994935 - RNA, 16 nt, Mycobacterium avium subsp. paratuberculosis
ucuggccccgucgucu

SEQ ID NO: 994936 - RNA, 17 nt, Mycobacterium avium subsp. paratuberculosis
ucuuguacaugucgucg

SEQ ID NO: 994937 - RNA, 19 nt, Mycobacterium avium subsp. paratuberculosis
ucuugcgggagaacaggua

SEQ ID NO: 994938 - RNA, 20 nt, Mycobacterium avium subsp. paratuberculosis
ucuugcguuccucgacggcg

SEQ ID NO: 994939 - RNA, 16 nt, Mycobacterium avium subsp. paratuberculosis
ucuuguccucgaagau

SEQ ID NO: 994940 - RNA, 14 nt, Mycobacterium avium subsp. paratuberculosis
ucuugcagccgggg

SEQ ID NO: 994941 - RNA, 15 nt, Mycobacterium avium subsp. paratuberculosis
ucuugcccagcgggg

SEQ ID NO: 994942 - RNA, 12 nt, Mycobacterium avium subsp. paratuberculosis
ucuugaucucgg

SEQ ID NO: 994943 - RNA, 15 nt, Mycobacterium avium subsp. paratuberculosis
ucuugacggccgcgg

SEQ ID NO: 994944 - RNA, 12 nt, Mycobacterium avium subsp. paratuberculosis
ucuucuuggccg

SEQ ID NO: 994945 - RNA, 19 nt, Mycobacterium avium subsp. paratuberculosis
ucuucucgccguccccacc

SEQ ID NO: 994946 - RNA, 22 nt, Mycobacterium avium subsp. paratuberculosis
ucuucucgcugcucugcgcgcg

SEQ ID NO: 994947 - RNA, 15 nt, Mycobacterium avium subsp. paratuberculosis
ucuucucacagguga

SEQ ID NO: 994948 - RNA, 15 nt, Mycobacterium avium subsp. paratuberculosis
ucuucuccaugguga

SEQ ID NO: 994949 - RNA, 20 nt, Mycobacterium avium subsp. paratuberculosis
ucuucuccauggugaacugg

SEQ ID NO: 994950 - RNA, 18 nt, Mycobacterium avium subsp. paratuberculosis
ucuucuccgcggccgcgc

SEQ ID NO: 994951 - RNA, 21 nt, Mycobacterium avium subsp. paratuberculosis
ucuucucgaagcgcagcagcu

SEQ ID NO: 994952 - RNA, 18 nt, Mycobacterium avium subsp. paratuberculosis
ucuucggggguggccagc

SEQ ID NO: 994953 - RNA, 17 nt, Mycobacterium avium subsp. paratuberculosis
ucuucggcgccgagcgu

SEQ ID NO: 994954 - RNA, 15 nt, Mycobacterium avium subsp. paratuberculosis
ucuucggccaucgac

SEQ ID NO: 994955 - RNA, 13 nt, Mycobacterium avium subsp. paratuberculosis
ucuucgcugccgc

SEQ ID NO: 994956 - RNA, 16 nt, Mycobacterium avium subsp. paratuberculosis
ucuucgcugccgccgc

SEQ ID NO: 994957 - RNA, 18 nt, Mycobacterium avium subsp. paratuberculosis
ucuucgcggucucucuaa

SEQ ID NO: 994958 - RNA, 20 nt, Mycobacterium avium subsp. paratuberculosis
ucuucgcagcgcucaguguc

SEQ ID NO: 994959 - RNA, 21 nt, Mycobacterium avium subsp. paratuberculosis
ucuucgccgcaaccuucuugg

SEQ ID NO: 994960 - RNA, 21 nt, Mycobacterium avium subsp. paratuberculosis
ucuucgccgcagccuucuugg

SEQ ID NO: 994961 - RNA, 22 nt, Mycobacterium avium subsp. paratuberculosis
ucuucgccggcgcuuugccguc

SEQ ID NO: 994962 - RNA, 21 nt, Mycobacterium avium subsp. paratuberculosis
ucuucgccggggccuucuugg

SEQ ID NO: 994963 - RNA, 14 nt, Mycobacterium avium subsp. paratuberculosis
ucuucgaggucgua

SEQ ID NO: 994964 - RNA, 16 nt, Mycobacterium avium subsp. paratuberculosis
ucuucaugugguuggg

SEQ ID NO: 994965 - RNA, 15 nt, Mycobacterium avium subsp. paratuberculosis
ucuuccucgcugucc

SEQ ID NO: 994966 - RNA, 17 nt, Mycobacterium avium subsp. paratuberculosis
ucuuccucgcuguccug

SEQ ID NO: 994967 - RNA, 16 nt, Mycobacterium avium subsp. paratuberculosis
uguaaccguggcaggc

SEQ ID NO: 994968 - RNA, 19 nt, Mycobacterium avium subsp. paratuberculosis
ugguguucuggaugcccag

SEQ ID NO: 994969 - RNA, 19 nt, Mycobacterium avium subsp. paratuberculosis
ugguucaccgccaccagca

SEQ ID NO: 994970 - RNA, 20 nt, Mycobacterium avium subsp. paratuberculosis
uguaccaggccuugucgucc

SEQ ID NO: 994971 - RNA, 19 nt, Mycobacterium avium subsp. paratuberculosis
uguauuaagcuggcagggu

SEQ ID NO: 994972 - RNA, 19 nt, Mycobacterium avium subsp. paratuberculosis
uguagcggacgggccgcau

SEQ ID NO: 994973 - RNA, 18 nt, Mycobacterium avium subsp. paratuberculosis
uguagcgcugguaguaca

SEQ ID NO: 994974 - RNA, 15 nt, Mycobacterium avium subsp. paratuberculosis
uguagcggcggucgg

SEQ ID NO: 994975 - RNA, 13 nt, Mycobacterium avium subsp. paratuberculosis
uguaggacgccgc

SEQ ID NO: 994976 - RNA, 14 nt, Mycobacterium avium subsp. paratuberculosis
uguagcagcgcggc

SEQ ID NO: 994977 - RNA, 21 nt, Mycobacterium avium subsp. paratuberculosis
uguagcaggcggugguggggu

SEQ ID NO: 994978 - RNA, 13 nt, Mycobacterium avium subsp. paratuberculosis
uguagcgcagcau

SEQ ID NO: 994979 - RNA, 22 nt, Mycobacterium avium subsp. paratuberculosis
uguaggccgcgcuggccagcgu

SEQ ID NO: 994980 - RNA, 23 nt, Mycobacterium avium subsp. paratuberculosis
uguaggcggccacacuggccaug

SEQ ID NO: 994981 - RNA, 14 nt, Mycobacterium avium subsp. paratuberculosis
uguaguugcaaccc

SEQ ID NO: 994982 - RNA, 14 nt, Mycobacterium avium subsp. paratuberculosis
ugguaccggcgcca

SEQ ID NO: 994983 - RNA, 18 nt, Mycobacterium avium subsp. paratuberculosis
ugguaccggcgccaggcc

SEQ ID NO: 994984 - RNA, 15 nt, Mycobacterium avium subsp. paratuberculosis
ugguacagcgccagc

SEQ ID NO: 994985 - RNA, 18 nt, Mycobacterium avium subsp. paratuberculosis
uggguguccuugcgcacc

SEQ ID NO: 994986 - RNA, 16 nt, Mycobacterium avium subsp. paratuberculosis
uggguggucaccagcg

SEQ ID NO: 994987 - RNA, 16 nt, Mycobacterium avium subsp. paratuberculosis
uggguggucagcgcgg

SEQ ID NO: 994988 - RNA, 14 nt, Mycobacterium avium subsp. paratuberculosis
ugggugguccaggc

SEQ ID NO: 994989 - RNA, 15 nt, Mycobacterium avium subsp. paratuberculosis
uggguucgaauccca

SEQ ID NO: 994990 - RNA, 23 nt, Mycobacterium avium subsp. paratuberculosis
uggguucuucgaccacgcgccaa

SEQ ID NO: 994991 - RNA, 17 nt, Mycobacterium avium subsp. paratuberculosis
ugguacgcgccgucguc

SEQ ID NO: 994992 - RNA, 12 nt, Mycobacterium avium subsp. paratuberculosis
uggucagcggcg

SEQ ID NO: 994993 - RNA, 20 nt, Mycobacterium avium subsp. paratuberculosis
uggucagcgcccccgaggag

SEQ ID NO: 994994 - RNA, 16 nt, Mycobacterium avium subsp. paratuberculosis
ugguguggaucuccag

SEQ ID NO: 994995 - RNA, 15 nt, Mycobacterium avium subsp. paratuberculosis
uggugugcaaaagca

SEQ ID NO: 994996 - RNA, 15 nt, Mycobacterium avium subsp. paratuberculosis
uggugugcaccagcg

SEQ ID NO: 994997 - RNA, 18 nt, Mycobacterium avium subsp. paratuberculosis
uggugugguagggccgcu

SEQ ID NO: 994998 - RNA, 16 nt, Mycobacterium avium subsp. paratuberculosis
ugguggccgcggccgc

SEQ ID NO: 994999 - RNA, 13 nt, Mycobacterium avium subsp. paratuberculosis
uggugucaggauc

SEQ ID NO: 995000 - RNA, 21 nt, Mycobacterium avium subsp. paratuberculosis
uggugucgaagucgaucccgg

SEQ ID NO: 995001 - RNA, 18 nt, Mycobacterium avium subsp. paratuberculosis
ugguggacgucaggccgu

SEQ ID NO: 995002 - RNA, 20 nt, Mycobacterium avium subsp. paratuberculosis
ugguggccagcaccacgucc

SEQ ID NO: 995003 - RNA, 19 nt, Mycobacterium avium subsp. paratuberculosis
ugguggcccaggcagaccc

SEQ ID NO: 995004 - RNA, 16 nt, Mycobacterium avium subsp. paratuberculosis
uggugagacccuggau

SEQ ID NO: 995005 - RNA, 15 nt, Mycobacterium avium subsp. paratuberculosis
uggugaucagcaucc

SEQ ID NO: 995006 - RNA, 16 nt, Mycobacterium avium subsp. paratuberculosis
uggugaucagccccgc

SEQ ID NO: 995007 - RNA, 13 nt, Mycobacterium avium subsp. paratuberculosis
uggugaucggcca

SEQ ID NO: 995008 - RNA, 11 nt, Mycobacterium avium subsp. paratuberculosis
uggucucccag

SEQ ID NO: 995009 - RNA, 20 nt, Mycobacterium avium subsp. paratuberculosis
uggucgguuugcgggccagu

SEQ ID NO: 995010 - RNA, 20 nt, Mycobacterium avium subsp. paratuberculosis
uggugaaggugcccuccucg

SEQ ID NO: 995011 - RNA, 20 nt, Mycobacterium avium subsp. paratuberculosis
uggugaccugcggaucgcgg

SEQ ID NO: 995012 - RNA, 21 nt, Mycobacterium avium subsp. paratuberculosis
uggugacgcucacccggccca

SEQ ID NO: 995013 - RNA, 20 nt, Mycobacterium avium subsp. paratuberculosis
uggucuccggccccgagccg

SEQ ID NO: 995014 - RNA, 20 nt, Mycobacterium avium subsp. paratuberculosis
uggucucguagaagcucagc

SEQ ID NO: 995015 - RNA, 18 nt, Mycobacterium avium subsp. paratuberculosis
uggucgaugcccgcgccg

SEQ ID NO: 995016 - RNA, 13 nt, Mycobacterium avium subsp. paratuberculosis
uggucggucagcu

SEQ ID NO: 995017 - RNA, 18 nt, Mycobacterium avium subsp. paratuberculosis
uggucgagcuccuccggg

SEQ ID NO: 995018 - RNA, 21 nt, Mycobacterium avium subsp. paratuberculosis
uggucgagggcguucgcggug

SEQ ID NO: 995019 - RNA, 19 nt, Mycobacterium avium subsp. paratuberculosis
uggucgaagauggccaggu

SEQ ID NO: 995020 - RNA, 18 nt, Mycobacterium avium subsp. paratuberculosis
ugguccggucucuggccu

SEQ ID NO: 995021 - RNA, 14 nt, Mycobacterium avium subsp. paratuberculosis
ugggccggugcagc

SEQ ID NO: 995022 - RNA, 14 nt, Mycobacterium avium subsp. paratuberculosis
ugggccucguccag

SEQ ID NO: 995023 - RNA, 15 nt, Mycobacterium avium subsp. paratuberculosis
ugggccgcagcagcg

SEQ ID NO: 995024 - RNA, 19 nt, Mycobacterium avium subsp. paratuberculosis
ugggccgggaugaagccgc

SEQ ID NO: 995025 - RNA, 14 nt, Mycobacterium avium subsp. paratuberculosis
ugggccgccggccg

SEQ ID NO: 995026 - RNA, 21 nt, Mycobacterium avium subsp. paratuberculosis
ugggccgccgucgccaccacc

SEQ ID NO: 995027 - RNA, 22 nt, Mycobacterium avium subsp. paratuberculosis
ugggcgaccacguccagcuggg

SEQ ID NO: 995028 - RNA, 15 nt, Mycobacterium avium subsp. paratuberculosis
ugggcgaacagcagc

SEQ ID NO: 995029 - RNA, 18 nt, Mycobacterium avium subsp. paratuberculosis
ugggcgaacagcagcacc

SEQ ID NO: 995030 - RNA, 17 nt, Mycobacterium avium subsp. paratuberculosis
ugggcgaacgaggccga

SEQ ID NO: 995031 - RNA, 20 nt, Mycobacterium avium subsp. paratuberculosis
ugggcuaccagccccaggag

SEQ ID NO: 995032 - RNA, 12 nt, Mycobacterium avium subsp. paratuberculosis
ugggcucgagca

SEQ ID NO: 995033 - RNA, 17 nt, Mycobacterium avium subsp. paratuberculosis
ugggcucgagcaacacc

SEQ ID NO: 995034 - RNA, 18 nt, Mycobacterium avium subsp. paratuberculosis
uggggccgaagccgacac

SEQ ID NO: 995035 - RNA, 23 nt, Mycobacterium avium subsp. paratuberculosis
ugggugagcggcgcguccauggu

SEQ ID NO: 995036 - RNA, 21 nt, Mycobacterium avium subsp. paratuberculosis
ugggucaaaacaacgcgcagc

SEQ ID NO: 995037 - RNA, 13 nt, Mycobacterium avium subsp. paratuberculosis
ugggucaccacgg

SEQ ID NO: 995038 - RNA, 19 nt, Mycobacterium avium subsp. paratuberculosis
uggguccgauugcccgacu

SEQ ID NO: 995039 - RNA, 19 nt, Mycobacterium avium subsp. paratuberculosis
uggguccgauuucccgacu

SEQ ID NO: 995040 - RNA, 15 nt, Mycobacterium avium subsp. paratuberculosis
uggguccgccgggcg

SEQ ID NO: 995041 - RNA, 17 nt, Mycobacterium avium subsp. paratuberculosis
uggguccggucagcacc

SEQ ID NO: 995042 - RNA, 12 nt, Mycobacterium avium subsp. paratuberculosis
ugggucagcucc

SEQ ID NO: 995043 - RNA, 21 nt, Mycobacterium avium subsp. paratuberculosis
ugggucaucgacucgaagaac

SEQ ID NO: 995044 - RNA, 22 nt, Mycobacterium avium subsp. paratuberculosis
uggggcucagccgaagccggcg

SEQ ID NO: 995045 - RNA, 22 nt, Mycobacterium avium subsp. paratuberculosis
uggggcaggaacgccuuggugc

SEQ ID NO: 995046 - RNA, 21 nt, Mycobacterium avium subsp. paratuberculosis
ugggauugccgggcaccagcg

SEQ ID NO: 995047 - RNA, 22 nt, Mycobacterium avium subsp. paratuberculosis
ugggaucggugcgcggcgaagg

SEQ ID NO: 995048 - RNA, 15 nt, Mycobacterium avium subsp. paratuberculosis
ugggcagccgcgcgu

SEQ ID NO: 995049 - RNA, 14 nt, Mycobacterium avium subsp. paratuberculosis
ugggcauggugaag

SEQ ID NO: 995050 - RNA, 16 nt, Mycobacterium avium subsp. paratuberculosis
ugggcauggugaagcc

SEQ ID NO: 995051 - RNA, 21 nt, Mycobacterium avium subsp. paratuberculosis
ugggcauggugaagcccagcg

SEQ ID NO: 995052 - RNA, 18 nt, Mycobacterium avium subsp. paratuberculosis
ugggcacgucggccagga

SEQ ID NO: 995053 - RNA, 21 nt, Mycobacterium avium subsp. paratuberculosis
ugggcacgucggccaggaucu

SEQ ID NO: 995054 - RNA, 12 nt, Mycobacterium avium subsp. paratuberculosis
ugggcagcgcgg

SEQ ID NO: 995055 - RNA, 19 nt, Mycobacterium avium subsp. paratuberculosis
ugggcagaugcccgcugac

SEQ ID NO: 995056 - RNA, 14 nt, Mycobacterium avium subsp. paratuberculosis
ugggaucagcagca

SEQ ID NO: 995057 - RNA, 15 nt, Mycobacterium avium subsp. paratuberculosis
ugggaucagcagcac

SEQ ID NO: 995058 - RNA, 22 nt, Mycobacterium avium subsp. paratuberculosis
uggcggcgaacgcgcggucguc

SEQ ID NO: 995059 - RNA, 16 nt, Mycobacterium avium subsp. paratuberculosis
uggcgcaccgcggccu

SEQ ID NO: 995060 - RNA, 17 nt, Mycobacterium avium subsp. paratuberculosis
uggcgcaccgcggccuc

SEQ ID NO: 995061 - RNA, 23 nt, Mycobacterium avium subsp. paratuberculosis
uggcgcacagcuuucgggcggcc

SEQ ID NO: 995062 - RNA, 18 nt, Mycobacterium avium subsp. paratuberculosis
uggcgcaggcgcugggug

SEQ ID NO: 995063 - RNA, 19 nt, Mycobacterium avium subsp. paratuberculosis
uggcgcaguuaccggcgua

SEQ ID NO: 995064 - RNA, 14 nt, Mycobacterium avium subsp. paratuberculosis
uggcgccgcgggcg

SEQ ID NO: 995065 - RNA, 18 nt, Mycobacterium avium subsp. paratuberculosis
uggcgcccggcagccgcu

SEQ ID NO: 995066 - RNA, 17 nt, Mycobacterium avium subsp. paratuberculosis
uggcgcccuuggccucc

SEQ ID NO: 995067 - RNA, 23 nt, Mycobacterium avium subsp. paratuberculosis
uggcgccgaacagaugccugccc

SEQ ID NO: 995068 - RNA, 15 nt, Mycobacterium avium subsp. paratuberculosis
uggcgccguccgcgg

SEQ ID NO: 995069 - RNA, 13 nt, Mycobacterium avium subsp. paratuberculosis
uggcgccggggcg

SEQ ID NO: 995070 - RNA, 17 nt, Mycobacterium avium subsp. paratuberculosis
uggcgccggcguccagc

SEQ ID NO: 995071 - RNA, 17 nt, Mycobacterium avium subsp. paratuberculosis
uggcgaacugcaccagc

SEQ ID NO: 995072 - RNA, 16 nt, Mycobacterium avium subsp. paratuberculosis
uggcgaagcccaugcc

SEQ ID NO: 995073 - RNA, 21 nt, Mycobacterium avium subsp. paratuberculosis
uggcgacgcugaacagcagca

SEQ ID NO: 995074 - RNA, 21 nt, Mycobacterium avium subsp. paratuberculosis
uggcgacggugcaugcgcugg

SEQ ID NO: 995075 - RNA, 22 nt, Mycobacterium avium subsp. paratuberculosis
uggcgacggugcaugcgcuggc

SEQ ID NO: 995076 - RNA, 16 nt, Mycobacterium avium subsp. paratuberculosis
uggcgauggccugcuc

SEQ ID NO: 995077 - RNA, 22 nt, Mycobacterium avium subsp. paratuberculosis
uggcgaugccggacucugacuc

SEQ ID NO: 995078 - RNA, 18 nt, Mycobacterium avium subsp. paratuberculosis
uggcgaugaccagcgcga

SEQ ID NO: 995079 - RNA, 16 nt, Mycobacterium avium subsp. paratuberculosis
uggcgaugacgucguc

SEQ ID NO: 995080 - RNA, 15 nt, Mycobacterium avium subsp. paratuberculosis
uggcgaugaucaaca

SEQ ID NO: 995081 - RNA, 22 nt, Mycobacterium avium subsp. paratuberculosis
uggcgaugaucaacaggauucc

SEQ ID NO: 995082 - RNA, 21 nt, Mycobacterium avium subsp. paratuberculosis
uggccucgucggcgccgucgc

SEQ ID NO: 995083 - RNA, 21 nt, Mycobacterium avium subsp. paratuberculosis
uggccugcuugggcagcagcu

SEQ ID NO: 995084 - RNA, 11 nt, Mycobacterium avium subsp. paratuberculosis
uggccugcccg

SEQ ID NO: 995085 - RNA, 17 nt, Mycobacterium avium subsp. paratuberculosis
uggccugaaccagcucg

SEQ ID NO: 995086 - RNA, 17 nt, Mycobacterium avium subsp. paratuberculosis
uggccucggcgcgggcg

SEQ ID NO: 995087 - RNA, 16 nt, Mycobacterium avium subsp. paratuberculosis
uggccuccccauccgc

SEQ ID NO: 995088 - RNA, 23 nt, Mycobacterium avium subsp. paratuberculosis
uggccuccccauccgcggccacc

SEQ ID NO: 995089 - RNA, 20 nt, Mycobacterium avium subsp. paratuberculosis
uggccuccgacccguccagc

SEQ ID NO: 995090 - RNA, 16 nt, Mycobacterium avium subsp. paratuberculosis
uggccucauuggccuu

SEQ ID NO: 995091 - RNA, 22 nt, Mycobacterium avium subsp. paratuberculosis
uggccucauuggccuuuugcac

SEQ ID NO: 995092 - RNA, 14 nt, Mycobacterium avium subsp. paratuberculosis
uggccuccaccggc

SEQ ID NO: 995093 - RNA, 20 nt, Mycobacterium avium subsp. paratuberculosis
uggccuucuggaagccuggc

SEQ ID NO: 995094 - RNA, 13 nt, Mycobacterium avium subsp. paratuberculosis
uggccuucaucac

SEQ ID NO: 995095 - RNA, 16 nt, Mycobacterium avium subsp. paratuberculosis
uggccugggccucguc

SEQ ID NO: 995096 - RNA, 17 nt, Mycobacterium avium subsp. paratuberculosis
uggccuggucgaacagc

SEQ ID NO: 995097 - RNA, 18 nt, Mycobacterium avium subsp. paratuberculosis
uggccugguggcccaggc

SEQ ID NO: 995098 - RNA, 15 nt, Mycobacterium avium subsp. paratuberculosis
uggcgaacagcgggu

SEQ ID NO: 995099 - RNA, 23 nt, Mycobacterium avium subsp. paratuberculosis
uggccggguuccgguuggccagg

SEQ ID NO: 995100 - RNA, 18 nt, Mycobacterium avium subsp. paratuberculosis
uggccgguauuggccacg

SEQ ID NO: 995101 - RNA, 19 nt, Mycobacterium avium subsp. paratuberculosis
uggccggccaccagcggcc

SEQ ID NO: 995102 - RNA, 12 nt, Mycobacterium avium subsp. paratuberculosis
uggccggccagc

SEQ ID NO: 995103 - RNA, 17 nt, Mycobacterium avium subsp. paratuberculosis
uggccggccaucuucag

SEQ ID NO: 995104 - RNA, 18 nt, Mycobacterium avium subsp. paratuberculosis
uggccggugggcggcgcc

SEQ ID NO: 995105 - RNA, 18 nt, Mycobacterium avium subsp. paratuberculosis
uggccggugcggaugaag

SEQ ID NO: 995106 - RNA, 18 nt, Mycobacterium avium subsp. paratuberculosis
uggccgucucgucggccg

SEQ ID NO: 995107 - RNA, 14 nt, Mycobacterium avium subsp. paratuberculosis
uggccgucgcggcg

SEQ ID NO: 995108 - RNA, 12 nt, Mycobacterium avium subsp. paratuberculosis
uggccgugcagg

SEQ ID NO: 995109 - RNA, 16 nt, Mycobacterium avium subsp. paratuberculosis
uggccgugcagggggc

SEQ ID NO: 995110 - RNA, 16 nt, Mycobacterium avium subsp. paratuberculosis
uggccgcgcagcgugu

SEQ ID NO: 995111 - RNA, 18 nt, Mycobacterium avium subsp. paratuberculosis
uggccgcgcccuucuucg

SEQ ID NO: 995112 - RNA, 21 nt, Mycobacterium avium subsp. paratuberculosis
uggccgcgccgccgcccuggc

SEQ ID NO: 995113 - RNA, 23 nt, Mycobacterium avium subsp. paratuberculosis
uggccgcgccgccgcccuggccc

SEQ ID NO: 995114 - RNA, 17 nt, Mycobacterium avium subsp. paratuberculosis
uggccgcgccguagcgg

SEQ ID NO: 995115 - RNA, 17 nt, Mycobacterium avium subsp. paratuberculosis
uggccgcgggcgggccg

SEQ ID NO: 995116 - RNA, 21 nt, Mycobacterium avium subsp. paratuberculosis
uggccgcgggcgggccgaacc

SEQ ID NO: 995117 - RNA, 12 nt, Mycobacterium avium subsp. paratuberculosis
uggccgcggccg

SEQ ID NO: 995118 - RNA, 13 nt, Mycobacterium avium subsp. paratuberculosis
uggccgcggccuu

SEQ ID NO: 995119 - RNA, 15 nt, Mycobacterium avium subsp. paratuberculosis
uggccgcggccuugc

SEQ ID NO: 995120 - RNA, 18 nt, Mycobacterium avium subsp. paratuberculosis
uggccgcggccagcugcc

SEQ ID NO: 995121 - RNA, 17 nt, Mycobacterium avium subsp. paratuberculosis
uggccgcgucgaccagc

SEQ ID NO: 995122 - RNA, 14 nt, Mycobacterium avium subsp. paratuberculosis
uggccgcgugcaac

SEQ ID NO: 995123 - RNA, 16 nt, Mycobacterium avium subsp. paratuberculosis
uggccggagccuuggu

SEQ ID NO: 995124 - RNA, 11 nt, Mycobacterium avium subsp. paratuberculosis
uggccaccacc

SEQ ID NO: 995125 - RNA, 14 nt, Mycobacterium avium subsp. paratuberculosis
uggccaccaccgag

SEQ ID NO: 995126 - RNA, 12 nt, Mycobacterium avium subsp. paratuberculosis
uggccaccagca

SEQ ID NO: 995127 - RNA, 15 nt, Mycobacterium avium subsp. paratuberculosis
uggccaccagcagca

SEQ ID NO: 995128 - RNA, 17 nt, Mycobacterium avium subsp. paratuberculosis
uggccaccagcagcagg

SEQ ID NO: 995129 - RNA, 18 nt, Mycobacterium avium subsp. paratuberculosis
uggccacccucgccgccg

SEQ ID NO: 995130 - RNA, 20 nt, Mycobacterium avium subsp. paratuberculosis
uggccagauacuccucggug

SEQ ID NO: 995131 - RNA, 13 nt, Mycobacterium avium subsp. paratuberculosis
uggccacgcccca

SEQ ID NO: 995132 - RNA, 20 nt, Mycobacterium avium subsp. paratuberculosis
uggccaccgaagccgacguc

SEQ ID NO: 995133 - RNA, 21 nt, Mycobacterium avium subsp. paratuberculosis
uggccaggcgggccaccacag

SEQ ID NO: 995134 - RNA, 19 nt, Mycobacterium avium subsp. paratuberculosis
uggccaggcccagcccggc

SEQ ID NO: 995135 - RNA, 15 nt, Mycobacterium avium subsp. paratuberculosis
uggccagcucggcca

SEQ ID NO: 995136 - RNA, 21 nt, Mycobacterium avium subsp. paratuberculosis
uggccaucuggccgcgggugc

SEQ ID NO: 995137 - RNA, 15 nt, Mycobacterium avium subsp. paratuberculosis
uggccagcaccgcgu

SEQ ID NO: 995138 - RNA, 12 nt, Mycobacterium avium subsp. paratuberculosis
uggccagcacca

SEQ ID NO: 995139 - RNA, 15 nt, Mycobacterium avium subsp. paratuberculosis
uggccagcaccaccg

SEQ ID NO: 995140 - RNA, 14 nt, Mycobacterium avium subsp. paratuberculosis
uggccagcaccagc

SEQ ID NO: 995141 - RNA, 15 nt, Mycobacterium avium subsp. paratuberculosis
uggccagcaccagcc

SEQ ID NO: 995142 - RNA, 12 nt, Mycobacterium avium subsp. paratuberculosis
uggccagcgcgu

SEQ ID NO: 995143 - RNA, 15 nt, Mycobacterium avium subsp. paratuberculosis
uggccagcgccucca

SEQ ID NO: 995144 - RNA, 15 nt, Mycobacterium avium subsp. paratuberculosis
uggcaugccggaaca

SEQ ID NO: 995145 - RNA, 17 nt, Mycobacterium avium subsp. paratuberculosis
uggcccggcgcggcggc

SEQ ID NO: 995146 - RNA, 17 nt, Mycobacterium avium subsp. paratuberculosis
uggccgagcggcugcug

SEQ ID NO: 995147 - RNA, 14 nt, Mycobacterium avium subsp. paratuberculosis
uggccgaggggucc

SEQ ID NO: 995148 - RNA, 22 nt, Mycobacterium avium subsp. paratuberculosis
uggccgaucagcugcucggcca

SEQ ID NO: 995149 - RNA, 16 nt, Mycobacterium avium subsp. paratuberculosis
uggccgauggucagcu

SEQ ID NO: 995150 - RNA, 16 nt, Mycobacterium avium subsp. paratuberculosis
uggccgccaccaacau

SEQ ID NO: 995151 - RNA, 13 nt, Mycobacterium avium subsp. paratuberculosis
uggccgccacgau

SEQ ID NO: 995152 - RNA, 15 nt, Mycobacterium avium subsp. paratuberculosis
uggccgccagcaccu

SEQ ID NO: 995153 - RNA, 23 nt, Mycobacterium avium subsp. paratuberculosis
uggccgccagcaccucgcggcag

SEQ ID NO: 995154 - RNA, 17 nt, Mycobacterium avium subsp. paratuberculosis
uggccgcccucgcugcc

SEQ ID NO: 995155 - RNA, 18 nt, Mycobacterium avium subsp. paratuberculosis
uggccgcccucgcugccg

SEQ ID NO: 995156 - RNA, 23 nt, Mycobacterium avium subsp. paratuberculosis
uggccgcgaacgggugaccggcg

SEQ ID NO: 995157 - RNA, 16 nt, Mycobacterium avium subsp. paratuberculosis
uggccgcgacucugca

SEQ ID NO: 995158 - RNA, 10 nt, Mycobacterium avium subsp. paratuberculosis
uggccgccgg

SEQ ID NO: 995159 - RNA, 13 nt, Mycobacterium avium subsp. paratuberculosis
uggccccagccac

SEQ ID NO: 995160 - RNA, 18 nt, Mycobacterium avium subsp. paratuberculosis
uggcccaggccgcggucg

SEQ ID NO: 995161 - RNA, 14 nt, Mycobacterium avium subsp. paratuberculosis
uggcccagccgcgu

SEQ ID NO: 995162 - RNA, 19 nt, Mycobacterium avium subsp. paratuberculosis
uggcccagccggccgacgc

SEQ ID NO: 995163 - RNA, 23 nt, Mycobacterium avium subsp. paratuberculosis
uggcccagacaggccggccgcua

SEQ ID NO: 995164 - RNA, 15 nt, Mycobacterium avium subsp. paratuberculosis
uggcccacgcagccg

SEQ ID NO: 995165 - RNA, 13 nt, Mycobacterium avium subsp. paratuberculosis
uggccccgggccg

SEQ ID NO: 995166 - RNA, 22 nt, Mycobacterium avium subsp. paratuberculosis
uggcccgccgcggcuccagcag

SEQ ID NO: 995167 - RNA, 17 nt, Mycobacterium avium subsp. paratuberculosis
uggcccgcucggucuug

SEQ ID NO: 995168 - RNA, 22 nt, Mycobacterium avium subsp. paratuberculosis
uggcccgcucggucuugaucag

SEQ ID NO: 995169 - RNA, 19 nt, Mycobacterium avium subsp. paratuberculosis
uggcccgacccguucuugu

SEQ ID NO: 995170 - RNA, 21 nt, Mycobacterium avium subsp. paratuberculosis
uggcccgcaccacccagcccu

SEQ ID NO: 995171 - RNA, 19 nt, Mycobacterium avium subsp. paratuberculosis
uggcccgcacccgccgccc

SEQ ID NO: 995172 - RNA, 14 nt, Mycobacterium avium subsp. paratuberculosis
uggcccccaccacg

SEQ ID NO: 995173 - RNA, 19 nt, Mycobacterium avium subsp. paratuberculosis
uggcagcagccggaaggcc

SEQ ID NO: 995174 - RNA, 17 nt, Mycobacterium avium subsp. paratuberculosis
uggcagcucgggcagcc

SEQ ID NO: 995175 - RNA, 20 nt, Mycobacterium avium subsp. paratuberculosis
uggcagcucgggcagcccgc

SEQ ID NO: 995176 - RNA, 16 nt, Mycobacterium avium subsp. paratuberculosis
uggcaggccaucagcc

SEQ ID NO: 995177 - RNA, 13 nt, Mycobacterium avium subsp. paratuberculosis
uggcagggccagc

SEQ ID NO: 995178 - RNA, 23 nt, Mycobacterium avium subsp. paratuberculosis
uggcaggugagccgggugcccgc

SEQ ID NO: 995179 - RNA, 17 nt, Mycobacterium avium subsp. paratuberculosis
uggcaauacgccucgca

SEQ ID NO: 995180 - RNA, 13 nt, Mycobacterium avium subsp. paratuberculosis
uggaugcccaggg

SEQ ID NO: 995181 - RNA, 12 nt, Mycobacterium avium subsp. paratuberculosis
uggaugaacagc

SEQ ID NO: 995182 - RNA, 18 nt, Mycobacterium avium subsp. paratuberculosis
uggaugucacgguccagg

SEQ ID NO: 995183 - RNA, 17 nt, Mycobacterium avium subsp. paratuberculosis
uggaguugucggugaag

SEQ ID NO: 995184 - RNA, 13 nt, Mycobacterium avium subsp. paratuberculosis
uggagaaguccuu

SEQ ID NO: 995185 - RNA, 20 nt, Mycobacterium avium subsp. paratuberculosis
uggagaggcccggcagccgg

SEQ ID NO: 995186 - RNA, 15 nt, Mycobacterium avium subsp. paratuberculosis
uggacuccagcacca

SEQ ID NO: 995187 - RNA, 18 nt, Mycobacterium avium subsp. paratuberculosis
uggacuccagcaccagca

SEQ ID NO: 995188 - RNA, 18 nt, Mycobacterium avium subsp. paratuberculosis
uggacgcgauggcgcugg

SEQ ID NO: 995189 - RNA, 20 nt, Mycobacterium avium subsp. paratuberculosis
uggacgcggccucaccgcgg

SEQ ID NO: 995190 - RNA, 16 nt, Mycobacterium avium subsp. paratuberculosis
uggacggucagcgcgc

SEQ ID NO: 995191 - RNA, 19 nt, Mycobacterium avium subsp. paratuberculosis
uggagggagcacucgaugg

SEQ ID NO: 995192 - RNA, 21 nt, Mycobacterium avium subsp. paratuberculosis
uggaggcguagugcgcccaga

SEQ ID NO: 995193 - RNA, 15 nt, Mycobacterium avium subsp. paratuberculosis
uggagcggaucccgg

SEQ ID NO: 995194 - RNA, 22 nt, Mycobacterium avium subsp. paratuberculosis
uggagcgcgacgggcugcugca

SEQ ID NO: 995195 - RNA, 17 nt, Mycobacterium avium subsp. paratuberculosis
uggagcgcggcaugccg

SEQ ID NO: 995196 - RNA, 14 nt, Mycobacterium avium subsp. paratuberculosis
uggagccgaccagc

SEQ ID NO: 995197 - RNA, 18 nt, Mycobacterium avium subsp. paratuberculosis
uggagccgaccagcgcga

SEQ ID NO: 995198 - RNA, 14 nt, Mycobacterium avium subsp. paratuberculosis
uggagauggccagc

SEQ ID NO: 995199 - RNA, 16 nt, Mycobacterium avium subsp. paratuberculosis
uggagaugcuucagcc

SEQ ID NO: 995200 - RNA, 22 nt, Mycobacterium avium subsp. paratuberculosis
uguuugaucaccaccugguccu

SEQ ID NO: 995201 - RNA, 21 nt, Mycobacterium avium subsp. paratuberculosis
uguuguagucagacccugugg

SEQ ID NO: 995202 - RNA, 19 nt, Mycobacterium avium subsp. paratuberculosis
uguugguagcccaggauuc

SEQ ID NO: 995203 - RNA, 11 nt, Mycobacterium avium subsp. paratuberculosis
uguuggccaga

SEQ ID NO: 995204 - RNA, 23 nt, Mycobacterium avium subsp. paratuberculosis
uguuguuccagaagaucuucaug

SEQ ID NO: 995205 - RNA, 15 nt, Mycobacterium avium subsp. paratuberculosis
uguucucgagcccga

SEQ ID NO: 995206 - RNA, 13 nt, Mycobacterium avium subsp. paratuberculosis
uguucucacggcg

SEQ ID NO: 995207 - RNA, 18 nt, Mycobacterium avium subsp. paratuberculosis
uguucgacugcaggaaca

SEQ ID NO: 995208 - RNA, 17 nt, Mycobacterium avium subsp. paratuberculosis
uguucgagaguuugccc

SEQ ID NO: 995209 - RNA, 22 nt, Mycobacterium avium subsp. paratuberculosis
uguucaggucgauggucugccc

SEQ ID NO: 995210 - RNA, 17 nt, Mycobacterium avium subsp. paratuberculosis
ugugccuggcccagaca

SEQ ID NO: 995211 - RNA, 17 nt, Mycobacterium avium subsp. paratuberculosis
ugugcggcagcucggcg

SEQ ID NO: 995212 - RNA, 18 nt, Mycobacterium avium subsp. paratuberculosis
ugugcaccugagucuggg

SEQ ID NO: 995213 - RNA, 13 nt, Mycobacterium avium subsp. paratuberculosis
ugucaccgcccac

SEQ ID NO: 995214 - RNA, 22 nt, Mycobacterium avium subsp. paratuberculosis
ugucacccguuugaggcgagca

SEQ ID NO: 995215 - RNA, 18 nt, Mycobacterium avium subsp. paratuberculosis
ugucacgguccagguccu

SEQ ID NO: 995216 - RNA, 17 nt, Mycobacterium avium subsp. paratuberculosis
ugugacggauccgggcg

SEQ ID NO: 995217 - RNA, 20 nt, Mycobacterium avium subsp. paratuberculosis
uguggccgcggcggcccggc

SEQ ID NO: 995218 - RNA, 16 nt, Mycobacterium avium subsp. paratuberculosis
ugugggugguccaggc

SEQ ID NO: 995219 - RNA, 19 nt, Mycobacterium avium subsp. paratuberculosis
ugugguacagcgccagcgg

SEQ ID NO: 995220 - RNA, 13 nt, Mycobacterium avium subsp. paratuberculosis
ugugcuagcgagc

SEQ ID NO: 995221 - RNA, 19 nt, Mycobacterium avium subsp. paratuberculosis
ugugcgggugaggccaggc

SEQ ID NO: 995222 - RNA, 21 nt, Mycobacterium avium subsp. paratuberculosis
ugugcgguucacgcggcuggc

SEQ ID NO: 995223 - RNA, 15 nt, Mycobacterium avium subsp. paratuberculosis
uguggcaucaccgcc

SEQ ID NO: 995224 - RNA, 16 nt, Mycobacterium avium subsp. paratuberculosis
uguggcccaggccggc

SEQ ID NO: 995225 - RNA, 17 nt, Mycobacterium avium subsp. paratuberculosis
uguggcccaggccggcg

SEQ ID NO: 995226 - RNA, 15 nt, Mycobacterium avium subsp. paratuberculosis
uguggucgaucccgc

SEQ ID NO: 995227 - RNA, 22 nt, Mycobacterium avium subsp. paratuberculosis
uuacgaccaguuccacaccgac

SEQ ID NO: 995228 - RNA, 18 nt, Mycobacterium avium subsp. paratuberculosis
uggacagcagcagcuccc

SEQ ID NO: 995229 - RNA, 12 nt, Mycobacterium avium subsp. paratuberculosis
uggacagcgcga

SEQ ID NO: 995230 - RNA, 18 nt, Mycobacterium avium subsp. paratuberculosis
uggacaguucgguggggc

SEQ ID NO: 995231 - RNA, 21 nt, Mycobacterium avium subsp. paratuberculosis
uggacaguucgguggggccgc

SEQ ID NO: 995232 - RNA, 22 nt, Mycobacterium avium subsp. paratuberculosis
uggacaggucgaugauguugcc

SEQ ID NO: 995233 - RNA, 17 nt, Mycobacterium avium subsp. paratuberculosis
uggacaggugcauccag

SEQ ID NO: 995234 - RNA, 22 nt, Mycobacterium avium subsp. paratuberculosis
uggacccgccccgacagcaacg

SEQ ID NO: 995235 - RNA, 16 nt, Mycobacterium avium subsp. paratuberculosis
uggacgacgugcccuu

SEQ ID NO: 995236 - RNA, 15 nt, Mycobacterium avium subsp. paratuberculosis
uggacgaugcggggc

SEQ ID NO: 995237 - RNA, 16 nt, Mycobacterium avium subsp. paratuberculosis
uggacgccagcaugau

SEQ ID NO: 995238 - RNA, 22 nt, Mycobacterium avium subsp. paratuberculosis
uggaacacccaggucuuccgga

SEQ ID NO: 995239 - RNA, 12 nt, Mycobacterium avium subsp. paratuberculosis
uggaacacgccc

SEQ ID NO: 995240 - RNA, 19 nt, Mycobacterium avium subsp. paratuberculosis
uggaacacgcccagcgccg

SEQ ID NO: 995241 - RNA, 16 nt, Mycobacterium avium subsp. paratuberculosis
uggaacagcgggccgg

SEQ ID NO: 995242 - RNA, 14 nt, Mycobacterium avium subsp. paratuberculosis
uggaacaucuccag

SEQ ID NO: 995243 - RNA, 13 nt, Mycobacterium avium subsp. paratuberculosis
uggaacaucccgg

SEQ ID NO: 995244 - RNA, 15 nt, Mycobacterium avium subsp. paratuberculosis
uggaaccgaaucggu

SEQ ID NO: 995245 - RNA, 15 nt, Mycobacterium avium subsp. paratuberculosis
uggaaccggccacca

SEQ ID NO: 995246 - RNA, 19 nt, Mycobacterium avium subsp. paratuberculosis
uggaacgcgucgcgccagc

SEQ ID NO: 995247 - RNA, 13 nt, Mycobacterium avium subsp. paratuberculosis
uggaaggacguca

SEQ ID NO: 995248 - RNA, 17 nt, Mycobacterium avium subsp. paratuberculosis
ugcuucuugaagaaccg

SEQ ID NO: 995249 - RNA, 14 nt, Mycobacterium avium subsp. paratuberculosis
ugcuuggcggccug

SEQ ID NO: 995250 - RNA, 16 nt, Mycobacterium avium subsp. paratuberculosis
ugcuuaccggccggcc

SEQ ID NO: 995251 - RNA, 17 nt, Mycobacterium avium subsp. paratuberculosis
ugcuucaucccgucguu

SEQ ID NO: 995252 - RNA, 14 nt, Mycobacterium avium subsp. paratuberculosis
ugcuucuggcucaa

SEQ ID NO: 995253 - RNA, 22 nt, Mycobacterium avium subsp. paratuberculosis
ugcuucuggguguaggucaaga

SEQ ID NO: 995254 - RNA, 20 nt, Mycobacterium avium subsp. paratuberculosis
ugcuuccgaucaacggcagc

SEQ ID NO: 995255 - RNA, 18 nt, Mycobacterium avium subsp. paratuberculosis
ugcugaccaugacccacg

SEQ ID NO: 995256 - RNA, 14 nt, Mycobacterium avium subsp. paratuberculosis
ugcugcgcagcagc

SEQ ID NO: 995257 - RNA, 16 nt, Mycobacterium avium subsp. paratuberculosis
ugcuggaugugguugc

SEQ ID NO: 995258 - RNA, 17 nt, Mycobacterium avium subsp. paratuberculosis
ugcugcgggucagcagc

SEQ ID NO: 995259 - RNA, 19 nt, Mycobacterium avium subsp. paratuberculosis
ugcugcgggugcggccagc

SEQ ID NO: 995260 - RNA, 22 nt, Mycobacterium avium subsp. paratuberculosis
ugcugcggaacccacgugcggc

SEQ ID NO: 995261 - RNA, 13 nt, Mycobacterium avium subsp. paratuberculosis
ugcugcggccgga

SEQ ID NO: 995262 - RNA, 18 nt, Mycobacterium avium subsp. paratuberculosis
ugcugucgucgcccugac

SEQ ID NO: 995263 - RNA, 17 nt, Mycobacterium avium subsp. paratuberculosis
ugcuggucaugccgucg

SEQ ID NO: 995264 - RNA, 13 nt, Mycobacterium avium subsp. paratuberculosis
ugcuggugaaguu

SEQ ID NO: 995265 - RNA, 19 nt, Mycobacterium avium subsp. paratuberculosis
ugcuggggucggccagcga

SEQ ID NO: 995266 - RNA, 19 nt, Mycobacterium avium subsp. paratuberculosis
ugcgcaucggcgacgccgc

SEQ ID NO: 995267 - RNA, 21 nt, Mycobacterium avium subsp. paratuberculosis
ugcgcaucggcgacgccgccg

SEQ ID NO: 995268 - RNA, 23 nt, Mycobacterium avium subsp. paratuberculosis
ugcgcauucggcgacgcucaggc

SEQ ID NO: 995269 - RNA, 22 nt, Mycobacterium avium subsp. paratuberculosis
ugcgcauggcgugcugaugcug

SEQ ID NO: 995270 - RNA, 14 nt, Mycobacterium avium subsp. paratuberculosis
ugcgcucggccggg

SEQ ID NO: 995271 - RNA, 17 nt, Mycobacterium avium subsp. paratuberculosis
ugcgcucggucgcggcg

SEQ ID NO: 995272 - RNA, 17 nt, Mycobacterium avium subsp. paratuberculosis
ugcgcugcccgauggug

SEQ ID NO: 995273 - RNA, 19 nt, Mycobacterium avium subsp. paratuberculosis
ugcgcugcuuagccccucc

SEQ ID NO: 995274 - RNA, 13 nt, Mycobacterium avium subsp. paratuberculosis
ugcgcugugcggg

SEQ ID NO: 995275 - RNA, 15 nt, Mycobacterium avium subsp. paratuberculosis
ugcggcaacagcacc

SEQ ID NO: 995276 - RNA, 12 nt, Mycobacterium avium subsp. paratuberculosis
ugcggcacacca

SEQ ID NO: 995277 - RNA, 15 nt, Mycobacterium avium subsp. paratuberculosis
ugcggcacaccagcg

SEQ ID NO: 995278 - RNA, 15 nt, Mycobacterium avium subsp. paratuberculosis
ugcggcaccagcccg

SEQ ID NO: 995279 - RNA, 16 nt, Mycobacterium avium subsp. paratuberculosis
ugcggcaccucggccu

SEQ ID NO: 995280 - RNA, 23 nt, Mycobacterium avium subsp. paratuberculosis
ugcggcacgccgaccacccccag

SEQ ID NO: 995281 - RNA, 22 nt, Mycobacterium avium subsp. paratuberculosis
ugcggcgucagguccgcgaacu

SEQ ID NO: 995282 - RNA, 14 nt, Mycobacterium avium subsp. paratuberculosis
ugcggcgggccgca

SEQ ID NO: 995283 - RNA, 14 nt, Mycobacterium avium subsp. paratuberculosis
ugcggcagggccac

SEQ ID NO: 995284 - RNA, 23 nt, Mycobacterium avium subsp. paratuberculosis
ugcggcggcagucgcagcagcag

SEQ ID NO: 995285 - RNA, 13 nt, Mycobacterium avium subsp. paratuberculosis
ugcggcggccggc

SEQ ID NO: 995286 - RNA, 21 nt, Mycobacterium avium subsp. paratuberculosis
ugcggcggccggccagcagcc

SEQ ID NO: 995287 - RNA, 14 nt, Mycobacterium avium subsp. paratuberculosis
ugcggcugcccagg

SEQ ID NO: 995288 - RNA, 17 nt, Mycobacterium avium subsp. paratuberculosis
ugcggcucaccaggucc

SEQ ID NO: 995289 - RNA, 16 nt, Mycobacterium avium subsp. paratuberculosis
ugcgguacaucccgcc

SEQ ID NO: 995290 - RNA, 19 nt, Mycobacterium avium subsp. paratuberculosis
ugcggguugcgggccaggc

SEQ ID NO: 995291 - RNA, 15 nt, Mycobacterium avium subsp. paratuberculosis
ugcguagcggcccga

SEQ ID NO: 995292 - RNA, 18 nt, Mycobacterium avium subsp. paratuberculosis
ugcggcuuugcugccaag

SEQ ID NO: 995293 - RNA, 22 nt, Mycobacterium avium subsp. paratuberculosis
ugcgggaccagcgccucggccu

SEQ ID NO: 995294 - RNA, 20 nt, Mycobacterium avium subsp. paratuberculosis
ugcgggauucgcgcaccuuc

SEQ ID NO: 995295 - RNA, 14 nt, Mycobacterium avium subsp. paratuberculosis
ugcgggucagcagc

SEQ ID NO: 995296 - RNA, 12 nt, Mycobacterium avium subsp. paratuberculosis
ugcgggccagga

SEQ ID NO: 995297 - RNA, 18 nt, Mycobacterium avium subsp. paratuberculosis
ugcgggccagcacgaccc

SEQ ID NO: 995298 - RNA, 16 nt, Mycobacterium avium subsp. paratuberculosis
ugcgggugcggccagc

SEQ ID NO: 995299 - RNA, 18 nt, Mycobacterium avium subsp. paratuberculosis
ugcgggucugcucacgca

SEQ ID NO: 995300 - RNA, 16 nt, Mycobacterium avium subsp. paratuberculosis
ugcgggugaggccagg

SEQ ID NO: 995301 - RNA, 13 nt, Mycobacterium avium subsp. paratuberculosis
ugcgggucggcgu

SEQ ID NO: 995302 - RNA, 13 nt, Mycobacterium avium subsp. paratuberculosis
ugcggguguccga

SEQ ID NO: 995303 - RNA, 12 nt, Mycobacterium avium subsp. paratuberculosis
ugcguccaggac

SEQ ID NO: 995304 - RNA, 19 nt, Mycobacterium avium subsp. paratuberculosis
ugcguccagaccggccggg

SEQ ID NO: 995305 - RNA, 21 nt, Mycobacterium avium subsp. paratuberculosis
ugcguccagaccggccggggc

SEQ ID NO: 995306 - RNA, 15 nt, Mycobacterium avium subsp. paratuberculosis
ugcguccgccggcgg

SEQ ID NO: 995307 - RNA, 23 nt, Mycobacterium avium subsp. paratuberculosis
ugcguccggcccggcguccgcga

SEQ ID NO: 995308 - RNA, 17 nt, Mycobacterium avium subsp. paratuberculosis
ugcgucggcaccagcgg

SEQ ID NO: 995309 - RNA, 19 nt, Mycobacterium avium subsp. paratuberculosis
ugcgucggcaccagcggca

SEQ ID NO: 995310 - RNA, 18 nt, Mycobacterium avium subsp. paratuberculosis
ugcucaccccggccaggg

SEQ ID NO: 995311 - RNA, 14 nt, Mycobacterium avium subsp. paratuberculosis
ugcucaccgagcug

SEQ ID NO: 995312 - RNA, 22 nt, Mycobacterium avium subsp. paratuberculosis
ugcucguugugcauguggccgu

SEQ ID NO: 995313 - RNA, 22 nt, Mycobacterium avium subsp. paratuberculosis
ugcucggaguaguccagcaccg

SEQ ID NO: 995314 - RNA, 16 nt, Mycobacterium avium subsp. paratuberculosis
ugcucggcgagcaccg

SEQ ID NO: 995315 - RNA, 14 nt, Mycobacterium avium subsp. paratuberculosis
ugcucuccugcuug

SEQ ID NO: 995316 - RNA, 18 nt, Mycobacterium avium subsp. paratuberculosis
ugcucuugacggccgcgg

SEQ ID NO: 995317 - RNA, 18 nt, Mycobacterium avium subsp. paratuberculosis
ugcucagcgggaagccga

SEQ ID NO: 995318 - RNA, 15 nt, Mycobacterium avium subsp. paratuberculosis
ugcucagcucccgag

SEQ ID NO: 995319 - RNA, 13 nt, Mycobacterium avium subsp. paratuberculosis
ugcucaggaugau

SEQ ID NO: 995320 - RNA, 16 nt, Mycobacterium avium subsp. paratuberculosis
ugcucgcuugccagcc

SEQ ID NO: 995321 - RNA, 16 nt, Mycobacterium avium subsp. paratuberculosis
ugcucgcgcaggaacu

SEQ ID NO: 995322 - RNA, 17 nt, Mycobacterium avium subsp. paratuberculosis
ugcucgcgccgggcggc

SEQ ID NO: 995323 - RNA, 18 nt, Mycobacterium avium subsp. paratuberculosis
ugcucgcgcucguccagg

SEQ ID NO: 995324 - RNA, 15 nt, Mycobacterium avium subsp. paratuberculosis
ugcucgcgcugccgc

SEQ ID NO: 995325 - RNA, 18 nt, Mycobacterium avium subsp. paratuberculosis
ugcucgcgauuggccucg

SEQ ID NO: 995326 - RNA, 17 nt, Mycobacterium avium subsp. paratuberculosis
ugcgaauacccgcccag

SEQ ID NO: 995327 - RNA, 14 nt, Mycobacterium avium subsp. paratuberculosis
ugcgacccaccguc

SEQ ID NO: 995328 - RNA, 18 nt, Mycobacterium avium subsp. paratuberculosis
ugcgacccaccgucgaag

SEQ ID NO: 995329 - RNA, 21 nt, Mycobacterium avium subsp. paratuberculosis
ugcgacggcaauccggccccg

SEQ ID NO: 995330 - RNA, 15 nt, Mycobacterium avium subsp. paratuberculosis
ugcgacggcagcacc

SEQ ID NO: 995331 - RNA, 18 nt, Mycobacterium avium subsp. paratuberculosis
ugcgacgcaccucggccg

SEQ ID NO: 995332 - RNA, 14 nt, Mycobacterium avium subsp. paratuberculosis
ugcgagccgagcac

SEQ ID NO: 995333 - RNA, 21 nt, Mycobacterium avium subsp. paratuberculosis
ugcgagccgagcacgcagccg

SEQ ID NO: 995334 - RNA, 14 nt, Mycobacterium avium subsp. paratuberculosis
ugcgaugaccaccc

SEQ ID NO: 995335 - RNA, 21 nt, Mycobacterium avium subsp. paratuberculosis
ugcgaugggugaucgcggccc

SEQ ID NO: 995336 - RNA, 16 nt, Mycobacterium avium subsp. paratuberculosis
ugcgauugguggcccg

SEQ ID NO: 995337 - RNA, 14 nt, Mycobacterium avium subsp. paratuberculosis
ugcgcaacagcgug

SEQ ID NO: 995338 - RNA, 14 nt, Mycobacterium avium subsp. paratuberculosis
ugcgcaagaagggc

SEQ ID NO: 995339 - RNA, 20 nt, Mycobacterium avium subsp. paratuberculosis
ugcgcaggcggcgcgcagcc

SEQ ID NO: 995340 - RNA, 21 nt, Mycobacterium avium subsp. paratuberculosis
ugcgcaggcggcgcgcagccg

SEQ ID NO: 995341 - RNA, 21 nt, Mycobacterium avium subsp. paratuberculosis
ugcgcagccgcugcagcgccg

SEQ ID NO: 995342 - RNA, 23 nt, Mycobacterium avium subsp. paratuberculosis
ugcgcagccgcugcagcgccgcc

SEQ ID NO: 995343 - RNA, 12 nt, Mycobacterium avium subsp. paratuberculosis
ugcgcagcagcg

SEQ ID NO: 995344 - RNA, 15 nt, Mycobacterium avium subsp. paratuberculosis
ugcgcacccgguccg

SEQ ID NO: 995345 - RNA, 14 nt, Mycobacterium avium subsp. paratuberculosis
ugcgcaccgcggcg

SEQ ID NO: 995346 - RNA, 20 nt, Mycobacterium avium subsp. paratuberculosis
ugcgcagcagcaggucggcc

SEQ ID NO: 995347 - RNA, 12 nt, Mycobacterium avium subsp. paratuberculosis
ugcgcagcaccu

SEQ ID NO: 995348 - RNA, 12 nt, Mycobacterium avium subsp. paratuberculosis
ugcgcagcagca

SEQ ID NO: 995349 - RNA, 16 nt, Mycobacterium avium subsp. paratuberculosis
ugccuacuugcggccg

SEQ ID NO: 995350 - RNA, 18 nt, Mycobacterium avium subsp. paratuberculosis
ugccguccucggccgcca

SEQ ID NO: 995351 - RNA, 19 nt, Mycobacterium avium subsp. paratuberculosis
ugccgucgggacgcggcag

SEQ ID NO: 995352 - RNA, 16 nt, Mycobacterium avium subsp. paratuberculosis
ugccgucggccgccga

SEQ ID NO: 995353 - RNA, 14 nt, Mycobacterium avium subsp. paratuberculosis
ugccugcccagcgg

SEQ ID NO: 995354 - RNA, 18 nt, Mycobacterium avium subsp. paratuberculosis
ugccugcccgcgcaggcc

SEQ ID NO: 995355 - RNA, 17 nt, Mycobacterium avium subsp. paratuberculosis
ugccugcgggcccagcu

SEQ ID NO: 995356 - RNA, 17 nt, Mycobacterium avium subsp. paratuberculosis
ugccuuggcccgcgcgg

SEQ ID NO: 995357 - RNA, 23 nt, Mycobacterium avium subsp. paratuberculosis
ugccuuggcccgcgcggccgcca

SEQ ID NO: 995358 - RNA, 15 nt, Mycobacterium avium subsp. paratuberculosis
ugccuuugccguggc

SEQ ID NO: 995359 - RNA, 18 nt, Mycobacterium avium subsp. paratuberculosis
ugccggcgcccagcggcg

SEQ ID NO: 995360 - RNA, 20 nt, Mycobacterium avium subsp. paratuberculosis
ugccggcggcgaagccggcc

SEQ ID NO: 995361 - RNA, 17 nt, Mycobacterium avium subsp. paratuberculosis
ugccggcggcgcggcag

SEQ ID NO: 995362 - RNA, 18 nt, Mycobacterium avium subsp. paratuberculosis
ugccggcgcucgucgucg

SEQ ID NO: 995363 - RNA, 23 nt, Mycobacterium avium subsp. paratuberculosis
ugccggcggacagccccgagccg

SEQ ID NO: 995364 - RNA, 21 nt, Mycobacterium avium subsp. paratuberculosis
ugccggcggcaggugaaggug

SEQ ID NO: 995365 - RNA, 14 nt, Mycobacterium avium subsp. paratuberculosis
ugccguccagcucc

SEQ ID NO: 995366 - RNA, 14 nt, Mycobacterium avium subsp. paratuberculosis
ugccgucgaucuug

SEQ ID NO: 995367 - RNA, 19 nt, Mycobacterium avium subsp. paratuberculosis
ugccguagcggucgcccca

SEQ ID NO: 995368 - RNA, 15 nt, Mycobacterium avium subsp. paratuberculosis
ugccguagaccagca

SEQ ID NO: 995369 - RNA, 23 nt, Mycobacterium avium subsp. paratuberculosis
ugccguagaucucgcgccgcgca

SEQ ID NO: 995370 - RNA, 16 nt, Mycobacterium avium subsp. paratuberculosis
ugccgccgcagcagcc

SEQ ID NO: 995371 - RNA, 16 nt, Mycobacterium avium subsp. paratuberculosis
ugccgccgcagcgcag

SEQ ID NO: 995372 - RNA, 16 nt, Mycobacterium avium subsp. paratuberculosis
ugccgccgcccaggcc

SEQ ID NO: 995373 - RNA, 15 nt, Mycobacterium avium subsp. paratuberculosis
ugccgccgccggcgg

SEQ ID NO: 995374 - RNA, 14 nt, Mycobacterium avium subsp. paratuberculosis
ugccgccgcgcgcg

SEQ ID NO: 995375 - RNA, 14 nt, Mycobacterium avium subsp. paratuberculosis
ugccggaugcgguc

SEQ ID NO: 995376 - RNA, 20 nt, Mycobacterium avium subsp. paratuberculosis
ugccggacgaggaucgcagg

SEQ ID NO: 995377 - RNA, 14 nt, Mycobacterium avium subsp. paratuberculosis
ugcccuugauguag

SEQ ID NO: 995378 - RNA, 18 nt, Mycobacterium avium subsp. paratuberculosis
ugcccuuggacaccugca

SEQ ID NO: 995379 - RNA, 21 nt, Mycobacterium avium subsp. paratuberculosis
ugcccuuggccagcagugcca

SEQ ID NO: 995380 - RNA, 16 nt, Mycobacterium avium subsp. paratuberculosis
ugcccuuccccggcgg

SEQ ID NO: 995381 - RNA, 23 nt, Mycobacterium avium subsp. paratuberculosis
ugcccuuccccggcggccggccc

SEQ ID NO: 995382 - RNA, 15 nt, Mycobacterium avium subsp. paratuberculosis
ugcccuugugguugc

SEQ ID NO: 995383 - RNA, 18 nt, Mycobacterium avium subsp. paratuberculosis
ugccgaacaacagggccg

SEQ ID NO: 995384 - RNA, 21 nt, Mycobacterium avium subsp. paratuberculosis
ugccgaacaacagggccgcgc

SEQ ID NO: 995385 - RNA, 10 nt, Mycobacterium avium subsp. paratuberculosis
ugcccggcga

SEQ ID NO: 995386 - RNA, 16 nt, Mycobacterium avium subsp. paratuberculosis
ugcccggcgccgacca

SEQ ID NO: 995387 - RNA, 21 nt, Mycobacterium avium subsp. paratuberculosis
ugcccgccgugcgccccgccc

SEQ ID NO: 995388 - RNA, 11 nt, Mycobacterium avium subsp. paratuberculosis
ugcccgggccg

SEQ ID NO: 995389 - RNA, 23 nt, Mycobacterium avium subsp. paratuberculosis
ugcccgggccgucaucgccgacg

SEQ ID NO: 995390 - RNA, 19 nt, Mycobacterium avium subsp. paratuberculosis
ugcccggcggugccgaacc

SEQ ID NO: 995391 - RNA, 17 nt, Mycobacterium avium subsp. paratuberculosis
ugcccggcucggugcgc

SEQ ID NO: 995392 - RNA, 23 nt, Mycobacterium avium subsp. paratuberculosis
ugcccggggucugacccaugccc

SEQ ID NO: 995393 - RNA, 16 nt, Mycobacterium avium subsp. paratuberculosis
ugccgcacaccgucuc

SEQ ID NO: 995394 - RNA, 14 nt, Mycobacterium avium subsp. paratuberculosis
ugccgauggccacc

SEQ ID NO: 995395 - RNA, 18 nt, Mycobacterium avium subsp. paratuberculosis
ugccgaugccggccuggc

SEQ ID NO: 995396 - RNA, 17 nt, Mycobacterium avium subsp. paratuberculosis
ugccgagcacgcggccg

SEQ ID NO: 995397 - RNA, 15 nt, Mycobacterium avium subsp. paratuberculosis
ugccgaagcgccgca

SEQ ID NO: 995398 - RNA, 18 nt, Mycobacterium avium subsp. paratuberculosis
ugccgaagcgccgcaugc

SEQ ID NO: 995399 - RNA, 22 nt, Mycobacterium avium subsp. paratuberculosis
ugccgaacgugcugugcgggcg

SEQ ID NO: 995400 - RNA, 22 nt, Mycobacterium avium subsp. paratuberculosis
ugccgaagggcaaccgcagcau

SEQ ID NO: 995401 - RNA, 13 nt, Mycobacterium avium subsp. paratuberculosis
ugccgaaguccuu

SEQ ID NO: 995402 - RNA, 19 nt, Mycobacterium avium subsp. paratuberculosis
ugccgacaccccacaccgu

SEQ ID NO: 995403 - RNA, 20 nt, Mycobacterium avium subsp. paratuberculosis
ugccgacggucccacucggg

SEQ ID NO: 995404 - RNA, 21 nt, Mycobacterium avium subsp. paratuberculosis
ugccccgccguuucagcagcg

SEQ ID NO: 995405 - RNA, 20 nt, Mycobacterium avium subsp. paratuberculosis
ugccccggcgaggccaggcg

SEQ ID NO: 995406 - RNA, 22 nt, Mycobacterium avium subsp. paratuberculosis
ugccccgggugaccgccuuggc

SEQ ID NO: 995407 - RNA, 20 nt, Mycobacterium avium subsp. paratuberculosis
ugccccgcgaccgcagcagg

SEQ ID NO: 995408 - RNA, 18 nt, Mycobacterium avium subsp. paratuberculosis
ugccccgcuccuccucgc

SEQ ID NO: 995409 - RNA, 22 nt, Mycobacterium avium subsp. paratuberculosis
ugccccgcuccuccucgcgccg

SEQ ID NO: 995410 - RNA, 21 nt, Mycobacterium avium subsp. paratuberculosis
ugccccucgacgaacgcggcg

SEQ ID NO: 995411 - RNA, 16 nt, Mycobacterium avium subsp. paratuberculosis
ugcccgccacggccag

SEQ ID NO: 995412 - RNA, 19 nt, Mycobacterium avium subsp. paratuberculosis
ugcccgccgacgcccaggc

SEQ ID NO: 995413 - RNA, 21 nt, Mycobacterium avium subsp. paratuberculosis
ugcccgccgccgaugcugauc

SEQ ID NO: 995414 - RNA, 13 nt, Mycobacterium avium subsp. paratuberculosis
ugcccgccgcgac

SEQ ID NO: 995415 - RNA, 15 nt, Mycobacterium avium subsp. paratuberculosis
ugcccgccgcgaccg

SEQ ID NO: 995416 - RNA, 15 nt, Mycobacterium avium subsp. paratuberculosis
ugcccgccgcggccg

SEQ ID NO: 995417 - RNA, 14 nt, Mycobacterium avium subsp. paratuberculosis
ugcccgauggugaa

SEQ ID NO: 995418 - RNA, 23 nt, Mycobacterium avium subsp. paratuberculosis
ugcccgauuggaagagggccauc

SEQ ID NO: 995419 - RNA, 12 nt, Mycobacterium avium subsp. paratuberculosis
ugcccagcgcgg

SEQ ID NO: 995420 - RNA, 22 nt, Mycobacterium avium subsp. paratuberculosis
ugcccagcgcgguaaagucuuc

SEQ ID NO: 995421 - RNA, 12 nt, Mycobacterium avium subsp. paratuberculosis
ugcccagcggca

SEQ ID NO: 995422 - RNA, 14 nt, Mycobacterium avium subsp. paratuberculosis
ugcccagccacgcc

SEQ ID NO: 995423 - RNA, 24 nt, Mycobacterium avium subsp. paratuberculosis
ugcccagccacgccaacugguccu

SEQ ID NO: 995424 - RNA, 17 nt, Mycobacterium avium subsp. paratuberculosis
ugcccaucugcacagcu

SEQ ID NO: 995425 - RNA, 18 nt, Mycobacterium avium subsp. paratuberculosis
ugcccaucugcacagcuu

SEQ ID NO: 995426 - RNA, 15 nt, Mycobacterium avium subsp. paratuberculosis
ugcccaucgacccgu

SEQ ID NO: 995427 - RNA, 20 nt, Mycobacterium avium subsp. paratuberculosis
ugcccaggaucaccgggacg

SEQ ID NO: 995428 - RNA, 13 nt, Mycobacterium avium subsp. paratuberculosis
ugcccaggaugau

SEQ ID NO: 995429 - RNA, 14 nt, Mycobacterium avium subsp. paratuberculosis
ugcccaccgggcag

SEQ ID NO: 995430 - RNA, 21 nt, Mycobacterium avium subsp. paratuberculosis
ugcccaccgggcagccgcaca

SEQ ID NO: 995431 - RNA, 18 nt, Mycobacterium avium subsp. paratuberculosis
ugcccaccaccugcuucc

SEQ ID NO: 995432 - RNA, 19 nt, Mycobacterium avium subsp. paratuberculosis
ugcccaccaccugcuucca

SEQ ID NO: 995433 - RNA, 14 nt, Mycobacterium avium subsp. paratuberculosis
ugcccacagccagg

SEQ ID NO: 995434 - RNA, 11 nt, Mycobacterium avium subsp. paratuberculosis
ugccagcagcu

SEQ ID NO: 995435 - RNA, 14 nt, Mycobacterium avium subsp. paratuberculosis
ugccagcagguccg

SEQ ID NO: 995436 - RNA, 21 nt, Mycobacterium avium subsp. paratuberculosis
ugccagcuucgggcgcgcgcg

SEQ ID NO: 995437 - RNA, 20 nt, Mycobacterium avium subsp. paratuberculosis
ugccaguccugggccggggc

SEQ ID NO: 995438 - RNA, 20 nt, Mycobacterium avium subsp. paratuberculosis
ugccaagcgguuccagaccg

SEQ ID NO: 995439 - RNA, 22 nt, Mycobacterium avium subsp. paratuberculosis
ugcaggugcgcggucagcgcgu

SEQ ID NO: 995440 - RNA, 15 nt, Mycobacterium avium subsp. paratuberculosis
ugcagguggcccaca

SEQ ID NO: 995441 - RNA, 15 nt, Mycobacterium avium subsp. paratuberculosis
ugcagguagguggcc

SEQ ID NO: 995442 - RNA, 17 nt, Mycobacterium avium subsp. paratuberculosis
ugcagguagguggccag

SEQ ID NO: 995443 - RNA, 22 nt, Mycobacterium avium subsp. paratuberculosis
ugccacaggccgaacagcagcg

SEQ ID NO: 995444 - RNA, 18 nt, Mycobacterium avium subsp. paratuberculosis
ugccaccaccacggccag

SEQ ID NO: 995445 - RNA, 16 nt, Mycobacterium avium subsp. paratuberculosis
ugccacucgucgaugu

SEQ ID NO: 995446 - RNA, 23 nt, Mycobacterium avium subsp. paratuberculosis
ugccagaagaucugccggugccg

SEQ ID NO: 995447 - RNA, 17 nt, Mycobacterium avium subsp. paratuberculosis
ugcacuuucggcagcug

SEQ ID NO: 995448 - RNA, 13 nt, Mycobacterium avium subsp. paratuberculosis
ugcagaacagcac

SEQ ID NO: 995449 - RNA, 14 nt, Mycobacterium avium subsp. paratuberculosis
ugcagaacagcacg

SEQ ID NO: 995450 - RNA, 19 nt, Mycobacterium avium subsp. paratuberculosis
ugcacgugcaccgcggcca

SEQ ID NO: 995451 - RNA, 22 nt, Mycobacterium avium subsp. paratuberculosis
ugcacguccgccuccgaccagc

SEQ ID NO: 995452 - RNA, 22 nt, Mycobacterium avium subsp. paratuberculosis
ugcacgucggcgcgcaggcugg

SEQ ID NO: 995453 - RNA, 23 nt, Mycobacterium avium subsp. paratuberculosis
ugcacgucggcgcgcaggcuggc

SEQ ID NO: 995454 - RNA, 16 nt, Mycobacterium avium subsp. paratuberculosis
ugcacgucggcggccg

SEQ ID NO: 995455 - RNA, 19 nt, Mycobacterium avium subsp. paratuberculosis
ugcacgucggcggccgcga

SEQ ID NO: 995456 - RNA, 22 nt, Mycobacterium avium subsp. paratuberculosis
ugcacgguguagacgcgggccg

SEQ ID NO: 995457 - RNA, 21 nt, Mycobacterium avium subsp. paratuberculosis
ugcacggucagcucgcgcccg

SEQ ID NO: 995458 - RNA, 23 nt, Mycobacterium avium subsp. paratuberculosis
ugcacgaugccgaccaacacccc

SEQ ID NO: 995459 - RNA, 18 nt, Mycobacterium avium subsp. paratuberculosis
ugcacggcgccaccagcc

SEQ ID NO: 995460 - RNA, 17 nt, Mycobacterium avium subsp. paratuberculosis
ugcacggcgccgugccg

SEQ ID NO: 995461 - RNA, 22 nt, Mycobacterium avium subsp. paratuberculosis
ugcacggcggcgaacgccgccg

SEQ ID NO: 995462 - RNA, 16 nt, Mycobacterium avium subsp. paratuberculosis
ugcacaggccgccgca

SEQ ID NO: 995463 - RNA, 14 nt, Mycobacterium avium subsp. paratuberculosis
ugcacgaagucgac

SEQ ID NO: 995464 - RNA, 15 nt, Mycobacterium avium subsp. paratuberculosis
ugcacgacgaacacc

SEQ ID NO: 995465 - RNA, 19 nt, Mycobacterium avium subsp. paratuberculosis
ugcacgacgaccgcguccg

SEQ ID NO: 995466 - RNA, 15 nt, Mycobacterium avium subsp. paratuberculosis
ugcacgaacagggug

SEQ ID NO: 995467 - RNA, 16 nt, Mycobacterium avium subsp. paratuberculosis
ugcacgaacgcggcca

SEQ ID NO: 995468 - RNA, 17 nt, Mycobacterium avium subsp. paratuberculosis
ugcacgaacgcggccag

SEQ ID NO: 995469 - RNA, 21 nt, Mycobacterium avium subsp. paratuberculosis
ugcaaucucgucggggcgccu

SEQ ID NO: 995470 - RNA, 21 nt, Mycobacterium avium subsp. paratuberculosis
ugcacaccggccuucaccagg

SEQ ID NO: 995471 - RNA, 21 nt, Mycobacterium avium subsp. paratuberculosis
ugcacacccuuuuccaucugg

SEQ ID NO: 995472 - RNA, 19 nt, Mycobacterium avium subsp. paratuberculosis
ugcagaucguccaucgcgu

SEQ ID NO: 995473 - RNA, 16 nt, Mycobacterium avium subsp. paratuberculosis
ugcagaucaccacggu

SEQ ID NO: 995474 - RNA, 16 nt, Mycobacterium avium subsp. paratuberculosis
ugcagcagcuggaaca

SEQ ID NO: 995475 - RNA, 16 nt, Mycobacterium avium subsp. paratuberculosis
ugcagcaccgccagca

SEQ ID NO: 995476 - RNA, 12 nt, Mycobacterium avium subsp. paratuberculosis
ugcagcacaccg

SEQ ID NO: 995477 - RNA, 13 nt, Mycobacterium avium subsp. paratuberculosis
ugcagcacaccgg

SEQ ID NO: 995478 - RNA, 21 nt, Mycobacterium avium subsp. paratuberculosis
ugcagcaccucgaagccgacg

SEQ ID NO: 995479 - RNA, 21 nt, Mycobacterium avium subsp. paratuberculosis
ugcagcccgcguccagcagca

SEQ ID NO: 995480 - RNA, 17 nt, Mycobacterium avium subsp. paratuberculosis
ugcagccgcccguccug

SEQ ID NO: 995481 - RNA, 22 nt, Mycobacterium avium subsp. paratuberculosis
ugcagccgcccguccuggauga

SEQ ID NO: 995482 - RNA, 19 nt, Mycobacterium avium subsp. paratuberculosis
ugcagccgggccugcagca

SEQ ID NO: 995483 - RNA, 22 nt, Mycobacterium avium subsp. paratuberculosis
ugcagcgacggaucggccgcgu

SEQ ID NO: 995484 - RNA, 16 nt, Mycobacterium avium subsp. paratuberculosis
ugcagccgcugccgca

SEQ ID NO: 995485 - RNA, 20 nt, Mycobacterium avium subsp. paratuberculosis
ugcagccggccaacagcagc

SEQ ID NO: 995486 - RNA, 18 nt, Mycobacterium avium subsp. paratuberculosis
ugcagcuccuugagccgc

SEQ ID NO: 995487 - RNA, 17 nt, Mycobacterium avium subsp. paratuberculosis
ugcagcucggugcgcac

SEQ ID NO: 995488 - RNA, 19 nt, Mycobacterium avium subsp. paratuberculosis
ugcagcucggugcgcaccc

SEQ ID NO: 995489 - RNA, 18 nt, Mycobacterium avium subsp. paratuberculosis
ugcagcggcuccgagcgg

SEQ ID NO: 995490 - RNA, 13 nt, Mycobacterium avium subsp. paratuberculosis
ugcagcgggcugg

SEQ ID NO: 995491 - RNA, 23 nt, Mycobacterium avium subsp. paratuberculosis
ugcagcggguuuggccgcgggcg

SEQ ID NO: 995492 - RNA, 19 nt, Mycobacterium avium subsp. paratuberculosis
ugcagcgugguccagcacg

SEQ ID NO: 995493 - RNA, 15 nt, Mycobacterium avium subsp. paratuberculosis
ugcagcgccagcacc

SEQ ID NO: 995494 - RNA, 15 nt, Mycobacterium avium subsp. paratuberculosis
ugcagcgcccgggcc

SEQ ID NO: 995495 - RNA, 18 nt, Mycobacterium avium subsp. paratuberculosis
ugcagcgcccgggccagg

SEQ ID NO: 995496 - RNA, 22 nt, Mycobacterium avium subsp. paratuberculosis
ugcagcgcccgggccaggaccg

SEQ ID NO: 995497 - RNA, 13 nt, Mycobacterium avium subsp. paratuberculosis
ugcagcgccgccc

SEQ ID NO: 995498 - RNA, 15 nt, Mycobacterium avium subsp. paratuberculosis
ugcagcgacuggccc

SEQ ID NO: 995499 - RNA, 16 nt, Mycobacterium avium subsp. paratuberculosis
ugcagggggcgcagcc

SEQ ID NO: 995500 - RNA, 15 nt, Mycobacterium avium subsp. paratuberculosis
ugcaggguccgccgu

SEQ ID NO: 995501 - RNA, 15 nt, Mycobacterium avium subsp. paratuberculosis
ugcagggucagcagc

SEQ ID NO: 995502 - RNA, 18 nt, Mycobacterium avium subsp. paratuberculosis
ugcaggcugacgcgaccg

SEQ ID NO: 995503 - RNA, 15 nt, Mycobacterium avium subsp. paratuberculosis
ugcaggcgcccagga

SEQ ID NO: 995504 - RNA, 23 nt, Mycobacterium avium subsp. paratuberculosis
ugcaggauccgcucgacgaguuc

SEQ ID NO: 995505 - RNA, 15 nt, Mycobacterium avium subsp. paratuberculosis
ugcaggccacgccca

SEQ ID NO: 995506 - RNA, 18 nt, Mycobacterium avium subsp. paratuberculosis
ugcaggcccgggcggcga

SEQ ID NO: 995507 - RNA, 16 nt, Mycobacterium avium subsp. paratuberculosis
ugcaggccgagccgcc

SEQ ID NO: 995508 - RNA, 13 nt, Mycobacterium avium subsp. paratuberculosis
ugcaggccgaggc

SEQ ID NO: 995509 - RNA, 23 nt, Mycobacterium avium subsp. paratuberculosis
ugcaggcagccguuguccacgau

SEQ ID NO: 995510 - RNA, 15 nt, Mycobacterium avium subsp. paratuberculosis
ugauguuggccgcga

SEQ ID NO: 995511 - RNA, 14 nt, Mycobacterium avium subsp. paratuberculosis
ugaugucguuggug

SEQ ID NO: 995512 - RNA, 18 nt, Mycobacterium avium subsp. paratuberculosis
ugaugucguuggugucga

SEQ ID NO: 995513 - RNA, 15 nt, Mycobacterium avium subsp. paratuberculosis
ugaugucggccagga

SEQ ID NO: 995514 - RNA, 21 nt, Mycobacterium avium subsp. paratuberculosis
ugauggugugguagggccgcu

SEQ ID NO: 995515 - RNA, 15 nt, Mycobacterium avium subsp. paratuberculosis
ugaugguccagcacc

SEQ ID NO: 995516 - RNA, 23 nt, Mycobacterium avium subsp. paratuberculosis
ugauggcgucgacgugcgcggcg

SEQ ID NO: 995517 - RNA, 18 nt, Mycobacterium avium subsp. paratuberculosis
ugauggccaucuggccgc

SEQ ID NO: 995518 - RNA, 20 nt, Mycobacterium avium subsp. paratuberculosis
ugauggccaucuggccgcgg

SEQ ID NO: 995519 - RNA, 15 nt, Mycobacterium avium subsp. paratuberculosis
ugauggccgccgcag

SEQ ID NO: 995520 - RNA, 12 nt, Mycobacterium avium subsp. paratuberculosis
ugauggccgcgc

SEQ ID NO: 995521 - RNA, 15 nt, Mycobacterium avium subsp. paratuberculosis
ugauggccgcgccgc

SEQ ID NO: 995522 - RNA, 17 nt, Mycobacterium avium subsp. paratuberculosis
ugauuucgcgcaccacc

SEQ ID NO: 995523 - RNA, 14 nt, Mycobacterium avium subsp. paratuberculosis
ugauucgggucaga

SEQ ID NO: 995524 - RNA, 15 nt, Mycobacterium avium subsp. paratuberculosis
ugaucggccaggcgc

SEQ ID NO: 995525 - RNA, 13 nt, Mycobacterium avium subsp. paratuberculosis
ugaucggccccuu

SEQ ID NO: 995526 - RNA, 20 nt, Mycobacterium avium subsp. paratuberculosis
ugaucggccgcaagcgaagc

SEQ ID NO: 995527 - RNA, 21 nt, Mycobacterium avium subsp. paratuberculosis
ugaucggggcccaccccggac

SEQ ID NO: 995528 - RNA, 14 nt, Mycobacterium avium subsp. paratuberculosis
ugaucgcggcccgc

SEQ ID NO: 995529 - RNA, 17 nt, Mycobacterium avium subsp. paratuberculosis
ugaucgcggcgcugccg

SEQ ID NO: 995530 - RNA, 17 nt, Mycobacterium avium subsp. paratuberculosis
ugaucgcgaacgcgccg

SEQ ID NO: 995531 - RNA, 24 nt, Mycobacterium avium subsp. paratuberculosis
ugaucgcgauccgggcgccggccg

SEQ ID NO: 995532 - RNA, 23 nt, Mycobacterium avium subsp. paratuberculosis
ugaucgccagcccggcguacagc

SEQ ID NO: 995533 - RNA, 18 nt, Mycobacterium avium subsp. paratuberculosis
ugaucgccaccaccagcg

SEQ ID NO: 995534 - RNA, 17 nt, Mycobacterium avium subsp. paratuberculosis
ugaucgccgcccacugg

SEQ ID NO: 995535 - RNA, 21 nt, Mycobacterium avium subsp. paratuberculosis
ugaugcagugguugagcagca

SEQ ID NO: 995536 - RNA, 21 nt, Mycobacterium avium subsp. paratuberculosis
ugaugcacccggacgugaucg

SEQ ID NO: 995537 - RNA, 13 nt, Mycobacterium avium subsp. paratuberculosis
ugaugcggccgga

SEQ ID NO: 995538 - RNA, 22 nt, Mycobacterium avium subsp. paratuberculosis
ugaugcugcccggcgccacgca

SEQ ID NO: 995539 - RNA, 20 nt, Mycobacterium avium subsp. paratuberculosis
ugagugcgccgugcagcacg

SEQ ID NO: 995540 - RNA, 22 nt, Mycobacterium avium subsp. paratuberculosis
ugagugcgccgugcagcacgcc

SEQ ID NO: 995541 - RNA, 17 nt, Mycobacterium avium subsp. paratuberculosis
ugaucacgggcacaccg

SEQ ID NO: 995542 - RNA, 22 nt, Mycobacterium avium subsp. paratuberculosis
ugaucagcagguugauccgcgc

SEQ ID NO: 995543 - RNA, 13 nt, Mycobacterium avium subsp. paratuberculosis
ugauccagcagcg

SEQ ID NO: 995544 - RNA, 17 nt, Mycobacterium avium subsp. paratuberculosis
ugaucccggugaugccg

SEQ ID NO: 995545 - RNA, 18 nt, Mycobacterium avium subsp. paratuberculosis
ugauccgaugcagggccg

SEQ ID NO: 995546 - RNA, 13 nt, Mycobacterium avium subsp. paratuberculosis
ugauccggaagcc

SEQ ID NO: 995547 - RNA, 21 nt, Mycobacterium avium subsp. paratuberculosis
ugauccgggcgccauccgcca

SEQ ID NO: 995548 - RNA, 19 nt, Mycobacterium avium subsp. paratuberculosis
ugagcgccagcgcggugcc

SEQ ID NO: 995549 - RNA, 13 nt, Mycobacterium avium subsp. paratuberculosis
ugagcgccaggcc

SEQ ID NO: 995550 - RNA, 21 nt, Mycobacterium avium subsp. paratuberculosis
ugagcgagaugaucagccgcc

SEQ ID NO: 995551 - RNA, 13 nt, Mycobacterium avium subsp. paratuberculosis
ugagcgcgccggc

SEQ ID NO: 995552 - RNA, 14 nt, Mycobacterium avium subsp. paratuberculosis
ugagcgccggggcg

SEQ ID NO: 995553 - RNA, 15 nt, Mycobacterium avium subsp. paratuberculosis
ugagcuaucagcucg

SEQ ID NO: 995554 - RNA, 14 nt, Mycobacterium avium subsp. paratuberculosis
ugagcgggaagcug

SEQ ID NO: 995555 - RNA, 16 nt, Mycobacterium avium subsp. paratuberculosis
ugagcgucgccaccac

SEQ ID NO: 995556 - RNA, 17 nt, Mycobacterium avium subsp. paratuberculosis
ugagcgucgccaccacc

SEQ ID NO: 995557 - RNA, 14 nt, Mycobacterium avium subsp. paratuberculosis
ugagcuggccgcgc

SEQ ID NO: 995558 - RNA, 20 nt, Mycobacterium avium subsp. paratuberculosis
ugagcugggcggcgcgcugc

SEQ ID NO: 995559 - RNA, 23 nt, Mycobacterium avium subsp. paratuberculosis
ugagcugggcggcgcgcugcggc

SEQ ID NO: 995560 - RNA, 15 nt, Mycobacterium avium subsp. paratuberculosis
ugaggaugcgcacca

SEQ ID NO: 995561 - RNA, 15 nt, Mycobacterium avium subsp. paratuberculosis
ugaggacgcccggcg

SEQ ID NO: 995562 - RNA, 20 nt, Mycobacterium avium subsp. paratuberculosis
ugaggcggcggcgggccagg

SEQ ID NO: 995563 - RNA, 23 nt, Mycobacterium avium subsp. paratuberculosis
ugaggccgccccggccgcgcacc

SEQ ID NO: 995564 - RNA, 12 nt, Mycobacterium avium subsp. paratuberculosis
ugaggccgaggc

SEQ ID NO: 995565 - RNA, 13 nt, Mycobacterium avium subsp. paratuberculosis
ugaggccagcacc

SEQ ID NO: 995566 - RNA, 11 nt, Mycobacterium avium subsp. paratuberculosis
ugaggccaggc

SEQ ID NO: 995567 - RNA, 17 nt, Mycobacterium avium subsp. paratuberculosis
ugagggcggggcagcag

SEQ ID NO: 995568 - RNA, 18 nt, Mycobacterium avium subsp. paratuberculosis
ugagguagucggcccagg

SEQ ID NO: 995569 - RNA, 23 nt, Mycobacterium avium subsp. paratuberculosis
ugaggguuuccacgugcacggcg

SEQ ID NO: 995570 - RNA, 14 nt, Mycobacterium avium subsp. paratuberculosis
ugagccgccgagcc

SEQ ID NO: 995571 - RNA, 11 nt, Mycobacterium avium subsp. paratuberculosis
ugagccgccgg

SEQ ID NO: 995572 - RNA, 17 nt, Mycobacterium avium subsp. paratuberculosis
ugagcccggcgacgaag

SEQ ID NO: 995573 - RNA, 18 nt, Mycobacterium avium subsp. paratuberculosis
ugagccgccacagcgccu

SEQ ID NO: 995574 - RNA, 19 nt, Mycobacterium avium subsp. paratuberculosis
ugagccuaugaggcgaccc

SEQ ID NO: 995575 - RNA, 14 nt, Mycobacterium avium subsp. paratuberculosis
ugagcaccagcccg

SEQ ID NO: 995576 - RNA, 13 nt, Mycobacterium avium subsp. paratuberculosis
ugagcaccgggaa

SEQ ID NO: 995577 - RNA, 20 nt, Mycobacterium avium subsp. paratuberculosis
ugagcaccgggaacagccag

SEQ ID NO: 995578 - RNA, 19 nt, Mycobacterium avium subsp. paratuberculosis
ugagcagcccgaccaccuc

SEQ ID NO: 995579 - RNA, 12 nt, Mycobacterium avium subsp. paratuberculosis
ugagcagcaccc

SEQ ID NO: 995580 - RNA, 14 nt, Mycobacterium avium subsp. paratuberculosis
ugagcagcagaccg

SEQ ID NO: 995581 - RNA, 12 nt, Mycobacterium avium subsp. paratuberculosis
ugagcaccgccg

SEQ ID NO: 995582 - RNA, 19 nt, Mycobacterium avium subsp. paratuberculosis
ugacugcgaucgccgacgc

SEQ ID NO: 995583 - RNA, 17 nt, Mycobacterium avium subsp. paratuberculosis
ugacuccuccucggcca

SEQ ID NO: 995584 - RNA, 23 nt, Mycobacterium avium subsp. paratuberculosis
ugacggccgcggcgcggcccggc

SEQ ID NO: 995585 - RNA, 17 nt, Mycobacterium avium subsp. paratuberculosis
ugacuugucgggccgca

SEQ ID NO: 995586 - RNA, 16 nt, Mycobacterium avium subsp. paratuberculosis
ugacgaguuccaccuc

SEQ ID NO: 995587 - RNA, 15 nt, Mycobacterium avium subsp. paratuberculosis
ugacgaugcugagca

SEQ ID NO: 995588 - RNA, 18 nt, Mycobacterium avium subsp. paratuberculosis
ugacgcucgacggccggc

SEQ ID NO: 995589 - RNA, 20 nt, Mycobacterium avium subsp. paratuberculosis
ugacgcucgccggcggccgc

SEQ ID NO: 995590 - RNA, 22 nt, Mycobacterium avium subsp. paratuberculosis
ugacgcucgccggcggccgcca

SEQ ID NO: 995591 - RNA, 21 nt, Mycobacterium avium subsp. paratuberculosis
ugacgcucgcgguugggccgc

SEQ ID NO: 995592 - RNA, 19 nt, Mycobacterium avium subsp. paratuberculosis
ugacgcucggccguggccg

SEQ ID NO: 995593 - RNA, 16 nt, Mycobacterium avium subsp. paratuberculosis
ugacgcucggcggccg

SEQ ID NO: 995594 - RNA, 15 nt, Mycobacterium avium subsp. paratuberculosis
ugacgcucggggccg

SEQ ID NO: 995595 - RNA, 16 nt, Mycobacterium avium subsp. paratuberculosis
ugacgaugcggccggc

SEQ ID NO: 995596 - RNA, 15 nt, Mycobacterium avium subsp. paratuberculosis
ugacgcugggcggcg

SEQ ID NO: 995597 - RNA, 19 nt, Mycobacterium avium subsp. paratuberculosis
ugaccggcgcgcagcaucu

SEQ ID NO: 995598 - RNA, 22 nt, Mycobacterium avium subsp. paratuberculosis
ugaccucgucgggcgccagccc

SEQ ID NO: 995599 - RNA, 15 nt, Mycobacterium avium subsp. paratuberculosis
ugaccugcagcgccu

SEQ ID NO: 995600 - RNA, 17 nt, Mycobacterium avium subsp. paratuberculosis
ugacgacguuggccagc

SEQ ID NO: 995601 - RNA, 21 nt, Mycobacterium avium subsp. paratuberculosis
ugacgacguuggccagcaccg

SEQ ID NO: 995602 - RNA, 15 nt, Mycobacterium avium subsp. paratuberculosis
ugaccucgagcaccg

SEQ ID NO: 995603 - RNA, 18 nt, Mycobacterium avium subsp. paratuberculosis
ugaccucgcgcagccccc

SEQ ID NO: 995604 - RNA, 16 nt, Mycobacterium avium subsp. paratuberculosis
ugaccucgcgcccggc

SEQ ID NO: 995605 - RNA, 16 nt, Mycobacterium avium subsp. paratuberculosis
ugaccucgcgccgcga

SEQ ID NO: 995606 - RNA, 17 nt, Mycobacterium avium subsp. paratuberculosis
ugaccaugacccacggg

SEQ ID NO: 995607 - RNA, 23 nt, Mycobacterium avium subsp. paratuberculosis
ugaccccgacggcgccgcggccg

SEQ ID NO: 995608 - RNA, 18 nt, Mycobacterium avium subsp. paratuberculosis
ugaccccggccccggccg

SEQ ID NO: 995609 - RNA, 17 nt, Mycobacterium avium subsp. paratuberculosis
ugaccggaucggccagc

SEQ ID NO: 995610 - RNA, 13 nt, Mycobacterium avium subsp. paratuberculosis
ugaccggcccggc

SEQ ID NO: 995611 - RNA, 18 nt, Mycobacterium avium subsp. paratuberculosis
ugaccggcccggcggccg

SEQ ID NO: 995612 - RNA, 20 nt, Mycobacterium avium subsp. paratuberculosis
ugaccggcccggcggccggc

SEQ ID NO: 995613 - RNA, 15 nt, Mycobacterium avium subsp. paratuberculosis
ugacccgccgcaaca

SEQ ID NO: 995614 - RNA, 17 nt, Mycobacterium avium subsp. paratuberculosis
ugacccgccgcaacagc

SEQ ID NO: 995615 - RNA, 15 nt, Mycobacterium avium subsp. paratuberculosis
ugaccggcggccagc

SEQ ID NO: 995616 - RNA, 15 nt, Mycobacterium avium subsp. paratuberculosis
ugacaggggcagcag

SEQ ID NO: 995617 - RNA, 17 nt, Mycobacterium avium subsp. paratuberculosis
ugacaggggcagcagca

SEQ ID NO: 995618 - RNA, 16 nt, Mycobacterium avium subsp. paratuberculosis
ugaccaccagguaggc

SEQ ID NO: 995619 - RNA, 16 nt, Mycobacterium avium subsp. paratuberculosis
ugaccaccggcaccac

SEQ ID NO: 995620 - RNA, 16 nt, Mycobacterium avium subsp. paratuberculosis
ugaccacgccgugccc

SEQ ID NO: 995621 - RNA, 24 nt, Mycobacterium avium subsp. paratuberculosis
ugacaggcggucgugucagggaug

SEQ ID NO: 995622 - RNA, 16 nt, Mycobacterium avium subsp. paratuberculosis
ugaaucgguaaauuga

SEQ ID NO: 995623 - RNA, 13 nt, Mycobacterium avium subsp. paratuberculosis
ugacacagcaccg

SEQ ID NO: 995624 - RNA, 12 nt, Mycobacterium avium subsp. paratuberculosis
ugacacagccaa

SEQ ID NO: 995625 - RNA, 16 nt, Mycobacterium avium subsp. paratuberculosis
ugacaaagcacaacuc

SEQ ID NO: 995626 - RNA, 20 nt, Mycobacterium avium subsp. paratuberculosis
ugaauuccuggccggugcgg

SEQ ID NO: 995627 - RNA, 17 nt, Mycobacterium avium subsp. paratuberculosis
ugaauucuguugucggc

SEQ ID NO: 995628 - RNA, 16 nt, Mycobacterium avium subsp. paratuberculosis
gacaguucgguggggc

SEQ ID NO: 995629 - RNA, 19 nt, Mycobacterium avium subsp. paratuberculosis
gacagguucuuggcggccu

SEQ ID NO: 995630 - RNA, 13 nt, Mycobacterium avium subsp. paratuberculosis
gacagguagcagg

SEQ ID NO: 995631 - RNA, 14 nt, Mycobacterium avium subsp. paratuberculosis
gacagguagcaggc

SEQ ID NO: 995632 - RNA, 15 nt, Mycobacterium avium subsp. paratuberculosis
gacaggucgaagggc

SEQ ID NO: 995633 - RNA, 16 nt, Mycobacterium avium subsp. paratuberculosis
gacaggucgaggguga

SEQ ID NO: 995634 - RNA, 16 nt, Mycobacterium avium subsp. paratuberculosis
gacaggcagcccggcu

SEQ ID NO: 995635 - RNA, 19 nt, Mycobacterium avium subsp. paratuberculosis
gacaggcacucgcccaggg

SEQ ID NO: 995636 - RNA, 12 nt, Mycobacterium avium subsp. paratuberculosis
gacaggaucugg

SEQ ID NO: 995637 - RNA, 15 nt, Mycobacterium avium subsp. paratuberculosis
gacaggccggccgcu

SEQ ID NO: 995638 - RNA, 12 nt, Mycobacterium avium subsp. paratuberculosis
gacaggccggcg

SEQ ID NO: 995639 - RNA, 22 nt, Mycobacterium avium subsp. paratuberculosis
gacaggcggucgugucagggau

SEQ ID NO: 995640 - RNA, 16 nt, Mycobacterium avium subsp. paratuberculosis
gacagggugccgaaca

SEQ ID NO: 995641 - RNA, 19 nt, Mycobacterium avium subsp. paratuberculosis
gacagggagccgacgaaga

SEQ ID NO: 995642 - RNA, 19 nt, Mycobacterium avium subsp. paratuberculosis
gacagggaggacagcaccg

SEQ ID NO: 995643 - RNA, 16 nt, Mycobacterium avium subsp. paratuberculosis
gacaugcagccgccgc

SEQ ID NO: 995644 - RNA, 14 nt, Mycobacterium avium subsp. paratuberculosis
gacaugcccgggcu

SEQ ID NO: 995645 - RNA, 13 nt, Mycobacterium avium subsp. paratuberculosis
gacaugccgagca

SEQ ID NO: 995646 - RNA, 17 nt, Mycobacterium avium subsp. paratuberculosis
gacaugaagcccccguu

SEQ ID NO: 995647 - RNA, 21 nt, Mycobacterium avium subsp. paratuberculosis
gacaucgucgcgcccaggaac

SEQ ID NO: 995648 - RNA, 14 nt, Mycobacterium avium subsp. paratuberculosis
gacaucgucggcuc

SEQ ID NO: 995649 - RNA, 15 nt, Mycobacterium avium subsp. paratuberculosis
gacaucaccaccgcc

SEQ ID NO: 995650 - RNA, 17 nt, Mycobacterium avium subsp. paratuberculosis
gacaucagugcgggcau

SEQ ID NO: 995651 - RNA, 21 nt, Mycobacterium avium subsp. paratuberculosis
gacauccagaugcccagcagg

SEQ ID NO: 995652 - RNA, 19 nt, Mycobacterium avium subsp. paratuberculosis
gacauccagaugcccagca

SEQ ID NO: 995653 - RNA, 23 nt, Mycobacterium avium subsp. paratuberculosis
gacauccgugagggaccuccagc

SEQ ID NO: 995654 - RNA, 19 nt, Mycobacterium avium subsp. paratuberculosis
gacaucggcagcagggugc

SEQ ID NO: 995655 - RNA, 16 nt, Mycobacterium avium subsp. paratuberculosis
gacauggacgcggccu

SEQ ID NO: 995656 - RNA, 20 nt, Mycobacterium avium subsp. paratuberculosis
gacauuggccgcgcgcaggc

SEQ ID NO: 995657 - RNA, 16 nt, Mycobacterium avium subsp. paratuberculosis
gaccagcgugucgccg

SEQ ID NO: 995658 - RNA, 17 nt, Mycobacterium avium subsp. paratuberculosis
gaccagcgugucgccgg

SEQ ID NO: 995659 - RNA, 20 nt, Mycobacterium avium subsp. paratuberculosis
gaccagcgugucgccggggc

SEQ ID NO: 995660 - RNA, 14 nt, Mycobacterium avium subsp. paratuberculosis
gaccagcuccugga

SEQ ID NO: 995661 - RNA, 21 nt, Mycobacterium avium subsp. paratuberculosis
gaccagcgggccgacagcacg

SEQ ID NO: 995662 - RNA, 18 nt, Mycobacterium avium subsp. paratuberculosis
gaccagcggcgcgccggg

SEQ ID NO: 995663 - RNA, 20 nt, Mycobacterium avium subsp. paratuberculosis
gaccagcggcgcgccgggca

SEQ ID NO: 995664 - RNA, 22 nt, Mycobacterium avium subsp. paratuberculosis
gaccagcggcgcgccgggcagc

SEQ ID NO: 995665 - RNA, 16 nt, Mycobacterium avium subsp. paratuberculosis
gaccagcgagcccagc

SEQ ID NO: 995666 - RNA, 21 nt, Mycobacterium avium subsp. paratuberculosis
gaccagccggucuuggacagc

SEQ ID NO: 995667 - RNA, 17 nt, Mycobacterium avium subsp. paratuberculosis
gaccagcgcggugccgg

SEQ ID NO: 995668 - RNA, 22 nt, Mycobacterium avium subsp. paratuberculosis
gaccagcgcgaacagcgcggcc

SEQ ID NO: 995669 - RNA, 16 nt, Mycobacterium avium subsp. paratuberculosis
gaccagcgcgccggcc

SEQ ID NO: 995670 - RNA, 15 nt, Mycobacterium avium subsp. paratuberculosis
gaccagcggcagcac

SEQ ID NO: 995671 - RNA, 17 nt, Mycobacterium avium subsp. paratuberculosis
gaccagcggcagcagca

SEQ ID NO: 995672 - RNA, 19 nt, Mycobacterium avium subsp. paratuberculosis
gaccagcggcagcagcacc

SEQ ID NO: 995673 - RNA, 20 nt, Mycobacterium avium subsp. paratuberculosis
gaccagcggcagcagcacca

SEQ ID NO: 995674 - RNA, 20 nt, Mycobacterium avium subsp. paratuberculosis
gaccagcgccgagaccagcc

SEQ ID NO: 995675 - RNA, 14 nt, Mycobacterium avium subsp. paratuberculosis
gaccagcgccgagg

SEQ ID NO: 995676 - RNA, 19 nt, Mycobacterium avium subsp. paratuberculosis
gaccagcgccgaggugcug

SEQ ID NO: 995677 - RNA, 13 nt, Mycobacterium avium subsp. paratuberculosis
gaccagcaccgcg

SEQ ID NO: 995678 - RNA, 13 nt, Mycobacterium avium subsp. paratuberculosis
gaccagcaccgca

SEQ ID NO: 995679 - RNA, 14 nt, Mycobacterium avium subsp. paratuberculosis
gaccagcagcugga

SEQ ID NO: 995680 - RNA, 16 nt, Mycobacterium avium subsp. paratuberculosis
gaccagcccggccgcc

SEQ ID NO: 995681 - RNA, 16 nt, Mycobacterium avium subsp. paratuberculosis
gaccagauugcggcac

SEQ ID NO: 995682 - RNA, 16 nt, Mycobacterium avium subsp. paratuberculosis
gaccaggacgucggcc

SEQ ID NO: 995683 - RNA, 15 nt, Mycobacterium avium subsp. paratuberculosis
gaccaggcccagcgg

SEQ ID NO: 995684 - RNA, 17 nt, Mycobacterium avium subsp. paratuberculosis
gaccaggccgaugauga

SEQ ID NO: 995685 - RNA, 17 nt, Mycobacterium avium subsp. paratuberculosis
gaccaggcuugccccgu

SEQ ID NO: 995686 - RNA, 18 nt, Mycobacterium avium subsp. paratuberculosis
gaccaggcucacgcugcc

SEQ ID NO: 995687 - RNA, 13 nt, Mycobacterium avium subsp. paratuberculosis
gaccagggccucg

SEQ ID NO: 995688 - RNA, 22 nt, Mycobacterium avium subsp. paratuberculosis
gaccagggcgaucaccgcggcc

SEQ ID NO: 995689 - RNA, 17 nt, Mycobacterium avium subsp. paratuberculosis
gaccagguagcgcugca

SEQ ID NO: 995690 - RNA, 14 nt, Mycobacterium avium subsp. paratuberculosis
gaccaggucgccgg

SEQ ID NO: 995691 - RNA, 21 nt, Mycobacterium avium subsp. paratuberculosis
gaccagguauucaucgcggcc

SEQ ID NO: 995692 - RNA, 14 nt, Mycobacterium avium subsp. paratuberculosis
gaccagggugguca

SEQ ID NO: 995693 - RNA, 17 nt, Mycobacterium avium subsp. paratuberculosis
gaccaguucgcccuggc

SEQ ID NO: 995694 - RNA, 19 nt, Mycobacterium avium subsp. paratuberculosis
gaccaguucgcccuggccg

SEQ ID NO: 995695 - RNA, 20 nt, Mycobacterium avium subsp. paratuberculosis
gaccaguucuucgaugacgg

SEQ ID NO: 995696 - RNA, 16 nt, Mycobacterium avium subsp. paratuberculosis
gaccaggugggcggcc

SEQ ID NO: 995697 - RNA, 19 nt, Mycobacterium avium subsp. paratuberculosis
gaccacaccggcgcugccc

SEQ ID NO: 995698 - RNA, 15 nt, Mycobacterium avium subsp. paratuberculosis
gaccacaccgucgac

SEQ ID NO: 995699 - RNA, 14 nt, Mycobacterium avium subsp. paratuberculosis
gaccaacgggcggc

SEQ ID NO: 995700 - RNA, 19 nt, Mycobacterium avium subsp. paratuberculosis
gaccaacgggcggcggauc

SEQ ID NO: 995701 - RNA, 12 nt, Mycobacterium avium subsp. paratuberculosis
gaccaacacccc

SEQ ID NO: 995702 - RNA, 19 nt, Mycobacterium avium subsp. paratuberculosis
gaccaacuccaccgcccgg

SEQ ID NO: 995703 - RNA, 12 nt, Mycobacterium avium subsp. paratuberculosis
gaccaagccccg

SEQ ID NO: 995704 - RNA, 19 nt, Mycobacterium avium subsp. paratuberculosis
gaccacguccagcugggcu

SEQ ID NO: 995705 - RNA, 15 nt, Mycobacterium avium subsp. paratuberculosis
gaccacggccccagc

SEQ ID NO: 995706 - RNA, 23 nt, Mycobacterium avium subsp. paratuberculosis
gaccacggccugguacagcaccg

SEQ ID NO: 995707 - RNA, 15 nt, Mycobacterium avium subsp. paratuberculosis
gaccaccgccggccc

SEQ ID NO: 995708 - RNA, 19 nt, Mycobacterium avium subsp. paratuberculosis
gaccaccaggagcaccugc

SEQ ID NO: 995709 - RNA, 14 nt, Mycobacterium avium subsp. paratuberculosis
gaccaccagccgca

SEQ ID NO: 995710 - RNA, 16 nt, Mycobacterium avium subsp. paratuberculosis
gaccaccgaccccugc

SEQ ID NO: 995711 - RNA, 15 nt, Mycobacterium avium subsp. paratuberculosis
gaccaccgagccggg

SEQ ID NO: 995712 - RNA, 21 nt, Mycobacterium avium subsp. paratuberculosis
gaccacccacucccagccgcc

SEQ ID NO: 995713 - RNA, 16 nt, Mycobacterium avium subsp. paratuberculosis
gaccacccccagcccg

SEQ ID NO: 995714 - RNA, 17 nt, Mycobacterium avium subsp. paratuberculosis
gaccacccccagcccgc

SEQ ID NO: 995715 - RNA, 14 nt, Mycobacterium avium subsp. paratuberculosis
gaccacccgcagcg

SEQ ID NO: 995716 - RNA, 16 nt, Mycobacterium avium subsp. paratuberculosis
gaccacccgcagcgag

SEQ ID NO: 995717 - RNA, 17 nt, Mycobacterium avium subsp. paratuberculosis
gaccacccgcagcgagg

SEQ ID NO: 995718 - RNA, 14 nt, Mycobacterium avium subsp. paratuberculosis
gaccacccucaggg

SEQ ID NO: 995719 - RNA, 18 nt, Mycobacterium avium subsp. paratuberculosis
gaccacccucagggagcu

SEQ ID NO: 995720 - RNA, 18 nt, Mycobacterium avium subsp. paratuberculosis
gacaaagaucacagcgcc

SEQ ID NO: 995721 - RNA, 20 nt, Mycobacterium avium subsp. paratuberculosis
gacaaagaucacagcgcccu

SEQ ID NO: 995722 - RNA, 15 nt, Mycobacterium avium subsp. paratuberculosis
gacaaagcacaacuc

SEQ ID NO: 995723 - RNA, 23 nt, Mycobacterium avium subsp. paratuberculosis
gacaacacgaucgucaccgugcc

SEQ ID NO: 995724 - RNA, 15 nt, Mycobacterium avium subsp. paratuberculosis
gacaacaccaccucu

SEQ ID NO: 995725 - RNA, 23 nt, Mycobacterium avium subsp. paratuberculosis
gacaacgcgucgaacagccgggc

SEQ ID NO: 995726 - RNA, 17 nt, Mycobacterium avium subsp. paratuberculosis
gacaacgcgugaugcag

SEQ ID NO: 995727 - RNA, 15 nt, Mycobacterium avium subsp. paratuberculosis
gacaacgggccgccu

SEQ ID NO: 995728 - RNA, 21 nt, Mycobacterium avium subsp. paratuberculosis
gacaacgacagcacccaggug

SEQ ID NO: 995729 - RNA, 17 nt, Mycobacterium avium subsp. paratuberculosis
gacaaggucgaccgcgc

SEQ ID NO: 995730 - RNA, 17 nt, Mycobacterium avium subsp. paratuberculosis
gacagcaacgccagggc

SEQ ID NO: 995731 - RNA, 18 nt, Mycobacterium avium subsp. paratuberculosis
gacagcaacgccagggcc

SEQ ID NO: 995732 - RNA, 13 nt, Mycobacterium avium subsp. paratuberculosis
gacagcagcaccg

SEQ ID NO: 995733 - RNA, 16 nt, Mycobacterium avium subsp. paratuberculosis
gacagcagcaccggca

SEQ ID NO: 995734 - RNA, 16 nt, Mycobacterium avium subsp. paratuberculosis
gacagcacccggcccc

SEQ ID NO: 995735 - RNA, 19 nt, Mycobacterium avium subsp. paratuberculosis
gacagaaaucgcgcagaaa

SEQ ID NO: 995736 - RNA, 14 nt, Mycobacterium avium subsp. paratuberculosis
gacagcuggcgguc

SEQ ID NO: 995737 - RNA, 14 nt, Mycobacterium avium subsp. paratuberculosis
gacagcugagcagc

SEQ ID NO: 995738 - RNA, 15 nt, Mycobacterium avium subsp. paratuberculosis
gacagcugagcagcc

SEQ ID NO: 995739 - RNA, 14 nt, Mycobacterium avium subsp. paratuberculosis
gacaggaaccuggu

SEQ ID NO: 995740 - RNA, 22 nt, Mycobacterium avium subsp. paratuberculosis
gacagcguggucgcgcagcaug

SEQ ID NO: 995741 - RNA, 16 nt, Mycobacterium avium subsp. paratuberculosis
gacagcgucguccaug

SEQ ID NO: 995742 - RNA, 18 nt, Mycobacterium avium subsp. paratuberculosis
gacagcgucguccaugcc

SEQ ID NO: 995743 - RNA, 18 nt, Mycobacterium avium subsp. paratuberculosis
gacagcgcgucggccagc

SEQ ID NO: 995744 - RNA, 11 nt, Mycobacterium avium subsp. paratuberculosis
gacagccaccg

SEQ ID NO: 995745 - RNA, 15 nt, Mycobacterium avium subsp. paratuberculosis
gacagcccccgcagc

SEQ ID NO: 995746 - RNA, 16 nt, Mycobacterium avium subsp. paratuberculosis
gacagcccccgcagcc

SEQ ID NO: 995747 - RNA, 18 nt, Mycobacterium avium subsp. paratuberculosis
gacagccaaacagguugg

SEQ ID NO: 995748 - RNA, 13 nt, Mycobacterium avium subsp. paratuberculosis
gacagccgcccgg

SEQ ID NO: 995749 - RNA, 11 nt, Mycobacterium avium subsp. paratuberculosis
gacacccagcg

SEQ ID NO: 995750 - RNA, 20 nt, Mycobacterium avium subsp. paratuberculosis
gacacccgacgaagccgccg

SEQ ID NO: 995751 - RNA, 19 nt, Mycobacterium avium subsp. paratuberculosis
gacaccaccggccgcccgg

SEQ ID NO: 995752 - RNA, 13 nt, Mycobacterium avium subsp. paratuberculosis
gacacagcacgcc

SEQ ID NO: 995753 - RNA, 22 nt, Mycobacterium avium subsp. paratuberculosis
gacacggcgccgugcgccucga

SEQ ID NO: 995754 - RNA, 20 nt, Mycobacterium avium subsp. paratuberculosis
gacacgcgccggcgcgggca

SEQ ID NO: 995755 - RNA, 22 nt, Mycobacterium avium subsp. paratuberculosis
gacacgccgcgcaucaggggcu

SEQ ID NO: 995756 - RNA, 18 nt, Mycobacterium avium subsp. paratuberculosis
gacacguccagcucucga

SEQ ID NO: 995757 - RNA, 14 nt, Mycobacterium avium subsp. paratuberculosis
gacacgucgacacg

SEQ ID NO: 995758 - RNA, 15 nt, Mycobacterium avium subsp. paratuberculosis
gacaccuuggcggcc

SEQ ID NO: 995759 - RNA, 15 nt, Mycobacterium avium subsp. paratuberculosis
gacaccucggccagc

SEQ ID NO: 995760 - RNA, 22 nt, Mycobacterium avium subsp. paratuberculosis
gacaccugcucaccgagcuggg

SEQ ID NO: 995761 - RNA, 21 nt, Mycobacterium avium subsp. paratuberculosis
gacaccgggcaccgacaucag

SEQ ID NO: 995762 - RNA, 16 nt, Mycobacterium avium subsp. paratuberculosis
gacacgaugggucagg

SEQ ID NO: 995763 - RNA, 18 nt, Mycobacterium avium subsp. paratuberculosis
gacacgaauacccuucgg

SEQ ID NO: 995764 - RNA, 15 nt, Mycobacterium avium subsp. paratuberculosis
gacaccggacugcuu

SEQ ID NO: 995765 - RNA, 13 nt, Mycobacterium avium subsp. paratuberculosis
gacaccgcuggcc

SEQ ID NO: 995766 - RNA, 14 nt, Mycobacterium avium subsp. paratuberculosis
gacaccggccggga

SEQ ID NO: 995767 - RNA, 19 nt, Mycobacterium avium subsp. paratuberculosis
gacacccuucaucagcacc

SEQ ID NO: 995768 - RNA, 16 nt, Mycobacterium avium subsp. paratuberculosis
gacaccgaacccacca

SEQ ID NO: 995769 - RNA, 18 nt, Mycobacterium avium subsp. paratuberculosis
gacaccgaaccgccccgc

SEQ ID NO: 995770 - RNA, 18 nt, Mycobacterium avium subsp. paratuberculosis
gacaccgacgaccaucag

SEQ ID NO: 995771 - RNA, 14 nt, Mycobacterium avium subsp. paratuberculosis
gacaccgcacccag

SEQ ID NO: 995772 - RNA, 23 nt, Mycobacterium avium subsp. paratuberculosis
gacaccgcacggcccaucaccag

SEQ ID NO: 995773 - RNA, 19 nt, Mycobacterium avium subsp. paratuberculosis
gacgacuucggccucgguu

SEQ ID NO: 995774 - RNA, 16 nt, Mycobacterium avium subsp. paratuberculosis
gacgagaucagcacca

SEQ ID NO: 995775 - RNA, 15 nt, Mycobacterium avium subsp. paratuberculosis
gacgagcccgccggc

SEQ ID NO: 995776 - RNA, 16 nt, Mycobacterium avium subsp. paratuberculosis
gacgagcccgccggcg

SEQ ID NO: 995777 - RNA, 15 nt, Mycobacterium avium subsp. paratuberculosis
gacgagccgccgcgg

SEQ ID NO: 995778 - RNA, 14 nt, Mycobacterium avium subsp. paratuberculosis
gacgacggccagcu

SEQ ID NO: 995779 - RNA, 21 nt, Mycobacterium avium subsp. paratuberculosis
gacgacggucaccggcaggcg

SEQ ID NO: 995780 - RNA, 14 nt, Mycobacterium avium subsp. paratuberculosis
gacgacucuuccag

SEQ ID NO: 995781 - RNA, 20 nt, Mycobacterium avium subsp. paratuberculosis
gacgacugggugcgcgggcg

SEQ ID NO: 995782 - RNA, 22 nt, Mycobacterium avium subsp. paratuberculosis
gacgagaucgguuggcucgcag

SEQ ID NO: 995783 - RNA, 15 nt, Mycobacterium avium subsp. paratuberculosis
gacgagucgccguug

SEQ ID NO: 995784 - RNA, 20 nt, Mycobacterium avium subsp. paratuberculosis
gacgaggggcagcagcgccc

SEQ ID NO: 995785 - RNA, 22 nt, Mycobacterium avium subsp. paratuberculosis
gacgaggggcagcagcgcccac

SEQ ID NO: 995786 - RNA, 18 nt, Mycobacterium avium subsp. paratuberculosis
gacgaucccggcgagcac

SEQ ID NO: 995787 - RNA, 21 nt, Mycobacterium avium subsp. paratuberculosis
gacgcaccucgcucagcccgg

SEQ ID NO: 995788 - RNA, 16 nt, Mycobacterium avium subsp. paratuberculosis
gacgcaccucggccgg

SEQ ID NO: 995789 - RNA, 19 nt, Mycobacterium avium subsp. paratuberculosis
gacgcagcgaucggcggcu

SEQ ID NO: 995790 - RNA, 21 nt, Mycobacterium avium subsp. paratuberculosis
gacgauggucuggaugaucgu

SEQ ID NO: 995791 - RNA, 17 nt, Mycobacterium avium subsp. paratuberculosis
gacgaugucgaugacgg

SEQ ID NO: 995792 - RNA, 23 nt, Mycobacterium avium subsp. paratuberculosis
gacgaugucgaugacggcggcgc

SEQ ID NO: 995793 - RNA, 16 nt, Mycobacterium avium subsp. paratuberculosis
gacgauguccgccggc

SEQ ID NO: 995794 - RNA, 17 nt, Mycobacterium avium subsp. paratuberculosis
gacgauggcgaccgcgc

SEQ ID NO: 995795 - RNA, 17 nt, Mycobacterium avium subsp. paratuberculosis
gacgaugggccgcccgc

SEQ ID NO: 995796 - RNA, 14 nt, Mycobacterium avium subsp. paratuberculosis
gacgaugcugagca

SEQ ID NO: 995797 - RNA, 13 nt, Mycobacterium avium subsp. paratuberculosis
gacgauggcccgg

SEQ ID NO: 995798 - RNA, 19 nt, Mycobacterium avium subsp. paratuberculosis
gacgaugcggccggcgggc

SEQ ID NO: 995799 - RNA, 20 nt, Mycobacterium avium subsp. paratuberculosis
gacgaugcggggccggcggc

SEQ ID NO: 995800 - RNA, 23 nt, Mycobacterium avium subsp. paratuberculosis
gacgaugcggggccggcggcggc

SEQ ID NO: 995801 - RNA, 18 nt, Mycobacterium avium subsp. paratuberculosis
gacgaugcggggcggcgg

SEQ ID NO: 995802 - RNA, 20 nt, Mycobacterium avium subsp. paratuberculosis
gacgaugagggugaugacgu

SEQ ID NO: 995803 - RNA, 17 nt, Mycobacterium avium subsp. paratuberculosis
gacgaaaucgucgggca

SEQ ID NO: 995804 - RNA, 20 nt, Mycobacterium avium subsp. paratuberculosis
gacgaacgcuuccagcacca

SEQ ID NO: 995805 - RNA, 19 nt, Mycobacterium avium subsp. paratuberculosis
gacgaacucaagggcguca

SEQ ID NO: 995806 - RNA, 17 nt, Mycobacterium avium subsp. paratuberculosis
gacgaacuccugcucgc

SEQ ID NO: 995807 - RNA, 12 nt, Mycobacterium avium subsp. paratuberculosis
gacgaacagcac

SEQ ID NO: 995808 - RNA, 14 nt, Mycobacterium avium subsp. paratuberculosis
gacgaacagcaccg

SEQ ID NO: 995809 - RNA, 18 nt, Mycobacterium avium subsp. paratuberculosis
gaccuugaccaccgagcc

SEQ ID NO: 995810 - RNA, 13 nt, Mycobacterium avium subsp. paratuberculosis
gaccuugaccagc

SEQ ID NO: 995811 - RNA, 16 nt, Mycobacterium avium subsp. paratuberculosis
gaccuugcgggcgguc

SEQ ID NO: 995812 - RNA, 12 nt, Mycobacterium avium subsp. paratuberculosis
gaccuuguccgg

SEQ ID NO: 995813 - RNA, 15 nt, Mycobacterium avium subsp. paratuberculosis
gacgaacgcggcgga

SEQ ID NO: 995814 - RNA, 16 nt, Mycobacterium avium subsp. paratuberculosis
gacgaagcggccgggg

SEQ ID NO: 995815 - RNA, 20 nt, Mycobacterium avium subsp. paratuberculosis
gacgaagaucccgcuggcca

SEQ ID NO: 995816 - RNA, 12 nt, Mycobacterium avium subsp. paratuberculosis
gacgaagcagcu

SEQ ID NO: 995817 - RNA, 14 nt, Mycobacterium avium subsp. paratuberculosis
gacgacgucgaccg

SEQ ID NO: 995818 - RNA, 17 nt, Mycobacterium avium subsp. paratuberculosis
gacgacgucgaccgcgc

SEQ ID NO: 995819 - RNA, 18 nt, Mycobacterium avium subsp. paratuberculosis
gacgacgucgacgacccg

SEQ ID NO: 995820 - RNA, 15 nt, Mycobacterium avium subsp. paratuberculosis
gacgacggcgccgcc

SEQ ID NO: 995821 - RNA, 20 nt, Mycobacterium avium subsp. paratuberculosis
gacgacggcgccgcccgggc

SEQ ID NO: 995822 - RNA, 16 nt, Mycobacterium avium subsp. paratuberculosis
gacgacggcgccgcgu

SEQ ID NO: 995823 - RNA, 16 nt, Mycobacterium avium subsp. paratuberculosis
gacgacgccagcugcc

SEQ ID NO: 995824 - RNA, 23 nt, Mycobacterium avium subsp. paratuberculosis
gacgacgccgauccgcagccgcu

SEQ ID NO: 995825 - RNA, 23 nt, Mycobacterium avium subsp. paratuberculosis
gacgaccgcgacggcgcccgccc

SEQ ID NO: 995826 - RNA, 19 nt, Mycobacterium avium subsp. paratuberculosis
gacgacccgagagcugcug

SEQ ID NO: 995827 - RNA, 15 nt, Mycobacterium avium subsp. paratuberculosis
gacgaccucgcccgc

SEQ ID NO: 995828 - RNA, 18 nt, Mycobacterium avium subsp. paratuberculosis
gacgaccucgcccgccgc

SEQ ID NO: 995829 - RNA, 14 nt, Mycobacterium avium subsp. paratuberculosis
gacgaccaucagcg

SEQ ID NO: 995830 - RNA, 20 nt, Mycobacterium avium subsp. paratuberculosis
gacgacccguaggagcugac

SEQ ID NO: 995831 - RNA, 24 nt, Mycobacterium avium subsp. paratuberculosis
gacgcugaucuacgucggcuggcg

SEQ ID NO: 995832 - RNA, 16 nt, Mycobacterium avium subsp. paratuberculosis
gacgcugccggggcgc

SEQ ID NO: 995833 - RNA, 17 nt, Mycobacterium avium subsp. paratuberculosis
gacgcugagcacccgcc

SEQ ID NO: 995834 - RNA, 18 nt, Mycobacterium avium subsp. paratuberculosis
gacgcugagcgccaggcc

SEQ ID NO: 995835 - RNA, 22 nt, Mycobacterium avium subsp. paratuberculosis
gacgcugagucuacuuggccag

SEQ ID NO: 995836 - RNA, 22 nt, Mycobacterium avium subsp. paratuberculosis
gacgcugacgaugcggccggcg

SEQ ID NO: 995837 - RNA, 20 nt, Mycobacterium avium subsp. paratuberculosis
gacgcugaacagcccgagca

SEQ ID NO: 995838 - RNA, 17 nt, Mycobacterium avium subsp. paratuberculosis
gacgcuggccgagagcc

SEQ ID NO: 995839 - RNA, 14 nt, Mycobacterium avium subsp. paratuberculosis
gacgcugggcggcg

SEQ ID NO: 995840 - RNA, 15 nt, Mycobacterium avium subsp. paratuberculosis
gacgcugggcggcga

SEQ ID NO: 995841 - RNA, 18 nt, Mycobacterium avium subsp. paratuberculosis
gacgcgucgagcgugggc

SEQ ID NO: 995842 - RNA, 15 nt, Mycobacterium avium subsp. paratuberculosis
gacgcggucgccgcc

SEQ ID NO: 995843 - RNA, 18 nt, Mycobacterium avium subsp. paratuberculosis
gacgcggggcggcggcgc

SEQ ID NO: 995844 - RNA, 20 nt, Mycobacterium avium subsp. paratuberculosis
gacgcggcgggaaaccaccu

SEQ ID NO: 995845 - RNA, 22 nt, Mycobacterium avium subsp. paratuberculosis
gacgcggcgggaaaccaccugc

SEQ ID NO: 995846 - RNA, 13 nt, Mycobacterium avium subsp. paratuberculosis
gacgcggcucgcg

SEQ ID NO: 995847 - RNA, 14 nt, Mycobacterium avium subsp. paratuberculosis
gacgcggcgaccac

SEQ ID NO: 995848 - RNA, 18 nt, Mycobacterium avium subsp. paratuberculosis
gacgcggccucgaagcug

SEQ ID NO: 995849 - RNA, 22 nt, Mycobacterium avium subsp. paratuberculosis
gacgcggccucgaagcuggaau

SEQ ID NO: 995850 - RNA, 17 nt, Mycobacterium avium subsp. paratuberculosis
gacgcggcaggcgcccc

SEQ ID NO: 995851 - RNA, 18 nt, Mycobacterium avium subsp. paratuberculosis
gacgcggccagcgcccgc

SEQ ID NO: 995852 - RNA, 19 nt, Mycobacterium avium subsp. paratuberculosis
gacgcucacccggcccacc

SEQ ID NO: 995853 - RNA, 18 nt, Mycobacterium avium subsp. paratuberculosis
gacgcguugaaaguccuu

SEQ ID NO: 995854 - RNA, 19 nt, Mycobacterium avium subsp. paratuberculosis
gacgcgguggugcucgccc

SEQ ID NO: 995855 - RNA, 23 nt, Mycobacterium avium subsp. paratuberculosis
gacggauucccgaacagggcgac

SEQ ID NO: 995856 - RNA, 17 nt, Mycobacterium avium subsp. paratuberculosis
gacggagucgucggcgc

SEQ ID NO: 995857 - RNA, 18 nt, Mycobacterium avium subsp. paratuberculosis
gacggaguuggaucgccg

SEQ ID NO: 995858 - RNA, 19 nt, Mycobacterium avium subsp. paratuberculosis
gacggaguuggaucgccgc

SEQ ID NO: 995859 - RNA, 19 nt, Mycobacterium avium subsp. paratuberculosis
gacggcccacgucgcgccg

SEQ ID NO: 995860 - RNA, 18 nt, Mycobacterium avium subsp. paratuberculosis
gacggccgcaccccaccc

SEQ ID NO: 995861 - RNA, 23 nt, Mycobacterium avium subsp. paratuberculosis
gacggcaugccgggccagccggc

SEQ ID NO: 995862 - RNA, 15 nt, Mycobacterium avium subsp. paratuberculosis
gacggccagaccgca

SEQ ID NO: 995863 - RNA, 11 nt, Mycobacterium avium subsp. paratuberculosis
gacggccagca

SEQ ID NO: 995864 - RNA, 13 nt, Mycobacterium avium subsp. paratuberculosis
gacggccagcagg

SEQ ID NO: 995865 - RNA, 14 nt, Mycobacterium avium subsp. paratuberculosis
gacggccagcagga

SEQ ID NO: 995866 - RNA, 16 nt, Mycobacterium avium subsp. paratuberculosis
gacggcgaccauccac

SEQ ID NO: 995867 - RNA, 24 nt, Mycobacterium avium subsp. paratuberculosis
gacggccugcaccaccacacccag

SEQ ID NO: 995868 - RNA, 18 nt, Mycobacterium avium subsp. paratuberculosis
gacggccugggcgaccac

SEQ ID NO: 995869 - RNA, 14 nt, Mycobacterium avium subsp. paratuberculosis
gacggccgggucag

SEQ ID NO: 995870 - RNA, 12 nt, Mycobacterium avium subsp. paratuberculosis
gacggccguucu

SEQ ID NO: 995871 - RNA, 14 nt, Mycobacterium avium subsp. paratuberculosis
gacggccucgccgu

SEQ ID NO: 995872 - RNA, 16 nt, Mycobacterium avium subsp. paratuberculosis
gacggccgcgccguug

SEQ ID NO: 995873 - RNA, 21 nt, Mycobacterium avium subsp. paratuberculosis
gacgcccaccugguuggcccg

SEQ ID NO: 995874 - RNA, 23 nt, Mycobacterium avium subsp. paratuberculosis
gacgcccaccugguuggcccgca

SEQ ID NO: 995875 - RNA, 13 nt, Mycobacterium avium subsp. paratuberculosis
gacgccagcugcc

SEQ ID NO: 995876 - RNA, 13 nt, Mycobacterium avium subsp. paratuberculosis
gacgcccagcgcg

SEQ ID NO: 995877 - RNA, 16 nt, Mycobacterium avium subsp. paratuberculosis
gacgcccagcgcggcg

SEQ ID NO: 995878 - RNA, 16 nt, Mycobacterium avium subsp. paratuberculosis
gacgcccaggcucagg

SEQ ID NO: 995879 - RNA, 19 nt, Mycobacterium avium subsp. paratuberculosis
gacgcccugccacagcgac

SEQ ID NO: 995880 - RNA, 14 nt, Mycobacterium avium subsp. paratuberculosis
gacgcccuccuggc

SEQ ID NO: 995881 - RNA, 14 nt, Mycobacterium avium subsp. paratuberculosis
gacgcccggcgccg

SEQ ID NO: 995882 - RNA, 17 nt, Mycobacterium avium subsp. paratuberculosis
gacgccgccgaacccca

SEQ ID NO: 995883 - RNA, 14 nt, Mycobacterium avium subsp. paratuberculosis
gacgccgcaccgca

SEQ ID NO: 995884 - RNA, 17 nt, Mycobacterium avium subsp. paratuberculosis
gacgccgauccgcagcc

SEQ ID NO: 995885 - RNA, 22 nt, Mycobacterium avium subsp. paratuberculosis
gacgccgacgcccagcgcggcg

SEQ ID NO: 995886 - RNA, 15 nt, Mycobacterium avium subsp. paratuberculosis
gacgccgacguagga

SEQ ID NO: 995887 - RNA, 17 nt, Mycobacterium avium subsp. paratuberculosis
gacgccggacagcuggc

SEQ ID NO: 995888 - RNA, 16 nt, Mycobacterium avium subsp. paratuberculosis
gacgccggcagccgcu

SEQ ID NO: 995889 - RNA, 17 nt, Mycobacterium avium subsp. paratuberculosis
gacgccgcucggccagc

SEQ ID NO: 995890 - RNA, 20 nt, Mycobacterium avium subsp. paratuberculosis
gacgccgcucggccagcgca

SEQ ID NO: 995891 - RNA, 14 nt, Mycobacterium avium subsp. paratuberculosis
gacgccggccucuc

SEQ ID NO: 995892 - RNA, 23 nt, Mycobacterium avium subsp. paratuberculosis
gacgccgcgguggccgggaugcc

SEQ ID NO: 995893 - RNA, 14 nt, Mycobacterium avium subsp. paratuberculosis
gacgccgcgcuggc

SEQ ID NO: 995894 - RNA, 18 nt, Mycobacterium avium subsp. paratuberculosis
gacgccgcggaagcccca

SEQ ID NO: 995895 - RNA, 16 nt, Mycobacterium avium subsp. paratuberculosis
gacgccgcgcaccccg

SEQ ID NO: 995896 - RNA, 15 nt, Mycobacterium avium subsp. paratuberculosis
gacgccgcgcagcgg

SEQ ID NO: 995897 - RNA, 14 nt, Mycobacterium avium subsp. paratuberculosis
gacgccgccgugga

SEQ ID NO: 995898 - RNA, 18 nt, Mycobacterium avium subsp. paratuberculosis
gacgccugcggcccagcg

SEQ ID NO: 995899 - RNA, 15 nt, Mycobacterium avium subsp. paratuberculosis
gacgccucgcgcagc

SEQ ID NO: 995900 - RNA, 13 nt, Mycobacterium avium subsp. paratuberculosis
gacgccucggugc

SEQ ID NO: 995901 - RNA, 17 nt, Mycobacterium avium subsp. paratuberculosis
gacgccgucgaugacgc

SEQ ID NO: 995902 - RNA, 15 nt, Mycobacterium avium subsp. paratuberculosis
gacgccgugcugccg

SEQ ID NO: 995903 - RNA, 15 nt, Mycobacterium avium subsp. paratuberculosis
gacgccgggcacucc

SEQ ID NO: 995904 - RNA, 14 nt, Mycobacterium avium subsp. paratuberculosis
gacgccgggcgccc

SEQ ID NO: 995905 - RNA, 16 nt, Mycobacterium avium subsp. paratuberculosis
gacgcgcugcgcgccg

SEQ ID NO: 995906 - RNA, 15 nt, Mycobacterium avium subsp. paratuberculosis
gacgcgcucagcccc

SEQ ID NO: 995907 - RNA, 23 nt, Mycobacterium avium subsp. paratuberculosis
gacgcgccgcacugcacggccuc

SEQ ID NO: 995908 - RNA, 16 nt, Mycobacterium avium subsp. paratuberculosis
gacgcgccggcccaga

SEQ ID NO: 995909 - RNA, 18 nt, Mycobacterium avium subsp. paratuberculosis
gacgcgacgcgcucggcg

SEQ ID NO: 995910 - RNA, 18 nt, Mycobacterium avium subsp. paratuberculosis
gacgcgaacgcgccccgc

SEQ ID NO: 995911 - RNA, 23 nt, Mycobacterium avium subsp. paratuberculosis
gacgcgaccaggcccagcggauc

SEQ ID NO: 995912 - RNA, 18 nt, Mycobacterium avium subsp. paratuberculosis
gacgcgcaccgccaccgc

SEQ ID NO: 995913 - RNA, 13 nt, Mycobacterium avium subsp. paratuberculosis
gaccaucagcccg

SEQ ID NO: 995914 - RNA, 21 nt, Mycobacterium avium subsp. paratuberculosis
gaccauccacucgggccagcc

SEQ ID NO: 995915 - RNA, 13 nt, Mycobacterium avium subsp. paratuberculosis
gaccaugcccagc

SEQ ID NO: 995916 - RNA, 14 nt, Mycobacterium avium subsp. paratuberculosis
gaccaugcccagca

SEQ ID NO: 995917 - RNA, 17 nt, Mycobacterium avium subsp. paratuberculosis
gaccauggcgcggcggc

SEQ ID NO: 995918 - RNA, 22 nt, Mycobacterium avium subsp. paratuberculosis
gaccauggcgcggcggccggcc

SEQ ID NO: 995919 - RNA, 15 nt, Mycobacterium avium subsp. paratuberculosis
gaccaugucggccag

SEQ ID NO: 995920 - RNA, 14 nt, Mycobacterium avium subsp. paratuberculosis
gaccaugucggcga

SEQ ID NO: 995921 - RNA, 23 nt, Mycobacterium avium subsp. paratuberculosis
gaccaugacccacggguuggggc

SEQ ID NO: 995922 - RNA, 18 nt, Mycobacterium avium subsp. paratuberculosis
gacccagacuugggcagc

SEQ ID NO: 995923 - RNA, 11 nt, Mycobacterium avium subsp. paratuberculosis
gacccagcgcg

SEQ ID NO: 995924 - RNA, 16 nt, Mycobacterium avium subsp. paratuberculosis
gacccagcagcggccg

SEQ ID NO: 995925 - RNA, 15 nt, Mycobacterium avium subsp. paratuberculosis
gacccagcuccucgg

SEQ ID NO: 995926 - RNA, 21 nt, Mycobacterium avium subsp. paratuberculosis
gacccagcuccucggccagca

SEQ ID NO: 995927 - RNA, 15 nt, Mycobacterium avium subsp. paratuberculosis
gacccgaaacuggga

SEQ ID NO: 995928 - RNA, 19 nt, Mycobacterium avium subsp. paratuberculosis
gacccgaacuucagcgcgu

SEQ ID NO: 995929 - RNA, 13 nt, Mycobacterium avium subsp. paratuberculosis
gacccgaagccca

SEQ ID NO: 995930 - RNA, 23 nt, Mycobacterium avium subsp. paratuberculosis
gaccccguucgccgacagcagcu

SEQ ID NO: 995931 - RNA, 21 nt, Mycobacterium avium subsp. paratuberculosis
gaccccuccaacggccgcacg

SEQ ID NO: 995932 - RNA, 22 nt, Mycobacterium avium subsp. paratuberculosis
gaccccucggcauaacgcaacc

SEQ ID NO: 995933 - RNA, 12 nt, Mycobacterium avium subsp. paratuberculosis
gaccccacagcg

SEQ ID NO: 995934 - RNA, 15 nt, Mycobacterium avium subsp. paratuberculosis
gaccccagugcaggc

SEQ ID NO: 995935 - RNA, 16 nt, Mycobacterium avium subsp. paratuberculosis
gaccccgacggcgccg

SEQ ID NO: 995936 - RNA, 19 nt, Mycobacterium avium subsp. paratuberculosis
gaccccgacggcgccgcgg

SEQ ID NO: 995937 - RNA, 14 nt, Mycobacterium avium subsp. paratuberculosis
gaccccgccggccc

SEQ ID NO: 995938 - RNA, 13 nt, Mycobacterium avium subsp. paratuberculosis
gaccgcagccuuc

SEQ ID NO: 995939 - RNA, 13 nt, Mycobacterium avium subsp. paratuberculosis
gaccgcagcaggc

SEQ ID NO: 995940 - RNA, 16 nt, Mycobacterium avium subsp. paratuberculosis
gaccgcaccgaccagc

SEQ ID NO: 995941 - RNA, 17 nt, Mycobacterium avium subsp. paratuberculosis
gaccgauggccgcccgc

SEQ ID NO: 995942 - RNA, 15 nt, Mycobacterium avium subsp. paratuberculosis
gaccgcaagugcggu

SEQ ID NO: 995943 - RNA, 21 nt, Mycobacterium avium subsp. paratuberculosis
gaccgcacaauccggucagcg

SEQ ID NO: 995944 - RNA, 12 nt, Mycobacterium avium subsp. paratuberculosis
gaccgcaggaaa

SEQ ID NO: 995945 - RNA, 21 nt, Mycobacterium avium subsp. paratuberculosis
gaccgccagacugaugcccuc

SEQ ID NO: 995946 - RNA, 13 nt, Mycobacterium avium subsp. paratuberculosis
gaccgccagcagc

SEQ ID NO: 995947 - RNA, 17 nt, Mycobacterium avium subsp. paratuberculosis
gaccgacagccgcacca

SEQ ID NO: 995948 - RNA, 17 nt, Mycobacterium avium subsp. paratuberculosis
gaccgacauggccagca

SEQ ID NO: 995949 - RNA, 17 nt, Mycobacterium avium subsp. paratuberculosis
gaccgacccggccagcg

SEQ ID NO: 995950 - RNA, 20 nt, Mycobacterium avium subsp. paratuberculosis
gaccgaccuccaaugcgccc

SEQ ID NO: 995951 - RNA, 17 nt, Mycobacterium avium subsp. paratuberculosis
gaccgacggcgaccagu

SEQ ID NO: 995952 - RNA, 21 nt, Mycobacterium avium subsp. paratuberculosis
gaccgaggcgaucgcggccac

SEQ ID NO: 995953 - RNA, 20 nt, Mycobacterium avium subsp. paratuberculosis
gaccgagcggcgcugcagca

SEQ ID NO: 995954 - RNA, 17 nt, Mycobacterium avium subsp. paratuberculosis
gacccgguugauccgga

SEQ ID NO: 995955 - RNA, 17 nt, Mycobacterium avium subsp. paratuberculosis
gacccgggcgauggugc

SEQ ID NO: 995956 - RNA, 13 nt, Mycobacterium avium subsp. paratuberculosis
gacccgggccagc

SEQ ID NO: 995957 - RNA, 19 nt, Mycobacterium avium subsp. paratuberculosis
gacccgguagcgcagcacc

SEQ ID NO: 995958 - RNA, 14 nt, Mycobacterium avium subsp. paratuberculosis
gacccgguccuuga

SEQ ID NO: 995959 - RNA, 17 nt, Mycobacterium avium subsp. paratuberculosis
gacccguacuucucgaa

SEQ ID NO: 995960 - RNA, 13 nt, Mycobacterium avium subsp. paratuberculosis
gacccguccagcg

SEQ ID NO: 995961 - RNA, 15 nt, Mycobacterium avium subsp. paratuberculosis
gacccgucggggugc

SEQ ID NO: 995962 - RNA, 14 nt, Mycobacterium avium subsp. paratuberculosis
gacccuggccagca

SEQ ID NO: 995963 - RNA, 17 nt, Mycobacterium avium subsp. paratuberculosis
gacccggaggcggcggg

SEQ ID NO: 995964 - RNA, 20 nt, Mycobacterium avium subsp. paratuberculosis
gacccgcgucaucgggcccg

SEQ ID NO: 995965 - RNA, 17 nt, Mycobacterium avium subsp. paratuberculosis
gacccgcuucgcccggc

SEQ ID NO: 995966 - RNA, 14 nt, Mycobacterium avium subsp. paratuberculosis
gacccggaacccgc

SEQ ID NO: 995967 - RNA, 17 nt, Mycobacterium avium subsp. paratuberculosis
gacccggccggucgccu

SEQ ID NO: 995968 - RNA, 20 nt, Mycobacterium avium subsp. paratuberculosis
gacccggccgugcgcagcaa

SEQ ID NO: 995969 - RNA, 19 nt, Mycobacterium avium subsp. paratuberculosis
gacccggcgagcggcaccu

SEQ ID NO: 995970 - RNA, 13 nt, Mycobacterium avium subsp. paratuberculosis
gacccggccaccg

SEQ ID NO: 995971 - RNA, 15 nt, Mycobacterium avium subsp. paratuberculosis
gacccggccaccgcc

SEQ ID NO: 995972 - RNA, 22 nt, Mycobacterium avium subsp. paratuberculosis
gacccggccaccgccgccagca

SEQ ID NO: 995973 - RNA, 15 nt, Mycobacterium avium subsp. paratuberculosis
gacccggccagcggc

SEQ ID NO: 995974 - RNA, 17 nt, Mycobacterium avium subsp. paratuberculosis
gacccgcaaggccgcca

SEQ ID NO: 995975 - RNA, 16 nt, Mycobacterium avium subsp. paratuberculosis
gacccgcaccaccgcc

SEQ ID NO: 995976 - RNA, 18 nt, Mycobacterium avium subsp. paratuberculosis
gacccgcaccaccgcccg

SEQ ID NO: 995977 - RNA, 22 nt, Mycobacterium avium subsp. paratuberculosis
gacccgacgggaacucggccag

SEQ ID NO: 995978 - RNA, 18 nt, Mycobacterium avium subsp. paratuberculosis
gacccgagagcugcugcc

SEQ ID NO: 995979 - RNA, 19 nt, Mycobacterium avium subsp. paratuberculosis
gacccgccuggccaccucg

SEQ ID NO: 995980 - RNA, 23 nt, Mycobacterium avium subsp. paratuberculosis
gacccgcggcgccgcggcggcac

SEQ ID NO: 995981 - RNA, 15 nt, Mycobacterium avium subsp. paratuberculosis
gaccuguuuggccag

SEQ ID NO: 995982 - RNA, 13 nt, Mycobacterium avium subsp. paratuberculosis
gaccugggcggcc

SEQ ID NO: 995983 - RNA, 19 nt, Mycobacterium avium subsp. paratuberculosis
gaccugggucaucaccuug

SEQ ID NO: 995984 - RNA, 20 nt, Mycobacterium avium subsp. paratuberculosis
gaccugguugccgcccucgg

SEQ ID NO: 995985 - RNA, 22 nt, Mycobacterium avium subsp. paratuberculosis
gaccugguccaccgcggcggcc

SEQ ID NO: 995986 - RNA, 16 nt, Mycobacterium avium subsp. paratuberculosis
gaccugcuuggcggcc

SEQ ID NO: 995987 - RNA, 24 nt, Mycobacterium avium subsp. paratuberculosis
gaccugcuuggcggccugcgccag

SEQ ID NO: 995988 - RNA, 16 nt, Mycobacterium avium subsp. paratuberculosis
gaccuggcgggccagc

SEQ ID NO: 995989 - RNA, 17 nt, Mycobacterium avium subsp. paratuberculosis
gaccuggcgggccagcu

SEQ ID NO: 995990 - RNA, 17 nt, Mycobacterium avium subsp. paratuberculosis
gaccucuucgacccgca

SEQ ID NO: 995991 - RNA, 23 nt, Mycobacterium avium subsp. paratuberculosis
gaccucuugggacuggauggcga

SEQ ID NO: 995992 - RNA, 14 nt, Mycobacterium avium subsp. paratuberculosis
gaccugcagcgccu

SEQ ID NO: 995993 - RNA, 18 nt, Mycobacterium avium subsp. paratuberculosis
gaccugcugggcgggcag

SEQ ID NO: 995994 - RNA, 16 nt, Mycobacterium avium subsp. paratuberculosis
gaccguucuccgaggc

SEQ ID NO: 995995 - RNA, 17 nt, Mycobacterium avium subsp. paratuberculosis
gaccgucgccgaccagc

SEQ ID NO: 995996 - RNA, 18 nt, Mycobacterium avium subsp. paratuberculosis
gaccgucgggacggccag

SEQ ID NO: 995997 - RNA, 21 nt, Mycobacterium avium subsp. paratuberculosis
gaccgucgggacggccagcag

SEQ ID NO: 995998 - RNA, 14 nt, Mycobacterium avium subsp. paratuberculosis
gaccucggccacca

SEQ ID NO: 995999 - RNA, 16 nt, Mycobacterium avium subsp. paratuberculosis
gaccucggccaccacc

SEQ ID NO: 996000 - RNA, 21 nt, Mycobacterium avium subsp. paratuberculosis
gaccucgccgacgucccagca

SEQ ID NO: 996001 - RNA, 17 nt, Mycobacterium avium subsp. paratuberculosis
gaccucgccgagcagcc

SEQ ID NO: 996002 - RNA, 23 nt, Mycobacterium avium subsp. paratuberculosis
gaccucgcgcccggcgccggccc

SEQ ID NO: 996003 - RNA, 15 nt, Mycobacterium avium subsp. paratuberculosis
gaccucgaagcagcc

SEQ ID NO: 996004 - RNA, 16 nt, Mycobacterium avium subsp. paratuberculosis
gaccucgaagcagccu

SEQ ID NO: 996005 - RNA, 16 nt, Mycobacterium avium subsp. paratuberculosis
gaccucgagcaccggc

SEQ ID NO: 996006 - RNA, 19 nt, Mycobacterium avium subsp. paratuberculosis
gaccucgagcgucacgcug

SEQ ID NO: 996007 - RNA, 17 nt, Mycobacterium avium subsp. paratuberculosis
gaccucgucgggcgcca

SEQ ID NO: 996008 - RNA, 19 nt, Mycobacterium avium subsp. paratuberculosis
gaccucgcgcgucacgcug

SEQ ID NO: 996009 - RNA, 19 nt, Mycobacterium avium subsp. paratuberculosis
gaccucggcggccagcgcg

SEQ ID NO: 996010 - RNA, 16 nt, Mycobacterium avium subsp. paratuberculosis
gaccgcccgcuguucg

SEQ ID NO: 996011 - RNA, 13 nt, Mycobacterium avium subsp. paratuberculosis
gaccgcccggggc

SEQ ID NO: 996012 - RNA, 13 nt, Mycobacterium avium subsp. paratuberculosis
gaccgccgcggcg

SEQ ID NO: 996013 - RNA, 21 nt, Mycobacterium avium subsp. paratuberculosis
gaccgccgcggcgcccggcgc

SEQ ID NO: 996014 - RNA, 20 nt, Mycobacterium avium subsp. paratuberculosis
gaccgccgcggcggccugcu

SEQ ID NO: 996015 - RNA, 22 nt, Mycobacterium avium subsp. paratuberculosis
gaccgccgcguacagccagccc

SEQ ID NO: 996016 - RNA, 19 nt, Mycobacterium avium subsp. paratuberculosis
gaccgccagcagcagccgc

SEQ ID NO: 996017 - RNA, 14 nt, Mycobacterium avium subsp. paratuberculosis
gaccgccgccaucc

SEQ ID NO: 996018 - RNA, 19 nt, Mycobacterium avium subsp. paratuberculosis
gaccgccgccauccguucg

SEQ ID NO: 996019 - RNA, 21 nt, Mycobacterium avium subsp. paratuberculosis
gaccgcgacggcgcccgcccc

SEQ ID NO: 996020 - RNA, 18 nt, Mycobacterium avium subsp. paratuberculosis
gaccgcuugacgccgccg

SEQ ID NO: 996021 - RNA, 19 nt, Mycobacterium avium subsp. paratuberculosis
gaccgcuugacgccgccga

SEQ ID NO: 996022 - RNA, 12 nt, Mycobacterium avium subsp. paratuberculosis
gaccgcuugcgg

SEQ ID NO: 996023 - RNA, 15 nt, Mycobacterium avium subsp. paratuberculosis
gaccgcuugcggcuc

SEQ ID NO: 996024 - RNA, 15 nt, Mycobacterium avium subsp. paratuberculosis
gaccgcgugugcccg

SEQ ID NO: 996025 - RNA, 14 nt, Mycobacterium avium subsp. paratuberculosis
gaccgcggccgcga

SEQ ID NO: 996026 - RNA, 16 nt, Mycobacterium avium subsp. paratuberculosis
gaccgcggucgcggcg

SEQ ID NO: 996027 - RNA, 13 nt, Mycobacterium avium subsp. paratuberculosis
gaccgcggaugac

SEQ ID NO: 996028 - RNA, 19 nt, Mycobacterium avium subsp. paratuberculosis
gaccgcgcgccggccagca

SEQ ID NO: 996029 - RNA, 20 nt, Mycobacterium avium subsp. paratuberculosis
gaccgcgaugcgacaccgcg

SEQ ID NO: 996030 - RNA, 23 nt, Mycobacterium avium subsp. paratuberculosis
gaccgguccgugccacggccgcg

SEQ ID NO: 996031 - RNA, 20 nt, Mycobacterium avium subsp. paratuberculosis
gaccggucucgaccgcggcg

SEQ ID NO: 996032 - RNA, 18 nt, Mycobacterium avium subsp. paratuberculosis
gaccgggccgcuggugag

SEQ ID NO: 996033 - RNA, 19 nt, Mycobacterium avium subsp. paratuberculosis
gaccggcucucagccggaa

SEQ ID NO: 996034 - RNA, 17 nt, Mycobacterium avium subsp. paratuberculosis
gaccggcugcucgcgcu

SEQ ID NO: 996035 - RNA, 19 nt, Mycobacterium avium subsp. paratuberculosis
gaccgggaaguagggcagc

SEQ ID NO: 996036 - RNA, 16 nt, Mycobacterium avium subsp. paratuberculosis
gaccggguuggcgcgc

SEQ ID NO: 996037 - RNA, 16 nt, Mycobacterium avium subsp. paratuberculosis
gaccgggucugccacg

SEQ ID NO: 996038 - RNA, 18 nt, Mycobacterium avium subsp. paratuberculosis
gaccgggugaccggcgcg

SEQ ID NO: 996039 - RNA, 15 nt, Mycobacterium avium subsp. paratuberculosis
gaccgguaggcgcac

SEQ ID NO: 996040 - RNA, 13 nt, Mycobacterium avium subsp. paratuberculosis
gaccggguccgag

SEQ ID NO: 996041 - RNA, 15 nt, Mycobacterium avium subsp. paratuberculosis
gaccggaagccuguu

SEQ ID NO: 996042 - RNA, 15 nt, Mycobacterium avium subsp. paratuberculosis
gaccggacagcuggg

SEQ ID NO: 996043 - RNA, 16 nt, Mycobacterium avium subsp. paratuberculosis
gaccggaucggccagc

SEQ ID NO: 996044 - RNA, 19 nt, Mycobacterium avium subsp. paratuberculosis
gaccggaucggccagcagg

SEQ ID NO: 996045 - RNA, 17 nt, Mycobacterium avium subsp. paratuberculosis
gaccggcaccagcagcc

SEQ ID NO: 996046 - RNA, 13 nt, Mycobacterium avium subsp. paratuberculosis
gaccggcggccag

SEQ ID NO: 996047 - RNA, 14 nt, Mycobacterium avium subsp. paratuberculosis
gaccggcggccagc

SEQ ID NO: 996048 - RNA, 21 nt, Mycobacterium avium subsp. paratuberculosis
gaccggcggccgccaucaucc

SEQ ID NO: 996049 - RNA, 13 nt, Mycobacterium avium subsp. paratuberculosis
gaccggccagcag

SEQ ID NO: 996050 - RNA, 18 nt, Mycobacterium avium subsp. paratuberculosis
gaccggccagcagccgcu

SEQ ID NO: 996051 - RNA, 15 nt, Mycobacterium avium subsp. paratuberculosis
gaccggcgccggccg

SEQ ID NO: 996052 - RNA, 17 nt, Mycobacterium avium subsp. paratuberculosis
gaccggcgcgcccgagu

SEQ ID NO: 996053 - RNA, 13 nt, Mycobacterium avium subsp. paratuberculosis
gaccggcucgccg

SEQ ID NO: 996054 - RNA, 12 nt, Mycobacterium avium subsp. paratuberculosis
gagaccagcagc

SEQ ID NO: 996055 - RNA, 14 nt, Mycobacterium avium subsp. paratuberculosis
gagaacgucaggcc

SEQ ID NO: 996056 - RNA, 18 nt, Mycobacterium avium subsp. paratuberculosis
gagaacuccuugagcucc

SEQ ID NO: 996057 - RNA, 15 nt, Mycobacterium avium subsp. paratuberculosis
gagaacgucgcgucc

SEQ ID NO: 996058 - RNA, 21 nt, Mycobacterium avium subsp. paratuberculosis
gagaaguccuuguggcccagg

SEQ ID NO: 996059 - RNA, 17 nt, Mycobacterium avium subsp. paratuberculosis
gagagcucuugcgcccc

SEQ ID NO: 996060 - RNA, 21 nt, Mycobacterium avium subsp. paratuberculosis
gagagccgguagaucagcgcc

SEQ ID NO: 996061 - RNA, 14 nt, Mycobacterium avium subsp. paratuberculosis
gagaggcgcggcgc

SEQ ID NO: 996062 - RNA, 22 nt, Mycobacterium avium subsp. paratuberculosis
gagacgaccaggaugcccagga

SEQ ID NO: 996063 - RNA, 15 nt, Mycobacterium avium subsp. paratuberculosis
gagacgacccaacgu

SEQ ID NO: 996064 - RNA, 14 nt, Mycobacterium avium subsp. paratuberculosis
gagacgacgccacc

SEQ ID NO: 996065 - RNA, 14 nt, Mycobacterium avium subsp. paratuberculosis
gagacggccagcag

SEQ ID NO: 996066 - RNA, 15 nt, Mycobacterium avium subsp. paratuberculosis
gagacggccagcagc

SEQ ID NO: 996067 - RNA, 16 nt, Mycobacterium avium subsp. paratuberculosis
gagacggccagcagca

SEQ ID NO: 996068 - RNA, 21 nt, Mycobacterium avium subsp. paratuberculosis
gagaccucccggcgccacgcc

SEQ ID NO: 996069 - RNA, 13 nt, Mycobacterium avium subsp. paratuberculosis
gagaccuccugcu

SEQ ID NO: 996070 - RNA, 17 nt, Mycobacterium avium subsp. paratuberculosis
gagaccaugucggccag

SEQ ID NO: 996071 - RNA, 18 nt, Mycobacterium avium subsp. paratuberculosis
gagaccaugucggccagg

SEQ ID NO: 996072 - RNA, 16 nt, Mycobacterium avium subsp. paratuberculosis
gagacguggcggcggu

SEQ ID NO: 996073 - RNA, 13 nt, Mycobacterium avium subsp. paratuberculosis
gagacguccucgg

SEQ ID NO: 996074 - RNA, 18 nt, Mycobacterium avium subsp. paratuberculosis
gagacgucggccgggucg

SEQ ID NO: 996075 - RNA, 21 nt, Mycobacterium avium subsp. paratuberculosis
gagacguaagccauggcggcc

SEQ ID NO: 996076 - RNA, 19 nt, Mycobacterium avium subsp. paratuberculosis
gagaaaggccagcacgcag

SEQ ID NO: 996077 - RNA, 15 nt, Mycobacterium avium subsp. paratuberculosis
gagaacaucagcccc

SEQ ID NO: 996078 - RNA, 12 nt, Mycobacterium avium subsp. paratuberculosis
gagaacaggccg

SEQ ID NO: 996079 - RNA, 18 nt, Mycobacterium avium subsp. paratuberculosis
gagaaaauccagaacagc

SEQ ID NO: 996080 - RNA, 17 nt, Mycobacterium avium subsp. paratuberculosis
gacuugguggccagcac

SEQ ID NO: 996081 - RNA, 13 nt, Mycobacterium avium subsp. paratuberculosis
gacugggccaggu

SEQ ID NO: 996082 - RNA, 17 nt, Mycobacterium avium subsp. paratuberculosis
gacugggccaggucgcu

SEQ ID NO: 996083 - RNA, 14 nt, Mycobacterium avium subsp. paratuberculosis
gacuggcggcggcg

SEQ ID NO: 996084 - RNA, 21 nt, Mycobacterium avium subsp. paratuberculosis
gacuggcggcggcgguccccg

SEQ ID NO: 996085 - RNA, 19 nt, Mycobacterium avium subsp. paratuberculosis
gacuggugggcgucguggu

SEQ ID NO: 996086 - RNA, 15 nt, Mycobacterium avium subsp. paratuberculosis
gacuucguugguggu

SEQ ID NO: 996087 - RNA, 16 nt, Mycobacterium avium subsp. paratuberculosis
gacuugaccagcagcu

SEQ ID NO: 996088 - RNA, 20 nt, Mycobacterium avium subsp. paratuberculosis
gacuucccaguccggccagc

SEQ ID NO: 996089 - RNA, 21 nt, Mycobacterium avium subsp. paratuberculosis
gacuucccaguccggccagcg

SEQ ID NO: 996090 - RNA, 13 nt, Mycobacterium avium subsp. paratuberculosis
gacuucauggcga

SEQ ID NO: 996091 - RNA, 12 nt, Mycobacterium avium subsp. paratuberculosis
gacuaccgcgcc

SEQ ID NO: 996092 - RNA, 20 nt, Mycobacterium avium subsp. paratuberculosis
gacucaaucggucagggugu

SEQ ID NO: 996093 - RNA, 17 nt, Mycobacterium avium subsp. paratuberculosis
gacucgggguugacccg

SEQ ID NO: 996094 - RNA, 20 nt, Mycobacterium avium subsp. paratuberculosis
gacucgaagaaccgcaacac

SEQ ID NO: 996095 - RNA, 23 nt, Mycobacterium avium subsp. paratuberculosis
gacuccaucccgugcggagaucg

SEQ ID NO: 996096 - RNA, 22 nt, Mycobacterium avium subsp. paratuberculosis
gacuccuccucggccagcccca

SEQ ID NO: 996097 - RNA, 19 nt, Mycobacterium avium subsp. paratuberculosis
gacuccucgguggccucgc

SEQ ID NO: 996098 - RNA, 22 nt, Mycobacterium avium subsp. paratuberculosis
gacucacggcggcagcgcggcg

SEQ ID NO: 996099 - RNA, 21 nt, Mycobacterium avium subsp. paratuberculosis
gacuccaccaccuggccggcc

SEQ ID NO: 996100 - RNA, 17 nt, Mycobacterium avium subsp. paratuberculosis
gacuccaccgccaccgc

SEQ ID NO: 996101 - RNA, 15 nt, Mycobacterium avium subsp. paratuberculosis
gacuccagcaccggc

SEQ ID NO: 996102 - RNA, 13 nt, Mycobacterium avium subsp. paratuberculosis
gacuccagcagcg

SEQ ID NO: 996103 - RNA, 20 nt, Mycobacterium avium subsp. paratuberculosis
gacuccagcagcgccagcac

SEQ ID NO: 996104 - RNA, 12 nt, Mycobacterium avium subsp. paratuberculosis
gacugccgagca

SEQ ID NO: 996105 - RNA, 22 nt, Mycobacterium avium subsp. paratuberculosis
gacugccggcgacgguggcgcc

SEQ ID NO: 996106 - RNA, 15 nt, Mycobacterium avium subsp. paratuberculosis
gacugcgugcugggc

SEQ ID NO: 996107 - RNA, 22 nt, Mycobacterium avium subsp. paratuberculosis
gacugcgaucgccgacgccagc

SEQ ID NO: 996108 - RNA, 17 nt, Mycobacterium avium subsp. paratuberculosis
gacugcgcaccgccagc

SEQ ID NO: 996109 - RNA, 18 nt, Mycobacterium avium subsp. paratuberculosis
gacugcgcaccgccagca

SEQ ID NO: 996110 - RNA, 22 nt, Mycobacterium avium subsp. paratuberculosis
gacugcgccggggccgcggcuc

SEQ ID NO: 996111 - RNA, 15 nt, Mycobacterium avium subsp. paratuberculosis
gacugcgcggccggc

SEQ ID NO: 996112 - RNA, 21 nt, Mycobacterium avium subsp. paratuberculosis
gacuggauggcgauggccuug

SEQ ID NO: 996113 - RNA, 18 nt, Mycobacterium avium subsp. paratuberculosis
gacuggaccgugccggaa

SEQ ID NO: 996114 - RNA, 16 nt, Mycobacterium avium subsp. paratuberculosis
gacugauccaccaucu

SEQ ID NO: 996115 - RNA, 20 nt, Mycobacterium avium subsp. paratuberculosis
gacugauccaccaucuucca

SEQ ID NO: 996116 - RNA, 17 nt, Mycobacterium avium subsp. paratuberculosis
gacucguuggccggcuc

SEQ ID NO: 996117 - RNA, 18 nt, Mycobacterium avium subsp. paratuberculosis
gacucguuggggccacca

SEQ ID NO: 996118 - RNA, 13 nt, Mycobacterium avium subsp. paratuberculosis
gacucuucuuccu

SEQ ID NO: 996119 - RNA, 20 nt, Mycobacterium avium subsp. paratuberculosis
gacguuguugucgaugaugu

SEQ ID NO: 996120 - RNA, 15 nt, Mycobacterium avium subsp. paratuberculosis
gacguuggccagcac

SEQ ID NO: 996121 - RNA, 16 nt, Mycobacterium avium subsp. paratuberculosis
gacguuggccagcacc

SEQ ID NO: 996122 - RNA, 16 nt, Mycobacterium avium subsp. paratuberculosis
gacguugaggcggcgg

SEQ ID NO: 996123 - RNA, 19 nt, Mycobacterium avium subsp. paratuberculosis
gacguucgucagcuaggaa

SEQ ID NO: 996124 - RNA, 18 nt, Mycobacterium avium subsp. paratuberculosis
gacguccuugacccggcc

SEQ ID NO: 996125 - RNA, 23 nt, Mycobacterium avium subsp. paratuberculosis
gacgucgaacccgaaaagcacca

SEQ ID NO: 996126 - RNA, 21 nt, Mycobacterium avium subsp. paratuberculosis
gacgucgacgucgagggcgcc

SEQ ID NO: 996127 - RNA, 19 nt, Mycobacterium avium subsp. paratuberculosis
gacgucgacgugggcggcc

SEQ ID NO: 996128 - RNA, 23 nt, Mycobacterium avium subsp. paratuberculosis
gacgucgacgugggcggccacca

SEQ ID NO: 996129 - RNA, 14 nt, Mycobacterium avium subsp. paratuberculosis
gacgucgacguucg

SEQ ID NO: 996130 - RNA, 19 nt, Mycobacterium avium subsp. paratuberculosis
gacgucgagaaaggccagc

SEQ ID NO: 996131 - RNA, 21 nt, Mycobacterium avium subsp. paratuberculosis
gacgucgagaaaggccagcac

SEQ ID NO: 996132 - RNA, 23 nt, Mycobacterium avium subsp. paratuberculosis
gacguccaucgggaccgcgggcg

SEQ ID NO: 996133 - RNA, 13 nt, Mycobacterium avium subsp. paratuberculosis
gacguccgagguc

SEQ ID NO: 996134 - RNA, 16 nt, Mycobacterium avium subsp. paratuberculosis
gacguccaggccggcg

SEQ ID NO: 996135 - RNA, 19 nt, Mycobacterium avium subsp. paratuberculosis
gacguccaggccggcgccg

SEQ ID NO: 996136 - RNA, 21 nt, Mycobacterium avium subsp. paratuberculosis
gacgucaggccguagcggcuc

SEQ ID NO: 996137 - RNA, 19 nt, Mycobacterium avium subsp. paratuberculosis
gacgucugguuggccggcg

SEQ ID NO: 996138 - RNA, 23 nt, Mycobacterium avium subsp. paratuberculosis
gacgucuaagucgaugccgcccc

SEQ ID NO: 996139 - RNA, 17 nt, Mycobacterium avium subsp. paratuberculosis
gacgucgucgcccaccc

SEQ ID NO: 996140 - RNA, 23 nt, Mycobacterium avium subsp. paratuberculosis
gacgucgggcacggucaggugga

SEQ ID NO: 996141 - RNA, 21 nt, Mycobacterium avium subsp. paratuberculosis
gacgucggguccgaccagcac

SEQ ID NO: 996142 - RNA, 19 nt, Mycobacterium avium subsp. paratuberculosis
gacgucgguguagcccucc

SEQ ID NO: 996143 - RNA, 16 nt, Mycobacterium avium subsp. paratuberculosis
gacgucgccggccugc

SEQ ID NO: 996144 - RNA, 14 nt, Mycobacterium avium subsp. paratuberculosis
gacgucgcccaccc

SEQ ID NO: 996145 - RNA, 15 nt, Mycobacterium avium subsp. paratuberculosis
gacgucggcgcgcuc

SEQ ID NO: 996146 - RNA, 13 nt, Mycobacterium avium subsp. paratuberculosis
gacgugggcggcc

SEQ ID NO: 996147 - RNA, 22 nt, Mycobacterium avium subsp. paratuberculosis
gacgugggcggccaccaacggc

SEQ ID NO: 996148 - RNA, 18 nt, Mycobacterium avium subsp. paratuberculosis
gacgugcuuggccagcuc

SEQ ID NO: 996149 - RNA, 20 nt, Mycobacterium avium subsp. paratuberculosis
gacguggaaauugcugacca

SEQ ID NO: 996150 - RNA, 19 nt, Mycobacterium avium subsp. paratuberculosis
gacguggcggcgguggcga

SEQ ID NO: 996151 - RNA, 13 nt, Mycobacterium avium subsp. paratuberculosis
gacgugcccuucc

SEQ ID NO: 996152 - RNA, 14 nt, Mycobacterium avium subsp. paratuberculosis
gacguggguggugg

SEQ ID NO: 996153 - RNA, 15 nt, Mycobacterium avium subsp. paratuberculosis
gacgugggugguggu

SEQ ID NO: 996154 - RNA, 21 nt, Mycobacterium avium subsp. paratuberculosis
gacguggugcaccgccagcgc

SEQ ID NO: 996155 - RNA, 16 nt, Mycobacterium avium subsp. paratuberculosis
gacgugguugcguucg

SEQ ID NO: 996156 - RNA, 21 nt, Mycobacterium avium subsp. paratuberculosis
gacgugguugcguucgccggc

SEQ ID NO: 996157 - RNA, 22 nt, Mycobacterium avium subsp. paratuberculosis
gacgugguugcguucgccggcg

SEQ ID NO: 996158 - RNA, 13 nt, Mycobacterium avium subsp. paratuberculosis
gacgugcaccacc

SEQ ID NO: 996159 - RNA, 14 nt, Mycobacterium avium subsp. paratuberculosis
gacgugcaccugca

SEQ ID NO: 996160 - RNA, 22 nt, Mycobacterium avium subsp. paratuberculosis
gacgugcaccugcagccggucg

SEQ ID NO: 996161 - RNA, 16 nt, Mycobacterium avium subsp. paratuberculosis
gacgugcacgcguucg

SEQ ID NO: 996162 - RNA, 22 nt, Mycobacterium avium subsp. paratuberculosis
gacgguuguucagcccggucag

SEQ ID NO: 996163 - RNA, 23 nt, Mycobacterium avium subsp. paratuberculosis
gacguagacgacgggcaggguga

SEQ ID NO: 996164 - RNA, 18 nt, Mycobacterium avium subsp. paratuberculosis
gacguagacgagccgguu

SEQ ID NO: 996165 - RNA, 18 nt, Mycobacterium avium subsp. paratuberculosis
gacguaggcggccagcag

SEQ ID NO: 996166 - RNA, 17 nt, Mycobacterium avium subsp. paratuberculosis
gacguagucgcugagcg

SEQ ID NO: 996167 - RNA, 13 nt, Mycobacterium avium subsp. paratuberculosis
gacggugcagccg

SEQ ID NO: 996168 - RNA, 15 nt, Mycobacterium avium subsp. paratuberculosis
gacgguggcccccac

SEQ ID NO: 996169 - RNA, 13 nt, Mycobacterium avium subsp. paratuberculosis
gacgguggccucg

SEQ ID NO: 996170 - RNA, 14 nt, Mycobacterium avium subsp. paratuberculosis
gacgguggcggcga

SEQ ID NO: 996171 - RNA, 16 nt, Mycobacterium avium subsp. paratuberculosis
gacggugcugccguug

SEQ ID NO: 996172 - RNA, 13 nt, Mycobacterium avium subsp. paratuberculosis
gacggugggcccg

SEQ ID NO: 996173 - RNA, 22 nt, Mycobacterium avium subsp. paratuberculosis
gacggugggcccgccgucgacc

SEQ ID NO: 996174 - RNA, 22 nt, Mycobacterium avium subsp. paratuberculosis
gacggucuucccgccgccgucg

SEQ ID NO: 996175 - RNA, 16 nt, Mycobacterium avium subsp. paratuberculosis
gacggucuugcggccg

SEQ ID NO: 996176 - RNA, 17 nt, Mycobacterium avium subsp. paratuberculosis
gacggugaucagggucc

SEQ ID NO: 996177 - RNA, 19 nt, Mycobacterium avium subsp. paratuberculosis
gacggugaugucgccggcg

SEQ ID NO: 996178 - RNA, 13 nt, Mycobacterium avium subsp. paratuberculosis
gacggucacgcug

SEQ ID NO: 996179 - RNA, 17 nt, Mycobacterium avium subsp. paratuberculosis
gacggucacgcuggcgu

SEQ ID NO: 996180 - RNA, 16 nt, Mycobacterium avium subsp. paratuberculosis
gacggucacggccgcc

SEQ ID NO: 996181 - RNA, 15 nt, Mycobacterium avium subsp. paratuberculosis
gacggucagcgcgcc

SEQ ID NO: 996182 - RNA, 20 nt, Mycobacterium avium subsp. paratuberculosis
gacggucaugccgagccgcu

SEQ ID NO: 996183 - RNA, 20 nt, Mycobacterium avium subsp. paratuberculosis
gacggguucgcgcagccacc

SEQ ID NO: 996184 - RNA, 19 nt, Mycobacterium avium subsp. paratuberculosis
gacggguugcaggccacgc

SEQ ID NO: 996185 - RNA, 18 nt, Mycobacterium avium subsp. paratuberculosis
gacggguugggcgccagc

SEQ ID NO: 996186 - RNA, 21 nt, Mycobacterium avium subsp. paratuberculosis
gacggguuggucggcgcggcg

SEQ ID NO: 996187 - RNA, 22 nt, Mycobacterium avium subsp. paratuberculosis
gacggcucuucggcgccgagcg

SEQ ID NO: 996188 - RNA, 17 nt, Mycobacterium avium subsp. paratuberculosis
gacggcgccgcggccgu

SEQ ID NO: 996189 - RNA, 14 nt, Mycobacterium avium subsp. paratuberculosis
gacggcguccagcu

SEQ ID NO: 996190 - RNA, 17 nt, Mycobacterium avium subsp. paratuberculosis
gacggcgucggcgagcg

SEQ ID NO: 996191 - RNA, 17 nt, Mycobacterium avium subsp. paratuberculosis
gacggcgucuuggggau

SEQ ID NO: 996192 - RNA, 16 nt, Mycobacterium avium subsp. paratuberculosis
gacggcuaccugacca

SEQ ID NO: 996193 - RNA, 22 nt, Mycobacterium avium subsp. paratuberculosis
gacggcgcuggccgcggccagc

SEQ ID NO: 996194 - RNA, 23 nt, Mycobacterium avium subsp. paratuberculosis
gacggcgcgugauccggaaugcg

SEQ ID NO: 996195 - RNA, 13 nt, Mycobacterium avium subsp. paratuberculosis
gacggcggggcgg

SEQ ID NO: 996196 - RNA, 12 nt, Mycobacterium avium subsp. paratuberculosis
gacggcggcggu

SEQ ID NO: 996197 - RNA, 15 nt, Mycobacterium avium subsp. paratuberculosis
gacgggucggcggcg

SEQ ID NO: 996198 - RNA, 23 nt, Mycobacterium avium subsp. paratuberculosis
gacgggcauccggcucagaaggc

SEQ ID NO: 996199 - RNA, 16 nt, Mycobacterium avium subsp. paratuberculosis
gacgggcaugccgucg

SEQ ID NO: 996200 - RNA, 14 nt, Mycobacterium avium subsp. paratuberculosis
gacgggccaccagc

SEQ ID NO: 996201 - RNA, 16 nt, Mycobacterium avium subsp. paratuberculosis
gacgggccgcauccgc

SEQ ID NO: 996202 - RNA, 14 nt, Mycobacterium avium subsp. paratuberculosis
gacgggccggcggg

SEQ ID NO: 996203 - RNA, 13 nt, Mycobacterium avium subsp. paratuberculosis
gacgggccgggca

SEQ ID NO: 996204 - RNA, 16 nt, Mycobacterium avium subsp. paratuberculosis
gaggaucugggcggcg

SEQ ID NO: 996205 - RNA, 17 nt, Mycobacterium avium subsp. paratuberculosis
gaggaucugggcggcgg

SEQ ID NO: 996206 - RNA, 14 nt, Mycobacterium avium subsp. paratuberculosis
gaggaugacgacgg

SEQ ID NO: 996207 - RNA, 19 nt, Mycobacterium avium subsp. paratuberculosis
gaggcaaggccuuggugug

SEQ ID NO: 996208 - RNA, 21 nt, Mycobacterium avium subsp. paratuberculosis
gaggauuucgcgaucgaggau

SEQ ID NO: 996209 - RNA, 21 nt, Mycobacterium avium subsp. paratuberculosis
gaggcacccgcugcaccagcc

SEQ ID NO: 996210 - RNA, 18 nt, Mycobacterium avium subsp. paratuberculosis
gaggcaccgaacgccagc

SEQ ID NO: 996211 - RNA, 17 nt, Mycobacterium avium subsp. paratuberculosis
gaggcaguuccaugucg

SEQ ID NO: 996212 - RNA, 20 nt, Mycobacterium avium subsp. paratuberculosis
gaggcagcgcggauuccagc

SEQ ID NO: 996213 - RNA, 23 nt, Mycobacterium avium subsp. paratuberculosis
gaggagggugucggcggggccgg

SEQ ID NO: 996214 - RNA, 13 nt, Mycobacterium avium subsp. paratuberculosis
gaggaggggucgg

SEQ ID NO: 996215 - RNA, 23 nt, Mycobacterium avium subsp. paratuberculosis
gaggaguuuuucgggguggugga

SEQ ID NO: 996216 - RNA, 23 nt, Mycobacterium avium subsp. paratuberculosis
gaggaucgcaggauggccugcac

SEQ ID NO: 996217 - RNA, 16 nt, Mycobacterium avium subsp. paratuberculosis
gaggcgagugaggacg

SEQ ID NO: 996218 - RNA, 22 nt, Mycobacterium avium subsp. paratuberculosis
gaggcgaucagguggggcagga

SEQ ID NO: 996219 - RNA, 20 nt, Mycobacterium avium subsp. paratuberculosis
gaggcgccguauuggcaggc

SEQ ID NO: 996220 - RNA, 17 nt, Mycobacterium avium subsp. paratuberculosis
gaggcgcaggaggcggc

SEQ ID NO: 996221 - RNA, 15 nt, Mycobacterium avium subsp. paratuberculosis
gaggcgcggggcgcg

SEQ ID NO: 996222 - RNA, 13 nt, Mycobacterium avium subsp. paratuberculosis
gaggccgcgggcg

SEQ ID NO: 996223 - RNA, 19 nt, Mycobacterium avium subsp. paratuberculosis
gaggccgccccggccgcgc

SEQ ID NO: 996224 - RNA, 13 nt, Mycobacterium avium subsp. paratuberculosis
gaggccgcccgcu

SEQ ID NO: 996225 - RNA, 15 nt, Mycobacterium avium subsp. paratuberculosis
gaggccgggcuggcg

SEQ ID NO: 996226 - RNA, 16 nt, Mycobacterium avium subsp. paratuberculosis
gaggccgggcuggcgc

SEQ ID NO: 996227 - RNA, 18 nt, Mycobacterium avium subsp. paratuberculosis
gaggccucgccgcuggga

SEQ ID NO: 996228 - RNA, 14 nt, Mycobacterium avium subsp. paratuberculosis
gaggccuccaggcu

SEQ ID NO: 996229 - RNA, 22 nt, Mycobacterium avium subsp. paratuberculosis
gaggccuuggugaugggcagcg

SEQ ID NO: 996230 - RNA, 14 nt, Mycobacterium avium subsp. paratuberculosis
gaggcgagcaauua

SEQ ID NO: 996231 - RNA, 22 nt, Mycobacterium avium subsp. paratuberculosis
gaggccgaggcgagugaggacg

SEQ ID NO: 996232 - RNA, 12 nt, Mycobacterium avium subsp. paratuberculosis
gaggccgagguc

SEQ ID NO: 996233 - RNA, 20 nt, Mycobacterium avium subsp. paratuberculosis
gaggcccggcgugggccgca

SEQ ID NO: 996234 - RNA, 11 nt, Mycobacterium avium subsp. paratuberculosis
gaggccaggcg

SEQ ID NO: 996235 - RNA, 19 nt, Mycobacterium avium subsp. paratuberculosis
gaggccagggcccgcagcc

SEQ ID NO: 996236 - RNA, 21 nt, Mycobacterium avium subsp. paratuberculosis
gaggccagcugcaccggggcc

SEQ ID NO: 996237 - RNA, 18 nt, Mycobacterium avium subsp. paratuberculosis
gaggcccacguugagcac

SEQ ID NO: 996238 - RNA, 15 nt, Mycobacterium avium subsp. paratuberculosis
gaggcccagcccgcc

SEQ ID NO: 996239 - RNA, 17 nt, Mycobacterium avium subsp. paratuberculosis
gaggcccagcccgccgc

SEQ ID NO: 996240 - RNA, 11 nt, Mycobacterium avium subsp. paratuberculosis
gaggccagcac

SEQ ID NO: 996241 - RNA, 22 nt, Mycobacterium avium subsp. paratuberculosis
gaggccagcacgccggucagca

SEQ ID NO: 996242 - RNA, 23 nt, Mycobacterium avium subsp. paratuberculosis
gagcuuuucgucggugcgcgccg

SEQ ID NO: 996243 - RNA, 21 nt, Mycobacterium avium subsp. paratuberculosis
gagcuucugcccggccagcag

SEQ ID NO: 996244 - RNA, 15 nt, Mycobacterium avium subsp. paratuberculosis
gagcuggccgcccac

SEQ ID NO: 996245 - RNA, 19 nt, Mycobacterium avium subsp. paratuberculosis
gagcugcuucgucgccggg

SEQ ID NO: 996246 - RNA, 22 nt, Mycobacterium avium subsp. paratuberculosis
gagcuggugggccaucgccagg

SEQ ID NO: 996247 - RNA, 15 nt, Mycobacterium avium subsp. paratuberculosis
gagcuggugcagcga

SEQ ID NO: 996248 - RNA, 13 nt, Mycobacterium avium subsp. paratuberculosis
gagcugggcggcg

SEQ ID NO: 996249 - RNA, 20 nt, Mycobacterium avium subsp. paratuberculosis
gaggaacagacucagcccgg

SEQ ID NO: 996250 - RNA, 14 nt, Mycobacterium avium subsp. paratuberculosis
gaggaagacgucga

SEQ ID NO: 996251 - RNA, 11 nt, Mycobacterium avium subsp. paratuberculosis
gagccuucuuc

SEQ ID NO: 996252 - RNA, 22 nt, Mycobacterium avium subsp. paratuberculosis
gagccuucuucgccgcaaccuu

SEQ ID NO: 996253 - RNA, 20 nt, Mycobacterium avium subsp. paratuberculosis
gagccuucuucgccgcagcc

SEQ ID NO: 996254 - RNA, 21 nt, Mycobacterium avium subsp. paratuberculosis
gagccuucuucgccgcagccu

SEQ ID NO: 996255 - RNA, 23 nt, Mycobacterium avium subsp. paratuberculosis
gagccuucuucgccgcagccuuc

SEQ ID NO: 996256 - RNA, 22 nt, Mycobacterium avium subsp. paratuberculosis
gagccuucuugaccgcagccuu

SEQ ID NO: 996257 - RNA, 23 nt, Mycobacterium avium subsp. paratuberculosis
gagccgucggcuuccuccucggc

SEQ ID NO: 996258 - RNA, 22 nt, Mycobacterium avium subsp. paratuberculosis
gagccguuugaugccguccggg

SEQ ID NO: 996259 - RNA, 20 nt, Mycobacterium avium subsp. paratuberculosis
gagccgucucggagcggugu

SEQ ID NO: 996260 - RNA, 13 nt, Mycobacterium avium subsp. paratuberculosis
gagccgugcagcg

SEQ ID NO: 996261 - RNA, 15 nt, Mycobacterium avium subsp. paratuberculosis
gagccgugcagcgcc

SEQ ID NO: 996262 - RNA, 19 nt, Mycobacterium avium subsp. paratuberculosis
gagccgucgaccggguccg

SEQ ID NO: 996263 - RNA, 20 nt, Mycobacterium avium subsp. paratuberculosis
gagcgagaugaucagccgcc

SEQ ID NO: 996264 - RNA, 18 nt, Mycobacterium avium subsp. paratuberculosis
gagccuugcuggcggccu

SEQ ID NO: 996265 - RNA, 19 nt, Mycobacterium avium subsp. paratuberculosis
gagccuugcuggcggccuu

SEQ ID NO: 996266 - RNA, 10 nt, Mycobacterium avium subsp. paratuberculosis
gagccuuggu

SEQ ID NO: 996267 - RNA, 18 nt, Mycobacterium avium subsp. paratuberculosis
gagccuuggucgcggccu

SEQ ID NO: 996268 - RNA, 19 nt, Mycobacterium avium subsp. paratuberculosis
gagccuuggucgcggccuu

SEQ ID NO: 996269 - RNA, 20 nt, Mycobacterium avium subsp. paratuberculosis
gagcgacauggucgggcgca

SEQ ID NO: 996270 - RNA, 13 nt, Mycobacterium avium subsp. paratuberculosis
gagcgcagcgggg

SEQ ID NO: 996271 - RNA, 20 nt, Mycobacterium avium subsp. paratuberculosis
gagcgcaccagauucaccag

SEQ ID NO: 996272 - RNA, 12 nt, Mycobacterium avium subsp. paratuberculosis
gagcgcaccgcc

SEQ ID NO: 996273 - RNA, 16 nt, Mycobacterium avium subsp. paratuberculosis
gagcgcagcgccaggc

SEQ ID NO: 996274 - RNA, 13 nt, Mycobacterium avium subsp. paratuberculosis
gagcgccgcggcc

SEQ ID NO: 996275 - RNA, 20 nt, Mycobacterium avium subsp. paratuberculosis
gagcgccagggucuggcccg

SEQ ID NO: 996276 - RNA, 23 nt, Mycobacterium avium subsp. paratuberculosis
gagcgcccggccagccggccgcu

SEQ ID NO: 996277 - RNA, 13 nt, Mycobacterium avium subsp. paratuberculosis
gagcgccagcgcg

SEQ ID NO: 996278 - RNA, 19 nt, Mycobacterium avium subsp. paratuberculosis
gagcgcgccgagcagcugg

SEQ ID NO: 996279 - RNA, 15 nt, Mycobacterium avium subsp. paratuberculosis
gagcgcgccgccgcc

SEQ ID NO: 996280 - RNA, 16 nt, Mycobacterium avium subsp. paratuberculosis
gagcgcgcgaucuccg

SEQ ID NO: 996281 - RNA, 23 nt, Mycobacterium avium subsp. paratuberculosis
gagcgcgcucaaccgcccagcgg

SEQ ID NO: 996282 - RNA, 16 nt, Mycobacterium avium subsp. paratuberculosis
gagcgcgucgaccagc

SEQ ID NO: 996283 - RNA, 19 nt, Mycobacterium avium subsp. paratuberculosis
gagcgcgucgaccagccgc

SEQ ID NO: 996284 - RNA, 14 nt, Mycobacterium avium subsp. paratuberculosis
gagcgcgggcaccg

SEQ ID NO: 996285 - RNA, 17 nt, Mycobacterium avium subsp. paratuberculosis
gagcgcggcgagcggca

SEQ ID NO: 996286 - RNA, 19 nt, Mycobacterium avium subsp. paratuberculosis
gagcgcgcuugggguucuu

SEQ ID NO: 996287 - RNA, 17 nt, Mycobacterium avium subsp. paratuberculosis
gagcgcggcaugccgcc

SEQ ID NO: 996288 - RNA, 22 nt, Mycobacterium avium subsp. paratuberculosis
gagcgugaacuuaacuucacgc

SEQ ID NO: 996289 - RNA, 17 nt, Mycobacterium avium subsp. paratuberculosis
gagcguucggcgcggau

SEQ ID NO: 996290 - RNA, 16 nt, Mycobacterium avium subsp. paratuberculosis
gagcguggacaccgca

SEQ ID NO: 996291 - RNA, 13 nt, Mycobacterium avium subsp. paratuberculosis
gagcggugcggcu

SEQ ID NO: 996292 - RNA, 13 nt, Mycobacterium avium subsp. paratuberculosis
gagcgucacgcug

SEQ ID NO: 996293 - RNA, 17 nt, Mycobacterium avium subsp. paratuberculosis
gagcgggucggccggcg

SEQ ID NO: 996294 - RNA, 13 nt, Mycobacterium avium subsp. paratuberculosis
gagcgggcgggcu

SEQ ID NO: 996295 - RNA, 12 nt, Mycobacterium avium subsp. paratuberculosis
gagcgggaacgc

SEQ ID NO: 996296 - RNA, 13 nt, Mycobacterium avium subsp. paratuberculosis
gagcgggccgacc

SEQ ID NO: 996297 - RNA, 14 nt, Mycobacterium avium subsp. paratuberculosis
gagcgggaucccca

SEQ ID NO: 996298 - RNA, 17 nt, Mycobacterium avium subsp. paratuberculosis
gagcggcugcuggucga

SEQ ID NO: 996299 - RNA, 23 nt, Mycobacterium avium subsp. paratuberculosis
gagcggcgacuccagcagcgcca

SEQ ID NO: 996300 - RNA, 18 nt, Mycobacterium avium subsp. paratuberculosis
gagcggcgcugcagcagc

SEQ ID NO: 996301 - RNA, 22 nt, Mycobacterium avium subsp. paratuberculosis
gagcggcccaacacgcccugca

SEQ ID NO: 996302 - RNA, 19 nt, Mycobacterium avium subsp. paratuberculosis
gagcggcccagcucgguga

SEQ ID NO: 996303 - RNA, 19 nt, Mycobacterium avium subsp. paratuberculosis
gagcggcccugcgcggccu

SEQ ID NO: 996304 - RNA, 16 nt, Mycobacterium avium subsp. paratuberculosis
gagcucgucgggugug

SEQ ID NO: 996305 - RNA, 14 nt, Mycobacterium avium subsp. paratuberculosis
gagcucgggcgcga

SEQ ID NO: 996306 - RNA, 22 nt, Mycobacterium avium subsp. paratuberculosis
gagcucugguuuuacacaccag

SEQ ID NO: 996307 - RNA, 19 nt, Mycobacterium avium subsp. paratuberculosis
gagcugaccuggcugacgg

SEQ ID NO: 996308 - RNA, 20 nt, Mycobacterium avium subsp. paratuberculosis
gagcugacgggaccgcacgc

SEQ ID NO: 996309 - RNA, 23 nt, Mycobacterium avium subsp. paratuberculosis
gagcugacgggaccgcacgccgg

SEQ ID NO: 996310 - RNA, 22 nt, Mycobacterium avium subsp. paratuberculosis
gagcugcugccgccgcagcagc

SEQ ID NO: 996311 - RNA, 23 nt, Mycobacterium avium subsp. paratuberculosis
gagcugcugccgccgcagcagcc

SEQ ID NO: 996312 - RNA, 15 nt, Mycobacterium avium subsp. paratuberculosis
gagcugccggcggcc

SEQ ID NO: 996313 - RNA, 20 nt, Mycobacterium avium subsp. paratuberculosis
gagcugccggcggccgccgg

SEQ ID NO: 996314 - RNA, 17 nt, Mycobacterium avium subsp. paratuberculosis
gagcugaucgcggccgg

SEQ ID NO: 996315 - RNA, 22 nt, Mycobacterium avium subsp. paratuberculosis
gagcugaucgcgucgacggcgc

SEQ ID NO: 996316 - RNA, 21 nt, Mycobacterium avium subsp. paratuberculosis
gagcuacugcugguagacccg

SEQ ID NO: 996317 - RNA, 23 nt, Mycobacterium avium subsp. paratuberculosis
gagcuacugcugguagacccggg

SEQ ID NO: 996318 - RNA, 17 nt, Mycobacterium avium subsp. paratuberculosis
gagcucggccaccagcg

SEQ ID NO: 996319 - RNA, 13 nt, Mycobacterium avium subsp. paratuberculosis
gagcagcaugccg

SEQ ID NO: 996320 - RNA, 22 nt, Mycobacterium avium subsp. paratuberculosis
gagcagcaugccgagcaccucc

SEQ ID NO: 996321 - RNA, 19 nt, Mycobacterium avium subsp. paratuberculosis
gagcagcccgaccaccucc

SEQ ID NO: 996322 - RNA, 23 nt, Mycobacterium avium subsp. paratuberculosis
gagcagcgggucgucgggccggg

SEQ ID NO: 996323 - RNA, 14 nt, Mycobacterium avium subsp. paratuberculosis
gagcagcgugcuga

SEQ ID NO: 996324 - RNA, 21 nt, Mycobacterium avium subsp. paratuberculosis
gagcagcgccugcugccagga

SEQ ID NO: 996325 - RNA, 22 nt, Mycobacterium avium subsp. paratuberculosis
gagcagcgccugcugccaggac

SEQ ID NO: 996326 - RNA, 14 nt, Mycobacterium avium subsp. paratuberculosis
gagcagcgcgcgcu

SEQ ID NO: 996327 - RNA, 21 nt, Mycobacterium avium subsp. paratuberculosis
gagcagcucgcggauccgcag

SEQ ID NO: 996328 - RNA, 22 nt, Mycobacterium avium subsp. paratuberculosis
gagcagcucgcggauccgcagc

SEQ ID NO: 996329 - RNA, 22 nt, Mycobacterium avium subsp. paratuberculosis
gagcagcucggucaccagcggc

SEQ ID NO: 996330 - RNA, 23 nt, Mycobacterium avium subsp. paratuberculosis
gagcagcucggucaccagcggcc

SEQ ID NO: 996331 - RNA, 16 nt, Mycobacterium avium subsp. paratuberculosis
gagcagggccagcggc

SEQ ID NO: 996332 - RNA, 17 nt, Mycobacterium avium subsp. paratuberculosis
gagcaguagacgccgcc

SEQ ID NO: 996333 - RNA, 13 nt, Mycobacterium avium subsp. paratuberculosis
gagcaggucagcc

SEQ ID NO: 996334 - RNA, 21 nt, Mycobacterium avium subsp. paratuberculosis
gagcaugcguccggucugcuc

SEQ ID NO: 996335 - RNA, 14 nt, Mycobacterium avium subsp. paratuberculosis
gagcaucacgaacc

SEQ ID NO: 996336 - RNA, 16 nt, Mycobacterium avium subsp. paratuberculosis
gagcaucuccagccgg

SEQ ID NO: 996337 - RNA, 15 nt, Mycobacterium avium subsp. paratuberculosis
gagcaucgccgagcg

SEQ ID NO: 996338 - RNA, 17 nt, Mycobacterium avium subsp. paratuberculosis
gagcauccggugccgag

SEQ ID NO: 996339 - RNA, 18 nt, Mycobacterium avium subsp. paratuberculosis
gagcauccggugccgagc

SEQ ID NO: 996340 - RNA, 14 nt, Mycobacterium avium subsp. paratuberculosis
gagcaucgggcgca

SEQ ID NO: 996341 - RNA, 20 nt, Mycobacterium avium subsp. paratuberculosis
gagccauaaaccggccggcg

SEQ ID NO: 996342 - RNA, 19 nt, Mycobacterium avium subsp. paratuberculosis
gagccagcugcgcgucggc

SEQ ID NO: 996343 - RNA, 18 nt, Mycobacterium avium subsp. paratuberculosis
gagccagcgggccgagcg

SEQ ID NO: 996344 - RNA, 13 nt, Mycobacterium avium subsp. paratuberculosis
gagcccuccagcu

SEQ ID NO: 996345 - RNA, 16 nt, Mycobacterium avium subsp. paratuberculosis
gagcccuccagcuggu

SEQ ID NO: 996346 - RNA, 23 nt, Mycobacterium avium subsp. paratuberculosis
gagccgaagaucaccgcgucggc

SEQ ID NO: 996347 - RNA, 15 nt, Mycobacterium avium subsp. paratuberculosis
gagccgacagucgcg

SEQ ID NO: 996348 - RNA, 14 nt, Mycobacterium avium subsp. paratuberculosis
gagcccgggcaggc

SEQ ID NO: 996349 - RNA, 17 nt, Mycobacterium avium subsp. paratuberculosis
gagcccgggcaggcggc

SEQ ID NO: 996350 - RNA, 15 nt, Mycobacterium avium subsp. paratuberculosis
gagcccgccggcggc

SEQ ID NO: 996351 - RNA, 17 nt, Mycobacterium avium subsp. paratuberculosis
gagcccgccggcggcga

SEQ ID NO: 996352 - RNA, 22 nt, Mycobacterium avium subsp. paratuberculosis
gagcccgaugcuggccaucgcc

SEQ ID NO: 996353 - RNA, 16 nt, Mycobacterium avium subsp. paratuberculosis
gagcccgacggcagca

SEQ ID NO: 996354 - RNA, 18 nt, Mycobacterium avium subsp. paratuberculosis
gagcccgacggcagcacc

SEQ ID NO: 996355 - RNA, 14 nt, Mycobacterium avium subsp. paratuberculosis
gagcccaccgcgcc

SEQ ID NO: 996356 - RNA, 15 nt, Mycobacterium avium subsp. paratuberculosis
gagcccaccgcgccc

SEQ ID NO: 996357 - RNA, 18 nt, Mycobacterium avium subsp. paratuberculosis
gagcccaccgcgcccagc

SEQ ID NO: 996358 - RNA, 21 nt, Mycobacterium avium subsp. paratuberculosis
gagcccaccgcgcccagcccc

SEQ ID NO: 996359 - RNA, 23 nt, Mycobacterium avium subsp. paratuberculosis
gagcccaccgcgcccagccccag

SEQ ID NO: 996360 - RNA, 14 nt, Mycobacterium avium subsp. paratuberculosis
gagcccagcgugaa

SEQ ID NO: 996361 - RNA, 21 nt, Mycobacterium avium subsp. paratuberculosis
gagcccagccgucgcaccgcc

SEQ ID NO: 996362 - RNA, 12 nt, Mycobacterium avium subsp. paratuberculosis
gagcccccaccu

SEQ ID NO: 996363 - RNA, 14 nt, Mycobacterium avium subsp. paratuberculosis
gagccgaccagcgc

SEQ ID NO: 996364 - RNA, 21 nt, Mycobacterium avium subsp. paratuberculosis
gagccgacguaaccguacggc

SEQ ID NO: 996365 - RNA, 16 nt, Mycobacterium avium subsp. paratuberculosis
gagccgagcaccaggc

SEQ ID NO: 996366 - RNA, 23 nt, Mycobacterium avium subsp. paratuberculosis
gagccgagcaccggcagcaccgc

SEQ ID NO: 996367 - RNA, 19 nt, Mycobacterium avium subsp. paratuberculosis
gagccgagcacgcagccgc

SEQ ID NO: 996368 - RNA, 13 nt, Mycobacterium avium subsp. paratuberculosis
gagccgcucccgc

SEQ ID NO: 996369 - RNA, 16 nt, Mycobacterium avium subsp. paratuberculosis
gagccgcucccgcagc

SEQ ID NO: 996370 - RNA, 18 nt, Mycobacterium avium subsp. paratuberculosis
gagccgcucccgcagcgg

SEQ ID NO: 996371 - RNA, 18 nt, Mycobacterium avium subsp. paratuberculosis
gagccgcucgcgcaccgg

SEQ ID NO: 996372 - RNA, 23 nt, Mycobacterium avium subsp. paratuberculosis
gagccgcugagcuucugcccggc

SEQ ID NO: 996373 - RNA, 13 nt, Mycobacterium avium subsp. paratuberculosis
gagccgccgagcc

SEQ ID NO: 996374 - RNA, 15 nt, Mycobacterium avium subsp. paratuberculosis
gagccgccgagccgg

SEQ ID NO: 996375 - RNA, 21 nt, Mycobacterium avium subsp. paratuberculosis
gagccgccggaucggcagcgc

SEQ ID NO: 996376 - RNA, 15 nt, Mycobacterium avium subsp. paratuberculosis
gagccgccggggcgc

SEQ ID NO: 996377 - RNA, 17 nt, Mycobacterium avium subsp. paratuberculosis
gagccgccggggcgccg

SEQ ID NO: 996378 - RNA, 16 nt, Mycobacterium avium subsp. paratuberculosis
gagccgaucgccuccg

SEQ ID NO: 996379 - RNA, 18 nt, Mycobacterium avium subsp. paratuberculosis
gagccgaugcccagcagc

SEQ ID NO: 996380 - RNA, 20 nt, Mycobacterium avium subsp. paratuberculosis
gagccgaugcccagcagcgg

SEQ ID NO: 996381 - RNA, 13 nt, Mycobacterium avium subsp. paratuberculosis
gagccgcagccgg

SEQ ID NO: 996382 - RNA, 17 nt, Mycobacterium avium subsp. paratuberculosis
gagccgcccaggcgggc

SEQ ID NO: 996383 - RNA, 15 nt, Mycobacterium avium subsp. paratuberculosis
gagccggaucggggu

SEQ ID NO: 996384 - RNA, 22 nt, Mycobacterium avium subsp. paratuberculosis
gagccggccagguugaccacca

SEQ ID NO: 996385 - RNA, 22 nt, Mycobacterium avium subsp. paratuberculosis
gagccggcccggggugugcccg

SEQ ID NO: 996386 - RNA, 15 nt, Mycobacterium avium subsp. paratuberculosis
gagccggcgcaccgc

SEQ ID NO: 996387 - RNA, 18 nt, Mycobacterium avium subsp. paratuberculosis
gagccggcgcacucccgc

SEQ ID NO: 996388 - RNA, 23 nt, Mycobacterium avium subsp. paratuberculosis
gagccgggccaauuacgcugcgg

SEQ ID NO: 996389 - RNA, 14 nt, Mycobacterium avium subsp. paratuberculosis
gagccgggccgggu

SEQ ID NO: 996390 - RNA, 22 nt, Mycobacterium avium subsp. paratuberculosis
gagccggcguacccgcccaugc

SEQ ID NO: 996391 - RNA, 24 nt, Mycobacterium avium subsp. paratuberculosis
gagccggcguuauuugugcgcugg

SEQ ID NO: 996392 - RNA, 22 nt, Mycobacterium avium subsp. paratuberculosis
gagccggugguuuugcggcccu

SEQ ID NO: 996393 - RNA, 20 nt, Mycobacterium avium subsp. paratuberculosis
gagccgguugacccucagca

SEQ ID NO: 996394 - RNA, 21 nt, Mycobacterium avium subsp. paratuberculosis
gagccggucgaacgccagcgc

SEQ ID NO: 996395 - RNA, 16 nt, Mycobacterium avium subsp. paratuberculosis
gagccggugccgaggc

SEQ ID NO: 996396 - RNA, 23 nt, Mycobacterium avium subsp. paratuberculosis
gagccggugccgaggcaguucca

SEQ ID NO: 996397 - RNA, 23 nt, Mycobacterium avium subsp. paratuberculosis
gagccgguacggcucgugggugg

SEQ ID NO: 996398 - RNA, 16 nt, Mycobacterium avium subsp. paratuberculosis
gagccggucugggcga

SEQ ID NO: 996399 - RNA, 22 nt, Mycobacterium avium subsp. paratuberculosis
gagagugcaacuagcgacggcc

SEQ ID NO: 996400 - RNA, 17 nt, Mycobacterium avium subsp. paratuberculosis
gagagucgcuggcgcgc

SEQ ID NO: 996401 - RNA, 14 nt, Mycobacterium avium subsp. paratuberculosis
gagaguaucgccac

SEQ ID NO: 996402 - RNA, 22 nt, Mycobacterium avium subsp. paratuberculosis
gagaucaccggcuuggcgguga

SEQ ID NO: 996403 - RNA, 17 nt, Mycobacterium avium subsp. paratuberculosis
gagaucagcaccaggug

SEQ ID NO: 996404 - RNA, 12 nt, Mycobacterium avium subsp. paratuberculosis
gagauaggggca

SEQ ID NO: 996405 - RNA, 15 nt, Mycobacterium avium subsp. paratuberculosis
gagauaggggcaggg

SEQ ID NO: 996406 - RNA, 20 nt, Mycobacterium avium subsp. paratuberculosis
gagaucccugcgcucagcac

SEQ ID NO: 996407 - RNA, 17 nt, Mycobacterium avium subsp. paratuberculosis
gagaucagcaccgggug

SEQ ID NO: 996408 - RNA, 15 nt, Mycobacterium avium subsp. paratuberculosis
gagaucagggugcuc

SEQ ID NO: 996409 - RNA, 22 nt, Mycobacterium avium subsp. paratuberculosis
gagaucagggugcucagccgca

SEQ ID NO: 996410 - RNA, 13 nt, Mycobacterium avium subsp. paratuberculosis
gagaugcccaccc

SEQ ID NO: 996411 - RNA, 14 nt, Mycobacterium avium subsp. paratuberculosis
gagauucugcagcc

SEQ ID NO: 996412 - RNA, 17 nt, Mycobacterium avium subsp. paratuberculosis
gagauucugcagccgca

SEQ ID NO: 996413 - RNA, 15 nt, Mycobacterium avium subsp. paratuberculosis
gagaucggcgagugc

SEQ ID NO: 996414 - RNA, 16 nt, Mycobacterium avium subsp. paratuberculosis
gagaucgcgguggcgc

SEQ ID NO: 996415 - RNA, 23 nt, Mycobacterium avium subsp. paratuberculosis
gagaucgcgguggcgcccgcggu

SEQ ID NO: 996416 - RNA, 14 nt, Mycobacterium avium subsp. paratuberculosis
gagaucgguuggcu

SEQ ID NO: 996417 - RNA, 22 nt, Mycobacterium avium subsp. paratuberculosis
gagaugaagacccggccgugga

SEQ ID NO: 996418 - RNA, 22 nt, Mycobacterium avium subsp. paratuberculosis
gagaucccagcgggacagcacc

SEQ ID NO: 996419 - RNA, 16 nt, Mycobacterium avium subsp. paratuberculosis
gagaugauggccgcgc

SEQ ID NO: 996420 - RNA, 15 nt, Mycobacterium avium subsp. paratuberculosis
gagaugccgggaagc

SEQ ID NO: 996421 - RNA, 14 nt, Mycobacterium avium subsp. paratuberculosis
gagcaacaccucgg

SEQ ID NO: 996422 - RNA, 22 nt, Mycobacterium avium subsp. paratuberculosis
gagcaaauccggcagcgcucgu

SEQ ID NO: 996423 - RNA, 19 nt, Mycobacterium avium subsp. paratuberculosis
gagcaauuaaccggcaggc

SEQ ID NO: 996424 - RNA, 20 nt, Mycobacterium avium subsp. paratuberculosis
gagcaauuaaccggcaggcc

SEQ ID NO: 996425 - RNA, 18 nt, Mycobacterium avium subsp. paratuberculosis
gagcacacccagcgagcc

SEQ ID NO: 996426 - RNA, 11 nt, Mycobacterium avium subsp. paratuberculosis
gagcaccacca

SEQ ID NO: 996427 - RNA, 20 nt, Mycobacterium avium subsp. paratuberculosis
gagcaccacggcccgcgccc

SEQ ID NO: 996428 - RNA, 21 nt, Mycobacterium avium subsp. paratuberculosis
gagcaccggaucgaccaacuc

SEQ ID NO: 996429 - RNA, 19 nt, Mycobacterium avium subsp. paratuberculosis
gagcaccggcagcaccgcc

SEQ ID NO: 996430 - RNA, 14 nt, Mycobacterium avium subsp. paratuberculosis
gagcaccggcagcc

SEQ ID NO: 996431 - RNA, 20 nt, Mycobacterium avium subsp. paratuberculosis
gagcaccggcagccgcagcg

SEQ ID NO: 996432 - RNA, 18 nt, Mycobacterium avium subsp. paratuberculosis
gagcaccccggcggccgc

SEQ ID NO: 996433 - RNA, 20 nt, Mycobacterium avium subsp. paratuberculosis
gagcaccccggcggccgcgu

SEQ ID NO: 996434 - RNA, 20 nt, Mycobacterium avium subsp. paratuberculosis
gagcaccccgucgagcagcc

SEQ ID NO: 996435 - RNA, 23 nt, Mycobacterium avium subsp. paratuberculosis
gagcaccccgucgagcagccgca

SEQ ID NO: 996436 - RNA, 17 nt, Mycobacterium avium subsp. paratuberculosis
gagcaccgaaaccuuga

SEQ ID NO: 996437 - RNA, 20 nt, Mycobacterium avium subsp. paratuberculosis
gagcacgcagccgcgcccga

SEQ ID NO: 996438 - RNA, 18 nt, Mycobacterium avium subsp. paratuberculosis
gagcaccgggaacagcca

SEQ ID NO: 996439 - RNA, 20 nt, Mycobacterium avium subsp. paratuberculosis
gagcaccgggcgucggggcc

SEQ ID NO: 996440 - RNA, 22 nt, Mycobacterium avium subsp. paratuberculosis
gagcaccgggcugucgggcagg

SEQ ID NO: 996441 - RNA, 21 nt, Mycobacterium avium subsp. paratuberculosis
gagcaccuccgacaucaggcc

SEQ ID NO: 996442 - RNA, 13 nt, Mycobacterium avium subsp. paratuberculosis
gagcaccgcgcuc

SEQ ID NO: 996443 - RNA, 17 nt, Mycobacterium avium subsp. paratuberculosis
gagcacggcucguccau

SEQ ID NO: 996444 - RNA, 13 nt, Mycobacterium avium subsp. paratuberculosis
gagcacgggauga

SEQ ID NO: 996445 - RNA, 19 nt, Mycobacterium avium subsp. paratuberculosis
gagcacgggaugaucggcg

SEQ ID NO: 996446 - RNA, 20 nt, Mycobacterium avium subsp. paratuberculosis
gagcacggugaucagcagca

SEQ ID NO: 996447 - RNA, 19 nt, Mycobacterium avium subsp. paratuberculosis
gagcacggugggcgccggg

SEQ ID NO: 996448 - RNA, 20 nt, Mycobacterium avium subsp. paratuberculosis
gagcacggugggcgccgggu

SEQ ID NO: 996449 - RNA, 15 nt, Mycobacterium avium subsp. paratuberculosis
gagcacgcccugcgg

SEQ ID NO: 996450 - RNA, 14 nt, Mycobacterium avium subsp. paratuberculosis
gagcacgcggccgc

SEQ ID NO: 996451 - RNA, 18 nt, Mycobacterium avium subsp. paratuberculosis
gagcagaucgggucccag

SEQ ID NO: 996452 - RNA, 14 nt, Mycobacterium avium subsp. paratuberculosis
gagcagacccgccg

SEQ ID NO: 996453 - RNA, 24 nt, Mycobacterium avium subsp. paratuberculosis
gagcagcaccacccgcaccucgcc

SEQ ID NO: 996454 - RNA, 22 nt, Mycobacterium avium subsp. paratuberculosis
gagcagcaccgcgacccaggcc

SEQ ID NO: 996455 - RNA, 14 nt, Mycobacterium avium subsp. paratuberculosis
gagcagcagccgca

SEQ ID NO: 996456 - RNA, 19 nt, Mycobacterium avium subsp. paratuberculosis
gagugggugaaggccugga

SEQ ID NO: 996457 - RNA, 15 nt, Mycobacterium avium subsp. paratuberculosis
gaguggucaggccca

SEQ ID NO: 996458 - RNA, 22 nt, Mycobacterium avium subsp. paratuberculosis
gaguguguacacagggcggcga

SEQ ID NO: 996459 - RNA, 15 nt, Mycobacterium avium subsp. paratuberculosis
gaguuugcccucguc

SEQ ID NO: 996460 - RNA, 13 nt, Mycobacterium avium subsp. paratuberculosis
gagugaccgccag

SEQ ID NO: 996461 - RNA, 20 nt, Mycobacterium avium subsp. paratuberculosis
gagugaccgccagcaccgcg

SEQ ID NO: 996462 - RNA, 13 nt, Mycobacterium avium subsp. paratuberculosis
gagucgaucgcca

SEQ ID NO: 996463 - RNA, 19 nt, Mycobacterium avium subsp. paratuberculosis
gagucgaucgccagcgcgc

SEQ ID NO: 996464 - RNA, 22 nt, Mycobacterium avium subsp. paratuberculosis
gaguccgggccgccggccgcgg

SEQ ID NO: 996465 - RNA, 20 nt, Mycobacterium avium subsp. paratuberculosis
gagucgacgcugugcgccuu

SEQ ID NO: 996466 - RNA, 22 nt, Mycobacterium avium subsp. paratuberculosis
gaguaggcgccgccgcgcaggc

SEQ ID NO: 996467 - RNA, 20 nt, Mycobacterium avium subsp. paratuberculosis
gaguaggugcccgagcugau

SEQ ID NO: 996468 - RNA, 20 nt, Mycobacterium avium subsp. paratuberculosis
gaguccgcggaggcgagcag

SEQ ID NO: 996469 - RNA, 15 nt, Mycobacterium avium subsp. paratuberculosis
gaguccuugaccuug

SEQ ID NO: 996470 - RNA, 18 nt, Mycobacterium avium subsp. paratuberculosis
gaguaccgacgagaucag

SEQ ID NO: 996471 - RNA, 13 nt, Mycobacterium avium subsp. paratuberculosis
gaguacucggugu

SEQ ID NO: 996472 - RNA, 23 nt, Mycobacterium avium subsp. paratuberculosis
gaguacucgguguagagcaccuc

SEQ ID NO: 996473 - RNA, 22 nt, Mycobacterium avium subsp. paratuberculosis
gaguaaggccgaggcgagugag

SEQ ID NO: 996474 - RNA, 23 nt, Mycobacterium avium subsp. paratuberculosis
gaguaaccggugcgcuccaaggu

SEQ ID NO: 996475 - RNA, 15 nt, Mycobacterium avium subsp. paratuberculosis
gaguaacacgugggc

SEQ ID NO: 996476 - RNA, 14 nt, Mycobacterium avium subsp. paratuberculosis
gaggucggugaggc

SEQ ID NO: 996477 - RNA, 15 nt, Mycobacterium avium subsp. paratuberculosis
gaggucuucgguccc

SEQ ID NO: 996478 - RNA, 15 nt, Mycobacterium avium subsp. paratuberculosis
gaggucgcgcagcac

SEQ ID NO: 996479 - RNA, 23 nt, Mycobacterium avium subsp. paratuberculosis
gaggucggacgccucccccaccc

SEQ ID NO: 996480 - RNA, 22 nt, Mycobacterium avium subsp. paratuberculosis
gaggucgggauacucguccucc

SEQ ID NO: 996481 - RNA, 16 nt, Mycobacterium avium subsp. paratuberculosis
gagguaggcgagauca

SEQ ID NO: 996482 - RNA, 21 nt, Mycobacterium avium subsp. paratuberculosis
gaggucgaaccacgcggcggc

SEQ ID NO: 996483 - RNA, 23 nt, Mycobacterium avium subsp. paratuberculosis
gaggucagcggcccgaucaccag

SEQ ID NO: 996484 - RNA, 12 nt, Mycobacterium avium subsp. paratuberculosis
gaggugaagccg

SEQ ID NO: 996485 - RNA, 13 nt, Mycobacterium avium subsp. paratuberculosis
gaggugaucgcca

SEQ ID NO: 996486 - RNA, 15 nt, Mycobacterium avium subsp. paratuberculosis
gaggugaucgccagc

SEQ ID NO: 996487 - RNA, 16 nt, Mycobacterium avium subsp. paratuberculosis
gagguggcugggcgcu

SEQ ID NO: 996488 - RNA, 13 nt, Mycobacterium avium subsp. paratuberculosis
gaggugugaggag

SEQ ID NO: 996489 - RNA, 15 nt, Mycobacterium avium subsp. paratuberculosis
gaggugugaggaguc

SEQ ID NO: 996490 - RNA, 24 nt, Mycobacterium avium subsp. paratuberculosis
gaggugguccgcgaaauugauagc

SEQ ID NO: 996491 - RNA, 22 nt, Mycobacterium avium subsp. paratuberculosis
gaggcguugcgucccgcgccgg

SEQ ID NO: 996492 - RNA, 14 nt, Mycobacterium avium subsp. paratuberculosis
gaggcggguaggcg

SEQ ID NO: 996493 - RNA, 17 nt, Mycobacterium avium subsp. paratuberculosis
gaggcgggugaggacgc

SEQ ID NO: 996494 - RNA, 14 nt, Mycobacterium avium subsp. paratuberculosis
gaggcguccuccuc

SEQ ID NO: 996495 - RNA, 13 nt, Mycobacterium avium subsp. paratuberculosis
gagggccagcagc

SEQ ID NO: 996496 - RNA, 20 nt, Mycobacterium avium subsp. paratuberculosis
gaggcugugggccagcagcg

SEQ ID NO: 996497 - RNA, 15 nt, Mycobacterium avium subsp. paratuberculosis
gagggaccuccagcg

SEQ ID NO: 996498 - RNA, 14 nt, Mycobacterium avium subsp. paratuberculosis
gagguacugcagca

SEQ ID NO: 996499 - RNA, 17 nt, Mycobacterium avium subsp. paratuberculosis
gagguacugcagcaguc

SEQ ID NO: 996500 - RNA, 22 nt, Mycobacterium avium subsp. paratuberculosis
gagggguccggggcacgguggg

SEQ ID NO: 996501 - RNA, 18 nt, Mycobacterium avium subsp. paratuberculosis
gagggucgguggcccagc

SEQ ID NO: 996502 - RNA, 21 nt, Mycobacterium avium subsp. paratuberculosis
gagggugaugucgcugccgcc

SEQ ID NO: 996503 - RNA, 15 nt, Mycobacterium avium subsp. paratuberculosis
gagggcggggcagca

SEQ ID NO: 996504 - RNA, 13 nt, Mycobacterium avium subsp. paratuberculosis
gagggcgccguug

SEQ ID NO: 996505 - RNA, 12 nt, Mycobacterium avium subsp. paratuberculosis
gagggcgcggcg

SEQ ID NO: 996506 - RNA, 13 nt, Mycobacterium avium subsp. paratuberculosis
gagggcgcggcgu

SEQ ID NO: 996507 - RNA, 20 nt, Mycobacterium avium subsp. paratuberculosis
gagggcgcggcguagccgcc

SEQ ID NO: 996508 - RNA, 22 nt, Mycobacterium avium subsp. paratuberculosis
gagggcgacgaugccggccggg

SEQ ID NO: 996509 - RNA, 14 nt, Mycobacterium avium subsp. paratuberculosis
gagggccagcagcc

SEQ ID NO: 996510 - RNA, 22 nt, Mycobacterium avium subsp. paratuberculosis
gagggccgaacgauggugugca

SEQ ID NO: 996511 - RNA, 19 nt, Mycobacterium avium subsp. paratuberculosis
gagggccuccaccaccaug

SEQ ID NO: 996512 - RNA, 14 nt, Mycobacterium avium subsp. paratuberculosis
gauaccggccggcg

SEQ ID NO: 996513 - RNA, 15 nt, Mycobacterium avium subsp. paratuberculosis
gauaccggccagcac

SEQ ID NO: 996514 - RNA, 17 nt, Mycobacterium avium subsp. paratuberculosis
gauaccggcccagcgcg

SEQ ID NO: 996515 - RNA, 15 nt, Mycobacterium avium subsp. paratuberculosis
gauacuccucgguga

SEQ ID NO: 996516 - RNA, 15 nt, Mycobacterium avium subsp. paratuberculosis
gauaguucgccgccg

SEQ ID NO: 996517 - RNA, 22 nt, Mycobacterium avium subsp. paratuberculosis
gauaguucgccgccgccagcac

SEQ ID NO: 996518 - RNA, 17 nt, Mycobacterium avium subsp. paratuberculosis
gauccagguggggcacg

SEQ ID NO: 996519 - RNA, 21 nt, Mycobacterium avium subsp. paratuberculosis
gauccagguggggcacgggcg

SEQ ID NO: 996520 - RNA, 19 nt, Mycobacterium avium subsp. paratuberculosis
gaucaugcgcgucauggcc

SEQ ID NO: 996521 - RNA, 17 nt, Mycobacterium avium subsp. paratuberculosis
gaucaugaagucgcgga

SEQ ID NO: 996522 - RNA, 19 nt, Mycobacterium avium subsp. paratuberculosis
gauccagcgcuggccggcc

SEQ ID NO: 996523 - RNA, 12 nt, Mycobacterium avium subsp. paratuberculosis
gauccagcggcg

SEQ ID NO: 996524 - RNA, 13 nt, Mycobacterium avium subsp. paratuberculosis
gaucauccaggug

SEQ ID NO: 996525 - RNA, 14 nt, Mycobacterium avium subsp. paratuberculosis
gaucacgaagaacu

SEQ ID NO: 996526 - RNA, 19 nt, Mycobacterium avium subsp. paratuberculosis
gaucaccuugcggccggcg

SEQ ID NO: 996527 - RNA, 15 nt, Mycobacterium avium subsp. paratuberculosis
gaucacgcggcggga

SEQ ID NO: 996528 - RNA, 14 nt, Mycobacterium avium subsp. paratuberculosis
gaucagagcgggcc

SEQ ID NO: 996529 - RNA, 18 nt, Mycobacterium avium subsp. paratuberculosis
gaucagacccagcgucag

SEQ ID NO: 996530 - RNA, 21 nt, Mycobacterium avium subsp. paratuberculosis
gaucaucaccaccgccgccga

SEQ ID NO: 996531 - RNA, 16 nt, Mycobacterium avium subsp. paratuberculosis
gaucagcaccggguga

SEQ ID NO: 996532 - RNA, 21 nt, Mycobacterium avium subsp. paratuberculosis
gaucagcaccagguggcccga

SEQ ID NO: 996533 - RNA, 13 nt, Mycobacterium avium subsp. paratuberculosis
gaucagcagcacc

SEQ ID NO: 996534 - RNA, 14 nt, Mycobacterium avium subsp. paratuberculosis
gaucagcagcaccg

SEQ ID NO: 996535 - RNA, 11 nt, Mycobacterium avium subsp. paratuberculosis
gaucagcagca

SEQ ID NO: 996536 - RNA, 17 nt, Mycobacterium avium subsp. paratuberculosis
gaucaaaucccgcagcu

SEQ ID NO: 996537 - RNA, 15 nt, Mycobacterium avium subsp. paratuberculosis
gaucaccaggcccag

SEQ ID NO: 996538 - RNA, 22 nt, Mycobacterium avium subsp. paratuberculosis
gaucacccgggucgagcggccc

SEQ ID NO: 996539 - RNA, 23 nt, Mycobacterium avium subsp. paratuberculosis
gaucaccacggucagggccagca

SEQ ID NO: 996540 - RNA, 15 nt, Mycobacterium avium subsp. paratuberculosis
gaucaccagaccggg

SEQ ID NO: 996541 - RNA, 15 nt, Mycobacterium avium subsp. paratuberculosis
gaucaccgccagcgc

SEQ ID NO: 996542 - RNA, 16 nt, Mycobacterium avium subsp. paratuberculosis
gaucaccgcugccacg

SEQ ID NO: 996543 - RNA, 19 nt, Mycobacterium avium subsp. paratuberculosis
gaucaccgugaucgccacc

SEQ ID NO: 996544 - RNA, 23 nt, Mycobacterium avium subsp. paratuberculosis
gaucaccuggugcucgcgcucgu

SEQ ID NO: 996545 - RNA, 14 nt, Mycobacterium avium subsp. paratuberculosis
gaucuucucgcugc

SEQ ID NO: 996546 - RNA, 18 nt, Mycobacterium avium subsp. paratuberculosis
gaucuggugggcgggcac

SEQ ID NO: 996547 - RNA, 15 nt, Mycobacterium avium subsp. paratuberculosis
gaucuggucggccag

SEQ ID NO: 996548 - RNA, 19 nt, Mycobacterium avium subsp. paratuberculosis
gaucugucgcgcucagugc

SEQ ID NO: 996549 - RNA, 13 nt, Mycobacterium avium subsp. paratuberculosis
gaucuggcccugg

SEQ ID NO: 996550 - RNA, 14 nt, Mycobacterium avium subsp. paratuberculosis
gaucuggcccuggc

SEQ ID NO: 996551 - RNA, 23 nt, Mycobacterium avium subsp. paratuberculosis
gaucugcucgaugcggcccuggu

SEQ ID NO: 996552 - RNA, 18 nt, Mycobacterium avium subsp. paratuberculosis
gaucuuugcauacagcag

SEQ ID NO: 996553 - RNA, 18 nt, Mycobacterium avium subsp. paratuberculosis
gaucuuggcgagcugacc

SEQ ID NO: 996554 - RNA, 14 nt, Mycobacterium avium subsp. paratuberculosis
gaucuugugcucga

SEQ ID NO: 996555 - RNA, 15 nt, Mycobacterium avium subsp. paratuberculosis
gaucuugugccagcc

SEQ ID NO: 996556 - RNA, 18 nt, Mycobacterium avium subsp. paratuberculosis
gaugaaaccccagccggc

SEQ ID NO: 996557 - RNA, 18 nt, Mycobacterium avium subsp. paratuberculosis
gaucucaccggcggcggc

SEQ ID NO: 996558 - RNA, 21 nt, Mycobacterium avium subsp. paratuberculosis
gaucuccagcagcuucaugcc

SEQ ID NO: 996559 - RNA, 18 nt, Mycobacterium avium subsp. paratuberculosis
gaucuccagcggccgggc

SEQ ID NO: 996560 - RNA, 19 nt, Mycobacterium avium subsp. paratuberculosis
gaucucccggguggccucc

SEQ ID NO: 996561 - RNA, 21 nt, Mycobacterium avium subsp. paratuberculosis
gaucguugaugucgguggugu

SEQ ID NO: 996562 - RNA, 23 nt, Mycobacterium avium subsp. paratuberculosis
gaucccgaaaccgucgaccaggg

SEQ ID NO: 996563 - RNA, 18 nt, Mycobacterium avium subsp. paratuberculosis
gaucccgaacugccgcgc

SEQ ID NO: 996564 - RNA, 19 nt, Mycobacterium avium subsp. paratuberculosis
gaucccgaggaugccgccc

SEQ ID NO: 996565 - RNA, 13 nt, Mycobacterium avium subsp. paratuberculosis
gauccccgcagcu

SEQ ID NO: 996566 - RNA, 17 nt, Mycobacterium avium subsp. paratuberculosis
gaucuccucgcgcggca

SEQ ID NO: 996567 - RNA, 18 nt, Mycobacterium avium subsp. paratuberculosis
gaucucgucgaugacgau

SEQ ID NO: 996568 - RNA, 16 nt, Mycobacterium avium subsp. paratuberculosis
gaucucgucgcgcagc

SEQ ID NO: 996569 - RNA, 22 nt, Mycobacterium avium subsp. paratuberculosis
gaucucgucggcggcggccugc

SEQ ID NO: 996570 - RNA, 16 nt, Mycobacterium avium subsp. paratuberculosis
gaucucgucgggcacc

SEQ ID NO: 996571 - RNA, 20 nt, Mycobacterium avium subsp. paratuberculosis
gaucucgugccgcacccgau

SEQ ID NO: 996572 - RNA, 19 nt, Mycobacterium avium subsp. paratuberculosis
gaucucguagguggccagc

SEQ ID NO: 996573 - RNA, 16 nt, Mycobacterium avium subsp. paratuberculosis
gaucucggucgccagc

SEQ ID NO: 996574 - RNA, 18 nt, Mycobacterium avium subsp. paratuberculosis
gaucucggucgccagcac

SEQ ID NO: 996575 - RNA, 19 nt, Mycobacterium avium subsp. paratuberculosis
gaucucggucgccagcacc

SEQ ID NO: 996576 - RNA, 14 nt, Mycobacterium avium subsp. paratuberculosis
gaucucgccgagca

SEQ ID NO: 996577 - RNA, 14 nt, Mycobacterium avium subsp. paratuberculosis
gaucucgccgagcg

SEQ ID NO: 996578 - RNA, 11 nt, Mycobacterium avium subsp. paratuberculosis
gaucugcaggc

SEQ ID NO: 996579 - RNA, 20 nt, Mycobacterium avium subsp. paratuberculosis
gaucugcacgucggcggccg

SEQ ID NO: 996580 - RNA, 22 nt, Mycobacterium avium subsp. paratuberculosis
gaucucuucgaugccgguggcc

SEQ ID NO: 996581 - RNA, 13 nt, Mycobacterium avium subsp. paratuberculosis
gaugacgcgcuug

SEQ ID NO: 996582 - RNA, 15 nt, Mycobacterium avium subsp. paratuberculosis
gaugacggcggcggu

SEQ ID NO: 996583 - RNA, 20 nt, Mycobacterium avium subsp. paratuberculosis
gaugacgccggacagcuggc

SEQ ID NO: 996584 - RNA, 19 nt, Mycobacterium avium subsp. paratuberculosis
gaugacgucgucgcggcgc

SEQ ID NO: 996585 - RNA, 16 nt, Mycobacterium avium subsp. paratuberculosis
gaugacgugcaccacc

SEQ ID NO: 996586 - RNA, 19 nt, Mycobacterium avium subsp. paratuberculosis
gaugaacucgugcggcgcc

SEQ ID NO: 996587 - RNA, 23 nt, Mycobacterium avium subsp. paratuberculosis
gaugaacgccucgagcgcccggg

SEQ ID NO: 996588 - RNA, 19 nt, Mycobacterium avium subsp. paratuberculosis
gaugaaggucgcggacugg

SEQ ID NO: 996589 - RNA, 22 nt, Mycobacterium avium subsp. paratuberculosis
gaugaccgacauggccagcacc

SEQ ID NO: 996590 - RNA, 23 nt, Mycobacterium avium subsp. paratuberculosis
gaugaccgacauggccagcacca

SEQ ID NO: 996591 - RNA, 16 nt, Mycobacterium avium subsp. paratuberculosis
gaugaccgcccaggac

SEQ ID NO: 996592 - RNA, 17 nt, Mycobacterium avium subsp. paratuberculosis
gaugaccucgcgcagcc

SEQ ID NO: 996593 - RNA, 20 nt, Mycobacterium avium subsp. paratuberculosis
gaugaccucgcgcagccccc

SEQ ID NO: 996594 - RNA, 21 nt, Mycobacterium avium subsp. paratuberculosis
gaugauguucuccggcccggc

SEQ ID NO: 996595 - RNA, 18 nt, Mycobacterium avium subsp. paratuberculosis
gaugaugucgcccggcgg

SEQ ID NO: 996596 - RNA, 16 nt, Mycobacterium avium subsp. paratuberculosis
gaugaugucggcggcc

SEQ ID NO: 996597 - RNA, 21 nt, Mycobacterium avium subsp. paratuberculosis
gaugcacaaccgcugcugcug

SEQ ID NO: 996598 - RNA, 20 nt, Mycobacterium avium subsp. paratuberculosis
gaugcacuucgcuguaguag

SEQ ID NO: 996599 - RNA, 15 nt, Mycobacterium avium subsp. paratuberculosis
gaugcagaacagccg

SEQ ID NO: 996600 - RNA, 15 nt, Mycobacterium avium subsp. paratuberculosis
gaugcagaucaccac

SEQ ID NO: 996601 - RNA, 21 nt, Mycobacterium avium subsp. paratuberculosis
gaugcacggucggccccgcgc

SEQ ID NO: 996602 - RNA, 22 nt, Mycobacterium avium subsp. paratuberculosis
gaugcacggucggccccgcgca

SEQ ID NO: 996603 - RNA, 22 nt, Mycobacterium avium subsp. paratuberculosis
gaugcugauacccgcgcggcgc

SEQ ID NO: 996604 - RNA, 22 nt, Mycobacterium avium subsp. paratuberculosis
gaugcugcccggcgccacgcac

SEQ ID NO: 996605 - RNA, 17 nt, Mycobacterium avium subsp. paratuberculosis
gaugcugcgggucagca

SEQ ID NO: 996606 - RNA, 20 nt, Mycobacterium avium subsp. paratuberculosis
gaugcugcgggucagcagcu

SEQ ID NO: 996607 - RNA, 14 nt, Mycobacterium avium subsp. paratuberculosis
gaugcggcccagcc

SEQ ID NO: 996608 - RNA, 15 nt, Mycobacterium avium subsp. paratuberculosis
gaugcggcccagccc

SEQ ID NO: 996609 - RNA, 16 nt, Mycobacterium avium subsp. paratuberculosis
gaugcggcaccagccc

SEQ ID NO: 996610 - RNA, 23 nt, Mycobacterium avium subsp. paratuberculosis
gaugcggccguuggccuugauuc

SEQ ID NO: 996611 - RNA, 14 nt, Mycobacterium avium subsp. paratuberculosis
gauggccugcacgg

SEQ ID NO: 996612 - RNA, 15 nt, Mycobacterium avium subsp. paratuberculosis
gauggcgaaccagcg

SEQ ID NO: 996613 - RNA, 20 nt, Mycobacterium avium subsp. paratuberculosis
gauggcgaaccagcgcccgc

SEQ ID NO: 996614 - RNA, 23 nt, Mycobacterium avium subsp. paratuberculosis
gauggccugguggcccaggcaga

SEQ ID NO: 996615 - RNA, 13 nt, Mycobacterium avium subsp. paratuberculosis
gauggccaccauc

SEQ ID NO: 996616 - RNA, 12 nt, Mycobacterium avium subsp. paratuberculosis
gauggccagcac

SEQ ID NO: 996617 - RNA, 15 nt, Mycobacterium avium subsp. paratuberculosis
gauggccagcgcggc

SEQ ID NO: 996618 - RNA, 20 nt, Mycobacterium avium subsp. paratuberculosis
gauggcccgggccacacccg

SEQ ID NO: 996619 - RNA, 18 nt, Mycobacterium avium subsp. paratuberculosis
gauggccauggccaggaa

SEQ ID NO: 996620 - RNA, 14 nt, Mycobacterium avium subsp. paratuberculosis
gauggccaggccca

SEQ ID NO: 996621 - RNA, 19 nt, Mycobacterium avium subsp. paratuberculosis
gauggccagguaguggugg

SEQ ID NO: 996622 - RNA, 20 nt, Mycobacterium avium subsp. paratuberculosis
gaugcccgacaccgccccgc

SEQ ID NO: 996623 - RNA, 21 nt, Mycobacterium avium subsp. paratuberculosis
gaugcccgccccggacaucca

SEQ ID NO: 996624 - RNA, 22 nt, Mycobacterium avium subsp. paratuberculosis
gaugcccgccccggacauccau

SEQ ID NO: 996625 - RNA, 21 nt, Mycobacterium avium subsp. paratuberculosis
gaugcccgcgccgaccagcgc

SEQ ID NO: 996626 - RNA, 18 nt, Mycobacterium avium subsp. paratuberculosis
gaugccgcgcugcgccgg

SEQ ID NO: 996627 - RNA, 13 nt, Mycobacterium avium subsp. paratuberculosis
gaugccgggcucc

SEQ ID NO: 996628 - RNA, 14 nt, Mycobacterium avium subsp. paratuberculosis
gaugccggccagcc

SEQ ID NO: 996629 - RNA, 16 nt, Mycobacterium avium subsp. paratuberculosis
gaugccggccagcggc

SEQ ID NO: 996630 - RNA, 21 nt, Mycobacterium avium subsp. paratuberculosis
gaugccggccaggcacagcag

SEQ ID NO: 996631 - RNA, 23 nt, Mycobacterium avium subsp. paratuberculosis
gaugccguagcgcaugaugccca

SEQ ID NO: 996632 - RNA, 18 nt, Mycobacterium avium subsp. paratuberculosis
gaugccggcgcccagcgg

SEQ ID NO: 996633 - RNA, 13 nt, Mycobacterium avium subsp. paratuberculosis
gaugcccagcgcg

SEQ ID NO: 996634 - RNA, 16 nt, Mycobacterium avium subsp. paratuberculosis
gaugcccagcaccacu

SEQ ID NO: 996635 - RNA, 15 nt, Mycobacterium avium subsp. paratuberculosis
gaugcccagggcgcg

SEQ ID NO: 996636 - RNA, 13 nt, Mycobacterium avium subsp. paratuberculosis
gaugcccagcccc

SEQ ID NO: 996637 - RNA, 22 nt, Mycobacterium avium subsp. paratuberculosis
gaugcccaggcccaccagcugg

SEQ ID NO: 996638 - RNA, 17 nt, Mycobacterium avium subsp. paratuberculosis
gaugcgcgguaacagag

SEQ ID NO: 996639 - RNA, 23 nt, Mycobacterium avium subsp. paratuberculosis
gaugcgcgguaacagagcgggau

SEQ ID NO: 996640 - RNA, 20 nt, Mycobacterium avium subsp. paratuberculosis
gaugcggaugcccgccggcg

SEQ ID NO: 996641 - RNA, 13 nt, Mycobacterium avium subsp. paratuberculosis
gaugcgcuggugc

SEQ ID NO: 996642 - RNA, 15 nt, Mycobacterium avium subsp. paratuberculosis
gaugccugcccagcg

SEQ ID NO: 996643 - RNA, 17 nt, Mycobacterium avium subsp. paratuberculosis
gaugccugcccagcggc

SEQ ID NO: 996644 - RNA, 16 nt, Mycobacterium avium subsp. paratuberculosis
gaugccugcccgcgca

SEQ ID NO: 996645 - RNA, 17 nt, Mycobacterium avium subsp. paratuberculosis
gaugccgugccggugga

SEQ ID NO: 996646 - RNA, 20 nt, Mycobacterium avium subsp. paratuberculosis
gaugccgugcgcgcuggugc

SEQ ID NO: 996647 - RNA, 22 nt, Mycobacterium avium subsp. paratuberculosis
gauuucaucgcggcgacccgcu

SEQ ID NO: 996648 - RNA, 17 nt, Mycobacterium avium subsp. paratuberculosis
gauuucgaagcugucgc

SEQ ID NO: 996649 - RNA, 14 nt, Mycobacterium avium subsp. paratuberculosis
gauuucggccagcc

SEQ ID NO: 996650 - RNA, 17 nt, Mycobacterium avium subsp. paratuberculosis
gauuucggccagccggg

SEQ ID NO: 996651 - RNA, 19 nt, Mycobacterium avium subsp. paratuberculosis
gauugucgcuguuagccuc

SEQ ID NO: 996652 - RNA, 21 nt, Mycobacterium avium subsp. paratuberculosis
gauucguucgugagcgguggc

SEQ ID NO: 996653 - RNA, 14 nt, Mycobacterium avium subsp. paratuberculosis
gauucgcggcggcg

SEQ ID NO: 996654 - RNA, 22 nt, Mycobacterium avium subsp. paratuberculosis
gauucgcggcggcgccgcagca

SEQ ID NO: 996655 - RNA, 23 nt, Mycobacterium avium subsp. paratuberculosis
gauucgaucaaaucccgcagcuc

SEQ ID NO: 996656 - RNA, 14 nt, Mycobacterium avium subsp. paratuberculosis
gauucaccagcgcc

SEQ ID NO: 996657 - RNA, 19 nt, Mycobacterium avium subsp. paratuberculosis
gauucccaugucgcgggcg

SEQ ID NO: 996658 - RNA, 20 nt, Mycobacterium avium subsp. paratuberculosis
gauucccgaccccgccagca

SEQ ID NO: 996659 - RNA, 23 nt, Mycobacterium avium subsp. paratuberculosis
gauucccggaugcugcgggucag

SEQ ID NO: 996660 - RNA, 20 nt, Mycobacterium avium subsp. paratuberculosis
gauguugccccgcgagagaa

SEQ ID NO: 996661 - RNA, 20 nt, Mycobacterium avium subsp. paratuberculosis
gauguugaccacccgcagcg

SEQ ID NO: 996662 - RNA, 15 nt, Mycobacterium avium subsp. paratuberculosis
gauguugcggcggcc

SEQ ID NO: 996663 - RNA, 17 nt, Mycobacterium avium subsp. paratuberculosis
gaugucggcgaaccagg

SEQ ID NO: 996664 - RNA, 17 nt, Mycobacterium avium subsp. paratuberculosis
gaugucggugggccgca

SEQ ID NO: 996665 - RNA, 15 nt, Mycobacterium avium subsp. paratuberculosis
gaugucggugguggg

SEQ ID NO: 996666 - RNA, 14 nt, Mycobacterium avium subsp. paratuberculosis
gaugucggugugca

SEQ ID NO: 996667 - RNA, 20 nt, Mycobacterium avium subsp. paratuberculosis
gaugucggugugcagcagcu

SEQ ID NO: 996668 - RNA, 16 nt, Mycobacterium avium subsp. paratuberculosis
gaugucgucgccggug

SEQ ID NO: 996669 - RNA, 20 nt, Mycobacterium avium subsp. paratuberculosis
gaugucgcggcgcacggugc

SEQ ID NO: 996670 - RNA, 17 nt, Mycobacterium avium subsp. paratuberculosis
gauggcuguggaugacg

SEQ ID NO: 996671 - RNA, 15 nt, Mycobacterium avium subsp. paratuberculosis
gauggcucagcgcac

SEQ ID NO: 996672 - RNA, 17 nt, Mycobacterium avium subsp. paratuberculosis
gauggcguucugcaccg

SEQ ID NO: 996673 - RNA, 21 nt, Mycobacterium avium subsp. paratuberculosis
gaugugcucggucaacccgau

SEQ ID NO: 996674 - RNA, 20 nt, Mycobacterium avium subsp. paratuberculosis
gaugugcgcgcuggccgcgu

SEQ ID NO: 996675 - RNA, 13 nt, Mycobacterium avium subsp. paratuberculosis
gaugugggccgca

SEQ ID NO: 996676 - RNA, 16 nt, Mycobacterium avium subsp. paratuberculosis
gaugugggccgcagca

SEQ ID NO: 996677 - RNA, 14 nt, Mycobacterium avium subsp. paratuberculosis
gauguggccggcga

SEQ ID NO: 996678 - RNA, 14 nt, Mycobacterium avium subsp. paratuberculosis
gaugugggugguca

SEQ ID NO: 996679 - RNA, 16 nt, Mycobacterium avium subsp. paratuberculosis
gaugugaugggucugc

SEQ ID NO: 996680 - RNA, 15 nt, Mycobacterium avium subsp. paratuberculosis
gcagggcggccggcc

SEQ ID NO: 996681 - RNA, 14 nt, Mycobacterium avium subsp. paratuberculosis
gcagggggcgcagc

SEQ ID NO: 996682 - RNA, 17 nt, Mycobacterium avium subsp. paratuberculosis
gcaggguuuucacgucg

SEQ ID NO: 996683 - RNA, 17 nt, Mycobacterium avium subsp. paratuberculosis
gcaggguggccagcacc

SEQ ID NO: 996684 - RNA, 14 nt, Mycobacterium avium subsp. paratuberculosis
gcaggguccgccgu

SEQ ID NO: 996685 - RNA, 23 nt, Mycobacterium avium subsp. paratuberculosis
gcagguacugcuugccgccgggc

SEQ ID NO: 996686 - RNA, 14 nt, Mycobacterium avium subsp. paratuberculosis
gcagguccguggug

SEQ ID NO: 996687 - RNA, 19 nt, Mycobacterium avium subsp. paratuberculosis
gcagguccacccgccccgc

SEQ ID NO: 996688 - RNA, 20 nt, Mycobacterium avium subsp. paratuberculosis
gcagguccacccgccccgcc

SEQ ID NO: 996689 - RNA, 16 nt, Mycobacterium avium subsp. paratuberculosis
gcagguucuccuccca

SEQ ID NO: 996690 - RNA, 19 nt, Mycobacterium avium subsp. paratuberculosis
gcagguguccagcccuacc

SEQ ID NO: 996691 - RNA, 12 nt, Mycobacterium avium subsp. paratuberculosis
gcaggugcucgc

SEQ ID NO: 996692 - RNA, 17 nt, Mycobacterium avium subsp. paratuberculosis
gcaggugcucgccggcg

SEQ ID NO: 996693 - RNA, 21 nt, Mycobacterium avium subsp. paratuberculosis
gcaguuccaugucgacgacgu

SEQ ID NO: 996694 - RNA, 23 nt, Mycobacterium avium subsp. paratuberculosis
gcaguuccucgccggaguucagc

SEQ ID NO: 996695 - RNA, 18 nt, Mycobacterium avium subsp. paratuberculosis
gcaguucgaugccgggca

SEQ ID NO: 996696 - RNA, 20 nt, Mycobacterium avium subsp. paratuberculosis
gcaguuguuccagucccagu

SEQ ID NO: 996697 - RNA, 18 nt, Mycobacterium avium subsp. paratuberculosis
gcagucuuguugaccuuc

SEQ ID NO: 996698 - RNA, 20 nt, Mycobacterium avium subsp. paratuberculosis
gcagucuuguugaccuucuc

SEQ ID NO: 996699 - RNA, 17 nt, Mycobacterium avium subsp. paratuberculosis
gcagcgagcacagcggc

SEQ ID NO: 996700 - RNA, 19 nt, Mycobacterium avium subsp. paratuberculosis
gcagcgagcacagcggcgg

SEQ ID NO: 996701 - RNA, 20 nt, Mycobacterium avium subsp. paratuberculosis
gcagcgacuugaccagcagc

SEQ ID NO: 996702 - RNA, 14 nt, Mycobacterium avium subsp. paratuberculosis
gcagcgacucgggc

SEQ ID NO: 996703 - RNA, 15 nt, Mycobacterium avium subsp. paratuberculosis
gcagcgugggcaccg

SEQ ID NO: 996704 - RNA, 22 nt, Mycobacterium avium subsp. paratuberculosis
gcagcgugucccgguacagguc

SEQ ID NO: 996705 - RNA, 21 nt, Mycobacterium avium subsp. paratuberculosis
gcagcgaggccucgccgcugg

SEQ ID NO: 996706 - RNA, 19 nt, Mycobacterium avium subsp. paratuberculosis
gcagcuccggucggcgcuc

SEQ ID NO: 996707 - RNA, 16 nt, Mycobacterium avium subsp. paratuberculosis
gcagcucagccgccug

SEQ ID NO: 996708 - RNA, 19 nt, Mycobacterium avium subsp. paratuberculosis
gcagcucauacagcggcgc

SEQ ID NO: 996709 - RNA, 14 nt, Mycobacterium avium subsp. paratuberculosis
gcagcucgccggcg

SEQ ID NO: 996710 - RNA, 22 nt, Mycobacterium avium subsp. paratuberculosis
gcagcucgccggcgcgcagcca

SEQ ID NO: 996711 - RNA, 19 nt, Mycobacterium avium subsp. paratuberculosis
gcagcucgcgcagcuggcc

SEQ ID NO: 996712 - RNA, 15 nt, Mycobacterium avium subsp. paratuberculosis
gcagcucggcgggcu

SEQ ID NO: 996713 - RNA, 13 nt, Mycobacterium avium subsp. paratuberculosis
gcagcucgggguc

SEQ ID NO: 996714 - RNA, 14 nt, Mycobacterium avium subsp. paratuberculosis
gcaggaaguagccc

SEQ ID NO: 996715 - RNA, 15 nt, Mycobacterium avium subsp. paratuberculosis
gcaggaauuccagcg

SEQ ID NO: 996716 - RNA, 18 nt, Mycobacterium avium subsp. paratuberculosis
gcaggaauuccagcgaca

SEQ ID NO: 996717 - RNA, 22 nt, Mycobacterium avium subsp. paratuberculosis
gcaggacccggugcccaccguc

SEQ ID NO: 996718 - RNA, 16 nt, Mycobacterium avium subsp. paratuberculosis
gcaggaccgagccgcg

SEQ ID NO: 996719 - RNA, 19 nt, Mycobacterium avium subsp. paratuberculosis
gcaggaccgagccgcgcgc

SEQ ID NO: 996720 - RNA, 17 nt, Mycobacterium avium subsp. paratuberculosis
gcaggaacuccagcagc

SEQ ID NO: 996721 - RNA, 19 nt, Mycobacterium avium subsp. paratuberculosis
gcaggaacuccagcagcug

SEQ ID NO: 996722 - RNA, 15 nt, Mycobacterium avium subsp. paratuberculosis
gcaggaacgccuugg

SEQ ID NO: 996723 - RNA, 20 nt, Mycobacterium avium subsp. paratuberculosis
gcaggaagcgaauccgggug

SEQ ID NO: 996724 - RNA, 13 nt, Mycobacterium avium subsp. paratuberculosis
gcagcuguuccug

SEQ ID NO: 996725 - RNA, 22 nt, Mycobacterium avium subsp. paratuberculosis
gcagcugggacagcgucaccaa

SEQ ID NO: 996726 - RNA, 20 nt, Mycobacterium avium subsp. paratuberculosis
gcaggaacaaccgcagcggc

SEQ ID NO: 996727 - RNA, 20 nt, Mycobacterium avium subsp. paratuberculosis
gcaggaaccgggucagcacc

SEQ ID NO: 996728 - RNA, 22 nt, Mycobacterium avium subsp. paratuberculosis
gcaggaaccgggucagcaccac

SEQ ID NO: 996729 - RNA, 13 nt, Mycobacterium avium subsp. paratuberculosis
gcaggcuggucug

SEQ ID NO: 996730 - RNA, 16 nt, Mycobacterium avium subsp. paratuberculosis
gcaggcuggucuggug

SEQ ID NO: 996731 - RNA, 14 nt, Mycobacterium avium subsp. paratuberculosis
gcaggcgccgcagc

SEQ ID NO: 996732 - RNA, 14 nt, Mycobacterium avium subsp. paratuberculosis
gcaggcgcccagga

SEQ ID NO: 996733 - RNA, 14 nt, Mycobacterium avium subsp. paratuberculosis
gcaggcgccccagc

SEQ ID NO: 996734 - RNA, 14 nt, Mycobacterium avium subsp. paratuberculosis
gcaggcgccggucg

SEQ ID NO: 996735 - RNA, 18 nt, Mycobacterium avium subsp. paratuberculosis
gcaggcggaccugggugc

SEQ ID NO: 996736 - RNA, 19 nt, Mycobacterium avium subsp. paratuberculosis
gcaggcgcgccgagcgcug

SEQ ID NO: 996737 - RNA, 22 nt, Mycobacterium avium subsp. paratuberculosis
gcaggcgcgccgagcgcugguu

SEQ ID NO: 996738 - RNA, 17 nt, Mycobacterium avium subsp. paratuberculosis
gcaggcggcgcgcagcc

SEQ ID NO: 996739 - RNA, 14 nt, Mycobacterium avium subsp. paratuberculosis
gcaggaucggcuug

SEQ ID NO: 996740 - RNA, 20 nt, Mycobacterium avium subsp. paratuberculosis
gcaggaugaugaccgacaug

SEQ ID NO: 996741 - RNA, 15 nt, Mycobacterium avium subsp. paratuberculosis
gcaggaugccgaugu

SEQ ID NO: 996742 - RNA, 19 nt, Mycobacterium avium subsp. paratuberculosis
gcaggaugccgaugucgga

SEQ ID NO: 996743 - RNA, 17 nt, Mycobacterium avium subsp. paratuberculosis
gcaggccgcggccgucg

SEQ ID NO: 996744 - RNA, 14 nt, Mycobacterium avium subsp. paratuberculosis
gcaggccgcgggug

SEQ ID NO: 996745 - RNA, 17 nt, Mycobacterium avium subsp. paratuberculosis
gcaggccgcggguggcg

SEQ ID NO: 996746 - RNA, 23 nt, Mycobacterium avium subsp. paratuberculosis
gcaggccgcggguggcgccacag

SEQ ID NO: 996747 - RNA, 21 nt, Mycobacterium avium subsp. paratuberculosis
gcaggccgggauagagcaccg

SEQ ID NO: 996748 - RNA, 14 nt, Mycobacterium avium subsp. paratuberculosis
gcaggccguccagc

SEQ ID NO: 996749 - RNA, 17 nt, Mycobacterium avium subsp. paratuberculosis
gcaggccguccagcagc

SEQ ID NO: 996750 - RNA, 21 nt, Mycobacterium avium subsp. paratuberculosis
gcaggauggccugcacggugc

SEQ ID NO: 996751 - RNA, 16 nt, Mycobacterium avium subsp. paratuberculosis
gcaggccgcccggccc

SEQ ID NO: 996752 - RNA, 19 nt, Mycobacterium avium subsp. paratuberculosis
gcaggccgaagaacucagc

SEQ ID NO: 996753 - RNA, 18 nt, Mycobacterium avium subsp. paratuberculosis
gcagcaauugacgccgac

SEQ ID NO: 996754 - RNA, 16 nt, Mycobacterium avium subsp. paratuberculosis
gcagcaaccggcggcu

SEQ ID NO: 996755 - RNA, 17 nt, Mycobacterium avium subsp. paratuberculosis
gcagcaacggcggcggc

SEQ ID NO: 996756 - RNA, 23 nt, Mycobacterium avium subsp. paratuberculosis
gcagcaacgguacgugcgccggc

SEQ ID NO: 996757 - RNA, 14 nt, Mycobacterium avium subsp. paratuberculosis
gcagcaagagcagg

SEQ ID NO: 996758 - RNA, 15 nt, Mycobacterium avium subsp. paratuberculosis
gcagcaagagcaggc

SEQ ID NO: 996759 - RNA, 18 nt, Mycobacterium avium subsp. paratuberculosis
gcagcaacucgcgcuccc

SEQ ID NO: 996760 - RNA, 19 nt, Mycobacterium avium subsp. paratuberculosis
gcagcagcucgauggaccg

SEQ ID NO: 996761 - RNA, 16 nt, Mycobacterium avium subsp. paratuberculosis
gcagcagcugcacccg

SEQ ID NO: 996762 - RNA, 17 nt, Mycobacterium avium subsp. paratuberculosis
gcagcagcugcgucggc

SEQ ID NO: 996763 - RNA, 15 nt, Mycobacterium avium subsp. paratuberculosis
gcagcagcgcggugc

SEQ ID NO: 996764 - RNA, 21 nt, Mycobacterium avium subsp. paratuberculosis
gcagcagcgcggugccgaccu

SEQ ID NO: 996765 - RNA, 21 nt, Mycobacterium avium subsp. paratuberculosis
gcagcaccucgcgcgcgagcc

SEQ ID NO: 996766 - RNA, 14 nt, Mycobacterium avium subsp. paratuberculosis
gcagcagcgcggca

SEQ ID NO: 996767 - RNA, 16 nt, Mycobacterium avium subsp. paratuberculosis
gcagcagaaccagcac

SEQ ID NO: 996768 - RNA, 18 nt, Mycobacterium avium subsp. paratuberculosis
gcagcagaccgccggugc

SEQ ID NO: 996769 - RNA, 19 nt, Mycobacterium avium subsp. paratuberculosis
gcagcagaccgccggugcg

SEQ ID NO: 996770 - RNA, 21 nt, Mycobacterium avium subsp. paratuberculosis
gcagcacguccccgggcaccc

SEQ ID NO: 996771 - RNA, 19 nt, Mycobacterium avium subsp. paratuberculosis
gcagcacgccgcggaaggc

SEQ ID NO: 996772 - RNA, 22 nt, Mycobacterium avium subsp. paratuberculosis
gcagcacgcugaagcccaccgc

SEQ ID NO: 996773 - RNA, 20 nt, Mycobacterium avium subsp. paratuberculosis
gcagcacggcaaugguugcg

SEQ ID NO: 996774 - RNA, 15 nt, Mycobacterium avium subsp. paratuberculosis
gcagcacgcccagcc

SEQ ID NO: 996775 - RNA, 21 nt, Mycobacterium avium subsp. paratuberculosis
gcagcacgcccagcccgcggg

SEQ ID NO: 996776 - RNA, 18 nt, Mycobacterium avium subsp. paratuberculosis
gcagcaccuugccggucg

SEQ ID NO: 996777 - RNA, 19 nt, Mycobacterium avium subsp. paratuberculosis
gcagaucgcggcccgccgc

SEQ ID NO: 996778 - RNA, 16 nt, Mycobacterium avium subsp. paratuberculosis
gcagauccucagcagc

SEQ ID NO: 996779 - RNA, 18 nt, Mycobacterium avium subsp. paratuberculosis
gcagaucgauggggaugg

SEQ ID NO: 996780 - RNA, 21 nt, Mycobacterium avium subsp. paratuberculosis
gcagaucgggucccagaugcg

SEQ ID NO: 996781 - RNA, 21 nt, Mycobacterium avium subsp. paratuberculosis
gcagaugcccgcugacaaagc

SEQ ID NO: 996782 - RNA, 15 nt, Mycobacterium avium subsp. paratuberculosis
gcagaugccgcccag

SEQ ID NO: 996783 - RNA, 12 nt, Mycobacterium avium subsp. paratuberculosis
gcagaucaccac

SEQ ID NO: 996784 - RNA, 14 nt, Mycobacterium avium subsp. paratuberculosis
gcagaucaccacgg

SEQ ID NO: 996785 - RNA, 15 nt, Mycobacterium avium subsp. paratuberculosis
gcagaucccgccggc

SEQ ID NO: 996786 - RNA, 20 nt, Mycobacterium avium subsp. paratuberculosis
gcagaucccgccggcggcca

SEQ ID NO: 996787 - RNA, 18 nt, Mycobacterium avium subsp. paratuberculosis
gcagauacaucucggugg

SEQ ID NO: 996788 - RNA, 15 nt, Mycobacterium avium subsp. paratuberculosis
gcagauagcccagcc

SEQ ID NO: 996789 - RNA, 12 nt, Mycobacterium avium subsp. paratuberculosis
gcagccuucuuc

SEQ ID NO: 996790 - RNA, 14 nt, Mycobacterium avium subsp. paratuberculosis
gcagccuucuucgc

SEQ ID NO: 996791 - RNA, 19 nt, Mycobacterium avium subsp. paratuberculosis
gcagccuucuucgccgggg

SEQ ID NO: 996792 - RNA, 20 nt, Mycobacterium avium subsp. paratuberculosis
gcagccuucuucgccggggc

SEQ ID NO: 996793 - RNA, 19 nt, Mycobacterium avium subsp. paratuberculosis
gcagccuucuuggcgggcg

SEQ ID NO: 996794 - RNA, 18 nt, Mycobacterium avium subsp. paratuberculosis
gcagccuuuccacaucug

SEQ ID NO: 996795 - RNA, 15 nt, Mycobacterium avium subsp. paratuberculosis
gcagcgaacgcggcu

SEQ ID NO: 996796 - RNA, 16 nt, Mycobacterium avium subsp. paratuberculosis
gcagcgaacgcggcug

SEQ ID NO: 996797 - RNA, 22 nt, Mycobacterium avium subsp. paratuberculosis
gcagcgaauacaccguccagcu

SEQ ID NO: 996798 - RNA, 19 nt, Mycobacterium avium subsp. paratuberculosis
gcagcgaacccgccagggc

SEQ ID NO: 996799 - RNA, 23 nt, Mycobacterium avium subsp. paratuberculosis
gcagcgacaaucggcucgccuca

SEQ ID NO: 996800 - RNA, 14 nt, Mycobacterium avium subsp. paratuberculosis
gcagccgguccggc

SEQ ID NO: 996801 - RNA, 16 nt, Mycobacterium avium subsp. paratuberculosis
gcagccgguccggcgg

SEQ ID NO: 996802 - RNA, 17 nt, Mycobacterium avium subsp. paratuberculosis
gcagccgcgagucgagg

SEQ ID NO: 996803 - RNA, 19 nt, Mycobacterium avium subsp. paratuberculosis
gcagccgcaccucggggcg

SEQ ID NO: 996804 - RNA, 21 nt, Mycobacterium avium subsp. paratuberculosis
gcagccgcaccucggggcgug

SEQ ID NO: 996805 - RNA, 12 nt, Mycobacterium avium subsp. paratuberculosis
gcagccgcacac

SEQ ID NO: 996806 - RNA, 20 nt, Mycobacterium avium subsp. paratuberculosis
gcagccgcacaccgcggcgg

SEQ ID NO: 996807 - RNA, 21 nt, Mycobacterium avium subsp. paratuberculosis
gcagccgggggcggugcagcc

SEQ ID NO: 996808 - RNA, 16 nt, Mycobacterium avium subsp. paratuberculosis
gcagccgggggucggc

SEQ ID NO: 996809 - RNA, 20 nt, Mycobacterium avium subsp. paratuberculosis
gcagccgggggucggcuucc

SEQ ID NO: 996810 - RNA, 14 nt, Mycobacterium avium subsp. paratuberculosis
gcagccgggugccc

SEQ ID NO: 996811 - RNA, 19 nt, Mycobacterium avium subsp. paratuberculosis
gcagccgggugcggugcag

SEQ ID NO: 996812 - RNA, 21 nt, Mycobacterium avium subsp. paratuberculosis
gcagccgggugcggugcagcc

SEQ ID NO: 996813 - RNA, 21 nt, Mycobacterium avium subsp. paratuberculosis
gcagccggguggcccgcccgg

SEQ ID NO: 996814 - RNA, 22 nt, Mycobacterium avium subsp. paratuberculosis
gcagccgcgccaccgcggggcu

SEQ ID NO: 996815 - RNA, 20 nt, Mycobacterium avium subsp. paratuberculosis
gcagccgcgccgacgcccac

SEQ ID NO: 996816 - RNA, 16 nt, Mycobacterium avium subsp. paratuberculosis
gcagccgcgccgccgc

SEQ ID NO: 996817 - RNA, 18 nt, Mycobacterium avium subsp. paratuberculosis
gcagccgccgcggagcgg

SEQ ID NO: 996818 - RNA, 20 nt, Mycobacterium avium subsp. paratuberculosis
gcagccgccgcggagcggcg

SEQ ID NO: 996819 - RNA, 15 nt, Mycobacterium avium subsp. paratuberculosis
gcagccgccgggcca

SEQ ID NO: 996820 - RNA, 18 nt, Mycobacterium avium subsp. paratuberculosis
gcagcagggugccgccgc

SEQ ID NO: 996821 - RNA, 18 nt, Mycobacterium avium subsp. paratuberculosis
gcagcagguaaaccagca

SEQ ID NO: 996822 - RNA, 17 nt, Mycobacterium avium subsp. paratuberculosis
gcagccacgagcccagc

SEQ ID NO: 996823 - RNA, 22 nt, Mycobacterium avium subsp. paratuberculosis
gcagcagggcgcgcaucugcuc

SEQ ID NO: 996824 - RNA, 13 nt, Mycobacterium avium subsp. paratuberculosis
gcagccagcccag

SEQ ID NO: 996825 - RNA, 14 nt, Mycobacterium avium subsp. paratuberculosis
gcagccagcccagc

SEQ ID NO: 996826 - RNA, 15 nt, Mycobacterium avium subsp. paratuberculosis
gcagccagcccagcc

SEQ ID NO: 996827 - RNA, 20 nt, Mycobacterium avium subsp. paratuberculosis
gcagccagccuggcggcgac

SEQ ID NO: 996828 - RNA, 22 nt, Mycobacterium avium subsp. paratuberculosis
gcagccagccuggcggcgaccc

SEQ ID NO: 996829 - RNA, 12 nt, Mycobacterium avium subsp. paratuberculosis
gcagccaggaca

SEQ ID NO: 996830 - RNA, 17 nt, Mycobacterium avium subsp. paratuberculosis
gcagccaggacagcguc

SEQ ID NO: 996831 - RNA, 16 nt, Mycobacterium avium subsp. paratuberculosis
gcagccagucgccggc

SEQ ID NO: 996832 - RNA, 22 nt, Mycobacterium avium subsp. paratuberculosis
gcagccagucgccggccaggcc

SEQ ID NO: 996833 - RNA, 17 nt, Mycobacterium avium subsp. paratuberculosis
gcagcccagccagcgac

SEQ ID NO: 996834 - RNA, 17 nt, Mycobacterium avium subsp. paratuberculosis
gcagcccaggcccagca

SEQ ID NO: 996835 - RNA, 22 nt, Mycobacterium avium subsp. paratuberculosis
gcagcccaggcccagcagcacc

SEQ ID NO: 996836 - RNA, 21 nt, Mycobacterium avium subsp. paratuberculosis
gcacuuucgcggucagccggc

SEQ ID NO: 996837 - RNA, 16 nt, Mycobacterium avium subsp. paratuberculosis
gcacuucgaucaucuc

SEQ ID NO: 996838 - RNA, 14 nt, Mycobacterium avium subsp. paratuberculosis
gcacgcggccgcgc

SEQ ID NO: 996839 - RNA, 20 nt, Mycobacterium avium subsp. paratuberculosis
gcacgcggaucgcgcugacc

SEQ ID NO: 996840 - RNA, 18 nt, Mycobacterium avium subsp. paratuberculosis
gcagaaaaaggccgccgc

SEQ ID NO: 996841 - RNA, 22 nt, Mycobacterium avium subsp. paratuberculosis
gcagaacagccgguccgaccgc

SEQ ID NO: 996842 - RNA, 19 nt, Mycobacterium avium subsp. paratuberculosis
gcagaacuucuccgccggc

SEQ ID NO: 996843 - RNA, 20 nt, Mycobacterium avium subsp. paratuberculosis
gcagacacaaaagcgcccga

SEQ ID NO: 996844 - RNA, 19 nt, Mycobacterium avium subsp. paratuberculosis
gcagacccgguggccgagg

SEQ ID NO: 996845 - RNA, 22 nt, Mycobacterium avium subsp. paratuberculosis
gcagacccagcagcggccggcg

SEQ ID NO: 996846 - RNA, 18 nt, Mycobacterium avium subsp. paratuberculosis
gcagacccgacgggaacu

SEQ ID NO: 996847 - RNA, 13 nt, Mycobacterium avium subsp. paratuberculosis
gcagacccgccgc

SEQ ID NO: 996848 - RNA, 15 nt, Mycobacterium avium subsp. paratuberculosis
gcagacccgccgcgg

SEQ ID NO: 996849 - RNA, 17 nt, Mycobacterium avium subsp. paratuberculosis
gcagaccgaacccgggc

SEQ ID NO: 996850 - RNA, 20 nt, Mycobacterium avium subsp. paratuberculosis
gcagaccgaacccgggcgcg

SEQ ID NO: 996851 - RNA, 23 nt, Mycobacterium avium subsp. paratuberculosis
gcagaccguccgguucggcggca

SEQ ID NO: 996852 - RNA, 16 nt, Mycobacterium avium subsp. paratuberculosis
gcagaggcguuuucgg

SEQ ID NO: 996853 - RNA, 11 nt, Mycobacterium avium subsp. paratuberculosis
gcaccagcacg

SEQ ID NO: 996854 - RNA, 24 nt, Mycobacterium avium subsp. paratuberculosis
gcaccagcacggcgaccagcgagc

SEQ ID NO: 996855 - RNA, 22 nt, Mycobacterium avium subsp. paratuberculosis
gcaccaccacguugcgcggccg

SEQ ID NO: 996856 - RNA, 19 nt, Mycobacterium avium subsp. paratuberculosis
gcaccagcaacaccagggu

SEQ ID NO: 996857 - RNA, 10 nt, Mycobacterium avium subsp. paratuberculosis
gcaccagcag

SEQ ID NO: 996858 - RNA, 18 nt, Mycobacterium avium subsp. paratuberculosis
gcaccagcaccccgccgc

SEQ ID NO: 996859 - RNA, 21 nt, Mycobacterium avium subsp. paratuberculosis
gcaccagcaccccgccgcagc

SEQ ID NO: 996860 - RNA, 11 nt, Mycobacterium avium subsp. paratuberculosis
gcaccagcagc

SEQ ID NO: 996861 - RNA, 11 nt, Mycobacterium avium subsp. paratuberculosis
gcaccagcagg

SEQ ID NO: 996862 - RNA, 18 nt, Mycobacterium avium subsp. paratuberculosis
gcaccagcagccgcagcg

SEQ ID NO: 996863 - RNA, 22 nt, Mycobacterium avium subsp. paratuberculosis
gcaccagcagcgcgacgccgac

SEQ ID NO: 996864 - RNA, 14 nt, Mycobacterium avium subsp. paratuberculosis
gcaccagcaggccc

SEQ ID NO: 996865 - RNA, 16 nt, Mycobacterium avium subsp. paratuberculosis
gcaccaccacgcuggc

SEQ ID NO: 996866 - RNA, 18 nt, Mycobacterium avium subsp. paratuberculosis
gcaccaccacgguggcgc

SEQ ID NO: 996867 - RNA, 22 nt, Mycobacterium avium subsp. paratuberculosis
gcaccaccacgguggcgccggc

SEQ ID NO: 996868 - RNA, 19 nt, Mycobacterium avium subsp. paratuberculosis
gcaccaccacacccagcgc

SEQ ID NO: 996869 - RNA, 22 nt, Mycobacterium avium subsp. paratuberculosis
gcaccaccacacccagcgccag

SEQ ID NO: 996870 - RNA, 21 nt, Mycobacterium avium subsp. paratuberculosis
gcaccaugaucaggccccacc

SEQ ID NO: 996871 - RNA, 22 nt, Mycobacterium avium subsp. paratuberculosis
gcaccaugaucaggccccaccc

SEQ ID NO: 996872 - RNA, 16 nt, Mycobacterium avium subsp. paratuberculosis
gcaccauugcgggaag

SEQ ID NO: 996873 - RNA, 15 nt, Mycobacterium avium subsp. paratuberculosis
gcaccauccagugca

SEQ ID NO: 996874 - RNA, 19 nt, Mycobacterium avium subsp. paratuberculosis
gcaccauccgcgacgccag

SEQ ID NO: 996875 - RNA, 13 nt, Mycobacterium avium subsp. paratuberculosis
gcaccauccgcgc

SEQ ID NO: 996876 - RNA, 18 nt, Mycobacterium avium subsp. paratuberculosis
gcaccagcccggccagcg

SEQ ID NO: 996877 - RNA, 18 nt, Mycobacterium avium subsp. paratuberculosis
gcaccagcgacagcaccc

SEQ ID NO: 996878 - RNA, 18 nt, Mycobacterium avium subsp. paratuberculosis
gcaccaguuccugcaugc

SEQ ID NO: 996879 - RNA, 16 nt, Mycobacterium avium subsp. paratuberculosis
gcaccagucgcgcagc

SEQ ID NO: 996880 - RNA, 23 nt, Mycobacterium avium subsp. paratuberculosis
gcaccagucggccaucagcaccg

SEQ ID NO: 996881 - RNA, 23 nt, Mycobacterium avium subsp. paratuberculosis
gcaccaguaggucacccgguccc

SEQ ID NO: 996882 - RNA, 18 nt, Mycobacterium avium subsp. paratuberculosis
gcacagcaccaguugcac

SEQ ID NO: 996883 - RNA, 22 nt, Mycobacterium avium subsp. paratuberculosis
gcacaccuuccaccaccgcggc

SEQ ID NO: 996884 - RNA, 22 nt, Mycobacterium avium subsp. paratuberculosis
gcacaccgucguccacgcccag

SEQ ID NO: 996885 - RNA, 18 nt, Mycobacterium avium subsp. paratuberculosis
gcacaccgucgcccgccc

SEQ ID NO: 996886 - RNA, 16 nt, Mycobacterium avium subsp. paratuberculosis
gcacaccggugcucuc

SEQ ID NO: 996887 - RNA, 14 nt, Mycobacterium avium subsp. paratuberculosis
gcacagccggcggc

SEQ ID NO: 996888 - RNA, 19 nt, Mycobacterium avium subsp. paratuberculosis
gcacagcgaaagcgcuugg

SEQ ID NO: 996889 - RNA, 13 nt, Mycobacterium avium subsp. paratuberculosis
gcacagccgcagc

SEQ ID NO: 996890 - RNA, 17 nt, Mycobacterium avium subsp. paratuberculosis
gcacagccgcagcagcc

SEQ ID NO: 996891 - RNA, 13 nt, Mycobacterium avium subsp. paratuberculosis
gcacaggggcgcg

SEQ ID NO: 996892 - RNA, 12 nt, Mycobacterium avium subsp. paratuberculosis
gcacagcgccac

SEQ ID NO: 996893 - RNA, 11 nt, Mycobacterium avium subsp. paratuberculosis
gcacagcggcg

SEQ ID NO: 996894 - RNA, 18 nt, Mycobacterium avium subsp. paratuberculosis
gcacagcgggaucccagu

SEQ ID NO: 996895 - RNA, 14 nt, Mycobacterium avium subsp. paratuberculosis
gcacagcgccgcgu

SEQ ID NO: 996896 - RNA, 16 nt, Mycobacterium avium subsp. paratuberculosis
gcacagcuucggcgcc

SEQ ID NO: 996897 - RNA, 21 nt, Mycobacterium avium subsp. paratuberculosis
gcacagcuucggcgccgagca

SEQ ID NO: 996898 - RNA, 13 nt, Mycobacterium avium subsp. paratuberculosis
gcacaacagccau

SEQ ID NO: 996899 - RNA, 15 nt, Mycobacterium avium subsp. paratuberculosis
gcacaacccgcccgg

SEQ ID NO: 996900 - RNA, 11 nt, Mycobacterium avium subsp. paratuberculosis
gcacacccggu

SEQ ID NO: 996901 - RNA, 12 nt, Mycobacterium avium subsp. paratuberculosis
gcacacccggug

SEQ ID NO: 996902 - RNA, 17 nt, Mycobacterium avium subsp. paratuberculosis
gcacacccggugcgccg

SEQ ID NO: 996903 - RNA, 19 nt, Mycobacterium avium subsp. paratuberculosis
gcacaccgcgcagaaccgc

SEQ ID NO: 996904 - RNA, 15 nt, Mycobacterium avium subsp. paratuberculosis
gcacaccgcggcggc

SEQ ID NO: 996905 - RNA, 23 nt, Mycobacterium avium subsp. paratuberculosis
gcacaccggaucggcugcgggcc

SEQ ID NO: 996906 - RNA, 16 nt, Mycobacterium avium subsp. paratuberculosis
gcaaucgggacgccac

SEQ ID NO: 996907 - RNA, 17 nt, Mycobacterium avium subsp. paratuberculosis
gcacccaccggcgcagc

SEQ ID NO: 996908 - RNA, 18 nt, Mycobacterium avium subsp. paratuberculosis
gcacccaaaacaucggcg

SEQ ID NO: 996909 - RNA, 16 nt, Mycobacterium avium subsp. paratuberculosis
gcacccauccccagga

SEQ ID NO: 996910 - RNA, 15 nt, Mycobacterium avium subsp. paratuberculosis
gcacccagcacagcg

SEQ ID NO: 996911 - RNA, 22 nt, Mycobacterium avium subsp. paratuberculosis
gcacccccggggccuccagcca

SEQ ID NO: 996912 - RNA, 17 nt, Mycobacterium avium subsp. paratuberculosis
gcaccccgaaccaguuc

SEQ ID NO: 996913 - RNA, 23 nt, Mycobacterium avium subsp. paratuberculosis
gcacccgcaacgcgcgcgacggc

SEQ ID NO: 996914 - RNA, 14 nt, Mycobacterium avium subsp. paratuberculosis
gcacccgcagccgc

SEQ ID NO: 996915 - RNA, 15 nt, Mycobacterium avium subsp. paratuberculosis
gcacccgccagcccg

SEQ ID NO: 996916 - RNA, 13 nt, Mycobacterium avium subsp. paratuberculosis
gcacccgcggcgc

SEQ ID NO: 996917 - RNA, 19 nt, Mycobacterium avium subsp. paratuberculosis
gcaccccgugguagacgcc

SEQ ID NO: 996918 - RNA, 22 nt, Mycobacterium avium subsp. paratuberculosis
gcaccccgccgcagcccaggcc

SEQ ID NO: 996919 - RNA, 17 nt, Mycobacterium avium subsp. paratuberculosis
gcacccgaccgacgccc

SEQ ID NO: 996920 - RNA, 20 nt, Mycobacterium avium subsp. paratuberculosis
gcaccccgucgagcagccgc

SEQ ID NO: 996921 - RNA, 21 nt, Mycobacterium avium subsp. paratuberculosis
gcaccccgucgagcagccgca

SEQ ID NO: 996922 - RNA, 17 nt, Mycobacterium avium subsp. paratuberculosis
gcaccccgucgcggacc

SEQ ID NO: 996923 - RNA, 14 nt, Mycobacterium avium subsp. paratuberculosis
gcaccccggcggcc

SEQ ID NO: 996924 - RNA, 16 nt, Mycobacterium avium subsp. paratuberculosis
gcaccccggcggccgc

SEQ ID NO: 996925 - RNA, 18 nt, Mycobacterium avium subsp. paratuberculosis
gcaccccggcggccgcgu

SEQ ID NO: 996926 - RNA, 17 nt, Mycobacterium avium subsp. paratuberculosis
gcaccccgcgccgggcg

SEQ ID NO: 996927 - RNA, 12 nt, Mycobacterium avium subsp. paratuberculosis
gcaccccgcggu

SEQ ID NO: 996928 - RNA, 19 nt, Mycobacterium avium subsp. paratuberculosis
gcacccgcugcaccagccc

SEQ ID NO: 996929 - RNA, 15 nt, Mycobacterium avium subsp. paratuberculosis
gcacccgcugcagcc

SEQ ID NO: 996930 - RNA, 16 nt, Mycobacterium avium subsp. paratuberculosis
gcaccgaacgccagca

SEQ ID NO: 996931 - RNA, 18 nt, Mycobacterium avium subsp. paratuberculosis
gcaccgaacgccagcagc

SEQ ID NO: 996932 - RNA, 19 nt, Mycobacterium avium subsp. paratuberculosis
gcaccgagaacagaugccg

SEQ ID NO: 996933 - RNA, 19 nt, Mycobacterium avium subsp. paratuberculosis
gcaccgacuguuugaugcc

SEQ ID NO: 996934 - RNA, 16 nt, Mycobacterium avium subsp. paratuberculosis
gcaccgacgcggcgac

SEQ ID NO: 996935 - RNA, 21 nt, Mycobacterium avium subsp. paratuberculosis
gcaccgacggccgcaccccac

SEQ ID NO: 996936 - RNA, 22 nt, Mycobacterium avium subsp. paratuberculosis
gcaccgacggccgcaccccacc

SEQ ID NO: 996937 - RNA, 19 nt, Mycobacterium avium subsp. paratuberculosis
gcaccgacuccuccggccc

SEQ ID NO: 996938 - RNA, 14 nt, Mycobacterium avium subsp. paratuberculosis
gcaccgcgcccgcc

SEQ ID NO: 996939 - RNA, 15 nt, Mycobacterium avium subsp. paratuberculosis
gcaccgcgcccgccc

SEQ ID NO: 996940 - RNA, 17 nt, Mycobacterium avium subsp. paratuberculosis
gcaccgcgacccaggcc

SEQ ID NO: 996941 - RNA, 17 nt, Mycobacterium avium subsp. paratuberculosis
gcaccgcgaccgguccg

SEQ ID NO: 996942 - RNA, 24 nt, Mycobacterium avium subsp. paratuberculosis
gcaccgcgacgaucgcgacggccg

SEQ ID NO: 996943 - RNA, 15 nt, Mycobacterium avium subsp. paratuberculosis
gcaccgcgcggcggu

SEQ ID NO: 996944 - RNA, 14 nt, Mycobacterium avium subsp. paratuberculosis
gcaccgcgaccagc

SEQ ID NO: 996945 - RNA, 23 nt, Mycobacterium avium subsp. paratuberculosis
gcaccgcgaaagugcaacuggca

SEQ ID NO: 996946 - RNA, 21 nt, Mycobacterium avium subsp. paratuberculosis
gcaccgcgaacaucgccagca

SEQ ID NO: 996947 - RNA, 23 nt, Mycobacterium avium subsp. paratuberculosis
gcaccgcgaacaucgccagcaac

SEQ ID NO: 996948 - RNA, 15 nt, Mycobacterium avium subsp. paratuberculosis
gcaccgccucggcca

SEQ ID NO: 996949 - RNA, 14 nt, Mycobacterium avium subsp. paratuberculosis
gcaccgccgucccg

SEQ ID NO: 996950 - RNA, 16 nt, Mycobacterium avium subsp. paratuberculosis
gcaccgccucaugcca

SEQ ID NO: 996951 - RNA, 17 nt, Mycobacterium avium subsp. paratuberculosis
gcaccgcgggcagcagc

SEQ ID NO: 996952 - RNA, 21 nt, Mycobacterium avium subsp. paratuberculosis
gcaccgcgggcagcagcuugg

SEQ ID NO: 996953 - RNA, 18 nt, Mycobacterium avium subsp. paratuberculosis
gcaccgcgggggcggccg

SEQ ID NO: 996954 - RNA, 23 nt, Mycobacterium avium subsp. paratuberculosis
gcaccgcgggggcggccgggccg

SEQ ID NO: 996955 - RNA, 13 nt, Mycobacterium avium subsp. paratuberculosis
gcaccgcggcggu

SEQ ID NO: 996956 - RNA, 15 nt, Mycobacterium avium subsp. paratuberculosis
gcaccgcggcguagc

SEQ ID NO: 996957 - RNA, 18 nt, Mycobacterium avium subsp. paratuberculosis
gcaccgcggcgugcgcca

SEQ ID NO: 996958 - RNA, 20 nt, Mycobacterium avium subsp. paratuberculosis
gcaccgcggcgugcgccagu

SEQ ID NO: 996959 - RNA, 15 nt, Mycobacterium avium subsp. paratuberculosis
gcaccgcugccggcc

SEQ ID NO: 996960 - RNA, 16 nt, Mycobacterium avium subsp. paratuberculosis
gcaccgcugccggccg

SEQ ID NO: 996961 - RNA, 24 nt, Mycobacterium avium subsp. paratuberculosis
gcaccguugugacccgcucgggcg

SEQ ID NO: 996962 - RNA, 15 nt, Mycobacterium avium subsp. paratuberculosis
gcaccugcucgaugc

SEQ ID NO: 996963 - RNA, 15 nt, Mycobacterium avium subsp. paratuberculosis
gcaccuggauccagu

SEQ ID NO: 996964 - RNA, 19 nt, Mycobacterium avium subsp. paratuberculosis
gcaccuggcgcaccgccgc

SEQ ID NO: 996965 - RNA, 14 nt, Mycobacterium avium subsp. paratuberculosis
gcaccuggcgcagc

SEQ ID NO: 996966 - RNA, 17 nt, Mycobacterium avium subsp. paratuberculosis
gcaccuggcgcagcacc

SEQ ID NO: 996967 - RNA, 18 nt, Mycobacterium avium subsp. paratuberculosis
gcaccuggcgcagcaccg

SEQ ID NO: 996968 - RNA, 15 nt, Mycobacterium avium subsp. paratuberculosis
gcaccggagccuugg

SEQ ID NO: 996969 - RNA, 16 nt, Mycobacterium avium subsp. paratuberculosis
gcaccggagccuuggu

SEQ ID NO: 996970 - RNA, 15 nt, Mycobacterium avium subsp. paratuberculosis
gcaccgugccgcgcg

SEQ ID NO: 996971 - RNA, 20 nt, Mycobacterium avium subsp. paratuberculosis
gcaccgugccgcgcggcggu

SEQ ID NO: 996972 - RNA, 16 nt, Mycobacterium avium subsp. paratuberculosis
gcaccggcaccgccag

SEQ ID NO: 996973 - RNA, 21 nt, Mycobacterium avium subsp. paratuberculosis
gcaccggcaccgccagccacc

SEQ ID NO: 996974 - RNA, 15 nt, Mycobacterium avium subsp. paratuberculosis
gcaccggcaccgccc

SEQ ID NO: 996975 - RNA, 16 nt, Mycobacterium avium subsp. paratuberculosis
gcaccggcaccgcccc

SEQ ID NO: 996976 - RNA, 18 nt, Mycobacterium avium subsp. paratuberculosis
gcaccguggugacccgga

SEQ ID NO: 996977 - RNA, 20 nt, Mycobacterium avium subsp. paratuberculosis
gcacgaagucgaccgcggcu

SEQ ID NO: 996978 - RNA, 15 nt, Mycobacterium avium subsp. paratuberculosis
gcacgaacgcggccg

SEQ ID NO: 996979 - RNA, 16 nt, Mycobacterium avium subsp. paratuberculosis
gcacgaacgcggccgc

SEQ ID NO: 996980 - RNA, 11 nt, Mycobacterium avium subsp. paratuberculosis
gcacgaacggc

SEQ ID NO: 996981 - RNA, 16 nt, Mycobacterium avium subsp. paratuberculosis
gcacgaugaacuccuc

SEQ ID NO: 996982 - RNA, 20 nt, Mycobacterium avium subsp. paratuberculosis
gcacgaucggcagcgccaac

SEQ ID NO: 996983 - RNA, 18 nt, Mycobacterium avium subsp. paratuberculosis
gcacgaucgucgccgcca

SEQ ID NO: 996984 - RNA, 17 nt, Mycobacterium avium subsp. paratuberculosis
gcacgaucucggcgguc

SEQ ID NO: 996985 - RNA, 22 nt, Mycobacterium avium subsp. paratuberculosis
gcacgaucucggcggucuuugc

SEQ ID NO: 996986 - RNA, 15 nt, Mycobacterium avium subsp. paratuberculosis
gcacgaucugcaggc

SEQ ID NO: 996987 - RNA, 16 nt, Mycobacterium avium subsp. paratuberculosis
gcacgaucugcaggcc

SEQ ID NO: 996988 - RNA, 16 nt, Mycobacterium avium subsp. paratuberculosis
gcacgaaguacagcgu

SEQ ID NO: 996989 - RNA, 13 nt, Mycobacterium avium subsp. paratuberculosis
gcacgaucgcggu

SEQ ID NO: 996990 - RNA, 16 nt, Mycobacterium avium subsp. paratuberculosis
gcacgauggcgcggcg

SEQ ID NO: 996991 - RNA, 17 nt, Mycobacterium avium subsp. paratuberculosis
gcacgauggcgcggcgc

SEQ ID NO: 996992 - RNA, 20 nt, Mycobacterium avium subsp. paratuberculosis
gcacgcaaaaaccaugccag

SEQ ID NO: 996993 - RNA, 15 nt, Mycobacterium avium subsp. paratuberculosis
gcacgauggacgccc

SEQ ID NO: 996994 - RNA, 13 nt, Mycobacterium avium subsp. paratuberculosis
gcacgcacggcga

SEQ ID NO: 996995 - RNA, 16 nt, Mycobacterium avium subsp. paratuberculosis
gcacgcaggcguggcc

SEQ ID NO: 996996 - RNA, 21 nt, Mycobacterium avium subsp. paratuberculosis
gcacgcaggcguggcccagcc

SEQ ID NO: 996997 - RNA, 18 nt, Mycobacterium avium subsp. paratuberculosis
gcacgcagugccgcacca

SEQ ID NO: 996998 - RNA, 21 nt, Mycobacterium avium subsp. paratuberculosis
gcacgcgagacgagccgccgc

SEQ ID NO: 996999 - RNA, 21 nt, Mycobacterium avium subsp. paratuberculosis
gcacgccguccuuggccgcca

SEQ ID NO: 997000 - RNA, 20 nt, Mycobacterium avium subsp. paratuberculosis
gcacgccggguugggcggcg

SEQ ID NO: 997001 - RNA, 22 nt, Mycobacterium avium subsp. paratuberculosis
gcacgccggguugggcggcggc

SEQ ID NO: 997002 - RNA, 15 nt, Mycobacterium avium subsp. paratuberculosis
gcaacagcgagucgg

SEQ ID NO: 997003 - RNA, 19 nt, Mycobacterium avium subsp. paratuberculosis
gcaacacguugagucccuc

SEQ ID NO: 997004 - RNA, 19 nt, Mycobacterium avium subsp. paratuberculosis
gcaacaucgucaacaugcu

SEQ ID NO: 997005 - RNA, 13 nt, Mycobacterium avium subsp. paratuberculosis
gcaacacccagcc

SEQ ID NO: 997006 - RNA, 15 nt, Mycobacterium avium subsp. paratuberculosis
gcaacaccagggugc

SEQ ID NO: 997007 - RNA, 20 nt, Mycobacterium avium subsp. paratuberculosis
gcaacaccggauuucgccag

SEQ ID NO: 997008 - RNA, 16 nt, Mycobacterium avium subsp. paratuberculosis
gcaacacgccggcggc

SEQ ID NO: 997009 - RNA, 12 nt, Mycobacterium avium subsp. paratuberculosis
gcaacagcagcg

SEQ ID NO: 997010 - RNA, 15 nt, Mycobacterium avium subsp. paratuberculosis
gcaacagcagcggca

SEQ ID NO: 997011 - RNA, 21 nt, Mycobacterium avium subsp. paratuberculosis
gcaacagcauuucgcgcggca

SEQ ID NO: 997012 - RNA, 16 nt, Mycobacterium avium subsp. paratuberculosis
gcaacagcaccagcac

SEQ ID NO: 997013 - RNA, 18 nt, Mycobacterium avium subsp. paratuberculosis
gcaacgcugaccgcagga

SEQ ID NO: 997014 - RNA, 13 nt, Mycobacterium avium subsp. paratuberculosis
gcaacggucggga

SEQ ID NO: 997015 - RNA, 21 nt, Mycobacterium avium subsp. paratuberculosis
gcaacgggccgcagccgcgcg

SEQ ID NO: 997016 - RNA, 14 nt, Mycobacterium avium subsp. paratuberculosis
gcaacggcggcggc

SEQ ID NO: 997017 - RNA, 15 nt, Mycobacterium avium subsp. paratuberculosis
gcaacggcuggcgca

SEQ ID NO: 997018 - RNA, 17 nt, Mycobacterium avium subsp. paratuberculosis
gcaacggcuggcgcagg

SEQ ID NO: 997019 - RNA, 17 nt, Mycobacterium avium subsp. paratuberculosis
gcaacgcacgggcggcg

SEQ ID NO: 997020 - RNA, 16 nt, Mycobacterium avium subsp. paratuberculosis
gcaacgauucacccag

SEQ ID NO: 997021 - RNA, 14 nt, Mycobacterium avium subsp. paratuberculosis
gcaacgcgccggcg

SEQ ID NO: 997022 - RNA, 17 nt, Mycobacterium avium subsp. paratuberculosis
gcaacgcgccggcgguc

SEQ ID NO: 997023 - RNA, 17 nt, Mycobacterium avium subsp. paratuberculosis
gcaaccugggcggcggc

SEQ ID NO: 997024 - RNA, 19 nt, Mycobacterium avium subsp. paratuberculosis
gcaaccuucuuggccggag

SEQ ID NO: 997025 - RNA, 21 nt, Mycobacterium avium subsp. paratuberculosis
gcaaccuucuuggccggagcc

SEQ ID NO: 997026 - RNA, 23 nt, Mycobacterium avium subsp. paratuberculosis
gcaaccuucuuggccggagccuu

SEQ ID NO: 997027 - RNA, 19 nt, Mycobacterium avium subsp. paratuberculosis
gcaacccgaaagcccccag

SEQ ID NO: 997028 - RNA, 15 nt, Mycobacterium avium subsp. paratuberculosis
gcaacccgaucgccg

SEQ ID NO: 997029 - RNA, 19 nt, Mycobacterium avium subsp. paratuberculosis
gcaacccgccgagcgugaa

SEQ ID NO: 997030 - RNA, 20 nt, Mycobacterium avium subsp. paratuberculosis
gcaaccggaauggcagcagc

SEQ ID NO: 997031 - RNA, 23 nt, Mycobacterium avium subsp. paratuberculosis
gcaaccggaauggcagcagccgg

SEQ ID NO: 997032 - RNA, 18 nt, Mycobacterium avium subsp. paratuberculosis
gcaaccgccggcagcggc

SEQ ID NO: 997033 - RNA, 19 nt, Mycobacterium avium subsp. paratuberculosis
gcaaccgccggcagcggcu

SEQ ID NO: 997034 - RNA, 18 nt, Mycobacterium avium subsp. paratuberculosis
gcaaccgcagcaucuugg

SEQ ID NO: 997035 - RNA, 15 nt, Mycobacterium avium subsp. paratuberculosis
gcaaucgagcgggcg

SEQ ID NO: 997036 - RNA, 18 nt, Mycobacterium avium subsp. paratuberculosis
gcaaucggacccagcccg

SEQ ID NO: 997037 - RNA, 18 nt, Mycobacterium avium subsp. paratuberculosis
gcaauacccgaccagcac

SEQ ID NO: 997038 - RNA, 18 nt, Mycobacterium avium subsp. paratuberculosis
gcaauaccggcagcaggu

SEQ ID NO: 997039 - RNA, 22 nt, Mycobacterium avium subsp. paratuberculosis
gcaauaccggcagcaggugcac

SEQ ID NO: 997040 - RNA, 16 nt, Mycobacterium avium subsp. paratuberculosis
gcaaggcccccgccuc

SEQ ID NO: 997041 - RNA, 18 nt, Mycobacterium avium subsp. paratuberculosis
gcaaggcccccgccucgc

SEQ ID NO: 997042 - RNA, 14 nt, Mycobacterium avium subsp. paratuberculosis
gcaaggccagcaac

SEQ ID NO: 997043 - RNA, 23 nt, Mycobacterium avium subsp. paratuberculosis
gcaaggccgccagccgcgucuug

SEQ ID NO: 997044 - RNA, 19 nt, Mycobacterium avium subsp. paratuberculosis
gcaaggccugcgccuuggc

SEQ ID NO: 997045 - RNA, 15 nt, Mycobacterium avium subsp. paratuberculosis
gcaacgugcgccggc

SEQ ID NO: 997046 - RNA, 15 nt, Mycobacterium avium subsp. paratuberculosis
gcaagcugauucggg

SEQ ID NO: 997047 - RNA, 19 nt, Mycobacterium avium subsp. paratuberculosis
gcaacuguucgcggcuggc

SEQ ID NO: 997048 - RNA, 20 nt, Mycobacterium avium subsp. paratuberculosis
gcaacuguucgcggcuggcc

SEQ ID NO: 997049 - RNA, 12 nt, Mycobacterium avium subsp. paratuberculosis
gcaagagcaggc

SEQ ID NO: 997050 - RNA, 19 nt, Mycobacterium avium subsp. paratuberculosis
gcggccaacaacgccaaga

SEQ ID NO: 997051 - RNA, 16 nt, Mycobacterium avium subsp. paratuberculosis
gcggccaacgcccacc

SEQ ID NO: 997052 - RNA, 16 nt, Mycobacterium avium subsp. paratuberculosis
gcggccaacccgggcg

SEQ ID NO: 997053 - RNA, 18 nt, Mycobacterium avium subsp. paratuberculosis
gcggcaucgucggggacg

SEQ ID NO: 997054 - RNA, 17 nt, Mycobacterium avium subsp. paratuberculosis
gcggcaucgccgccaag

SEQ ID NO: 997055 - RNA, 20 nt, Mycobacterium avium subsp. paratuberculosis
gcggcaucgccgccaagggg

SEQ ID NO: 997056 - RNA, 15 nt, Mycobacterium avium subsp. paratuberculosis
gcggcaucgcgccgc

SEQ ID NO: 997057 - RNA, 16 nt, Mycobacterium avium subsp. paratuberculosis
gcggcaucgcgccgca

SEQ ID NO: 997058 - RNA, 18 nt, Mycobacterium avium subsp. paratuberculosis
gcggcaucgcgccgcaug

SEQ ID NO: 997059 - RNA, 20 nt, Mycobacterium avium subsp. paratuberculosis
gcggcaucgcgcgcggcggc

SEQ ID NO: 997060 - RNA, 14 nt, Mycobacterium avium subsp. paratuberculosis
gcggccagcccauc

SEQ ID NO: 997061 - RNA, 13 nt, Mycobacterium avium subsp. paratuberculosis
gcggccagcagca

SEQ ID NO: 997062 - RNA, 12 nt, Mycobacterium avium subsp. paratuberculosis
gcggccagcagc

SEQ ID NO: 997063 - RNA, 17 nt, Mycobacterium avium subsp. paratuberculosis
gcggccacaccggggcc

SEQ ID NO: 997064 - RNA, 19 nt, Mycobacterium avium subsp. paratuberculosis
gcggccacaccggggccag

SEQ ID NO: 997065 - RNA, 22 nt, Mycobacterium avium subsp. paratuberculosis
gcggccaccaacggcagcagca

SEQ ID NO: 997066 - RNA, 13 nt, Mycobacterium avium subsp. paratuberculosis
gcggccaccacca

SEQ ID NO: 997067 - RNA, 18 nt, Mycobacterium avium subsp. paratuberculosis
gcggccaccaccacggcc

SEQ ID NO: 997068 - RNA, 18 nt, Mycobacterium avium subsp. paratuberculosis
gcggccaagugcggucgg

SEQ ID NO: 997069 - RNA, 15 nt, Mycobacterium avium subsp. paratuberculosis
gcggccaccaccgcc

SEQ ID NO: 997070 - RNA, 12 nt, Mycobacterium avium subsp. paratuberculosis
gcggccaccagc

SEQ ID NO: 997071 - RNA, 18 nt, Mycobacterium avium subsp. paratuberculosis
gcggccaccagccggccg

SEQ ID NO: 997072 - RNA, 17 nt, Mycobacterium avium subsp. paratuberculosis
gcggccaccagcgcggc

SEQ ID NO: 997073 - RNA, 22 nt, Mycobacterium avium subsp. paratuberculosis
gcggccaccaucuccgcggcgc

SEQ ID NO: 997074 - RNA, 17 nt, Mycobacterium avium subsp. paratuberculosis
gcggccaccccggagca

SEQ ID NO: 997075 - RNA, 15 nt, Mycobacterium avium subsp. paratuberculosis
gcggccaccgcgccc

SEQ ID NO: 997076 - RNA, 17 nt, Mycobacterium avium subsp. paratuberculosis
gcggccaccgggucguc

SEQ ID NO: 997077 - RNA, 23 nt, Mycobacterium avium subsp. paratuberculosis
gcggccaccucggcggcaccgcc

SEQ ID NO: 997078 - RNA, 14 nt, Mycobacterium avium subsp. paratuberculosis
gcggccaccugggc

SEQ ID NO: 997079 - RNA, 19 nt, Mycobacterium avium subsp. paratuberculosis
gcggccaccugggcggggc

SEQ ID NO: 997080 - RNA, 21 nt, Mycobacterium avium subsp. paratuberculosis
gcggccacgacggcgcuggcc

SEQ ID NO: 997081 - RNA, 18 nt, Mycobacterium avium subsp. paratuberculosis
gcggccacgaucgcggcc

SEQ ID NO: 997082 - RNA, 12 nt, Mycobacterium avium subsp. paratuberculosis
gcggcccgcggg

SEQ ID NO: 997083 - RNA, 13 nt, Mycobacterium avium subsp. paratuberculosis
gcggcccgcggca

SEQ ID NO: 997084 - RNA, 16 nt, Mycobacterium avium subsp. paratuberculosis
gcggcccgccgcgccc

SEQ ID NO: 997085 - RNA, 18 nt, Mycobacterium avium subsp. paratuberculosis
gcggcccgccgggcgucg

SEQ ID NO: 997086 - RNA, 22 nt, Mycobacterium avium subsp. paratuberculosis
gcggccccuucgaugucgccgg

SEQ ID NO: 997087 - RNA, 17 nt, Mycobacterium avium subsp. paratuberculosis
gcggccccggcucgggc

SEQ ID NO: 997088 - RNA, 18 nt, Mycobacterium avium subsp. paratuberculosis
gcggccccggcucgggcc

SEQ ID NO: 997089 - RNA, 19 nt, Mycobacterium avium subsp. paratuberculosis
gcggcccgaucaccaggcc

SEQ ID NO: 997090 - RNA, 20 nt, Mycobacterium avium subsp. paratuberculosis
gcggcccgaucaccaggccc

SEQ ID NO: 997091 - RNA, 18 nt, Mycobacterium avium subsp. paratuberculosis
gcggcccccacgcagcgg

SEQ ID NO: 997092 - RNA, 22 nt, Mycobacterium avium subsp. paratuberculosis
gcggcccccugaucggccgcaa

SEQ ID NO: 997093 - RNA, 21 nt, Mycobacterium avium subsp. paratuberculosis
gcggcccagggcgcucuggaa

SEQ ID NO: 997094 - RNA, 18 nt, Mycobacterium avium subsp. paratuberculosis
gcggcccagcccggccag

SEQ ID NO: 997095 - RNA, 17 nt, Mycobacterium avium subsp. paratuberculosis
gcggcccagcucgguga

SEQ ID NO: 997096 - RNA, 14 nt, Mycobacterium avium subsp. paratuberculosis
gcggcccaccgcga

SEQ ID NO: 997097 - RNA, 20 nt, Mycobacterium avium subsp. paratuberculosis
gcggcccacccgcagggcgc

SEQ ID NO: 997098 - RNA, 22 nt, Mycobacterium avium subsp. paratuberculosis
gcggcccacccgcagggcgccg

SEQ ID NO: 997099 - RNA, 23 nt, Mycobacterium avium subsp. paratuberculosis
gcggccauucaucgcgcaccagg

SEQ ID NO: 997100 - RNA, 18 nt, Mycobacterium avium subsp. paratuberculosis
gcggccaguucgagcgcc

SEQ ID NO: 997101 - RNA, 23 nt, Mycobacterium avium subsp. paratuberculosis
gcggccaguucgagcgccgcggc

SEQ ID NO: 997102 - RNA, 18 nt, Mycobacterium avium subsp. paratuberculosis
gcggccauauaggggugg

SEQ ID NO: 997103 - RNA, 23 nt, Mycobacterium avium subsp. paratuberculosis
gcggccaucgccugagcaaccgg

SEQ ID NO: 997104 - RNA, 17 nt, Mycobacterium avium subsp. paratuberculosis
gcggccaggaaguccuu

SEQ ID NO: 997105 - RNA, 20 nt, Mycobacterium avium subsp. paratuberculosis
gcggccagcguggcgcgccc

SEQ ID NO: 997106 - RNA, 20 nt, Mycobacterium avium subsp. paratuberculosis
gcggccagcgcccgcgggug

SEQ ID NO: 997107 - RNA, 14 nt, Mycobacterium avium subsp. paratuberculosis
gcggccagcgccuu

SEQ ID NO: 997108 - RNA, 14 nt, Mycobacterium avium subsp. paratuberculosis
gcggccagcgcgcc

SEQ ID NO: 997109 - RNA, 17 nt, Mycobacterium avium subsp. paratuberculosis
gcggccagcgcgccgcc

SEQ ID NO: 997110 - RNA, 16 nt, Mycobacterium avium subsp. paratuberculosis
gcggcagcucggcggc

SEQ ID NO: 997111 - RNA, 20 nt, Mycobacterium avium subsp. paratuberculosis
gcggcaggaauuccagcgac

SEQ ID NO: 997112 - RNA, 15 nt, Mycobacterium avium subsp. paratuberculosis
gcggcaggcgcccca

SEQ ID NO: 997113 - RNA, 23 nt, Mycobacterium avium subsp. paratuberculosis
gcggcagcgcggcguucagcagc

SEQ ID NO: 997114 - RNA, 19 nt, Mycobacterium avium subsp. paratuberculosis
gcggcagcgaacugccggc

SEQ ID NO: 997115 - RNA, 11 nt, Mycobacterium avium subsp. paratuberculosis
gcggcagccgg

SEQ ID NO: 997116 - RNA, 13 nt, Mycobacterium avium subsp. paratuberculosis
gcggcagcgccag

SEQ ID NO: 997117 - RNA, 14 nt, Mycobacterium avium subsp. paratuberculosis
gcggcagccacggc

SEQ ID NO: 997118 - RNA, 15 nt, Mycobacterium avium subsp. paratuberculosis
gcggcagccacggca

SEQ ID NO: 997119 - RNA, 16 nt, Mycobacterium avium subsp. paratuberculosis
gcggcagccacggcag

SEQ ID NO: 997120 - RNA, 15 nt, Mycobacterium avium subsp. paratuberculosis
gcggcagucgcagca

SEQ ID NO: 997121 - RNA, 23 nt, Mycobacterium avium subsp. paratuberculosis
gcggcagucgcagcagcagcccg

SEQ ID NO: 997122 - RNA, 23 nt, Mycobacterium avium subsp. paratuberculosis
gcggcauaguccagcucgcgaag

SEQ ID NO: 997123 - RNA, 15 nt, Mycobacterium avium subsp. paratuberculosis
gcggcaucccuggug

SEQ ID NO: 997124 - RNA, 17 nt, Mycobacterium avium subsp. paratuberculosis
gcggcagguggggcagc

SEQ ID NO: 997125 - RNA, 18 nt, Mycobacterium avium subsp. paratuberculosis
gcggcagguuggggacgg

SEQ ID NO: 997126 - RNA, 22 nt, Mycobacterium avium subsp. paratuberculosis
gcggcaggucggcgggagccgg

SEQ ID NO: 997127 - RNA, 22 nt, Mycobacterium avium subsp. paratuberculosis
gcggcaggucccaggccaggau

SEQ ID NO: 997128 - RNA, 13 nt, Mycobacterium avium subsp. paratuberculosis
gcggcagggccac

SEQ ID NO: 997129 - RNA, 23 nt, Mycobacterium avium subsp. paratuberculosis
gcggcagggccaccgucagggug

SEQ ID NO: 997130 - RNA, 16 nt, Mycobacterium avium subsp. paratuberculosis
gcggcagggccagcac

SEQ ID NO: 997131 - RNA, 18 nt, Mycobacterium avium subsp. paratuberculosis
gcggcagggccagcacca

SEQ ID NO: 997132 - RNA, 22 nt, Mycobacterium avium subsp. paratuberculosis
gcgcugguaguggcgugcggcc

SEQ ID NO: 997133 - RNA, 23 nt, Mycobacterium avium subsp. paratuberculosis
gcgcugguaguggcgugcggccu

SEQ ID NO: 997134 - RNA, 21 nt, Mycobacterium avium subsp. paratuberculosis
gcgcuggguguuccccgggcg

SEQ ID NO: 997135 - RNA, 20 nt, Mycobacterium avium subsp. paratuberculosis
gcgcuggugcgggccagcac

SEQ ID NO: 997136 - RNA, 19 nt, Mycobacterium avium subsp. paratuberculosis
gcgcuggucggcgggcagc

SEQ ID NO: 997137 - RNA, 16 nt, Mycobacterium avium subsp. paratuberculosis
gcgcugucgcgggccc

SEQ ID NO: 997138 - RNA, 18 nt, Mycobacterium avium subsp. paratuberculosis
gcgcuguccucgucgggg

SEQ ID NO: 997139 - RNA, 14 nt, Mycobacterium avium subsp. paratuberculosis
gcgcugugcgggug

SEQ ID NO: 997140 - RNA, 16 nt, Mycobacterium avium subsp. paratuberculosis
gcgcuguaggcggcgu

SEQ ID NO: 997141 - RNA, 20 nt, Mycobacterium avium subsp. paratuberculosis
gcgcuguaggucgcguacgg

SEQ ID NO: 997142 - RNA, 15 nt, Mycobacterium avium subsp. paratuberculosis
gcggcagcacccgca

SEQ ID NO: 997143 - RNA, 21 nt, Mycobacterium avium subsp. paratuberculosis
gcggcagcacccgcaucaacu

SEQ ID NO: 997144 - RNA, 14 nt, Mycobacterium avium subsp. paratuberculosis
gcggcagcagcugc

SEQ ID NO: 997145 - RNA, 17 nt, Mycobacterium avium subsp. paratuberculosis
gcggcagcagcaccagc

SEQ ID NO: 997146 - RNA, 17 nt, Mycobacterium avium subsp. paratuberculosis
gcggcacggugcgggug

SEQ ID NO: 997147 - RNA, 18 nt, Mycobacterium avium subsp. paratuberculosis
gcggcacgucgccguucu

SEQ ID NO: 997148 - RNA, 17 nt, Mycobacterium avium subsp. paratuberculosis
gcggccuaugcgcccgg

SEQ ID NO: 997149 - RNA, 18 nt, Mycobacterium avium subsp. paratuberculosis
gcggccgucgucgugcac

SEQ ID NO: 997150 - RNA, 19 nt, Mycobacterium avium subsp. paratuberculosis
gcggccgucuugcccggcg

SEQ ID NO: 997151 - RNA, 14 nt, Mycobacterium avium subsp. paratuberculosis
gcggccugcggcgg

SEQ ID NO: 997152 - RNA, 14 nt, Mycobacterium avium subsp. paratuberculosis
gcggccugcgggcg

SEQ ID NO: 997153 - RNA, 18 nt, Mycobacterium avium subsp. paratuberculosis
gcggccugcgggcgccgg

SEQ ID NO: 997154 - RNA, 15 nt, Mycobacterium avium subsp. paratuberculosis
gcggccugcgccagg

SEQ ID NO: 997155 - RNA, 17 nt, Mycobacterium avium subsp. paratuberculosis
gcggccugcgccaggau

SEQ ID NO: 997156 - RNA, 18 nt, Mycobacterium avium subsp. paratuberculosis
gcggccucggugcucauc

SEQ ID NO: 997157 - RNA, 13 nt, Mycobacterium avium subsp. paratuberculosis
gcggccugagccg

SEQ ID NO: 997158 - RNA, 16 nt, Mycobacterium avium subsp. paratuberculosis
gcggccugagccgccg

SEQ ID NO: 997159 - RNA, 13 nt, Mycobacterium avium subsp. paratuberculosis
gcggccucggcac

SEQ ID NO: 997160 - RNA, 16 nt, Mycobacterium avium subsp. paratuberculosis
gcggccuccagccgcu

SEQ ID NO: 997161 - RNA, 18 nt, Mycobacterium avium subsp. paratuberculosis
gcggccuccgagcggcgc

SEQ ID NO: 997162 - RNA, 19 nt, Mycobacterium avium subsp. paratuberculosis
gcggccuccgagcggcgca

SEQ ID NO: 997163 - RNA, 21 nt, Mycobacterium avium subsp. paratuberculosis
gcggccgucgccgggcggggu

SEQ ID NO: 997164 - RNA, 23 nt, Mycobacterium avium subsp. paratuberculosis
gcggccgucgcggcgaucgcgag

SEQ ID NO: 997165 - RNA, 14 nt, Mycobacterium avium subsp. paratuberculosis
gcggccguccagcg

SEQ ID NO: 997166 - RNA, 19 nt, Mycobacterium avium subsp. paratuberculosis
gcggccguccagcgucugg

SEQ ID NO: 997167 - RNA, 17 nt, Mycobacterium avium subsp. paratuberculosis
gcggccggugccacggu

SEQ ID NO: 997168 - RNA, 22 nt, Mycobacterium avium subsp. paratuberculosis
gcggccggugccacggucaggc

SEQ ID NO: 997169 - RNA, 15 nt, Mycobacterium avium subsp. paratuberculosis
gcggccgggcggccg

SEQ ID NO: 997170 - RNA, 16 nt, Mycobacterium avium subsp. paratuberculosis
gcggccgggcggccgg

SEQ ID NO: 997171 - RNA, 11 nt, Mycobacterium avium subsp. paratuberculosis
gcggccgggcu

SEQ ID NO: 997172 - RNA, 13 nt, Mycobacterium avium subsp. paratuberculosis
gcggccgggcggc

SEQ ID NO: 997173 - RNA, 14 nt, Mycobacterium avium subsp. paratuberculosis
gcggccgggcggcc

SEQ ID NO: 997174 - RNA, 14 nt, Mycobacterium avium subsp. paratuberculosis
gcggccgggucgag

SEQ ID NO: 997175 - RNA, 15 nt, Mycobacterium avium subsp. paratuberculosis
gcggccgggucgagc

SEQ ID NO: 997176 - RNA, 16 nt, Mycobacterium avium subsp. paratuberculosis
gcggccgggccgcggc

SEQ ID NO: 997177 - RNA, 14 nt, Mycobacterium avium subsp. paratuberculosis
gcggccggcggcgu

SEQ ID NO: 997178 - RNA, 16 nt, Mycobacterium avium subsp. paratuberculosis
gcggccggcgggcagc

SEQ ID NO: 997179 - RNA, 20 nt, Mycobacterium avium subsp. paratuberculosis
gcggccggcgggcagcacgg

SEQ ID NO: 997180 - RNA, 12 nt, Mycobacterium avium subsp. paratuberculosis
gcggccggcggu

SEQ ID NO: 997181 - RNA, 12 nt, Mycobacterium avium subsp. paratuberculosis
gcggccggcggc

SEQ ID NO: 997182 - RNA, 17 nt, Mycobacterium avium subsp. paratuberculosis
gcggccggcgcagccgg

SEQ ID NO: 997183 - RNA, 16 nt, Mycobacterium avium subsp. paratuberculosis
gcggccggcgccgacc

SEQ ID NO: 997184 - RNA, 14 nt, Mycobacterium avium subsp. paratuberculosis
gcggccggcgccgg

SEQ ID NO: 997185 - RNA, 18 nt, Mycobacterium avium subsp. paratuberculosis
gcggccggccggccuggu

SEQ ID NO: 997186 - RNA, 16 nt, Mycobacterium avium subsp. paratuberculosis
gcggccggccaguccu

SEQ ID NO: 997187 - RNA, 14 nt, Mycobacterium avium subsp. paratuberculosis
gcggccggccgcgc

SEQ ID NO: 997188 - RNA, 14 nt, Mycobacterium avium subsp. paratuberculosis
gcggccggcccggc

SEQ ID NO: 997189 - RNA, 15 nt, Mycobacterium avium subsp. paratuberculosis
gcggccggccgacac

SEQ ID NO: 997190 - RNA, 10 nt, Mycobacterium avium subsp. paratuberculosis
gcggccggcc

SEQ ID NO: 997191 - RNA, 19 nt, Mycobacterium avium subsp. paratuberculosis
gcggccggaacagcugguc

SEQ ID NO: 997192 - RNA, 18 nt, Mycobacterium avium subsp. paratuberculosis
gcggccgcggcgcgcauc

SEQ ID NO: 997193 - RNA, 15 nt, Mycobacterium avium subsp. paratuberculosis
gcggccgcugcgccc

SEQ ID NO: 997194 - RNA, 18 nt, Mycobacterium avium subsp. paratuberculosis
gcggccgcugcgcccagc

SEQ ID NO: 997195 - RNA, 13 nt, Mycobacterium avium subsp. paratuberculosis
gcggccgcuggcg

SEQ ID NO: 997196 - RNA, 22 nt, Mycobacterium avium subsp. paratuberculosis
gcggccgcguccucgccguacg

SEQ ID NO: 997197 - RNA, 18 nt, Mycobacterium avium subsp. paratuberculosis
gcggccgcgucggcggcg

SEQ ID NO: 997198 - RNA, 19 nt, Mycobacterium avium subsp. paratuberculosis
gcggccgcgucggcggcgg

SEQ ID NO: 997199 - RNA, 22 nt, Mycobacterium avium subsp. paratuberculosis
gcggccgcgauguagcggacgg

SEQ ID NO: 997200 - RNA, 13 nt, Mycobacterium avium subsp. paratuberculosis
gcggccgccgggg

SEQ ID NO: 997201 - RNA, 18 nt, Mycobacterium avium subsp. paratuberculosis
gcggccgccggggcccca

SEQ ID NO: 997202 - RNA, 19 nt, Mycobacterium avium subsp. paratuberculosis
gcggccgccggggccccaa

SEQ ID NO: 997203 - RNA, 19 nt, Mycobacterium avium subsp. paratuberculosis
gcggccgcgacggaccagu

SEQ ID NO: 997204 - RNA, 14 nt, Mycobacterium avium subsp. paratuberculosis
gcggccgcgagccc

SEQ ID NO: 997205 - RNA, 16 nt, Mycobacterium avium subsp. paratuberculosis
gcggccgcgagcccgg

SEQ ID NO: 997206 - RNA, 16 nt, Mycobacterium avium subsp. paratuberculosis
gcggccgcgaucgcca

SEQ ID NO: 997207 - RNA, 14 nt, Mycobacterium avium subsp. paratuberculosis
gcggccgcccaguc

SEQ ID NO: 997208 - RNA, 11 nt, Mycobacterium avium subsp. paratuberculosis
gcggccgccgg

SEQ ID NO: 997209 - RNA, 16 nt, Mycobacterium avium subsp. paratuberculosis
gcggccgccggcaccg

SEQ ID NO: 997210 - RNA, 17 nt, Mycobacterium avium subsp. paratuberculosis
gcggccgccggcaccgu

SEQ ID NO: 997211 - RNA, 13 nt, Mycobacterium avium subsp. paratuberculosis
gcggccgccggcc

SEQ ID NO: 997212 - RNA, 22 nt, Mycobacterium avium subsp. paratuberculosis
gcggccgccggccagcuccgcc

SEQ ID NO: 997213 - RNA, 15 nt, Mycobacterium avium subsp. paratuberculosis
gcggccgcagcgcga

SEQ ID NO: 997214 - RNA, 17 nt, Mycobacterium avium subsp. paratuberculosis
gcggccgcagcgugggc

SEQ ID NO: 997215 - RNA, 22 nt, Mycobacterium avium subsp. paratuberculosis
gcggccgcagcgugggcaccgg

SEQ ID NO: 997216 - RNA, 23 nt, Mycobacterium avium subsp. paratuberculosis
gcggccgcaugucgaccucggcc

SEQ ID NO: 997217 - RNA, 21 nt, Mycobacterium avium subsp. paratuberculosis
gcggccgauucggcgccgcga

SEQ ID NO: 997218 - RNA, 22 nt, Mycobacterium avium subsp. paratuberculosis
gcggccgaucccgaugcggacg

SEQ ID NO: 997219 - RNA, 16 nt, Mycobacterium avium subsp. paratuberculosis
gcggccgagcgcaccg

SEQ ID NO: 997220 - RNA, 19 nt, Mycobacterium avium subsp. paratuberculosis
gcggccgagcgcaccgcgg

SEQ ID NO: 997221 - RNA, 16 nt, Mycobacterium avium subsp. paratuberculosis
gcggccgagggcuucc

SEQ ID NO: 997222 - RNA, 18 nt, Mycobacterium avium subsp. paratuberculosis
gcggccgaauccggccgg

SEQ ID NO: 997223 - RNA, 22 nt, Mycobacterium avium subsp. paratuberculosis
gcggccgaaaucaacgcgccga

SEQ ID NO: 997224 - RNA, 14 nt, Mycobacterium avium subsp. paratuberculosis
gcggccgaaccgcu

SEQ ID NO: 997225 - RNA, 17 nt, Mycobacterium avium subsp. paratuberculosis
gcggccgaaccgcugca

SEQ ID NO: 997226 - RNA, 22 nt, Mycobacterium avium subsp. paratuberculosis
gcggccgaaccgcugcaaccgg

SEQ ID NO: 997227 - RNA, 22 nt, Mycobacterium avium subsp. paratuberculosis
gcggcccugguugagcaccgcg

SEQ ID NO: 997228 - RNA, 19 nt, Mycobacterium avium subsp. paratuberculosis
gcggcccuguucgccgucg

SEQ ID NO: 997229 - RNA, 20 nt, Mycobacterium avium subsp. paratuberculosis
gcggcccuggcgggcggccc

SEQ ID NO: 997230 - RNA, 16 nt, Mycobacterium avium subsp. paratuberculosis
gcggcccgucgccacc

SEQ ID NO: 997231 - RNA, 17 nt, Mycobacterium avium subsp. paratuberculosis
gcggcccgucgccacca

SEQ ID NO: 997232 - RNA, 18 nt, Mycobacterium avium subsp. paratuberculosis
gcggcccgucgccgugcg

SEQ ID NO: 997233 - RNA, 18 nt, Mycobacterium avium subsp. paratuberculosis
gcggcccguugagcaccg

SEQ ID NO: 997234 - RNA, 20 nt, Mycobacterium avium subsp. paratuberculosis
gcggcccguugagcaccgcg

SEQ ID NO: 997235 - RNA, 14 nt, Mycobacterium avium subsp. paratuberculosis
gcggcccggcacug

SEQ ID NO: 997236 - RNA, 15 nt, Mycobacterium avium subsp. paratuberculosis
gcggcccggcccgcu

SEQ ID NO: 997237 - RNA, 23 nt, Mycobacterium avium subsp. paratuberculosis
gcggcccggcccgcuggccgccg

SEQ ID NO: 997238 - RNA, 12 nt, Mycobacterium avium subsp. paratuberculosis
gcggcgaguccc

SEQ ID NO: 997239 - RNA, 17 nt, Mycobacterium avium subsp. paratuberculosis
gcggcgaguucggcggc

SEQ ID NO: 997240 - RNA, 18 nt, Mycobacterium avium subsp. paratuberculosis
gcggcgacuccagcagcg

SEQ ID NO: 997241 - RNA, 17 nt, Mycobacterium avium subsp. paratuberculosis
gcggcgaucggcgcggc

SEQ ID NO: 997242 - RNA, 18 nt, Mycobacterium avium subsp. paratuberculosis
gcggcgaucggcgcggcg

SEQ ID NO: 997243 - RNA, 15 nt, Mycobacterium avium subsp. paratuberculosis
gcggcgaucggcggu

SEQ ID NO: 997244 - RNA, 22 nt, Mycobacterium avium subsp. paratuberculosis
gcggcgaucgggucaccggccg

SEQ ID NO: 997245 - RNA, 20 nt, Mycobacterium avium subsp. paratuberculosis
gcggcgaucucggcggccgc

SEQ ID NO: 997246 - RNA, 23 nt, Mycobacterium avium subsp. paratuberculosis
gcggcgaucuugucccgcauggc

SEQ ID NO: 997247 - RNA, 17 nt, Mycobacterium avium subsp. paratuberculosis
gcggcgaugcccacagc

SEQ ID NO: 997248 - RNA, 21 nt, Mycobacterium avium subsp. paratuberculosis
gcggcgaugcgcuccagcagg

SEQ ID NO: 997249 - RNA, 13 nt, Mycobacterium avium subsp. paratuberculosis
gcggcgcgcaggc

SEQ ID NO: 997250 - RNA, 14 nt, Mycobacterium avium subsp. paratuberculosis
gcggcgcgcacguc

SEQ ID NO: 997251 - RNA, 18 nt, Mycobacterium avium subsp. paratuberculosis
gcggcgcgcagccggccg

SEQ ID NO: 997252 - RNA, 22 nt, Mycobacterium avium subsp. paratuberculosis
gcggcgcgaggcgcggggcgcg

SEQ ID NO: 997253 - RNA, 15 nt, Mycobacterium avium subsp. paratuberculosis
gcggcgcggagccgg

SEQ ID NO: 997254 - RNA, 13 nt, Mycobacterium avium subsp. paratuberculosis
gcggcgcggcggu

SEQ ID NO: 997255 - RNA, 17 nt, Mycobacterium avium subsp. paratuberculosis
gcggcgcgggcgcccuc

SEQ ID NO: 997256 - RNA, 15 nt, Mycobacterium avium subsp. paratuberculosis
gcggcgcggcgcagc

SEQ ID NO: 997257 - RNA, 15 nt, Mycobacterium avium subsp. paratuberculosis
gcggcgcgccggccg

SEQ ID NO: 997258 - RNA, 21 nt, Mycobacterium avium subsp. paratuberculosis
gcggcgcgcucgucgucggug

SEQ ID NO: 997259 - RNA, 13 nt, Mycobacterium avium subsp. paratuberculosis
gcggcgcgcggcc

SEQ ID NO: 997260 - RNA, 15 nt, Mycobacterium avium subsp. paratuberculosis
gcggcgcgcggccgc

SEQ ID NO: 997261 - RNA, 13 nt, Mycobacterium avium subsp. paratuberculosis
gcggcgcgcgccg

SEQ ID NO: 997262 - RNA, 23 nt, Mycobacterium avium subsp. paratuberculosis
gcggcgcgcgccgcagcgcgcgc

SEQ ID NO: 997263 - RNA, 14 nt, Mycobacterium avium subsp. paratuberculosis
gcggcgcugcagca

SEQ ID NO: 997264 - RNA, 16 nt, Mycobacterium avium subsp. paratuberculosis
gcggcgcugcagcagc

SEQ ID NO: 997265 - RNA, 17 nt, Mycobacterium avium subsp. paratuberculosis
gcggcgcugcagcagcc

SEQ ID NO: 997266 - RNA, 16 nt, Mycobacterium avium subsp. paratuberculosis
gcggcgcugccccagc

SEQ ID NO: 997267 - RNA, 15 nt, Mycobacterium avium subsp. paratuberculosis
gcggcgcugccggcg

SEQ ID NO: 997268 - RNA, 17 nt, Mycobacterium avium subsp. paratuberculosis
gcggcgcugcgccguug

SEQ ID NO: 997269 - RNA, 19 nt, Mycobacterium avium subsp. paratuberculosis
gcggcgcucagcgcggcgg

SEQ ID NO: 997270 - RNA, 21 nt, Mycobacterium avium subsp. paratuberculosis
gcggcgcucagcgcggcgggc

SEQ ID NO: 997271 - RNA, 16 nt, Mycobacterium avium subsp. paratuberculosis
gcggcgcgucgcuggg

SEQ ID NO: 997272 - RNA, 17 nt, Mycobacterium avium subsp. paratuberculosis
gcggcgcgucgcugggc

SEQ ID NO: 997273 - RNA, 15 nt, Mycobacterium avium subsp. paratuberculosis
gcggcgcgugcgccg

SEQ ID NO: 997274 - RNA, 16 nt, Mycobacterium avium subsp. paratuberculosis
gcggcgcgugcgccgc

SEQ ID NO: 997275 - RNA, 21 nt, Mycobacterium avium subsp. paratuberculosis
gcggcgcgugcgccgcggcgg

SEQ ID NO: 997276 - RNA, 19 nt, Mycobacterium avium subsp. paratuberculosis
gcggcgcggucgcaggccg

SEQ ID NO: 997277 - RNA, 23 nt, Mycobacterium avium subsp. paratuberculosis
gcggcgcgguugaccgccgacac

SEQ ID NO: 997278 - RNA, 19 nt, Mycobacterium avium subsp. paratuberculosis
gcggcgaagccggccccgc

SEQ ID NO: 997279 - RNA, 20 nt, Mycobacterium avium subsp. paratuberculosis
gcggcgaagccggccccgcc

SEQ ID NO: 997280 - RNA, 16 nt, Mycobacterium avium subsp. paratuberculosis
gcggcgaauccgagca

SEQ ID NO: 997281 - RNA, 23 nt, Mycobacterium avium subsp. paratuberculosis
gcggcgaaugccugacgggaguc

SEQ ID NO: 997282 - RNA, 17 nt, Mycobacterium avium subsp. paratuberculosis
gcggcgacagcggccua

SEQ ID NO: 997283 - RNA, 20 nt, Mycobacterium avium subsp. paratuberculosis
gcggcgacauuggccgcgcg

SEQ ID NO: 997284 - RNA, 20 nt, Mycobacterium avium subsp. paratuberculosis
gcggcgaccaaugcccugac

SEQ ID NO: 997285 - RNA, 14 nt, Mycobacterium avium subsp. paratuberculosis
gcggcgaccaccuc

SEQ ID NO: 997286 - RNA, 23 nt, Mycobacterium avium subsp. paratuberculosis
gcggcgacggcaccgccggcggc

SEQ ID NO: 997287 - RNA, 13 nt, Mycobacterium avium subsp. paratuberculosis
gcggcgacggcga

SEQ ID NO: 997288 - RNA, 17 nt, Mycobacterium avium subsp. paratuberculosis
gcggcgacggcgucggc

SEQ ID NO: 997289 - RNA, 17 nt, Mycobacterium avium subsp. paratuberculosis
gcggcgacgucgugcac

SEQ ID NO: 997290 - RNA, 22 nt, Mycobacterium avium subsp. paratuberculosis
gcggcgaaaacgccugcgccgc

SEQ ID NO: 997291 - RNA, 17 nt, Mycobacterium avium subsp. paratuberculosis
gcggcgaacaccagcac

SEQ ID NO: 997292 - RNA, 17 nt, Mycobacterium avium subsp. paratuberculosis
gcggccuugcgcaccgg

SEQ ID NO: 997293 - RNA, 16 nt, Mycobacterium avium subsp. paratuberculosis
gcggcgaaccagcaug

SEQ ID NO: 997294 - RNA, 17 nt, Mycobacterium avium subsp. paratuberculosis
gcggcgaaccagcaugc

SEQ ID NO: 997295 - RNA, 15 nt, Mycobacterium avium subsp. paratuberculosis
gcggcgaacgcgcgg

SEQ ID NO: 997296 - RNA, 17 nt, Mycobacterium avium subsp. paratuberculosis
gcggcgaacgcgcgguc

SEQ ID NO: 997297 - RNA, 21 nt, Mycobacterium avium subsp. paratuberculosis
gcggcgaacgcgucccgggcc

SEQ ID NO: 997298 - RNA, 18 nt, Mycobacterium avium subsp. paratuberculosis
gcggcgaaccgggcccgu

SEQ ID NO: 997299 - RNA, 19 nt, Mycobacterium avium subsp. paratuberculosis
gcggccuugcgggccggag

SEQ ID NO: 997300 - RNA, 24 nt, Mycobacterium avium subsp. paratuberculosis
gcggccuucuuggccggagccuuc

SEQ ID NO: 997301 - RNA, 20 nt, Mycobacterium avium subsp. paratuberculosis
gcggccugcuugaccgccag

SEQ ID NO: 997302 - RNA, 22 nt, Mycobacterium avium subsp. paratuberculosis
gcggccugcuugaccgccagac

SEQ ID NO: 997303 - RNA, 16 nt, Mycobacterium avium subsp. paratuberculosis
gcggccugcucgcaga

SEQ ID NO: 997304 - RNA, 15 nt, Mycobacterium avium subsp. paratuberculosis
gcgguugggccggcg

SEQ ID NO: 997305 - RNA, 19 nt, Mycobacterium avium subsp. paratuberculosis
gcgguuggucaccaggucg

SEQ ID NO: 997306 - RNA, 20 nt, Mycobacterium avium subsp. paratuberculosis
gcgguuccagaccggcggcg

SEQ ID NO: 997307 - RNA, 14 nt, Mycobacterium avium subsp. paratuberculosis
gcgguucggcgggc

SEQ ID NO: 997308 - RNA, 16 nt, Mycobacterium avium subsp. paratuberculosis
gcgguucgggccccau

SEQ ID NO: 997309 - RNA, 13 nt, Mycobacterium avium subsp. paratuberculosis
gcgguugcgggug

SEQ ID NO: 997310 - RNA, 15 nt, Mycobacterium avium subsp. paratuberculosis
gcgguugcggguggc

SEQ ID NO: 997311 - RNA, 19 nt, Mycobacterium avium subsp. paratuberculosis
gcggugucgaaggccgggg

SEQ ID NO: 997312 - RNA, 22 nt, Mycobacterium avium subsp. paratuberculosis
gcgguguuuggccgcgcagcuc

SEQ ID NO: 997313 - RNA, 18 nt, Mycobacterium avium subsp. paratuberculosis
gcgguucacgcggcuggc

SEQ ID NO: 997314 - RNA, 16 nt, Mycobacterium avium subsp. paratuberculosis
gcggugucggugccca

SEQ ID NO: 997315 - RNA, 19 nt, Mycobacterium avium subsp. paratuberculosis
gcggugucggugccgagca

SEQ ID NO: 997316 - RNA, 21 nt, Mycobacterium avium subsp. paratuberculosis
gcggugucguaguugcgcgcc

SEQ ID NO: 997317 - RNA, 14 nt, Mycobacterium avium subsp. paratuberculosis
gcggugugcggcgg

SEQ ID NO: 997318 - RNA, 17 nt, Mycobacterium avium subsp. paratuberculosis
gcggugugcggcggcuc

SEQ ID NO: 997319 - RNA, 23 nt, Mycobacterium avium subsp. paratuberculosis
gcggugugcuggccagcaccagc

SEQ ID NO: 997320 - RNA, 13 nt, Mycobacterium avium subsp. paratuberculosis
gcgguguggagau

SEQ ID NO: 997321 - RNA, 13 nt, Mycobacterium avium subsp. paratuberculosis
gcguacagcagcu

SEQ ID NO: 997322 - RNA, 14 nt, Mycobacterium avium subsp. paratuberculosis
gcguacagcggcgc

SEQ ID NO: 997323 - RNA, 15 nt, Mycobacterium avium subsp. paratuberculosis
gcguagucggugcag

SEQ ID NO: 997324 - RNA, 12 nt, Mycobacterium avium subsp. paratuberculosis
gcguagagccgc

SEQ ID NO: 997325 - RNA, 15 nt, Mycobacterium avium subsp. paratuberculosis
gcguagaaccagugc

SEQ ID NO: 997326 - RNA, 21 nt, Mycobacterium avium subsp. paratuberculosis
gcguagaagaaauacaucugc

SEQ ID NO: 997327 - RNA, 16 nt, Mycobacterium avium subsp. paratuberculosis
gcguacugcucggcgc

SEQ ID NO: 997328 - RNA, 18 nt, Mycobacterium avium subsp. paratuberculosis
gcguacugcucggcgcgg

SEQ ID NO: 997329 - RNA, 12 nt, Mycobacterium avium subsp. paratuberculosis
gcguacccgccc

SEQ ID NO: 997330 - RNA, 19 nt, Mycobacterium avium subsp. paratuberculosis
gcgguguacagcgcgccgc

SEQ ID NO: 997331 - RNA, 13 nt, Mycobacterium avium subsp. paratuberculosis
gcgguggugcucg

SEQ ID NO: 997332 - RNA, 19 nt, Mycobacterium avium subsp. paratuberculosis
gcgguggugcucgccccgc

SEQ ID NO: 997333 - RNA, 22 nt, Mycobacterium avium subsp. paratuberculosis
gcgguggugcucgccccgcccg

SEQ ID NO: 997334 - RNA, 17 nt, Mycobacterium avium subsp. paratuberculosis
gcggugguuaccagcuc

SEQ ID NO: 997335 - RNA, 16 nt, Mycobacterium avium subsp. paratuberculosis
gcgguggguccgccgg

SEQ ID NO: 997336 - RNA, 19 nt, Mycobacterium avium subsp. paratuberculosis
gcgguggguccgccgggcg

SEQ ID NO: 997337 - RNA, 13 nt, Mycobacterium avium subsp. paratuberculosis
gcggugggccagu

SEQ ID NO: 997338 - RNA, 16 nt, Mycobacterium avium subsp. paratuberculosis
gcgguggcgugcucga

SEQ ID NO: 997339 - RNA, 18 nt, Mycobacterium avium subsp. paratuberculosis
gcggugggaauccacagc

SEQ ID NO: 997340 - RNA, 15 nt, Mycobacterium avium subsp. paratuberculosis
gcggugggcaccagc

SEQ ID NO: 997341 - RNA, 17 nt, Mycobacterium avium subsp. paratuberculosis
gcggugggcaccagcag

SEQ ID NO: 997342 - RNA, 16 nt, Mycobacterium avium subsp. paratuberculosis
gcgguggcgcccgcgg

SEQ ID NO: 997343 - RNA, 19 nt, Mycobacterium avium subsp. paratuberculosis
gcgguggcgccgcgggcgg

SEQ ID NO: 997344 - RNA, 15 nt, Mycobacterium avium subsp. paratuberculosis
gcgguggcgccgggg

SEQ ID NO: 997345 - RNA, 20 nt, Mycobacterium avium subsp. paratuberculosis
gcgguggcgccggggcgggc

SEQ ID NO: 997346 - RNA, 13 nt, Mycobacterium avium subsp. paratuberculosis
gcgguggcggcga

SEQ ID NO: 997347 - RNA, 19 nt, Mycobacterium avium subsp. paratuberculosis
gcgguggccucggggguga

SEQ ID NO: 997348 - RNA, 23 nt, Mycobacterium avium subsp. paratuberculosis
gcgguggccucgggggugaaggc

SEQ ID NO: 997349 - RNA, 22 nt, Mycobacterium avium subsp. paratuberculosis
gcgguggccugcccggcggugc

SEQ ID NO: 997350 - RNA, 15 nt, Mycobacterium avium subsp. paratuberculosis
gcgguggcgaacugc

SEQ ID NO: 997351 - RNA, 16 nt, Mycobacterium avium subsp. paratuberculosis
gcggucggcgcggggc

SEQ ID NO: 997352 - RNA, 15 nt, Mycobacterium avium subsp. paratuberculosis
gcggucgguggcggu

SEQ ID NO: 997353 - RNA, 14 nt, Mycobacterium avium subsp. paratuberculosis
gcggucggcggcgu

SEQ ID NO: 997354 - RNA, 20 nt, Mycobacterium avium subsp. paratuberculosis
gcggucggaucgagcucgca

SEQ ID NO: 997355 - RNA, 18 nt, Mycobacterium avium subsp. paratuberculosis
gcggucggcaacccgacc

SEQ ID NO: 997356 - RNA, 21 nt, Mycobacterium avium subsp. paratuberculosis
gcggugcgcagucgcuggucg

SEQ ID NO: 997357 - RNA, 13 nt, Mycobacterium avium subsp. paratuberculosis
gcggugccgggcc

SEQ ID NO: 997358 - RNA, 13 nt, Mycobacterium avium subsp. paratuberculosis
gcggugccgggug

SEQ ID NO: 997359 - RNA, 17 nt, Mycobacterium avium subsp. paratuberculosis
gcggugcugcagcgcga

SEQ ID NO: 997360 - RNA, 22 nt, Mycobacterium avium subsp. paratuberculosis
gcggugcucgcgccgggcggcc

SEQ ID NO: 997361 - RNA, 16 nt, Mycobacterium avium subsp. paratuberculosis
gcggugcucggcgcgc

SEQ ID NO: 997362 - RNA, 22 nt, Mycobacterium avium subsp. paratuberculosis
gcggugcggggccgcggccggc

SEQ ID NO: 997363 - RNA, 15 nt, Mycobacterium avium subsp. paratuberculosis
gcggugcggucgcgc

SEQ ID NO: 997364 - RNA, 12 nt, Mycobacterium avium subsp. paratuberculosis
gcggugcggcgg

SEQ ID NO: 997365 - RNA, 16 nt, Mycobacterium avium subsp. paratuberculosis
gcggugcggcucgggc

SEQ ID NO: 997366 - RNA, 16 nt, Mycobacterium avium subsp. paratuberculosis
gcggugcggcuuugcu

SEQ ID NO: 997367 - RNA, 12 nt, Mycobacterium avium subsp. paratuberculosis
gcggugcggccc

SEQ ID NO: 997368 - RNA, 15 nt, Mycobacterium avium subsp. paratuberculosis
gcggugcggccgcgc

SEQ ID NO: 997369 - RNA, 20 nt, Mycobacterium avium subsp. paratuberculosis
gcggugcggccgcgcagcuc

SEQ ID NO: 997370 - RNA, 16 nt, Mycobacterium avium subsp. paratuberculosis
gcggucaugcgcgggc

SEQ ID NO: 997371 - RNA, 16 nt, Mycobacterium avium subsp. paratuberculosis
gcggucaucgagccgg

SEQ ID NO: 997372 - RNA, 18 nt, Mycobacterium avium subsp. paratuberculosis
gcggucaccggucggugc

SEQ ID NO: 997373 - RNA, 12 nt, Mycobacterium avium subsp. paratuberculosis
gcggucaacacg

SEQ ID NO: 997374 - RNA, 14 nt, Mycobacterium avium subsp. paratuberculosis
gcggucagcaccgu

SEQ ID NO: 997375 - RNA, 17 nt, Mycobacterium avium subsp. paratuberculosis
gcggucgcggugcccag

SEQ ID NO: 997376 - RNA, 21 nt, Mycobacterium avium subsp. paratuberculosis
gcggucgcgucgucggcgggc

SEQ ID NO: 997377 - RNA, 19 nt, Mycobacterium avium subsp. paratuberculosis
gcggucgcugacccgccgc

SEQ ID NO: 997378 - RNA, 22 nt, Mycobacterium avium subsp. paratuberculosis
gcggucgcggaaccggccgggg

SEQ ID NO: 997379 - RNA, 16 nt, Mycobacterium avium subsp. paratuberculosis
gcggucgcggcgccgg

SEQ ID NO: 997380 - RNA, 18 nt, Mycobacterium avium subsp. paratuberculosis
gcggucgccgcccacgcc

SEQ ID NO: 997381 - RNA, 15 nt, Mycobacterium avium subsp. paratuberculosis
gcggucgcgcagccg

SEQ ID NO: 997382 - RNA, 16 nt, Mycobacterium avium subsp. paratuberculosis
gcggucgcgcagccgg

SEQ ID NO: 997383 - RNA, 19 nt, Mycobacterium avium subsp. paratuberculosis
gcggucgcgcagccgggcg

SEQ ID NO: 997384 - RNA, 22 nt, Mycobacterium avium subsp. paratuberculosis
gcggucgcgcagccgggcggcg

SEQ ID NO: 997385 - RNA, 15 nt, Mycobacterium avium subsp. paratuberculosis
gcggucgcgccagac

SEQ ID NO: 997386 - RNA, 14 nt, Mycobacterium avium subsp. paratuberculosis
gcgguccaccacca

SEQ ID NO: 997387 - RNA, 13 nt, Mycobacterium avium subsp. paratuberculosis
gcggguguucagc

SEQ ID NO: 997388 - RNA, 19 nt, Mycobacterium avium subsp. paratuberculosis
gcggguguuucggucggcg

SEQ ID NO: 997389 - RNA, 16 nt, Mycobacterium avium subsp. paratuberculosis
gcgggugucgccggug

SEQ ID NO: 997390 - RNA, 17 nt, Mycobacterium avium subsp. paratuberculosis
gcggguugccgcuggcg

SEQ ID NO: 997391 - RNA, 20 nt, Mycobacterium avium subsp. paratuberculosis
gcggguugcugagccgccga

SEQ ID NO: 997392 - RNA, 20 nt, Mycobacterium avium subsp. paratuberculosis
gcggguuguucuccagcggc

SEQ ID NO: 997393 - RNA, 23 nt, Mycobacterium avium subsp. paratuberculosis
gcggguuguucuccagcggccgc

SEQ ID NO: 997394 - RNA, 21 nt, Mycobacterium avium subsp. paratuberculosis
gcggguuggccgucgaacugc

SEQ ID NO: 997395 - RNA, 15 nt, Mycobacterium avium subsp. paratuberculosis
gcggguuggucccga

SEQ ID NO: 997396 - RNA, 20 nt, Mycobacterium avium subsp. paratuberculosis
gcggguugucgucgucggcg

SEQ ID NO: 997397 - RNA, 21 nt, Mycobacterium avium subsp. paratuberculosis
gcgggauuuggcuagcgggcg

SEQ ID NO: 997398 - RNA, 23 nt, Mycobacterium avium subsp. paratuberculosis
gcgggauuggcgccacugccgcc

SEQ ID NO: 997399 - RNA, 22 nt, Mycobacterium avium subsp. paratuberculosis
gcgggcaccccaucggccagga

SEQ ID NO: 997400 - RNA, 19 nt, Mycobacterium avium subsp. paratuberculosis
gcgggcaccucggccaggu

SEQ ID NO: 997401 - RNA, 15 nt, Mycobacterium avium subsp. paratuberculosis
gcgggcaaucgcugc

SEQ ID NO: 997402 - RNA, 17 nt, Mycobacterium avium subsp. paratuberculosis
gcgggcaaucgcugcgc

SEQ ID NO: 997403 - RNA, 13 nt, Mycobacterium avium subsp. paratuberculosis
gcgggcacggcga

SEQ ID NO: 997404 - RNA, 22 nt, Mycobacterium avium subsp. paratuberculosis
gcgggcacgucgcgcggggucg

SEQ ID NO: 997405 - RNA, 23 nt, Mycobacterium avium subsp. paratuberculosis
gcgggcacgucgcgcggggucgg

SEQ ID NO: 997406 - RNA, 18 nt, Mycobacterium avium subsp. paratuberculosis
gcgggcacuucguccauc

SEQ ID NO: 997407 - RNA, 12 nt, Mycobacterium avium subsp. paratuberculosis
gcgggcagcacc

SEQ ID NO: 997408 - RNA, 15 nt, Mycobacterium avium subsp. paratuberculosis
gcgggcagcaccagc

SEQ ID NO: 997409 - RNA, 12 nt, Mycobacterium avium subsp. paratuberculosis
gcgggcagcagc

SEQ ID NO: 997410 - RNA, 13 nt, Mycobacterium avium subsp. paratuberculosis
gcgggcagccggc

SEQ ID NO: 997411 - RNA, 15 nt, Mycobacterium avium subsp. paratuberculosis
gcgggcagcgagcac

SEQ ID NO: 997412 - RNA, 21 nt, Mycobacterium avium subsp. paratuberculosis
gcggcuucauaugacgccggc

SEQ ID NO: 997413 - RNA, 23 nt, Mycobacterium avium subsp. paratuberculosis
gcggcuucauaugacgccggccu

SEQ ID NO: 997414 - RNA, 18 nt, Mycobacterium avium subsp. paratuberculosis
gcggcuugccgccgcagc

SEQ ID NO: 997415 - RNA, 19 nt, Mycobacterium avium subsp. paratuberculosis
gcgggaucccgcagccgcg

SEQ ID NO: 997416 - RNA, 16 nt, Mycobacterium avium subsp. paratuberculosis
gcgggaucgcggcggu

SEQ ID NO: 997417 - RNA, 16 nt, Mycobacterium avium subsp. paratuberculosis
gcgggaucggaccgca

SEQ ID NO: 997418 - RNA, 19 nt, Mycobacterium avium subsp. paratuberculosis
gcgggaucggaccgcacca

SEQ ID NO: 997419 - RNA, 18 nt, Mycobacterium avium subsp. paratuberculosis
gcgggaucggugccgacg

SEQ ID NO: 997420 - RNA, 16 nt, Mycobacterium avium subsp. paratuberculosis
gcgggaucugcgccgc

SEQ ID NO: 997421 - RNA, 15 nt, Mycobacterium avium subsp. paratuberculosis
gcgggaugccgagca

SEQ ID NO: 997422 - RNA, 23 nt, Mycobacterium avium subsp. paratuberculosis
gcggcgcuggucggcgggcagcg

SEQ ID NO: 997423 - RNA, 23 nt, Mycobacterium avium subsp. paratuberculosis
gcggcgcuugaccucgccgagca

SEQ ID NO: 997424 - RNA, 19 nt, Mycobacterium avium subsp. paratuberculosis
gcggcggccggccagcagc

SEQ ID NO: 997425 - RNA, 13 nt, Mycobacterium avium subsp. paratuberculosis
gcggcggccggcg

SEQ ID NO: 997426 - RNA, 20 nt, Mycobacterium avium subsp. paratuberculosis
gcggcggccuuuuucugcgc

SEQ ID NO: 997427 - RNA, 22 nt, Mycobacterium avium subsp. paratuberculosis
gcggcggcgccgacgggcccgc

SEQ ID NO: 997428 - RNA, 13 nt, Mycobacterium avium subsp. paratuberculosis
gcggcggcgccgc

SEQ ID NO: 997429 - RNA, 13 nt, Mycobacterium avium subsp. paratuberculosis
gcggcggcgcgcc

SEQ ID NO: 997430 - RNA, 15 nt, Mycobacterium avium subsp. paratuberculosis
gcggcggcgcgggcg

SEQ ID NO: 997431 - RNA, 17 nt, Mycobacterium avium subsp. paratuberculosis
gcggcggcugaagcgcu

SEQ ID NO: 997432 - RNA, 12 nt, Mycobacterium avium subsp. paratuberculosis
gcggcggcgggc

SEQ ID NO: 997433 - RNA, 15 nt, Mycobacterium avium subsp. paratuberculosis
gcggcggcgcugguc

SEQ ID NO: 997434 - RNA, 13 nt, Mycobacterium avium subsp. paratuberculosis
gcggcggcgcugg

SEQ ID NO: 997435 - RNA, 17 nt, Mycobacterium avium subsp. paratuberculosis
gcggcugaagcgcuggg

SEQ ID NO: 997436 - RNA, 23 nt, Mycobacterium avium subsp. paratuberculosis
gcggcugaagcgcugggacagcg

SEQ ID NO: 997437 - RNA, 15 nt, Mycobacterium avium subsp. paratuberculosis
gcggcucggccuucg

SEQ ID NO: 997438 - RNA, 14 nt, Mycobacterium avium subsp. paratuberculosis
gcggcggcggccgc

SEQ ID NO: 997439 - RNA, 16 nt, Mycobacterium avium subsp. paratuberculosis
gcggcgggccagggcg

SEQ ID NO: 997440 - RNA, 15 nt, Mycobacterium avium subsp. paratuberculosis
gcggcgggcccagca

SEQ ID NO: 997441 - RNA, 17 nt, Mycobacterium avium subsp. paratuberculosis
gcggcgggcccagcaga

SEQ ID NO: 997442 - RNA, 21 nt, Mycobacterium avium subsp. paratuberculosis
gcggcugccggccaaggcaag

SEQ ID NO: 997443 - RNA, 14 nt, Mycobacterium avium subsp. paratuberculosis
gcggcugaggcaag

SEQ ID NO: 997444 - RNA, 19 nt, Mycobacterium avium subsp. paratuberculosis
gcggcugaccgagcggcgc

SEQ ID NO: 997445 - RNA, 18 nt, Mycobacterium avium subsp. paratuberculosis
gcggggaaggugcgggcg

SEQ ID NO: 997446 - RNA, 15 nt, Mycobacterium avium subsp. paratuberculosis
gcggggccaccaggc

SEQ ID NO: 997447 - RNA, 12 nt, Mycobacterium avium subsp. paratuberculosis
gcggggcccggg

SEQ ID NO: 997448 - RNA, 17 nt, Mycobacterium avium subsp. paratuberculosis
gcggggccggcgcggug

SEQ ID NO: 997449 - RNA, 18 nt, Mycobacterium avium subsp. paratuberculosis
gcggggccggcgcuggcg

SEQ ID NO: 997450 - RNA, 15 nt, Mycobacterium avium subsp. paratuberculosis
gcggggccggcggcg

SEQ ID NO: 997451 - RNA, 20 nt, Mycobacterium avium subsp. paratuberculosis
gcggggccucgucgccgcgg

SEQ ID NO: 997452 - RNA, 20 nt, Mycobacterium avium subsp. paratuberculosis
gcggggcgggggcguuggug

SEQ ID NO: 997453 - RNA, 19 nt, Mycobacterium avium subsp. paratuberculosis
gcggggcgucgaugcguga

SEQ ID NO: 997454 - RNA, 22 nt, Mycobacterium avium subsp. paratuberculosis
gcggggcgaacccggcgcccgg

SEQ ID NO: 997455 - RNA, 16 nt, Mycobacterium avium subsp. paratuberculosis
gcggggcgccgacagu

SEQ ID NO: 997456 - RNA, 12 nt, Mycobacterium avium subsp. paratuberculosis
gcggggcggccg

SEQ ID NO: 997457 - RNA, 13 nt, Mycobacterium avium subsp. paratuberculosis
gcggggcggccgc

SEQ ID NO: 997458 - RNA, 18 nt, Mycobacterium avium subsp. paratuberculosis
gcggggcggccgccgggc

SEQ ID NO: 997459 - RNA, 16 nt, Mycobacterium avium subsp. paratuberculosis
gcgggggcgcguccgc

SEQ ID NO: 997460 - RNA, 13 nt, Mycobacterium avium subsp. paratuberculosis
gcgggggcggccg

SEQ ID NO: 997461 - RNA, 24 nt, Mycobacterium avium subsp. paratuberculosis
gcgggggauccgccugcgcgggcg

SEQ ID NO: 997462 - RNA, 17 nt, Mycobacterium avium subsp. paratuberculosis
gcgggggaucgggaagu

SEQ ID NO: 997463 - RNA, 17 nt, Mycobacterium avium subsp. paratuberculosis
gcgggucacggucaggc

SEQ ID NO: 997464 - RNA, 23 nt, Mycobacterium avium subsp. paratuberculosis
gcgggucagcuccaccugcggca

SEQ ID NO: 997465 - RNA, 20 nt, Mycobacterium avium subsp. paratuberculosis
gcgggucgauaugcugcaac

SEQ ID NO: 997466 - RNA, 14 nt, Mycobacterium avium subsp. paratuberculosis
gcgggucgccgggc

SEQ ID NO: 997467 - RNA, 23 nt, Mycobacterium avium subsp. paratuberculosis
gcggguccaucgccucgaccagc

SEQ ID NO: 997468 - RNA, 15 nt, Mycobacterium avium subsp. paratuberculosis
gcggguccagccgcc

SEQ ID NO: 997469 - RNA, 19 nt, Mycobacterium avium subsp. paratuberculosis
gcggguccagccgccggcg

SEQ ID NO: 997470 - RNA, 15 nt, Mycobacterium avium subsp. paratuberculosis
gcgggucggccggcg

SEQ ID NO: 997471 - RNA, 15 nt, Mycobacterium avium subsp. paratuberculosis
gcgggucggcgacgg

SEQ ID NO: 997472 - RNA, 20 nt, Mycobacterium avium subsp. paratuberculosis
gcgggucggcgacggcgcuc

SEQ ID NO: 997473 - RNA, 14 nt, Mycobacterium avium subsp. paratuberculosis
gcgggucuggcucg

SEQ ID NO: 997474 - RNA, 14 nt, Mycobacterium avium subsp. paratuberculosis
gcgggucggugggc

SEQ ID NO: 997475 - RNA, 14 nt, Mycobacterium avium subsp. paratuberculosis
gcgggucgguggug

SEQ ID NO: 997476 - RNA, 15 nt, Mycobacterium avium subsp. paratuberculosis
gcgggucgccgggca

SEQ ID NO: 997477 - RNA, 15 nt, Mycobacterium avium subsp. paratuberculosis
gcgggucgcgcugcg

SEQ ID NO: 997478 - RNA, 17 nt, Mycobacterium avium subsp. paratuberculosis
gcgggucgucgaugccc

SEQ ID NO: 997479 - RNA, 21 nt, Mycobacterium avium subsp. paratuberculosis
gcgggucgugcaucggcgccu

SEQ ID NO: 997480 - RNA, 22 nt, Mycobacterium avium subsp. paratuberculosis
gcgggucguuggcggcgguggg

SEQ ID NO: 997481 - RNA, 19 nt, Mycobacterium avium subsp. paratuberculosis
gcgggucucgaaccgggcg

SEQ ID NO: 997482 - RNA, 18 nt, Mycobacterium avium subsp. paratuberculosis
gcgggucucgcccaccuu

SEQ ID NO: 997483 - RNA, 23 nt, Mycobacterium avium subsp. paratuberculosis
gcgggcgaaggagaagacacgcu

SEQ ID NO: 997484 - RNA, 19 nt, Mycobacterium avium subsp. paratuberculosis
gcgggcgaaguagccggcg

SEQ ID NO: 997485 - RNA, 16 nt, Mycobacterium avium subsp. paratuberculosis
gcgggcgauggcgggc

SEQ ID NO: 997486 - RNA, 16 nt, Mycobacterium avium subsp. paratuberculosis
gcgggcgaucuccagc

SEQ ID NO: 997487 - RNA, 21 nt, Mycobacterium avium subsp. paratuberculosis
gcgggcgacuucuucgccggc

SEQ ID NO: 997488 - RNA, 16 nt, Mycobacterium avium subsp. paratuberculosis
gcgggcgagcagcgcc

SEQ ID NO: 997489 - RNA, 17 nt, Mycobacterium avium subsp. paratuberculosis
gcgggcgagcagcgccc

SEQ ID NO: 997490 - RNA, 19 nt, Mycobacterium avium subsp. paratuberculosis
gcgggcuguccgcguggcc

SEQ ID NO: 997491 - RNA, 21 nt, Mycobacterium avium subsp. paratuberculosis
gcgggcgauuucgucggcggu

SEQ ID NO: 997492 - RNA, 14 nt, Mycobacterium avium subsp. paratuberculosis
gcgggccaaagagc

SEQ ID NO: 997493 - RNA, 19 nt, Mycobacterium avium subsp. paratuberculosis
gcgggccaaagagcuuggc

SEQ ID NO: 997494 - RNA, 15 nt, Mycobacterium avium subsp. paratuberculosis
gcgggcaucggcugg

SEQ ID NO: 997495 - RNA, 17 nt, Mycobacterium avium subsp. paratuberculosis
gcgggccaccgcggcgu

SEQ ID NO: 997496 - RNA, 13 nt, Mycobacterium avium subsp. paratuberculosis
gcgggccagcacg

SEQ ID NO: 997497 - RNA, 12 nt, Mycobacterium avium subsp. paratuberculosis
gcgggccagcag

SEQ ID NO: 997498 - RNA, 14 nt, Mycobacterium avium subsp. paratuberculosis
gcgggccagcagca

SEQ ID NO: 997499 - RNA, 13 nt, Mycobacterium avium subsp. paratuberculosis
gcgggccagcagc

SEQ ID NO: 997500 - RNA, 13 nt, Mycobacterium avium subsp. paratuberculosis
gcgggccagcagu

SEQ ID NO: 997501 - RNA, 18 nt, Mycobacterium avium subsp. paratuberculosis
gcgggccucgccgcuucg

SEQ ID NO: 997502 - RNA, 13 nt, Mycobacterium avium subsp. paratuberculosis
gcgggccaggaug

SEQ ID NO: 997503 - RNA, 17 nt, Mycobacterium avium subsp. paratuberculosis
gcgggccagcgccuucg

SEQ ID NO: 997504 - RNA, 12 nt, Mycobacterium avium subsp. paratuberculosis
gcgggccaggcg

SEQ ID NO: 997505 - RNA, 20 nt, Mycobacterium avium subsp. paratuberculosis
gcgggccagggcgaggacgg

SEQ ID NO: 997506 - RNA, 21 nt, Mycobacterium avium subsp. paratuberculosis
gcgggccaucgacuccagcac

SEQ ID NO: 997507 - RNA, 14 nt, Mycobacterium avium subsp. paratuberculosis
gcgggcccaccgcc

SEQ ID NO: 997508 - RNA, 15 nt, Mycobacterium avium subsp. paratuberculosis
gcgggcccaccgcgc

SEQ ID NO: 997509 - RNA, 19 nt, Mycobacterium avium subsp. paratuberculosis
gcgggcccaccgcgcgcug

SEQ ID NO: 997510 - RNA, 15 nt, Mycobacterium avium subsp. paratuberculosis
gcucaggcguccagc

SEQ ID NO: 997511 - RNA, 17 nt, Mycobacterium avium subsp. paratuberculosis
gcucaggcguccagcca

SEQ ID NO: 997512 - RNA, 19 nt, Mycobacterium avium subsp. paratuberculosis
gcucaggcguccagccagc

SEQ ID NO: 997513 - RNA, 17 nt, Mycobacterium avium subsp. paratuberculosis
gcucagggugcgcuggc

SEQ ID NO: 997514 - RNA, 17 nt, Mycobacterium avium subsp. paratuberculosis
gcucaggugcgacgccc

SEQ ID NO: 997515 - RNA, 19 nt, Mycobacterium avium subsp. paratuberculosis
gcucaggucggccgcggcc

SEQ ID NO: 997516 - RNA, 20 nt, Mycobacterium avium subsp. paratuberculosis
gcucagguugcgcagcagcc

SEQ ID NO: 997517 - RNA, 11 nt, Mycobacterium avium subsp. paratuberculosis
gcucagugcac

SEQ ID NO: 997518 - RNA, 19 nt, Mycobacterium avium subsp. paratuberculosis
gcucagugcacgcucggcg

SEQ ID NO: 997519 - RNA, 14 nt, Mycobacterium avium subsp. paratuberculosis
gcucauacggcggc

SEQ ID NO: 997520 - RNA, 16 nt, Mycobacterium avium subsp. paratuberculosis
gcucauacggcggcuc

SEQ ID NO: 997521 - RNA, 18 nt, Mycobacterium avium subsp. paratuberculosis
gcucaucaccggcgcgcc

SEQ ID NO: 997522 - RNA, 15 nt, Mycobacterium avium subsp. paratuberculosis
gcuccaacagccggu

SEQ ID NO: 997523 - RNA, 22 nt, Mycobacterium avium subsp. paratuberculosis
gcucaucgaggucgaaccacgc

SEQ ID NO: 997524 - RNA, 13 nt, Mycobacterium avium subsp. paratuberculosis
gcuccagcaggcu

SEQ ID NO: 997525 - RNA, 11 nt, Mycobacterium avium subsp. paratuberculosis
gcuccagcagc

SEQ ID NO: 997526 - RNA, 12 nt, Mycobacterium avium subsp. paratuberculosis
gcuccagcagcg

SEQ ID NO: 997527 - RNA, 14 nt, Mycobacterium avium subsp. paratuberculosis
gcuccagcagcggc

SEQ ID NO: 997528 - RNA, 18 nt, Mycobacterium avium subsp. paratuberculosis
gcuccagccacuccacca

SEQ ID NO: 997529 - RNA, 16 nt, Mycobacterium avium subsp. paratuberculosis
gcucagcaacccgccg

SEQ ID NO: 997530 - RNA, 18 nt, Mycobacterium avium subsp. paratuberculosis
gcucagacugccgagcau

SEQ ID NO: 997531 - RNA, 18 nt, Mycobacterium avium subsp. paratuberculosis
gcucagccccagcggagc

SEQ ID NO: 997532 - RNA, 19 nt, Mycobacterium avium subsp. paratuberculosis
gcucagcccgauucagccg

SEQ ID NO: 997533 - RNA, 22 nt, Mycobacterium avium subsp. paratuberculosis
gcucagcccggaaaaccccacc

SEQ ID NO: 997534 - RNA, 19 nt, Mycobacterium avium subsp. paratuberculosis
gcucaggacgaacgcuggc

SEQ ID NO: 997535 - RNA, 16 nt, Mycobacterium avium subsp. paratuberculosis
gcucaggaucagcagc

SEQ ID NO: 997536 - RNA, 20 nt, Mycobacterium avium subsp. paratuberculosis
gcucaccccggccagggugc

SEQ ID NO: 997537 - RNA, 19 nt, Mycobacterium avium subsp. paratuberculosis
gcucacccggcccaccggc

SEQ ID NO: 997538 - RNA, 21 nt, Mycobacterium avium subsp. paratuberculosis
gcucaccgagcugggccggcg

SEQ ID NO: 997539 - RNA, 15 nt, Mycobacterium avium subsp. paratuberculosis
gcucaccgccgagcc

SEQ ID NO: 997540 - RNA, 18 nt, Mycobacterium avium subsp. paratuberculosis
gcucaccgccgagccgcu

SEQ ID NO: 997541 - RNA, 14 nt, Mycobacterium avium subsp. paratuberculosis
gcucacagcgcggc

SEQ ID NO: 997542 - RNA, 18 nt, Mycobacterium avium subsp. paratuberculosis
gcuacugccgacgcauuu

SEQ ID NO: 997543 - RNA, 21 nt, Mycobacterium avium subsp. paratuberculosis
gcuacuucuucuccaugguga

SEQ ID NO: 997544 - RNA, 19 nt, Mycobacterium avium subsp. paratuberculosis
gcuaggcggccgggcggcc

SEQ ID NO: 997545 - RNA, 14 nt, Mycobacterium avium subsp. paratuberculosis
gcuaggccagcagc

SEQ ID NO: 997546 - RNA, 16 nt, Mycobacterium avium subsp. paratuberculosis
gcuagucgcccagcag

SEQ ID NO: 997547 - RNA, 18 nt, Mycobacterium avium subsp. paratuberculosis
gcuagucgcccagcagcc

SEQ ID NO: 997548 - RNA, 20 nt, Mycobacterium avium subsp. paratuberculosis
gcuccguccaccggcacggc

SEQ ID NO: 997549 - RNA, 18 nt, Mycobacterium avium subsp. paratuberculosis
gcuccggugauucgugca

SEQ ID NO: 997550 - RNA, 21 nt, Mycobacterium avium subsp. paratuberculosis
gcuccggugauucgugcagug

SEQ ID NO: 997551 - RNA, 16 nt, Mycobacterium avium subsp. paratuberculosis
gcuccgacgcgguggc

SEQ ID NO: 997552 - RNA, 14 nt, Mycobacterium avium subsp. paratuberculosis
gcuccgaucuccug

SEQ ID NO: 997553 - RNA, 21 nt, Mycobacterium avium subsp. paratuberculosis
gcuccgccacccugcgcaccg

SEQ ID NO: 997554 - RNA, 16 nt, Mycobacterium avium subsp. paratuberculosis
gcuccuaugucggugc

SEQ ID NO: 997555 - RNA, 23 nt, Mycobacterium avium subsp. paratuberculosis
gcuccuaugucggugcggcgggc

SEQ ID NO: 997556 - RNA, 21 nt, Mycobacterium avium subsp. paratuberculosis
gcuccuccggguccccgccgc

SEQ ID NO: 997557 - RNA, 22 nt, Mycobacterium avium subsp. paratuberculosis
gcuccuccucgcgccgccacgc

SEQ ID NO: 997558 - RNA, 23 nt, Mycobacterium avium subsp. paratuberculosis
gcucgaaaugccuuggcggcgug

SEQ ID NO: 997559 - RNA, 19 nt, Mycobacterium avium subsp. paratuberculosis
gcuccucgaaccucgcggc

SEQ ID NO: 997560 - RNA, 22 nt, Mycobacterium avium subsp. paratuberculosis
gcuccucgaaccucgcggcggc

SEQ ID NO: 997561 - RNA, 17 nt, Mycobacterium avium subsp. paratuberculosis
gcuccucggucagcggc

SEQ ID NO: 997562 - RNA, 12 nt, Mycobacterium avium subsp. paratuberculosis
gcuccucggcca

SEQ ID NO: 997563 - RNA, 19 nt, Mycobacterium avium subsp. paratuberculosis
gcucgacaggcagcccggc

SEQ ID NO: 997564 - RNA, 15 nt, Mycobacterium avium subsp. paratuberculosis
gcucgaccacgccgu

SEQ ID NO: 997565 - RNA, 19 nt, Mycobacterium avium subsp. paratuberculosis
gcucgaaguggcagcgcuc

SEQ ID NO: 997566 - RNA, 14 nt, Mycobacterium avium subsp. paratuberculosis
gcucgaagcccagg

SEQ ID NO: 997567 - RNA, 15 nt, Mycobacterium avium subsp. paratuberculosis
gcucgaaccuggagg

SEQ ID NO: 997568 - RNA, 21 nt, Mycobacterium avium subsp. paratuberculosis
gcucgaugcgcaccugcggcc

SEQ ID NO: 997569 - RNA, 20 nt, Mycobacterium avium subsp. paratuberculosis
gcucgaugcgcgccagcagc

SEQ ID NO: 997570 - RNA, 14 nt, Mycobacterium avium subsp. paratuberculosis
gcucgaccagcccc

SEQ ID NO: 997571 - RNA, 17 nt, Mycobacterium avium subsp. paratuberculosis
gcucgaccccucggcau

SEQ ID NO: 997572 - RNA, 17 nt, Mycobacterium avium subsp. paratuberculosis
gcucgaccucggcggcc

SEQ ID NO: 997573 - RNA, 23 nt, Mycobacterium avium subsp. paratuberculosis
gcucgacgaacuccgcgcgcggc

SEQ ID NO: 997574 - RNA, 19 nt, Mycobacterium avium subsp. paratuberculosis
gcucgauggccagcgcguc

SEQ ID NO: 997575 - RNA, 21 nt, Mycobacterium avium subsp. paratuberculosis
gcucgauggcgccgaucgcgc

SEQ ID NO: 997576 - RNA, 13 nt, Mycobacterium avium subsp. paratuberculosis
gcucgcaggcgag

SEQ ID NO: 997577 - RNA, 15 nt, Mycobacterium avium subsp. paratuberculosis
gcucgccggggacga

SEQ ID NO: 997578 - RNA, 21 nt, Mycobacterium avium subsp. paratuberculosis
gcucgccgucacaccgcggcc

SEQ ID NO: 997579 - RNA, 14 nt, Mycobacterium avium subsp. paratuberculosis
gcucgccgucggcc

SEQ ID NO: 997580 - RNA, 13 nt, Mycobacterium avium subsp. paratuberculosis
gcucgccggcggc

SEQ ID NO: 997581 - RNA, 16 nt, Mycobacterium avium subsp. paratuberculosis
gcucgccggcggccgc

SEQ ID NO: 997582 - RNA, 18 nt, Mycobacterium avium subsp. paratuberculosis
gcucgcagauggucggga

SEQ ID NO: 997583 - RNA, 13 nt, Mycobacterium avium subsp. paratuberculosis
gcucgcgcugaag

SEQ ID NO: 997584 - RNA, 16 nt, Mycobacterium avium subsp. paratuberculosis
gcucgcgcugccgcgc

SEQ ID NO: 997585 - RNA, 17 nt, Mycobacterium avium subsp. paratuberculosis
gcucgcgcugccgcgcg

SEQ ID NO: 997586 - RNA, 19 nt, Mycobacterium avium subsp. paratuberculosis
gcucgcgcugccgcgcgcc

SEQ ID NO: 997587 - RNA, 13 nt, Mycobacterium avium subsp. paratuberculosis
gcucgcgcuggcg

SEQ ID NO: 997588 - RNA, 16 nt, Mycobacterium avium subsp. paratuberculosis
gcucgcgcagcuggcc

SEQ ID NO: 997589 - RNA, 20 nt, Mycobacterium avium subsp. paratuberculosis
gcucgcgguugggccgccgg

SEQ ID NO: 997590 - RNA, 22 nt, Mycobacterium avium subsp. paratuberculosis
gcucgcgguugggccgccggcc

SEQ ID NO: 997591 - RNA, 19 nt, Mycobacterium avium subsp. paratuberculosis
gcucgcgguugggccggcg

SEQ ID NO: 997592 - RNA, 20 nt, Mycobacterium avium subsp. paratuberculosis
gcucgcgguugggccggcgc

SEQ ID NO: 997593 - RNA, 21 nt, Mycobacterium avium subsp. paratuberculosis
gcucgcgguugggccggcgcc

SEQ ID NO: 997594 - RNA, 18 nt, Mycobacterium avium subsp. paratuberculosis
gcucgcgggugucgagcc

SEQ ID NO: 997595 - RNA, 22 nt, Mycobacterium avium subsp. paratuberculosis
gcucgcgggugucgagccacca

SEQ ID NO: 997596 - RNA, 20 nt, Mycobacterium avium subsp. paratuberculosis
gcucgcgggccacagcggcg

SEQ ID NO: 997597 - RNA, 14 nt, Mycobacterium avium subsp. paratuberculosis
gcucgcgggccacc

SEQ ID NO: 997598 - RNA, 13 nt, Mycobacterium avium subsp. paratuberculosis
gcucgcgggcccg

SEQ ID NO: 997599 - RNA, 21 nt, Mycobacterium avium subsp. paratuberculosis
gcucgcgggcgaugcggcccg

SEQ ID NO: 997600 - RNA, 14 nt, Mycobacterium avium subsp. paratuberculosis
gcucgcggcgcagc

SEQ ID NO: 997601 - RNA, 16 nt, Mycobacterium avium subsp. paratuberculosis
gcucgcggcgcagcuc

SEQ ID NO: 997602 - RNA, 21 nt, Mycobacterium avium subsp. paratuberculosis
gcucgcggauccgggccggcg

SEQ ID NO: 997603 - RNA, 17 nt, Mycobacterium avium subsp. paratuberculosis
gcucgcgccgggcggcc

SEQ ID NO: 997604 - RNA, 19 nt, Mycobacterium avium subsp. paratuberculosis
gcucgcucccgcgcgggca

SEQ ID NO: 997605 - RNA, 23 nt, Mycobacterium avium subsp. paratuberculosis
gcucgcguucgggcccggccgcc

SEQ ID NO: 997606 - RNA, 18 nt, Mycobacterium avium subsp. paratuberculosis
gcucgcguggccugggcg

SEQ ID NO: 997607 - RNA, 15 nt, Mycobacterium avium subsp. paratuberculosis
gcucgcggucgggga

SEQ ID NO: 997608 - RNA, 21 nt, Mycobacterium avium subsp. paratuberculosis
gcucggaguugcgcagccggg

SEQ ID NO: 997609 - RNA, 13 nt, Mycobacterium avium subsp. paratuberculosis
gcucggcgaccug

SEQ ID NO: 997610 - RNA, 15 nt, Mycobacterium avium subsp. paratuberculosis
gcucggcgaucuggc

SEQ ID NO: 997611 - RNA, 23 nt, Mycobacterium avium subsp. paratuberculosis
gcucggcgaucaccgcguucucg

SEQ ID NO: 997612 - RNA, 21 nt, Mycobacterium avium subsp. paratuberculosis
gcucggccuucggggugguca

SEQ ID NO: 997613 - RNA, 15 nt, Mycobacterium avium subsp. paratuberculosis
gcucggcgcaacggg

SEQ ID NO: 997614 - RNA, 13 nt, Mycobacterium avium subsp. paratuberculosis
gcucggcgcccca

SEQ ID NO: 997615 - RNA, 14 nt, Mycobacterium avium subsp. paratuberculosis
gcucggcgccgcgg

SEQ ID NO: 997616 - RNA, 13 nt, Mycobacterium avium subsp. paratuberculosis
gcucggcgcggcu

SEQ ID NO: 997617 - RNA, 15 nt, Mycobacterium avium subsp. paratuberculosis
gcucggcgcuccagc

SEQ ID NO: 997618 - RNA, 13 nt, Mycobacterium avium subsp. paratuberculosis
gcucggcggcccg

SEQ ID NO: 997619 - RNA, 17 nt, Mycobacterium avium subsp. paratuberculosis
gcucggcggcccgcagg

SEQ ID NO: 997620 - RNA, 14 nt, Mycobacterium avium subsp. paratuberculosis
gcucggcggccgcc

SEQ ID NO: 997621 - RNA, 16 nt, Mycobacterium avium subsp. paratuberculosis
gcucggcggccugcuu

SEQ ID NO: 997622 - RNA, 15 nt, Mycobacterium avium subsp. paratuberculosis
gcucggcggcgcagg

SEQ ID NO: 997623 - RNA, 14 nt, Mycobacterium avium subsp. paratuberculosis
gcucggcggcgcgc

SEQ ID NO: 997624 - RNA, 14 nt, Mycobacterium avium subsp. paratuberculosis
gcucggccaccagc

SEQ ID NO: 997625 - RNA, 14 nt, Mycobacterium avium subsp. paratuberculosis
gcucggccaucccc

SEQ ID NO: 997626 - RNA, 20 nt, Mycobacterium avium subsp. paratuberculosis
gcucggccgccgacaccacc

SEQ ID NO: 997627 - RNA, 14 nt, Mycobacterium avium subsp. paratuberculosis
gcucggccggggcg

SEQ ID NO: 997628 - RNA, 15 nt, Mycobacterium avium subsp. paratuberculosis
gcucggccucaggcg

SEQ ID NO: 997629 - RNA, 15 nt, Mycobacterium avium subsp. paratuberculosis
gcuaaaccccacggc

SEQ ID NO: 997630 - RNA, 14 nt, Mycobacterium avium subsp. paratuberculosis
gcuaagcgauuacg

SEQ ID NO: 997631 - RNA, 23 nt, Mycobacterium avium subsp. paratuberculosis
gcuaccaggcgugcacccgguuc

SEQ ID NO: 997632 - RNA, 16 nt, Mycobacterium avium subsp. paratuberculosis
gcuaccagccccagga

SEQ ID NO: 997633 - RNA, 21 nt, Mycobacterium avium subsp. paratuberculosis
gcuacccggcgaaccgggaca

SEQ ID NO: 997634 - RNA, 23 nt, Mycobacterium avium subsp. paratuberculosis
gcgucucgaugaccucgcgggug

SEQ ID NO: 997635 - RNA, 21 nt, Mycobacterium avium subsp. paratuberculosis
gcgucucggcgaucagcugcc

SEQ ID NO: 997636 - RNA, 17 nt, Mycobacterium avium subsp. paratuberculosis
gcguauccggccagccg

SEQ ID NO: 997637 - RNA, 18 nt, Mycobacterium avium subsp. paratuberculosis
gcguauccggccagccgg

SEQ ID NO: 997638 - RNA, 16 nt, Mycobacterium avium subsp. paratuberculosis
gcgucuuuucccacac

SEQ ID NO: 997639 - RNA, 20 nt, Mycobacterium avium subsp. paratuberculosis
gcgucuugacgaacuccugc

SEQ ID NO: 997640 - RNA, 17 nt, Mycobacterium avium subsp. paratuberculosis
gcgucugcucggcggcu

SEQ ID NO: 997641 - RNA, 16 nt, Mycobacterium avium subsp. paratuberculosis
gcgucugcucgcgccc

SEQ ID NO: 997642 - RNA, 21 nt, Mycobacterium avium subsp. paratuberculosis
gcgugcccgcgcccaccugga

SEQ ID NO: 997643 - RNA, 15 nt, Mycobacterium avium subsp. paratuberculosis
gcgugccagggcagc

SEQ ID NO: 997644 - RNA, 13 nt, Mycobacterium avium subsp. paratuberculosis
gcgugcuccagca

SEQ ID NO: 997645 - RNA, 18 nt, Mycobacterium avium subsp. paratuberculosis
gcgugccaccgcugggcg

SEQ ID NO: 997646 - RNA, 22 nt, Mycobacterium avium subsp. paratuberculosis
gcgugccaccgcugggcggcgc

SEQ ID NO: 997647 - RNA, 22 nt, Mycobacterium avium subsp. paratuberculosis
gcgugccaaccacuugaagccg

SEQ ID NO: 997648 - RNA, 21 nt, Mycobacterium avium subsp. paratuberculosis
gcgugaaucuuggccagcagc

SEQ ID NO: 997649 - RNA, 17 nt, Mycobacterium avium subsp. paratuberculosis
gcgugauguacagcgac

SEQ ID NO: 997650 - RNA, 18 nt, Mycobacterium avium subsp. paratuberculosis
gcgugaacagcgcccggc

SEQ ID NO: 997651 - RNA, 20 nt, Mycobacterium avium subsp. paratuberculosis
gcgugaacgugugggugagc

SEQ ID NO: 997652 - RNA, 18 nt, Mycobacterium avium subsp. paratuberculosis
gcgugcacacccgcagcg

SEQ ID NO: 997653 - RNA, 16 nt, Mycobacterium avium subsp. paratuberculosis
gcgugcacaggccgcc

SEQ ID NO: 997654 - RNA, 15 nt, Mycobacterium avium subsp. paratuberculosis
gcgugcagccgaaga

SEQ ID NO: 997655 - RNA, 13 nt, Mycobacterium avium subsp. paratuberculosis
gcgugcagccgca

SEQ ID NO: 997656 - RNA, 14 nt, Mycobacterium avium subsp. paratuberculosis
gcgugcagcgcggc

SEQ ID NO: 997657 - RNA, 18 nt, Mycobacterium avium subsp. paratuberculosis
gcguggggcgucgccgcc

SEQ ID NO: 997658 - RNA, 16 nt, Mycobacterium avium subsp. paratuberculosis
gcguggcacccgggcg

SEQ ID NO: 997659 - RNA, 18 nt, Mycobacterium avium subsp. paratuberculosis
gcguggcaggccaucagc

SEQ ID NO: 997660 - RNA, 21 nt, Mycobacterium avium subsp. paratuberculosis
gcguggaacacgcccagcgcc

SEQ ID NO: 997661 - RNA, 19 nt, Mycobacterium avium subsp. paratuberculosis
gcgugcuugaacgccgccc

SEQ ID NO: 997662 - RNA, 18 nt, Mycobacterium avium subsp. paratuberculosis
gcguggaacgcgucgcgc

SEQ ID NO: 997663 - RNA, 22 nt, Mycobacterium avium subsp. paratuberculosis
gcguggaacgcgucgcgccagc

SEQ ID NO: 997664 - RNA, 15 nt, Mycobacterium avium subsp. paratuberculosis
gcgugcuccagcagg

SEQ ID NO: 997665 - RNA, 21 nt, Mycobacterium avium subsp. paratuberculosis
gcgugcucggaguaguccagc

SEQ ID NO: 997666 - RNA, 18 nt, Mycobacterium avium subsp. paratuberculosis
gcgugcucgucgcggagg

SEQ ID NO: 997667 - RNA, 19 nt, Mycobacterium avium subsp. paratuberculosis
gcgugcucgucgcggagga

SEQ ID NO: 997668 - RNA, 15 nt, Mycobacterium avium subsp. paratuberculosis
gcgugcugggcaccg

SEQ ID NO: 997669 - RNA, 18 nt, Mycobacterium avium subsp. paratuberculosis
gcguggucacccgcagcc

SEQ ID NO: 997670 - RNA, 21 nt, Mycobacterium avium subsp. paratuberculosis
gcguggucagcgucucgccgg

SEQ ID NO: 997671 - RNA, 16 nt, Mycobacterium avium subsp. paratuberculosis
gcguggguguccuugc

SEQ ID NO: 997672 - RNA, 17 nt, Mycobacterium avium subsp. paratuberculosis
gcguuccggcggccggc

SEQ ID NO: 997673 - RNA, 16 nt, Mycobacterium avium subsp. paratuberculosis
gcguucccgggcccgc

SEQ ID NO: 997674 - RNA, 18 nt, Mycobacterium avium subsp. paratuberculosis
gcguucgcguucgggcag

SEQ ID NO: 997675 - RNA, 15 nt, Mycobacterium avium subsp. paratuberculosis
gcguucgacccacac

SEQ ID NO: 997676 - RNA, 19 nt, Mycobacterium avium subsp. paratuberculosis
gcguucgaugcccugcccc

SEQ ID NO: 997677 - RNA, 18 nt, Mycobacterium avium subsp. paratuberculosis
gcguucgauugccggacg

SEQ ID NO: 997678 - RNA, 21 nt, Mycobacterium avium subsp. paratuberculosis
gcguuuggccugcggcaacag

SEQ ID NO: 997679 - RNA, 16 nt, Mycobacterium avium subsp. paratuberculosis
gcguucugcaccagcu

SEQ ID NO: 997680 - RNA, 20 nt, Mycobacterium avium subsp. paratuberculosis
gcguucuccacccgccccuc

SEQ ID NO: 997681 - RNA, 20 nt, Mycobacterium avium subsp. paratuberculosis
gcguugagcgucgccaccac

SEQ ID NO: 997682 - RNA, 15 nt, Mycobacterium avium subsp. paratuberculosis
gcguugaccgggccg

SEQ ID NO: 997683 - RNA, 16 nt, Mycobacterium avium subsp. paratuberculosis
gcgcccacagcaggua

SEQ ID NO: 997684 - RNA, 21 nt, Mycobacterium avium subsp. paratuberculosis
gcgcccacagguccagcgucc

SEQ ID NO: 997685 - RNA, 14 nt, Mycobacterium avium subsp. paratuberculosis
gcgcccaggggagc

SEQ ID NO: 997686 - RNA, 20 nt, Mycobacterium avium subsp. paratuberculosis
gcgccauguccuuggugaug

SEQ ID NO: 997687 - RNA, 22 nt, Mycobacterium avium subsp. paratuberculosis
gcgccaguaguggaucagccag

SEQ ID NO: 997688 - RNA, 15 nt, Mycobacterium avium subsp. paratuberculosis
gcgccagggucuggc

SEQ ID NO: 997689 - RNA, 13 nt, Mycobacterium avium subsp. paratuberculosis
gcgccagcgccag

SEQ ID NO: 997690 - RNA, 21 nt, Mycobacterium avium subsp. paratuberculosis
gcgccagcguggccagcaccg

SEQ ID NO: 997691 - RNA, 16 nt, Mycobacterium avium subsp. paratuberculosis
gcgccaggugggugaa

SEQ ID NO: 997692 - RNA, 23 nt, Mycobacterium avium subsp. paratuberculosis
gcgccagucgcggcgaaccagca

SEQ ID NO: 997693 - RNA, 20 nt, Mycobacterium avium subsp. paratuberculosis
gcgccaggucgaagaggugc

SEQ ID NO: 997694 - RNA, 12 nt, Mycobacterium avium subsp. paratuberculosis
gcgcaggcgcgc

SEQ ID NO: 997695 - RNA, 22 nt, Mycobacterium avium subsp. paratuberculosis
gcgccacugccgccgcccaggc

SEQ ID NO: 997696 - RNA, 16 nt, Mycobacterium avium subsp. paratuberculosis
gcgcaggaacagcgac

SEQ ID NO: 997697 - RNA, 14 nt, Mycobacterium avium subsp. paratuberculosis
gcgcaggccccggc

SEQ ID NO: 997698 - RNA, 17 nt, Mycobacterium avium subsp. paratuberculosis
gcgcaggccguccagca

SEQ ID NO: 997699 - RNA, 19 nt, Mycobacterium avium subsp. paratuberculosis
gcgcaggccguccagcagc

SEQ ID NO: 997700 - RNA, 16 nt, Mycobacterium avium subsp. paratuberculosis
gcgccagcgccagcgu

SEQ ID NO: 997701 - RNA, 19 nt, Mycobacterium avium subsp. paratuberculosis
gcgccagcgagugggugaa

SEQ ID NO: 997702 - RNA, 21 nt, Mycobacterium avium subsp. paratuberculosis
gcgccagcaacacccagccgc

SEQ ID NO: 997703 - RNA, 18 nt, Mycobacterium avium subsp. paratuberculosis
gcgccagaucccgcagcu

SEQ ID NO: 997704 - RNA, 23 nt, Mycobacterium avium subsp. paratuberculosis
gcgccagauuccgaaaggggucg

SEQ ID NO: 997705 - RNA, 18 nt, Mycobacterium avium subsp. paratuberculosis
gcgccagacguccagcgc

SEQ ID NO: 997706 - RNA, 20 nt, Mycobacterium avium subsp. paratuberculosis
gcgccagacguccagcgccg

SEQ ID NO: 997707 - RNA, 18 nt, Mycobacterium avium subsp. paratuberculosis
gcgcccgcugcgcggguc

SEQ ID NO: 997708 - RNA, 21 nt, Mycobacterium avium subsp. paratuberculosis
gcgcccgcuugauggcggcgc

SEQ ID NO: 997709 - RNA, 22 nt, Mycobacterium avium subsp. paratuberculosis
gcgcccgcucgaggggcuuggc

SEQ ID NO: 997710 - RNA, 21 nt, Mycobacterium avium subsp. paratuberculosis
gcgcccgcgcgcucgggggug

SEQ ID NO: 997711 - RNA, 14 nt, Mycobacterium avium subsp. paratuberculosis
gcgcccgcggccuc

SEQ ID NO: 997712 - RNA, 14 nt, Mycobacterium avium subsp. paratuberculosis
gcgcccgcgcgcuc

SEQ ID NO: 997713 - RNA, 24 nt, Mycobacterium avium subsp. paratuberculosis
gcgcccgcgcgaucggcgagccgg

SEQ ID NO: 997714 - RNA, 20 nt, Mycobacterium avium subsp. paratuberculosis
gcgcccgccggcccagcucc

SEQ ID NO: 997715 - RNA, 18 nt, Mycobacterium avium subsp. paratuberculosis
gcgcccggaugucgggcg

SEQ ID NO: 997716 - RNA, 16 nt, Mycobacterium avium subsp. paratuberculosis
gcgcccggccagccgg

SEQ ID NO: 997717 - RNA, 20 nt, Mycobacterium avium subsp. paratuberculosis
gcgcccggccagccggccgc

SEQ ID NO: 997718 - RNA, 12 nt, Mycobacterium avium subsp. paratuberculosis
gcgcccggccgu

SEQ ID NO: 997719 - RNA, 20 nt, Mycobacterium avium subsp. paratuberculosis
gcgcccggcccagccgcugc

SEQ ID NO: 997720 - RNA, 13 nt, Mycobacterium avium subsp. paratuberculosis
gcgcccggccggc

SEQ ID NO: 997721 - RNA, 13 nt, Mycobacterium avium subsp. paratuberculosis
gcgcccggcgggc

SEQ ID NO: 997722 - RNA, 16 nt, Mycobacterium avium subsp. paratuberculosis
gcgcccggcgccggcc

SEQ ID NO: 997723 - RNA, 17 nt, Mycobacterium avium subsp. paratuberculosis
gcgcccggcgccggccc

SEQ ID NO: 997724 - RNA, 19 nt, Mycobacterium avium subsp. paratuberculosis
gcgcccggcgcgccacgac

SEQ ID NO: 997725 - RNA, 13 nt, Mycobacterium avium subsp. paratuberculosis
gcgcccggcgccc

SEQ ID NO: 997726 - RNA, 16 nt, Mycobacterium avium subsp. paratuberculosis
gcgcccggcgcccggc

SEQ ID NO: 997727 - RNA, 17 nt, Mycobacterium avium subsp. paratuberculosis
gcgcccugcgagcccgg

SEQ ID NO: 997728 - RNA, 23 nt, Mycobacterium avium subsp. paratuberculosis
gcgcccucgauaauggcggccgc

SEQ ID NO: 997729 - RNA, 15 nt, Mycobacterium avium subsp. paratuberculosis
gcgcccucgccgacc

SEQ ID NO: 997730 - RNA, 16 nt, Mycobacterium avium subsp. paratuberculosis
gcgcccguagcggcgg

SEQ ID NO: 997731 - RNA, 19 nt, Mycobacterium avium subsp. paratuberculosis
gcgcccggucgaggucggc

SEQ ID NO: 997732 - RNA, 23 nt, Mycobacterium avium subsp. paratuberculosis
gcgcccggucgaggucggccagc

SEQ ID NO: 997733 - RNA, 17 nt, Mycobacterium avium subsp. paratuberculosis
gcgcccgucgagcguca

SEQ ID NO: 997734 - RNA, 18 nt, Mycobacterium avium subsp. paratuberculosis
gcgccccagcuccucggc

SEQ ID NO: 997735 - RNA, 23 nt, Mycobacterium avium subsp. paratuberculosis
gcgccccagcacgaucccgccgc

SEQ ID NO: 997736 - RNA, 17 nt, Mycobacterium avium subsp. paratuberculosis
gcgcccauccggcgccg

SEQ ID NO: 997737 - RNA, 18 nt, Mycobacterium avium subsp. paratuberculosis
gcgcccauccggcgccgc

SEQ ID NO: 997738 - RNA, 15 nt, Mycobacterium avium subsp. paratuberculosis
gcgcccaucgcggcc

SEQ ID NO: 997739 - RNA, 14 nt, Mycobacterium avium subsp. paratuberculosis
gcgcccaggggucc

SEQ ID NO: 997740 - RNA, 16 nt, Mycobacterium avium subsp. paratuberculosis
gcgcccagguccacca

SEQ ID NO: 997741 - RNA, 12 nt, Mycobacterium avium subsp. paratuberculosis
gcgccccgccgg

SEQ ID NO: 997742 - RNA, 17 nt, Mycobacterium avium subsp. paratuberculosis
gcgccccgccgggggag

SEQ ID NO: 997743 - RNA, 15 nt, Mycobacterium avium subsp. paratuberculosis
gcgccccggcccggc

SEQ ID NO: 997744 - RNA, 18 nt, Mycobacterium avium subsp. paratuberculosis
gcgccccggcgcagcgcc

SEQ ID NO: 997745 - RNA, 17 nt, Mycobacterium avium subsp. paratuberculosis
gcgccccggcgcgccug

SEQ ID NO: 997746 - RNA, 12 nt, Mycobacterium avium subsp. paratuberculosis
gcgccccggcgg

SEQ ID NO: 997747 - RNA, 18 nt, Mycobacterium avium subsp. paratuberculosis
gcgccccccugcucgcug

SEQ ID NO: 997748 - RNA, 15 nt, Mycobacterium avium subsp. paratuberculosis
gcgccccagugcagg

SEQ ID NO: 997749 - RNA, 22 nt, Mycobacterium avium subsp. paratuberculosis
gcgccccagugcaggcaggccc

SEQ ID NO: 997750 - RNA, 12 nt, Mycobacterium avium subsp. paratuberculosis
gcgcccgcaggc

SEQ ID NO: 997751 - RNA, 18 nt, Mycobacterium avium subsp. paratuberculosis
gcgcccgcccggcccggc

SEQ ID NO: 997752 - RNA, 22 nt, Mycobacterium avium subsp. paratuberculosis
gcgcccgccgaacaccggcagc

SEQ ID NO: 997753 - RNA, 20 nt, Mycobacterium avium subsp. paratuberculosis
gcgcccgccgccaccacggc

SEQ ID NO: 997754 - RNA, 23 nt, Mycobacterium avium subsp. paratuberculosis
gcgccccggcgggcggccgaucc

SEQ ID NO: 997755 - RNA, 19 nt, Mycobacterium avium subsp. paratuberculosis
gcgcccgacggucgccacc

SEQ ID NO: 997756 - RNA, 17 nt, Mycobacterium avium subsp. paratuberculosis
gcgcccgauuccccggc

SEQ ID NO: 997757 - RNA, 19 nt, Mycobacterium avium subsp. paratuberculosis
gcgcccgauuccccggcgu

SEQ ID NO: 997758 - RNA, 17 nt, Mycobacterium avium subsp. paratuberculosis
gcgcccgauucgcggcc

SEQ ID NO: 997759 - RNA, 22 nt, Mycobacterium avium subsp. paratuberculosis
gcgcccgagucacccggcuggc

SEQ ID NO: 997760 - RNA, 15 nt, Mycobacterium avium subsp. paratuberculosis
gcgcccgaucggcac

SEQ ID NO: 997761 - RNA, 18 nt, Mycobacterium avium subsp. paratuberculosis
gcgccgugccgcgcggcg

SEQ ID NO: 997762 - RNA, 22 nt, Mycobacterium avium subsp. paratuberculosis
gcgccgucgcgggagagcgcgg

SEQ ID NO: 997763 - RNA, 16 nt, Mycobacterium avium subsp. paratuberculosis
gcgccguccgcaccgc

SEQ ID NO: 997764 - RNA, 17 nt, Mycobacterium avium subsp. paratuberculosis
gcgccguccgcggcggc

SEQ ID NO: 997765 - RNA, 19 nt, Mycobacterium avium subsp. paratuberculosis
gcgccgucggugggggcca

SEQ ID NO: 997766 - RNA, 22 nt, Mycobacterium avium subsp. paratuberculosis
gcgccgucggugggggccaggc

SEQ ID NO: 997767 - RNA, 20 nt, Mycobacterium avium subsp. paratuberculosis
gcgccgucuuccgggccacc

SEQ ID NO: 997768 - RNA, 23 nt, Mycobacterium avium subsp. paratuberculosis
gcgccgucgucgucggccgggcc

SEQ ID NO: 997769 - RNA, 14 nt, Mycobacterium avium subsp. paratuberculosis
gcgccgucuccggc

SEQ ID NO: 997770 - RNA, 15 nt, Mycobacterium avium subsp. paratuberculosis
gcgccguagcggccc

SEQ ID NO: 997771 - RNA, 17 nt, Mycobacterium avium subsp. paratuberculosis
gcgccguagcggcccag

SEQ ID NO: 997772 - RNA, 14 nt, Mycobacterium avium subsp. paratuberculosis
gcgccguaggccgc

SEQ ID NO: 997773 - RNA, 15 nt, Mycobacterium avium subsp. paratuberculosis
gcgccguaggccgcg

SEQ ID NO: 997774 - RNA, 11 nt, Mycobacterium avium subsp. paratuberculosis
gcgccguaggu

SEQ ID NO: 997775 - RNA, 16 nt, Mycobacterium avium subsp. paratuberculosis
gcgccggcgcagcggc

SEQ ID NO: 997776 - RNA, 15 nt, Mycobacterium avium subsp. paratuberculosis
gcgccggcgcgcagc

SEQ ID NO: 997777 - RNA, 17 nt, Mycobacterium avium subsp. paratuberculosis
gcgccggcgcggccagc

SEQ ID NO: 997778 - RNA, 21 nt, Mycobacterium avium subsp. paratuberculosis
gcgccggcgauaggcggccag

SEQ ID NO: 997779 - RNA, 13 nt, Mycobacterium avium subsp. paratuberculosis
gcgccggccggcg

SEQ ID NO: 997780 - RNA, 15 nt, Mycobacterium avium subsp. paratuberculosis
gcgccggccgggcug

SEQ ID NO: 997781 - RNA, 14 nt, Mycobacterium avium subsp. paratuberculosis
gcgccggcccgcgg

SEQ ID NO: 997782 - RNA, 13 nt, Mycobacterium avium subsp. paratuberculosis
gcgccggccggca

SEQ ID NO: 997783 - RNA, 15 nt, Mycobacterium avium subsp. paratuberculosis
gcgccggccgccgga

SEQ ID NO: 997784 - RNA, 24 nt, Mycobacterium avium subsp. paratuberculosis
gcgccgguguucggcgccagccgc

SEQ ID NO: 997785 - RNA, 23 nt, Mycobacterium avium subsp. paratuberculosis
gcgccgguucgcuggcggccagc

SEQ ID NO: 997786 - RNA, 16 nt, Mycobacterium avium subsp. paratuberculosis
gcgccggugccgcagc

SEQ ID NO: 997787 - RNA, 11 nt, Mycobacterium avium subsp. paratuberculosis
gcgccggcggc

SEQ ID NO: 997788 - RNA, 18 nt, Mycobacterium avium subsp. paratuberculosis
gcgccggucccgcggcgg

SEQ ID NO: 997789 - RNA, 19 nt, Mycobacterium avium subsp. paratuberculosis
gcgccggucccgcggcggc

SEQ ID NO: 997790 - RNA, 13 nt, Mycobacterium avium subsp. paratuberculosis
gcgccgguccggc

SEQ ID NO: 997791 - RNA, 20 nt, Mycobacterium avium subsp. paratuberculosis
gcgccggucgacgcggggcg

SEQ ID NO: 997792 - RNA, 21 nt, Mycobacterium avium subsp. paratuberculosis
gcgccgcgggugcggcacggc

SEQ ID NO: 997793 - RNA, 13 nt, Mycobacterium avium subsp. paratuberculosis
gcgccggaggcca

SEQ ID NO: 997794 - RNA, 22 nt, Mycobacterium avium subsp. paratuberculosis
gcgccggaggggcgacgggccg

SEQ ID NO: 997795 - RNA, 18 nt, Mycobacterium avium subsp. paratuberculosis
gcgccggaucggcccccg

SEQ ID NO: 997796 - RNA, 19 nt, Mycobacterium avium subsp. paratuberculosis
gcgccggaucggcccccgg

SEQ ID NO: 997797 - RNA, 23 nt, Mycobacterium avium subsp. paratuberculosis
gcgccggaucggcccccgggccc

SEQ ID NO: 997798 - RNA, 22 nt, Mycobacterium avium subsp. paratuberculosis
gcgccggaugccagcagguccg

SEQ ID NO: 997799 - RNA, 21 nt, Mycobacterium avium subsp. paratuberculosis
gcgccggaugcugcgcaacac

SEQ ID NO: 997800 - RNA, 17 nt, Mycobacterium avium subsp. paratuberculosis
gcgccggaugggcgcac

SEQ ID NO: 997801 - RNA, 18 nt, Mycobacterium avium subsp. paratuberculosis
gcgccggaugggcgcacg

SEQ ID NO: 997802 - RNA, 17 nt, Mycobacterium avium subsp. paratuberculosis
gcgccggcagcaaccgg

SEQ ID NO: 997803 - RNA, 15 nt, Mycobacterium avium subsp. paratuberculosis
gcgccggcagcgccu

SEQ ID NO: 997804 - RNA, 18 nt, Mycobacterium avium subsp. paratuberculosis
gcgccggccagcggcuug

SEQ ID NO: 997805 - RNA, 20 nt, Mycobacterium avium subsp. paratuberculosis
gcgccggccagcggcuuggc

SEQ ID NO: 997806 - RNA, 14 nt, Mycobacterium avium subsp. paratuberculosis
gcgccggccagcac

SEQ ID NO: 997807 - RNA, 15 nt, Mycobacterium avium subsp. paratuberculosis
gcgccggccagcacg

SEQ ID NO: 997808 - RNA, 17 nt, Mycobacterium avium subsp. paratuberculosis
gcgccggccagcacggc

SEQ ID NO: 997809 - RNA, 21 nt, Mycobacterium avium subsp. paratuberculosis
gcgccggccagcacggccagc

SEQ ID NO: 997810 - RNA, 15 nt, Mycobacterium avium subsp. paratuberculosis
gcgccggccagcagc

SEQ ID NO: 997811 - RNA, 20 nt, Mycobacterium avium subsp. paratuberculosis
gcgccggcaccagcagccgc

SEQ ID NO: 997812 - RNA, 20 nt, Mycobacterium avium subsp. paratuberculosis
gcgccggcauccagcacggc

SEQ ID NO: 997813 - RNA, 19 nt, Mycobacterium avium subsp. paratuberculosis
gcgccggcaucgaccgccc

SEQ ID NO: 997814 - RNA, 15 nt, Mycobacterium avium subsp. paratuberculosis
gcgccgcccagcggc

SEQ ID NO: 997815 - RNA, 17 nt, Mycobacterium avium subsp. paratuberculosis
gcgccgcccagcggccc

SEQ ID NO: 997816 - RNA, 21 nt, Mycobacterium avium subsp. paratuberculosis
gcgccgcccagcggccccggc

SEQ ID NO: 997817 - RNA, 12 nt, Mycobacterium avium subsp. paratuberculosis
gcgccgccaggg

SEQ ID NO: 997818 - RNA, 17 nt, Mycobacterium avium subsp. paratuberculosis
gcgccgcccgggcccgg

SEQ ID NO: 997819 - RNA, 19 nt, Mycobacterium avium subsp. paratuberculosis
gcgccgcccgggcggcccg

SEQ ID NO: 997820 - RNA, 17 nt, Mycobacterium avium subsp. paratuberculosis
gcgccgcccgcaccugc

SEQ ID NO: 997821 - RNA, 23 nt, Mycobacterium avium subsp. paratuberculosis
gcgccgcccgcaccugcgcgccg

SEQ ID NO: 997822 - RNA, 15 nt, Mycobacterium avium subsp. paratuberculosis
gcgccgcccccgcgg

SEQ ID NO: 997823 - RNA, 17 nt, Mycobacterium avium subsp. paratuberculosis
gcgccgcguucggcggc

SEQ ID NO: 997824 - RNA, 19 nt, Mycobacterium avium subsp. paratuberculosis
gcgccgcgucgacgccgcu

SEQ ID NO: 997825 - RNA, 12 nt, Mycobacterium avium subsp. paratuberculosis
gcgccgcggcgc

SEQ ID NO: 997826 - RNA, 14 nt, Mycobacterium avium subsp. paratuberculosis
gcgccgcggcgccc

SEQ ID NO: 997827 - RNA, 16 nt, Mycobacterium avium subsp. paratuberculosis
gcgccgcggcgcccuc

SEQ ID NO: 997828 - RNA, 21 nt, Mycobacterium avium subsp. paratuberculosis
gcgccgcggcgcccucgccgg

SEQ ID NO: 997829 - RNA, 22 nt, Mycobacterium avium subsp. paratuberculosis
gcgccgcggcgcccucgccggc

SEQ ID NO: 997830 - RNA, 15 nt, Mycobacterium avium subsp. paratuberculosis
gcgccgcggcgccgc

SEQ ID NO: 997831 - RNA, 18 nt, Mycobacterium avium subsp. paratuberculosis
gcgccgcggcccugcagc

SEQ ID NO: 997832 - RNA, 12 nt, Mycobacterium avium subsp. paratuberculosis
gcgccgcggccg

SEQ ID NO: 997833 - RNA, 12 nt, Mycobacterium avium subsp. paratuberculosis
gcgccgcggcca

SEQ ID NO: 997834 - RNA, 17 nt, Mycobacterium avium subsp. paratuberculosis
gcgccgcggccagccgg

SEQ ID NO: 997835 - RNA, 16 nt, Mycobacterium avium subsp. paratuberculosis
gcgccgcggccagcgc

SEQ ID NO: 997836 - RNA, 19 nt, Mycobacterium avium subsp. paratuberculosis
gcgccgcggccagcgcccc

SEQ ID NO: 997837 - RNA, 15 nt, Mycobacterium avium subsp. paratuberculosis
gcgccgaggucaccg

SEQ ID NO: 997838 - RNA, 20 nt, Mycobacterium avium subsp. paratuberculosis
gcgccgagguggcccgccac

SEQ ID NO: 997839 - RNA, 20 nt, Mycobacterium avium subsp. paratuberculosis
gcgccgagguggccgccagc

SEQ ID NO: 997840 - RNA, 21 nt, Mycobacterium avium subsp. paratuberculosis
gcgccgagguggccgccagca

SEQ ID NO: 997841 - RNA, 22 nt, Mycobacterium avium subsp. paratuberculosis
gcgccgagguggccgccagcac

SEQ ID NO: 997842 - RNA, 23 nt, Mycobacterium avium subsp. paratuberculosis
gcgccgagguggccgccagcacc

SEQ ID NO: 997843 - RNA, 22 nt, Mycobacterium avium subsp. paratuberculosis
gcgccgaguccgggccgccggc

SEQ ID NO: 997844 - RNA, 21 nt, Mycobacterium avium subsp. paratuberculosis
gcgccgauccggcuccacagc

SEQ ID NO: 997845 - RNA, 15 nt, Mycobacterium avium subsp. paratuberculosis
gcgccgaucgcccag

SEQ ID NO: 997846 - RNA, 18 nt, Mycobacterium avium subsp. paratuberculosis
gcgccgaucgcccagugc

SEQ ID NO: 997847 - RNA, 21 nt, Mycobacterium avium subsp. paratuberculosis
gcgccgaugcagcacauccag

SEQ ID NO: 997848 - RNA, 14 nt, Mycobacterium avium subsp. paratuberculosis
gcgccgaucugcuc

SEQ ID NO: 997849 - RNA, 16 nt, Mycobacterium avium subsp. paratuberculosis
gcgccgaucugcucgg

SEQ ID NO: 997850 - RNA, 17 nt, Mycobacterium avium subsp. paratuberculosis
gcgccgaucugcucggc

SEQ ID NO: 997851 - RNA, 19 nt, Mycobacterium avium subsp. paratuberculosis
gcgccgauguacugggccg

SEQ ID NO: 997852 - RNA, 16 nt, Mycobacterium avium subsp. paratuberculosis
gcgccgaugcccgccc

SEQ ID NO: 997853 - RNA, 17 nt, Mycobacterium avium subsp. paratuberculosis
gcgccgaugcccgcccc

SEQ ID NO: 997854 - RNA, 12 nt, Mycobacterium avium subsp. paratuberculosis
gcgccgaugccg

SEQ ID NO: 997855 - RNA, 22 nt, Mycobacterium avium subsp. paratuberculosis
gcgccgcacagccggcggcggc

SEQ ID NO: 997856 - RNA, 15 nt, Mycobacterium avium subsp. paratuberculosis
gcgccgcaacggcgc

SEQ ID NO: 997857 - RNA, 18 nt, Mycobacterium avium subsp. paratuberculosis
gcgccgcaacggcgcaac

SEQ ID NO: 997858 - RNA, 15 nt, Mycobacterium avium subsp. paratuberculosis
gcgccgaugccgcgc

SEQ ID NO: 997859 - RNA, 22 nt, Mycobacterium avium subsp. paratuberculosis
gcgccgcauuggugccggccuc

SEQ ID NO: 997860 - RNA, 17 nt, Mycobacterium avium subsp. paratuberculosis
gcgccgccaaccagguc

SEQ ID NO: 997861 - RNA, 17 nt, Mycobacterium avium subsp. paratuberculosis
gcgccgcacugcacggc

SEQ ID NO: 997862 - RNA, 15 nt, Mycobacterium avium subsp. paratuberculosis
gcgccgcagcgguga

SEQ ID NO: 997863 - RNA, 19 nt, Mycobacterium avium subsp. paratuberculosis
gcgccgcaggagaucggcg

SEQ ID NO: 997864 - RNA, 19 nt, Mycobacterium avium subsp. paratuberculosis
gcgccgccacgcggcgcgc

SEQ ID NO: 997865 - RNA, 16 nt, Mycobacterium avium subsp. paratuberculosis
gcgccgccaccggccg

SEQ ID NO: 997866 - RNA, 17 nt, Mycobacterium avium subsp. paratuberculosis
gcgccgccaccggccgg

SEQ ID NO: 997867 - RNA, 17 nt, Mycobacterium avium subsp. paratuberculosis
gcgccgaacaccugcgg

SEQ ID NO: 997868 - RNA, 21 nt, Mycobacterium avium subsp. paratuberculosis
gcgccgaacaccugcggcggc

SEQ ID NO: 997869 - RNA, 12 nt, Mycobacterium avium subsp. paratuberculosis
gcgcccuucuuc

SEQ ID NO: 997870 - RNA, 15 nt, Mycobacterium avium subsp. paratuberculosis
gcgcccuugagcacg

SEQ ID NO: 997871 - RNA, 18 nt, Mycobacterium avium subsp. paratuberculosis
gcgcccuugagcucggcc

SEQ ID NO: 997872 - RNA, 16 nt, Mycobacterium avium subsp. paratuberculosis
gcgcccuugagcuucc

SEQ ID NO: 997873 - RNA, 22 nt, Mycobacterium avium subsp. paratuberculosis
gcgccgaacgucgagcgcggcc

SEQ ID NO: 997874 - RNA, 22 nt, Mycobacterium avium subsp. paratuberculosis
gcgccgaacgugcacucagggc

SEQ ID NO: 997875 - RNA, 19 nt, Mycobacterium avium subsp. paratuberculosis
gcgccgaaguugucggguu

SEQ ID NO: 997876 - RNA, 15 nt, Mycobacterium avium subsp. paratuberculosis
gcgccgaaucggcug

SEQ ID NO: 997877 - RNA, 15 nt, Mycobacterium avium subsp. paratuberculosis
gcgccgacagcugag

SEQ ID NO: 997878 - RNA, 22 nt, Mycobacterium avium subsp. paratuberculosis
gcgccgacagcugagcagcccg

SEQ ID NO: 997879 - RNA, 21 nt, Mycobacterium avium subsp. paratuberculosis
gcgccgacagucgcgggcagc

SEQ ID NO: 997880 - RNA, 15 nt, Mycobacterium avium subsp. paratuberculosis
gcgccgaacgccgga

SEQ ID NO: 997881 - RNA, 15 nt, Mycobacterium avium subsp. paratuberculosis
gcgcccugcgcgccc

SEQ ID NO: 997882 - RNA, 22 nt, Mycobacterium avium subsp. paratuberculosis
gcgccgaacucggcgccgccgg

SEQ ID NO: 997883 - RNA, 19 nt, Mycobacterium avium subsp. paratuberculosis
gcgccgaagauggccagga

SEQ ID NO: 997884 - RNA, 15 nt, Mycobacterium avium subsp. paratuberculosis
gcgccgaagcccgca

SEQ ID NO: 997885 - RNA, 17 nt, Mycobacterium avium subsp. paratuberculosis
gcgccgaagcccgcagc

SEQ ID NO: 997886 - RNA, 18 nt, Mycobacterium avium subsp. paratuberculosis
gcgccgaagcccgcagcg

SEQ ID NO: 997887 - RNA, 15 nt, Mycobacterium avium subsp. paratuberculosis
gcgccgagagcgcgu

SEQ ID NO: 997888 - RNA, 17 nt, Mycobacterium avium subsp. paratuberculosis
gcgccgacgcccacagc

SEQ ID NO: 997889 - RNA, 21 nt, Mycobacterium avium subsp. paratuberculosis
gcgccgagaucgcgguggcgc

SEQ ID NO: 997890 - RNA, 22 nt, Mycobacterium avium subsp. paratuberculosis
gcgccgagcacgaacgcggccg

SEQ ID NO: 997891 - RNA, 23 nt, Mycobacterium avium subsp. paratuberculosis
gcgccgagcacgaacgcggccgc

SEQ ID NO: 997892 - RNA, 15 nt, Mycobacterium avium subsp. paratuberculosis
gcgccgagcagcugg

SEQ ID NO: 997893 - RNA, 20 nt, Mycobacterium avium subsp. paratuberculosis
gcgccgagaacaggccgagc

SEQ ID NO: 997894 - RNA, 21 nt, Mycobacterium avium subsp. paratuberculosis
gcgccgagaacaggccgagcg

SEQ ID NO: 997895 - RNA, 14 nt, Mycobacterium avium subsp. paratuberculosis
gcgccgagaccagc

SEQ ID NO: 997896 - RNA, 14 nt, Mycobacterium avium subsp. paratuberculosis
gcgccgacgggccc

SEQ ID NO: 997897 - RNA, 16 nt, Mycobacterium avium subsp. paratuberculosis
gcgccgacgucagggg

SEQ ID NO: 997898 - RNA, 18 nt, Mycobacterium avium subsp. paratuberculosis
gcgccgacgucaggggug

SEQ ID NO: 997899 - RNA, 18 nt, Mycobacterium avium subsp. paratuberculosis
gcgccgacggccagcagg

SEQ ID NO: 997900 - RNA, 15 nt, Mycobacterium avium subsp. paratuberculosis
gcgccgacggccgcg

SEQ ID NO: 997901 - RNA, 18 nt, Mycobacterium avium subsp. paratuberculosis
gcgccgacggccgcgccg

SEQ ID NO: 997902 - RNA, 23 nt, Mycobacterium avium subsp. paratuberculosis
gcgccgacgaucccggcgagcac

SEQ ID NO: 997903 - RNA, 18 nt, Mycobacterium avium subsp. paratuberculosis
gcgccgaccucggccagc

SEQ ID NO: 997904 - RNA, 23 nt, Mycobacterium avium subsp. paratuberculosis
gcgccgacgaccaguucgcccug

SEQ ID NO: 997905 - RNA, 14 nt, Mycobacterium avium subsp. paratuberculosis
gcgccgaccacggc

SEQ ID NO: 997906 - RNA, 19 nt, Mycobacterium avium subsp. paratuberculosis
gcgccgaccacggccccag

SEQ ID NO: 997907 - RNA, 19 nt, Mycobacterium avium subsp. paratuberculosis
gcgccgaccagcgcguuga

SEQ ID NO: 997908 - RNA, 14 nt, Mycobacterium avium subsp. paratuberculosis
gcgccgaccaggcu

SEQ ID NO: 997909 - RNA, 17 nt, Mycobacterium avium subsp. paratuberculosis
gcgccgacccccgccgc

SEQ ID NO: 997910 - RNA, 15 nt, Mycobacterium avium subsp. paratuberculosis
gcgccgacccgcccg

SEQ ID NO: 997911 - RNA, 22 nt, Mycobacterium avium subsp. paratuberculosis
gcgccgacccgcccgccgggca

SEQ ID NO: 997912 - RNA, 18 nt, Mycobacterium avium subsp. paratuberculosis
gcgcuaaagccaccagcg

SEQ ID NO: 997913 - RNA, 15 nt, Mycobacterium avium subsp. paratuberculosis
gcgcguuggccggcu

SEQ ID NO: 997914 - RNA, 17 nt, Mycobacterium avium subsp. paratuberculosis
gcgcguuguccagcagc

SEQ ID NO: 997915 - RNA, 16 nt, Mycobacterium avium subsp. paratuberculosis
gcgcguugcgcggacc

SEQ ID NO: 997916 - RNA, 17 nt, Mycobacterium avium subsp. paratuberculosis
gcgcuaaggccgcugcc

SEQ ID NO: 997917 - RNA, 19 nt, Mycobacterium avium subsp. paratuberculosis
gcgcuacgccggcucgguc

SEQ ID NO: 997918 - RNA, 16 nt, Mycobacterium avium subsp. paratuberculosis
gcgcucagcacgcgga

SEQ ID NO: 997919 - RNA, 22 nt, Mycobacterium avium subsp. paratuberculosis
gcgcucaccgcaucgaaccgcc

SEQ ID NO: 997920 - RNA, 18 nt, Mycobacterium avium subsp. paratuberculosis
gcgcucaccggcguggug

SEQ ID NO: 997921 - RNA, 13 nt, Mycobacterium avium subsp. paratuberculosis
gcgcucagugcac

SEQ ID NO: 997922 - RNA, 20 nt, Mycobacterium avium subsp. paratuberculosis
gcgcucagugcacgcucggc

SEQ ID NO: 997923 - RNA, 15 nt, Mycobacterium avium subsp. paratuberculosis
gcgcucagcgcggcc

SEQ ID NO: 997924 - RNA, 22 nt, Mycobacterium avium subsp. paratuberculosis
gcgcucacccaaaaaggcgcgg

SEQ ID NO: 997925 - RNA, 18 nt, Mycobacterium avium subsp. paratuberculosis
gcgcucaaccgcccagcg

SEQ ID NO: 997926 - RNA, 16 nt, Mycobacterium avium subsp. paratuberculosis
gcgcguggucccacac

SEQ ID NO: 997927 - RNA, 17 nt, Mycobacterium avium subsp. paratuberculosis
gcgcguguccagaacuc

SEQ ID NO: 997928 - RNA, 14 nt, Mycobacterium avium subsp. paratuberculosis
gcgcguuccagcac

SEQ ID NO: 997929 - RNA, 19 nt, Mycobacterium avium subsp. paratuberculosis
gcgcguuccaucagcgccc

SEQ ID NO: 997930 - RNA, 21 nt, Mycobacterium avium subsp. paratuberculosis
gcgcguuccaucagcgcccgc

SEQ ID NO: 997931 - RNA, 18 nt, Mycobacterium avium subsp. paratuberculosis
gcgcguggggcgucgccg

SEQ ID NO: 997932 - RNA, 21 nt, Mycobacterium avium subsp. paratuberculosis
gcgcguggggcgucgccgccc

SEQ ID NO: 997933 - RNA, 21 nt, Mycobacterium avium subsp. paratuberculosis
gcgcgugaucggugcccgcgg

SEQ ID NO: 997934 - RNA, 17 nt, Mycobacterium avium subsp. paratuberculosis
gcgcgugacgcgcguga

SEQ ID NO: 997935 - RNA, 15 nt, Mycobacterium avium subsp. paratuberculosis
gcgcgugacggcggg

SEQ ID NO: 997936 - RNA, 14 nt, Mycobacterium avium subsp. paratuberculosis
gcgcgugcccgcgg

SEQ ID NO: 997937 - RNA, 18 nt, Mycobacterium avium subsp. paratuberculosis
gcgcgucgguaaucggcg

SEQ ID NO: 997938 - RNA, 14 nt, Mycobacterium avium subsp. paratuberculosis
gcgcgucgucgccg

SEQ ID NO: 997939 - RNA, 23 nt, Mycobacterium avium subsp. paratuberculosis
gcgcgucggccagcaccaccaac

SEQ ID NO: 997940 - RNA, 13 nt, Mycobacterium avium subsp. paratuberculosis
gcgcgucgcggcg

SEQ ID NO: 997941 - RNA, 19 nt, Mycobacterium avium subsp. paratuberculosis
gcgcgucgcggcgcggacc

SEQ ID NO: 997942 - RNA, 14 nt, Mycobacterium avium subsp. paratuberculosis
gcgcgucgcgggcc

SEQ ID NO: 997943 - RNA, 17 nt, Mycobacterium avium subsp. paratuberculosis
gcgcgucgaggucgcgc

SEQ ID NO: 997944 - RNA, 22 nt, Mycobacterium avium subsp. paratuberculosis
gcgcgucgaggucgcgcagcac

SEQ ID NO: 997945 - RNA, 21 nt, Mycobacterium avium subsp. paratuberculosis
gcgcgucgaggucgucgggcg

SEQ ID NO: 997946 - RNA, 14 nt, Mycobacterium avium subsp. paratuberculosis
gcgcgucgcacagc

SEQ ID NO: 997947 - RNA, 16 nt, Mycobacterium avium subsp. paratuberculosis
gcgcgucgacaccccg

SEQ ID NO: 997948 - RNA, 24 nt, Mycobacterium avium subsp. paratuberculosis
gcgcgucgacguucgccgccagca

SEQ ID NO: 997949 - RNA, 14 nt, Mycobacterium avium subsp. paratuberculosis
gcgcgucgagcagc

SEQ ID NO: 997950 - RNA, 16 nt, Mycobacterium avium subsp. paratuberculosis
gcgcgucgagcagcac

SEQ ID NO: 997951 - RNA, 14 nt, Mycobacterium avium subsp. paratuberculosis
gcgcggggccggcg

SEQ ID NO: 997952 - RNA, 16 nt, Mycobacterium avium subsp. paratuberculosis
gcgcggggccggcgcg

SEQ ID NO: 997953 - RNA, 18 nt, Mycobacterium avium subsp. paratuberculosis
gcgcggggccggcgcggu

SEQ ID NO: 997954 - RNA, 22 nt, Mycobacterium avium subsp. paratuberculosis
gcgcguccgcgggcggggccug

SEQ ID NO: 997955 - RNA, 14 nt, Mycobacterium avium subsp. paratuberculosis
gcgcguccggaggu

SEQ ID NO: 997956 - RNA, 23 nt, Mycobacterium avium subsp. paratuberculosis
gcgcguccggaggugccggccgg

SEQ ID NO: 997957 - RNA, 21 nt, Mycobacterium avium subsp. paratuberculosis
gcgcgggcguccucgucggcg

SEQ ID NO: 997958 - RNA, 14 nt, Mycobacterium avium subsp. paratuberculosis
gcgcgggcgcggcc

SEQ ID NO: 997959 - RNA, 14 nt, Mycobacterium avium subsp. paratuberculosis
gcgcgggccgcagc

SEQ ID NO: 997960 - RNA, 14 nt, Mycobacterium avium subsp. paratuberculosis
gcgcgggcgaccug

SEQ ID NO: 997961 - RNA, 14 nt, Mycobacterium avium subsp. paratuberculosis
gcgcgggcgcccgu

SEQ ID NO: 997962 - RNA, 14 nt, Mycobacterium avium subsp. paratuberculosis
gcgcgggcgcccuc

SEQ ID NO: 997963 - RNA, 15 nt, Mycobacterium avium subsp. paratuberculosis
gcgcgggcgcccucc

SEQ ID NO: 997964 - RNA, 13 nt, Mycobacterium avium subsp. paratuberculosis
gcgcugggcuggc

SEQ ID NO: 997965 - RNA, 18 nt, Mycobacterium avium subsp. paratuberculosis
gcgcugcgcgacaccugc

SEQ ID NO: 997966 - RNA, 14 nt, Mycobacterium avium subsp. paratuberculosis
gcgcugccggugcu

SEQ ID NO: 997967 - RNA, 16 nt, Mycobacterium avium subsp. paratuberculosis
gcgcugccggugcugc

SEQ ID NO: 997968 - RNA, 15 nt, Mycobacterium avium subsp. paratuberculosis
gcgcugccgccggcc

SEQ ID NO: 997969 - RNA, 14 nt, Mycobacterium avium subsp. paratuberculosis
gcgcugcccgccgc

SEQ ID NO: 997970 - RNA, 23 nt, Mycobacterium avium subsp. paratuberculosis
gcgcugcaagggcuugggcgcga

SEQ ID NO: 997971 - RNA, 20 nt, Mycobacterium avium subsp. paratuberculosis
gcgcugcauagucggcccga

SEQ ID NO: 997972 - RNA, 14 nt, Mycobacterium avium subsp. paratuberculosis
gcgcugcccagcgc

SEQ ID NO: 997973 - RNA, 17 nt, Mycobacterium avium subsp. paratuberculosis
gcgcugcccagcgcggu

SEQ ID NO: 997974 - RNA, 13 nt, Mycobacterium avium subsp. paratuberculosis
gcgcugccccagc

SEQ ID NO: 997975 - RNA, 12 nt, Mycobacterium avium subsp. paratuberculosis
gcgcugccaggg

SEQ ID NO: 997976 - RNA, 18 nt, Mycobacterium avium subsp. paratuberculosis
gcgcugccagggccgggc

SEQ ID NO: 997977 - RNA, 19 nt, Mycobacterium avium subsp. paratuberculosis
gcgcugcaaccgguccgcc

SEQ ID NO: 997978 - RNA, 18 nt, Mycobacterium avium subsp. paratuberculosis
gcgcuccugcagcgcggc

SEQ ID NO: 997979 - RNA, 14 nt, Mycobacterium avium subsp. paratuberculosis
gcgcuccugccagc

SEQ ID NO: 997980 - RNA, 18 nt, Mycobacterium avium subsp. paratuberculosis
gcgcuccagcaggcuggc

SEQ ID NO: 997981 - RNA, 17 nt, Mycobacterium avium subsp. paratuberculosis
gcgcuccagcgggcggc

SEQ ID NO: 997982 - RNA, 12 nt, Mycobacterium avium subsp. paratuberculosis
gcgcucgacggc

SEQ ID NO: 997983 - RNA, 16 nt, Mycobacterium avium subsp. paratuberculosis
gcgcucgacggccugc

SEQ ID NO: 997984 - RNA, 19 nt, Mycobacterium avium subsp. paratuberculosis
gcgcucgacggccugcacg

SEQ ID NO: 997985 - RNA, 14 nt, Mycobacterium avium subsp. paratuberculosis
gcgcucggccgggu

SEQ ID NO: 997986 - RNA, 15 nt, Mycobacterium avium subsp. paratuberculosis
gcgcucggccggguu

SEQ ID NO: 997987 - RNA, 18 nt, Mycobacterium avium subsp. paratuberculosis
gcgcucggcgaccgccgg

SEQ ID NO: 997988 - RNA, 22 nt, Mycobacterium avium subsp. paratuberculosis
gcgcucuaacuccgcucgggcc

SEQ ID NO: 997989 - RNA, 22 nt, Mycobacterium avium subsp. paratuberculosis
gcgcucguccaggguggccagc

SEQ ID NO: 997990 - RNA, 20 nt, Mycobacterium avium subsp. paratuberculosis
gcgcggauuucucagcggcg

SEQ ID NO: 997991 - RNA, 21 nt, Mycobacterium avium subsp. paratuberculosis
gcgcggauuucucagcggcgc

SEQ ID NO: 997992 - RNA, 22 nt, Mycobacterium avium subsp. paratuberculosis
gcgcggauuucucagcggcgcu

SEQ ID NO: 997993 - RNA, 18 nt, Mycobacterium avium subsp. paratuberculosis
gcgcggaugcccaggccg

SEQ ID NO: 997994 - RNA, 21 nt, Mycobacterium avium subsp. paratuberculosis
gcgcggaugcccaggccggcg

SEQ ID NO: 997995 - RNA, 19 nt, Mycobacterium avium subsp. paratuberculosis
gcgcggccaccaccacggc

SEQ ID NO: 997996 - RNA, 14 nt, Mycobacterium avium subsp. paratuberculosis
gcgcggccagcggc

SEQ ID NO: 997997 - RNA, 13 nt, Mycobacterium avium subsp. paratuberculosis
gcgcggccagcgc

SEQ ID NO: 997998 - RNA, 13 nt, Mycobacterium avium subsp. paratuberculosis
gcgcgggcagccc

SEQ ID NO: 997999 - RNA, 21 nt, Mycobacterium avium subsp. paratuberculosis
gcgcgggcaugaaccaggccg

SEQ ID NO: 998000 - RNA, 14 nt, Mycobacterium avium subsp. paratuberculosis
gcgcgggccagcgc

SEQ ID NO: 998001 - RNA, 22 nt, Mycobacterium avium subsp. paratuberculosis
gcgcggcggaggucagcggccc

SEQ ID NO: 998002 - RNA, 15 nt, Mycobacterium avium subsp. paratuberculosis
gcgcggcgcccccgc

SEQ ID NO: 998003 - RNA, 14 nt, Mycobacterium avium subsp. paratuberculosis
gcgcggcgcagggc

SEQ ID NO: 998004 - RNA, 23 nt, Mycobacterium avium subsp. paratuberculosis
gcgcggcgaucgucaugccuugg

SEQ ID NO: 998005 - RNA, 12 nt, Mycobacterium avium subsp. paratuberculosis
gcgcggcgauga

SEQ ID NO: 998006 - RNA, 15 nt, Mycobacterium avium subsp. paratuberculosis
gcgcggcgagcggca

SEQ ID NO: 998007 - RNA, 18 nt, Mycobacterium avium subsp. paratuberculosis
gcgcggcgaucagcugcu

SEQ ID NO: 998008 - RNA, 12 nt, Mycobacterium avium subsp. paratuberculosis
gcgcggcgacgg

SEQ ID NO: 998009 - RNA, 21 nt, Mycobacterium avium subsp. paratuberculosis
gcgcggcgacgguggcgggcc

SEQ ID NO: 998010 - RNA, 13 nt, Mycobacterium avium subsp. paratuberculosis
gcgcgcugccgcg

SEQ ID NO: 998011 - RNA, 22 nt, Mycobacterium avium subsp. paratuberculosis
gcgcgcugccgcgccccgagca

SEQ ID NO: 998012 - RNA, 16 nt, Mycobacterium avium subsp. paratuberculosis
gcgcgcuggugcgggc

SEQ ID NO: 998013 - RNA, 18 nt, Mycobacterium avium subsp. paratuberculosis
gcgcggacauucggacgg

SEQ ID NO: 998014 - RNA, 15 nt, Mycobacterium avium subsp. paratuberculosis
gcgcggagccggccg

SEQ ID NO: 998015 - RNA, 14 nt, Mycobacterium avium subsp. paratuberculosis
gcgcggacgcggcg

SEQ ID NO: 998016 - RNA, 13 nt, Mycobacterium avium subsp. paratuberculosis
gcgcggaacgcgc

SEQ ID NO: 998017 - RNA, 16 nt, Mycobacterium avium subsp. paratuberculosis
gcgcggaacgcgccgg

SEQ ID NO: 998018 - RNA, 19 nt, Mycobacterium avium subsp. paratuberculosis
gcgcggaacgcgccgggca

SEQ ID NO: 998019 - RNA, 23 nt, Mycobacterium avium subsp. paratuberculosis
gcgcgcuugcgcucggucgcggc

SEQ ID NO: 998020 - RNA, 20 nt, Mycobacterium avium subsp. paratuberculosis
gcgcgcucgggggugcccgg

SEQ ID NO: 998021 - RNA, 14 nt, Mycobacterium avium subsp. paratuberculosis
gcgcgcucggugcu

SEQ ID NO: 998022 - RNA, 13 nt, Mycobacterium avium subsp. paratuberculosis
gcgcgcucggugg

SEQ ID NO: 998023 - RNA, 23 nt, Mycobacterium avium subsp. paratuberculosis
gcgcgcucuaacuccgcucgggc

SEQ ID NO: 998024 - RNA, 18 nt, Mycobacterium avium subsp. paratuberculosis
gcgcgcugaagcgcgacc

SEQ ID NO: 998025 - RNA, 13 nt, Mycobacterium avium subsp. paratuberculosis
gcgcgccgggcag

SEQ ID NO: 998026 - RNA, 16 nt, Mycobacterium avium subsp. paratuberculosis
gcgcgccgggcagccc

SEQ ID NO: 998027 - RNA, 12 nt, Mycobacterium avium subsp. paratuberculosis
gcgcgccggccg

SEQ ID NO: 998028 - RNA, 13 nt, Mycobacterium avium subsp. paratuberculosis
gcgcgccggcccg

SEQ ID NO: 998029 - RNA, 16 nt, Mycobacterium avium subsp. paratuberculosis
gcgcgccgcgcuggcc

SEQ ID NO: 998030 - RNA, 18 nt, Mycobacterium avium subsp. paratuberculosis
gcgcgccggccagcagca

SEQ ID NO: 998031 - RNA, 13 nt, Mycobacterium avium subsp. paratuberculosis
gcgcgccgcccag

SEQ ID NO: 998032 - RNA, 12 nt, Mycobacterium avium subsp. paratuberculosis
gcgcgccgcagc

SEQ ID NO: 998033 - RNA, 14 nt, Mycobacterium avium subsp. paratuberculosis
gcgcgauagccggu

SEQ ID NO: 998034 - RNA, 21 nt, Mycobacterium avium subsp. paratuberculosis
gcgcgaggcggguaggcgucg

SEQ ID NO: 998035 - RNA, 19 nt, Mycobacterium avium subsp. paratuberculosis
gcgcgaggaggggucggug

SEQ ID NO: 998036 - RNA, 12 nt, Mycobacterium avium subsp. paratuberculosis
gcgcgagcgcgc

SEQ ID NO: 998037 - RNA, 17 nt, Mycobacterium avium subsp. paratuberculosis
gcgcgacggccucgccg

SEQ ID NO: 998038 - RNA, 15 nt, Mycobacterium avium subsp. paratuberculosis
gcgcgacgcacgccg

SEQ ID NO: 998039 - RNA, 12 nt, Mycobacterium avium subsp. paratuberculosis
gcgcgccgcaca

SEQ ID NO: 998040 - RNA, 14 nt, Mycobacterium avium subsp. paratuberculosis
gcgcgccgcacagc

SEQ ID NO: 998041 - RNA, 18 nt, Mycobacterium avium subsp. paratuberculosis
gcgcgccgcacagccggc

SEQ ID NO: 998042 - RNA, 22 nt, Mycobacterium avium subsp. paratuberculosis
gcgcgccacgacguacccccgc

SEQ ID NO: 998043 - RNA, 18 nt, Mycobacterium avium subsp. paratuberculosis
gcgcgcaucgucgcggcg

SEQ ID NO: 998044 - RNA, 20 nt, Mycobacterium avium subsp. paratuberculosis
gcgcgcaucgcgggccaccg

SEQ ID NO: 998045 - RNA, 14 nt, Mycobacterium avium subsp. paratuberculosis
gcgcgaaucccggc

SEQ ID NO: 998046 - RNA, 15 nt, Mycobacterium avium subsp. paratuberculosis
gcgcgaaucgcuucc

SEQ ID NO: 998047 - RNA, 13 nt, Mycobacterium avium subsp. paratuberculosis
gcgcgaccagguu

SEQ ID NO: 998048 - RNA, 20 nt, Mycobacterium avium subsp. paratuberculosis
gcgcgaccaguaccgggccu

SEQ ID NO: 998049 - RNA, 21 nt, Mycobacterium avium subsp. paratuberculosis
gcgcgaccaguaccgggccug

SEQ ID NO: 998050 - RNA, 14 nt, Mycobacterium avium subsp. paratuberculosis
gcgcgaccaucagc

SEQ ID NO: 998051 - RNA, 15 nt, Mycobacterium avium subsp. paratuberculosis
gcgcgaccucggugg

SEQ ID NO: 998052 - RNA, 20 nt, Mycobacterium avium subsp. paratuberculosis
gcgcgaccccuacgggcgca

SEQ ID NO: 998053 - RNA, 17 nt, Mycobacterium avium subsp. paratuberculosis
gcgcgacccgcucgacg

SEQ ID NO: 998054 - RNA, 19 nt, Mycobacterium avium subsp. paratuberculosis
gcgcgacaccugcucaccg

SEQ ID NO: 998055 - RNA, 23 nt, Mycobacterium avium subsp. paratuberculosis
gcgcgacaucaccgcgggcgcgc

SEQ ID NO: 998056 - RNA, 16 nt, Mycobacterium avium subsp. paratuberculosis
gcgcgacaucgccggc

SEQ ID NO: 998057 - RNA, 13 nt, Mycobacterium avium subsp. paratuberculosis
gcgcgaccagccc

SEQ ID NO: 998058 - RNA, 18 nt, Mycobacterium avium subsp. paratuberculosis
gcgcgaccagcccggccg

SEQ ID NO: 998059 - RNA, 14 nt, Mycobacterium avium subsp. paratuberculosis
gcgcgaccagcggc

SEQ ID NO: 998060 - RNA, 23 nt, Mycobacterium avium subsp. paratuberculosis
gcgccguugguggucugccagaa

SEQ ID NO: 998061 - RNA, 19 nt, Mycobacterium avium subsp. paratuberculosis
gcgccguuguaggccgcgc

SEQ ID NO: 998062 - RNA, 18 nt, Mycobacterium avium subsp. paratuberculosis
gcgccguugaccggccgg

SEQ ID NO: 998063 - RNA, 22 nt, Mycobacterium avium subsp. paratuberculosis
gcgccguugauugcgcccgccg

SEQ ID NO: 998064 - RNA, 17 nt, Mycobacterium avium subsp. paratuberculosis
gcgcgaacagcgcggcc

SEQ ID NO: 998065 - RNA, 15 nt, Mycobacterium avium subsp. paratuberculosis
gcgcgaacagguccu

SEQ ID NO: 998066 - RNA, 14 nt, Mycobacterium avium subsp. paratuberculosis
gcgcaacagcgugc

SEQ ID NO: 998067 - RNA, 17 nt, Mycobacterium avium subsp. paratuberculosis
gcgcaacaccgaaagcc

SEQ ID NO: 998068 - RNA, 14 nt, Mycobacterium avium subsp. paratuberculosis
gcgcaaccgggccg

SEQ ID NO: 998069 - RNA, 16 nt, Mycobacterium avium subsp. paratuberculosis
gcgcaaccgcggcggc

SEQ ID NO: 998070 - RNA, 18 nt, Mycobacterium avium subsp. paratuberculosis
gcgcaacgauucacccag

SEQ ID NO: 998071 - RNA, 23 nt, Mycobacterium avium subsp. paratuberculosis
gcgcaacgauucacccagcgagc

SEQ ID NO: 998072 - RNA, 13 nt, Mycobacterium avium subsp. paratuberculosis
gcgauucccgccg

SEQ ID NO: 998073 - RNA, 17 nt, Mycobacterium avium subsp. paratuberculosis
gcgauugcggccgccgg

SEQ ID NO: 998074 - RNA, 17 nt, Mycobacterium avium subsp. paratuberculosis
gcgaugucgggcaccug

SEQ ID NO: 998075 - RNA, 17 nt, Mycobacterium avium subsp. paratuberculosis
gcgauggccauggccag

SEQ ID NO: 998076 - RNA, 17 nt, Mycobacterium avium subsp. paratuberculosis
gcgauggcccgcugcgc

SEQ ID NO: 998077 - RNA, 14 nt, Mycobacterium avium subsp. paratuberculosis
gcgauggcgcggcc

SEQ ID NO: 998078 - RNA, 17 nt, Mycobacterium avium subsp. paratuberculosis
gcgauggcgugccggcg

SEQ ID NO: 998079 - RNA, 21 nt, Mycobacterium avium subsp. paratuberculosis
gcgaugggugaucgcggcccg

SEQ ID NO: 998080 - RNA, 14 nt, Mycobacterium avium subsp. paratuberculosis
gcgauggugcugcc

SEQ ID NO: 998081 - RNA, 16 nt, Mycobacterium avium subsp. paratuberculosis
gcgauggugccgccgg

SEQ ID NO: 998082 - RNA, 20 nt, Mycobacterium avium subsp. paratuberculosis
gcgauguccgacagcccgcc

SEQ ID NO: 998083 - RNA, 12 nt, Mycobacterium avium subsp. paratuberculosis
gcgcagcuggga

SEQ ID NO: 998084 - RNA, 14 nt, Mycobacterium avium subsp. paratuberculosis
gcgcagcugggaga

SEQ ID NO: 998085 - RNA, 14 nt, Mycobacterium avium subsp. paratuberculosis
gcgcagcugcgccg

SEQ ID NO: 998086 - RNA, 19 nt, Mycobacterium avium subsp. paratuberculosis
gcgcagcucgcgcagcugg

SEQ ID NO: 998087 - RNA, 15 nt, Mycobacterium avium subsp. paratuberculosis
gcgcagcgugucggg

SEQ ID NO: 998088 - RNA, 20 nt, Mycobacterium avium subsp. paratuberculosis
gcgcagcggggaggcccagc

SEQ ID NO: 998089 - RNA, 21 nt, Mycobacterium avium subsp. paratuberculosis
gcgcagcggggaggcccagcc

SEQ ID NO: 998090 - RNA, 16 nt, Mycobacterium avium subsp. paratuberculosis
gcgcagcggggcgcgc

SEQ ID NO: 998091 - RNA, 20 nt, Mycobacterium avium subsp. paratuberculosis
gcgcagcggggcgcgcaggc

SEQ ID NO: 998092 - RNA, 14 nt, Mycobacterium avium subsp. paratuberculosis
gcgcagcgucggcg

SEQ ID NO: 998093 - RNA, 19 nt, Mycobacterium avium subsp. paratuberculosis
gcgcagcgucggcgugccc

SEQ ID NO: 998094 - RNA, 20 nt, Mycobacterium avium subsp. paratuberculosis
gcgcagcgucuugcccagcg

SEQ ID NO: 998095 - RNA, 23 nt, Mycobacterium avium subsp. paratuberculosis
gcgcagcgcgucgggcucggccg

SEQ ID NO: 998096 - RNA, 19 nt, Mycobacterium avium subsp. paratuberculosis
gcgcagcaucacgucggcg

SEQ ID NO: 998097 - RNA, 17 nt, Mycobacterium avium subsp. paratuberculosis
gcgcagcauccgcacca

SEQ ID NO: 998098 - RNA, 15 nt, Mycobacterium avium subsp. paratuberculosis
gcgcagcaucggcag

SEQ ID NO: 998099 - RNA, 14 nt, Mycobacterium avium subsp. paratuberculosis
gcgcagccaccgcc

SEQ ID NO: 998100 - RNA, 19 nt, Mycobacterium avium subsp. paratuberculosis
gcgcagccacgagcccagc

SEQ ID NO: 998101 - RNA, 23 nt, Mycobacterium avium subsp. paratuberculosis
gcgcagccagaccucgccgacgg

SEQ ID NO: 998102 - RNA, 22 nt, Mycobacterium avium subsp. paratuberculosis
gcgcagcagguaaaccagcagc

SEQ ID NO: 998103 - RNA, 16 nt, Mycobacterium avium subsp. paratuberculosis
gcgcagcagcggcuug

SEQ ID NO: 998104 - RNA, 19 nt, Mycobacterium avium subsp. paratuberculosis
gcgcagcauggcccacagg

SEQ ID NO: 998105 - RNA, 15 nt, Mycobacterium avium subsp. paratuberculosis
gcgcagccagcucgg

SEQ ID NO: 998106 - RNA, 17 nt, Mycobacterium avium subsp. paratuberculosis
gcgcagcccagccagcg

SEQ ID NO: 998107 - RNA, 15 nt, Mycobacterium avium subsp. paratuberculosis
gcgcagccaggugaa

SEQ ID NO: 998108 - RNA, 19 nt, Mycobacterium avium subsp. paratuberculosis
gcgcagccagucgccggcc

SEQ ID NO: 998109 - RNA, 23 nt, Mycobacterium avium subsp. paratuberculosis
gcgcagccagucgccggccaggc

SEQ ID NO: 998110 - RNA, 12 nt, Mycobacterium avium subsp. paratuberculosis
gcgcagccgccg

SEQ ID NO: 998111 - RNA, 13 nt, Mycobacterium avium subsp. paratuberculosis
gcgcagcccccgg

SEQ ID NO: 998112 - RNA, 20 nt, Mycobacterium avium subsp. paratuberculosis
gcgcagcccgaucgccagcg

SEQ ID NO: 998113 - RNA, 17 nt, Mycobacterium avium subsp. paratuberculosis
gcgcagcccgccgggau

SEQ ID NO: 998114 - RNA, 14 nt, Mycobacterium avium subsp. paratuberculosis
gcgcaaugccgccg

SEQ ID NO: 998115 - RNA, 21 nt, Mycobacterium avium subsp. paratuberculosis
gcgcaauugaacuguuuuucc

SEQ ID NO: 998116 - RNA, 17 nt, Mycobacterium avium subsp. paratuberculosis
gcgcacggcgcgcaccg

SEQ ID NO: 998117 - RNA, 17 nt, Mycobacterium avium subsp. paratuberculosis
gcgcagcacaaaagggc

SEQ ID NO: 998118 - RNA, 13 nt, Mycobacterium avium subsp. paratuberculosis
gcgcagcaccucc

SEQ ID NO: 998119 - RNA, 22 nt, Mycobacterium avium subsp. paratuberculosis
gcgcagcaccuccugggugagc

SEQ ID NO: 998120 - RNA, 18 nt, Mycobacterium avium subsp. paratuberculosis
gcgcagcacugagcggca

SEQ ID NO: 998121 - RNA, 16 nt, Mycobacterium avium subsp. paratuberculosis
gcgcagcacggccacu

SEQ ID NO: 998122 - RNA, 15 nt, Mycobacterium avium subsp. paratuberculosis
gcgcagcagcagguc

SEQ ID NO: 998123 - RNA, 19 nt, Mycobacterium avium subsp. paratuberculosis
gcgcagcagcgccagcagc

SEQ ID NO: 998124 - RNA, 17 nt, Mycobacterium avium subsp. paratuberculosis
gcgcacguuggcggcca

SEQ ID NO: 998125 - RNA, 18 nt, Mycobacterium avium subsp. paratuberculosis
gcgcacguuggcggccag

SEQ ID NO: 998126 - RNA, 19 nt, Mycobacterium avium subsp. paratuberculosis
gcgcacucgaacggcccgg

SEQ ID NO: 998127 - RNA, 19 nt, Mycobacterium avium subsp. paratuberculosis
gcgcacgucggccgccagg

SEQ ID NO: 998128 - RNA, 21 nt, Mycobacterium avium subsp. paratuberculosis
gcgcacgucggccgccagggc

SEQ ID NO: 998129 - RNA, 22 nt, Mycobacterium avium subsp. paratuberculosis
gcgcacguaccgguacagcgac

SEQ ID NO: 998130 - RNA, 17 nt, Mycobacterium avium subsp. paratuberculosis
gcgcacguagcccagcg

SEQ ID NO: 998131 - RNA, 22 nt, Mycobacterium avium subsp. paratuberculosis
gcgacgauaucggccgcggggc

SEQ ID NO: 998132 - RNA, 18 nt, Mycobacterium avium subsp. paratuberculosis
gcgacgaucagcagccgg

SEQ ID NO: 998133 - RNA, 16 nt, Mycobacterium avium subsp. paratuberculosis
gcgacgaugccggccg

SEQ ID NO: 998134 - RNA, 15 nt, Mycobacterium avium subsp. paratuberculosis
gcgacgaugccggcg

SEQ ID NO: 998135 - RNA, 18 nt, Mycobacterium avium subsp. paratuberculosis
gcgacgaccaccaggagc

SEQ ID NO: 998136 - RNA, 19 nt, Mycobacterium avium subsp. paratuberculosis
gcgacgaauaucccagcca

SEQ ID NO: 998137 - RNA, 17 nt, Mycobacterium avium subsp. paratuberculosis
gcgacgaaccgccacac

SEQ ID NO: 998138 - RNA, 15 nt, Mycobacterium avium subsp. paratuberculosis
gcgacgaacgccggc

SEQ ID NO: 998139 - RNA, 20 nt, Mycobacterium avium subsp. paratuberculosis
gcgacgaacgcuuccagcac

SEQ ID NO: 998140 - RNA, 17 nt, Mycobacterium avium subsp. paratuberculosis
gcgacgaccucgcccgc

SEQ ID NO: 998141 - RNA, 19 nt, Mycobacterium avium subsp. paratuberculosis
gcgacgaccucgcccgccg

SEQ ID NO: 998142 - RNA, 14 nt, Mycobacterium avium subsp. paratuberculosis
gcgacugggcgccc

SEQ ID NO: 998143 - RNA, 10 nt, Mycobacterium avium subsp. paratuberculosis
gcgacugucg

SEQ ID NO: 998144 - RNA, 16 nt, Mycobacterium avium subsp. paratuberculosis
gcgacugucggcgccc

SEQ ID NO: 998145 - RNA, 22 nt, Mycobacterium avium subsp. paratuberculosis
gcgacugucggcgccccgcccg

SEQ ID NO: 998146 - RNA, 18 nt, Mycobacterium avium subsp. paratuberculosis
gcgacugucggcucgccc

SEQ ID NO: 998147 - RNA, 23 nt, Mycobacterium avium subsp. paratuberculosis
gcgacugucggcucgcccgcgac

SEQ ID NO: 998148 - RNA, 14 nt, Mycobacterium avium subsp. paratuberculosis
gcgacucguuggcc

SEQ ID NO: 998149 - RNA, 17 nt, Mycobacterium avium subsp. paratuberculosis
gcgacucguuggccggc

SEQ ID NO: 998150 - RNA, 17 nt, Mycobacterium avium subsp. paratuberculosis
gcgacuucuucgccggc

SEQ ID NO: 998151 - RNA, 18 nt, Mycobacterium avium subsp. paratuberculosis
gcgacuugaccagcagcu

SEQ ID NO: 998152 - RNA, 15 nt, Mycobacterium avium subsp. paratuberculosis
gcgacuugccgccgg

SEQ ID NO: 998153 - RNA, 18 nt, Mycobacterium avium subsp. paratuberculosis
gcgaggauuucgcucagc

SEQ ID NO: 998154 - RNA, 20 nt, Mycobacterium avium subsp. paratuberculosis
gcgaggauuucgcucagccg

SEQ ID NO: 998155 - RNA, 21 nt, Mycobacterium avium subsp. paratuberculosis
gcgaggauuucgcucagccgu

SEQ ID NO: 998156 - RNA, 19 nt, Mycobacterium avium subsp. paratuberculosis
gcgaggaaguccggcgcgc

SEQ ID NO: 998157 - RNA, 19 nt, Mycobacterium avium subsp. paratuberculosis
gcgaggaaucgcggcaggc

SEQ ID NO: 998158 - RNA, 22 nt, Mycobacterium avium subsp. paratuberculosis
gcgaggaacucagcgcccagga

SEQ ID NO: 998159 - RNA, 19 nt, Mycobacterium avium subsp. paratuberculosis
gcgagcgcagcgccaggca

SEQ ID NO: 998160 - RNA, 16 nt, Mycobacterium avium subsp. paratuberculosis
gcgaggcgggcacacg

SEQ ID NO: 998161 - RNA, 14 nt, Mycobacterium avium subsp. paratuberculosis
gcgaggcggucggc

SEQ ID NO: 998162 - RNA, 15 nt, Mycobacterium avium subsp. paratuberculosis
gcgaggcggccagcg

SEQ ID NO: 998163 - RNA, 15 nt, Mycobacterium avium subsp. paratuberculosis
gcgaggcgcggggcg

SEQ ID NO: 998164 - RNA, 18 nt, Mycobacterium avium subsp. paratuberculosis
gcgaggcgccacaacugg

SEQ ID NO: 998165 - RNA, 22 nt, Mycobacterium avium subsp. paratuberculosis
gcgagccgacagucgcgggcgg

SEQ ID NO: 998166 - RNA, 12 nt, Mycobacterium avium subsp. paratuberculosis
gcgagccgagca

SEQ ID NO: 998167 - RNA, 15 nt, Mycobacterium avium subsp. paratuberculosis
gcgagccggagccuu

SEQ ID NO: 998168 - RNA, 23 nt, Mycobacterium avium subsp. paratuberculosis
gcgagcgcaccagauucaccagc

SEQ ID NO: 998169 - RNA, 17 nt, Mycobacterium avium subsp. paratuberculosis
gcgagcaaggcgagcac

SEQ ID NO: 998170 - RNA, 19 nt, Mycobacterium avium subsp. paratuberculosis
gcgagaugaucagccgccc

SEQ ID NO: 998171 - RNA, 15 nt, Mycobacterium avium subsp. paratuberculosis
gcgagaugcccaccc

SEQ ID NO: 998172 - RNA, 17 nt, Mycobacterium avium subsp. paratuberculosis
gcgagaugcccacccgc

SEQ ID NO: 998173 - RNA, 23 nt, Mycobacterium avium subsp. paratuberculosis
gcgagaugcccacccgcucggcg

SEQ ID NO: 998174 - RNA, 24 nt, Mycobacterium avium subsp. paratuberculosis
gcgagauuggccucggcgcgggcg

SEQ ID NO: 998175 - RNA, 18 nt, Mycobacterium avium subsp. paratuberculosis
gcgaucaucgccccggag

SEQ ID NO: 998176 - RNA, 22 nt, Mycobacterium avium subsp. paratuberculosis
gcgaucaggcugccgcugcgcc

SEQ ID NO: 998177 - RNA, 18 nt, Mycobacterium avium subsp. paratuberculosis
gcgaucagggcccacagc

SEQ ID NO: 998178 - RNA, 18 nt, Mycobacterium avium subsp. paratuberculosis
gcgaucagggccgcggcc

SEQ ID NO: 998179 - RNA, 21 nt, Mycobacterium avium subsp. paratuberculosis
gcgauagccggugaucgcggc

SEQ ID NO: 998180 - RNA, 14 nt, Mycobacterium avium subsp. paratuberculosis
gcgagggggugggu

SEQ ID NO: 998181 - RNA, 19 nt, Mycobacterium avium subsp. paratuberculosis
gcgaggucgucgagggcca

SEQ ID NO: 998182 - RNA, 14 nt, Mycobacterium avium subsp. paratuberculosis
gcgauccgcaggcc

SEQ ID NO: 998183 - RNA, 15 nt, Mycobacterium avium subsp. paratuberculosis
gcgauccgcgcggcg

SEQ ID NO: 998184 - RNA, 15 nt, Mycobacterium avium subsp. paratuberculosis
gcgauccgggcgccg

SEQ ID NO: 998185 - RNA, 20 nt, Mycobacterium avium subsp. paratuberculosis
gcgauccgggcgccggccgg

SEQ ID NO: 998186 - RNA, 21 nt, Mycobacterium avium subsp. paratuberculosis
gcgauccgggcgccggccggc

SEQ ID NO: 998187 - RNA, 20 nt, Mycobacterium avium subsp. paratuberculosis
gcgaucgaggaucucccggg

SEQ ID NO: 998188 - RNA, 20 nt, Mycobacterium avium subsp. paratuberculosis
gcgaucgaugcccagcgcgc

SEQ ID NO: 998189 - RNA, 13 nt, Mycobacterium avium subsp. paratuberculosis
gcgaucgccgggg

SEQ ID NO: 998190 - RNA, 16 nt, Mycobacterium avium subsp. paratuberculosis
gcgaucgacagcucca

SEQ ID NO: 998191 - RNA, 22 nt, Mycobacterium avium subsp. paratuberculosis
gcgaugcaacaccgaacgccga

SEQ ID NO: 998192 - RNA, 21 nt, Mycobacterium avium subsp. paratuberculosis
gcgaugccagcgcaccgggcc

SEQ ID NO: 998193 - RNA, 19 nt, Mycobacterium avium subsp. paratuberculosis
gcgaugcccacagccaggu

SEQ ID NO: 998194 - RNA, 17 nt, Mycobacterium avium subsp. paratuberculosis
gcgauggaagcgcccgc

SEQ ID NO: 998195 - RNA, 19 nt, Mycobacterium avium subsp. paratuberculosis
gcgaugaucacgaaguuga

SEQ ID NO: 998196 - RNA, 14 nt, Mycobacterium avium subsp. paratuberculosis
gcgaugaucaggcc

SEQ ID NO: 998197 - RNA, 15 nt, Mycobacterium avium subsp. paratuberculosis
gcgaugaucgccggc

SEQ ID NO: 998198 - RNA, 18 nt, Mycobacterium avium subsp. paratuberculosis
gcgaugaacgggauggag

SEQ ID NO: 998199 - RNA, 14 nt, Mycobacterium avium subsp. paratuberculosis
gcgaugaagccccg

SEQ ID NO: 998200 - RNA, 21 nt, Mycobacterium avium subsp. paratuberculosis
gcgaugacgucgucgcggcgc

SEQ ID NO: 998201 - RNA, 18 nt, Mycobacterium avium subsp. paratuberculosis
gcgaugaccgccugcggc

SEQ ID NO: 998202 - RNA, 18 nt, Mycobacterium avium subsp. paratuberculosis
gcgaucgcgagcagggcg

SEQ ID NO: 998203 - RNA, 18 nt, Mycobacterium avium subsp. paratuberculosis
gccuuuccacaucugcuu

SEQ ID NO: 998204 - RNA, 19 nt, Mycobacterium avium subsp. paratuberculosis
gccuuuugcacccgccaug

SEQ ID NO: 998205 - RNA, 16 nt, Mycobacterium avium subsp. paratuberculosis
gcgaaccgggccagga

SEQ ID NO: 998206 - RNA, 17 nt, Mycobacterium avium subsp. paratuberculosis
gcgaaccgggccaggau

SEQ ID NO: 998207 - RNA, 22 nt, Mycobacterium avium subsp. paratuberculosis
gcgaacaauuccucugcgcgcc

SEQ ID NO: 998208 - RNA, 23 nt, Mycobacterium avium subsp. paratuberculosis
gcgaacaauuccucugcgcgcca

SEQ ID NO: 998209 - RNA, 22 nt, Mycobacterium avium subsp. paratuberculosis
gcgaacaccacgguccccgcgc

SEQ ID NO: 998210 - RNA, 17 nt, Mycobacterium avium subsp. paratuberculosis
gcgaacgcgucccgggc

SEQ ID NO: 998211 - RNA, 21 nt, Mycobacterium avium subsp. paratuberculosis
gcgaacgccucguuggccagc

SEQ ID NO: 998212 - RNA, 13 nt, Mycobacterium avium subsp. paratuberculosis
gcgaacgcgcccc

SEQ ID NO: 998213 - RNA, 18 nt, Mycobacterium avium subsp. paratuberculosis
gcgaacgcgguuuugaug

SEQ ID NO: 998214 - RNA, 18 nt, Mycobacterium avium subsp. paratuberculosis
gcgaacucaggcgcgcac

SEQ ID NO: 998215 - RNA, 16 nt, Mycobacterium avium subsp. paratuberculosis
gcgaacuccagaucgc

SEQ ID NO: 998216 - RNA, 15 nt, Mycobacterium avium subsp. paratuberculosis
gcgaacgggucgggg

SEQ ID NO: 998217 - RNA, 21 nt, Mycobacterium avium subsp. paratuberculosis
gcgaacgggugaccggcggcc

SEQ ID NO: 998218 - RNA, 19 nt, Mycobacterium avium subsp. paratuberculosis
gcgaacgggugcggcgcuc

SEQ ID NO: 998219 - RNA, 17 nt, Mycobacterium avium subsp. paratuberculosis
gcgaacucgcggcgggu

SEQ ID NO: 998220 - RNA, 22 nt, Mycobacterium avium subsp. paratuberculosis
gcgaaggagaaccgcugcuccg

SEQ ID NO: 998221 - RNA, 18 nt, Mycobacterium avium subsp. paratuberculosis
gcgaaggacagccggacg

SEQ ID NO: 998222 - RNA, 21 nt, Mycobacterium avium subsp. paratuberculosis
gcgaaguagacgagcucaccg

SEQ ID NO: 998223 - RNA, 23 nt, Mycobacterium avium subsp. paratuberculosis
gcgaaggucugaaaugccgggcc

SEQ ID NO: 998224 - RNA, 21 nt, Mycobacterium avium subsp. paratuberculosis
gcgaaguuggucaccaccaac

SEQ ID NO: 998225 - RNA, 14 nt, Mycobacterium avium subsp. paratuberculosis
gcgaagucccacug

SEQ ID NO: 998226 - RNA, 14 nt, Mycobacterium avium subsp. paratuberculosis
gcgaagucgccgcc

SEQ ID NO: 998227 - RNA, 15 nt, Mycobacterium avium subsp. paratuberculosis
gcgaagucgccgccc

SEQ ID NO: 998228 - RNA, 18 nt, Mycobacterium avium subsp. paratuberculosis
gcgaagucgccgcccggg

SEQ ID NO: 998229 - RNA, 14 nt, Mycobacterium avium subsp. paratuberculosis
gcgacaaaggaggg

SEQ ID NO: 998230 - RNA, 15 nt, Mycobacterium avium subsp. paratuberculosis
gcgacaccugcucac

SEQ ID NO: 998231 - RNA, 14 nt, Mycobacterium avium subsp. paratuberculosis
gcgacaacagcgcc

SEQ ID NO: 998232 - RNA, 20 nt, Mycobacterium avium subsp. paratuberculosis
gcgacacgucgacacgccgg

SEQ ID NO: 998233 - RNA, 23 nt, Mycobacterium avium subsp. paratuberculosis
gcgacacgucgacacgccggccg

SEQ ID NO: 998234 - RNA, 17 nt, Mycobacterium avium subsp. paratuberculosis
gcgacacccagcggcgc

SEQ ID NO: 998235 - RNA, 21 nt, Mycobacterium avium subsp. paratuberculosis
gcgacacccagcggcgcggcc

SEQ ID NO: 998236 - RNA, 20 nt, Mycobacterium avium subsp. paratuberculosis
gcgacaccgcauggccggcg

SEQ ID NO: 998237 - RNA, 16 nt, Mycobacterium avium subsp. paratuberculosis
gcgaccgucgggacgg

SEQ ID NO: 998238 - RNA, 18 nt, Mycobacterium avium subsp. paratuberculosis
gcgaccgugcccaccagc

SEQ ID NO: 998239 - RNA, 19 nt, Mycobacterium avium subsp. paratuberculosis
gcgaccgugcccaccagcc

SEQ ID NO: 998240 - RNA, 21 nt, Mycobacterium avium subsp. paratuberculosis
gcgaccgguccgugccacggc

SEQ ID NO: 998241 - RNA, 15 nt, Mycobacterium avium subsp. paratuberculosis
gcgacccaggccgcc

SEQ ID NO: 998242 - RNA, 19 nt, Mycobacterium avium subsp. paratuberculosis
gcgacccaggccgccgcca

SEQ ID NO: 998243 - RNA, 12 nt, Mycobacterium avium subsp. paratuberculosis
gcgaccccgccg

SEQ ID NO: 998244 - RNA, 20 nt, Mycobacterium avium subsp. paratuberculosis
gcgaccccuacgggcgcacc

SEQ ID NO: 998245 - RNA, 14 nt, Mycobacterium avium subsp. paratuberculosis
gcgaccccuccaac

SEQ ID NO: 998246 - RNA, 16 nt, Mycobacterium avium subsp. paratuberculosis
gcgacccggccgagcg

SEQ ID NO: 998247 - RNA, 20 nt, Mycobacterium avium subsp. paratuberculosis
gcgacccggccgagcgcgcc

SEQ ID NO: 998248 - RNA, 20 nt, Mycobacterium avium subsp. paratuberculosis
gcgacccgggccgccacggc

SEQ ID NO: 998249 - RNA, 20 nt, Mycobacterium avium subsp. paratuberculosis
gcgaccuccugcaaggcccc

SEQ ID NO: 998250 - RNA, 21 nt, Mycobacterium avium subsp. paratuberculosis
gcgaccugcuuggcggccugc

SEQ ID NO: 998251 - RNA, 15 nt, Mycobacterium avium subsp. paratuberculosis
gcgaccuggacgccg

SEQ ID NO: 998252 - RNA, 16 nt, Mycobacterium avium subsp. paratuberculosis
gcgaccuggacgccgc

SEQ ID NO: 998253 - RNA, 17 nt, Mycobacterium avium subsp. paratuberculosis
gcgaccugguccaccgc

SEQ ID NO: 998254 - RNA, 20 nt, Mycobacterium avium subsp. paratuberculosis
gcgaccugguccaccgcggc

SEQ ID NO: 998255 - RNA, 23 nt, Mycobacterium avium subsp. paratuberculosis
gcgaccugguccaccgcggcggc

SEQ ID NO: 998256 - RNA, 21 nt, Mycobacterium avium subsp. paratuberculosis
gcgaccucgguggugcugaug

SEQ ID NO: 998257 - RNA, 16 nt, Mycobacterium avium subsp. paratuberculosis
gcgaccaugcccggcg

SEQ ID NO: 998258 - RNA, 18 nt, Mycobacterium avium subsp. paratuberculosis
gcgaccaugccgcgggcc

SEQ ID NO: 998259 - RNA, 20 nt, Mycobacterium avium subsp. paratuberculosis
gcgaccaguaggccagcauc

SEQ ID NO: 998260 - RNA, 15 nt, Mycobacterium avium subsp. paratuberculosis
gcgaccagcucgggc

SEQ ID NO: 998261 - RNA, 20 nt, Mycobacterium avium subsp. paratuberculosis
gcgacagcgcgucggccagc

SEQ ID NO: 998262 - RNA, 15 nt, Mycobacterium avium subsp. paratuberculosis
gcgaccagcgacggc

SEQ ID NO: 998263 - RNA, 18 nt, Mycobacterium avium subsp. paratuberculosis
gcgaccagcgagcccagc

SEQ ID NO: 998264 - RNA, 15 nt, Mycobacterium avium subsp. paratuberculosis
gcgaccagcgcgccg

SEQ ID NO: 998265 - RNA, 17 nt, Mycobacterium avium subsp. paratuberculosis
gcgaccagcggcagcag

SEQ ID NO: 998266 - RNA, 17 nt, Mycobacterium avium subsp. paratuberculosis
gcgacagcacgggcggg

SEQ ID NO: 998267 - RNA, 22 nt, Mycobacterium avium subsp. paratuberculosis
gcgacagccgggaaucgagggc

SEQ ID NO: 998268 - RNA, 16 nt, Mycobacterium avium subsp. paratuberculosis
gccuucgacggccggc

SEQ ID NO: 998269 - RNA, 19 nt, Mycobacterium avium subsp. paratuberculosis
gccuucggcgccagcccgc

SEQ ID NO: 998270 - RNA, 17 nt, Mycobacterium avium subsp. paratuberculosis
gccuuccacgaccuggc

SEQ ID NO: 998271 - RNA, 17 nt, Mycobacterium avium subsp. paratuberculosis
gccuucaucaccgcccc

SEQ ID NO: 998272 - RNA, 16 nt, Mycobacterium avium subsp. paratuberculosis
gccuucacgcuggccu

SEQ ID NO: 998273 - RNA, 21 nt, Mycobacterium avium subsp. paratuberculosis
gccuucacgcuggccuccagc

SEQ ID NO: 998274 - RNA, 23 nt, Mycobacterium avium subsp. paratuberculosis
gccuucacgcuggccuccagcuu

SEQ ID NO: 998275 - RNA, 20 nt, Mycobacterium avium subsp. paratuberculosis
gccuugguagaugcguucca

SEQ ID NO: 998276 - RNA, 21 nt, Mycobacterium avium subsp. paratuberculosis
gccuugguagaugcguuccag

SEQ ID NO: 998277 - RNA, 15 nt, Mycobacterium avium subsp. paratuberculosis
gccuuggccgcaggc

SEQ ID NO: 998278 - RNA, 21 nt, Mycobacterium avium subsp. paratuberculosis
gccuugcugauccccagcggc

SEQ ID NO: 998279 - RNA, 14 nt, Mycobacterium avium subsp. paratuberculosis
gccuuggccaacgc

SEQ ID NO: 998280 - RNA, 12 nt, Mycobacterium avium subsp. paratuberculosis
gccuuggccacc

SEQ ID NO: 998281 - RNA, 13 nt, Mycobacterium avium subsp. paratuberculosis
gccuuggccacca

SEQ ID NO: 998282 - RNA, 20 nt, Mycobacterium avium subsp. paratuberculosis
gccuuggccaccgccugcgc

SEQ ID NO: 998283 - RNA, 19 nt, Mycobacterium avium subsp. paratuberculosis
gccuugccgaucagcuggc

SEQ ID NO: 998284 - RNA, 21 nt, Mycobacterium avium subsp. paratuberculosis
gccuugcccggcucggugcgc

SEQ ID NO: 998285 - RNA, 16 nt, Mycobacterium avium subsp. paratuberculosis
gccuugcgcccacagu

SEQ ID NO: 998286 - RNA, 22 nt, Mycobacterium avium subsp. paratuberculosis
gccuucucgcgcaccgcgggcu

SEQ ID NO: 998287 - RNA, 15 nt, Mycobacterium avium subsp. paratuberculosis
gccuucuuggcggcg

SEQ ID NO: 998288 - RNA, 15 nt, Mycobacterium avium subsp. paratuberculosis
gccuucuugaccgca

SEQ ID NO: 998289 - RNA, 17 nt, Mycobacterium avium subsp. paratuberculosis
gccuucuugaccgcagc

SEQ ID NO: 998290 - RNA, 17 nt, Mycobacterium avium subsp. paratuberculosis
gccuucuugcugcccgc

SEQ ID NO: 998291 - RNA, 21 nt, Mycobacterium avium subsp. paratuberculosis
gccuugaacgcguccgacggc

SEQ ID NO: 998292 - RNA, 14 nt, Mycobacterium avium subsp. paratuberculosis
gccuugcacccagc

SEQ ID NO: 998293 - RNA, 13 nt, Mycobacterium avium subsp. paratuberculosis
gccuugcagccgc

SEQ ID NO: 998294 - RNA, 18 nt, Mycobacterium avium subsp. paratuberculosis
gccuggcacgacgccgcc

SEQ ID NO: 998295 - RNA, 12 nt, Mycobacterium avium subsp. paratuberculosis
gccuggccacgu

SEQ ID NO: 998296 - RNA, 20 nt, Mycobacterium avium subsp. paratuberculosis
gccugcuugggcagcagcuc

SEQ ID NO: 998297 - RNA, 18 nt, Mycobacterium avium subsp. paratuberculosis
gccugcuugaccgccaga

SEQ ID NO: 998298 - RNA, 21 nt, Mycobacterium avium subsp. paratuberculosis
gccugcuugaugaugccggcc

SEQ ID NO: 998299 - RNA, 15 nt, Mycobacterium avium subsp. paratuberculosis
gccugcugcccaucc

SEQ ID NO: 998300 - RNA, 18 nt, Mycobacterium avium subsp. paratuberculosis
gccugcugaauuagggga

SEQ ID NO: 998301 - RNA, 14 nt, Mycobacterium avium subsp. paratuberculosis
gccugcggugaugc

SEQ ID NO: 998302 - RNA, 15 nt, Mycobacterium avium subsp. paratuberculosis
gccugcggugaugcg

SEQ ID NO: 998303 - RNA, 20 nt, Mycobacterium avium subsp. paratuberculosis
gccugcggugaugcgcggcg

SEQ ID NO: 998304 - RNA, 18 nt, Mycobacterium avium subsp. paratuberculosis
gccugcgucacuccucga

SEQ ID NO: 998305 - RNA, 23 nt, Mycobacterium avium subsp. paratuberculosis
gccugcgucacuccucgaucugg

SEQ ID NO: 998306 - RNA, 18 nt, Mycobacterium avium subsp. paratuberculosis
gccugcggcggcaacggg

SEQ ID NO: 998307 - RNA, 13 nt, Mycobacterium avium subsp. paratuberculosis
gccugcggcggcc

SEQ ID NO: 998308 - RNA, 14 nt, Mycobacterium avium subsp. paratuberculosis
gccugcggcggccg

SEQ ID NO: 998309 - RNA, 16 nt, Mycobacterium avium subsp. paratuberculosis
gccugcggcgcggcca

SEQ ID NO: 998310 - RNA, 20 nt, Mycobacterium avium subsp. paratuberculosis
gccugcggcgcggccacccc

SEQ ID NO: 998311 - RNA, 21 nt, Mycobacterium avium subsp. paratuberculosis
gccugcggcgcggccaccccg

SEQ ID NO: 998312 - RNA, 13 nt, Mycobacterium avium subsp. paratuberculosis
gccugcggccugc

SEQ ID NO: 998313 - RNA, 16 nt, Mycobacterium avium subsp. paratuberculosis
gccugcggccugcaca

SEQ ID NO: 998314 - RNA, 22 nt, Mycobacterium avium subsp. paratuberculosis
gccugcggcagguaggcgccgc

SEQ ID NO: 998315 - RNA, 15 nt, Mycobacterium avium subsp. paratuberculosis
gccugcgcugcggcc

SEQ ID NO: 998316 - RNA, 17 nt, Mycobacterium avium subsp. paratuberculosis
gccugcggcaacagcac

SEQ ID NO: 998317 - RNA, 21 nt, Mycobacterium avium subsp. paratuberculosis
gccugcggcaacagcaccagc

SEQ ID NO: 998318 - RNA, 13 nt, Mycobacterium avium subsp. paratuberculosis
gccugcgcggccg

SEQ ID NO: 998319 - RNA, 19 nt, Mycobacterium avium subsp. paratuberculosis
gccugcgcgggcgcggaca

SEQ ID NO: 998320 - RNA, 14 nt, Mycobacterium avium subsp. paratuberculosis
gccuguggagacca

SEQ ID NO: 998321 - RNA, 20 nt, Mycobacterium avium subsp. paratuberculosis
gccugguuggucaauccggg

SEQ ID NO: 998322 - RNA, 17 nt, Mycobacterium avium subsp. paratuberculosis
gccuggcgcuccagcca

SEQ ID NO: 998323 - RNA, 19 nt, Mycobacterium avium subsp. paratuberculosis
gccuggcgcagggcguucg

SEQ ID NO: 998324 - RNA, 20 nt, Mycobacterium avium subsp. paratuberculosis
gccuggcgaacucgcgcaga

SEQ ID NO: 998325 - RNA, 17 nt, Mycobacterium avium subsp. paratuberculosis
gccuggcuccccggcga

SEQ ID NO: 998326 - RNA, 19 nt, Mycobacterium avium subsp. paratuberculosis
gccugggcaauggccgcga

SEQ ID NO: 998327 - RNA, 21 nt, Mycobacterium avium subsp. paratuberculosis
gccugggcaauggccgcgacu

SEQ ID NO: 998328 - RNA, 22 nt, Mycobacterium avium subsp. paratuberculosis
gccugguacagcaccgccgcgg

SEQ ID NO: 998329 - RNA, 18 nt, Mycobacterium avium subsp. paratuberculosis
gccuggucaaggugcuga

SEQ ID NO: 998330 - RNA, 19 nt, Mycobacterium avium subsp. paratuberculosis
gccuggucaaggugcugaa

SEQ ID NO: 998331 - RNA, 20 nt, Mycobacterium avium subsp. paratuberculosis
gccugguagcugagcagcag

SEQ ID NO: 998332 - RNA, 20 nt, Mycobacterium avium subsp. paratuberculosis
gccugguagggguccuccag

SEQ ID NO: 998333 - RNA, 22 nt, Mycobacterium avium subsp. paratuberculosis
gccugguccucccgggugggca

SEQ ID NO: 998334 - RNA, 18 nt, Mycobacterium avium subsp. paratuberculosis
gccugguggcccaggcag

SEQ ID NO: 998335 - RNA, 23 nt, Mycobacterium avium subsp. paratuberculosis
gccugcacgaagucgaccgcggc

SEQ ID NO: 998336 - RNA, 14 nt, Mycobacterium avium subsp. paratuberculosis
gccugcacccaggu

SEQ ID NO: 998337 - RNA, 18 nt, Mycobacterium avium subsp. paratuberculosis
gccugcacccaggucaug

SEQ ID NO: 998338 - RNA, 18 nt, Mycobacterium avium subsp. paratuberculosis
gccugcaacuggucgugc

SEQ ID NO: 998339 - RNA, 20 nt, Mycobacterium avium subsp. paratuberculosis
gccugcaacuggucgugcag

SEQ ID NO: 998340 - RNA, 22 nt, Mycobacterium avium subsp. paratuberculosis
gccugcacgucggcgcgcaggc

SEQ ID NO: 998341 - RNA, 11 nt, Mycobacterium avium subsp. paratuberculosis
gccugcagccg

SEQ ID NO: 998342 - RNA, 12 nt, Mycobacterium avium subsp. paratuberculosis
gccugcagccgc

SEQ ID NO: 998343 - RNA, 13 nt, Mycobacterium avium subsp. paratuberculosis
gccugcccggcgg

SEQ ID NO: 998344 - RNA, 13 nt, Mycobacterium avium subsp. paratuberculosis
gccugcccgccgc

SEQ ID NO: 998345 - RNA, 18 nt, Mycobacterium avium subsp. paratuberculosis
gccugcccgccgcggccg

SEQ ID NO: 998346 - RNA, 14 nt, Mycobacterium avium subsp. paratuberculosis
gccugcccgcgcag

SEQ ID NO: 998347 - RNA, 13 nt, Mycobacterium avium subsp. paratuberculosis
gccugcccgcggg

SEQ ID NO: 998348 - RNA, 14 nt, Mycobacterium avium subsp. paratuberculosis
gccugcccagcggc

SEQ ID NO: 998349 - RNA, 18 nt, Mycobacterium avium subsp. paratuberculosis
gccugccggaugccgcgc

SEQ ID NO: 998350 - RNA, 19 nt, Mycobacterium avium subsp. paratuberculosis
gccugccggccgccgcgca

SEQ ID NO: 998351 - RNA, 13 nt, Mycobacterium avium subsp. paratuberculosis
gccugcgccgccg

SEQ ID NO: 998352 - RNA, 13 nt, Mycobacterium avium subsp. paratuberculosis
gccugcgccuugg

SEQ ID NO: 998353 - RNA, 22 nt, Mycobacterium avium subsp. paratuberculosis
gccugcgccaggauccgcccgc

SEQ ID NO: 998354 - RNA, 13 nt, Mycobacterium avium subsp. paratuberculosis
gccugaaccagcu

SEQ ID NO: 998355 - RNA, 21 nt, Mycobacterium avium subsp. paratuberculosis
gccugauacgacguccgggcc

SEQ ID NO: 998356 - RNA, 15 nt, Mycobacterium avium subsp. paratuberculosis
gccugagcaaccggu

SEQ ID NO: 998357 - RNA, 18 nt, Mycobacterium avium subsp. paratuberculosis
gccugagcccgccucagu

SEQ ID NO: 998358 - RNA, 15 nt, Mycobacterium avium subsp. paratuberculosis
gccuaggacgccgcc

SEQ ID NO: 998359 - RNA, 22 nt, Mycobacterium avium subsp. paratuberculosis
gccuagccuuggccgcaggcgg

SEQ ID NO: 998360 - RNA, 20 nt, Mycobacterium avium subsp. paratuberculosis
gccuaugaggcgacccccgg

SEQ ID NO: 998361 - RNA, 22 nt, Mycobacterium avium subsp. paratuberculosis
gccucaccccagcgcgaccagu

SEQ ID NO: 998362 - RNA, 15 nt, Mycobacterium avium subsp. paratuberculosis
gccucaccgcgggcc

SEQ ID NO: 998363 - RNA, 19 nt, Mycobacterium avium subsp. paratuberculosis
gccucaccgcgggccaggc

SEQ ID NO: 998364 - RNA, 24 nt, Mycobacterium avium subsp. paratuberculosis
gccucaccgcgggccaggcccacc

SEQ ID NO: 998365 - RNA, 16 nt, Mycobacterium avium subsp. paratuberculosis
gccuacacagccccca

SEQ ID NO: 998366 - RNA, 18 nt, Mycobacterium avium subsp. paratuberculosis
gccuaccggguggccagc

SEQ ID NO: 998367 - RNA, 22 nt, Mycobacterium avium subsp. paratuberculosis
gccguugggcacgguguagcug

SEQ ID NO: 998368 - RNA, 13 nt, Mycobacterium avium subsp. paratuberculosis
gccguugggcagc

SEQ ID NO: 998369 - RNA, 16 nt, Mycobacterium avium subsp. paratuberculosis
gccguugccggcccgc

SEQ ID NO: 998370 - RNA, 18 nt, Mycobacterium avium subsp. paratuberculosis
gccguugaugcgcaccgc

SEQ ID NO: 998371 - RNA, 19 nt, Mycobacterium avium subsp. paratuberculosis
gccguugauugcgcccgcc

SEQ ID NO: 998372 - RNA, 14 nt, Mycobacterium avium subsp. paratuberculosis
gccguugccaggcc

SEQ ID NO: 998373 - RNA, 18 nt, Mycobacterium avium subsp. paratuberculosis
gccguugccaggccgcga

SEQ ID NO: 998374 - RNA, 21 nt, Mycobacterium avium subsp. paratuberculosis
gccgggguccgcaacgccggc

SEQ ID NO: 998375 - RNA, 14 nt, Mycobacterium avium subsp. paratuberculosis
gccgggggcgcggg

SEQ ID NO: 998376 - RNA, 13 nt, Mycobacterium avium subsp. paratuberculosis
gccgggggcggcg

SEQ ID NO: 998377 - RNA, 21 nt, Mycobacterium avium subsp. paratuberculosis
gccgggggcggugcagccggg

SEQ ID NO: 998378 - RNA, 14 nt, Mycobacterium avium subsp. paratuberculosis
gccgggugcgggcc

SEQ ID NO: 998379 - RNA, 13 nt, Mycobacterium avium subsp. paratuberculosis
gccgggugcggug

SEQ ID NO: 998380 - RNA, 15 nt, Mycobacterium avium subsp. paratuberculosis
gccgggugggcggca

SEQ ID NO: 998381 - RNA, 16 nt, Mycobacterium avium subsp. paratuberculosis
gccgggucgcgguggg

SEQ ID NO: 998382 - RNA, 13 nt, Mycobacterium avium subsp. paratuberculosis
gccgggugcccgc

SEQ ID NO: 998383 - RNA, 15 nt, Mycobacterium avium subsp. paratuberculosis
gccggggucgcgcgc

SEQ ID NO: 998384 - RNA, 13 nt, Mycobacterium avium subsp. paratuberculosis
gccggguccagcc

SEQ ID NO: 998385 - RNA, 21 nt, Mycobacterium avium subsp. paratuberculosis
gccgggucccuuugcuguucg

SEQ ID NO: 998386 - RNA, 13 nt, Mycobacterium avium subsp. paratuberculosis
gccggguccuugc

SEQ ID NO: 998387 - RNA, 18 nt, Mycobacterium avium subsp. paratuberculosis
gccggguccuugcgcccc

SEQ ID NO: 998388 - RNA, 20 nt, Mycobacterium avium subsp. paratuberculosis
gccgggucgaacggcaaccu

SEQ ID NO: 998389 - RNA, 19 nt, Mycobacterium avium subsp. paratuberculosis
gccgguaaaacuggccagc

SEQ ID NO: 998390 - RNA, 19 nt, Mycobacterium avium subsp. paratuberculosis
gccggguugggcggcggcc

SEQ ID NO: 998391 - RNA, 20 nt, Mycobacterium avium subsp. paratuberculosis
gccggguuguccuggcccuu

SEQ ID NO: 998392 - RNA, 15 nt, Mycobacterium avium subsp. paratuberculosis
gccggguuucggccc

SEQ ID NO: 998393 - RNA, 14 nt, Mycobacterium avium subsp. paratuberculosis
gccgucgggacgcg

SEQ ID NO: 998394 - RNA, 15 nt, Mycobacterium avium subsp. paratuberculosis
gccgucggggcgucg

SEQ ID NO: 998395 - RNA, 18 nt, Mycobacterium avium subsp. paratuberculosis
gccgucgggucggcgagc

SEQ ID NO: 998396 - RNA, 22 nt, Mycobacterium avium subsp. paratuberculosis
gccgucgguuucggucgcggug

SEQ ID NO: 998397 - RNA, 16 nt, Mycobacterium avium subsp. paratuberculosis
gccgucgucagccggg

SEQ ID NO: 998398 - RNA, 16 nt, Mycobacterium avium subsp. paratuberculosis
gccgucuccucgacca

SEQ ID NO: 998399 - RNA, 22 nt, Mycobacterium avium subsp. paratuberculosis
gccgucuccucgaccagcgcgc

SEQ ID NO: 998400 - RNA, 19 nt, Mycobacterium avium subsp. paratuberculosis
gccgugaucggccagccac

SEQ ID NO: 998401 - RNA, 19 nt, Mycobacterium avium subsp. paratuberculosis
gccgugaucuucgugcuca

SEQ ID NO: 998402 - RNA, 15 nt, Mycobacterium avium subsp. paratuberculosis
gccgucgucgcugca

SEQ ID NO: 998403 - RNA, 15 nt, Mycobacterium avium subsp. paratuberculosis
gccgucgucgggcag

SEQ ID NO: 998404 - RNA, 20 nt, Mycobacterium avium subsp. paratuberculosis
gccgucguucuccauccggg

SEQ ID NO: 998405 - RNA, 17 nt, Mycobacterium avium subsp. paratuberculosis
gccgucguugacgcccu

SEQ ID NO: 998406 - RNA, 19 nt, Mycobacterium avium subsp. paratuberculosis
gccgugcaccgucgccggc

SEQ ID NO: 998407 - RNA, 16 nt, Mycobacterium avium subsp. paratuberculosis
gccgugcacgccgucg

SEQ ID NO: 998408 - RNA, 17 nt, Mycobacterium avium subsp. paratuberculosis
gccgugcagaacagcac

SEQ ID NO: 998409 - RNA, 12 nt, Mycobacterium avium subsp. paratuberculosis
gccgugcagcac

SEQ ID NO: 998410 - RNA, 21 nt, Mycobacterium avium subsp. paratuberculosis
gccgugcagcaguuccggagc

SEQ ID NO: 998411 - RNA, 19 nt, Mycobacterium avium subsp. paratuberculosis
gccgugcagcgcccagccg

SEQ ID NO: 998412 - RNA, 22 nt, Mycobacterium avium subsp. paratuberculosis
gccgugcagcgcccagccgagc

SEQ ID NO: 998413 - RNA, 12 nt, Mycobacterium avium subsp. paratuberculosis
gccguggcggcc

SEQ ID NO: 998414 - RNA, 14 nt, Mycobacterium avium subsp. paratuberculosis
gccguggcggcccg

SEQ ID NO: 998415 - RNA, 19 nt, Mycobacterium avium subsp. paratuberculosis
gccgugccguggucggugc

SEQ ID NO: 998416 - RNA, 18 nt, Mycobacterium avium subsp. paratuberculosis
gccgugcagggggcgcag

SEQ ID NO: 998417 - RNA, 15 nt, Mycobacterium avium subsp. paratuberculosis
gccgugccagccggc

SEQ ID NO: 998418 - RNA, 21 nt, Mycobacterium avium subsp. paratuberculosis
gccgugcccaauagcacccgc

SEQ ID NO: 998419 - RNA, 22 nt, Mycobacterium avium subsp. paratuberculosis
gccgugcccaauagcacccgcu

SEQ ID NO: 998420 - RNA, 12 nt, Mycobacterium avium subsp. paratuberculosis
gccgugccccag

SEQ ID NO: 998421 - RNA, 14 nt, Mycobacterium avium subsp. paratuberculosis
gccgugcccgcggg

SEQ ID NO: 998422 - RNA, 13 nt, Mycobacterium avium subsp. paratuberculosis
gccgugcccggcg

SEQ ID NO: 998423 - RNA, 19 nt, Mycobacterium avium subsp. paratuberculosis
gccgugcccggcgcccugc

SEQ ID NO: 998424 - RNA, 17 nt, Mycobacterium avium subsp. paratuberculosis
gccgugugcgcaucggc

SEQ ID NO: 998425 - RNA, 16 nt, Mycobacterium avium subsp. paratuberculosis
gccguguaggccgcgc

SEQ ID NO: 998426 - RNA, 14 nt, Mycobacterium avium subsp. paratuberculosis
gccguucucguccu

SEQ ID NO: 998427 - RNA, 17 nt, Mycobacterium avium subsp. paratuberculosis
gccguucucguccuggg

SEQ ID NO: 998428 - RNA, 17 nt, Mycobacterium avium subsp. paratuberculosis
gccguugacaccgggug

SEQ ID NO: 998429 - RNA, 22 nt, Mycobacterium avium subsp. paratuberculosis
gccguugaucagggcggcgcgc

SEQ ID NO: 998430 - RNA, 20 nt, Mycobacterium avium subsp. paratuberculosis
gccguugaucgagcaccggg

SEQ ID NO: 998431 - RNA, 14 nt, Mycobacterium avium subsp. paratuberculosis
gccguggcggcggu

SEQ ID NO: 998432 - RNA, 16 nt, Mycobacterium avium subsp. paratuberculosis
gccgugguccagccgg

SEQ ID NO: 998433 - RNA, 17 nt, Mycobacterium avium subsp. paratuberculosis
gccgugguccagccggu

SEQ ID NO: 998434 - RNA, 23 nt, Mycobacterium avium subsp. paratuberculosis
gccucaggcgucggucagcaggc

SEQ ID NO: 998435 - RNA, 13 nt, Mycobacterium avium subsp. paratuberculosis
gccuccagccagc

SEQ ID NO: 998436 - RNA, 16 nt, Mycobacterium avium subsp. paratuberculosis
gccuccagccagcgcg

SEQ ID NO: 998437 - RNA, 23 nt, Mycobacterium avium subsp. paratuberculosis
gccuccagccgcuccgcggcggg

SEQ ID NO: 998438 - RNA, 19 nt, Mycobacterium avium subsp. paratuberculosis
gccuccagccgcuccucgu

SEQ ID NO: 998439 - RNA, 13 nt, Mycobacterium avium subsp. paratuberculosis
gccuccagccggc

SEQ ID NO: 998440 - RNA, 15 nt, Mycobacterium avium subsp. paratuberculosis
gccuccaccaccaug

SEQ ID NO: 998441 - RNA, 15 nt, Mycobacterium avium subsp. paratuberculosis
gccuccaccagcggc

SEQ ID NO: 998442 - RNA, 16 nt, Mycobacterium avium subsp. paratuberculosis
gccuccaccagcggcg

SEQ ID NO: 998443 - RNA, 12 nt, Mycobacterium avium subsp. paratuberculosis
gccuccaccggc

SEQ ID NO: 998444 - RNA, 22 nt, Mycobacterium avium subsp. paratuberculosis
gccuccgaauccagcgcgccgc

SEQ ID NO: 998445 - RNA, 15 nt, Mycobacterium avium subsp. paratuberculosis
gccuccgacagccgc

SEQ ID NO: 998446 - RNA, 17 nt, Mycobacterium avium subsp. paratuberculosis
gccuccgaccagccggu

SEQ ID NO: 998447 - RNA, 21 nt, Mycobacterium avium subsp. paratuberculosis
gccuccgagauggacagcacc

SEQ ID NO: 998448 - RNA, 18 nt, Mycobacterium avium subsp. paratuberculosis
gccuccgagcggcgcagg

SEQ ID NO: 998449 - RNA, 17 nt, Mycobacterium avium subsp. paratuberculosis
gccuccgccaccuccuc

SEQ ID NO: 998450 - RNA, 19 nt, Mycobacterium avium subsp. paratuberculosis
gccuccgccaccuccuccg

SEQ ID NO: 998451 - RNA, 17 nt, Mycobacterium avium subsp. paratuberculosis
gccuccgcccgggugca

SEQ ID NO: 998452 - RNA, 21 nt, Mycobacterium avium subsp. paratuberculosis
gccuccgcccgggugcaggcc

SEQ ID NO: 998453 - RNA, 22 nt, Mycobacterium avium subsp. paratuberculosis
gccuccgcccgggugcaggccc

SEQ ID NO: 998454 - RNA, 13 nt, Mycobacterium avium subsp. paratuberculosis
gccuccgccgccc

SEQ ID NO: 998455 - RNA, 14 nt, Mycobacterium avium subsp. paratuberculosis
gccuccgccgcccc

SEQ ID NO: 998456 - RNA, 19 nt, Mycobacterium avium subsp. paratuberculosis
gccuccagguucgccgccc

SEQ ID NO: 998457 - RNA, 15 nt, Mycobacterium avium subsp. paratuberculosis
gccuccagcuguuga

SEQ ID NO: 998458 - RNA, 19 nt, Mycobacterium avium subsp. paratuberculosis
gccuccauucgggccagcg

SEQ ID NO: 998459 - RNA, 18 nt, Mycobacterium avium subsp. paratuberculosis
gccuccugcuggcgcugc

SEQ ID NO: 998460 - RNA, 15 nt, Mycobacterium avium subsp. paratuberculosis
gccuccuguuggccc

SEQ ID NO: 998461 - RNA, 16 nt, Mycobacterium avium subsp. paratuberculosis
gccucgaagucgccgg

SEQ ID NO: 998462 - RNA, 18 nt, Mycobacterium avium subsp. paratuberculosis
gccucgaagucgccggcc

SEQ ID NO: 998463 - RNA, 14 nt, Mycobacterium avium subsp. paratuberculosis
gccucgaccagcac

SEQ ID NO: 998464 - RNA, 15 nt, Mycobacterium avium subsp. paratuberculosis
gccucgaccagcacc

SEQ ID NO: 998465 - RNA, 15 nt, Mycobacterium avium subsp. paratuberculosis
gccucgaccaggcuu

SEQ ID NO: 998466 - RNA, 18 nt, Mycobacterium avium subsp. paratuberculosis
gccucgaccaggcuuggc

SEQ ID NO: 998467 - RNA, 19 nt, Mycobacterium avium subsp. paratuberculosis
gccuccgucagcgccgccc

SEQ ID NO: 998468 - RNA, 13 nt, Mycobacterium avium subsp. paratuberculosis
gccuccgugcugg

SEQ ID NO: 998469 - RNA, 20 nt, Mycobacterium avium subsp. paratuberculosis
gccuccgggaaggcggccgc

SEQ ID NO: 998470 - RNA, 17 nt, Mycobacterium avium subsp. paratuberculosis
gccuccgguuugcgccg

SEQ ID NO: 998471 - RNA, 16 nt, Mycobacterium avium subsp. paratuberculosis
gccuccuccucgcugc

SEQ ID NO: 998472 - RNA, 22 nt, Mycobacterium avium subsp. paratuberculosis
gccuccggcaguacgcgccggc

SEQ ID NO: 998473 - RNA, 13 nt, Mycobacterium avium subsp. paratuberculosis
gccuccggcggca

SEQ ID NO: 998474 - RNA, 18 nt, Mycobacterium avium subsp. paratuberculosis
gccucgaucagagcgggc

SEQ ID NO: 998475 - RNA, 15 nt, Mycobacterium avium subsp. paratuberculosis
gccucgagcgcccgg

SEQ ID NO: 998476 - RNA, 21 nt, Mycobacterium avium subsp. paratuberculosis
gccucgagcaacggccgcagc

SEQ ID NO: 998477 - RNA, 22 nt, Mycobacterium avium subsp. paratuberculosis
gccucgagcaacggccgcagcg

SEQ ID NO: 998478 - RNA, 19 nt, Mycobacterium avium subsp. paratuberculosis
gccucgaggaucgcggcca

SEQ ID NO: 998479 - RNA, 17 nt, Mycobacterium avium subsp. paratuberculosis
gccucgacggugaccuc

SEQ ID NO: 998480 - RNA, 23 nt, Mycobacterium avium subsp. paratuberculosis
gccucgacggugaccucgucggg

SEQ ID NO: 998481 - RNA, 19 nt, Mycobacterium avium subsp. paratuberculosis
gccucgccacugggcgucg

SEQ ID NO: 998482 - RNA, 19 nt, Mycobacterium avium subsp. paratuberculosis
gccucgccagccguccugg

SEQ ID NO: 998483 - RNA, 22 nt, Mycobacterium avium subsp. paratuberculosis
gccucgaucugguucaccgcca

SEQ ID NO: 998484 - RNA, 22 nt, Mycobacterium avium subsp. paratuberculosis
gccucgcgcaaugccgccgcga

SEQ ID NO: 998485 - RNA, 15 nt, Mycobacterium avium subsp. paratuberculosis
gccucgccgggcccg

SEQ ID NO: 998486 - RNA, 18 nt, Mycobacterium avium subsp. paratuberculosis
gccucgccguugccggcc

SEQ ID NO: 998487 - RNA, 22 nt, Mycobacterium avium subsp. paratuberculosis
gccucgccuacacagcccccac

SEQ ID NO: 998488 - RNA, 17 nt, Mycobacterium avium subsp. paratuberculosis
gccucggaggccaccgc

SEQ ID NO: 998489 - RNA, 21 nt, Mycobacterium avium subsp. paratuberculosis
gccucggaucccggggcgcgc

SEQ ID NO: 998490 - RNA, 20 nt, Mycobacterium avium subsp. paratuberculosis
gccucggcaccgugccgcgc

SEQ ID NO: 998491 - RNA, 22 nt, Mycobacterium avium subsp. paratuberculosis
gccucggcaccgugccgcgcgg

SEQ ID NO: 998492 - RNA, 19 nt, Mycobacterium avium subsp. paratuberculosis
gccucgcuaaucgccgcgc

SEQ ID NO: 998493 - RNA, 18 nt, Mycobacterium avium subsp. paratuberculosis
gccucgucgaccgcggcc

SEQ ID NO: 998494 - RNA, 19 nt, Mycobacterium avium subsp. paratuberculosis
gccucgucgaccgcggccu

SEQ ID NO: 998495 - RNA, 22 nt, Mycobacterium avium subsp. paratuberculosis
gccucgucgaccgcggccuggg

SEQ ID NO: 998496 - RNA, 18 nt, Mycobacterium avium subsp. paratuberculosis
gccucgucgacgucgggg

SEQ ID NO: 998497 - RNA, 16 nt, Mycobacterium avium subsp. paratuberculosis
gccucgucgagccggg

SEQ ID NO: 998498 - RNA, 19 nt, Mycobacterium avium subsp. paratuberculosis
gccucggucacggucuggc

SEQ ID NO: 998499 - RNA, 14 nt, Mycobacterium avium subsp. paratuberculosis
gccucgguggcggu

SEQ ID NO: 998500 - RNA, 18 nt, Mycobacterium avium subsp. paratuberculosis
gccucgguggcgguggcc

SEQ ID NO: 998501 - RNA, 23 nt, Mycobacterium avium subsp. paratuberculosis
gccucgguggucgacgagcccgc

SEQ ID NO: 998502 - RNA, 16 nt, Mycobacterium avium subsp. paratuberculosis
gccucgguucugcagc

SEQ ID NO: 998503 - RNA, 18 nt, Mycobacterium avium subsp. paratuberculosis
gccucggugcucaucagc

SEQ ID NO: 998504 - RNA, 12 nt, Mycobacterium avium subsp. paratuberculosis
gccucguccagg

SEQ ID NO: 998505 - RNA, 15 nt, Mycobacterium avium subsp. paratuberculosis
gccucguuggccagc

SEQ ID NO: 998506 - RNA, 16 nt, Mycobacterium avium subsp. paratuberculosis
gccucguuggccagcu

SEQ ID NO: 998507 - RNA, 19 nt, Mycobacterium avium subsp. paratuberculosis
gccucgugcaugugcucgg

SEQ ID NO: 998508 - RNA, 18 nt, Mycobacterium avium subsp. paratuberculosis
gccucgugcaaggccugc

SEQ ID NO: 998509 - RNA, 20 nt, Mycobacterium avium subsp. paratuberculosis
gccucgugcaaggccugcgc

SEQ ID NO: 998510 - RNA, 20 nt, Mycobacterium avium subsp. paratuberculosis
gccucggggaucgccaggcg

SEQ ID NO: 998511 - RNA, 15 nt, Mycobacterium avium subsp. paratuberculosis
gccucgggccggcag

SEQ ID NO: 998512 - RNA, 17 nt, Mycobacterium avium subsp. paratuberculosis
gccucgggccggcagcc

SEQ ID NO: 998513 - RNA, 13 nt, Mycobacterium avium subsp. paratuberculosis
gccucggcguggc

SEQ ID NO: 998514 - RNA, 19 nt, Mycobacterium avium subsp. paratuberculosis
gccucggcguggcaggcga

SEQ ID NO: 998515 - RNA, 14 nt, Mycobacterium avium subsp. paratuberculosis
gccucggcggccgc

SEQ ID NO: 998516 - RNA, 22 nt, Mycobacterium avium subsp. paratuberculosis
gccucggcggccgcccgggcgg

SEQ ID NO: 998517 - RNA, 15 nt, Mycobacterium avium subsp. paratuberculosis
gccucggccagcacc

SEQ ID NO: 998518 - RNA, 22 nt, Mycobacterium avium subsp. paratuberculosis
gccucggcgaugccgaggauuu

SEQ ID NO: 998519 - RNA, 18 nt, Mycobacterium avium subsp. paratuberculosis
gccucggcgaccgcccgg

SEQ ID NO: 998520 - RNA, 15 nt, Mycobacterium avium subsp. paratuberculosis
gccucggcgagccgc

SEQ ID NO: 998521 - RNA, 16 nt, Mycobacterium avium subsp. paratuberculosis
gccucggcgagccgcu

SEQ ID NO: 998522 - RNA, 14 nt, Mycobacterium avium subsp. paratuberculosis
gccucggccugcgc

SEQ ID NO: 998523 - RNA, 15 nt, Mycobacterium avium subsp. paratuberculosis
gccucggcgcgggcg

SEQ ID NO: 998524 - RNA, 15 nt, Mycobacterium avium subsp. paratuberculosis
gccucggcgcugccc

SEQ ID NO: 998525 - RNA, 17 nt, Mycobacterium avium subsp. paratuberculosis
gccucggcgcugcccgc

SEQ ID NO: 998526 - RNA, 22 nt, Mycobacterium avium subsp. paratuberculosis
gccucggcgcugcccgccgcgg

SEQ ID NO: 998527 - RNA, 21 nt, Mycobacterium avium subsp. paratuberculosis
gccgcuuguucgggcccacac

SEQ ID NO: 998528 - RNA, 14 nt, Mycobacterium avium subsp. paratuberculosis
gccgcuggugguga

SEQ ID NO: 998529 - RNA, 22 nt, Mycobacterium avium subsp. paratuberculosis
gccgcugguggugaucacccag

SEQ ID NO: 998530 - RNA, 19 nt, Mycobacterium avium subsp. paratuberculosis
gccgcuggugaacucgccg

SEQ ID NO: 998531 - RNA, 17 nt, Mycobacterium avium subsp. paratuberculosis
gccgcuggucaggccga

SEQ ID NO: 998532 - RNA, 17 nt, Mycobacterium avium subsp. paratuberculosis
gccgcugggcguggugc

SEQ ID NO: 998533 - RNA, 19 nt, Mycobacterium avium subsp. paratuberculosis
gccggaaaaguucggcggg

SEQ ID NO: 998534 - RNA, 22 nt, Mycobacterium avium subsp. paratuberculosis
gccggaccguucgguccggaac

SEQ ID NO: 998535 - RNA, 20 nt, Mycobacterium avium subsp. paratuberculosis
gccggaccgcgcgggccagc

SEQ ID NO: 998536 - RNA, 22 nt, Mycobacterium avium subsp. paratuberculosis
gccggaccgcuugacgccgccg

SEQ ID NO: 998537 - RNA, 20 nt, Mycobacterium avium subsp. paratuberculosis
gccggacaccgaaccgcccc

SEQ ID NO: 998538 - RNA, 16 nt, Mycobacterium avium subsp. paratuberculosis
gccggacacggcugca

SEQ ID NO: 998539 - RNA, 15 nt, Mycobacterium avium subsp. paratuberculosis
gccggacagcuggcg

SEQ ID NO: 998540 - RNA, 13 nt, Mycobacterium avium subsp. paratuberculosis
gccggaacagcug

SEQ ID NO: 998541 - RNA, 14 nt, Mycobacterium avium subsp. paratuberculosis
gccggaacaccucg

SEQ ID NO: 998542 - RNA, 12 nt, Mycobacterium avium subsp. paratuberculosis
gccggacagcug

SEQ ID NO: 998543 - RNA, 20 nt, Mycobacterium avium subsp. paratuberculosis
gccggacccccucggggcuc

SEQ ID NO: 998544 - RNA, 14 nt, Mycobacterium avium subsp. paratuberculosis
gccggacagcgggc

SEQ ID NO: 998545 - RNA, 20 nt, Mycobacterium avium subsp. paratuberculosis
gccggaucgaauccggcggc

SEQ ID NO: 998546 - RNA, 19 nt, Mycobacterium avium subsp. paratuberculosis
gccggaucgccgagguagc

SEQ ID NO: 998547 - RNA, 13 nt, Mycobacterium avium subsp. paratuberculosis
gccggaucgggac

SEQ ID NO: 998548 - RNA, 23 nt, Mycobacterium avium subsp. paratuberculosis
gccggaucggucucgguggagaa

SEQ ID NO: 998549 - RNA, 23 nt, Mycobacterium avium subsp. paratuberculosis
gccggaucucgucgggcaccgcc

SEQ ID NO: 998550 - RNA, 22 nt, Mycobacterium avium subsp. paratuberculosis
gccggcaccagcagccgcagcg

SEQ ID NO: 998551 - RNA, 20 nt, Mycobacterium avium subsp. paratuberculosis
gccggcaggucgaggccggc

SEQ ID NO: 998552 - RNA, 13 nt, Mycobacterium avium subsp. paratuberculosis
gccggcagcugcc

SEQ ID NO: 998553 - RNA, 19 nt, Mycobacterium avium subsp. paratuberculosis
gccggcaguugcggccgcu

SEQ ID NO: 998554 - RNA, 22 nt, Mycobacterium avium subsp. paratuberculosis
gccggcauccagcacggccgcc

SEQ ID NO: 998555 - RNA, 17 nt, Mycobacterium avium subsp. paratuberculosis
gccggcacaccgagcga

SEQ ID NO: 998556 - RNA, 12 nt, Mycobacterium avium subsp. paratuberculosis
gccggcaccagc

SEQ ID NO: 998557 - RNA, 14 nt, Mycobacterium avium subsp. paratuberculosis
gccggcacccgggc

SEQ ID NO: 998558 - RNA, 16 nt, Mycobacterium avium subsp. paratuberculosis
gccggcaacgacccgu

SEQ ID NO: 998559 - RNA, 17 nt, Mycobacterium avium subsp. paratuberculosis
gccgcgcaggccgccga

SEQ ID NO: 998560 - RNA, 17 nt, Mycobacterium avium subsp. paratuberculosis
gccgcgcagaucgaugg

SEQ ID NO: 998561 - RNA, 21 nt, Mycobacterium avium subsp. paratuberculosis
gccgcgcagaucgccagcacc

SEQ ID NO: 998562 - RNA, 15 nt, Mycobacterium avium subsp. paratuberculosis
gccgcgccacgcgca

SEQ ID NO: 998563 - RNA, 14 nt, Mycobacterium avium subsp. paratuberculosis
gccgcggcgguggc

SEQ ID NO: 998564 - RNA, 11 nt, Mycobacterium avium subsp. paratuberculosis
gccgcggcggu

SEQ ID NO: 998565 - RNA, 19 nt, Mycobacterium avium subsp. paratuberculosis
gccgcgcccaucgcggccg

SEQ ID NO: 998566 - RNA, 20 nt, Mycobacterium avium subsp. paratuberculosis
gccgcgcccaucgcggccgc

SEQ ID NO: 998567 - RNA, 21 nt, Mycobacterium avium subsp. paratuberculosis
gccgcggcuccagcagcggcu

SEQ ID NO: 998568 - RNA, 17 nt, Mycobacterium avium subsp. paratuberculosis
gccgcggugcggcccgc

SEQ ID NO: 998569 - RNA, 16 nt, Mycobacterium avium subsp. paratuberculosis
gccgcgguggcgccgc

SEQ ID NO: 998570 - RNA, 13 nt, Mycobacterium avium subsp. paratuberculosis
gccgcgguggugg

SEQ ID NO: 998571 - RNA, 14 nt, Mycobacterium avium subsp. paratuberculosis
gccgcggugguggg

SEQ ID NO: 998572 - RNA, 19 nt, Mycobacterium avium subsp. paratuberculosis
gccgcgguggugggcgcgg

SEQ ID NO: 998573 - RNA, 16 nt, Mycobacterium avium subsp. paratuberculosis
gccgcgguugaacagg

SEQ ID NO: 998574 - RNA, 18 nt, Mycobacterium avium subsp. paratuberculosis
gccgcgguugaacaggcu

SEQ ID NO: 998575 - RNA, 17 nt, Mycobacterium avium subsp. paratuberculosis
gccgcggucgccccggc

SEQ ID NO: 998576 - RNA, 16 nt, Mycobacterium avium subsp. paratuberculosis
gccgcggucaucgagc

SEQ ID NO: 998577 - RNA, 18 nt, Mycobacterium avium subsp. paratuberculosis
gccgcggugaccgcgccg

SEQ ID NO: 998578 - RNA, 19 nt, Mycobacterium avium subsp. paratuberculosis
gccgcggugaccgcgccgc

SEQ ID NO: 998579 - RNA, 21 nt, Mycobacterium avium subsp. paratuberculosis
gccgcggugaccgcgccgcgg

SEQ ID NO: 998580 - RNA, 19 nt, Mycobacterium avium subsp. paratuberculosis
gccgcgguagacaccgccg

SEQ ID NO: 998581 - RNA, 17 nt, Mycobacterium avium subsp. paratuberculosis
gccgcgggucggcgacg

SEQ ID NO: 998582 - RNA, 19 nt, Mycobacterium avium subsp. paratuberculosis
gccgcgggugacgaucugg

SEQ ID NO: 998583 - RNA, 15 nt, Mycobacterium avium subsp. paratuberculosis
gccgcgggugcggca

SEQ ID NO: 998584 - RNA, 16 nt, Mycobacterium avium subsp. paratuberculosis
gccgcgggugcggccc

SEQ ID NO: 998585 - RNA, 16 nt, Mycobacterium avium subsp. paratuberculosis
gccgcggguggccagc

SEQ ID NO: 998586 - RNA, 14 nt, Mycobacterium avium subsp. paratuberculosis
gccgcgggcucccg

SEQ ID NO: 998587 - RNA, 15 nt, Mycobacterium avium subsp. paratuberculosis
gccgcggggccggcg

SEQ ID NO: 998588 - RNA, 16 nt, Mycobacterium avium subsp. paratuberculosis
gccgcggggccggcgc

SEQ ID NO: 998589 - RNA, 22 nt, Mycobacterium avium subsp. paratuberculosis
gccgcgggcggucgcgcagccg

SEQ ID NO: 998590 - RNA, 19 nt, Mycobacterium avium subsp. paratuberculosis
gccgcguucggcggcgcgc

SEQ ID NO: 998591 - RNA, 17 nt, Mycobacterium avium subsp. paratuberculosis
gccgcguugucgaccac

SEQ ID NO: 998592 - RNA, 14 nt, Mycobacterium avium subsp. paratuberculosis
gccgcguuccccgg

SEQ ID NO: 998593 - RNA, 15 nt, Mycobacterium avium subsp. paratuberculosis
gccgcguuccccggc

SEQ ID NO: 998594 - RNA, 16 nt, Mycobacterium avium subsp. paratuberculosis
gccgcguacgccgccu

SEQ ID NO: 998595 - RNA, 20 nt, Mycobacterium avium subsp. paratuberculosis
gccgcguucacccgcgcccg

SEQ ID NO: 998596 - RNA, 16 nt, Mycobacterium avium subsp. paratuberculosis
gccgcguacagcagcu

SEQ ID NO: 998597 - RNA, 17 nt, Mycobacterium avium subsp. paratuberculosis
gccgcguacagcagcug

SEQ ID NO: 998598 - RNA, 13 nt, Mycobacterium avium subsp. paratuberculosis
gccgcguacagcc

SEQ ID NO: 998599 - RNA, 16 nt, Mycobacterium avium subsp. paratuberculosis
gccgcguacagccagc

SEQ ID NO: 998600 - RNA, 17 nt, Mycobacterium avium subsp. paratuberculosis
gccgcguacagccagcc

SEQ ID NO: 998601 - RNA, 19 nt, Mycobacterium avium subsp. paratuberculosis
gccgcuagguuuggccagc

SEQ ID NO: 998602 - RNA, 22 nt, Mycobacterium avium subsp. paratuberculosis
gccgcuagguuuggccagcacc

SEQ ID NO: 998603 - RNA, 22 nt, Mycobacterium avium subsp. paratuberculosis
gccgcuacgccgaggcgcagga

SEQ ID NO: 998604 - RNA, 15 nt, Mycobacterium avium subsp. paratuberculosis
gccgcucgcccagcg

SEQ ID NO: 998605 - RNA, 11 nt, Mycobacterium avium subsp. paratuberculosis
gccgcucgccg

SEQ ID NO: 998606 - RNA, 13 nt, Mycobacterium avium subsp. paratuberculosis
gccgcucgcgcac

SEQ ID NO: 998607 - RNA, 23 nt, Mycobacterium avium subsp. paratuberculosis
gccgcucggaguucgcccgcagc

SEQ ID NO: 998608 - RNA, 15 nt, Mycobacterium avium subsp. paratuberculosis
gccgcucggccagca

SEQ ID NO: 998609 - RNA, 19 nt, Mycobacterium avium subsp. paratuberculosis
gccgcucggccagcgcagc

SEQ ID NO: 998610 - RNA, 14 nt, Mycobacterium avium subsp. paratuberculosis
gccgcuggccgccc

SEQ ID NO: 998611 - RNA, 23 nt, Mycobacterium avium subsp. paratuberculosis
gccgcugcgugcccggaucgccg

SEQ ID NO: 998612 - RNA, 17 nt, Mycobacterium avium subsp. paratuberculosis
gccgcugcugggugccg

SEQ ID NO: 998613 - RNA, 15 nt, Mycobacterium avium subsp. paratuberculosis
gccgcugacgcggcg

SEQ ID NO: 998614 - RNA, 20 nt, Mycobacterium avium subsp. paratuberculosis
gccgcugacugcgaucgccg

SEQ ID NO: 998615 - RNA, 21 nt, Mycobacterium avium subsp. paratuberculosis
gccgcugagcuucugcccggc

SEQ ID NO: 998616 - RNA, 17 nt, Mycobacterium avium subsp. paratuberculosis
gccgcucgucggccagc

SEQ ID NO: 998617 - RNA, 21 nt, Mycobacterium avium subsp. paratuberculosis
gccgcucgucggccagcgagu

SEQ ID NO: 998618 - RNA, 22 nt, Mycobacterium avium subsp. paratuberculosis
gccgcucgucgggcacaucccg

SEQ ID NO: 998619 - RNA, 14 nt, Mycobacterium avium subsp. paratuberculosis
gccgcucgcccagc

SEQ ID NO: 998620 - RNA, 22 nt, Mycobacterium avium subsp. paratuberculosis
gccgcucggcgcuccagcgggc

SEQ ID NO: 998621 - RNA, 23 nt, Mycobacterium avium subsp. paratuberculosis
gccgcucgggugucgccgagccg

SEQ ID NO: 998622 - RNA, 16 nt, Mycobacterium avium subsp. paratuberculosis
gccggggacgacggcg

SEQ ID NO: 998623 - RNA, 11 nt, Mycobacterium avium subsp. paratuberculosis
gccggggcacc

SEQ ID NO: 998624 - RNA, 15 nt, Mycobacterium avium subsp. paratuberculosis
gccggggcagcugcu

SEQ ID NO: 998625 - RNA, 12 nt, Mycobacterium avium subsp. paratuberculosis
gccggggccagc

SEQ ID NO: 998626 - RNA, 17 nt, Mycobacterium avium subsp. paratuberculosis
gccggggccccaacccc

SEQ ID NO: 998627 - RNA, 12 nt, Mycobacterium avium subsp. paratuberculosis
gccgggcgcccc

SEQ ID NO: 998628 - RNA, 13 nt, Mycobacterium avium subsp. paratuberculosis
gccgggcgcccga

SEQ ID NO: 998629 - RNA, 21 nt, Mycobacterium avium subsp. paratuberculosis
gccgggcgcccgagccgcaca

SEQ ID NO: 998630 - RNA, 14 nt, Mycobacterium avium subsp. paratuberculosis
gccgggcgccacgc

SEQ ID NO: 998631 - RNA, 18 nt, Mycobacterium avium subsp. paratuberculosis
gccgggcgccacgcuggc

SEQ ID NO: 998632 - RNA, 13 nt, Mycobacterium avium subsp. paratuberculosis
gccggggccggcg

SEQ ID NO: 998633 - RNA, 16 nt, Mycobacterium avium subsp. paratuberculosis
gccggggcgccgccga

SEQ ID NO: 998634 - RNA, 22 nt, Mycobacterium avium subsp. paratuberculosis
gccggggcucauacggcggcuc

SEQ ID NO: 998635 - RNA, 21 nt, Mycobacterium avium subsp. paratuberculosis
gccggggcuucgaacgcccgc

SEQ ID NO: 998636 - RNA, 23 nt, Mycobacterium avium subsp. paratuberculosis
gccggggcuucgaacgcccgcac

SEQ ID NO: 998637 - RNA, 14 nt, Mycobacterium avium subsp. paratuberculosis
gccggggcggcggu

SEQ ID NO: 998638 - RNA, 20 nt, Mycobacterium avium subsp. paratuberculosis
gccggggcggauccccgcgc

SEQ ID NO: 998639 - RNA, 16 nt, Mycobacterium avium subsp. paratuberculosis
gccgggcaggccggga

SEQ ID NO: 998640 - RNA, 14 nt, Mycobacterium avium subsp. paratuberculosis
gccgggcagcccgc

SEQ ID NO: 998641 - RNA, 19 nt, Mycobacterium avium subsp. paratuberculosis
gccgggcagcccgccgcgg

SEQ ID NO: 998642 - RNA, 14 nt, Mycobacterium avium subsp. paratuberculosis
gccgggcagcgcga

SEQ ID NO: 998643 - RNA, 18 nt, Mycobacterium avium subsp. paratuberculosis
gccgggcagcggccccac

SEQ ID NO: 998644 - RNA, 14 nt, Mycobacterium avium subsp. paratuberculosis
gccgggcaccagcg

SEQ ID NO: 998645 - RNA, 22 nt, Mycobacterium avium subsp. paratuberculosis
gccgggcaccagcgacagcacc

SEQ ID NO: 998646 - RNA, 19 nt, Mycobacterium avium subsp. paratuberculosis
gccgggcacccggguggac

SEQ ID NO: 998647 - RNA, 19 nt, Mycobacterium avium subsp. paratuberculosis
gccgggcaccucggcgucg

SEQ ID NO: 998648 - RNA, 20 nt, Mycobacterium avium subsp. paratuberculosis
gccgggcacgucgacgcccu

SEQ ID NO: 998649 - RNA, 22 nt, Mycobacterium avium subsp. paratuberculosis
gccgggcacgucgacgcccugc

SEQ ID NO: 998650 - RNA, 23 nt, Mycobacterium avium subsp. paratuberculosis
gccgggccaauuacgcugcggcg

SEQ ID NO: 998651 - RNA, 19 nt, Mycobacterium avium subsp. paratuberculosis
gccgggccagcaacagcag

SEQ ID NO: 998652 - RNA, 20 nt, Mycobacterium avium subsp. paratuberculosis
gccgggccagcaacagcagc

SEQ ID NO: 998653 - RNA, 15 nt, Mycobacterium avium subsp. paratuberculosis
gccgggccagcagcu

SEQ ID NO: 998654 - RNA, 18 nt, Mycobacterium avium subsp. paratuberculosis
gccgggccagcccgggaa

SEQ ID NO: 998655 - RNA, 20 nt, Mycobacterium avium subsp. paratuberculosis
gccgggcauccgggccgccg

SEQ ID NO: 998656 - RNA, 19 nt, Mycobacterium avium subsp. paratuberculosis
gccgggccugcggcgcggc

SEQ ID NO: 998657 - RNA, 17 nt, Mycobacterium avium subsp. paratuberculosis
gccgggccgccgaugcg

SEQ ID NO: 998658 - RNA, 22 nt, Mycobacterium avium subsp. paratuberculosis
gccgggccgccgaugcgcccgc

SEQ ID NO: 998659 - RNA, 12 nt, Mycobacterium avium subsp. paratuberculosis
gccgggccgcgg

SEQ ID NO: 998660 - RNA, 14 nt, Mycobacterium avium subsp. paratuberculosis
gccgggccggaacg

SEQ ID NO: 998661 - RNA, 13 nt, Mycobacterium avium subsp. paratuberculosis
gccgggccggaga

SEQ ID NO: 998662 - RNA, 13 nt, Mycobacterium avium subsp. paratuberculosis
gccgggccgagcg

SEQ ID NO: 998663 - RNA, 16 nt, Mycobacterium avium subsp. paratuberculosis
gccgggccgagcgcgc

SEQ ID NO: 998664 - RNA, 16 nt, Mycobacterium avium subsp. paratuberculosis
gccgggccagguccca

SEQ ID NO: 998665 - RNA, 20 nt, Mycobacterium avium subsp. paratuberculosis
gccgggccaggugugcccgc

SEQ ID NO: 998666 - RNA, 22 nt, Mycobacterium avium subsp. paratuberculosis
gccgggccgcauccagcgccgc

SEQ ID NO: 998667 - RNA, 14 nt, Mycobacterium avium subsp. paratuberculosis
gccgggccgcccgc

SEQ ID NO: 998668 - RNA, 16 nt, Mycobacterium avium subsp. paratuberculosis
gccgggccgcccgcgc

SEQ ID NO: 998669 - RNA, 21 nt, Mycobacterium avium subsp. paratuberculosis
gccgggcaacagcgcgccggc

SEQ ID NO: 998670 - RNA, 22 nt, Mycobacterium avium subsp. paratuberculosis
gccggcuucucggcgugcccgc

SEQ ID NO: 998671 - RNA, 15 nt, Mycobacterium avium subsp. paratuberculosis
gccggcuuccucgcg

SEQ ID NO: 998672 - RNA, 16 nt, Mycobacterium avium subsp. paratuberculosis
gccggcugcccgcgac

SEQ ID NO: 998673 - RNA, 21 nt, Mycobacterium avium subsp. paratuberculosis
gccggcugacugccggcgacg

SEQ ID NO: 998674 - RNA, 16 nt, Mycobacterium avium subsp. paratuberculosis
gccggcugcagccggg

SEQ ID NO: 998675 - RNA, 21 nt, Mycobacterium avium subsp. paratuberculosis
gccggcugcagccgggcggcg

SEQ ID NO: 998676 - RNA, 20 nt, Mycobacterium avium subsp. paratuberculosis
gccggcuccauguccggagc

SEQ ID NO: 998677 - RNA, 20 nt, Mycobacterium avium subsp. paratuberculosis
gccggcucgaaaugccuugg

SEQ ID NO: 998678 - RNA, 15 nt, Mycobacterium avium subsp. paratuberculosis
gccggcucggcggcu

SEQ ID NO: 998679 - RNA, 19 nt, Mycobacterium avium subsp. paratuberculosis
gccggcucggucuccucca

SEQ ID NO: 998680 - RNA, 22 nt, Mycobacterium avium subsp. paratuberculosis
gccggcucggucuccuccagga

SEQ ID NO: 998681 - RNA, 20 nt, Mycobacterium avium subsp. paratuberculosis
gccggcugaaccugcugggc

SEQ ID NO: 998682 - RNA, 23 nt, Mycobacterium avium subsp. paratuberculosis
gccggcucagggugcgcuggccg

SEQ ID NO: 998683 - RNA, 23 nt, Mycobacterium avium subsp. paratuberculosis
gccggcggccacgaucgcggcca

SEQ ID NO: 998684 - RNA, 17 nt, Mycobacterium avium subsp. paratuberculosis
gccggcggccgccacgc

SEQ ID NO: 998685 - RNA, 23 nt, Mycobacterium avium subsp. paratuberculosis
gccggcggccauggucgcggccg

SEQ ID NO: 998686 - RNA, 22 nt, Mycobacterium avium subsp. paratuberculosis
gccggcggacgcggccagcgcc

SEQ ID NO: 998687 - RNA, 15 nt, Mycobacterium avium subsp. paratuberculosis
gccggcggcagguga

SEQ ID NO: 998688 - RNA, 13 nt, Mycobacterium avium subsp. paratuberculosis
gccggcgcgugcg

SEQ ID NO: 998689 - RNA, 17 nt, Mycobacterium avium subsp. paratuberculosis
gccggcgcggugcucgg

SEQ ID NO: 998690 - RNA, 16 nt, Mycobacterium avium subsp. paratuberculosis
gccggcgcguccggag

SEQ ID NO: 998691 - RNA, 17 nt, Mycobacterium avium subsp. paratuberculosis
gccggcgcguccggagg

SEQ ID NO: 998692 - RNA, 18 nt, Mycobacterium avium subsp. paratuberculosis
gccggcgcgggccgcagc

SEQ ID NO: 998693 - RNA, 19 nt, Mycobacterium avium subsp. paratuberculosis
gccggcgcgggccgcagcg

SEQ ID NO: 998694 - RNA, 22 nt, Mycobacterium avium subsp. paratuberculosis
gccggcgcgggccgcagcgcgc

SEQ ID NO: 998695 - RNA, 14 nt, Mycobacterium avium subsp. paratuberculosis
gccggcgcggcggc

SEQ ID NO: 998696 - RNA, 21 nt, Mycobacterium avium subsp. paratuberculosis
gccggcgcccgcaggccgcga

SEQ ID NO: 998697 - RNA, 19 nt, Mycobacterium avium subsp. paratuberculosis
gccggcgcccugcgcgccc

SEQ ID NO: 998698 - RNA, 12 nt, Mycobacterium avium subsp. paratuberculosis
gccggcgccgcc

SEQ ID NO: 998699 - RNA, 19 nt, Mycobacterium avium subsp. paratuberculosis
gccggcgaaacacagcagc

SEQ ID NO: 998700 - RNA, 20 nt, Mycobacterium avium subsp. paratuberculosis
gccggcgaaacacagcagca

SEQ ID NO: 998701 - RNA, 17 nt, Mycobacterium avium subsp. paratuberculosis
gccggccuucucgcgca

SEQ ID NO: 998702 - RNA, 18 nt, Mycobacterium avium subsp. paratuberculosis
gccggccuucucgcgcac

SEQ ID NO: 998703 - RNA, 20 nt, Mycobacterium avium subsp. paratuberculosis
gccggccuuggcccgcgccc

SEQ ID NO: 998704 - RNA, 18 nt, Mycobacterium avium subsp. paratuberculosis
gccggcgaacucgcggcg

SEQ ID NO: 998705 - RNA, 16 nt, Mycobacterium avium subsp. paratuberculosis
gccggcgaagccgcuc

SEQ ID NO: 998706 - RNA, 20 nt, Mycobacterium avium subsp. paratuberculosis
gccggcgaaggacagccgga

SEQ ID NO: 998707 - RNA, 16 nt, Mycobacterium avium subsp. paratuberculosis
gccggccuggcccagc

SEQ ID NO: 998708 - RNA, 19 nt, Mycobacterium avium subsp. paratuberculosis
gccggccuggcccagccgc

SEQ ID NO: 998709 - RNA, 17 nt, Mycobacterium avium subsp. paratuberculosis
gccggccugcccgccgc

SEQ ID NO: 998710 - RNA, 18 nt, Mycobacterium avium subsp. paratuberculosis
gccggccugacugaguca

SEQ ID NO: 998711 - RNA, 13 nt, Mycobacterium avium subsp. paratuberculosis
gccggccuccagc

SEQ ID NO: 998712 - RNA, 15 nt, Mycobacterium avium subsp. paratuberculosis
gccggccucgccggc

SEQ ID NO: 998713 - RNA, 19 nt, Mycobacterium avium subsp. paratuberculosis
gccggccucgucggcgagc

SEQ ID NO: 998714 - RNA, 23 nt, Mycobacterium avium subsp. paratuberculosis
gccggccucucgucgacgauggc

SEQ ID NO: 998715 - RNA, 16 nt, Mycobacterium avium subsp. paratuberculosis
gccggccggggcggcg

SEQ ID NO: 998716 - RNA, 17 nt, Mycobacterium avium subsp. paratuberculosis
gccggccguucgccggc

SEQ ID NO: 998717 - RNA, 21 nt, Mycobacterium avium subsp. paratuberculosis
gccggccguucgccggccagc

SEQ ID NO: 998718 - RNA, 19 nt, Mycobacterium avium subsp. paratuberculosis
gccggccguugcggguguc

SEQ ID NO: 998719 - RNA, 13 nt, Mycobacterium avium subsp. paratuberculosis
gccggccggggcg

SEQ ID NO: 998720 - RNA, 16 nt, Mycobacterium avium subsp. paratuberculosis
gccggcgcagcggccc

SEQ ID NO: 998721 - RNA, 22 nt, Mycobacterium avium subsp. paratuberculosis
gccggcgcagccggccaccgcc

SEQ ID NO: 998722 - RNA, 22 nt, Mycobacterium avium subsp. paratuberculosis
gccggcgaucucgucgcgcagc

SEQ ID NO: 998723 - RNA, 19 nt, Mycobacterium avium subsp. paratuberculosis
gccggcgauggcgcggccg

SEQ ID NO: 998724 - RNA, 20 nt, Mycobacterium avium subsp. paratuberculosis
gccggcgaugguggcgcugc

SEQ ID NO: 998725 - RNA, 14 nt, Mycobacterium avium subsp. paratuberculosis
gccggcgcaccagg

SEQ ID NO: 998726 - RNA, 14 nt, Mycobacterium avium subsp. paratuberculosis
gccggcgcacccgc

SEQ ID NO: 998727 - RNA, 21 nt, Mycobacterium avium subsp. paratuberculosis
gccggcgcccgucacgcuggc

SEQ ID NO: 998728 - RNA, 16 nt, Mycobacterium avium subsp. paratuberculosis
gccggcgcccagcggc

SEQ ID NO: 998729 - RNA, 19 nt, Mycobacterium avium subsp. paratuberculosis
gccggcgcccagcggcgau

SEQ ID NO: 998730 - RNA, 23 nt, Mycobacterium avium subsp. paratuberculosis
gccggcgcaguccaggguggugg

SEQ ID NO: 998731 - RNA, 17 nt, Mycobacterium avium subsp. paratuberculosis
gccggcgaacuccaccc

SEQ ID NO: 998732 - RNA, 16 nt, Mycobacterium avium subsp. paratuberculosis
gccggcgaccagcccc

SEQ ID NO: 998733 - RNA, 15 nt, Mycobacterium avium subsp. paratuberculosis
gccggcgaggugggc

SEQ ID NO: 998734 - RNA, 20 nt, Mycobacterium avium subsp. paratuberculosis
gccggcgauaggcggccagc

SEQ ID NO: 998735 - RNA, 18 nt, Mycobacterium avium subsp. paratuberculosis
gccggcgauccgcgcggc

SEQ ID NO: 998736 - RNA, 16 nt, Mycobacterium avium subsp. paratuberculosis
gccggcgaugcgcgcc

SEQ ID NO: 998737 - RNA, 23 nt, Mycobacterium avium subsp. paratuberculosis
gccggccggagcggauggcgccg

SEQ ID NO: 998738 - RNA, 16 nt, Mycobacterium avium subsp. paratuberculosis
gccggccgccggcggc

SEQ ID NO: 998739 - RNA, 14 nt, Mycobacterium avium subsp. paratuberculosis
gccggccgccugga

SEQ ID NO: 998740 - RNA, 20 nt, Mycobacterium avium subsp. paratuberculosis
gccggccgcgucgccgacca

SEQ ID NO: 998741 - RNA, 14 nt, Mycobacterium avium subsp. paratuberculosis
gccggccgcgggcg

SEQ ID NO: 998742 - RNA, 15 nt, Mycobacterium avium subsp. paratuberculosis
gccggccggcagcug

SEQ ID NO: 998743 - RNA, 11 nt, Mycobacterium avium subsp. paratuberculosis
gccggccggcc

SEQ ID NO: 998744 - RNA, 16 nt, Mycobacterium avium subsp. paratuberculosis
gccggccggccuggug

SEQ ID NO: 998745 - RNA, 15 nt, Mycobacterium avium subsp. paratuberculosis
gccggccggcgaagc

SEQ ID NO: 998746 - RNA, 15 nt, Mycobacterium avium subsp. paratuberculosis
gccggccggcggacg

SEQ ID NO: 998747 - RNA, 23 nt, Mycobacterium avium subsp. paratuberculosis
gccggccggcggacgcggccagc

SEQ ID NO: 998748 - RNA, 18 nt, Mycobacterium avium subsp. paratuberculosis
gccggccggcggucaggc

SEQ ID NO: 998749 - RNA, 19 nt, Mycobacterium avium subsp. paratuberculosis
gccggccggcggucaggcc

SEQ ID NO: 998750 - RNA, 22 nt, Mycobacterium avium subsp. paratuberculosis
gccggccgggacgcgguccagc

SEQ ID NO: 998751 - RNA, 12 nt, Mycobacterium avium subsp. paratuberculosis
gccggccgggcg

SEQ ID NO: 998752 - RNA, 13 nt, Mycobacterium avium subsp. paratuberculosis
gccggccgcccgc

SEQ ID NO: 998753 - RNA, 12 nt, Mycobacterium avium subsp. paratuberculosis
gccggccgccga

SEQ ID NO: 998754 - RNA, 14 nt, Mycobacterium avium subsp. paratuberculosis
gccggccgccgcga

SEQ ID NO: 998755 - RNA, 15 nt, Mycobacterium avium subsp. paratuberculosis
gccggccgccagcgc

SEQ ID NO: 998756 - RNA, 19 nt, Mycobacterium avium subsp. paratuberculosis
gccggccgccagcgcccgc

SEQ ID NO: 998757 - RNA, 23 nt, Mycobacterium avium subsp. paratuberculosis
gccggccgccagcgcccgcgcgu

SEQ ID NO: 998758 - RNA, 12 nt, Mycobacterium avium subsp. paratuberculosis
gccggccgcagc

SEQ ID NO: 998759 - RNA, 12 nt, Mycobacterium avium subsp. paratuberculosis
gccggccgagcg

SEQ ID NO: 998760 - RNA, 22 nt, Mycobacterium avium subsp. paratuberculosis
gccggccgaagcguuccgccgu

SEQ ID NO: 998761 - RNA, 14 nt, Mycobacterium avium subsp. paratuberculosis
gccggcccugcggc

SEQ ID NO: 998762 - RNA, 19 nt, Mycobacterium avium subsp. paratuberculosis
gccggcccgcccggcggcg

SEQ ID NO: 998763 - RNA, 12 nt, Mycobacterium avium subsp. paratuberculosis
gccggcccggcc

SEQ ID NO: 998764 - RNA, 15 nt, Mycobacterium avium subsp. paratuberculosis
gccggcccggcccga

SEQ ID NO: 998765 - RNA, 17 nt, Mycobacterium avium subsp. paratuberculosis
gccggcccgagcccugc

SEQ ID NO: 998766 - RNA, 17 nt, Mycobacterium avium subsp. paratuberculosis
gccggcccgcagccagc

SEQ ID NO: 998767 - RNA, 14 nt, Mycobacterium avium subsp. paratuberculosis
gccggcccgcagcg

SEQ ID NO: 998768 - RNA, 15 nt, Mycobacterium avium subsp. paratuberculosis
gccggcccgcagcgc

SEQ ID NO: 998769 - RNA, 21 nt, Mycobacterium avium subsp. paratuberculosis
gccggccccgggggaccagcg

SEQ ID NO: 998770 - RNA, 22 nt, Mycobacterium avium subsp. paratuberculosis
gccggccccgcccggggcggcg

SEQ ID NO: 998771 - RNA, 12 nt, Mycobacterium avium subsp. paratuberculosis
gccggcccagcu

SEQ ID NO: 998772 - RNA, 23 nt, Mycobacterium avium subsp. paratuberculosis
gccggcccaguggaucggcccga

SEQ ID NO: 998773 - RNA, 20 nt, Mycobacterium avium subsp. paratuberculosis
gccggccaguucccgggcga

SEQ ID NO: 998774 - RNA, 23 nt, Mycobacterium avium subsp. paratuberculosis
gccggccaacagcagcgccgcgg

SEQ ID NO: 998775 - RNA, 19 nt, Mycobacterium avium subsp. paratuberculosis
gccggcaugguucccccca

SEQ ID NO: 998776 - RNA, 18 nt, Mycobacterium avium subsp. paratuberculosis
gccggcauccucggcgcg

SEQ ID NO: 998777 - RNA, 22 nt, Mycobacterium avium subsp. paratuberculosis
gccgcacguguucucacggcga

SEQ ID NO: 998778 - RNA, 23 nt, Mycobacterium avium subsp. paratuberculosis
gccgcacgucccgcccggcgccg

SEQ ID NO: 998779 - RNA, 17 nt, Mycobacterium avium subsp. paratuberculosis
gccgcacggugcagcag

SEQ ID NO: 998780 - RNA, 13 nt, Mycobacterium avium subsp. paratuberculosis
gccgcaccugguu

SEQ ID NO: 998781 - RNA, 18 nt, Mycobacterium avium subsp. paratuberculosis
gccgcacgaaccgcucga

SEQ ID NO: 998782 - RNA, 23 nt, Mycobacterium avium subsp. paratuberculosis
gccgcacgaauugccgguggugc

SEQ ID NO: 998783 - RNA, 18 nt, Mycobacterium avium subsp. paratuberculosis
gccgcacgcgaacaccag

SEQ ID NO: 998784 - RNA, 14 nt, Mycobacterium avium subsp. paratuberculosis
gccgcaccggccgg

SEQ ID NO: 998785 - RNA, 18 nt, Mycobacterium avium subsp. paratuberculosis
gccgcaccggccggcccc

SEQ ID NO: 998786 - RNA, 16 nt, Mycobacterium avium subsp. paratuberculosis
gccgcaccucgccggc

SEQ ID NO: 998787 - RNA, 20 nt, Mycobacterium avium subsp. paratuberculosis
gccgcaccucgccggccgcc

SEQ ID NO: 998788 - RNA, 20 nt, Mycobacterium avium subsp. paratuberculosis
gccgcacccagcgggcgacg

SEQ ID NO: 998789 - RNA, 18 nt, Mycobacterium avium subsp. paratuberculosis
gccgcaccccacccgcgc

SEQ ID NO: 998790 - RNA, 20 nt, Mycobacterium avium subsp. paratuberculosis
gccgcaccccacccgcgcga

SEQ ID NO: 998791 - RNA, 19 nt, Mycobacterium avium subsp. paratuberculosis
gccgauggccaccgggcgu

SEQ ID NO: 998792 - RNA, 21 nt, Mycobacterium avium subsp. paratuberculosis
gccgaugccggccuggcccag

SEQ ID NO: 998793 - RNA, 12 nt, Mycobacterium avium subsp. paratuberculosis
gccgaugcgccc

SEQ ID NO: 998794 - RNA, 16 nt, Mycobacterium avium subsp. paratuberculosis
gccgaugcgcccgcug

SEQ ID NO: 998795 - RNA, 19 nt, Mycobacterium avium subsp. paratuberculosis
gccgaugucggacuucugg

SEQ ID NO: 998796 - RNA, 19 nt, Mycobacterium avium subsp. paratuberculosis
gccgauguaguccagccca

SEQ ID NO: 998797 - RNA, 17 nt, Mycobacterium avium subsp. paratuberculosis
gccgauguccccgcggg

SEQ ID NO: 998798 - RNA, 20 nt, Mycobacterium avium subsp. paratuberculosis
gccgauggucagcugccgca

SEQ ID NO: 998799 - RNA, 14 nt, Mycobacterium avium subsp. paratuberculosis
gccgcaccagcacc

SEQ ID NO: 998800 - RNA, 20 nt, Mycobacterium avium subsp. paratuberculosis
gccgcaccagcaccccgccg

SEQ ID NO: 998801 - RNA, 20 nt, Mycobacterium avium subsp. paratuberculosis
gccgauauaggugagaaaag

SEQ ID NO: 998802 - RNA, 12 nt, Mycobacterium avium subsp. paratuberculosis
gccgaucaacag

SEQ ID NO: 998803 - RNA, 15 nt, Mycobacterium avium subsp. paratuberculosis
gccgaucaacaggcc

SEQ ID NO: 998804 - RNA, 23 nt, Mycobacterium avium subsp. paratuberculosis
gcccugguaggccuggaaccggg

SEQ ID NO: 998805 - RNA, 18 nt, Mycobacterium avium subsp. paratuberculosis
gcccuggucggccagggc

SEQ ID NO: 998806 - RNA, 17 nt, Mycobacterium avium subsp. paratuberculosis
gccgaugaccgcggcgg

SEQ ID NO: 998807 - RNA, 19 nt, Mycobacterium avium subsp. paratuberculosis
gccgaugaacaugcccugc

SEQ ID NO: 998808 - RNA, 18 nt, Mycobacterium avium subsp. paratuberculosis
gccgaucuucucccgggc

SEQ ID NO: 998809 - RNA, 16 nt, Mycobacterium avium subsp. paratuberculosis
gccgaugaugaaaccg

SEQ ID NO: 998810 - RNA, 20 nt, Mycobacterium avium subsp. paratuberculosis
gccgaugacguugcgcgcca

SEQ ID NO: 998811 - RNA, 16 nt, Mycobacterium avium subsp. paratuberculosis
gccgaucuggcgcagc

SEQ ID NO: 998812 - RNA, 18 nt, Mycobacterium avium subsp. paratuberculosis
gccgaucuggcgggcggu

SEQ ID NO: 998813 - RNA, 23 nt, Mycobacterium avium subsp. paratuberculosis
gccgaucugucgcgcucagugca

SEQ ID NO: 998814 - RNA, 14 nt, Mycobacterium avium subsp. paratuberculosis
gccgaucgccgcgg

SEQ ID NO: 998815 - RNA, 15 nt, Mycobacterium avium subsp. paratuberculosis
gccgaucgccgcggc

SEQ ID NO: 998816 - RNA, 13 nt, Mycobacterium avium subsp. paratuberculosis
gccgaucgcgcgc

SEQ ID NO: 998817 - RNA, 12 nt, Mycobacterium avium subsp. paratuberculosis
gccgaucgcggc

SEQ ID NO: 998818 - RNA, 20 nt, Mycobacterium avium subsp. paratuberculosis
gccgaucgcggugcugcaga

SEQ ID NO: 998819 - RNA, 15 nt, Mycobacterium avium subsp. paratuberculosis
gccgaucagcaccag

SEQ ID NO: 998820 - RNA, 18 nt, Mycobacterium avium subsp. paratuberculosis
gccgaucaccugacagac

SEQ ID NO: 998821 - RNA, 13 nt, Mycobacterium avium subsp. paratuberculosis
gccgaucacgaac

SEQ ID NO: 998822 - RNA, 14 nt, Mycobacterium avium subsp. paratuberculosis
gccgaucacgguga

SEQ ID NO: 998823 - RNA, 15 nt, Mycobacterium avium subsp. paratuberculosis
gccgcauccagcgcc

SEQ ID NO: 998824 - RNA, 17 nt, Mycobacterium avium subsp. paratuberculosis
gccgcauccgcgagccg

SEQ ID NO: 998825 - RNA, 15 nt, Mycobacterium avium subsp. paratuberculosis
gccgcagugccggcg

SEQ ID NO: 998826 - RNA, 16 nt, Mycobacterium avium subsp. paratuberculosis
gccgcagugccggcgc

SEQ ID NO: 998827 - RNA, 18 nt, Mycobacterium avium subsp. paratuberculosis
gccgcaggugcagcuccu

SEQ ID NO: 998828 - RNA, 17 nt, Mycobacterium avium subsp. paratuberculosis
gccgcaggugcucgccg

SEQ ID NO: 998829 - RNA, 20 nt, Mycobacterium avium subsp. paratuberculosis
gccgcaggugcucgccggcg

SEQ ID NO: 998830 - RNA, 14 nt, Mycobacterium avium subsp. paratuberculosis
gccgcagguggugg

SEQ ID NO: 998831 - RNA, 16 nt, Mycobacterium avium subsp. paratuberculosis
gccgcagguggugggc

SEQ ID NO: 998832 - RNA, 12 nt, Mycobacterium avium subsp. paratuberculosis
gccgcaggcgaa

SEQ ID NO: 998833 - RNA, 15 nt, Mycobacterium avium subsp. paratuberculosis
gccgcaggcggccag

SEQ ID NO: 998834 - RNA, 19 nt, Mycobacterium avium subsp. paratuberculosis
gccgcaggcggccagcacc

SEQ ID NO: 998835 - RNA, 14 nt, Mycobacterium avium subsp. paratuberculosis
gccgcaggguggcc

SEQ ID NO: 998836 - RNA, 17 nt, Mycobacterium avium subsp. paratuberculosis
gccgcaggguggccagc

SEQ ID NO: 998837 - RNA, 20 nt, Mycobacterium avium subsp. paratuberculosis
gccgcaggguggccagcacc

SEQ ID NO: 998838 - RNA, 18 nt, Mycobacterium avium subsp. paratuberculosis
gccgcagcgugggcaccg

SEQ ID NO: 998839 - RNA, 16 nt, Mycobacterium avium subsp. paratuberculosis
gccgcagcucgaucac

SEQ ID NO: 998840 - RNA, 22 nt, Mycobacterium avium subsp. paratuberculosis
gccgcagcucguugugaaucca

SEQ ID NO: 998841 - RNA, 18 nt, Mycobacterium avium subsp. paratuberculosis
gccgcagcugcugcggcc

SEQ ID NO: 998842 - RNA, 17 nt, Mycobacterium avium subsp. paratuberculosis
gccgcagcgcgcgaccg

SEQ ID NO: 998843 - RNA, 12 nt, Mycobacterium avium subsp. paratuberculosis
gccgcagcggcg

SEQ ID NO: 998844 - RNA, 16 nt, Mycobacterium avium subsp. paratuberculosis
gccgcagcggcgccgc

SEQ ID NO: 998845 - RNA, 17 nt, Mycobacterium avium subsp. paratuberculosis
gccgcagcggcgccggg

SEQ ID NO: 998846 - RNA, 12 nt, Mycobacterium avium subsp. paratuberculosis
gccgcagccggg

SEQ ID NO: 998847 - RNA, 20 nt, Mycobacterium avium subsp. paratuberculosis
gccgcagccgggugggcggc

SEQ ID NO: 998848 - RNA, 16 nt, Mycobacterium avium subsp. paratuberculosis
gccgcagccgcgcggc

SEQ ID NO: 998849 - RNA, 17 nt, Mycobacterium avium subsp. paratuberculosis
gccgcagccgcgcggcc

SEQ ID NO: 998850 - RNA, 12 nt, Mycobacterium avium subsp. paratuberculosis
gccgcagcccgc

SEQ ID NO: 998851 - RNA, 14 nt, Mycobacterium avium subsp. paratuberculosis
gccgcagcccaggc

SEQ ID NO: 998852 - RNA, 20 nt, Mycobacterium avium subsp. paratuberculosis
gccgcagcccaggcccagca

SEQ ID NO: 998853 - RNA, 16 nt, Mycobacterium avium subsp. paratuberculosis
gccgcagcagccgcgc

SEQ ID NO: 998854 - RNA, 13 nt, Mycobacterium avium subsp. paratuberculosis
gccgccagccagc

SEQ ID NO: 998855 - RNA, 14 nt, Mycobacterium avium subsp. paratuberculosis
gccgccagccagcc

SEQ ID NO: 998856 - RNA, 14 nt, Mycobacterium avium subsp. paratuberculosis
gccgccagcaccuc

SEQ ID NO: 998857 - RNA, 15 nt, Mycobacterium avium subsp. paratuberculosis
gccgccagcagcacg

SEQ ID NO: 998858 - RNA, 15 nt, Mycobacterium avium subsp. paratuberculosis
gccgccaccacggca

SEQ ID NO: 998859 - RNA, 13 nt, Mycobacterium avium subsp. paratuberculosis
gccgccaccgcga

SEQ ID NO: 998860 - RNA, 13 nt, Mycobacterium avium subsp. paratuberculosis
gccgccaccccag

SEQ ID NO: 998861 - RNA, 15 nt, Mycobacterium avium subsp. paratuberculosis
gccgccaccccaggc

SEQ ID NO: 998862 - RNA, 17 nt, Mycobacterium avium subsp. paratuberculosis
gccgccacgcuggugug

SEQ ID NO: 998863 - RNA, 22 nt, Mycobacterium avium subsp. paratuberculosis
gccgccacggcgccaugcgccg

SEQ ID NO: 998864 - RNA, 12 nt, Mycobacterium avium subsp. paratuberculosis
gccgccaccggc

SEQ ID NO: 998865 - RNA, 14 nt, Mycobacterium avium subsp. paratuberculosis
gccgccaccggccg

SEQ ID NO: 998866 - RNA, 22 nt, Mycobacterium avium subsp. paratuberculosis
gccgccaccgucgccggcugac

SEQ ID NO: 998867 - RNA, 19 nt, Mycobacterium avium subsp. paratuberculosis
gccgcauuccucggccagc

SEQ ID NO: 998868 - RNA, 22 nt, Mycobacterium avium subsp. paratuberculosis
gccgcauguugugcccgacggc

SEQ ID NO: 998869 - RNA, 19 nt, Mycobacterium avium subsp. paratuberculosis
gccgcauuggugccggccu

SEQ ID NO: 998870 - RNA, 21 nt, Mycobacterium avium subsp. paratuberculosis
gccgccaaccaggucgcggcg

SEQ ID NO: 998871 - RNA, 14 nt, Mycobacterium avium subsp. paratuberculosis
gccgccacagcgcc

SEQ ID NO: 998872 - RNA, 19 nt, Mycobacterium avium subsp. paratuberculosis
gccgcccugcccgucgggc

SEQ ID NO: 998873 - RNA, 14 nt, Mycobacterium avium subsp. paratuberculosis
gccgccgcaccggc

SEQ ID NO: 998874 - RNA, 20 nt, Mycobacterium avium subsp. paratuberculosis
gccgccgcaccggccggccc

SEQ ID NO: 998875 - RNA, 16 nt, Mycobacterium avium subsp. paratuberculosis
gccgccgcagcgcagc

SEQ ID NO: 998876 - RNA, 13 nt, Mycobacterium avium subsp. paratuberculosis
gccgccggcgccc

SEQ ID NO: 998877 - RNA, 14 nt, Mycobacterium avium subsp. paratuberculosis
gccgccgcccuggc

SEQ ID NO: 998878 - RNA, 13 nt, Mycobacterium avium subsp. paratuberculosis
gccgccgccgccc

SEQ ID NO: 998879 - RNA, 15 nt, Mycobacterium avium subsp. paratuberculosis
gccgccgccagcacc

SEQ ID NO: 998880 - RNA, 16 nt, Mycobacterium avium subsp. paratuberculosis
gccgccgccagccagc

SEQ ID NO: 998881 - RNA, 15 nt, Mycobacterium avium subsp. paratuberculosis
gccgccguagccggc

SEQ ID NO: 998882 - RNA, 16 nt, Mycobacterium avium subsp. paratuberculosis
gccgccgggccgccga

SEQ ID NO: 998883 - RNA, 20 nt, Mycobacterium avium subsp. paratuberculosis
gccgccgggauaacccagca

SEQ ID NO: 998884 - RNA, 20 nt, Mycobacterium avium subsp. paratuberculosis
gccgccguccccgcgcggcu

SEQ ID NO: 998885 - RNA, 17 nt, Mycobacterium avium subsp. paratuberculosis
gccgccgucgacgacga

SEQ ID NO: 998886 - RNA, 14 nt, Mycobacterium avium subsp. paratuberculosis
gccgccgucccacc

SEQ ID NO: 998887 - RNA, 18 nt, Mycobacterium avium subsp. paratuberculosis
gccgccgucgcgccagga

SEQ ID NO: 998888 - RNA, 20 nt, Mycobacterium avium subsp. paratuberculosis
gccgccggcgguggcguagc

SEQ ID NO: 998889 - RNA, 19 nt, Mycobacterium avium subsp. paratuberculosis
gccgccggcgcuggcgcgc

SEQ ID NO: 998890 - RNA, 21 nt, Mycobacterium avium subsp. paratuberculosis
gccgccggcgcuggcgcgccg

SEQ ID NO: 998891 - RNA, 14 nt, Mycobacterium avium subsp. paratuberculosis
gccgccggcgcggu

SEQ ID NO: 998892 - RNA, 16 nt, Mycobacterium avium subsp. paratuberculosis
gccgccggcgcccugc

SEQ ID NO: 998893 - RNA, 17 nt, Mycobacterium avium subsp. paratuberculosis
gccgcgaacggcccgcc

SEQ ID NO: 998894 - RNA, 15 nt, Mycobacterium avium subsp. paratuberculosis
gccgccugcccgggc

SEQ ID NO: 998895 - RNA, 19 nt, Mycobacterium avium subsp. paratuberculosis
gccgccugcccgggcgccg

SEQ ID NO: 998896 - RNA, 15 nt, Mycobacterium avium subsp. paratuberculosis
gccgcgacagccggg

SEQ ID NO: 998897 - RNA, 17 nt, Mycobacterium avium subsp. paratuberculosis
gccgcgacagccgggaa

SEQ ID NO: 998898 - RNA, 23 nt, Mycobacterium avium subsp. paratuberculosis
gccgcgcacuggagugcugcaga

SEQ ID NO: 998899 - RNA, 23 nt, Mycobacterium avium subsp. paratuberculosis
gccgcgcaccccgaaccgcccgc

SEQ ID NO: 998900 - RNA, 23 nt, Mycobacterium avium subsp. paratuberculosis
gccgcgcaccaccucuucgugca

SEQ ID NO: 998901 - RNA, 20 nt, Mycobacterium avium subsp. paratuberculosis
gccgcgcaccacgguggcgc

SEQ ID NO: 998902 - RNA, 22 nt, Mycobacterium avium subsp. paratuberculosis
gccgcgcaccacgguggcgccg

SEQ ID NO: 998903 - RNA, 15 nt, Mycobacterium avium subsp. paratuberculosis
gccgcgacccgggcc

SEQ ID NO: 998904 - RNA, 19 nt, Mycobacterium avium subsp. paratuberculosis
gccgcgaccgucagcaggg

SEQ ID NO: 998905 - RNA, 19 nt, Mycobacterium avium subsp. paratuberculosis
gccgccucgaagucgccgg

SEQ ID NO: 998906 - RNA, 21 nt, Mycobacterium avium subsp. paratuberculosis
gccgccucgaagucgccggcc

SEQ ID NO: 998907 - RNA, 21 nt, Mycobacterium avium subsp. paratuberculosis
gccgccuccagcacgucgggg

SEQ ID NO: 998908 - RNA, 15 nt, Mycobacterium avium subsp. paratuberculosis
gccgccucccgcagc

SEQ ID NO: 998909 - RNA, 14 nt, Mycobacterium avium subsp. paratuberculosis
gccgccucacgcag

SEQ ID NO: 998910 - RNA, 17 nt, Mycobacterium avium subsp. paratuberculosis
gccgccguguaggccgc

SEQ ID NO: 998911 - RNA, 14 nt, Mycobacterium avium subsp. paratuberculosis
gccgcccagcccgc

SEQ ID NO: 998912 - RNA, 13 nt, Mycobacterium avium subsp. paratuberculosis
gccgcccaggccc

SEQ ID NO: 998913 - RNA, 17 nt, Mycobacterium avium subsp. paratuberculosis
gccgcccaggccccggc

SEQ ID NO: 998914 - RNA, 19 nt, Mycobacterium avium subsp. paratuberculosis
gccgcccaggccccggccg

SEQ ID NO: 998915 - RNA, 19 nt, Mycobacterium avium subsp. paratuberculosis
gccgcccaggccgagcgca

SEQ ID NO: 998916 - RNA, 19 nt, Mycobacterium avium subsp. paratuberculosis
gccgcccaggcgggccagc

SEQ ID NO: 998917 - RNA, 17 nt, Mycobacterium avium subsp. paratuberculosis
gccgcccaucagcagga

SEQ ID NO: 998918 - RNA, 14 nt, Mycobacterium avium subsp. paratuberculosis
gccgcccccgccgc

SEQ ID NO: 998919 - RNA, 19 nt, Mycobacterium avium subsp. paratuberculosis
gccgcccccgccgcgagca

SEQ ID NO: 998920 - RNA, 19 nt, Mycobacterium avium subsp. paratuberculosis
gccgccccgaacagcgcca

SEQ ID NO: 998921 - RNA, 13 nt, Mycobacterium avium subsp. paratuberculosis
gccgccccggccg

SEQ ID NO: 998922 - RNA, 14 nt, Mycobacterium avium subsp. paratuberculosis
gccgccccggccgc

SEQ ID NO: 998923 - RNA, 17 nt, Mycobacterium avium subsp. paratuberculosis
gccgcccgcaccugcgc

SEQ ID NO: 998924 - RNA, 21 nt, Mycobacterium avium subsp. paratuberculosis
gccgcccgcaccugcgcgccg

SEQ ID NO: 998925 - RNA, 19 nt, Mycobacterium avium subsp. paratuberculosis
gccgccccgucggucgggc

SEQ ID NO: 998926 - RNA, 14 nt, Mycobacterium avium subsp. paratuberculosis
gccgcccgcgcggc

SEQ ID NO: 998927 - RNA, 13 nt, Mycobacterium avium subsp. paratuberculosis
gccgcccgcgcgu

SEQ ID NO: 998928 - RNA, 13 nt, Mycobacterium avium subsp. paratuberculosis
gccgcccucggcc

SEQ ID NO: 998929 - RNA, 14 nt, Mycobacterium avium subsp. paratuberculosis
gccgcccgucagcc

SEQ ID NO: 998930 - RNA, 24 nt, Mycobacterium avium subsp. paratuberculosis
gccgcccgcuccugcaggccgagc

SEQ ID NO: 998931 - RNA, 13 nt, Mycobacterium avium subsp. paratuberculosis
gccgcccggccca

SEQ ID NO: 998932 - RNA, 14 nt, Mycobacterium avium subsp. paratuberculosis
gccgcccggcgagc

SEQ ID NO: 998933 - RNA, 17 nt, Mycobacterium avium subsp. paratuberculosis
gccgcccggcgccccgc

SEQ ID NO: 998934 - RNA, 16 nt, Mycobacterium avium subsp. paratuberculosis
gccgcccggcgcgccg

SEQ ID NO: 998935 - RNA, 13 nt, Mycobacterium avium subsp. paratuberculosis
gccgcccgggccg

SEQ ID NO: 998936 - RNA, 16 nt, Mycobacterium avium subsp. paratuberculosis
gccgcccgggcggccc

SEQ ID NO: 998937 - RNA, 17 nt, Mycobacterium avium subsp. paratuberculosis
gccgccaucaccgcgcu

SEQ ID NO: 998938 - RNA, 15 nt, Mycobacterium avium subsp. paratuberculosis
gccgccaucauccgc

SEQ ID NO: 998939 - RNA, 18 nt, Mycobacterium avium subsp. paratuberculosis
gccgccaucauccgcugg

SEQ ID NO: 998940 - RNA, 17 nt, Mycobacterium avium subsp. paratuberculosis
gccgccaggucggggcc

SEQ ID NO: 998941 - RNA, 19 nt, Mycobacterium avium subsp. paratuberculosis
gccgccaggucggggcccg

SEQ ID NO: 998942 - RNA, 14 nt, Mycobacterium avium subsp. paratuberculosis
gccgccagggcgcg

SEQ ID NO: 998943 - RNA, 19 nt, Mycobacterium avium subsp. paratuberculosis
gccgccaggaugucguccu

SEQ ID NO: 998944 - RNA, 19 nt, Mycobacterium avium subsp. paratuberculosis
gccgccagcgcggggucgg

SEQ ID NO: 998945 - RNA, 13 nt, Mycobacterium avium subsp. paratuberculosis
gccgccagcgcca

SEQ ID NO: 998946 - RNA, 13 nt, Mycobacterium avium subsp. paratuberculosis
gccgccagccggu

SEQ ID NO: 998947 - RNA, 16 nt, Mycobacterium avium subsp. paratuberculosis
gccgccaucgccgccg

SEQ ID NO: 998948 - RNA, 17 nt, Mycobacterium avium subsp. paratuberculosis
gccgccaucgccgccgc

SEQ ID NO: 998949 - RNA, 19 nt, Mycobacterium avium subsp. paratuberculosis
gccgccaucgccucguccc

SEQ ID NO: 998950 - RNA, 14 nt, Mycobacterium avium subsp. paratuberculosis
gccgccaucuccuc

SEQ ID NO: 998951 - RNA, 23 nt, Mycobacterium avium subsp. paratuberculosis
gccgccauguacagaccccacac

SEQ ID NO: 998952 - RNA, 20 nt, Mycobacterium avium subsp. paratuberculosis
gccgcccacguaggggcccg

SEQ ID NO: 998953 - RNA, 17 nt, Mycobacterium avium subsp. paratuberculosis
gccgcccaccuucccaa

SEQ ID NO: 998954 - RNA, 12 nt, Mycobacterium avium subsp. paratuberculosis
gccaccuucacc

SEQ ID NO: 998955 - RNA, 22 nt, Mycobacterium avium subsp. paratuberculosis
gccaccuugcgcgggucgccgg

SEQ ID NO: 998956 - RNA, 15 nt, Mycobacterium avium subsp. paratuberculosis
gccaccgucgccggc

SEQ ID NO: 998957 - RNA, 22 nt, Mycobacterium avium subsp. paratuberculosis
gccaccgucgucgagcgcucgc

SEQ ID NO: 998958 - RNA, 19 nt, Mycobacterium avium subsp. paratuberculosis
gccaccgucuucggggccg

SEQ ID NO: 998959 - RNA, 23 nt, Mycobacterium avium subsp. paratuberculosis
gccaccgucuucggggccgccgu

SEQ ID NO: 998960 - RNA, 22 nt, Mycobacterium avium subsp. paratuberculosis
gccaccgugccuuacgccgggg

SEQ ID NO: 998961 - RNA, 22 nt, Mycobacterium avium subsp. paratuberculosis
gccaccguggccccacgggcca

SEQ ID NO: 998962 - RNA, 19 nt, Mycobacterium avium subsp. paratuberculosis
gccaccucgucccagcgca

SEQ ID NO: 998963 - RNA, 17 nt, Mycobacterium avium subsp. paratuberculosis
gccaccucggcggcacc

SEQ ID NO: 998964 - RNA, 14 nt, Mycobacterium avium subsp. paratuberculosis
gccaccucgaucag

SEQ ID NO: 998965 - RNA, 18 nt, Mycobacterium avium subsp. paratuberculosis
gccaccucgaucagcggc

SEQ ID NO: 998966 - RNA, 20 nt, Mycobacterium avium subsp. paratuberculosis
gccaccgucagcgucagcac

SEQ ID NO: 998967 - RNA, 19 nt, Mycobacterium avium subsp. paratuberculosis
gccaccggguaagugucgu

SEQ ID NO: 998968 - RNA, 12 nt, Mycobacterium avium subsp. paratuberculosis
gccaccgcccca

SEQ ID NO: 998969 - RNA, 14 nt, Mycobacterium avium subsp. paratuberculosis
gccaccgccccagc

SEQ ID NO: 998970 - RNA, 12 nt, Mycobacterium avium subsp. paratuberculosis
gccaccgcccgc

SEQ ID NO: 998971 - RNA, 24 nt, Mycobacterium avium subsp. paratuberculosis
gccaccgccgccagcagcagcgcc

SEQ ID NO: 998972 - RNA, 17 nt, Mycobacterium avium subsp. paratuberculosis
gccaccgccaucucggg

SEQ ID NO: 998973 - RNA, 16 nt, Mycobacterium avium subsp. paratuberculosis
gccaccgaggccagca

SEQ ID NO: 998974 - RNA, 18 nt, Mycobacterium avium subsp. paratuberculosis
gccaccgaggccagcaga

SEQ ID NO: 998975 - RNA, 16 nt, Mycobacterium avium subsp. paratuberculosis
gccaccgaugcgggcc

SEQ ID NO: 998976 - RNA, 17 nt, Mycobacterium avium subsp. paratuberculosis
gccaccuuggacaggcc

SEQ ID NO: 998977 - RNA, 20 nt, Mycobacterium avium subsp. paratuberculosis
gccacgacauccccgcaaac

SEQ ID NO: 998978 - RNA, 15 nt, Mycobacterium avium subsp. paratuberculosis
gccacgaccagcggc

SEQ ID NO: 998979 - RNA, 14 nt, Mycobacterium avium subsp. paratuberculosis
gccacgacgcgcca

SEQ ID NO: 998980 - RNA, 18 nt, Mycobacterium avium subsp. paratuberculosis
gccacgacgcgccacgcc

SEQ ID NO: 998981 - RNA, 15 nt, Mycobacterium avium subsp. paratuberculosis
gccacgacgcggcgc

SEQ ID NO: 998982 - RNA, 23 nt, Mycobacterium avium subsp. paratuberculosis
gccacgacggcgcuggccgcggc

SEQ ID NO: 998983 - RNA, 17 nt, Mycobacterium avium subsp. paratuberculosis
gccacgacguacccccg

SEQ ID NO: 998984 - RNA, 18 nt, Mycobacterium avium subsp. paratuberculosis
gccacgacguacccccgc

SEQ ID NO: 998985 - RNA, 22 nt, Mycobacterium avium subsp. paratuberculosis
gccacgacguacccccgcacgc

SEQ ID NO: 998986 - RNA, 17 nt, Mycobacterium avium subsp. paratuberculosis
gccacgacugcgcggcc

SEQ ID NO: 998987 - RNA, 15 nt, Mycobacterium avium subsp. paratuberculosis
gccacgcacaccgcg

SEQ ID NO: 998988 - RNA, 16 nt, Mycobacterium avium subsp. paratuberculosis
gccacgagcccagccg

SEQ ID NO: 998989 - RNA, 17 nt, Mycobacterium avium subsp. paratuberculosis
gccacgagcccagccgu

SEQ ID NO: 998990 - RNA, 20 nt, Mycobacterium avium subsp. paratuberculosis
gccacgagcccagccgucgc

SEQ ID NO: 998991 - RNA, 16 nt, Mycobacterium avium subsp. paratuberculosis
gccacgaucgcggcca

SEQ ID NO: 998992 - RNA, 18 nt, Mycobacterium avium subsp. paratuberculosis
gccacgaucgcggccagc

SEQ ID NO: 998993 - RNA, 17 nt, Mycobacterium avium subsp. paratuberculosis
gccacgauccgcgcggc

SEQ ID NO: 998994 - RNA, 21 nt, Mycobacterium avium subsp. paratuberculosis
gccacgauccgcgcggccacc

SEQ ID NO: 998995 - RNA, 18 nt, Mycobacterium avium subsp. paratuberculosis
gccacgauccggggcagc

SEQ ID NO: 998996 - RNA, 19 nt, Mycobacterium avium subsp. paratuberculosis
gccacgauccggggcagca

SEQ ID NO: 998997 - RNA, 12 nt, Mycobacterium avium subsp. paratuberculosis
gccacgccagcc

SEQ ID NO: 998998 - RNA, 13 nt, Mycobacterium avium subsp. paratuberculosis
gccacgccagcca

SEQ ID NO: 998999 - RNA, 19 nt, Mycobacterium avium subsp. paratuberculosis
gccacgccgacaccgucgc

SEQ ID NO: 999000 - RNA, 16 nt, Mycobacterium avium subsp. paratuberculosis
gccacgccgaccaggu

SEQ ID NO: 999001 - RNA, 17 nt, Mycobacterium avium subsp. paratuberculosis
gccacgccgaccagguc

SEQ ID NO: 999002 - RNA, 23 nt, Mycobacterium avium subsp. paratuberculosis
gccacgccccauugccgcgccgg

SEQ ID NO: 999003 - RNA, 22 nt, Mycobacterium avium subsp. paratuberculosis
gccacgccccggcgccgucguu

SEQ ID NO: 999004 - RNA, 14 nt, Mycobacterium avium subsp. paratuberculosis
gccacgcccgcagc

SEQ ID NO: 999005 - RNA, 16 nt, Mycobacterium avium subsp. paratuberculosis
gccacgcccgcagcgc

SEQ ID NO: 999006 - RNA, 21 nt, Mycobacterium avium subsp. paratuberculosis
gccacgccgcccccgccgcga

SEQ ID NO: 999007 - RNA, 22 nt, Mycobacterium avium subsp. paratuberculosis
gcauagauaccggccagcacga

SEQ ID NO: 999008 - RNA, 14 nt, Mycobacterium avium subsp. paratuberculosis
gcauacagcaggcu

SEQ ID NO: 999009 - RNA, 21 nt, Mycobacterium avium subsp. paratuberculosis
gcauacaccuugucggcgagc

SEQ ID NO: 999010 - RNA, 22 nt, Mycobacterium avium subsp. paratuberculosis
gcauagcgguccauccagcgcc

SEQ ID NO: 999011 - RNA, 19 nt, Mycobacterium avium subsp. paratuberculosis
gccaccagaccggcgaagc

SEQ ID NO: 999012 - RNA, 18 nt, Mycobacterium avium subsp. paratuberculosis
gccaccagaugccgggcu

SEQ ID NO: 999013 - RNA, 12 nt, Mycobacterium avium subsp. paratuberculosis
gccaccagcagg

SEQ ID NO: 999014 - RNA, 18 nt, Mycobacterium avium subsp. paratuberculosis
gccaccagcgcggccacc

SEQ ID NO: 999015 - RNA, 10 nt, Mycobacterium avium subsp. paratuberculosis
gccaccagcg

SEQ ID NO: 999016 - RNA, 23 nt, Mycobacterium avium subsp. paratuberculosis
gccaccagcgcacacagcagcag

SEQ ID NO: 999017 - RNA, 14 nt, Mycobacterium avium subsp. paratuberculosis
gccaccagcagcag

SEQ ID NO: 999018 - RNA, 17 nt, Mycobacterium avium subsp. paratuberculosis
gccaccagccggccggc

SEQ ID NO: 999019 - RNA, 18 nt, Mycobacterium avium subsp. paratuberculosis
gccaccagccggccggcc

SEQ ID NO: 999020 - RNA, 12 nt, Mycobacterium avium subsp. paratuberculosis
gccaccaggcgg

SEQ ID NO: 999021 - RNA, 21 nt, Mycobacterium avium subsp. paratuberculosis
gccaccaggcugaacgucguc

SEQ ID NO: 999022 - RNA, 19 nt, Mycobacterium avium subsp. paratuberculosis
gccaccaccuucaucgccg

SEQ ID NO: 999023 - RNA, 23 nt, Mycobacterium avium subsp. paratuberculosis
gccaccaccuucaucgccgucgc

SEQ ID NO: 999024 - RNA, 22 nt, Mycobacterium avium subsp. paratuberculosis
gccaccacgacgccgggcgccc

SEQ ID NO: 999025 - RNA, 14 nt, Mycobacterium avium subsp. paratuberculosis
gccaccaccuccuc

SEQ ID NO: 999026 - RNA, 17 nt, Mycobacterium avium subsp. paratuberculosis
gccaccaccucgcgggc

SEQ ID NO: 999027 - RNA, 18 nt, Mycobacterium avium subsp. paratuberculosis
gccaccacguacuccugc

SEQ ID NO: 999028 - RNA, 20 nt, Mycobacterium avium subsp. paratuberculosis
gccaccacguacuccugcgc

SEQ ID NO: 999029 - RNA, 18 nt, Mycobacterium avium subsp. paratuberculosis
gccaccacugcgccguca

SEQ ID NO: 999030 - RNA, 13 nt, Mycobacterium avium subsp. paratuberculosis
gccacauguucuc

SEQ ID NO: 999031 - RNA, 13 nt, Mycobacterium avium subsp. paratuberculosis
gccaccaccgagg

SEQ ID NO: 999032 - RNA, 13 nt, Mycobacterium avium subsp. paratuberculosis
gccaccaccgcca

SEQ ID NO: 999033 - RNA, 21 nt, Mycobacterium avium subsp. paratuberculosis
gccacguggucgcugaccuuc

SEQ ID NO: 999034 - RNA, 22 nt, Mycobacterium avium subsp. paratuberculosis
gccacguccggaugcggcgccc

SEQ ID NO: 999035 - RNA, 22 nt, Mycobacterium avium subsp. paratuberculosis
gccacgggcggucggacgcggg

SEQ ID NO: 999036 - RNA, 18 nt, Mycobacterium avium subsp. paratuberculosis
gccacggguugagccaga

SEQ ID NO: 999037 - RNA, 17 nt, Mycobacterium avium subsp. paratuberculosis
gccacguagcagcagac

SEQ ID NO: 999038 - RNA, 16 nt, Mycobacterium avium subsp. paratuberculosis
gccacggucaggcgca

SEQ ID NO: 999039 - RNA, 22 nt, Mycobacterium avium subsp. paratuberculosis
gccacguacaccgggaucgggg

SEQ ID NO: 999040 - RNA, 14 nt, Mycobacterium avium subsp. paratuberculosis
gccacggccgcggc

SEQ ID NO: 999041 - RNA, 19 nt, Mycobacterium avium subsp. paratuberculosis
gccacgccguggcccgccc

SEQ ID NO: 999042 - RNA, 20 nt, Mycobacterium avium subsp. paratuberculosis
gccacgcgucaggcgucgua

SEQ ID NO: 999043 - RNA, 16 nt, Mycobacterium avium subsp. paratuberculosis
gccacgcucucgccgg

SEQ ID NO: 999044 - RNA, 14 nt, Mycobacterium avium subsp. paratuberculosis
gccacgcucaugcc

SEQ ID NO: 999045 - RNA, 19 nt, Mycobacterium avium subsp. paratuberculosis
gccacgcucggcggcgcgc

SEQ ID NO: 999046 - RNA, 14 nt, Mycobacterium avium subsp. paratuberculosis
gccacgcucgggcc

SEQ ID NO: 999047 - RNA, 18 nt, Mycobacterium avium subsp. paratuberculosis
gccacgcucgggccggcg

SEQ ID NO: 999048 - RNA, 21 nt, Mycobacterium avium subsp. paratuberculosis
gccacgcucgggccggcgccg

SEQ ID NO: 999049 - RNA, 22 nt, Mycobacterium avium subsp. paratuberculosis
gccacgcucgggccggcgccga

SEQ ID NO: 999050 - RNA, 17 nt, Mycobacterium avium subsp. paratuberculosis
gccagaacggcggcagc

SEQ ID NO: 999051 - RNA, 21 nt, Mycobacterium avium subsp. paratuberculosis
gccagaacggcggcagcgagg

SEQ ID NO: 999052 - RNA, 19 nt, Mycobacterium avium subsp. paratuberculosis
gccagaaccggcaacacag

SEQ ID NO: 999053 - RNA, 21 nt, Mycobacterium avium subsp. paratuberculosis
gccagaaccggcaacacagcc

SEQ ID NO: 999054 - RNA, 14 nt, Mycobacterium avium subsp. paratuberculosis
gccacugccgccgc

SEQ ID NO: 999055 - RNA, 16 nt, Mycobacterium avium subsp. paratuberculosis
gccacugccgccgccc

SEQ ID NO: 999056 - RNA, 18 nt, Mycobacterium avium subsp. paratuberculosis
gccagaacacgccccggc

SEQ ID NO: 999057 - RNA, 22 nt, Mycobacterium avium subsp. paratuberculosis
gccagaccucgccgacgguguc

SEQ ID NO: 999058 - RNA, 15 nt, Mycobacterium avium subsp. paratuberculosis
gccagaugcccgccc

SEQ ID NO: 999059 - RNA, 18 nt, Mycobacterium avium subsp. paratuberculosis
gccagaugcccgccccgc

SEQ ID NO: 999060 - RNA, 14 nt, Mycobacterium avium subsp. paratuberculosis
gccagaucgccugg

SEQ ID NO: 999061 - RNA, 18 nt, Mycobacterium avium subsp. paratuberculosis
gccagcacgcccccgcug

SEQ ID NO: 999062 - RNA, 15 nt, Mycobacterium avium subsp. paratuberculosis
gccagcacguggccg

SEQ ID NO: 999063 - RNA, 23 nt, Mycobacterium avium subsp. paratuberculosis
gccagcacggucagcggccagcc

SEQ ID NO: 999064 - RNA, 19 nt, Mycobacterium avium subsp. paratuberculosis
gccagcacggccagccagc

SEQ ID NO: 999065 - RNA, 22 nt, Mycobacterium avium subsp. paratuberculosis
gccagcacggccagccagccgc

SEQ ID NO: 999066 - RNA, 23 nt, Mycobacterium avium subsp. paratuberculosis
gccagcacgccggucagcaccau

SEQ ID NO: 999067 - RNA, 22 nt, Mycobacterium avium subsp. paratuberculosis
gccagauagaugagccgcagcc

SEQ ID NO: 999068 - RNA, 14 nt, Mycobacterium avium subsp. paratuberculosis
gccagaucgcugau

SEQ ID NO: 999069 - RNA, 17 nt, Mycobacterium avium subsp. paratuberculosis
gccagaucgaggccagc

SEQ ID NO: 999070 - RNA, 19 nt, Mycobacterium avium subsp. paratuberculosis
gccagaucgaggccagcgc

SEQ ID NO: 999071 - RNA, 21 nt, Mycobacterium avium subsp. paratuberculosis
gccagaucuguauuaagcugg

SEQ ID NO: 999072 - RNA, 17 nt, Mycobacterium avium subsp. paratuberculosis
gccagacgaacgcggcc

SEQ ID NO: 999073 - RNA, 13 nt, Mycobacterium avium subsp. paratuberculosis
gccaugccggccu

SEQ ID NO: 999074 - RNA, 17 nt, Mycobacterium avium subsp. paratuberculosis
gccaugccggccugacu

SEQ ID NO: 999075 - RNA, 21 nt, Mycobacterium avium subsp. paratuberculosis
gccaugccucuucggcgcgcc

SEQ ID NO: 999076 - RNA, 23 nt, Mycobacterium avium subsp. paratuberculosis
gccaugccucuucggcgcgccgg

SEQ ID NO: 999077 - RNA, 13 nt, Mycobacterium avium subsp. paratuberculosis
gccaucgcggccc

SEQ ID NO: 999078 - RNA, 18 nt, Mycobacterium avium subsp. paratuberculosis
gccaucgccucgucccuc

SEQ ID NO: 999079 - RNA, 15 nt, Mycobacterium avium subsp. paratuberculosis
gccaucggcagaccc

SEQ ID NO: 999080 - RNA, 12 nt, Mycobacterium avium subsp. paratuberculosis
gccaucgcccgg

SEQ ID NO: 999081 - RNA, 19 nt, Mycobacterium avium subsp. paratuberculosis
gccauccgccacccgcugc

SEQ ID NO: 999082 - RNA, 14 nt, Mycobacterium avium subsp. paratuberculosis
gccauccgcgccga

SEQ ID NO: 999083 - RNA, 19 nt, Mycobacterium avium subsp. paratuberculosis
gccauccccgcguuggcca

SEQ ID NO: 999084 - RNA, 18 nt, Mycobacterium avium subsp. paratuberculosis
gccagucugagcccgggc

SEQ ID NO: 999085 - RNA, 12 nt, Mycobacterium avium subsp. paratuberculosis
gccagucgccgg

SEQ ID NO: 999086 - RNA, 19 nt, Mycobacterium avium subsp. paratuberculosis
gccagucgccggccaggcc

SEQ ID NO: 999087 - RNA, 14 nt, Mycobacterium avium subsp. paratuberculosis
gccagucgccgcgc

SEQ ID NO: 999088 - RNA, 15 nt, Mycobacterium avium subsp. paratuberculosis
gccaguccugggcca

SEQ ID NO: 999089 - RNA, 13 nt, Mycobacterium avium subsp. paratuberculosis
gccagugccgcgc

SEQ ID NO: 999090 - RNA, 16 nt, Mycobacterium avium subsp. paratuberculosis
gccaguaccagcggcc

SEQ ID NO: 999091 - RNA, 23 nt, Mycobacterium avium subsp. paratuberculosis
gccaguaccagcggccgucgcgc

SEQ ID NO: 999092 - RNA, 15 nt, Mycobacterium avium subsp. paratuberculosis
gccaguccgccgccg

SEQ ID NO: 999093 - RNA, 20 nt, Mycobacterium avium subsp. paratuberculosis
gccaguccggcagcagcgag

SEQ ID NO: 999094 - RNA, 19 nt, Mycobacterium avium subsp. paratuberculosis
gccaguuguuggccgggca

SEQ ID NO: 999095 - RNA, 19 nt, Mycobacterium avium subsp. paratuberculosis
gccaguugggggccagcgc

SEQ ID NO: 999096 - RNA, 14 nt, Mycobacterium avium subsp. paratuberculosis
gccaguugaucagc

SEQ ID NO: 999097 - RNA, 13 nt, Mycobacterium avium subsp. paratuberculosis
gccaguuugccgu

SEQ ID NO: 999098 - RNA, 19 nt, Mycobacterium avium subsp. paratuberculosis
gccaguucgacgaucuugc

SEQ ID NO: 999099 - RNA, 19 nt, Mycobacterium avium subsp. paratuberculosis
gccaguucgucgcgcgacu

SEQ ID NO: 999100 - RNA, 20 nt, Mycobacterium avium subsp. paratuberculosis
gccaguguggccgcggcggc

SEQ ID NO: 999101 - RNA, 15 nt, Mycobacterium avium subsp. paratuberculosis
gccaguucaccgcgc

SEQ ID NO: 999102 - RNA, 22 nt, Mycobacterium avium subsp. paratuberculosis
gccagguccacaccguggagac

SEQ ID NO: 999103 - RNA, 14 nt, Mycobacterium avium subsp. paratuberculosis
gccagguccgggca

SEQ ID NO: 999104 - RNA, 16 nt, Mycobacterium avium subsp. paratuberculosis
gccaggucgcugacga

SEQ ID NO: 999105 - RNA, 19 nt, Mycobacterium avium subsp. paratuberculosis
gccagguacuccucgaaga

SEQ ID NO: 999106 - RNA, 21 nt, Mycobacterium avium subsp. paratuberculosis
gccagguacugaucaccgcgc

SEQ ID NO: 999107 - RNA, 17 nt, Mycobacterium avium subsp. paratuberculosis
gccagggccgccgcaua

SEQ ID NO: 999108 - RNA, 19 nt, Mycobacterium avium subsp. paratuberculosis
gccagggccgggcgugccc

SEQ ID NO: 999109 - RNA, 18 nt, Mycobacterium avium subsp. paratuberculosis
gccagggcgacgccgcgg

SEQ ID NO: 999110 - RNA, 19 nt, Mycobacterium avium subsp. paratuberculosis
gccagggcgacgccgcgga

SEQ ID NO: 999111 - RNA, 14 nt, Mycobacterium avium subsp. paratuberculosis
gccagggcgaggac

SEQ ID NO: 999112 - RNA, 16 nt, Mycobacterium avium subsp. paratuberculosis
gccagggcccgcagcc

SEQ ID NO: 999113 - RNA, 16 nt, Mycobacterium avium subsp. paratuberculosis
gccaggcccugccagc

SEQ ID NO: 999114 - RNA, 15 nt, Mycobacterium avium subsp. paratuberculosis
gccaggcccaccguc

SEQ ID NO: 999115 - RNA, 15 nt, Mycobacterium avium subsp. paratuberculosis
gccaggaagccggcg

SEQ ID NO: 999116 - RNA, 20 nt, Mycobacterium avium subsp. paratuberculosis
gccaggaaccacaccccggc

SEQ ID NO: 999117 - RNA, 12 nt, Mycobacterium avium subsp. paratuberculosis
gccaggcaggcg

SEQ ID NO: 999118 - RNA, 13 nt, Mycobacterium avium subsp. paratuberculosis
gccaggacagcgu

SEQ ID NO: 999119 - RNA, 13 nt, Mycobacterium avium subsp. paratuberculosis
gccaggcccagcc

SEQ ID NO: 999120 - RNA, 15 nt, Mycobacterium avium subsp. paratuberculosis
gccaggccauggcgc

SEQ ID NO: 999121 - RNA, 17 nt, Mycobacterium avium subsp. paratuberculosis
gccaggccauggcgcac

SEQ ID NO: 999122 - RNA, 20 nt, Mycobacterium avium subsp. paratuberculosis
gccaggccauggcgcaccgc

SEQ ID NO: 999123 - RNA, 23 nt, Mycobacterium avium subsp. paratuberculosis
gccaggccaccgcacgucuuacg

SEQ ID NO: 999124 - RNA, 19 nt, Mycobacterium avium subsp. paratuberculosis
gccagcuccucggggauga

SEQ ID NO: 999125 - RNA, 17 nt, Mycobacterium avium subsp. paratuberculosis
gccagcucgaccgcggc

SEQ ID NO: 999126 - RNA, 21 nt, Mycobacterium avium subsp. paratuberculosis
gccagcucgagcaucacgaac

SEQ ID NO: 999127 - RNA, 14 nt, Mycobacterium avium subsp. paratuberculosis
gccagcucgccgcc

SEQ ID NO: 999128 - RNA, 15 nt, Mycobacterium avium subsp. paratuberculosis
gccagcucccgggcg

SEQ ID NO: 999129 - RNA, 15 nt, Mycobacterium avium subsp. paratuberculosis
gccagcuccagcagc

SEQ ID NO: 999130 - RNA, 12 nt, Mycobacterium avium subsp. paratuberculosis
gccagcgucagg

SEQ ID NO: 999131 - RNA, 21 nt, Mycobacterium avium subsp. paratuberculosis
gccagcgucgaguuguugggc

SEQ ID NO: 999132 - RNA, 13 nt, Mycobacterium avium subsp. paratuberculosis
gccagcgucgcgc

SEQ ID NO: 999133 - RNA, 22 nt, Mycobacterium avium subsp. paratuberculosis
gccagcgucgcgccgccacccc

SEQ ID NO: 999134 - RNA, 21 nt, Mycobacterium avium subsp. paratuberculosis
gccagcucgucgagccggccg

SEQ ID NO: 999135 - RNA, 15 nt, Mycobacterium avium subsp. paratuberculosis
gccagcucguccagc

SEQ ID NO: 999136 - RNA, 19 nt, Mycobacterium avium subsp. paratuberculosis
gccagcucguccagcgugc

SEQ ID NO: 999137 - RNA, 20 nt, Mycobacterium avium subsp. paratuberculosis
gccagcucggcccgcugcgc

SEQ ID NO: 999138 - RNA, 14 nt, Mycobacterium avium subsp. paratuberculosis
gccagcucggcggc

SEQ ID NO: 999139 - RNA, 15 nt, Mycobacterium avium subsp. paratuberculosis
gccagcucggcggcc

SEQ ID NO: 999140 - RNA, 18 nt, Mycobacterium avium subsp. paratuberculosis
gccagcucggcggccggg

SEQ ID NO: 999141 - RNA, 14 nt, Mycobacterium avium subsp. paratuberculosis
gccagcgguccagc

SEQ ID NO: 999142 - RNA, 19 nt, Mycobacterium avium subsp. paratuberculosis
gccagcgucagggcgacuc

SEQ ID NO: 999143 - RNA, 21 nt, Mycobacterium avium subsp. paratuberculosis
gccagcgggccgagcguucgg

SEQ ID NO: 999144 - RNA, 14 nt, Mycobacterium avium subsp. paratuberculosis
gccagcgggcggcc

SEQ ID NO: 999145 - RNA, 20 nt, Mycobacterium avium subsp. paratuberculosis
gccagcgggcggccccgggc

SEQ ID NO: 999146 - RNA, 23 nt, Mycobacterium avium subsp. paratuberculosis
gccagcgggucgugcaucggcgc

SEQ ID NO: 999147 - RNA, 22 nt, Mycobacterium avium subsp. paratuberculosis
gccagcgggugauggccgccgc

SEQ ID NO: 999148 - RNA, 21 nt, Mycobacterium avium subsp. paratuberculosis
gccagcgcgugcggggugugc

SEQ ID NO: 999149 - RNA, 14 nt, Mycobacterium avium subsp. paratuberculosis
gccagcgcgucgca

SEQ ID NO: 999150 - RNA, 18 nt, Mycobacterium avium subsp. paratuberculosis
gccagcgcgucggccagc

SEQ ID NO: 999151 - RNA, 21 nt, Mycobacterium avium subsp. paratuberculosis
gccagcgcgucggccagcacc

SEQ ID NO: 999152 - RNA, 15 nt, Mycobacterium avium subsp. paratuberculosis
gccagcgcggcggcg

SEQ ID NO: 999153 - RNA, 18 nt, Mycobacterium avium subsp. paratuberculosis
gccagcgcggcggcgccg

SEQ ID NO: 999154 - RNA, 13 nt, Mycobacterium avium subsp. paratuberculosis
gccagcgcggcgu

SEQ ID NO: 999155 - RNA, 21 nt, Mycobacterium avium subsp. paratuberculosis
gccagcgcgguggccagcagg

SEQ ID NO: 999156 - RNA, 22 nt, Mycobacterium avium subsp. paratuberculosis
gccagcgcggugugcggcggcu

SEQ ID NO: 999157 - RNA, 23 nt, Mycobacterium avium subsp. paratuberculosis
gccagcgcggugugcggcggcuc

SEQ ID NO: 999158 - RNA, 21 nt, Mycobacterium avium subsp. paratuberculosis
gccagcgcggcgaucagcagc

SEQ ID NO: 999159 - RNA, 12 nt, Mycobacterium avium subsp. paratuberculosis
gccagcgcggcc

SEQ ID NO: 999160 - RNA, 13 nt, Mycobacterium avium subsp. paratuberculosis
gccagcgcggccg

SEQ ID NO: 999161 - RNA, 17 nt, Mycobacterium avium subsp. paratuberculosis
gccagcgcggccgggcg

SEQ ID NO: 999162 - RNA, 15 nt, Mycobacterium avium subsp. paratuberculosis
gccagcgccagcgcc

SEQ ID NO: 999163 - RNA, 14 nt, Mycobacterium avium subsp. paratuberculosis
gccagcgcgcccgc

SEQ ID NO: 999164 - RNA, 12 nt, Mycobacterium avium subsp. paratuberculosis
gccagcgcgccg

SEQ ID NO: 999165 - RNA, 14 nt, Mycobacterium avium subsp. paratuberculosis
gccagcgcgccgcc

SEQ ID NO: 999166 - RNA, 14 nt, Mycobacterium avium subsp. paratuberculosis
gccagcgcgcgcag

SEQ ID NO: 999167 - RNA, 12 nt, Mycobacterium avium subsp. paratuberculosis
gccagcgcgcgc

SEQ ID NO: 999168 - RNA, 15 nt, Mycobacterium avium subsp. paratuberculosis
gccagcgcgccgccg

SEQ ID NO: 999169 - RNA, 16 nt, Mycobacterium avium subsp. paratuberculosis
gccagcgcgccgccga

SEQ ID NO: 999170 - RNA, 21 nt, Mycobacterium avium subsp. paratuberculosis
gccagcgcaucggucaccagc

SEQ ID NO: 999171 - RNA, 14 nt, Mycobacterium avium subsp. paratuberculosis
gccagcgccacccc

SEQ ID NO: 999172 - RNA, 12 nt, Mycobacterium avium subsp. paratuberculosis
gccagcgccacg

SEQ ID NO: 999173 - RNA, 15 nt, Mycobacterium avium subsp. paratuberculosis
gccagcgccacgcuc

SEQ ID NO: 999174 - RNA, 19 nt, Mycobacterium avium subsp. paratuberculosis
gccagcgcaccgggcccgc

SEQ ID NO: 999175 - RNA, 23 nt, Mycobacterium avium subsp. paratuberculosis
gccagcgcaccgggcccgcccgc

SEQ ID NO: 999176 - RNA, 23 nt, Mycobacterium avium subsp. paratuberculosis
gccagcagaucggagacguccuc

SEQ ID NO: 999177 - RNA, 12 nt, Mycobacterium avium subsp. paratuberculosis
gccagcagcagc

SEQ ID NO: 999178 - RNA, 14 nt, Mycobacterium avium subsp. paratuberculosis
gccagcagcagccg

SEQ ID NO: 999179 - RNA, 17 nt, Mycobacterium avium subsp. paratuberculosis
gccagcagcagccgcgc

SEQ ID NO: 999180 - RNA, 18 nt, Mycobacterium avium subsp. paratuberculosis
gccagcagcagcgccgcc

SEQ ID NO: 999181 - RNA, 17 nt, Mycobacterium avium subsp. paratuberculosis
gccagcagguagaagcc

SEQ ID NO: 999182 - RNA, 21 nt, Mycobacterium avium subsp. paratuberculosis
gccagcagguagaagccgcga

SEQ ID NO: 999183 - RNA, 17 nt, Mycobacterium avium subsp. paratuberculosis
gccagcaguguccaguc

SEQ ID NO: 999184 - RNA, 15 nt, Mycobacterium avium subsp. paratuberculosis
gccagcagugccacc

SEQ ID NO: 999185 - RNA, 18 nt, Mycobacterium avium subsp. paratuberculosis
gccagccggucaucgcgu

SEQ ID NO: 999186 - RNA, 22 nt, Mycobacterium avium subsp. paratuberculosis
gccagccggccgcugaggaugg

SEQ ID NO: 999187 - RNA, 17 nt, Mycobacterium avium subsp. paratuberculosis
gccagccgggccgagcg

SEQ ID NO: 999188 - RNA, 21 nt, Mycobacterium avium subsp. paratuberculosis
gccagccgggccgagcgcgcc

SEQ ID NO: 999189 - RNA, 23 nt, Mycobacterium avium subsp. paratuberculosis
gccagccgggccgagcgcgccgc

SEQ ID NO: 999190 - RNA, 14 nt, Mycobacterium avium subsp. paratuberculosis
gccagccgggcgac

SEQ ID NO: 999191 - RNA, 15 nt, Mycobacterium avium subsp. paratuberculosis
gccagccgggcggcc

SEQ ID NO: 999192 - RNA, 14 nt, Mycobacterium avium subsp. paratuberculosis
gccagccggguggc

SEQ ID NO: 999193 - RNA, 20 nt, Mycobacterium avium subsp. paratuberculosis
gccagccggguggcccgcgc

SEQ ID NO: 999194 - RNA, 19 nt, Mycobacterium avium subsp. paratuberculosis
gccagccggugcggucggc

SEQ ID NO: 999195 - RNA, 13 nt, Mycobacterium avium subsp. paratuberculosis
gccagccggugcu

SEQ ID NO: 999196 - RNA, 20 nt, Mycobacterium avium subsp. paratuberculosis
gccagccgguggcggccacg

SEQ ID NO: 999197 - RNA, 15 nt, Mycobacterium avium subsp. paratuberculosis
gccagccgucccgcc

SEQ ID NO: 999198 - RNA, 17 nt, Mycobacterium avium subsp. paratuberculosis
gccagccgucccgccgu

SEQ ID NO: 999199 - RNA, 14 nt, Mycobacterium avium subsp. paratuberculosis
gccagccgucgccg

SEQ ID NO: 999200 - RNA, 15 nt, Mycobacterium avium subsp. paratuberculosis
gccagccgucgccgc

SEQ ID NO: 999201 - RNA, 19 nt, Mycobacterium avium subsp. paratuberculosis
gccagccgucgccgcgccc

SEQ ID NO: 999202 - RNA, 20 nt, Mycobacterium avium subsp. paratuberculosis
gccagccgucgccgcgcccg

SEQ ID NO: 999203 - RNA, 17 nt, Mycobacterium avium subsp. paratuberculosis
gccagccgugcggcggc

SEQ ID NO: 999204 - RNA, 14 nt, Mycobacterium avium subsp. paratuberculosis
gccccauugccgcg

SEQ ID NO: 999205 - RNA, 17 nt, Mycobacterium avium subsp. paratuberculosis
gccccauugccgcgccg

SEQ ID NO: 999206 - RNA, 21 nt, Mycobacterium avium subsp. paratuberculosis
gcccccaccgcgccgugaacu

SEQ ID NO: 999207 - RNA, 18 nt, Mycobacterium avium subsp. paratuberculosis
gcccccaccugaucgcgg

SEQ ID NO: 999208 - RNA, 20 nt, Mycobacterium avium subsp. paratuberculosis
gcccccaccugaucgcggcg

SEQ ID NO: 999209 - RNA, 23 nt, Mycobacterium avium subsp. paratuberculosis
gcccccaccugaucgcggcgagc

SEQ ID NO: 999210 - RNA, 14 nt, Mycobacterium avium subsp. paratuberculosis
gcccccagcggggc

SEQ ID NO: 999211 - RNA, 15 nt, Mycobacterium avium subsp. paratuberculosis
gcccccaaugucacg

SEQ ID NO: 999212 - RNA, 21 nt, Mycobacterium avium subsp. paratuberculosis
gcccccacgcagcggugcagc

SEQ ID NO: 999213 - RNA, 14 nt, Mycobacterium avium subsp. paratuberculosis
gccccccgggcacc

SEQ ID NO: 999214 - RNA, 23 nt, Mycobacterium avium subsp. paratuberculosis
gccccaggucggggugggcgacg

SEQ ID NO: 999215 - RNA, 19 nt, Mycobacterium avium subsp. paratuberculosis
gccccagugcaggcaggcc

SEQ ID NO: 999216 - RNA, 23 nt, Mycobacterium avium subsp. paratuberculosis
gccccaggcgaacauggcggcca

SEQ ID NO: 999217 - RNA, 13 nt, Mycobacterium avium subsp. paratuberculosis
gccccagggacca

SEQ ID NO: 999218 - RNA, 20 nt, Mycobacterium avium subsp. paratuberculosis
gccccagggccucggcgacc

SEQ ID NO: 999219 - RNA, 19 nt, Mycobacterium avium subsp. paratuberculosis
gccccaguucgaucagcag

SEQ ID NO: 999220 - RNA, 20 nt, Mycobacterium avium subsp. paratuberculosis
gccccgccagauagggcagc

SEQ ID NO: 999221 - RNA, 12 nt, Mycobacterium avium subsp. paratuberculosis
gccccgccaggc

SEQ ID NO: 999222 - RNA, 14 nt, Mycobacterium avium subsp. paratuberculosis
gccccgccaggcgg

SEQ ID NO: 999223 - RNA, 13 nt, Mycobacterium avium subsp. paratuberculosis
gccccgcccggcg

SEQ ID NO: 999224 - RNA, 21 nt, Mycobacterium avium subsp. paratuberculosis
gccccgcccggcgcgcagccc

SEQ ID NO: 999225 - RNA, 15 nt, Mycobacterium avium subsp. paratuberculosis
gccccgcccggcggc

SEQ ID NO: 999226 - RNA, 16 nt, Mycobacterium avium subsp. paratuberculosis
gccccgcccggcggcc

SEQ ID NO: 999227 - RNA, 19 nt, Mycobacterium avium subsp. paratuberculosis
gccccgcccggcggccacc

SEQ ID NO: 999228 - RNA, 21 nt, Mycobacterium avium subsp. paratuberculosis
gccccgcccggcggccaccau

SEQ ID NO: 999229 - RNA, 23 nt, Mycobacterium avium subsp. paratuberculosis
gccccgaucggauccgccugccc

SEQ ID NO: 999230 - RNA, 18 nt, Mycobacterium avium subsp. paratuberculosis
gccccgacgaucgcgccg

SEQ ID NO: 999231 - RNA, 20 nt, Mycobacterium avium subsp. paratuberculosis
gccccgacgaucgcgccggc

SEQ ID NO: 999232 - RNA, 21 nt, Mycobacterium avium subsp. paratuberculosis
gccccgacgaucgcgccggcc

SEQ ID NO: 999233 - RNA, 21 nt, Mycobacterium avium subsp. paratuberculosis
gccccgacgugcagcgccagc

SEQ ID NO: 999234 - RNA, 23 nt, Mycobacterium avium subsp. paratuberculosis
gccccgacgugcagcgccagcac

SEQ ID NO: 999235 - RNA, 20 nt, Mycobacterium avium subsp. paratuberculosis
gccccgagcgucacgccagc

SEQ ID NO: 999236 - RNA, 17 nt, Mycobacterium avium subsp. paratuberculosis
gcccccgggcccgaagc

SEQ ID NO: 999237 - RNA, 14 nt, Mycobacterium avium subsp. paratuberculosis
gcccccgcggcguc

SEQ ID NO: 999238 - RNA, 17 nt, Mycobacterium avium subsp. paratuberculosis
gcccccgauagccccgc

SEQ ID NO: 999239 - RNA, 19 nt, Mycobacterium avium subsp. paratuberculosis
gcccccgacaggcccaccc

SEQ ID NO: 999240 - RNA, 12 nt, Mycobacterium avium subsp. paratuberculosis
gcccccgcagcc

SEQ ID NO: 999241 - RNA, 12 nt, Mycobacterium avium subsp. paratuberculosis
gcccccgcccgg

SEQ ID NO: 999242 - RNA, 13 nt, Mycobacterium avium subsp. paratuberculosis
gcccccgcccggc

SEQ ID NO: 999243 - RNA, 14 nt, Mycobacterium avium subsp. paratuberculosis
gcccccgcccggcc

SEQ ID NO: 999244 - RNA, 17 nt, Mycobacterium avium subsp. paratuberculosis
gcccccugcucagcggc

SEQ ID NO: 999245 - RNA, 22 nt, Mycobacterium avium subsp. paratuberculosis
gccccgacaucgccaucagcag

SEQ ID NO: 999246 - RNA, 13 nt, Mycobacterium avium subsp. paratuberculosis
gccccaccgccgc

SEQ ID NO: 999247 - RNA, 22 nt, Mycobacterium avium subsp. paratuberculosis
gccccacgccaugugccggcgc

SEQ ID NO: 999248 - RNA, 14 nt, Mycobacterium avium subsp. paratuberculosis
gccccacgccuggc

SEQ ID NO: 999249 - RNA, 20 nt, Mycobacterium avium subsp. paratuberculosis
gccccagaacugguccucca

SEQ ID NO: 999250 - RNA, 22 nt, Mycobacterium avium subsp. paratuberculosis
gccccagaaccgcucggcggcg

SEQ ID NO: 999251 - RNA, 23 nt, Mycobacterium avium subsp. paratuberculosis
gccccaccaccgccaccagcgca

SEQ ID NO: 999252 - RNA, 23 nt, Mycobacterium avium subsp. paratuberculosis
gccccacauugcugaugcccuug

SEQ ID NO: 999253 - RNA, 17 nt, Mycobacterium avium subsp. paratuberculosis
gccccagcccggcuggc

SEQ ID NO: 999254 - RNA, 18 nt, Mycobacterium avium subsp. paratuberculosis
gccccagcccggcuggca

SEQ ID NO: 999255 - RNA, 12 nt, Mycobacterium avium subsp. paratuberculosis
gccccagcuccu

SEQ ID NO: 999256 - RNA, 13 nt, Mycobacterium avium subsp. paratuberculosis
gccccagcuccuc

SEQ ID NO: 999257 - RNA, 20 nt, Mycobacterium avium subsp. paratuberculosis
gccccagcuccucggcccca

SEQ ID NO: 999258 - RNA, 22 nt, Mycobacterium avium subsp. paratuberculosis
gccccaggaggcacuggcgcug

SEQ ID NO: 999259 - RNA, 21 nt, Mycobacterium avium subsp. paratuberculosis
gccccaggcccgguugagugc

SEQ ID NO: 999260 - RNA, 16 nt, Mycobacterium avium subsp. paratuberculosis
gccccagccgaccagu

SEQ ID NO: 999261 - RNA, 12 nt, Mycobacterium avium subsp. paratuberculosis
gccccagcgagc

SEQ ID NO: 999262 - RNA, 14 nt, Mycobacterium avium subsp. paratuberculosis
gcccaugucgccgg

SEQ ID NO: 999263 - RNA, 17 nt, Mycobacterium avium subsp. paratuberculosis
gcccaucggcagcccgg

SEQ ID NO: 999264 - RNA, 23 nt, Mycobacterium avium subsp. paratuberculosis
gcccaucggcagcccggaggcga

SEQ ID NO: 999265 - RNA, 16 nt, Mycobacterium avium subsp. paratuberculosis
gcccaugaucacaccg

SEQ ID NO: 999266 - RNA, 13 nt, Mycobacterium avium subsp. paratuberculosis
gcccaugccgcca

SEQ ID NO: 999267 - RNA, 18 nt, Mycobacterium avium subsp. paratuberculosis
gcccagcaaacccagcac

SEQ ID NO: 999268 - RNA, 20 nt, Mycobacterium avium subsp. paratuberculosis
gcccagcaaacccagcacca

SEQ ID NO: 999269 - RNA, 15 nt, Mycobacterium avium subsp. paratuberculosis
gcccagcaccgccgg

SEQ ID NO: 999270 - RNA, 16 nt, Mycobacterium avium subsp. paratuberculosis
gcccagcaccgccggc

SEQ ID NO: 999271 - RNA, 19 nt, Mycobacterium avium subsp. paratuberculosis
gcccagcaccgccggcgcc

SEQ ID NO: 999272 - RNA, 16 nt, Mycobacterium avium subsp. paratuberculosis
gcccagcaccacuucc

SEQ ID NO: 999273 - RNA, 19 nt, Mycobacterium avium subsp. paratuberculosis
gcccagcagauagcccagc

SEQ ID NO: 999274 - RNA, 21 nt, Mycobacterium avium subsp. paratuberculosis
gcccagcagauagcccagcca

SEQ ID NO: 999275 - RNA, 23 nt, Mycobacterium avium subsp. paratuberculosis
gcccagcagauagcccagccagc

SEQ ID NO: 999276 - RNA, 19 nt, Mycobacterium avium subsp. paratuberculosis
gcccagcacccgcucgccg

SEQ ID NO: 999277 - RNA, 23 nt, Mycobacterium avium subsp. paratuberculosis
gcccagcacccgcucgccgauga

SEQ ID NO: 999278 - RNA, 19 nt, Mycobacterium avium subsp. paratuberculosis
gcccagcacgacgccgcug

SEQ ID NO: 999279 - RNA, 16 nt, Mycobacterium avium subsp. paratuberculosis
gcccacgggucgccga

SEQ ID NO: 999280 - RNA, 20 nt, Mycobacterium avium subsp. paratuberculosis
gcccacggugaggacaccac

SEQ ID NO: 999281 - RNA, 18 nt, Mycobacterium avium subsp. paratuberculosis
gcccacgugccaucgcug

SEQ ID NO: 999282 - RNA, 22 nt, Mycobacterium avium subsp. paratuberculosis
gccaugcugcccuuguugacgu

SEQ ID NO: 999283 - RNA, 14 nt, Mycobacterium avium subsp. paratuberculosis
gccaugcgccgcgc

SEQ ID NO: 999284 - RNA, 13 nt, Mycobacterium avium subsp. paratuberculosis
gcccagccggccg

SEQ ID NO: 999285 - RNA, 14 nt, Mycobacterium avium subsp. paratuberculosis
gcccagccggccga

SEQ ID NO: 999286 - RNA, 15 nt, Mycobacterium avium subsp. paratuberculosis
gcccagcgcggcggc

SEQ ID NO: 999287 - RNA, 19 nt, Mycobacterium avium subsp. paratuberculosis
gcccagcgcggcggccacc

SEQ ID NO: 999288 - RNA, 18 nt, Mycobacterium avium subsp. paratuberculosis
gcccagcgagcugccggc

SEQ ID NO: 999289 - RNA, 21 nt, Mycobacterium avium subsp. paratuberculosis
gcccagcgagcugccggcggc

SEQ ID NO: 999290 - RNA, 23 nt, Mycobacterium avium subsp. paratuberculosis
gcccagcgagcugccggcggccg

SEQ ID NO: 999291 - RNA, 13 nt, Mycobacterium avium subsp. paratuberculosis
gcccagcccggcc

SEQ ID NO: 999292 - RNA, 22 nt, Mycobacterium avium subsp. paratuberculosis
gcccagccgagccgggccaggu

SEQ ID NO: 999293 - RNA, 18 nt, Mycobacterium avium subsp. paratuberculosis
gcccagccgccagccggu

SEQ ID NO: 999294 - RNA, 14 nt, Mycobacterium avium subsp. paratuberculosis
gcccagcagcaccg

SEQ ID NO: 999295 - RNA, 19 nt, Mycobacterium avium subsp. paratuberculosis
gcccagcagcaccgcgacc

SEQ ID NO: 999296 - RNA, 20 nt, Mycobacterium avium subsp. paratuberculosis
gcccagcagcaccgcgaccg

SEQ ID NO: 999297 - RNA, 16 nt, Mycobacterium avium subsp. paratuberculosis
gcccagcccgcgggcg

SEQ ID NO: 999298 - RNA, 16 nt, Mycobacterium avium subsp. paratuberculosis
gcccaggcccagcagc

SEQ ID NO: 999299 - RNA, 17 nt, Mycobacterium avium subsp. paratuberculosis
gcccaggcccagcagca

SEQ ID NO: 999300 - RNA, 18 nt, Mycobacterium avium subsp. paratuberculosis
gcccaggcccagcagcac

SEQ ID NO: 999301 - RNA, 16 nt, Mycobacterium avium subsp. paratuberculosis
gcccaggcccaccagc

SEQ ID NO: 999302 - RNA, 23 nt, Mycobacterium avium subsp. paratuberculosis
gcccagcucggugaucugcacca

SEQ ID NO: 999303 - RNA, 20 nt, Mycobacterium avium subsp. paratuberculosis
gcccagcuccaaugcggccg

SEQ ID NO: 999304 - RNA, 22 nt, Mycobacterium avium subsp. paratuberculosis
gcccagcguggucacccgcagc

SEQ ID NO: 999305 - RNA, 12 nt, Mycobacterium avium subsp. paratuberculosis
gcccagcggggc

SEQ ID NO: 999306 - RNA, 12 nt, Mycobacterium avium subsp. paratuberculosis
gcccagcgguga

SEQ ID NO: 999307 - RNA, 20 nt, Mycobacterium avium subsp. paratuberculosis
gcccagcguagaacauccac

SEQ ID NO: 999308 - RNA, 17 nt, Mycobacterium avium subsp. paratuberculosis
gcccagcgcguugcggc

SEQ ID NO: 999309 - RNA, 18 nt, Mycobacterium avium subsp. paratuberculosis
gcccauccaggccagcac

SEQ ID NO: 999310 - RNA, 15 nt, Mycobacterium avium subsp. paratuberculosis
gcccaucagcaggac

SEQ ID NO: 999311 - RNA, 21 nt, Mycobacterium avium subsp. paratuberculosis
gcccaucagcaggaccaggcc

SEQ ID NO: 999312 - RNA, 16 nt, Mycobacterium avium subsp. paratuberculosis
gcccaucaccagcaga

SEQ ID NO: 999313 - RNA, 17 nt, Mycobacterium avium subsp. paratuberculosis
gcccaucacgccccagg

SEQ ID NO: 999314 - RNA, 16 nt, Mycobacterium avium subsp. paratuberculosis
gcccaggccggcgagc

SEQ ID NO: 999315 - RNA, 15 nt, Mycobacterium avium subsp. paratuberculosis
gcccaggccgccagc

SEQ ID NO: 999316 - RNA, 19 nt, Mycobacterium avium subsp. paratuberculosis
gcccaggccgccagcucgu

SEQ ID NO: 999317 - RNA, 18 nt, Mycobacterium avium subsp. paratuberculosis
gcccaggccgacgccggc

SEQ ID NO: 999318 - RNA, 14 nt, Mycobacterium avium subsp. paratuberculosis
gcccaggccgagcg

SEQ ID NO: 999319 - RNA, 17 nt, Mycobacterium avium subsp. paratuberculosis
gcccaggcccggcaccg

SEQ ID NO: 999320 - RNA, 16 nt, Mycobacterium avium subsp. paratuberculosis
gcccaggcgggccagc

SEQ ID NO: 999321 - RNA, 21 nt, Mycobacterium avium subsp. paratuberculosis
gcccaggcucaggaucagcag

SEQ ID NO: 999322 - RNA, 22 nt, Mycobacterium avium subsp. paratuberculosis
gcccaggcucaggaucagcagc

SEQ ID NO: 999323 - RNA, 23 nt, Mycobacterium avium subsp. paratuberculosis
gcccaggcucaggaucagcagcc

SEQ ID NO: 999324 - RNA, 22 nt, Mycobacterium avium subsp. paratuberculosis
gcccaggucgggacguccgcgc

SEQ ID NO: 999325 - RNA, 14 nt, Mycobacterium avium subsp. paratuberculosis
gcccagguccacca

SEQ ID NO: 999326 - RNA, 19 nt, Mycobacterium avium subsp. paratuberculosis
gcccaguggaucggcccga

SEQ ID NO: 999327 - RNA, 22 nt, Mycobacterium avium subsp. paratuberculosis
gcccaguggaucggcccgacgg

SEQ ID NO: 999328 - RNA, 18 nt, Mycobacterium avium subsp. paratuberculosis
gcccagguucuccggccc

SEQ ID NO: 999329 - RNA, 20 nt, Mycobacterium avium subsp. paratuberculosis
gcccagguucuccggcccgc

SEQ ID NO: 999330 - RNA, 13 nt, Mycobacterium avium subsp. paratuberculosis
gcccaguccaguc

SEQ ID NO: 999331 - RNA, 22 nt, Mycobacterium avium subsp. paratuberculosis
gcccaguccugcagcucgccgg

SEQ ID NO: 999332 - RNA, 14 nt, Mycobacterium avium subsp. paratuberculosis
gcccucccccgagu

SEQ ID NO: 999333 - RNA, 16 nt, Mycobacterium avium subsp. paratuberculosis
gcccuccgcggcgccg

SEQ ID NO: 999334 - RNA, 17 nt, Mycobacterium avium subsp. paratuberculosis
gcccucguagcggccgc

SEQ ID NO: 999335 - RNA, 21 nt, Mycobacterium avium subsp. paratuberculosis
gcccucguagcggccgcacgc

SEQ ID NO: 999336 - RNA, 23 nt, Mycobacterium avium subsp. paratuberculosis
gcccucgucgaugacguccacca

SEQ ID NO: 999337 - RNA, 19 nt, Mycobacterium avium subsp. paratuberculosis
gcccucaggcguccagcac

SEQ ID NO: 999338 - RNA, 21 nt, Mycobacterium avium subsp. paratuberculosis
gcccucaggcguccagcaccu

SEQ ID NO: 999339 - RNA, 15 nt, Mycobacterium avium subsp. paratuberculosis
gcccuccagcugguu

SEQ ID NO: 999340 - RNA, 22 nt, Mycobacterium avium subsp. paratuberculosis
gcccguuguggcggccagcgag

SEQ ID NO: 999341 - RNA, 15 nt, Mycobacterium avium subsp. paratuberculosis
gcccgucgagcguca

SEQ ID NO: 999342 - RNA, 19 nt, Mycobacterium avium subsp. paratuberculosis
gcccgucgagcgucauucc

SEQ ID NO: 999343 - RNA, 21 nt, Mycobacterium avium subsp. paratuberculosis
gcccgucgagcgucauuccgc

SEQ ID NO: 999344 - RNA, 21 nt, Mycobacterium avium subsp. paratuberculosis
gcccgucccggcccauggcga

SEQ ID NO: 999345 - RNA, 13 nt, Mycobacterium avium subsp. paratuberculosis
gcccguccgcccc

SEQ ID NO: 999346 - RNA, 18 nt, Mycobacterium avium subsp. paratuberculosis
gcccguccgccccgcugc

SEQ ID NO: 999347 - RNA, 17 nt, Mycobacterium avium subsp. paratuberculosis
gcccguccccaccaccg

SEQ ID NO: 999348 - RNA, 22 nt, Mycobacterium avium subsp. paratuberculosis
gcccguccgggccggccagacc

SEQ ID NO: 999349 - RNA, 15 nt, Mycobacterium avium subsp. paratuberculosis
gcccgucgccaccac

SEQ ID NO: 999350 - RNA, 17 nt, Mycobacterium avium subsp. paratuberculosis
gcccgucgccaccacgg

SEQ ID NO: 999351 - RNA, 18 nt, Mycobacterium avium subsp. paratuberculosis
gcccgucgccaccacggc

SEQ ID NO: 999352 - RNA, 23 nt, Mycobacterium avium subsp. paratuberculosis
gcccgucgccuccugcuggcgcu

SEQ ID NO: 999353 - RNA, 16 nt, Mycobacterium avium subsp. paratuberculosis
gcccgugucgcggccu

SEQ ID NO: 999354 - RNA, 22 nt, Mycobacterium avium subsp. paratuberculosis
gcccugaagcugggcgcccaga

SEQ ID NO: 999355 - RNA, 17 nt, Mycobacterium avium subsp. paratuberculosis
gcccugacacagcaccg

SEQ ID NO: 999356 - RNA, 14 nt, Mycobacterium avium subsp. paratuberculosis
gcccugcccgucgg

SEQ ID NO: 999357 - RNA, 17 nt, Mycobacterium avium subsp. paratuberculosis
gcccugcgccagcagca

SEQ ID NO: 999358 - RNA, 24 nt, Mycobacterium avium subsp. paratuberculosis
gcccugcgccagcagcagcgcggc

SEQ ID NO: 999359 - RNA, 14 nt, Mycobacterium avium subsp. paratuberculosis
gcccugcgcggccu

SEQ ID NO: 999360 - RNA, 21 nt, Mycobacterium avium subsp. paratuberculosis
gcccugcucggccagcgggug

SEQ ID NO: 999361 - RNA, 14 nt, Mycobacterium avium subsp. paratuberculosis
gcccugcucgguga

SEQ ID NO: 999362 - RNA, 17 nt, Mycobacterium avium subsp. paratuberculosis
gcccugcucggugaugc

SEQ ID NO: 999363 - RNA, 17 nt, Mycobacterium avium subsp. paratuberculosis
gcccugcgucaucggcu

SEQ ID NO: 999364 - RNA, 19 nt, Mycobacterium avium subsp. paratuberculosis
gcccuggcgggcggcccgc

SEQ ID NO: 999365 - RNA, 18 nt, Mycobacterium avium subsp. paratuberculosis
gcccgcguaaccggcggc

SEQ ID NO: 999366 - RNA, 20 nt, Mycobacterium avium subsp. paratuberculosis
gcccgcgucguguccgggcc

SEQ ID NO: 999367 - RNA, 22 nt, Mycobacterium avium subsp. paratuberculosis
gcccgcgucguguccgggcccg

SEQ ID NO: 999368 - RNA, 23 nt, Mycobacterium avium subsp. paratuberculosis
gcccgcgucguguccgggcccga

SEQ ID NO: 999369 - RNA, 22 nt, Mycobacterium avium subsp. paratuberculosis
gcccgcuccgcgggcagcgagc

SEQ ID NO: 999370 - RNA, 16 nt, Mycobacterium avium subsp. paratuberculosis
gcccgcuccgcggugc

SEQ ID NO: 999371 - RNA, 16 nt, Mycobacterium avium subsp. paratuberculosis
gcccgcucgaugggug

SEQ ID NO: 999372 - RNA, 12 nt, Mycobacterium avium subsp. paratuberculosis
gcccggccggcc

SEQ ID NO: 999373 - RNA, 14 nt, Mycobacterium avium subsp. paratuberculosis
gcccggccggcccc

SEQ ID NO: 999374 - RNA, 14 nt, Mycobacterium avium subsp. paratuberculosis
gcccggccgccagc

SEQ ID NO: 999375 - RNA, 22 nt, Mycobacterium avium subsp. paratuberculosis
gcccggcccaagacccgcguca

SEQ ID NO: 999376 - RNA, 13 nt, Mycobacterium avium subsp. paratuberculosis
gcccggcccagcc

SEQ ID NO: 999377 - RNA, 14 nt, Mycobacterium avium subsp. paratuberculosis
gcccggcccagccg

SEQ ID NO: 999378 - RNA, 18 nt, Mycobacterium avium subsp. paratuberculosis
gcccggcccaggcacagc

SEQ ID NO: 999379 - RNA, 16 nt, Mycobacterium avium subsp. paratuberculosis
gcccggcccgcaugca

SEQ ID NO: 999380 - RNA, 16 nt, Mycobacterium avium subsp. paratuberculosis
gcccggcccgccgcug

SEQ ID NO: 999381 - RNA, 17 nt, Mycobacterium avium subsp. paratuberculosis
gcccggcccgccgcugc

SEQ ID NO: 999382 - RNA, 16 nt, Mycobacterium avium subsp. paratuberculosis
gcccggcccgcuggcc

SEQ ID NO: 999383 - RNA, 17 nt, Mycobacterium avium subsp. paratuberculosis
gcccggcccggcgcggc

SEQ ID NO: 999384 - RNA, 19 nt, Mycobacterium avium subsp. paratuberculosis
gcccgcugcagcgccgagg

SEQ ID NO: 999385 - RNA, 14 nt, Mycobacterium avium subsp. paratuberculosis
gcccgcugaccagg

SEQ ID NO: 999386 - RNA, 16 nt, Mycobacterium avium subsp. paratuberculosis
gcccgcugcgcggccg

SEQ ID NO: 999387 - RNA, 17 nt, Mycobacterium avium subsp. paratuberculosis
gcccgcugcgcggccga

SEQ ID NO: 999388 - RNA, 13 nt, Mycobacterium avium subsp. paratuberculosis
gcccgcugcgcgg

SEQ ID NO: 999389 - RNA, 15 nt, Mycobacterium avium subsp. paratuberculosis
gcccgcuggggcgca

SEQ ID NO: 999390 - RNA, 18 nt, Mycobacterium avium subsp. paratuberculosis
gcccgcuggggcgcaccg

SEQ ID NO: 999391 - RNA, 14 nt, Mycobacterium avium subsp. paratuberculosis
gcccgcuguggucc

SEQ ID NO: 999392 - RNA, 17 nt, Mycobacterium avium subsp. paratuberculosis
gcccggccagccgggcg

SEQ ID NO: 999393 - RNA, 11 nt, Mycobacterium avium subsp. paratuberculosis
gcccggccagu

SEQ ID NO: 999394 - RNA, 22 nt, Mycobacterium avium subsp. paratuberculosis
gcccggccaguccggcagcagc

SEQ ID NO: 999395 - RNA, 17 nt, Mycobacterium avium subsp. paratuberculosis
gcccggcgugggccgca

SEQ ID NO: 999396 - RNA, 17 nt, Mycobacterium avium subsp. paratuberculosis
gcccggcguuccagcgc

SEQ ID NO: 999397 - RNA, 18 nt, Mycobacterium avium subsp. paratuberculosis
gcccggcguuccagcgca

SEQ ID NO: 999398 - RNA, 14 nt, Mycobacterium avium subsp. paratuberculosis
gcccgggccaggcg

SEQ ID NO: 999399 - RNA, 17 nt, Mycobacterium avium subsp. paratuberculosis
gcccgggccaggcgcgc

SEQ ID NO: 999400 - RNA, 15 nt, Mycobacterium avium subsp. paratuberculosis
gcccgggccgcagcu

SEQ ID NO: 999401 - RNA, 22 nt, Mycobacterium avium subsp. paratuberculosis
gcccggcuacucggacgccggc

SEQ ID NO: 999402 - RNA, 19 nt, Mycobacterium avium subsp. paratuberculosis
gcccggcuaauucgggccg

SEQ ID NO: 999403 - RNA, 23 nt, Mycobacterium avium subsp. paratuberculosis
gcccggcuaauucgggccgccgc

SEQ ID NO: 999404 - RNA, 15 nt, Mycobacterium avium subsp. paratuberculosis
gcccggcggccggcc

SEQ ID NO: 999405 - RNA, 17 nt, Mycobacterium avium subsp. paratuberculosis
gcccggcggccggccgc

SEQ ID NO: 999406 - RNA, 12 nt, Mycobacterium avium subsp. paratuberculosis
gcccggcggcca

SEQ ID NO: 999407 - RNA, 16 nt, Mycobacterium avium subsp. paratuberculosis
gcccggcgcugcgccc

SEQ ID NO: 999408 - RNA, 15 nt, Mycobacterium avium subsp. paratuberculosis
gcccggccgcggccc

SEQ ID NO: 999409 - RNA, 17 nt, Mycobacterium avium subsp. paratuberculosis
gcccguagucggcggcg

SEQ ID NO: 999410 - RNA, 17 nt, Mycobacterium avium subsp. paratuberculosis
gcccgucacgcuggcgu

SEQ ID NO: 999411 - RNA, 15 nt, Mycobacterium avium subsp. paratuberculosis
gcccguagcggcgga

SEQ ID NO: 999412 - RNA, 22 nt, Mycobacterium avium subsp. paratuberculosis
gcccgggugacaacgguggugg

SEQ ID NO: 999413 - RNA, 18 nt, Mycobacterium avium subsp. paratuberculosis
gcccguagacccacagcu

SEQ ID NO: 999414 - RNA, 19 nt, Mycobacterium avium subsp. paratuberculosis
gcccguagacccacagcug

SEQ ID NO: 999415 - RNA, 21 nt, Mycobacterium avium subsp. paratuberculosis
gcccguagaugcggcccagcc

SEQ ID NO: 999416 - RNA, 14 nt, Mycobacterium avium subsp. paratuberculosis
gcccguccagcgca

SEQ ID NO: 999417 - RNA, 17 nt, Mycobacterium avium subsp. paratuberculosis
gcccgucccgccgacgg

SEQ ID NO: 999418 - RNA, 18 nt, Mycobacterium avium subsp. paratuberculosis
gcccggggacacccucgg

SEQ ID NO: 999419 - RNA, 15 nt, Mycobacterium avium subsp. paratuberculosis
gcccgggcggcccgc

SEQ ID NO: 999420 - RNA, 17 nt, Mycobacterium avium subsp. paratuberculosis
gcccgggcugcagcagc

SEQ ID NO: 999421 - RNA, 16 nt, Mycobacterium avium subsp. paratuberculosis
gcccgggcugcccggg

SEQ ID NO: 999422 - RNA, 17 nt, Mycobacterium avium subsp. paratuberculosis
gcccgggccggaggugc

SEQ ID NO: 999423 - RNA, 17 nt, Mycobacterium avium subsp. paratuberculosis
gcccggggcgcggaccg

SEQ ID NO: 999424 - RNA, 20 nt, Mycobacterium avium subsp. paratuberculosis
gcccggggcgcggaccgcac

SEQ ID NO: 999425 - RNA, 13 nt, Mycobacterium avium subsp. paratuberculosis
gcccggggugugc

SEQ ID NO: 999426 - RNA, 16 nt, Mycobacterium avium subsp. paratuberculosis
gcccggguagcgcagc

SEQ ID NO: 999427 - RNA, 22 nt, Mycobacterium avium subsp. paratuberculosis
gcccgggucuagaucuccaggc

SEQ ID NO: 999428 - RNA, 17 nt, Mycobacterium avium subsp. paratuberculosis
gcccgggugauggucuc

SEQ ID NO: 999429 - RNA, 16 nt, Mycobacterium avium subsp. paratuberculosis
gcccgggugcaggccc

SEQ ID NO: 999430 - RNA, 16 nt, Mycobacterium avium subsp. paratuberculosis
gcccggguugcacagg

SEQ ID NO: 999431 - RNA, 22 nt, Mycobacterium avium subsp. paratuberculosis
gcccgcgacugucggcgccccg

SEQ ID NO: 999432 - RNA, 22 nt, Mycobacterium avium subsp. paratuberculosis
gcccgcgaucaacaccgguccg

SEQ ID NO: 999433 - RNA, 16 nt, Mycobacterium avium subsp. paratuberculosis
gcccgccgcggcgagc

SEQ ID NO: 999434 - RNA, 16 nt, Mycobacterium avium subsp. paratuberculosis
gcccgcgaacacgcga

SEQ ID NO: 999435 - RNA, 18 nt, Mycobacterium avium subsp. paratuberculosis
gcccgccuuugagcgaca

SEQ ID NO: 999436 - RNA, 12 nt, Mycobacterium avium subsp. paratuberculosis
gcccgcgcaggc

SEQ ID NO: 999437 - RNA, 15 nt, Mycobacterium avium subsp. paratuberculosis
gcccgcgccgacggc

SEQ ID NO: 999438 - RNA, 20 nt, Mycobacterium avium subsp. paratuberculosis
gcccgcgccgacggccgcgc

SEQ ID NO: 999439 - RNA, 16 nt, Mycobacterium avium subsp. paratuberculosis
gcccgcguccugcagc

SEQ ID NO: 999440 - RNA, 13 nt, Mycobacterium avium subsp. paratuberculosis
gcccgcguccagc

SEQ ID NO: 999441 - RNA, 21 nt, Mycobacterium avium subsp. paratuberculosis
gcccgcggugugcuggccagc

SEQ ID NO: 999442 - RNA, 22 nt, Mycobacterium avium subsp. paratuberculosis
gcccgcggugugcuggccagca

SEQ ID NO: 999443 - RNA, 12 nt, Mycobacterium avium subsp. paratuberculosis
gcccgccgccgg

SEQ ID NO: 999444 - RNA, 13 nt, Mycobacterium avium subsp. paratuberculosis
gcccgccgccggc

SEQ ID NO: 999445 - RNA, 14 nt, Mycobacterium avium subsp. paratuberculosis
gcccgccgccacca

SEQ ID NO: 999446 - RNA, 13 nt, Mycobacterium avium subsp. paratuberculosis
gcccgccgcgacc

SEQ ID NO: 999447 - RNA, 16 nt, Mycobacterium avium subsp. paratuberculosis
gcccgccgcggccgcu

SEQ ID NO: 999448 - RNA, 20 nt, Mycobacterium avium subsp. paratuberculosis
gcccgccgcggcgagccggc

SEQ ID NO: 999449 - RNA, 14 nt, Mycobacterium avium subsp. paratuberculosis
gcccgccgcguaca

SEQ ID NO: 999450 - RNA, 19 nt, Mycobacterium avium subsp. paratuberculosis
gcccgccgcguacaccggc

SEQ ID NO: 999451 - RNA, 19 nt, Mycobacterium avium subsp. paratuberculosis
gcccgccgcucaccgccga

SEQ ID NO: 999452 - RNA, 13 nt, Mycobacterium avium subsp. paratuberculosis
gcccgccgcugca

SEQ ID NO: 999453 - RNA, 19 nt, Mycobacterium avium subsp. paratuberculosis
gcccgccggaacucggccg

SEQ ID NO: 999454 - RNA, 14 nt, Mycobacterium avium subsp. paratuberculosis
gcccgccggagccg

SEQ ID NO: 999455 - RNA, 21 nt, Mycobacterium avium subsp. paratuberculosis
gcccgccgaaccagaucggcg

SEQ ID NO: 999456 - RNA, 19 nt, Mycobacterium avium subsp. paratuberculosis
gcccgccgaacgccuccgc

SEQ ID NO: 999457 - RNA, 21 nt, Mycobacterium avium subsp. paratuberculosis
gcccgccgaccaccuugcgca

SEQ ID NO: 999458 - RNA, 23 nt, Mycobacterium avium subsp. paratuberculosis
gcccgccgaccaccuugcgcagc

SEQ ID NO: 999459 - RNA, 18 nt, Mycobacterium avium subsp. paratuberculosis
gcccgccgacgcccaggc

SEQ ID NO: 999460 - RNA, 20 nt, Mycobacterium avium subsp. paratuberculosis
gcccgccgaucgaucagccg

SEQ ID NO: 999461 - RNA, 21 nt, Mycobacterium avium subsp. paratuberculosis
gcccgccgaucgaucagccgc

SEQ ID NO: 999462 - RNA, 23 nt, Mycobacterium avium subsp. paratuberculosis
gcccgccgauggacacgcugccg

SEQ ID NO: 999463 - RNA, 19 nt, Mycobacterium avium subsp. paratuberculosis
gcccgcauguucucgagcc

SEQ ID NO: 999464 - RNA, 15 nt, Mycobacterium avium subsp. paratuberculosis
gcccgcaucgcggcg

SEQ ID NO: 999465 - RNA, 14 nt, Mycobacterium avium subsp. paratuberculosis
gcccgcaugcaccg

SEQ ID NO: 999466 - RNA, 20 nt, Mycobacterium avium subsp. paratuberculosis
gcccgccacgugcggcugcg

SEQ ID NO: 999467 - RNA, 16 nt, Mycobacterium avium subsp. paratuberculosis
gcccgccacccgaggc

SEQ ID NO: 999468 - RNA, 22 nt, Mycobacterium avium subsp. paratuberculosis
gcccgccacccgaggccguuca

SEQ ID NO: 999469 - RNA, 20 nt, Mycobacterium avium subsp. paratuberculosis
gcccgcaggaucgagccggc

SEQ ID NO: 999470 - RNA, 22 nt, Mycobacterium avium subsp. paratuberculosis
gcccgcaggaucgagccggccg

SEQ ID NO: 999471 - RNA, 23 nt, Mycobacterium avium subsp. paratuberculosis
gcccgcaggaucgagccggccgu

SEQ ID NO: 999472 - RNA, 18 nt, Mycobacterium avium subsp. paratuberculosis
gcccgcaguucggccgcc

SEQ ID NO: 999473 - RNA, 17 nt, Mycobacterium avium subsp. paratuberculosis
gcccgcacuggucgugc

SEQ ID NO: 999474 - RNA, 18 nt, Mycobacterium avium subsp. paratuberculosis
gcccgcaccagcaggucc

SEQ ID NO: 999475 - RNA, 15 nt, Mycobacterium avium subsp. paratuberculosis
gcccgcacccgccgc

SEQ ID NO: 999476 - RNA, 22 nt, Mycobacterium avium subsp. paratuberculosis
gcccgacgggcgugccggcggc

SEQ ID NO: 999477 - RNA, 15 nt, Mycobacterium avium subsp. paratuberculosis
gcccgacggcagcac

SEQ ID NO: 999478 - RNA, 15 nt, Mycobacterium avium subsp. paratuberculosis
gcccgacuccucaca

SEQ ID NO: 999479 - RNA, 20 nt, Mycobacterium avium subsp. paratuberculosis
gcccgacuccucacaccucg

SEQ ID NO: 999480 - RNA, 18 nt, Mycobacterium avium subsp. paratuberculosis
gcccgcaccugcgcgccg

SEQ ID NO: 999481 - RNA, 13 nt, Mycobacterium avium subsp. paratuberculosis
gcccgcaccaccc

SEQ ID NO: 999482 - RNA, 21 nt, Mycobacterium avium subsp. paratuberculosis
gcccgcaccacccagcccuug

SEQ ID NO: 999483 - RNA, 16 nt, Mycobacterium avium subsp. paratuberculosis
gcccgagcccgacggc

SEQ ID NO: 999484 - RNA, 19 nt, Mycobacterium avium subsp. paratuberculosis
gcccgagcccugcgccagc

SEQ ID NO: 999485 - RNA, 22 nt, Mycobacterium avium subsp. paratuberculosis
gccccgccgggaucggcggggc

SEQ ID NO: 999486 - RNA, 13 nt, Mycobacterium avium subsp. paratuberculosis
gccccgccgcggc

SEQ ID NO: 999487 - RNA, 18 nt, Mycobacterium avium subsp. paratuberculosis
gccccgccgcggccaggu

SEQ ID NO: 999488 - RNA, 22 nt, Mycobacterium avium subsp. paratuberculosis
gccccgcgacacgccgcgcauc

SEQ ID NO: 999489 - RNA, 16 nt, Mycobacterium avium subsp. paratuberculosis
gccccgcgaccgcagc

SEQ ID NO: 999490 - RNA, 20 nt, Mycobacterium avium subsp. paratuberculosis
gccccgcgaccgcagcaggc

SEQ ID NO: 999491 - RNA, 16 nt, Mycobacterium avium subsp. paratuberculosis
gccccgcuccuccucg

SEQ ID NO: 999492 - RNA, 21 nt, Mycobacterium avium subsp. paratuberculosis
gccccgcgugacggccgcggc

SEQ ID NO: 999493 - RNA, 22 nt, Mycobacterium avium subsp. paratuberculosis
gccccgcuaaagccgacugccc

SEQ ID NO: 999494 - RNA, 21 nt, Mycobacterium avium subsp. paratuberculosis
gccccgcugccguccggcggc

SEQ ID NO: 999495 - RNA, 18 nt, Mycobacterium avium subsp. paratuberculosis
gccccgcuggaacgccga

SEQ ID NO: 999496 - RNA, 14 nt, Mycobacterium avium subsp. paratuberculosis
gccccggccgcgca

SEQ ID NO: 999497 - RNA, 16 nt, Mycobacterium avium subsp. paratuberculosis
gccccggccgggcgac

SEQ ID NO: 999498 - RNA, 12 nt, Mycobacterium avium subsp. paratuberculosis
gccccggcgcgc

SEQ ID NO: 999499 - RNA, 14 nt, Mycobacterium avium subsp. paratuberculosis
gccccggcgacggc

SEQ ID NO: 999500 - RNA, 20 nt, Mycobacterium avium subsp. paratuberculosis
gccccggcgacgucgccggc

SEQ ID NO: 999501 - RNA, 23 nt, Mycobacterium avium subsp. paratuberculosis
gccccggcgacgucgccggccug

SEQ ID NO: 999502 - RNA, 13 nt, Mycobacterium avium subsp. paratuberculosis
gccccggcgcagc

SEQ ID NO: 999503 - RNA, 16 nt, Mycobacterium avium subsp. paratuberculosis
gccccggcggccacgc

SEQ ID NO: 999504 - RNA, 20 nt, Mycobacterium avium subsp. paratuberculosis
gccccggcggccacgcaggc

SEQ ID NO: 999505 - RNA, 18 nt, Mycobacterium avium subsp. paratuberculosis
gccccggcgcgccugcgc

SEQ ID NO: 999506 - RNA, 14 nt, Mycobacterium avium subsp. paratuberculosis
gccccggaccggag

SEQ ID NO: 999507 - RNA, 14 nt, Mycobacterium avium subsp. paratuberculosis
gccccggcccgucc

SEQ ID NO: 999508 - RNA, 18 nt, Mycobacterium avium subsp. paratuberculosis
gccccggccgagcgcagc

SEQ ID NO: 999509 - RNA, 19 nt, Mycobacterium avium subsp. paratuberculosis
gccccggccgagcgcagcg

SEQ ID NO: 999510 - RNA, 19 nt, Mycobacterium avium subsp. paratuberculosis
gccccuucgaugucgccgg

SEQ ID NO: 999511 - RNA, 22 nt, Mycobacterium avium subsp. paratuberculosis
gccccuucgaugucgccggcga

SEQ ID NO: 999512 - RNA, 15 nt, Mycobacterium avium subsp. paratuberculosis
gccccuuaccggccg

SEQ ID NO: 999513 - RNA, 13 nt, Mycobacterium avium subsp. paratuberculosis
gcccgacauccag

SEQ ID NO: 999514 - RNA, 21 nt, Mycobacterium avium subsp. paratuberculosis
gcccgacauccaggaccgcgc

SEQ ID NO: 999515 - RNA, 24 nt, Mycobacterium avium subsp. paratuberculosis
gcccgaccaccuccccgcggugcc

SEQ ID NO: 999516 - RNA, 15 nt, Mycobacterium avium subsp. paratuberculosis
gcccgaccagcgggc

SEQ ID NO: 999517 - RNA, 18 nt, Mycobacterium avium subsp. paratuberculosis
gcccgacccgcaccaccg

SEQ ID NO: 999518 - RNA, 16 nt, Mycobacterium avium subsp. paratuberculosis
gccccgguagccagca

SEQ ID NO: 999519 - RNA, 17 nt, Mycobacterium avium subsp. paratuberculosis
gccccgguagccagcac

SEQ ID NO: 999520 - RNA, 23 nt, Mycobacterium avium subsp. paratuberculosis
gccccgguagccagcaccgcccc

SEQ ID NO: 999521 - RNA, 14 nt, Mycobacterium avium subsp. paratuberculosis
gccccgggggacca

SEQ ID NO: 999522 - RNA, 22 nt, Mycobacterium avium subsp. paratuberculosis
gccccgggggaccagcgcaacc

SEQ ID NO: 999523 - RNA, 21 nt, Mycobacterium avium subsp. paratuberculosis
gccccgggaaccagcccaggu

SEQ ID NO: 999524 - RNA, 12 nt, Mycobacterium avium subsp. paratuberculosis
gccccgggccgc

SEQ ID NO: 999525 - RNA, 16 nt, Mycobacterium avium subsp. paratuberculosis
gccccgggcgcuggcg

SEQ ID NO: 999526 - RNA, 17 nt, Mycobacterium avium subsp. paratuberculosis
gccccggcgggcggccg

SEQ ID NO: 999527 - RNA, 15 nt, Mycobacterium avium subsp. paratuberculosis
gccccggcucgggcc

SEQ ID NO: 999528 - RNA, 21 nt, Mycobacterium avium subsp. paratuberculosis
uagaaccaacgcggcgccggu

SEQ ID NO: 999529 - RNA, 20 nt, Mycobacterium avium subsp. paratuberculosis
uagauaagcggauugaccag

SEQ ID NO: 999530 - RNA, 19 nt, Mycobacterium avium subsp. paratuberculosis
uagagccgcugcacgcguu

SEQ ID NO: 999531 - RNA, 24 nt, Mycobacterium avium subsp. paratuberculosis
uagagccgcugcacgcguugcagc

SEQ ID NO: 999532 - RNA, 17 nt, Mycobacterium avium subsp. paratuberculosis
uagagcgggauccccac

SEQ ID NO: 999533 - RNA, 13 nt, Mycobacterium avium subsp. paratuberculosis
uagacguucuccc

SEQ ID NO: 999534 - RNA, 14 nt, Mycobacterium avium subsp. paratuberculosis
uagacggcaugccg

SEQ ID NO: 999535 - RNA, 21 nt, Mycobacterium avium subsp. paratuberculosis
uagacggcaugccgggccagc

SEQ ID NO: 999536 - RNA, 13 nt, Mycobacterium avium subsp. paratuberculosis
uagacccacagcu

SEQ ID NO: 999537 - RNA, 19 nt, Mycobacterium avium subsp. paratuberculosis
uagacgacgggcaggguga

SEQ ID NO: 999538 - RNA, 23 nt, Mycobacterium avium subsp. paratuberculosis
uagacgacgucgaccgcgccggg

SEQ ID NO: 999539 - RNA, 22 nt, Mycobacterium avium subsp. paratuberculosis
uagacagcguggucgcgcagca

SEQ ID NO: 999540 - RNA, 14 nt, Mycobacterium avium subsp. paratuberculosis
uagggguccuccag

SEQ ID NO: 999541 - RNA, 15 nt, Mycobacterium avium subsp. paratuberculosis
uaggcggccagcucc

SEQ ID NO: 999542 - RNA, 16 nt, Mycobacterium avium subsp. paratuberculosis
uagggacugcgccggg

SEQ ID NO: 999543 - RNA, 19 nt, Mycobacterium avium subsp. paratuberculosis
uagggcaacacgaccagga

SEQ ID NO: 999544 - RNA, 21 nt, Mycobacterium avium subsp. paratuberculosis
uagggccaccacgccagccuc

SEQ ID NO: 999545 - RNA, 15 nt, Mycobacterium avium subsp. paratuberculosis
uaggccucguggaac

SEQ ID NO: 999546 - RNA, 15 nt, Mycobacterium avium subsp. paratuberculosis
uaggcgaucgggaac

SEQ ID NO: 999547 - RNA, 21 nt, Mycobacterium avium subsp. paratuberculosis
uaggcgaaauaacccaccccg

SEQ ID NO: 999548 - RNA, 14 nt, Mycobacterium avium subsp. paratuberculosis
uagcugagcagcag

SEQ ID NO: 999549 - RNA, 15 nt, Mycobacterium avium subsp. paratuberculosis
uagcucgccgcggcc

SEQ ID NO: 999550 - RNA, 18 nt, Mycobacterium avium subsp. paratuberculosis
uagcucgccgcggccacg

SEQ ID NO: 999551 - RNA, 16 nt, Mycobacterium avium subsp. paratuberculosis
uagcgaggugugagga

SEQ ID NO: 999552 - RNA, 17 nt, Mycobacterium avium subsp. paratuberculosis
uagcgaggugugaggag

SEQ ID NO: 999553 - RNA, 12 nt, Mycobacterium avium subsp. paratuberculosis
uagcguggguuc

SEQ ID NO: 999554 - RNA, 22 nt, Mycobacterium avium subsp. paratuberculosis
uagcguugccggccgaagugcu

SEQ ID NO: 999555 - RNA, 22 nt, Mycobacterium avium subsp. paratuberculosis
uagaucgccggaucgagcaccc

SEQ ID NO: 999556 - RNA, 19 nt, Mycobacterium avium subsp. paratuberculosis
uagaucagcaggcccucgg

SEQ ID NO: 999557 - RNA, 20 nt, Mycobacterium avium subsp. paratuberculosis
uagccgucgaaacggcugcu

SEQ ID NO: 999558 - RNA, 19 nt, Mycobacterium avium subsp. paratuberculosis
uagccgucggcggagguca

SEQ ID NO: 999559 - RNA, 19 nt, Mycobacterium avium subsp. paratuberculosis
uagccgguauccauccgcc

SEQ ID NO: 999560 - RNA, 19 nt, Mycobacterium avium subsp. paratuberculosis
uagccggggacggugcagc

SEQ ID NO: 999561 - RNA, 17 nt, Mycobacterium avium subsp. paratuberculosis
uagccgguccuggccaa

SEQ ID NO: 999562 - RNA, 20 nt, Mycobacterium avium subsp. paratuberculosis
uagccgcucgcccagcgcgg

SEQ ID NO: 999563 - RNA, 13 nt, Mycobacterium avium subsp. paratuberculosis
uagccgccgggcg

SEQ ID NO: 999564 - RNA, 19 nt, Mycobacterium avium subsp. paratuberculosis
uagccggcccgcagccagc

SEQ ID NO: 999565 - RNA, 19 nt, Mycobacterium avium subsp. paratuberculosis
uaucgagguaggccaccgg

SEQ ID NO: 999566 - RNA, 21 nt, Mycobacterium avium subsp. paratuberculosis
uaucccgauuuuuuccgcucu

SEQ ID NO: 999567 - RNA, 15 nt, Mycobacterium avium subsp. paratuberculosis
uauaggugagaaaag

SEQ ID NO: 999568 - RNA, 15 nt, Mycobacterium avium subsp. paratuberculosis
uauacacgccuggac

SEQ ID NO: 999569 - RNA, 13 nt, Mycobacterium avium subsp. paratuberculosis
uaggucaucagcg

SEQ ID NO: 999570 - RNA, 17 nt, Mycobacterium avium subsp. paratuberculosis
uaggucaacccgcucag

SEQ ID NO: 999571 - RNA, 21 nt, Mycobacterium avium subsp. paratuberculosis
uacgcgacgaaccgccacacg

SEQ ID NO: 999572 - RNA, 15 nt, Mycobacterium avium subsp. paratuberculosis
uacgccucaccccag

SEQ ID NO: 999573 - RNA, 16 nt, Mycobacterium avium subsp. paratuberculosis
uacgacguccgggccg

SEQ ID NO: 999574 - RNA, 20 nt, Mycobacterium avium subsp. paratuberculosis
uaccaucaacccgagcaccg

SEQ ID NO: 999575 - RNA, 16 nt, Mycobacterium avium subsp. paratuberculosis
uacccguccagcgcga

SEQ ID NO: 999576 - RNA, 13 nt, Mycobacterium avium subsp. paratuberculosis
uacccgcgcggcg

SEQ ID NO: 999577 - RNA, 19 nt, Mycobacterium avium subsp. paratuberculosis
uacccggcgaaccgggaca

SEQ ID NO: 999578 - RNA, 18 nt, Mycobacterium avium subsp. paratuberculosis
uacccgcgauggcacaca

SEQ ID NO: 999579 - RNA, 19 nt, Mycobacterium avium subsp. paratuberculosis
uacccgcgauggcacacag

SEQ ID NO: 999580 - RNA, 18 nt, Mycobacterium avium subsp. paratuberculosis
uaccggcagcaggugcac

SEQ ID NO: 999581 - RNA, 17 nt, Mycobacterium avium subsp. paratuberculosis
uaccggccggcgcggcg

SEQ ID NO: 999582 - RNA, 15 nt, Mycobacterium avium subsp. paratuberculosis
uacaucguucccugc

SEQ ID NO: 999583 - RNA, 12 nt, Mycobacterium avium subsp. paratuberculosis
uacagcggcgcg

SEQ ID NO: 999584 - RNA, 15 nt, Mycobacterium avium subsp. paratuberculosis
uacagcgacuccagc

SEQ ID NO: 999585 - RNA, 12 nt, Mycobacterium avium subsp. paratuberculosis
uaaggccgaggc

SEQ ID NO: 999586 - RNA, 20 nt, Mycobacterium avium subsp. paratuberculosis
uaaggccgaggcgagugagg

SEQ ID NO: 999587 - RNA, 21 nt, Mycobacterium avium subsp. paratuberculosis
uaaggcgaauaaggggguaga

SEQ ID NO: 999588 - RNA, 19 nt, Mycobacterium avium subsp. paratuberculosis
uaaccucggcggcggcgcg

SEQ ID NO: 999589 - RNA, 14 nt, Mycobacterium avium subsp. paratuberculosis
guuugaggcccacg

SEQ ID NO: 999590 - RNA, 23 nt, Mycobacterium avium subsp. paratuberculosis
guugucagccacucgccgugaga

SEQ ID NO: 999591 - RNA, 18 nt, Mycobacterium avium subsp. paratuberculosis
guuguagcaggcgguggu

SEQ ID NO: 999592 - RNA, 17 nt, Mycobacterium avium subsp. paratuberculosis
guuguaguagaccuuga

SEQ ID NO: 999593 - RNA, 21 nt, Mycobacterium avium subsp. paratuberculosis
guuucgaacugggucugccgc

SEQ ID NO: 999594 - RNA, 14 nt, Mycobacterium avium subsp. paratuberculosis
guuucgaagacgcc

SEQ ID NO: 999595 - RNA, 13 nt, Mycobacterium avium subsp. paratuberculosis
guuuccuggugca

SEQ ID NO: 999596 - RNA, 20 nt, Mycobacterium avium subsp. paratuberculosis
guuuccuggugcaccaggua

SEQ ID NO: 999597 - RNA, 14 nt, Mycobacterium avium subsp. paratuberculosis
guuuccccagcccg

SEQ ID NO: 999598 - RNA, 19 nt, Mycobacterium avium subsp. paratuberculosis
guuggugaucagccccgcc

SEQ ID NO: 999599 - RNA, 15 nt, Mycobacterium avium subsp. paratuberculosis
guuggugcgguguca

SEQ ID NO: 999600 - RNA, 15 nt, Mycobacterium avium subsp. paratuberculosis
guuggugcugggcac

SEQ ID NO: 999601 - RNA, 22 nt, Mycobacterium avium subsp. paratuberculosis
guugggggucgacugggccagg

SEQ ID NO: 999602 - RNA, 14 nt, Mycobacterium avium subsp. paratuberculosis
guugggccaggccu

SEQ ID NO: 999603 - RNA, 15 nt, Mycobacterium avium subsp. paratuberculosis
guugggcgccagcag

SEQ ID NO: 999604 - RNA, 17 nt, Mycobacterium avium subsp. paratuberculosis
guugggcgccagcagca

SEQ ID NO: 999605 - RNA, 18 nt, Mycobacterium avium subsp. paratuberculosis
guuggcggccagcgcgcc

SEQ ID NO: 999606 - RNA, 16 nt, Mycobacterium avium subsp. paratuberculosis
guuggcgcgcaccagc

SEQ ID NO: 999607 - RNA, 18 nt, Mycobacterium avium subsp. paratuberculosis
guuggcgaucagggcggc

SEQ ID NO: 999608 - RNA, 18 nt, Mycobacterium avium subsp. paratuberculosis
guuggccagcgccuccag

SEQ ID NO: 999609 - RNA, 15 nt, Mycobacterium avium subsp. paratuberculosis
guuggacaugaagcc

SEQ ID NO: 999610 - RNA, 14 nt, Mycobacterium avium subsp. paratuberculosis
guuggaaggggucg

SEQ ID NO: 999611 - RNA, 16 nt, Mycobacterium avium subsp. paratuberculosis
guuggaaccggccacc

SEQ ID NO: 999612 - RNA, 16 nt, Mycobacterium avium subsp. paratuberculosis
guugcuguacuggggu

SEQ ID NO: 999613 - RNA, 18 nt, Mycobacterium avium subsp. paratuberculosis
guuggcccacagcuugcc

SEQ ID NO: 999614 - RNA, 16 nt, Mycobacterium avium subsp. paratuberculosis
guuggcccgcaccacc

SEQ ID NO: 999615 - RNA, 12 nt, Mycobacterium avium subsp. paratuberculosis
guuggcccgcgg

SEQ ID NO: 999616 - RNA, 14 nt, Mycobacterium avium subsp. paratuberculosis
guuggcccugcucu

SEQ ID NO: 999617 - RNA, 21 nt, Mycobacterium avium subsp. paratuberculosis
guuggcccuucgaccucgagu

SEQ ID NO: 999618 - RNA, 15 nt, Mycobacterium avium subsp. paratuberculosis
guuggccuccagguu

SEQ ID NO: 999619 - RNA, 17 nt, Mycobacterium avium subsp. paratuberculosis
guuggccgcgacgccgc

SEQ ID NO: 999620 - RNA, 13 nt, Mycobacterium avium subsp. paratuberculosis
guugccgacggcg

SEQ ID NO: 999621 - RNA, 23 nt, Mycobacterium avium subsp. paratuberculosis
guugccgauggcgguccaccacc

SEQ ID NO: 999622 - RNA, 17 nt, Mycobacterium avium subsp. paratuberculosis
guugccucggccagcac

SEQ ID NO: 999623 - RNA, 15 nt, Mycobacterium avium subsp. paratuberculosis
guugccggcggccag

SEQ ID NO: 999624 - RNA, 16 nt, Mycobacterium avium subsp. paratuberculosis
guugccggcggccagc

SEQ ID NO: 999625 - RNA, 15 nt, Mycobacterium avium subsp. paratuberculosis
guugccgcuggucag

SEQ ID NO: 999626 - RNA, 15 nt, Mycobacterium avium subsp. paratuberculosis
guugcgggccaggca

SEQ ID NO: 999627 - RNA, 18 nt, Mycobacterium avium subsp. paratuberculosis
guugcgggugucgccggu

SEQ ID NO: 999628 - RNA, 14 nt, Mycobacterium avium subsp. paratuberculosis
guugcgugcagccg

SEQ ID NO: 999629 - RNA, 20 nt, Mycobacterium avium subsp. paratuberculosis
guugcucggggcucgcggug

SEQ ID NO: 999630 - RNA, 15 nt, Mycobacterium avium subsp. paratuberculosis
guugcgcagcgucuc

SEQ ID NO: 999631 - RNA, 13 nt, Mycobacterium avium subsp. paratuberculosis
guugcgccagcag

SEQ ID NO: 999632 - RNA, 19 nt, Mycobacterium avium subsp. paratuberculosis
guugcggccccgccagcag

SEQ ID NO: 999633 - RNA, 12 nt, Mycobacterium avium subsp. paratuberculosis
guugcggcggcc

SEQ ID NO: 999634 - RNA, 23 nt, Mycobacterium avium subsp. paratuberculosis
guugcggcggccggccagcagcc

SEQ ID NO: 999635 - RNA, 15 nt, Mycobacterium avium subsp. paratuberculosis
guugcgcggccgcau

SEQ ID NO: 999636 - RNA, 13 nt, Mycobacterium avium subsp. paratuberculosis
guugcgcggcggc

SEQ ID NO: 999637 - RNA, 14 nt, Mycobacterium avium subsp. paratuberculosis
guugcgcggcggcc

SEQ ID NO: 999638 - RNA, 15 nt, Mycobacterium avium subsp. paratuberculosis
guugaaaguccuugc

SEQ ID NO: 999639 - RNA, 19 nt, Mycobacterium avium subsp. paratuberculosis
guugaacggcaccccgcgg

SEQ ID NO: 999640 - RNA, 19 nt, Mycobacterium avium subsp. paratuberculosis
guugaaccgguacaggccc

SEQ ID NO: 999641 - RNA, 15 nt, Mycobacterium avium subsp. paratuberculosis
guugaagcuggccac

SEQ ID NO: 999642 - RNA, 15 nt, Mycobacterium avium subsp. paratuberculosis
guugaccaccaggua

SEQ ID NO: 999643 - RNA, 22 nt, Mycobacterium avium subsp. paratuberculosis
guucuucgucagguucgaggug

SEQ ID NO: 999644 - RNA, 21 nt, Mycobacterium avium subsp. paratuberculosis
guucggcaucucggccggaag

SEQ ID NO: 999645 - RNA, 19 nt, Mycobacterium avium subsp. paratuberculosis
guucguccgugcugccggc

SEQ ID NO: 999646 - RNA, 18 nt, Mycobacterium avium subsp. paratuberculosis
guucuuggcggccugcuc

SEQ ID NO: 999647 - RNA, 16 nt, Mycobacterium avium subsp. paratuberculosis
guugaggaucugcacg

SEQ ID NO: 999648 - RNA, 16 nt, Mycobacterium avium subsp. paratuberculosis
guugagcacacacagg

SEQ ID NO: 999649 - RNA, 16 nt, Mycobacterium avium subsp. paratuberculosis
guugagcgucgccacc

SEQ ID NO: 999650 - RNA, 16 nt, Mycobacterium avium subsp. paratuberculosis
guugacuccucugcca

SEQ ID NO: 999651 - RNA, 16 nt, Mycobacterium avium subsp. paratuberculosis
guugacgcccuccugg

SEQ ID NO: 999652 - RNA, 14 nt, Mycobacterium avium subsp. paratuberculosis
guugacgccgaugc

SEQ ID NO: 999653 - RNA, 20 nt, Mycobacterium avium subsp. paratuberculosis
guugacgccgaugcgguuga

SEQ ID NO: 999654 - RNA, 18 nt, Mycobacterium avium subsp. paratuberculosis
guugacgcugggcggcga

SEQ ID NO: 999655 - RNA, 20 nt, Mycobacterium avium subsp. paratuberculosis
guugcacaccaccagcgagg

SEQ ID NO: 999656 - RNA, 13 nt, Mycobacterium avium subsp. paratuberculosis
guugcacaggcac

SEQ ID NO: 999657 - RNA, 20 nt, Mycobacterium avium subsp. paratuberculosis
guugcacguaggcggcgagc

SEQ ID NO: 999658 - RNA, 20 nt, Mycobacterium avium subsp. paratuberculosis
guugaucucgucgaugacga

SEQ ID NO: 999659 - RNA, 16 nt, Mycobacterium avium subsp. paratuberculosis
guugaugucgguggug

SEQ ID NO: 999660 - RNA, 20 nt, Mycobacterium avium subsp. paratuberculosis
guucagguaggucaacccgc

SEQ ID NO: 999661 - RNA, 19 nt, Mycobacterium avium subsp. paratuberculosis
guucaucaccacgaacucc

SEQ ID NO: 999662 - RNA, 24 nt, Mycobacterium avium subsp. paratuberculosis
guucauguagcagcgcggcuuggc

SEQ ID NO: 999663 - RNA, 23 nt, Mycobacterium avium subsp. paratuberculosis
guucacgucgaucacgccgccgg

SEQ ID NO: 999664 - RNA, 22 nt, Mycobacterium avium subsp. paratuberculosis
guucagcgcggccaccuccagc

SEQ ID NO: 999665 - RNA, 22 nt, Mycobacterium avium subsp. paratuberculosis
guuccaaccaccguggccccag

SEQ ID NO: 999666 - RNA, 17 nt, Mycobacterium avium subsp. paratuberculosis
guuccaccucgggccgg

SEQ ID NO: 999667 - RNA, 23 nt, Mycobacterium avium subsp. paratuberculosis
guuccacaucagguugaccaggu

SEQ ID NO: 999668 - RNA, 20 nt, Mycobacterium avium subsp. paratuberculosis
guucccgacagcucgcgcug

SEQ ID NO: 999669 - RNA, 19 nt, Mycobacterium avium subsp. paratuberculosis
guuccgguggacuccagca

SEQ ID NO: 999670 - RNA, 17 nt, Mycobacterium avium subsp. paratuberculosis
guuccgguuggccaggu

SEQ ID NO: 999671 - RNA, 17 nt, Mycobacterium avium subsp. paratuberculosis
guucccgugcuggccau

SEQ ID NO: 999672 - RNA, 17 nt, Mycobacterium avium subsp. paratuberculosis
guucgcgcacgcuggcc

SEQ ID NO: 999673 - RNA, 19 nt, Mycobacterium avium subsp. paratuberculosis
guucgcucuucucguucug

SEQ ID NO: 999674 - RNA, 23 nt, Mycobacterium avium subsp. paratuberculosis
guucgcuggcggggcgugcccgg

SEQ ID NO: 999675 - RNA, 14 nt, Mycobacterium avium subsp. paratuberculosis
guucgcggcgcagc

SEQ ID NO: 999676 - RNA, 22 nt, Mycobacterium avium subsp. paratuberculosis
guucgccggaauggcaaggcca

SEQ ID NO: 999677 - RNA, 13 nt, Mycobacterium avium subsp. paratuberculosis
guucgauaucgcc

SEQ ID NO: 999678 - RNA, 14 nt, Mycobacterium avium subsp. paratuberculosis
guucgagggcgcgg

SEQ ID NO: 999679 - RNA, 18 nt, Mycobacterium avium subsp. paratuberculosis
guuccucgacguaggcca

SEQ ID NO: 999680 - RNA, 22 nt, Mycobacterium avium subsp. paratuberculosis
guuccucgacguaggccagauc

SEQ ID NO: 999681 - RNA, 18 nt, Mycobacterium avium subsp. paratuberculosis
guucgagcgccgcggcca

SEQ ID NO: 999682 - RNA, 14 nt, Mycobacterium avium subsp. paratuberculosis
guuccugcaugccg

SEQ ID NO: 999683 - RNA, 23 nt, Mycobacterium avium subsp. paratuberculosis
guguugccgacggcgccggugcc

SEQ ID NO: 999684 - RNA, 19 nt, Mycobacterium avium subsp. paratuberculosis
guguugcggcagggccacc

SEQ ID NO: 999685 - RNA, 21 nt, Mycobacterium avium subsp. paratuberculosis
guguucgguggagcgcggcau

SEQ ID NO: 999686 - RNA, 16 nt, Mycobacterium avium subsp. paratuberculosis
guguugucgugccggg

SEQ ID NO: 999687 - RNA, 13 nt, Mycobacterium avium subsp. paratuberculosis
guguuucggucgg

SEQ ID NO: 999688 - RNA, 21 nt, Mycobacterium avium subsp. paratuberculosis
guguggggaauccgguggggu

SEQ ID NO: 999689 - RNA, 20 nt, Mycobacterium avium subsp. paratuberculosis
gugugauucgggucagaccg

SEQ ID NO: 999690 - RNA, 18 nt, Mycobacterium avium subsp. paratuberculosis
gugugcagccagguggug

SEQ ID NO: 999691 - RNA, 13 nt, Mycobacterium avium subsp. paratuberculosis
gugugccagcccg

SEQ ID NO: 999692 - RNA, 22 nt, Mycobacterium avium subsp. paratuberculosis
guguacucggcgucgccgagcu

SEQ ID NO: 999693 - RNA, 14 nt, Mycobacterium avium subsp. paratuberculosis
guggugucgaaguc

SEQ ID NO: 999694 - RNA, 20 nt, Mycobacterium avium subsp. paratuberculosis
guggugggcgaacagcagca

SEQ ID NO: 999695 - RNA, 22 nt, Mycobacterium avium subsp. paratuberculosis
guggugggcgcgaagguggcgc

SEQ ID NO: 999696 - RNA, 19 nt, Mycobacterium avium subsp. paratuberculosis
gugguugcguucgccggcg

SEQ ID NO: 999697 - RNA, 13 nt, Mycobacterium avium subsp. paratuberculosis
gugguggcggcga

SEQ ID NO: 999698 - RNA, 13 nt, Mycobacterium avium subsp. paratuberculosis
guggugcaccgcc

SEQ ID NO: 999699 - RNA, 20 nt, Mycobacterium avium subsp. paratuberculosis
guggugcgcccgucgguggg

SEQ ID NO: 999700 - RNA, 16 nt, Mycobacterium avium subsp. paratuberculosis
guggugcggugcaccg

SEQ ID NO: 999701 - RNA, 17 nt, Mycobacterium avium subsp. paratuberculosis
guggucagcgucucggc

SEQ ID NO: 999702 - RNA, 23 nt, Mycobacterium avium subsp. paratuberculosis
guggugaacucuucgcagcgcuc

SEQ ID NO: 999703 - RNA, 16 nt, Mycobacterium avium subsp. paratuberculosis
guggugaucgcggcgg

SEQ ID NO: 999704 - RNA, 19 nt, Mycobacterium avium subsp. paratuberculosis
guggugaucgcggcggcgu

SEQ ID NO: 999705 - RNA, 14 nt, Mycobacterium avium subsp. paratuberculosis
guggcugucgggug

SEQ ID NO: 999706 - RNA, 14 nt, Mycobacterium avium subsp. paratuberculosis
guggcugaacagcg

SEQ ID NO: 999707 - RNA, 16 nt, Mycobacterium avium subsp. paratuberculosis
guggcucagcggcagg

SEQ ID NO: 999708 - RNA, 19 nt, Mycobacterium avium subsp. paratuberculosis
guggcucagcggcaggugc

SEQ ID NO: 999709 - RNA, 17 nt, Mycobacterium avium subsp. paratuberculosis
guggucaacggcaccga

SEQ ID NO: 999710 - RNA, 17 nt, Mycobacterium avium subsp. paratuberculosis
gugguaccggcgccagg

SEQ ID NO: 999711 - RNA, 14 nt, Mycobacterium avium subsp. paratuberculosis
gugggggccaggcg

SEQ ID NO: 999712 - RNA, 18 nt, Mycobacterium avium subsp. paratuberculosis
guggggcuggccgcacgg

SEQ ID NO: 999713 - RNA, 17 nt, Mycobacterium avium subsp. paratuberculosis
guggauggccggccggg

SEQ ID NO: 999714 - RNA, 22 nt, Mycobacterium avium subsp. paratuberculosis
guggccagcaccgucagccagg

SEQ ID NO: 999715 - RNA, 11 nt, Mycobacterium avium subsp. paratuberculosis
guggccagcag

SEQ ID NO: 999716 - RNA, 18 nt, Mycobacterium avium subsp. paratuberculosis
guggccacccucgccgcc

SEQ ID NO: 999717 - RNA, 22 nt, Mycobacterium avium subsp. paratuberculosis
gugcuuaccggccggccgccug

SEQ ID NO: 999718 - RNA, 19 nt, Mycobacterium avium subsp. paratuberculosis
gugcugucgucgcccugac

SEQ ID NO: 999719 - RNA, 22 nt, Mycobacterium avium subsp. paratuberculosis
gugcugugagcuuccugccaac

SEQ ID NO: 999720 - RNA, 14 nt, Mycobacterium avium subsp. paratuberculosis
gugcuugccgaugu

SEQ ID NO: 999721 - RNA, 17 nt, Mycobacterium avium subsp. paratuberculosis
gugcuuccauucacggu

SEQ ID NO: 999722 - RNA, 22 nt, Mycobacterium avium subsp. paratuberculosis
guggcgcccggagcugucggug

SEQ ID NO: 999723 - RNA, 15 nt, Mycobacterium avium subsp. paratuberculosis
guggcgccgcgggcg

SEQ ID NO: 999724 - RNA, 15 nt, Mycobacterium avium subsp. paratuberculosis
guggcgccggccagc

SEQ ID NO: 999725 - RNA, 17 nt, Mycobacterium avium subsp. paratuberculosis
guggcgccggccagcac

SEQ ID NO: 999726 - RNA, 19 nt, Mycobacterium avium subsp. paratuberculosis
guggcgccggccagcacca

SEQ ID NO: 999727 - RNA, 17 nt, Mycobacterium avium subsp. paratuberculosis
guggcgccggcgcgcga

SEQ ID NO: 999728 - RNA, 13 nt, Mycobacterium avium subsp. paratuberculosis
guggcgccggggc

SEQ ID NO: 999729 - RNA, 23 nt, Mycobacterium avium subsp. paratuberculosis
guggcgccgguaggcgcggguga

SEQ ID NO: 999730 - RNA, 12 nt, Mycobacterium avium subsp. paratuberculosis
guggcggccggg

SEQ ID NO: 999731 - RNA, 13 nt, Mycobacterium avium subsp. paratuberculosis
guggcggccgggg

SEQ ID NO: 999732 - RNA, 13 nt, Mycobacterium avium subsp. paratuberculosis
guggcggcgccgg

SEQ ID NO: 999733 - RNA, 23 nt, Mycobacterium avium subsp. paratuberculosis
guggcggcgccggaugccagcag

SEQ ID NO: 999734 - RNA, 22 nt, Mycobacterium avium subsp. paratuberculosis
guggcgcacaacccggacagcg

SEQ ID NO: 999735 - RNA, 20 nt, Mycobacterium avium subsp. paratuberculosis
guggccuugcugauccccag

SEQ ID NO: 999736 - RNA, 16 nt, Mycobacterium avium subsp. paratuberculosis
guggcgaacagcgggu

SEQ ID NO: 999737 - RNA, 19 nt, Mycobacterium avium subsp. paratuberculosis
guggcccggauggccgggc

SEQ ID NO: 999738 - RNA, 14 nt, Mycobacterium avium subsp. paratuberculosis
guggccuucaucac

SEQ ID NO: 999739 - RNA, 22 nt, Mycobacterium avium subsp. paratuberculosis
guggcccaggccggcgguggug

SEQ ID NO: 999740 - RNA, 23 nt, Mycobacterium avium subsp. paratuberculosis
guggcccaaccgcauucggccgc

SEQ ID NO: 999741 - RNA, 14 nt, Mycobacterium avium subsp. paratuberculosis
guggcccagccgcu

SEQ ID NO: 999742 - RNA, 22 nt, Mycobacterium avium subsp. paratuberculosis
guggcgacaucgccgcggccgg

SEQ ID NO: 999743 - RNA, 20 nt, Mycobacterium avium subsp. paratuberculosis
guggcgaacugcaccagcac

SEQ ID NO: 999744 - RNA, 16 nt, Mycobacterium avium subsp. paratuberculosis
guggcgauggugcugc

SEQ ID NO: 999745 - RNA, 17 nt, Mycobacterium avium subsp. paratuberculosis
gucgcuguaggccagcc

SEQ ID NO: 999746 - RNA, 19 nt, Mycobacterium avium subsp. paratuberculosis
gucgcuguuggcgacggcg

SEQ ID NO: 999747 - RNA, 13 nt, Mycobacterium avium subsp. paratuberculosis
gugaucuuggccu

SEQ ID NO: 999748 - RNA, 13 nt, Mycobacterium avium subsp. paratuberculosis
gucgcuggccagg

SEQ ID NO: 999749 - RNA, 14 nt, Mycobacterium avium subsp. paratuberculosis
gucgcuggccaggu

SEQ ID NO: 999750 - RNA, 14 nt, Mycobacterium avium subsp. paratuberculosis
gucgcugccgccgc

SEQ ID NO: 999751 - RNA, 16 nt, Mycobacterium avium subsp. paratuberculosis
gugaugacggcggcgg

SEQ ID NO: 999752 - RNA, 22 nt, Mycobacterium avium subsp. paratuberculosis
gugaugaggucgcgaccgccgg

SEQ ID NO: 999753 - RNA, 17 nt, Mycobacterium avium subsp. paratuberculosis
gugaugcagcugaaggu

SEQ ID NO: 999754 - RNA, 17 nt, Mycobacterium avium subsp. paratuberculosis
gugaugcgcgccgacga

SEQ ID NO: 999755 - RNA, 21 nt, Mycobacterium avium subsp. paratuberculosis
gugaugcggucggcgcggggc

SEQ ID NO: 999756 - RNA, 16 nt, Mycobacterium avium subsp. paratuberculosis
gugauggacggggcga

SEQ ID NO: 999757 - RNA, 19 nt, Mycobacterium avium subsp. paratuberculosis
gugauggucucccgggcgg

SEQ ID NO: 999758 - RNA, 23 nt, Mycobacterium avium subsp. paratuberculosis
gugauggucucccgggcggucgc

SEQ ID NO: 999759 - RNA, 19 nt, Mycobacterium avium subsp. paratuberculosis
gugaugucgccggcggcga

SEQ ID NO: 999760 - RNA, 14 nt, Mycobacterium avium subsp. paratuberculosis
gugaugugcggcgc

SEQ ID NO: 999761 - RNA, 16 nt, Mycobacterium avium subsp. paratuberculosis
gugaugugcggcgcgg

SEQ ID NO: 999762 - RNA, 19 nt, Mycobacterium avium subsp. paratuberculosis
gugaugugcggcgcggcgg

SEQ ID NO: 999763 - RNA, 17 nt, Mycobacterium avium subsp. paratuberculosis
gugcaacgugaugccgu

SEQ ID NO: 999764 - RNA, 14 nt, Mycobacterium avium subsp. paratuberculosis
gugcaagcucgcca

SEQ ID NO: 999765 - RNA, 18 nt, Mycobacterium avium subsp. paratuberculosis
gugcaaggccugcgccuu

SEQ ID NO: 999766 - RNA, 12 nt, Mycobacterium avium subsp. paratuberculosis
gugcaccaggua

SEQ ID NO: 999767 - RNA, 17 nt, Mycobacterium avium subsp. paratuberculosis
gugcagccacccgucgg

SEQ ID NO: 999768 - RNA, 16 nt, Mycobacterium avium subsp. paratuberculosis
gugcagcagcucggcg

SEQ ID NO: 999769 - RNA, 13 nt, Mycobacterium avium subsp. paratuberculosis
gugcagcagcugg

SEQ ID NO: 999770 - RNA, 20 nt, Mycobacterium avium subsp. paratuberculosis
gugcagcaccacgaacgcug

SEQ ID NO: 999771 - RNA, 16 nt, Mycobacterium avium subsp. paratuberculosis
gugcagcaccucgaag

SEQ ID NO: 999772 - RNA, 23 nt, Mycobacterium avium subsp. paratuberculosis
gugcagcagcagccacgccagcc

SEQ ID NO: 999773 - RNA, 23 nt, Mycobacterium avium subsp. paratuberculosis
gugcagacaaccggugugccugg

SEQ ID NO: 999774 - RNA, 12 nt, Mycobacterium avium subsp. paratuberculosis
gugcagaccgga

SEQ ID NO: 999775 - RNA, 16 nt, Mycobacterium avium subsp. paratuberculosis
gugcagaccggacagc

SEQ ID NO: 999776 - RNA, 21 nt, Mycobacterium avium subsp. paratuberculosis
gugcagaccggacagcugggc

SEQ ID NO: 999777 - RNA, 12 nt, Mycobacterium avium subsp. paratuberculosis
gugccagcagcu

SEQ ID NO: 999778 - RNA, 16 nt, Mycobacterium avium subsp. paratuberculosis
gugccaccgcugggcg

SEQ ID NO: 999779 - RNA, 20 nt, Mycobacterium avium subsp. paratuberculosis
gugccacggccgcggcccgg

SEQ ID NO: 999780 - RNA, 22 nt, Mycobacterium avium subsp. paratuberculosis
gugccacggccgcggcccggcc

SEQ ID NO: 999781 - RNA, 16 nt, Mycobacterium avium subsp. paratuberculosis
gugccacggucaggcg

SEQ ID NO: 999782 - RNA, 19 nt, Mycobacterium avium subsp. paratuberculosis
gugccacuggcgccaccuc

SEQ ID NO: 999783 - RNA, 19 nt, Mycobacterium avium subsp. paratuberculosis
gugccacuucgacggcagc

SEQ ID NO: 999784 - RNA, 22 nt, Mycobacterium avium subsp. paratuberculosis
gugccacuucgacggcagcggc

SEQ ID NO: 999785 - RNA, 16 nt, Mycobacterium avium subsp. paratuberculosis
gugccaccgccgaugg

SEQ ID NO: 999786 - RNA, 22 nt, Mycobacterium avium subsp. paratuberculosis
gugccaagcguauccggccagc

SEQ ID NO: 999787 - RNA, 13 nt, Mycobacterium avium subsp. paratuberculosis
gugcccgggcccg

SEQ ID NO: 999788 - RNA, 16 nt, Mycobacterium avium subsp. paratuberculosis
gugcccggcccaggca

SEQ ID NO: 999789 - RNA, 11 nt, Mycobacterium avium subsp. paratuberculosis
gugcccggcga

SEQ ID NO: 999790 - RNA, 11 nt, Mycobacterium avium subsp. paratuberculosis
gugcccggcgc

SEQ ID NO: 999791 - RNA, 14 nt, Mycobacterium avium subsp. paratuberculosis
gugcccggcgcaca

SEQ ID NO: 999792 - RNA, 22 nt, Mycobacterium avium subsp. paratuberculosis
gugcccggcgccgaccaggcuc

SEQ ID NO: 999793 - RNA, 17 nt, Mycobacterium avium subsp. paratuberculosis
gugcccggcugggcgcg

SEQ ID NO: 999794 - RNA, 21 nt, Mycobacterium avium subsp. paratuberculosis
gugcccggaacggcgggcccg

SEQ ID NO: 999795 - RNA, 20 nt, Mycobacterium avium subsp. paratuberculosis
gugcccgccucgcagcgaca

SEQ ID NO: 999796 - RNA, 13 nt, Mycobacterium avium subsp. paratuberculosis
gugccgaagcgcc

SEQ ID NO: 999797 - RNA, 21 nt, Mycobacterium avium subsp. paratuberculosis
gugccgaagcgccgcaugccc

SEQ ID NO: 999798 - RNA, 23 nt, Mycobacterium avium subsp. paratuberculosis
gugccgaagggcaaccgcagcau

SEQ ID NO: 999799 - RNA, 17 nt, Mycobacterium avium subsp. paratuberculosis
gugccgaccugggcggc

SEQ ID NO: 999800 - RNA, 13 nt, Mycobacterium avium subsp. paratuberculosis
gugcccgacggcg

SEQ ID NO: 999801 - RNA, 21 nt, Mycobacterium avium subsp. paratuberculosis
gugcccgagcugaucgcggcc

SEQ ID NO: 999802 - RNA, 18 nt, Mycobacterium avium subsp. paratuberculosis
gugccccguccggcgcca

SEQ ID NO: 999803 - RNA, 12 nt, Mycobacterium avium subsp. paratuberculosis
gugccccgccgu

SEQ ID NO: 999804 - RNA, 22 nt, Mycobacterium avium subsp. paratuberculosis
gugccccgccguuucagcagcg

SEQ ID NO: 999805 - RNA, 15 nt, Mycobacterium avium subsp. paratuberculosis
gugcccgcagcauca

SEQ ID NO: 999806 - RNA, 14 nt, Mycobacterium avium subsp. paratuberculosis
gugccccacaagcg

SEQ ID NO: 999807 - RNA, 19 nt, Mycobacterium avium subsp. paratuberculosis
gugccagccgugcggcggc

SEQ ID NO: 999808 - RNA, 21 nt, Mycobacterium avium subsp. paratuberculosis
gugccagcccguuguggcggc

SEQ ID NO: 999809 - RNA, 22 nt, Mycobacterium avium subsp. paratuberculosis
gugccagcccguuguggcggcc

SEQ ID NO: 999810 - RNA, 18 nt, Mycobacterium avium subsp. paratuberculosis
gugcucagccgcacggau

SEQ ID NO: 999811 - RNA, 16 nt, Mycobacterium avium subsp. paratuberculosis
gugcgucuuuucccac

SEQ ID NO: 999812 - RNA, 14 nt, Mycobacterium avium subsp. paratuberculosis
gugcgugccagcag

SEQ ID NO: 999813 - RNA, 17 nt, Mycobacterium avium subsp. paratuberculosis
gugcgguugagcaccag

SEQ ID NO: 999814 - RNA, 17 nt, Mycobacterium avium subsp. paratuberculosis
gugcgucagaaccgggg

SEQ ID NO: 999815 - RNA, 19 nt, Mycobacterium avium subsp. paratuberculosis
gugcgucagaaccggggcc

SEQ ID NO: 999816 - RNA, 19 nt, Mycobacterium avium subsp. paratuberculosis
gugcucgacggcacccggc

SEQ ID NO: 999817 - RNA, 14 nt, Mycobacterium avium subsp. paratuberculosis
gugcucgcgcagca

SEQ ID NO: 999818 - RNA, 14 nt, Mycobacterium avium subsp. paratuberculosis
gugcucgcgccggg

SEQ ID NO: 999819 - RNA, 14 nt, Mycobacterium avium subsp. paratuberculosis
gugcucggccacga

SEQ ID NO: 999820 - RNA, 20 nt, Mycobacterium avium subsp. paratuberculosis
gugcucggggcaguaguggu

SEQ ID NO: 999821 - RNA, 23 nt, Mycobacterium avium subsp. paratuberculosis
gugcucgucgagcauccggcgca

SEQ ID NO: 999822 - RNA, 17 nt, Mycobacterium avium subsp. paratuberculosis
gugcucgucgcggagga

SEQ ID NO: 999823 - RNA, 20 nt, Mycobacterium avium subsp. paratuberculosis
gugcugacccagcgcggggg

SEQ ID NO: 999824 - RNA, 21 nt, Mycobacterium avium subsp. paratuberculosis
gugcugacccggucgcggccg

SEQ ID NO: 999825 - RNA, 13 nt, Mycobacterium avium subsp. paratuberculosis
gugcuggccagca

SEQ ID NO: 999826 - RNA, 15 nt, Mycobacterium avium subsp. paratuberculosis
gugcuggccagcacc

SEQ ID NO: 999827 - RNA, 19 nt, Mycobacterium avium subsp. paratuberculosis
gugcuggccagcaccagcg

SEQ ID NO: 999828 - RNA, 19 nt, Mycobacterium avium subsp. paratuberculosis
gugcugcucgagggccucc

SEQ ID NO: 999829 - RNA, 14 nt, Mycobacterium avium subsp. paratuberculosis
gugcugggcggacg

SEQ ID NO: 999830 - RNA, 15 nt, Mycobacterium avium subsp. paratuberculosis
gugcugggcggacgg

SEQ ID NO: 999831 - RNA, 15 nt, Mycobacterium avium subsp. paratuberculosis
gugcugccggccggc

SEQ ID NO: 999832 - RNA, 16 nt, Mycobacterium avium subsp. paratuberculosis
gugcugcgcagcagcg

SEQ ID NO: 999833 - RNA, 19 nt, Mycobacterium avium subsp. paratuberculosis
gugcugcgcagcagcgcca

SEQ ID NO: 999834 - RNA, 19 nt, Mycobacterium avium subsp. paratuberculosis
gugcugcccggcgcggaca

SEQ ID NO: 999835 - RNA, 12 nt, Mycobacterium avium subsp. paratuberculosis
gugcgccaggca

SEQ ID NO: 999836 - RNA, 14 nt, Mycobacterium avium subsp. paratuberculosis
gugcgccaggcagg

SEQ ID NO: 999837 - RNA, 21 nt, Mycobacterium avium subsp. paratuberculosis
gugcgcccagguacuccucgg

SEQ ID NO: 999838 - RNA, 19 nt, Mycobacterium avium subsp. paratuberculosis
gugcgcccgcgaucaacac

SEQ ID NO: 999839 - RNA, 20 nt, Mycobacterium avium subsp. paratuberculosis
gugcgccgcauuggugccgg

SEQ ID NO: 999840 - RNA, 13 nt, Mycobacterium avium subsp. paratuberculosis
gugcgccgcccac

SEQ ID NO: 999841 - RNA, 15 nt, Mycobacterium avium subsp. paratuberculosis
gugcgccgcccacac

SEQ ID NO: 999842 - RNA, 22 nt, Mycobacterium avium subsp. paratuberculosis
gugcgacuugguggccagcacc

SEQ ID NO: 999843 - RNA, 12 nt, Mycobacterium avium subsp. paratuberculosis
gugcgacggcuc

SEQ ID NO: 999844 - RNA, 14 nt, Mycobacterium avium subsp. paratuberculosis
gugccgcgcagcac

SEQ ID NO: 999845 - RNA, 19 nt, Mycobacterium avium subsp. paratuberculosis
gugccgcugcauccgcagc

SEQ ID NO: 999846 - RNA, 21 nt, Mycobacterium avium subsp. paratuberculosis
gugccgcugcauccgcagcac

SEQ ID NO: 999847 - RNA, 19 nt, Mycobacterium avium subsp. paratuberculosis
gugccgcgaugcccgccgg

SEQ ID NO: 999848 - RNA, 17 nt, Mycobacterium avium subsp. paratuberculosis
gugccgcgcggcgguga

SEQ ID NO: 999849 - RNA, 17 nt, Mycobacterium avium subsp. paratuberculosis
gugcggcaccuccagcc

SEQ ID NO: 999850 - RNA, 13 nt, Mycobacterium avium subsp. paratuberculosis
gugcgcuccucga

SEQ ID NO: 999851 - RNA, 20 nt, Mycobacterium avium subsp. paratuberculosis
gugcgcgauggcgugccggc

SEQ ID NO: 999852 - RNA, 16 nt, Mycobacterium avium subsp. paratuberculosis
gugcgcgcgcaccuga

SEQ ID NO: 999853 - RNA, 14 nt, Mycobacterium avium subsp. paratuberculosis
gugcgcgcuggugc

SEQ ID NO: 999854 - RNA, 23 nt, Mycobacterium avium subsp. paratuberculosis
gugcgcgacgaauugcagaucca

SEQ ID NO: 999855 - RNA, 17 nt, Mycobacterium avium subsp. paratuberculosis
gugcgccgugcagcacg

SEQ ID NO: 999856 - RNA, 17 nt, Mycobacterium avium subsp. paratuberculosis
gugcggccagcgcaggu

SEQ ID NO: 999857 - RNA, 16 nt, Mycobacterium avium subsp. paratuberculosis
gugcggcggggccucg

SEQ ID NO: 999858 - RNA, 13 nt, Mycobacterium avium subsp. paratuberculosis
gugcggcggcggc

SEQ ID NO: 999859 - RNA, 19 nt, Mycobacterium avium subsp. paratuberculosis
gugcggcggcggugccugg

SEQ ID NO: 999860 - RNA, 16 nt, Mycobacterium avium subsp. paratuberculosis
gugcggguguccgagc

SEQ ID NO: 999861 - RNA, 17 nt, Mycobacterium avium subsp. paratuberculosis
gugcgguaggugccggc

SEQ ID NO: 999862 - RNA, 13 nt, Mycobacterium avium subsp. paratuberculosis
gugcgggccagca

SEQ ID NO: 999863 - RNA, 14 nt, Mycobacterium avium subsp. paratuberculosis
gugcgggccagcag

SEQ ID NO: 999864 - RNA, 16 nt, Mycobacterium avium subsp. paratuberculosis
gugcgggccagcagcc

SEQ ID NO: 999865 - RNA, 16 nt, Mycobacterium avium subsp. paratuberculosis
gugcgggcguccuuga

SEQ ID NO: 999866 - RNA, 15 nt, Mycobacterium avium subsp. paratuberculosis
gugcgggcugcacca

SEQ ID NO: 999867 - RNA, 17 nt, Mycobacterium avium subsp. paratuberculosis
gucaggucaaccaggcc

SEQ ID NO: 999868 - RNA, 18 nt, Mycobacterium avium subsp. paratuberculosis
gucaggucaaccaggccu

SEQ ID NO: 999869 - RNA, 18 nt, Mycobacterium avium subsp. paratuberculosis
gucaggggugccggaggc

SEQ ID NO: 999870 - RNA, 20 nt, Mycobacterium avium subsp. paratuberculosis
gucagggugacguggcggcc

SEQ ID NO: 999871 - RNA, 13 nt, Mycobacterium avium subsp. paratuberculosis
gucagggucagcu

SEQ ID NO: 999872 - RNA, 13 nt, Mycobacterium avium subsp. paratuberculosis
gucagcaccacca

SEQ ID NO: 999873 - RNA, 22 nt, Mycobacterium avium subsp. paratuberculosis
gucagcacgucggucagcgagc

SEQ ID NO: 999874 - RNA, 16 nt, Mycobacterium avium subsp. paratuberculosis
gucagcaccgcgcggc

SEQ ID NO: 999875 - RNA, 14 nt, Mycobacterium avium subsp. paratuberculosis
gucagcagggccuc

SEQ ID NO: 999876 - RNA, 15 nt, Mycobacterium avium subsp. paratuberculosis
gucagcagggccucg

SEQ ID NO: 999877 - RNA, 17 nt, Mycobacterium avium subsp. paratuberculosis
gucagcgccagcaugcc

SEQ ID NO: 999878 - RNA, 12 nt, Mycobacterium avium subsp. paratuberculosis
gucagcgccccc

SEQ ID NO: 999879 - RNA, 18 nt, Mycobacterium avium subsp. paratuberculosis
gucagcgacaacggcccc

SEQ ID NO: 999880 - RNA, 19 nt, Mycobacterium avium subsp. paratuberculosis
gucagcgagugguaccggg

SEQ ID NO: 999881 - RNA, 23 nt, Mycobacterium avium subsp. paratuberculosis
gucagcgagugguaccggguggc

SEQ ID NO: 999882 - RNA, 16 nt, Mycobacterium avium subsp. paratuberculosis
gucagccgcaccaggu

SEQ ID NO: 999883 - RNA, 17 nt, Mycobacterium avium subsp. paratuberculosis
gucagccggccugcuuu

SEQ ID NO: 999884 - RNA, 17 nt, Mycobacterium avium subsp. paratuberculosis
gucagccgggcggccuc

SEQ ID NO: 999885 - RNA, 20 nt, Mycobacterium avium subsp. paratuberculosis
gucagcgccgcccgcaguuc

SEQ ID NO: 999886 - RNA, 23 nt, Mycobacterium avium subsp. paratuberculosis
gucagcgcgugaccccggcgacc

SEQ ID NO: 999887 - RNA, 16 nt, Mycobacterium avium subsp. paratuberculosis
gucagcggccagccca

SEQ ID NO: 999888 - RNA, 18 nt, Mycobacterium avium subsp. paratuberculosis
gucagcggcgccaccggg

SEQ ID NO: 999889 - RNA, 20 nt, Mycobacterium avium subsp. paratuberculosis
gucaggccugguaggccgcc

SEQ ID NO: 999890 - RNA, 14 nt, Mycobacterium avium subsp. paratuberculosis
gucaggcgcugggu

SEQ ID NO: 999891 - RNA, 16 nt, Mycobacterium avium subsp. paratuberculosis
gucaggcgcugggugc

SEQ ID NO: 999892 - RNA, 22 nt, Mycobacterium avium subsp. paratuberculosis
gucagggccagcaacaccagcu

SEQ ID NO: 999893 - RNA, 15 nt, Mycobacterium avium subsp. paratuberculosis
gucaggccgaaugac

SEQ ID NO: 999894 - RNA, 14 nt, Mycobacterium avium subsp. paratuberculosis
gucaggccggucag

SEQ ID NO: 999895 - RNA, 16 nt, Mycobacterium avium subsp. paratuberculosis
gucaggcccagcgagg

SEQ ID NO: 999896 - RNA, 15 nt, Mycobacterium avium subsp. paratuberculosis
gucaggagugcucgg

SEQ ID NO: 999897 - RNA, 18 nt, Mycobacterium avium subsp. paratuberculosis
gucagcuccaccugcggc

SEQ ID NO: 999898 - RNA, 21 nt, Mycobacterium avium subsp. paratuberculosis
gucagcucgaucgccgcgccc

SEQ ID NO: 999899 - RNA, 18 nt, Mycobacterium avium subsp. paratuberculosis
gucagcucgccguccggg

SEQ ID NO: 999900 - RNA, 14 nt, Mycobacterium avium subsp. paratuberculosis
gucagcucgcgccc

SEQ ID NO: 999901 - RNA, 24 nt, Mycobacterium avium subsp. paratuberculosis
gucagcuggugcagauaggugguc

SEQ ID NO: 999902 - RNA, 18 nt, Mycobacterium avium subsp. paratuberculosis
gucacgggccaggcgcgc

SEQ ID NO: 999903 - RNA, 22 nt, Mycobacterium avium subsp. paratuberculosis
gucacguagugcuucuugaaga

SEQ ID NO: 999904 - RNA, 17 nt, Mycobacterium avium subsp. paratuberculosis
gucacgguccagguccu

SEQ ID NO: 999905 - RNA, 18 nt, Mycobacterium avium subsp. paratuberculosis
gucacggccgccagcagc

SEQ ID NO: 999906 - RNA, 15 nt, Mycobacterium avium subsp. paratuberculosis
gucaccggcucggga

SEQ ID NO: 999907 - RNA, 14 nt, Mycobacterium avium subsp. paratuberculosis
gucaccggcugccc

SEQ ID NO: 999908 - RNA, 15 nt, Mycobacterium avium subsp. paratuberculosis
gucacgcccgucccu

SEQ ID NO: 999909 - RNA, 18 nt, Mycobacterium avium subsp. paratuberculosis
gucaccggggugccgccc

SEQ ID NO: 999910 - RNA, 19 nt, Mycobacterium avium subsp. paratuberculosis
gucaccccaccgagcagcu

SEQ ID NO: 999911 - RNA, 14 nt, Mycobacterium avium subsp. paratuberculosis
gucacccggcuggc

SEQ ID NO: 999912 - RNA, 17 nt, Mycobacterium avium subsp. paratuberculosis
gucacccgguugagcac

SEQ ID NO: 999913 - RNA, 17 nt, Mycobacterium avium subsp. paratuberculosis
gucacccgugggccgac

SEQ ID NO: 999914 - RNA, 14 nt, Mycobacterium avium subsp. paratuberculosis
gucacccuccucgc

SEQ ID NO: 999915 - RNA, 20 nt, Mycobacterium avium subsp. paratuberculosis
gucaccgagguagggccggg

SEQ ID NO: 999916 - RNA, 20 nt, Mycobacterium avium subsp. paratuberculosis
gucaccgccuccuggcugga

SEQ ID NO: 999917 - RNA, 15 nt, Mycobacterium avium subsp. paratuberculosis
gucaccgcgaccaug

SEQ ID NO: 999918 - RNA, 22 nt, Mycobacterium avium subsp. paratuberculosis
gucaccgcgggaauggccgcgc

SEQ ID NO: 999919 - RNA, 20 nt, Mycobacterium avium subsp. paratuberculosis
gucacguucaccaccggagc

SEQ ID NO: 999920 - RNA, 19 nt, Mycobacterium avium subsp. paratuberculosis
gucagagcccgaacacggg

SEQ ID NO: 999921 - RNA, 23 nt, Mycobacterium avium subsp. paratuberculosis
gucaacacgaagccggugucggg

SEQ ID NO: 999922 - RNA, 16 nt, Mycobacterium avium subsp. paratuberculosis
gucaacgccgcgcgca

SEQ ID NO: 999923 - RNA, 20 nt, Mycobacterium avium subsp. paratuberculosis
gucaaugauggucagccgca

SEQ ID NO: 999924 - RNA, 22 nt, Mycobacterium avium subsp. paratuberculosis
gucaagccggccagcagcggcu

SEQ ID NO: 999925 - RNA, 14 nt, Mycobacterium avium subsp. paratuberculosis
guccucgucggcga

SEQ ID NO: 999926 - RNA, 15 nt, Mycobacterium avium subsp. paratuberculosis
guccucuucgcggau

SEQ ID NO: 999927 - RNA, 19 nt, Mycobacterium avium subsp. paratuberculosis
guccugcaccgaguugaac

SEQ ID NO: 999928 - RNA, 15 nt, Mycobacterium avium subsp. paratuberculosis
guccugcaggcaggc

SEQ ID NO: 999929 - RNA, 17 nt, Mycobacterium avium subsp. paratuberculosis
guccugcaggcaggccg

SEQ ID NO: 999930 - RNA, 19 nt, Mycobacterium avium subsp. paratuberculosis
guccuggcgcuggugcagc

SEQ ID NO: 999931 - RNA, 21 nt, Mycobacterium avium subsp. paratuberculosis
guccuggcccccgccccagcc

SEQ ID NO: 999932 - RNA, 18 nt, Mycobacterium avium subsp. paratuberculosis
guccuggaucgcgcaggu

SEQ ID NO: 999933 - RNA, 17 nt, Mycobacterium avium subsp. paratuberculosis
guccuggaugaacagca

SEQ ID NO: 999934 - RNA, 23 nt, Mycobacterium avium subsp. paratuberculosis
guccuggacgucgucgcuguccu

SEQ ID NO: 999935 - RNA, 13 nt, Mycobacterium avium subsp. paratuberculosis
guccgauaccagc

SEQ ID NO: 999936 - RNA, 13 nt, Mycobacterium avium subsp. paratuberculosis
guccgaugacgag

SEQ ID NO: 999937 - RNA, 17 nt, Mycobacterium avium subsp. paratuberculosis
gucccgcgcggcgcagg

SEQ ID NO: 999938 - RNA, 23 nt, Mycobacterium avium subsp. paratuberculosis
guccgauuucccgacuccucaca

SEQ ID NO: 999939 - RNA, 18 nt, Mycobacterium avium subsp. paratuberculosis
guccggaagcccuugcag

SEQ ID NO: 999940 - RNA, 13 nt, Mycobacterium avium subsp. paratuberculosis
guccggcgccacg

SEQ ID NO: 999941 - RNA, 22 nt, Mycobacterium avium subsp. paratuberculosis
guccgggaacagcgacuccuga

SEQ ID NO: 999942 - RNA, 22 nt, Mycobacterium avium subsp. paratuberculosis
guccgggauaguucgccgccgc

SEQ ID NO: 999943 - RNA, 13 nt, Mycobacterium avium subsp. paratuberculosis
guccggcguccac

SEQ ID NO: 999944 - RNA, 13 nt, Mycobacterium avium subsp. paratuberculosis
guccggccggccg

SEQ ID NO: 999945 - RNA, 16 nt, Mycobacterium avium subsp. paratuberculosis
guccggccgugccgug

SEQ ID NO: 999946 - RNA, 15 nt, Mycobacterium avium subsp. paratuberculosis
guccggcccuggucg

SEQ ID NO: 999947 - RNA, 15 nt, Mycobacterium avium subsp. paratuberculosis
guccggcccgaugcg

SEQ ID NO: 999948 - RNA, 17 nt, Mycobacterium avium subsp. paratuberculosis
guccggccaguccagcg

SEQ ID NO: 999949 - RNA, 15 nt, Mycobacterium avium subsp. paratuberculosis
guccaucuccagcuc

SEQ ID NO: 999950 - RNA, 17 nt, Mycobacterium avium subsp. paratuberculosis
guccaucuccagcuccg

SEQ ID NO: 999951 - RNA, 13 nt, Mycobacterium avium subsp. paratuberculosis
gucccaggugcug

SEQ ID NO: 999952 - RNA, 18 nt, Mycobacterium avium subsp. paratuberculosis
gucccagugcgugaccug

SEQ ID NO: 999953 - RNA, 20 nt, Mycobacterium avium subsp. paratuberculosis
gucccagugcucgaccagau

SEQ ID NO: 999954 - RNA, 19 nt, Mycobacterium avium subsp. paratuberculosis
gucccaguucccggcgggc

SEQ ID NO: 999955 - RNA, 15 nt, Mycobacterium avium subsp. paratuberculosis
gucccaggccaggau

SEQ ID NO: 999956 - RNA, 12 nt, Mycobacterium avium subsp. paratuberculosis
gucccaggccag

SEQ ID NO: 999957 - RNA, 13 nt, Mycobacterium avium subsp. paratuberculosis
gucccacugcccg

SEQ ID NO: 999958 - RNA, 20 nt, Mycobacterium avium subsp. paratuberculosis
gucccagaucguagggcucg

SEQ ID NO: 999959 - RNA, 20 nt, Mycobacterium avium subsp. paratuberculosis
gucccagaugcgcgacggcc

SEQ ID NO: 999960 - RNA, 16 nt, Mycobacterium avium subsp. paratuberculosis
gucccagcgccacugg

SEQ ID NO: 999961 - RNA, 16 nt, Mycobacterium avium subsp. paratuberculosis
gucccagccggacagc

SEQ ID NO: 999962 - RNA, 16 nt, Mycobacterium avium subsp. paratuberculosis
guccccgguucaccag

SEQ ID NO: 999963 - RNA, 17 nt, Mycobacterium avium subsp. paratuberculosis
guccccgugcagccggg

SEQ ID NO: 999964 - RNA, 17 nt, Mycobacterium avium subsp. paratuberculosis
guccccgcgcccgccgc

SEQ ID NO: 999965 - RNA, 20 nt, Mycobacterium avium subsp. paratuberculosis
guccccgccgccgugcaucc

SEQ ID NO: 999966 - RNA, 16 nt, Mycobacterium avium subsp. paratuberculosis
gucccccgagcgggcc

SEQ ID NO: 999967 - RNA, 24 nt, Mycobacterium avium subsp. paratuberculosis
gucccccgagcgggccuucacgcu

SEQ ID NO: 999968 - RNA, 12 nt, Mycobacterium avium subsp. paratuberculosis
gucccccgccga

SEQ ID NO: 999969 - RNA, 13 nt, Mycobacterium avium subsp. paratuberculosis
gucgcaaagacau

SEQ ID NO: 999970 - RNA, 21 nt, Mycobacterium avium subsp. paratuberculosis
gucgaucgcggcgauggacgu

SEQ ID NO: 999971 - RNA, 23 nt, Mycobacterium avium subsp. paratuberculosis
gucgaucgcguaggguucgccga

SEQ ID NO: 999972 - RNA, 22 nt, Mycobacterium avium subsp. paratuberculosis
gucgagugcucgauggccagcg

SEQ ID NO: 999973 - RNA, 20 nt, Mycobacterium avium subsp. paratuberculosis
gucgaucauguagcgcuggu

SEQ ID NO: 999974 - RNA, 17 nt, Mycobacterium avium subsp. paratuberculosis
gucgauccccgcagcuc

SEQ ID NO: 999975 - RNA, 19 nt, Mycobacterium avium subsp. paratuberculosis
gucgauccccgcagcuccc

SEQ ID NO: 999976 - RNA, 22 nt, Mycobacterium avium subsp. paratuberculosis
gucgcacaaccgugacugggug

SEQ ID NO: 999977 - RNA, 22 nt, Mycobacterium avium subsp. paratuberculosis
gucgcacaccagcacggcggcg

SEQ ID NO: 999978 - RNA, 20 nt, Mycobacterium avium subsp. paratuberculosis
gucgcacagcauguccucgg

SEQ ID NO: 999979 - RNA, 14 nt, Mycobacterium avium subsp. paratuberculosis
gucgcaccgccucc

SEQ ID NO: 999980 - RNA, 16 nt, Mycobacterium avium subsp. paratuberculosis
gucgcacuugaagcug

SEQ ID NO: 999981 - RNA, 19 nt, Mycobacterium avium subsp. paratuberculosis
gucgcagaucccgccggcg

SEQ ID NO: 999982 - RNA, 21 nt, Mycobacterium avium subsp. paratuberculosis
gucgcagaucccgccggcggc

SEQ ID NO: 999983 - RNA, 12 nt, Mycobacterium avium subsp. paratuberculosis
gucgcacugcuu

SEQ ID NO: 999984 - RNA, 22 nt, Mycobacterium avium subsp. paratuberculosis
gucgcacugcuucgggucgccg

SEQ ID NO: 999985 - RNA, 15 nt, Mycobacterium avium subsp. paratuberculosis
gucgcaggcagcagc

SEQ ID NO: 999986 - RNA, 16 nt, Mycobacterium avium subsp. paratuberculosis
gucgcaggcagcagca

SEQ ID NO: 999987 - RNA, 20 nt, Mycobacterium avium subsp. paratuberculosis
gucgcagcggcacgucgccg

SEQ ID NO: 999988 - RNA, 22 nt, Mycobacterium avium subsp. paratuberculosis
gucgaggcccucgacaccggug

SEQ ID NO: 999989 - RNA, 17 nt, Mycobacterium avium subsp. paratuberculosis
gucgaggccggccagcg

SEQ ID NO: 999990 - RNA, 23 nt, Mycobacterium avium subsp. paratuberculosis
gucgagguagugcgcgauggcgu

SEQ ID NO: 999991 - RNA, 21 nt, Mycobacterium avium subsp. paratuberculosis
gucgaggucggugaggcuggg

SEQ ID NO: 999992 - RNA, 23 nt, Mycobacterium avium subsp. paratuberculosis
gucgagguucauguggaagccgc

SEQ ID NO: 999993 - RNA, 23 nt, Mycobacterium avium subsp. paratuberculosis
gucgagcggcuugccgccgcagc

SEQ ID NO: 999994 - RNA, 24 nt, Mycobacterium avium subsp. paratuberculosis
gucgagcggcuugccgccgcagcg

SEQ ID NO: 999995 - RNA, 22 nt, Mycobacterium avium subsp. paratuberculosis
guccuugcggaaccgcugcaug

SEQ ID NO: 999996 - RNA, 23 nt, Mycobacterium avium subsp. paratuberculosis
guccuugcggaaccgcugcaugc

SEQ ID NO: 999997 - RNA, 22 nt, Mycobacterium avium subsp. paratuberculosis
gucgagcgucauuccgccgcgc

SEQ ID NO: 999998 - RNA, 17 nt, Mycobacterium avium subsp. paratuberculosis
gucgagcguggggccug

SEQ ID NO: 999999 - RNA, 20 nt, Mycobacterium avium subsp. paratuberculosis
gucgagcuccucggccagcg

SEQ ID NO: 1000000 - RNA, 14 nt, Mycobacterium avium subsp. paratuberculosis
guccuugaaccgca

SEQ ID NO: 1000001 - RNA, 13 nt, Mycobacterium avium subsp. paratuberculosis
guccuugaacuuc

SEQ ID NO: 1000002 - RNA, 13 nt, Mycobacterium avium subsp. paratuberculosis
guccuugaccuug

SEQ ID NO: 1000003 - RNA, 23 nt, Mycobacterium avium subsp. paratuberculosis
guccugguaccccagcaaaaccc

SEQ ID NO: 1000004 - RNA, 19 nt, Mycobacterium avium subsp. paratuberculosis
guccugguugaggaucugc

SEQ ID NO: 1000005 - RNA, 15 nt, Mycobacterium avium subsp. paratuberculosis
gucgccguuggucug

SEQ ID NO: 1000006 - RNA, 22 nt, Mycobacterium avium subsp. paratuberculosis
gucgccguuggucugcgcgagc

SEQ ID NO: 1000007 - RNA, 13 nt, Mycobacterium avium subsp. paratuberculosis
gucgccguccggg

SEQ ID NO: 1000008 - RNA, 17 nt, Mycobacterium avium subsp. paratuberculosis
gucgccguccggggccg

SEQ ID NO: 1000009 - RNA, 16 nt, Mycobacterium avium subsp. paratuberculosis
gucgccgucggggucg

SEQ ID NO: 1000010 - RNA, 22 nt, Mycobacterium avium subsp. paratuberculosis
gucgccgucguauucgacggcg

SEQ ID NO: 1000011 - RNA, 13 nt, Mycobacterium avium subsp. paratuberculosis
gucgccggugcug

SEQ ID NO: 1000012 - RNA, 14 nt, Mycobacterium avium subsp. paratuberculosis
gucgccgugccgga

SEQ ID NO: 1000013 - RNA, 13 nt, Mycobacterium avium subsp. paratuberculosis
gucgccggucugg

SEQ ID NO: 1000014 - RNA, 22 nt, Mycobacterium avium subsp. paratuberculosis
gucgccggcuuaccgaccucga

SEQ ID NO: 1000015 - RNA, 13 nt, Mycobacterium avium subsp. paratuberculosis
gucgccggcggcg

SEQ ID NO: 1000016 - RNA, 15 nt, Mycobacterium avium subsp. paratuberculosis
gucgccggcggggcg

SEQ ID NO: 1000017 - RNA, 23 nt, Mycobacterium avium subsp. paratuberculosis
gucgccggccaggauggagcuga

SEQ ID NO: 1000018 - RNA, 13 nt, Mycobacterium avium subsp. paratuberculosis
gucgccggccucc

SEQ ID NO: 1000019 - RNA, 14 nt, Mycobacterium avium subsp. paratuberculosis
gucgccggccucca

SEQ ID NO: 1000020 - RNA, 15 nt, Mycobacterium avium subsp. paratuberculosis
gucgccggccugccc

SEQ ID NO: 1000021 - RNA, 20 nt, Mycobacterium avium subsp. paratuberculosis
gucgccggccugcccgccgc

SEQ ID NO: 1000022 - RNA, 16 nt, Mycobacterium avium subsp. paratuberculosis
gucgccgcgccgccgg

SEQ ID NO: 1000023 - RNA, 23 nt, Mycobacterium avium subsp. paratuberculosis
gucgccgcgguagacaccgccgu

SEQ ID NO: 1000024 - RNA, 15 nt, Mycobacterium avium subsp. paratuberculosis
gucgcggagcggguc

SEQ ID NO: 1000025 - RNA, 22 nt, Mycobacterium avium subsp. paratuberculosis
gucgcgcgccggcgcagcggcc

SEQ ID NO: 1000026 - RNA, 21 nt, Mycobacterium avium subsp. paratuberculosis
gucgccuccgagauggacagc

SEQ ID NO: 1000027 - RNA, 16 nt, Mycobacterium avium subsp. paratuberculosis
gucgccugcuucugga

SEQ ID NO: 1000028 - RNA, 18 nt, Mycobacterium avium subsp. paratuberculosis
gucgccuucuggcugggg

SEQ ID NO: 1000029 - RNA, 18 nt, Mycobacterium avium subsp. paratuberculosis
gucgcgaagacgcuggcc

SEQ ID NO: 1000030 - RNA, 20 nt, Mycobacterium avium subsp. paratuberculosis
gucgcgaagacgcuggccac

SEQ ID NO: 1000031 - RNA, 20 nt, Mycobacterium avium subsp. paratuberculosis
gucgcgaaaaucgguggugu

SEQ ID NO: 1000032 - RNA, 15 nt, Mycobacterium avium subsp. paratuberculosis
gucgcggcgcugccg

SEQ ID NO: 1000033 - RNA, 17 nt, Mycobacterium avium subsp. paratuberculosis
gucgcggcgcugcgccg

SEQ ID NO: 1000034 - RNA, 11 nt, Mycobacterium avium subsp. paratuberculosis
gucgcggcugc

SEQ ID NO: 1000035 - RNA, 12 nt, Mycobacterium avium subsp. paratuberculosis
gucgcggcgcug

SEQ ID NO: 1000036 - RNA, 14 nt, Mycobacterium avium subsp. paratuberculosis
gucgcggccuucuu

SEQ ID NO: 1000037 - RNA, 13 nt, Mycobacterium avium subsp. paratuberculosis
gucgcggccuugc

SEQ ID NO: 1000038 - RNA, 21 nt, Mycobacterium avium subsp. paratuberculosis
gucgcggcgcacccgggcagc

SEQ ID NO: 1000039 - RNA, 20 nt, Mycobacterium avium subsp. paratuberculosis
gucgcggccuccgagcggcg

SEQ ID NO: 1000040 - RNA, 22 nt, Mycobacterium avium subsp. paratuberculosis
gucgcggaugcgggcgcugccg

SEQ ID NO: 1000041 - RNA, 15 nt, Mycobacterium avium subsp. paratuberculosis
gucgcgcggcugcuc

SEQ ID NO: 1000042 - RNA, 15 nt, Mycobacterium avium subsp. paratuberculosis
gucgcggcccaccgc

SEQ ID NO: 1000043 - RNA, 14 nt, Mycobacterium avium subsp. paratuberculosis
gucgccgacgccgu

SEQ ID NO: 1000044 - RNA, 21 nt, Mycobacterium avium subsp. paratuberculosis
gucgccgacgggcccagcgcg

SEQ ID NO: 1000045 - RNA, 16 nt, Mycobacterium avium subsp. paratuberculosis
gucgccgacgguggcg

SEQ ID NO: 1000046 - RNA, 19 nt, Mycobacterium avium subsp. paratuberculosis
gucgccgacucgcaggugc

SEQ ID NO: 1000047 - RNA, 21 nt, Mycobacterium avium subsp. paratuberculosis
gucgccgaacgccaccaccuc

SEQ ID NO: 1000048 - RNA, 15 nt, Mycobacterium avium subsp. paratuberculosis
gucgccgagccgcgc

SEQ ID NO: 1000049 - RNA, 19 nt, Mycobacterium avium subsp. paratuberculosis
gucgccgauguaguccagc

SEQ ID NO: 1000050 - RNA, 15 nt, Mycobacterium avium subsp. paratuberculosis
gucgccgcccgggcc

SEQ ID NO: 1000051 - RNA, 20 nt, Mycobacterium avium subsp. paratuberculosis
gucgccaucgcaccgcgagc

SEQ ID NO: 1000052 - RNA, 14 nt, Mycobacterium avium subsp. paratuberculosis
gucgccagcgccac

SEQ ID NO: 1000053 - RNA, 17 nt, Mycobacterium avium subsp. paratuberculosis
gucgccagcaccaccuc

SEQ ID NO: 1000054 - RNA, 14 nt, Mycobacterium avium subsp. paratuberculosis
gucgccagccgccg

SEQ ID NO: 1000055 - RNA, 15 nt, Mycobacterium avium subsp. paratuberculosis
gucgcccacccgcca

SEQ ID NO: 1000056 - RNA, 15 nt, Mycobacterium avium subsp. paratuberculosis
gucgcccaucaccag

SEQ ID NO: 1000057 - RNA, 22 nt, Mycobacterium avium subsp. paratuberculosis
gucgcccaucaccagcagaccc

SEQ ID NO: 1000058 - RNA, 16 nt, Mycobacterium avium subsp. paratuberculosis
gucgccaggccaccgc

SEQ ID NO: 1000059 - RNA, 20 nt, Mycobacterium avium subsp. paratuberculosis
gucgccaccaccacggggcg

SEQ ID NO: 1000060 - RNA, 20 nt, Mycobacterium avium subsp. paratuberculosis
gucgccaccaccagcgggcu

SEQ ID NO: 1000061 - RNA, 17 nt, Mycobacterium avium subsp. paratuberculosis
gucgccaccaccgcgcc

SEQ ID NO: 1000062 - RNA, 18 nt, Mycobacterium avium subsp. paratuberculosis
gucgccaccagaccggcg

SEQ ID NO: 1000063 - RNA, 22 nt, Mycobacterium avium subsp. paratuberculosis
gucgccaauccggcgggccucg

SEQ ID NO: 1000064 - RNA, 23 nt, Mycobacterium avium subsp. paratuberculosis
guagaucuccucggacccgauga

SEQ ID NO: 1000065 - RNA, 14 nt, Mycobacterium avium subsp. paratuberculosis
guagcgcgccgggg

SEQ ID NO: 1000066 - RNA, 14 nt, Mycobacterium avium subsp. paratuberculosis
guagcgcagcauca

SEQ ID NO: 1000067 - RNA, 20 nt, Mycobacterium avium subsp. paratuberculosis
guagcgaggugugaggaguc

SEQ ID NO: 1000068 - RNA, 22 nt, Mycobacterium avium subsp. paratuberculosis
guagcgaggugugaggagucgg

SEQ ID NO: 1000069 - RNA, 16 nt, Mycobacterium avium subsp. paratuberculosis
guagcguugccggccg

SEQ ID NO: 1000070 - RNA, 22 nt, Mycobacterium avium subsp. paratuberculosis
guagcucgccgcggccacgcuc

SEQ ID NO: 1000071 - RNA, 20 nt, Mycobacterium avium subsp. paratuberculosis
guaggcgaucagcgcgcaca

SEQ ID NO: 1000072 - RNA, 23 nt, Mycobacterium avium subsp. paratuberculosis
guaggccgccgcgaccgucagca

SEQ ID NO: 1000073 - RNA, 23 nt, Mycobacterium avium subsp. paratuberculosis
guaggccgccugcccgggcgccg

SEQ ID NO: 1000074 - RNA, 22 nt, Mycobacterium avium subsp. paratuberculosis
guagggcacaccggugcucucc

SEQ ID NO: 1000075 - RNA, 13 nt, Mycobacterium avium subsp. paratuberculosis
guagggccgcagc

SEQ ID NO: 1000076 - RNA, 19 nt, Mycobacterium avium subsp. paratuberculosis
guagggcgccgucggcggg

SEQ ID NO: 1000077 - RNA, 13 nt, Mycobacterium avium subsp. paratuberculosis
guagggguccucc

SEQ ID NO: 1000078 - RNA, 20 nt, Mycobacterium avium subsp. paratuberculosis
guagggguccuccagcggca

SEQ ID NO: 1000079 - RNA, 19 nt, Mycobacterium avium subsp. paratuberculosis
guaggcggcgcagccagcg

SEQ ID NO: 1000080 - RNA, 14 nt, Mycobacterium avium subsp. paratuberculosis
guaggcgccgaugc

SEQ ID NO: 1000081 - RNA, 20 nt, Mycobacterium avium subsp. paratuberculosis
guaggcgucgcgcagcagcg

SEQ ID NO: 1000082 - RNA, 13 nt, Mycobacterium avium subsp. paratuberculosis
guaggcgguggcg

SEQ ID NO: 1000083 - RNA, 17 nt, Mycobacterium avium subsp. paratuberculosis
guaggcgguggcgcaca

SEQ ID NO: 1000084 - RNA, 19 nt, Mycobacterium avium subsp. paratuberculosis
guaggcggccagcagcacc

SEQ ID NO: 1000085 - RNA, 14 nt, Mycobacterium avium subsp. paratuberculosis
guaguucugcacgu

SEQ ID NO: 1000086 - RNA, 19 nt, Mycobacterium avium subsp. paratuberculosis
guaguucaccccguaugcg

SEQ ID NO: 1000087 - RNA, 20 nt, Mycobacterium avium subsp. paratuberculosis
guagugguccaccgccgcgc

SEQ ID NO: 1000088 - RNA, 14 nt, Mycobacterium avium subsp. paratuberculosis
guaguggugcaggu

SEQ ID NO: 1000089 - RNA, 19 nt, Mycobacterium avium subsp. paratuberculosis
guagucgucgaccgccacc

SEQ ID NO: 1000090 - RNA, 19 nt, Mycobacterium avium subsp. paratuberculosis
guagugcacggacagcuca

SEQ ID NO: 1000091 - RNA, 14 nt, Mycobacterium avium subsp. paratuberculosis
guagugcagcugca

SEQ ID NO: 1000092 - RNA, 15 nt, Mycobacterium avium subsp. paratuberculosis
guagucggcccaggc

SEQ ID NO: 1000093 - RNA, 23 nt, Mycobacterium avium subsp. paratuberculosis
guagucggcccgccgggccggau

SEQ ID NO: 1000094 - RNA, 19 nt, Mycobacterium avium subsp. paratuberculosis
guagucggcgccgacggcc

SEQ ID NO: 1000095 - RNA, 19 nt, Mycobacterium avium subsp. paratuberculosis
guagucgggauagggcgcg

SEQ ID NO: 1000096 - RNA, 20 nt, Mycobacterium avium subsp. paratuberculosis
guagucgaccacccgcagcu

SEQ ID NO: 1000097 - RNA, 19 nt, Mycobacterium avium subsp. paratuberculosis
guaguaccccgggcugacc

SEQ ID NO: 1000098 - RNA, 22 nt, Mycobacterium avium subsp. paratuberculosis
guaguagaccuugaccaccgag

SEQ ID NO: 1000099 - RNA, 20 nt, Mycobacterium avium subsp. paratuberculosis
guaggugaucgccucgacca

SEQ ID NO: 1000100 - RNA, 18 nt, Mycobacterium avium subsp. paratuberculosis
guaccgguuccgggcgac

SEQ ID NO: 1000101 - RNA, 21 nt, Mycobacterium avium subsp. paratuberculosis
guacggcucguggguggucug

SEQ ID NO: 1000102 - RNA, 19 nt, Mycobacterium avium subsp. paratuberculosis
guagacguagugcagccgc

SEQ ID NO: 1000103 - RNA, 17 nt, Mycobacterium avium subsp. paratuberculosis
guagagccgcugcacgc

SEQ ID NO: 1000104 - RNA, 19 nt, Mycobacterium avium subsp. paratuberculosis
guagagcgggaucugcgcc

SEQ ID NO: 1000105 - RNA, 14 nt, Mycobacterium avium subsp. paratuberculosis
guagagcugacggg

SEQ ID NO: 1000106 - RNA, 23 nt, Mycobacterium avium subsp. paratuberculosis
guagacgagcucaccgccgauga

SEQ ID NO: 1000107 - RNA, 17 nt, Mycobacterium avium subsp. paratuberculosis
guagacgaugcccagcc

SEQ ID NO: 1000108 - RNA, 15 nt, Mycobacterium avium subsp. paratuberculosis
guagacggcaugccg

SEQ ID NO: 1000109 - RNA, 18 nt, Mycobacterium avium subsp. paratuberculosis
guacauggugaccagcgu

SEQ ID NO: 1000110 - RNA, 17 nt, Mycobacterium avium subsp. paratuberculosis
guacccgcccaugcacg

SEQ ID NO: 1000111 - RNA, 16 nt, Mycobacterium avium subsp. paratuberculosis
guaccgccggccaggc

SEQ ID NO: 1000112 - RNA, 14 nt, Mycobacterium avium subsp. paratuberculosis
guaccgcuuggccc

SEQ ID NO: 1000113 - RNA, 13 nt, Mycobacterium avium subsp. paratuberculosis
guacccccgccgg

SEQ ID NO: 1000114 - RNA, 17 nt, Mycobacterium avium subsp. paratuberculosis
guacccccgccggggcc

SEQ ID NO: 1000115 - RNA, 15 nt, Mycobacterium avium subsp. paratuberculosis
ggugugcagcagcuc

SEQ ID NO: 1000116 - RNA, 17 nt, Mycobacterium avium subsp. paratuberculosis
ggugugcagccaggugg

SEQ ID NO: 1000117 - RNA, 16 nt, Mycobacterium avium subsp. paratuberculosis
guaacccuccggcgcc

SEQ ID NO: 1000118 - RNA, 15 nt, Mycobacterium avium subsp. paratuberculosis
guaaccgcagccggg

SEQ ID NO: 1000119 - RNA, 21 nt, Mycobacterium avium subsp. paratuberculosis
guaaccguccagucgcauaug

SEQ ID NO: 1000120 - RNA, 15 nt, Mycobacterium avium subsp. paratuberculosis
guaaggccgaggcga

SEQ ID NO: 1000121 - RNA, 22 nt, Mycobacterium avium subsp. paratuberculosis
guaaggccgaggcgagugagga

SEQ ID NO: 1000122 - RNA, 17 nt, Mycobacterium avium subsp. paratuberculosis
guaagcgacgaggugau

SEQ ID NO: 1000123 - RNA, 15 nt, Mycobacterium avium subsp. paratuberculosis
ggucuucggucccgg

SEQ ID NO: 1000124 - RNA, 14 nt, Mycobacterium avium subsp. paratuberculosis
ggucuucucggcca

SEQ ID NO: 1000125 - RNA, 15 nt, Mycobacterium avium subsp. paratuberculosis
ggucgugucagggau

SEQ ID NO: 1000126 - RNA, 19 nt, Mycobacterium avium subsp. paratuberculosis
ggucguuggagucguccga

SEQ ID NO: 1000127 - RNA, 15 nt, Mycobacterium avium subsp. paratuberculosis
ggucguuggccuccu

SEQ ID NO: 1000128 - RNA, 16 nt, Mycobacterium avium subsp. paratuberculosis
ggucguuggcggcggu

SEQ ID NO: 1000129 - RNA, 14 nt, Mycobacterium avium subsp. paratuberculosis
ggucguggcgccga

SEQ ID NO: 1000130 - RNA, 16 nt, Mycobacterium avium subsp. paratuberculosis
ggucguagcgucgggg

SEQ ID NO: 1000131 - RNA, 15 nt, Mycobacterium avium subsp. paratuberculosis
ggucguagucggccc

SEQ ID NO: 1000132 - RNA, 15 nt, Mycobacterium avium subsp. paratuberculosis
ggucgucgggcggca

SEQ ID NO: 1000133 - RNA, 14 nt, Mycobacterium avium subsp. paratuberculosis
ggucgucgacggcc

SEQ ID NO: 1000134 - RNA, 22 nt, Mycobacterium avium subsp. paratuberculosis
ggucgucuucuuggccgcggcc

SEQ ID NO: 1000135 - RNA, 14 nt, Mycobacterium avium subsp. paratuberculosis
ggucggcgcggcga

SEQ ID NO: 1000136 - RNA, 15 nt, Mycobacterium avium subsp. paratuberculosis
ggucguagagcgcga

SEQ ID NO: 1000137 - RNA, 19 nt, Mycobacterium avium subsp. paratuberculosis
ggucggccacgacgcggcg

SEQ ID NO: 1000138 - RNA, 18 nt, Mycobacterium avium subsp. paratuberculosis
ggucggccuucagcgucc

SEQ ID NO: 1000139 - RNA, 16 nt, Mycobacterium avium subsp. paratuberculosis
ggugaacaccccgcgg

SEQ ID NO: 1000140 - RNA, 20 nt, Mycobacterium avium subsp. paratuberculosis
ggugaaggcggccaccgcgg

SEQ ID NO: 1000141 - RNA, 16 nt, Mycobacterium avium subsp. paratuberculosis
ggugaacugguugacg

SEQ ID NO: 1000142 - RNA, 18 nt, Mycobacterium avium subsp. paratuberculosis
ggugaagaucgcccgccg

SEQ ID NO: 1000143 - RNA, 19 nt, Mycobacterium avium subsp. paratuberculosis
ggugacgaacccgccgcgg

SEQ ID NO: 1000144 - RNA, 16 nt, Mycobacterium avium subsp. paratuberculosis
ggugaccucccggaca

SEQ ID NO: 1000145 - RNA, 19 nt, Mycobacterium avium subsp. paratuberculosis
ggugaccggaucggccagc

SEQ ID NO: 1000146 - RNA, 14 nt, Mycobacterium avium subsp. paratuberculosis
ggugaccggcgcgc

SEQ ID NO: 1000147 - RNA, 23 nt, Mycobacterium avium subsp. paratuberculosis
ggugaccuugcgggcggucagca

SEQ ID NO: 1000148 - RNA, 23 nt, Mycobacterium avium subsp. paratuberculosis
ggugauagaucaucccggccacc

SEQ ID NO: 1000149 - RNA, 23 nt, Mycobacterium avium subsp. paratuberculosis
ggugagaaaagcgaccagcgcgc

SEQ ID NO: 1000150 - RNA, 17 nt, Mycobacterium avium subsp. paratuberculosis
ggugacguacgggcuga

SEQ ID NO: 1000151 - RNA, 11 nt, Mycobacterium avium subsp. paratuberculosis
ggugacgcuga

SEQ ID NO: 1000152 - RNA, 16 nt, Mycobacterium avium subsp. paratuberculosis
ggugacggcgucggcg

SEQ ID NO: 1000153 - RNA, 14 nt, Mycobacterium avium subsp. paratuberculosis
ggucaggcccaggc

SEQ ID NO: 1000154 - RNA, 20 nt, Mycobacterium avium subsp. paratuberculosis
ggucaggguguuguccgagc

SEQ ID NO: 1000155 - RNA, 15 nt, Mycobacterium avium subsp. paratuberculosis
ggucagcucccggca

SEQ ID NO: 1000156 - RNA, 22 nt, Mycobacterium avium subsp. paratuberculosis
ggucagcucgaaaagcuucuug

SEQ ID NO: 1000157 - RNA, 15 nt, Mycobacterium avium subsp. paratuberculosis
ggucagcgucgccgc

SEQ ID NO: 1000158 - RNA, 17 nt, Mycobacterium avium subsp. paratuberculosis
ggucagcgucuggcggg

SEQ ID NO: 1000159 - RNA, 13 nt, Mycobacterium avium subsp. paratuberculosis
ggucagcgcggcc

SEQ ID NO: 1000160 - RNA, 18 nt, Mycobacterium avium subsp. paratuberculosis
ggucagcgcggcccgcgg

SEQ ID NO: 1000161 - RNA, 17 nt, Mycobacterium avium subsp. paratuberculosis
ggucagcgcgucggcga

SEQ ID NO: 1000162 - RNA, 19 nt, Mycobacterium avium subsp. paratuberculosis
ggucagcgcgucggcgacc

SEQ ID NO: 1000163 - RNA, 14 nt, Mycobacterium avium subsp. paratuberculosis
ggucagcggcaggu

SEQ ID NO: 1000164 - RNA, 19 nt, Mycobacterium avium subsp. paratuberculosis
ggucagcggccagcccauc

SEQ ID NO: 1000165 - RNA, 16 nt, Mycobacterium avium subsp. paratuberculosis
ggucagcggcgugcug

SEQ ID NO: 1000166 - RNA, 15 nt, Mycobacterium avium subsp. paratuberculosis
gguccuugcccagca

SEQ ID NO: 1000167 - RNA, 18 nt, Mycobacterium avium subsp. paratuberculosis
gguccuugcccagcaguu

SEQ ID NO: 1000168 - RNA, 19 nt, Mycobacterium avium subsp. paratuberculosis
gguccuugccggcggcggg

SEQ ID NO: 1000169 - RNA, 17 nt, Mycobacterium avium subsp. paratuberculosis
ggucagguuggggccga

SEQ ID NO: 1000170 - RNA, 20 nt, Mycobacterium avium subsp. paratuberculosis
ggucgaacagcacgccggcc

SEQ ID NO: 1000171 - RNA, 14 nt, Mycobacterium avium subsp. paratuberculosis
ggucgaacagcgcg

SEQ ID NO: 1000172 - RNA, 15 nt, Mycobacterium avium subsp. paratuberculosis
ggucgaacagcgcgc

SEQ ID NO: 1000173 - RNA, 19 nt, Mycobacterium avium subsp. paratuberculosis
ggucgaacagcgcgcccga

SEQ ID NO: 1000174 - RNA, 19 nt, Mycobacterium avium subsp. paratuberculosis
ggucgaaccgcgagcgcgc

SEQ ID NO: 1000175 - RNA, 17 nt, Mycobacterium avium subsp. paratuberculosis
ggucgaacgccagcgcc

SEQ ID NO: 1000176 - RNA, 16 nt, Mycobacterium avium subsp. paratuberculosis
ggucgaacgcggcgcc

SEQ ID NO: 1000177 - RNA, 14 nt, Mycobacterium avium subsp. paratuberculosis
ggucgaagaggugc

SEQ ID NO: 1000178 - RNA, 22 nt, Mycobacterium avium subsp. paratuberculosis
ggucgaccaagacggugggccc

SEQ ID NO: 1000179 - RNA, 18 nt, Mycobacterium avium subsp. paratuberculosis
ggucgacccgccgcagcc

SEQ ID NO: 1000180 - RNA, 18 nt, Mycobacterium avium subsp. paratuberculosis
ggucgacgcggggcggcg

SEQ ID NO: 1000181 - RNA, 20 nt, Mycobacterium avium subsp. paratuberculosis
ggucgacgcggggcggcggc

SEQ ID NO: 1000182 - RNA, 22 nt, Mycobacterium avium subsp. paratuberculosis
ggucgacggaagccgagcgguc

SEQ ID NO: 1000183 - RNA, 15 nt, Mycobacterium avium subsp. paratuberculosis
ggucgaugugcgcgc

SEQ ID NO: 1000184 - RNA, 13 nt, Mycobacterium avium subsp. paratuberculosis
ggucgcaggcagc

SEQ ID NO: 1000185 - RNA, 17 nt, Mycobacterium avium subsp. paratuberculosis
ggucgcaggcagcagca

SEQ ID NO: 1000186 - RNA, 15 nt, Mycobacterium avium subsp. paratuberculosis
ggucgaggucgccga

SEQ ID NO: 1000187 - RNA, 19 nt, Mycobacterium avium subsp. paratuberculosis
ggucgccaccaccagcggg

SEQ ID NO: 1000188 - RNA, 21 nt, Mycobacterium avium subsp. paratuberculosis
ggucgccaccaccagcgggcu

SEQ ID NO: 1000189 - RNA, 19 nt, Mycobacterium avium subsp. paratuberculosis
ggucgccacggccggcagc

SEQ ID NO: 1000190 - RNA, 13 nt, Mycobacterium avium subsp. paratuberculosis
ggucgccagcgcc

SEQ ID NO: 1000191 - RNA, 24 nt, Mycobacterium avium subsp. paratuberculosis
ggucgccagcgccacgcucaugcc

SEQ ID NO: 1000192 - RNA, 18 nt, Mycobacterium avium subsp. paratuberculosis
ggucggaggccuugguga

SEQ ID NO: 1000193 - RNA, 14 nt, Mycobacterium avium subsp. paratuberculosis
ggucggccggcagg

SEQ ID NO: 1000194 - RNA, 14 nt, Mycobacterium avium subsp. paratuberculosis
ggucggccggcggg

SEQ ID NO: 1000195 - RNA, 13 nt, Mycobacterium avium subsp. paratuberculosis
ggucggccagcug

SEQ ID NO: 1000196 - RNA, 15 nt, Mycobacterium avium subsp. paratuberculosis
ggucggccagcugcg

SEQ ID NO: 1000197 - RNA, 16 nt, Mycobacterium avium subsp. paratuberculosis
ggucgcugcgcucgcc

SEQ ID NO: 1000198 - RNA, 17 nt, Mycobacterium avium subsp. paratuberculosis
ggucgccggugugcagc

SEQ ID NO: 1000199 - RNA, 15 nt, Mycobacterium avium subsp. paratuberculosis
ggucgccgcccacgc

SEQ ID NO: 1000200 - RNA, 14 nt, Mycobacterium avium subsp. paratuberculosis
ggucgccgcgcagc

SEQ ID NO: 1000201 - RNA, 17 nt, Mycobacterium avium subsp. paratuberculosis
ggucgccgcgcagcacc

SEQ ID NO: 1000202 - RNA, 17 nt, Mycobacterium avium subsp. paratuberculosis
ggugaucucgccgagca

SEQ ID NO: 1000203 - RNA, 16 nt, Mycobacterium avium subsp. paratuberculosis
ggugaucuuggugaag

SEQ ID NO: 1000204 - RNA, 19 nt, Mycobacterium avium subsp. paratuberculosis
ggugaucuuguuguuggug

SEQ ID NO: 1000205 - RNA, 15 nt, Mycobacterium avium subsp. paratuberculosis
ggugauccagcccug

SEQ ID NO: 1000206 - RNA, 13 nt, Mycobacterium avium subsp. paratuberculosis
ggugaucccagga

SEQ ID NO: 1000207 - RNA, 23 nt, Mycobacterium avium subsp. paratuberculosis
ggugaucgacauagucgaggggc

SEQ ID NO: 1000208 - RNA, 20 nt, Mycobacterium avium subsp. paratuberculosis
ggugaucgccggaucgccga

SEQ ID NO: 1000209 - RNA, 17 nt, Mycobacterium avium subsp. paratuberculosis
ggugaucgcgaacgcgc

SEQ ID NO: 1000210 - RNA, 17 nt, Mycobacterium avium subsp. paratuberculosis
ggugaucgcgucaacca

SEQ ID NO: 1000211 - RNA, 14 nt, Mycobacterium avium subsp. paratuberculosis
ggugaucggccagg

SEQ ID NO: 1000212 - RNA, 14 nt, Mycobacterium avium subsp. paratuberculosis
ggugcagcagcgcc

SEQ ID NO: 1000213 - RNA, 15 nt, Mycobacterium avium subsp. paratuberculosis
ggugcagcagcugga

SEQ ID NO: 1000214 - RNA, 19 nt, Mycobacterium avium subsp. paratuberculosis
ggugcacccgaugcucccg

SEQ ID NO: 1000215 - RNA, 13 nt, Mycobacterium avium subsp. paratuberculosis
ggugccgaccugg

SEQ ID NO: 1000216 - RNA, 19 nt, Mycobacterium avium subsp. paratuberculosis
ggugccgacgagcucgccg

SEQ ID NO: 1000217 - RNA, 22 nt, Mycobacterium avium subsp. paratuberculosis
ggugccgacggugcgugccagc

SEQ ID NO: 1000218 - RNA, 15 nt, Mycobacterium avium subsp. paratuberculosis
ggugccgagcccgcc

SEQ ID NO: 1000219 - RNA, 22 nt, Mycobacterium avium subsp. paratuberculosis
ggugccgagcccgccggcggcg

SEQ ID NO: 1000220 - RNA, 15 nt, Mycobacterium avium subsp. paratuberculosis
ggugcccugugaggc

SEQ ID NO: 1000221 - RNA, 17 nt, Mycobacterium avium subsp. paratuberculosis
ggugccgcagccguccc

SEQ ID NO: 1000222 - RNA, 15 nt, Mycobacterium avium subsp. paratuberculosis
ggugccgcagcggcg

SEQ ID NO: 1000223 - RNA, 12 nt, Mycobacterium avium subsp. paratuberculosis
ggugccgcagcu

SEQ ID NO: 1000224 - RNA, 21 nt, Mycobacterium avium subsp. paratuberculosis
ggugccgcguucggaggcuuc

SEQ ID NO: 1000225 - RNA, 14 nt, Mycobacterium avium subsp. paratuberculosis
ggugccgccgggca

SEQ ID NO: 1000226 - RNA, 18 nt, Mycobacterium avium subsp. paratuberculosis
ggugccgauccgcaccgg

SEQ ID NO: 1000227 - RNA, 23 nt, Mycobacterium avium subsp. paratuberculosis
ggugccgcccaacgacgucggcg

SEQ ID NO: 1000228 - RNA, 20 nt, Mycobacterium avium subsp. paratuberculosis
ggugccgcccggaggguauu

SEQ ID NO: 1000229 - RNA, 16 nt, Mycobacterium avium subsp. paratuberculosis
ggugcgacgccgcgca

SEQ ID NO: 1000230 - RNA, 15 nt, Mycobacterium avium subsp. paratuberculosis
ggugcgccggcagcg

SEQ ID NO: 1000231 - RNA, 16 nt, Mycobacterium avium subsp. paratuberculosis
ggugcgccagaucgcu

SEQ ID NO: 1000232 - RNA, 16 nt, Mycobacterium avium subsp. paratuberculosis
ggugcgccagcgccgg

SEQ ID NO: 1000233 - RNA, 15 nt, Mycobacterium avium subsp. paratuberculosis
ggugcgccaggcagg

SEQ ID NO: 1000234 - RNA, 18 nt, Mycobacterium avium subsp. paratuberculosis
ggugcgccaggcaggcgg

SEQ ID NO: 1000235 - RNA, 15 nt, Mycobacterium avium subsp. paratuberculosis
ggugcgcauggcgug

SEQ ID NO: 1000236 - RNA, 15 nt, Mycobacterium avium subsp. paratuberculosis
ggugcgcggucagcg

SEQ ID NO: 1000237 - RNA, 20 nt, Mycobacterium avium subsp. paratuberculosis
ggugcgcgaguaggcgaaga

SEQ ID NO: 1000238 - RNA, 23 nt, Mycobacterium avium subsp. paratuberculosis
ggugcgcgcaccaggccgacgcu

SEQ ID NO: 1000239 - RNA, 14 nt, Mycobacterium avium subsp. paratuberculosis
ggugcgcggcgccg

SEQ ID NO: 1000240 - RNA, 12 nt, Mycobacterium avium subsp. paratuberculosis
ggugcggccagc

SEQ ID NO: 1000241 - RNA, 13 nt, Mycobacterium avium subsp. paratuberculosis
ggugcggccagcg

SEQ ID NO: 1000242 - RNA, 22 nt, Mycobacterium avium subsp. paratuberculosis
ggugcgcucgugaccggcggug

SEQ ID NO: 1000243 - RNA, 17 nt, Mycobacterium avium subsp. paratuberculosis
ggugcggacggucgccg

SEQ ID NO: 1000244 - RNA, 18 nt, Mycobacterium avium subsp. paratuberculosis
ggugcggacggucgccga

SEQ ID NO: 1000245 - RNA, 21 nt, Mycobacterium avium subsp. paratuberculosis
ggugcggcaacccgaucgccg

SEQ ID NO: 1000246 - RNA, 14 nt, Mycobacterium avium subsp. paratuberculosis
ggugccgggccagg

SEQ ID NO: 1000247 - RNA, 15 nt, Mycobacterium avium subsp. paratuberculosis
ggugccgggccaggu

SEQ ID NO: 1000248 - RNA, 20 nt, Mycobacterium avium subsp. paratuberculosis
ggugccgucgaucgcccgcu

SEQ ID NO: 1000249 - RNA, 11 nt, Mycobacterium avium subsp. paratuberculosis
ggugccgucgc

SEQ ID NO: 1000250 - RNA, 19 nt, Mycobacterium avium subsp. paratuberculosis
ggugccgucgcgcucgacg

SEQ ID NO: 1000251 - RNA, 15 nt, Mycobacterium avium subsp. paratuberculosis
ggugccgucggcggg

SEQ ID NO: 1000252 - RNA, 18 nt, Mycobacterium avium subsp. paratuberculosis
ggugccgcgaugcccgcc

SEQ ID NO: 1000253 - RNA, 16 nt, Mycobacterium avium subsp. paratuberculosis
ggugccggaggcggcg

SEQ ID NO: 1000254 - RNA, 20 nt, Mycobacterium avium subsp. paratuberculosis
ggugcucagguugcgcagca

SEQ ID NO: 1000255 - RNA, 14 nt, Mycobacterium avium subsp. paratuberculosis
ggugcucgcgcagg

SEQ ID NO: 1000256 - RNA, 19 nt, Mycobacterium avium subsp. paratuberculosis
ggugcucgacggcacccgg

SEQ ID NO: 1000257 - RNA, 22 nt, Mycobacterium avium subsp. paratuberculosis
ggugcguccagaccggccgggg

SEQ ID NO: 1000258 - RNA, 21 nt, Mycobacterium avium subsp. paratuberculosis
ggugcgucgaaucacaaggga

SEQ ID NO: 1000259 - RNA, 19 nt, Mycobacterium avium subsp. paratuberculosis
ggugcgugaugaccagggc

SEQ ID NO: 1000260 - RNA, 22 nt, Mycobacterium avium subsp. paratuberculosis
ggugcgugaugaccagggccuc

SEQ ID NO: 1000261 - RNA, 22 nt, Mycobacterium avium subsp. paratuberculosis
ggugcgguaggugccggccgcg

SEQ ID NO: 1000262 - RNA, 18 nt, Mycobacterium avium subsp. paratuberculosis
ggugcggucgcgcagccg

SEQ ID NO: 1000263 - RNA, 19 nt, Mycobacterium avium subsp. paratuberculosis
ggugcggugcaccgcggcg

SEQ ID NO: 1000264 - RNA, 13 nt, Mycobacterium avium subsp. paratuberculosis
ggugcggugcagc

SEQ ID NO: 1000265 - RNA, 17 nt, Mycobacterium avium subsp. paratuberculosis
ggugcggugcggccgcg

SEQ ID NO: 1000266 - RNA, 17 nt, Mycobacterium avium subsp. paratuberculosis
ggugcgggugcggccgg

SEQ ID NO: 1000267 - RNA, 15 nt, Mycobacterium avium subsp. paratuberculosis
ggugcggcgugcggu

SEQ ID NO: 1000268 - RNA, 19 nt, Mycobacterium avium subsp. paratuberculosis
ggugcggcuuugcugccaa

SEQ ID NO: 1000269 - RNA, 13 nt, Mycobacterium avium subsp. paratuberculosis
ggugcgggcugca

SEQ ID NO: 1000270 - RNA, 17 nt, Mycobacterium avium subsp. paratuberculosis
gguggaugaugccggcg

SEQ ID NO: 1000271 - RNA, 18 nt, Mycobacterium avium subsp. paratuberculosis
gguggaugaugccggcgg

SEQ ID NO: 1000272 - RNA, 19 nt, Mycobacterium avium subsp. paratuberculosis
gguggaugcgagccagcug

SEQ ID NO: 1000273 - RNA, 21 nt, Mycobacterium avium subsp. paratuberculosis
gguggauugucggccgcccgu

SEQ ID NO: 1000274 - RNA, 17 nt, Mycobacterium avium subsp. paratuberculosis
gguggcgcugccgagca

SEQ ID NO: 1000275 - RNA, 14 nt, Mycobacterium avium subsp. paratuberculosis
gguggcggcgagga

SEQ ID NO: 1000276 - RNA, 23 nt, Mycobacterium avium subsp. paratuberculosis
ggugcuuuugugucugcucgccu

SEQ ID NO: 1000277 - RNA, 19 nt, Mycobacterium avium subsp. paratuberculosis
gguggacgagcagccgcaa

SEQ ID NO: 1000278 - RNA, 18 nt, Mycobacterium avium subsp. paratuberculosis
gguggagaaguggcuggu

SEQ ID NO: 1000279 - RNA, 12 nt, Mycobacterium avium subsp. paratuberculosis
gguggagcggcc

SEQ ID NO: 1000280 - RNA, 13 nt, Mycobacterium avium subsp. paratuberculosis
gguggagcgcggc

SEQ ID NO: 1000281 - RNA, 15 nt, Mycobacterium avium subsp. paratuberculosis
gguggugggcgcggu

SEQ ID NO: 1000282 - RNA, 14 nt, Mycobacterium avium subsp. paratuberculosis
ggugguguggcagg

SEQ ID NO: 1000283 - RNA, 18 nt, Mycobacterium avium subsp. paratuberculosis
ggugucccgcgcccgcga

SEQ ID NO: 1000284 - RNA, 16 nt, Mycobacterium avium subsp. paratuberculosis
ggugucaggaucgccg

SEQ ID NO: 1000285 - RNA, 14 nt, Mycobacterium avium subsp. paratuberculosis
gguggugggcgugc

SEQ ID NO: 1000286 - RNA, 14 nt, Mycobacterium avium subsp. paratuberculosis
ggugguggugccca

SEQ ID NO: 1000287 - RNA, 20 nt, Mycobacterium avium subsp. paratuberculosis
ggugguugaucacgggcaca

SEQ ID NO: 1000288 - RNA, 13 nt, Mycobacterium avium subsp. paratuberculosis
ggugucggcggca

SEQ ID NO: 1000289 - RNA, 22 nt, Mycobacterium avium subsp. paratuberculosis
ggugucgaagcugcgcagccgu

SEQ ID NO: 1000290 - RNA, 17 nt, Mycobacterium avium subsp. paratuberculosis
ggugucgacgccgggcu

SEQ ID NO: 1000291 - RNA, 14 nt, Mycobacterium avium subsp. paratuberculosis
ggugucgagccggu

SEQ ID NO: 1000292 - RNA, 16 nt, Mycobacterium avium subsp. paratuberculosis
ggugucgcacagcaug

SEQ ID NO: 1000293 - RNA, 12 nt, Mycobacterium avium subsp. paratuberculosis
ggugucgcccuc

SEQ ID NO: 1000294 - RNA, 22 nt, Mycobacterium avium subsp. paratuberculosis
gguggcggugcggucgcgcagc

SEQ ID NO: 1000295 - RNA, 15 nt, Mycobacterium avium subsp. paratuberculosis
ggugggcaccagcag

SEQ ID NO: 1000296 - RNA, 16 nt, Mycobacterium avium subsp. paratuberculosis
ggugggcaccagcagc

SEQ ID NO: 1000297 - RNA, 20 nt, Mycobacterium avium subsp. paratuberculosis
gguggugauuguaggugugc

SEQ ID NO: 1000298 - RNA, 14 nt, Mycobacterium avium subsp. paratuberculosis
ggugguccacccag

SEQ ID NO: 1000299 - RNA, 14 nt, Mycobacterium avium subsp. paratuberculosis
ggugggcccgccgu

SEQ ID NO: 1000300 - RNA, 14 nt, Mycobacterium avium subsp. paratuberculosis
gguggucaccagcg

SEQ ID NO: 1000301 - RNA, 20 nt, Mycobacterium avium subsp. paratuberculosis
gguacagcgacuccagcgcg

SEQ ID NO: 1000302 - RNA, 14 nt, Mycobacterium avium subsp. paratuberculosis
gguacucggcggcg

SEQ ID NO: 1000303 - RNA, 21 nt, Mycobacterium avium subsp. paratuberculosis
gguacgugcgccggcggugcg

SEQ ID NO: 1000304 - RNA, 15 nt, Mycobacterium avium subsp. paratuberculosis
gguacuagccuggca

SEQ ID NO: 1000305 - RNA, 20 nt, Mycobacterium avium subsp. paratuberculosis
gguagaaccaacgcggcgcc

SEQ ID NO: 1000306 - RNA, 17 nt, Mycobacterium avium subsp. paratuberculosis
gguagacgucgggcugg

SEQ ID NO: 1000307 - RNA, 21 nt, Mycobacterium avium subsp. paratuberculosis
gguagacguucuccccgccgg

SEQ ID NO: 1000308 - RNA, 21 nt, Mycobacterium avium subsp. paratuberculosis
gguaccagggcagcgccucgg

SEQ ID NO: 1000309 - RNA, 14 nt, Mycobacterium avium subsp. paratuberculosis
gguaccucugcgcg

SEQ ID NO: 1000310 - RNA, 20 nt, Mycobacterium avium subsp. paratuberculosis
gguaccucugcgcgagcagc

SEQ ID NO: 1000311 - RNA, 21 nt, Mycobacterium avium subsp. paratuberculosis
gguacggcucaacggccggcg

SEQ ID NO: 1000312 - RNA, 14 nt, Mycobacterium avium subsp. paratuberculosis
gguaguucugcucg

SEQ ID NO: 1000313 - RNA, 15 nt, Mycobacterium avium subsp. paratuberculosis
gguaguucagcgcgc

SEQ ID NO: 1000314 - RNA, 18 nt, Mycobacterium avium subsp. paratuberculosis
gguaguacaccgggcugg

SEQ ID NO: 1000315 - RNA, 15 nt, Mycobacterium avium subsp. paratuberculosis
gguaguagcgcgccg

SEQ ID NO: 1000316 - RNA, 21 nt, Mycobacterium avium subsp. paratuberculosis
gguagugcacggacagcucac

SEQ ID NO: 1000317 - RNA, 16 nt, Mycobacterium avium subsp. paratuberculosis
gguagucggcccaggc

SEQ ID NO: 1000318 - RNA, 16 nt, Mycobacterium avium subsp. paratuberculosis
gguagaucagcgccug

SEQ ID NO: 1000319 - RNA, 22 nt, Mycobacterium avium subsp. paratuberculosis
gguagagcggcaccagguucac

SEQ ID NO: 1000320 - RNA, 13 nt, Mycobacterium avium subsp. paratuberculosis
gguagggcacacc

SEQ ID NO: 1000321 - RNA, 13 nt, Mycobacterium avium subsp. paratuberculosis
gguagggcggcgg

SEQ ID NO: 1000322 - RNA, 15 nt, Mycobacterium avium subsp. paratuberculosis
gguagggucgggugc

SEQ ID NO: 1000323 - RNA, 12 nt, Mycobacterium avium subsp. paratuberculosis
gguaggcggcga

SEQ ID NO: 1000324 - RNA, 13 nt, Mycobacterium avium subsp. paratuberculosis
gguaggcggcgcc

SEQ ID NO: 1000325 - RNA, 21 nt, Mycobacterium avium subsp. paratuberculosis
gguaggcguuguugggcuugg

SEQ ID NO: 1000326 - RNA, 19 nt, Mycobacterium avium subsp. paratuberculosis
ggucaccaucagcaccgcc

SEQ ID NO: 1000327 - RNA, 14 nt, Mycobacterium avium subsp. paratuberculosis
ggucaccagcgcgg

SEQ ID NO: 1000328 - RNA, 18 nt, Mycobacterium avium subsp. paratuberculosis
ggucaccagcggcccgcu

SEQ ID NO: 1000329 - RNA, 11 nt, Mycobacterium avium subsp. paratuberculosis
ggucaccagcu

SEQ ID NO: 1000330 - RNA, 19 nt, Mycobacterium avium subsp. paratuberculosis
ggucacccgguugagcacc

SEQ ID NO: 1000331 - RNA, 18 nt, Mycobacterium avium subsp. paratuberculosis
ggucacggucuggcuggu

SEQ ID NO: 1000332 - RNA, 15 nt, Mycobacterium avium subsp. paratuberculosis
ggucagcgccagcau

SEQ ID NO: 1000333 - RNA, 16 nt, Mycobacterium avium subsp. paratuberculosis
ggucagccgggcggcc

SEQ ID NO: 1000334 - RNA, 20 nt, Mycobacterium avium subsp. paratuberculosis
ggucacgcugaucgaccggu

SEQ ID NO: 1000335 - RNA, 16 nt, Mycobacterium avium subsp. paratuberculosis
ggucacgcuggcguga

SEQ ID NO: 1000336 - RNA, 21 nt, Mycobacterium avium subsp. paratuberculosis
ggucacggccgccagcagcac

SEQ ID NO: 1000337 - RNA, 14 nt, Mycobacterium avium subsp. paratuberculosis
ggucacgcccgggu

SEQ ID NO: 1000338 - RNA, 14 nt, Mycobacterium avium subsp. paratuberculosis
ggucaccgagcggc

SEQ ID NO: 1000339 - RNA, 20 nt, Mycobacterium avium subsp. paratuberculosis
ggucaccgagcggccgucca

SEQ ID NO: 1000340 - RNA, 19 nt, Mycobacterium avium subsp. paratuberculosis
ggucaccgugucggcgggc

SEQ ID NO: 1000341 - RNA, 22 nt, Mycobacterium avium subsp. paratuberculosis
ggucaccgugucggcgggcggg

SEQ ID NO: 1000342 - RNA, 21 nt, Mycobacterium avium subsp. paratuberculosis
ggucaccgucguacucgaccg

SEQ ID NO: 1000343 - RNA, 17 nt, Mycobacterium avium subsp. paratuberculosis
ggucaccuuggccggau

SEQ ID NO: 1000344 - RNA, 22 nt, Mycobacterium avium subsp. paratuberculosis
ggguuuucacgucgagcggccc

SEQ ID NO: 1000345 - RNA, 14 nt, Mycobacterium avium subsp. paratuberculosis
ggguuggccagggc

SEQ ID NO: 1000346 - RNA, 15 nt, Mycobacterium avium subsp. paratuberculosis
ggguuggccagggcg

SEQ ID NO: 1000347 - RNA, 18 nt, Mycobacterium avium subsp. paratuberculosis
ggguuggccagggcggcc

SEQ ID NO: 1000348 - RNA, 16 nt, Mycobacterium avium subsp. paratuberculosis
ggguugggcgccagca

SEQ ID NO: 1000349 - RNA, 15 nt, Mycobacterium avium subsp. paratuberculosis
ggguugcuguacugg

SEQ ID NO: 1000350 - RNA, 16 nt, Mycobacterium avium subsp. paratuberculosis
ggguugcgggccaggc

SEQ ID NO: 1000351 - RNA, 12 nt, Mycobacterium avium subsp. paratuberculosis
ggguugccggcg

SEQ ID NO: 1000352 - RNA, 17 nt, Mycobacterium avium subsp. paratuberculosis
ggguugcgaaagcccag

SEQ ID NO: 1000353 - RNA, 19 nt, Mycobacterium avium subsp. paratuberculosis
ggguugcgaaagcccaggc

SEQ ID NO: 1000354 - RNA, 18 nt, Mycobacterium avium subsp. paratuberculosis
ggguugagcaggucagcc

SEQ ID NO: 1000355 - RNA, 18 nt, Mycobacterium avium subsp. paratuberculosis
ggguucuucagggcggug

SEQ ID NO: 1000356 - RNA, 16 nt, Mycobacterium avium subsp. paratuberculosis
ggguucuggccguggu

SEQ ID NO: 1000357 - RNA, 23 nt, Mycobacterium avium subsp. paratuberculosis
ggguucggcggcgcggcccaggg

SEQ ID NO: 1000358 - RNA, 20 nt, Mycobacterium avium subsp. paratuberculosis
ggguucggucucggcggcgc

SEQ ID NO: 1000359 - RNA, 16 nt, Mycobacterium avium subsp. paratuberculosis
ggguguuggcgcacag

SEQ ID NO: 1000360 - RNA, 23 nt, Mycobacterium avium subsp. paratuberculosis
ggguggacaccuuggcggccacc

SEQ ID NO: 1000361 - RNA, 16 nt, Mycobacterium avium subsp. paratuberculosis
ggguggccuucaucac

SEQ ID NO: 1000362 - RNA, 23 nt, Mycobacterium avium subsp. paratuberculosis
ggguggcgccacagccggggauc

SEQ ID NO: 1000363 - RNA, 21 nt, Mycobacterium avium subsp. paratuberculosis
ggguggaucuugacggcgacg

SEQ ID NO: 1000364 - RNA, 12 nt, Mycobacterium avium subsp. paratuberculosis
ggguggccagca

SEQ ID NO: 1000365 - RNA, 22 nt, Mycobacterium avium subsp. paratuberculosis
ggguggaacuggacgccgugga

SEQ ID NO: 1000366 - RNA, 17 nt, Mycobacterium avium subsp. paratuberculosis
gggugcgggcgcugcaa

SEQ ID NO: 1000367 - RNA, 19 nt, Mycobacterium avium subsp. paratuberculosis
gggugcgggugcggccggu

SEQ ID NO: 1000368 - RNA, 17 nt, Mycobacterium avium subsp. paratuberculosis
gggugcucaccccggcc

SEQ ID NO: 1000369 - RNA, 19 nt, Mycobacterium avium subsp. paratuberculosis
gggugcucgaucggcgcgc

SEQ ID NO: 1000370 - RNA, 17 nt, Mycobacterium avium subsp. paratuberculosis
ggggaccguccccgucc

SEQ ID NO: 1000371 - RNA, 23 nt, Mycobacterium avium subsp. paratuberculosis
ggggacacccucgggguagccgg

SEQ ID NO: 1000372 - RNA, 17 nt, Mycobacterium avium subsp. paratuberculosis
ggggacggugcagccgg

SEQ ID NO: 1000373 - RNA, 19 nt, Mycobacterium avium subsp. paratuberculosis
ggggacgucgacgugggcg

SEQ ID NO: 1000374 - RNA, 14 nt, Mycobacterium avium subsp. paratuberculosis
ggggagaggcgcgg

SEQ ID NO: 1000375 - RNA, 17 nt, Mycobacterium avium subsp. paratuberculosis
ggguaguucugcucgau

SEQ ID NO: 1000376 - RNA, 13 nt, Mycobacterium avium subsp. paratuberculosis
ggguccagccgcc

SEQ ID NO: 1000377 - RNA, 14 nt, Mycobacterium avium subsp. paratuberculosis
ggguccagccgccg

SEQ ID NO: 1000378 - RNA, 18 nt, Mycobacterium avium subsp. paratuberculosis
ggguccaggccgcgccgg

SEQ ID NO: 1000379 - RNA, 14 nt, Mycobacterium avium subsp. paratuberculosis
ggguccagggcggg

SEQ ID NO: 1000380 - RNA, 23 nt, Mycobacterium avium subsp. paratuberculosis
gggucccggcaacaccggcggcg

SEQ ID NO: 1000381 - RNA, 14 nt, Mycobacterium avium subsp. paratuberculosis
ggguccgccgggcg

SEQ ID NO: 1000382 - RNA, 16 nt, Mycobacterium avium subsp. paratuberculosis
ggguccgccgggcgcg

SEQ ID NO: 1000383 - RNA, 15 nt, Mycobacterium avium subsp. paratuberculosis
ggguccgaccagcac

SEQ ID NO: 1000384 - RNA, 22 nt, Mycobacterium avium subsp. paratuberculosis
ggguccgccccgagaucccagc

SEQ ID NO: 1000385 - RNA, 17 nt, Mycobacterium avium subsp. paratuberculosis
gggucugugaccacggu

SEQ ID NO: 1000386 - RNA, 18 nt, Mycobacterium avium subsp. paratuberculosis
gggucuucagcccgcgca

SEQ ID NO: 1000387 - RNA, 14 nt, Mycobacterium avium subsp. paratuberculosis
gggucuuccacgcc

SEQ ID NO: 1000388 - RNA, 17 nt, Mycobacterium avium subsp. paratuberculosis
gggucucaucccgccga

SEQ ID NO: 1000389 - RNA, 20 nt, Mycobacterium avium subsp. paratuberculosis
gggucucgaaccgggcggug

SEQ ID NO: 1000390 - RNA, 15 nt, Mycobacterium avium subsp. paratuberculosis
gggucucgcgcagca

SEQ ID NO: 1000391 - RNA, 16 nt, Mycobacterium avium subsp. paratuberculosis
gggucguuggcggcgg

SEQ ID NO: 1000392 - RNA, 17 nt, Mycobacterium avium subsp. paratuberculosis
gggucguuggcggcggu

SEQ ID NO: 1000393 - RNA, 20 nt, Mycobacterium avium subsp. paratuberculosis
gggucguuggcggcgguggg

SEQ ID NO: 1000394 - RNA, 14 nt, Mycobacterium avium subsp. paratuberculosis
gggucgucggccug

SEQ ID NO: 1000395 - RNA, 21 nt, Mycobacterium avium subsp. paratuberculosis
gggucgucguucucgggggcg

SEQ ID NO: 1000396 - RNA, 22 nt, Mycobacterium avium subsp. paratuberculosis
gggucguccgcgacgcugagcg

SEQ ID NO: 1000397 - RNA, 21 nt, Mycobacterium avium subsp. paratuberculosis
gggucgggggugggcucccag

SEQ ID NO: 1000398 - RNA, 15 nt, Mycobacterium avium subsp. paratuberculosis
gggucgggugcggcg

SEQ ID NO: 1000399 - RNA, 19 nt, Mycobacterium avium subsp. paratuberculosis
gggucgguggcccagccgg

SEQ ID NO: 1000400 - RNA, 14 nt, Mycobacterium avium subsp. paratuberculosis
gggucguagagcgc

SEQ ID NO: 1000401 - RNA, 22 nt, Mycobacterium avium subsp. paratuberculosis
gggucguagagcgcgaagcccu

SEQ ID NO: 1000402 - RNA, 17 nt, Mycobacterium avium subsp. paratuberculosis
ggguccuggcccccgcc

SEQ ID NO: 1000403 - RNA, 20 nt, Mycobacterium avium subsp. paratuberculosis
ggguccguguggcgcugaug

SEQ ID NO: 1000404 - RNA, 18 nt, Mycobacterium avium subsp. paratuberculosis
ggguccuccagcggcagg

SEQ ID NO: 1000405 - RNA, 19 nt, Mycobacterium avium subsp. paratuberculosis
ggguccucgauggcggcgg

SEQ ID NO: 1000406 - RNA, 19 nt, Mycobacterium avium subsp. paratuberculosis
gggucgggaggcagcgcgg

SEQ ID NO: 1000407 - RNA, 18 nt, Mycobacterium avium subsp. paratuberculosis
ggguccuugccggcggcg

SEQ ID NO: 1000408 - RNA, 13 nt, Mycobacterium avium subsp. paratuberculosis
gggugagcggcgc

SEQ ID NO: 1000409 - RNA, 17 nt, Mycobacterium avium subsp. paratuberculosis
gggugagacggccagca

SEQ ID NO: 1000410 - RNA, 11 nt, Mycobacterium avium subsp. paratuberculosis
gggugccuucu

SEQ ID NO: 1000411 - RNA, 13 nt, Mycobacterium avium subsp. paratuberculosis
gggugcggccagc

SEQ ID NO: 1000412 - RNA, 16 nt, Mycobacterium avium subsp. paratuberculosis
gggugacguggcggcc

SEQ ID NO: 1000413 - RNA, 15 nt, Mycobacterium avium subsp. paratuberculosis
gggugaccgacagca

SEQ ID NO: 1000414 - RNA, 13 nt, Mycobacterium avium subsp. paratuberculosis
gggugacgccuca

SEQ ID NO: 1000415 - RNA, 23 nt, Mycobacterium avium subsp. paratuberculosis
gggugacgcgaaugucgaccacc

SEQ ID NO: 1000416 - RNA, 14 nt, Mycobacterium avium subsp. paratuberculosis
gggugaaggcggcc

SEQ ID NO: 1000417 - RNA, 16 nt, Mycobacterium avium subsp. paratuberculosis
gggugaacgaggccgc

SEQ ID NO: 1000418 - RNA, 17 nt, Mycobacterium avium subsp. paratuberculosis
gggucuucucgaagcgc

SEQ ID NO: 1000419 - RNA, 16 nt, Mycobacterium avium subsp. paratuberculosis
gggcauccgcucgccg

SEQ ID NO: 1000420 - RNA, 22 nt, Mycobacterium avium subsp. paratuberculosis
gggcauccgcucgccgcgggug

SEQ ID NO: 1000421 - RNA, 17 nt, Mycobacterium avium subsp. paratuberculosis
gggcauccgggaggcca

SEQ ID NO: 1000422 - RNA, 15 nt, Mycobacterium avium subsp. paratuberculosis
gggcaugccggccgg

SEQ ID NO: 1000423 - RNA, 22 nt, Mycobacterium avium subsp. paratuberculosis
gggcaugccguucagcgcggcc

SEQ ID NO: 1000424 - RNA, 14 nt, Mycobacterium avium subsp. paratuberculosis
gggcaucggcuggu

SEQ ID NO: 1000425 - RNA, 18 nt, Mycobacterium avium subsp. paratuberculosis
gggcaugaaccaggccgc

SEQ ID NO: 1000426 - RNA, 21 nt, Mycobacterium avium subsp. paratuberculosis
gggcaugaaccaggccgcgcu

SEQ ID NO: 1000427 - RNA, 23 nt, Mycobacterium avium subsp. paratuberculosis
gggcagcuuccgccucggcgagg

SEQ ID NO: 1000428 - RNA, 23 nt, Mycobacterium avium subsp. paratuberculosis
gggcaggccgggauagagcaccg

SEQ ID NO: 1000429 - RNA, 17 nt, Mycobacterium avium subsp. paratuberculosis
gggcaggccggugcugu

SEQ ID NO: 1000430 - RNA, 21 nt, Mycobacterium avium subsp. paratuberculosis
gggcagcucgucggcgcgcca

SEQ ID NO: 1000431 - RNA, 15 nt, Mycobacterium avium subsp. paratuberculosis
gggcagcucggcggg

SEQ ID NO: 1000432 - RNA, 22 nt, Mycobacterium avium subsp. paratuberculosis
gggcagcucggcgggcucccuc

SEQ ID NO: 1000433 - RNA, 23 nt, Mycobacterium avium subsp. paratuberculosis
gggcagcugauagcccgccgcgg

SEQ ID NO: 1000434 - RNA, 16 nt, Mycobacterium avium subsp. paratuberculosis
gggcacgcagcggcgu

SEQ ID NO: 1000435 - RNA, 22 nt, Mycobacterium avium subsp. paratuberculosis
gggcacgcgagacgagccgccg

SEQ ID NO: 1000436 - RNA, 18 nt, Mycobacterium avium subsp. paratuberculosis
gggcaggcucagguaggc

SEQ ID NO: 1000437 - RNA, 14 nt, Mycobacterium avium subsp. paratuberculosis
gggcagggucgcgg

SEQ ID NO: 1000438 - RNA, 17 nt, Mycobacterium avium subsp. paratuberculosis
gggcagggucgcggagc

SEQ ID NO: 1000439 - RNA, 21 nt, Mycobacterium avium subsp. paratuberculosis
gggcagggugaccgaggccgc

SEQ ID NO: 1000440 - RNA, 17 nt, Mycobacterium avium subsp. paratuberculosis
gggcaguagcgacgcga

SEQ ID NO: 1000441 - RNA, 14 nt, Mycobacterium avium subsp. paratuberculosis
gggcccgacgacga

SEQ ID NO: 1000442 - RNA, 17 nt, Mycobacterium avium subsp. paratuberculosis
gggccccuccagccgcc

SEQ ID NO: 1000443 - RNA, 17 nt, Mycobacterium avium subsp. paratuberculosis
gggcccgauggcggccu

SEQ ID NO: 1000444 - RNA, 22 nt, Mycobacterium avium subsp. paratuberculosis
gggcccgauggcggccugcagg

SEQ ID NO: 1000445 - RNA, 12 nt, Mycobacterium avium subsp. paratuberculosis
gggcccgcagcc

SEQ ID NO: 1000446 - RNA, 15 nt, Mycobacterium avium subsp. paratuberculosis
gggcccgcagccgcu

SEQ ID NO: 1000447 - RNA, 20 nt, Mycobacterium avium subsp. paratuberculosis
gggcccgcccgcagcggcgg

SEQ ID NO: 1000448 - RNA, 21 nt, Mycobacterium avium subsp. paratuberculosis
gggcccgcccgcagcggcggu

SEQ ID NO: 1000449 - RNA, 18 nt, Mycobacterium avium subsp. paratuberculosis
gggccagcaacagcagcg

SEQ ID NO: 1000450 - RNA, 19 nt, Mycobacterium avium subsp. paratuberculosis
gggccagcaacagcagcgg

SEQ ID NO: 1000451 - RNA, 16 nt, Mycobacterium avium subsp. paratuberculosis
gggccagcagccagcu

SEQ ID NO: 1000452 - RNA, 19 nt, Mycobacterium avium subsp. paratuberculosis
gggccgcggcgucgggaug

SEQ ID NO: 1000453 - RNA, 15 nt, Mycobacterium avium subsp. paratuberculosis
gggcccgggcgcuga

SEQ ID NO: 1000454 - RNA, 13 nt, Mycobacterium avium subsp. paratuberculosis
gggcccggcgcca

SEQ ID NO: 1000455 - RNA, 14 nt, Mycobacterium avium subsp. paratuberculosis
gggcccgcugcagc

SEQ ID NO: 1000456 - RNA, 15 nt, Mycobacterium avium subsp. paratuberculosis
gggcccgcugcagcg

SEQ ID NO: 1000457 - RNA, 16 nt, Mycobacterium avium subsp. paratuberculosis
gggccaaagagcuugg

SEQ ID NO: 1000458 - RNA, 13 nt, Mycobacterium avium subsp. paratuberculosis
gggcaugucgccg

SEQ ID NO: 1000459 - RNA, 19 nt, Mycobacterium avium subsp. paratuberculosis
gggcauugcccaucgccac

SEQ ID NO: 1000460 - RNA, 14 nt, Mycobacterium avium subsp. paratuberculosis
gggccaagcaccgg

SEQ ID NO: 1000461 - RNA, 24 nt, Mycobacterium avium subsp. paratuberculosis
gggccaaaucgcuugcgccgcagc

SEQ ID NO: 1000462 - RNA, 23 nt, Mycobacterium avium subsp. paratuberculosis
gggccaacuccggcggcagccag

SEQ ID NO: 1000463 - RNA, 15 nt, Mycobacterium avium subsp. paratuberculosis
gggccaacugggugg

SEQ ID NO: 1000464 - RNA, 16 nt, Mycobacterium avium subsp. paratuberculosis
gggccaacuggguggg

SEQ ID NO: 1000465 - RNA, 18 nt, Mycobacterium avium subsp. paratuberculosis
gggccacacacugcugcg

SEQ ID NO: 1000466 - RNA, 19 nt, Mycobacterium avium subsp. paratuberculosis
gggccacgauccgcgcggc

SEQ ID NO: 1000467 - RNA, 20 nt, Mycobacterium avium subsp. paratuberculosis
gggccagacugcgcaccgcc

SEQ ID NO: 1000468 - RNA, 23 nt, Mycobacterium avium subsp. paratuberculosis
gggccacgccgacuagcgcggcg

SEQ ID NO: 1000469 - RNA, 12 nt, Mycobacterium avium subsp. paratuberculosis
gggccaccgcgg

SEQ ID NO: 1000470 - RNA, 16 nt, Mycobacterium avium subsp. paratuberculosis
gggccaccggcgccag

SEQ ID NO: 1000471 - RNA, 16 nt, Mycobacterium avium subsp. paratuberculosis
gggccaccagcgcagg

SEQ ID NO: 1000472 - RNA, 20 nt, Mycobacterium avium subsp. paratuberculosis
gggccaccagcgcagguccu

SEQ ID NO: 1000473 - RNA, 14 nt, Mycobacterium avium subsp. paratuberculosis
gggccaccaggccg

SEQ ID NO: 1000474 - RNA, 16 nt, Mycobacterium avium subsp. paratuberculosis
gggccaccacgccagc

SEQ ID NO: 1000475 - RNA, 15 nt, Mycobacterium avium subsp. paratuberculosis
gggagcgcuggucgg

SEQ ID NO: 1000476 - RNA, 20 nt, Mycobacterium avium subsp. paratuberculosis
gggagcgcuggucggcgaac

SEQ ID NO: 1000477 - RNA, 16 nt, Mycobacterium avium subsp. paratuberculosis
gggagcgggccacgca

SEQ ID NO: 1000478 - RNA, 11 nt, Mycobacterium avium subsp. paratuberculosis
gggagcggggu

SEQ ID NO: 1000479 - RNA, 18 nt, Mycobacterium avium subsp. paratuberculosis
gggaggaagugcacgccg

SEQ ID NO: 1000480 - RNA, 22 nt, Mycobacterium avium subsp. paratuberculosis
gggaggaagugcacgccgaggc

SEQ ID NO: 1000481 - RNA, 11 nt, Mycobacterium avium subsp. paratuberculosis
gggaggacagc

SEQ ID NO: 1000482 - RNA, 15 nt, Mycobacterium avium subsp. paratuberculosis
gggaggacagcaccg

SEQ ID NO: 1000483 - RNA, 13 nt, Mycobacterium avium subsp. paratuberculosis
gggagugcggccc

SEQ ID NO: 1000484 - RNA, 12 nt, Mycobacterium avium subsp. paratuberculosis
gggaggcggcgg

SEQ ID NO: 1000485 - RNA, 21 nt, Mycobacterium avium subsp. paratuberculosis
gggaaaguuguagcgcagcau

SEQ ID NO: 1000486 - RNA, 14 nt, Mycobacterium avium subsp. paratuberculosis
gggaaaggcagcag

SEQ ID NO: 1000487 - RNA, 14 nt, Mycobacterium avium subsp. paratuberculosis
gggaacagccaggc

SEQ ID NO: 1000488 - RNA, 14 nt, Mycobacterium avium subsp. paratuberculosis
gggaacagcccgcc

SEQ ID NO: 1000489 - RNA, 15 nt, Mycobacterium avium subsp. paratuberculosis
gggaacucgaugcgg

SEQ ID NO: 1000490 - RNA, 14 nt, Mycobacterium avium subsp. paratuberculosis
gggauagggcguga

SEQ ID NO: 1000491 - RNA, 15 nt, Mycobacterium avium subsp. paratuberculosis
gggauagagcaccgc

SEQ ID NO: 1000492 - RNA, 14 nt, Mycobacterium avium subsp. paratuberculosis
gggauagccgagcg

SEQ ID NO: 1000493 - RNA, 18 nt, Mycobacterium avium subsp. paratuberculosis
gggauagccgagcggcgc

SEQ ID NO: 1000494 - RNA, 22 nt, Mycobacterium avium subsp. paratuberculosis
gggaugccaguccugggccggg

SEQ ID NO: 1000495 - RNA, 22 nt, Mycobacterium avium subsp. paratuberculosis
gggaucgucgccgggcuugguc

SEQ ID NO: 1000496 - RNA, 19 nt, Mycobacterium avium subsp. paratuberculosis
gggaucguguggccgcccu

SEQ ID NO: 1000497 - RNA, 18 nt, Mycobacterium avium subsp. paratuberculosis
gggaucugcggugagcgu

SEQ ID NO: 1000498 - RNA, 13 nt, Mycobacterium avium subsp. paratuberculosis
gggcaccgccagg

SEQ ID NO: 1000499 - RNA, 20 nt, Mycobacterium avium subsp. paratuberculosis
gggcacccggcgcggccgcc

SEQ ID NO: 1000500 - RNA, 17 nt, Mycobacterium avium subsp. paratuberculosis
gggcaccucggccaggu

SEQ ID NO: 1000501 - RNA, 11 nt, Mycobacterium avium subsp. paratuberculosis
gggcaccagcg

SEQ ID NO: 1000502 - RNA, 14 nt, Mycobacterium avium subsp. paratuberculosis
gggcaccagcgcga

SEQ ID NO: 1000503 - RNA, 13 nt, Mycobacterium avium subsp. paratuberculosis
gggcaccacggcg

SEQ ID NO: 1000504 - RNA, 20 nt, Mycobacterium avium subsp. paratuberculosis
gggcaccacguccaccagca

SEQ ID NO: 1000505 - RNA, 23 nt, Mycobacterium avium subsp. paratuberculosis
gggcacaccggugcucuccugcu

SEQ ID NO: 1000506 - RNA, 21 nt, Mycobacterium avium subsp. paratuberculosis
gggaugccgaaccgcugcgga

SEQ ID NO: 1000507 - RNA, 21 nt, Mycobacterium avium subsp. paratuberculosis
gggaugucuagccgccgagcg

SEQ ID NO: 1000508 - RNA, 23 nt, Mycobacterium avium subsp. paratuberculosis
gggauggugagcccgaugcuggc

SEQ ID NO: 1000509 - RNA, 16 nt, Mycobacterium avium subsp. paratuberculosis
gggcacagccagcgcc

SEQ ID NO: 1000510 - RNA, 20 nt, Mycobacterium avium subsp. paratuberculosis
gggcacagccagcgcccggc

SEQ ID NO: 1000511 - RNA, 17 nt, Mycobacterium avium subsp. paratuberculosis
gggccuucuuggcggcg

SEQ ID NO: 1000512 - RNA, 15 nt, Mycobacterium avium subsp. paratuberculosis
gggccuugagcaccg

SEQ ID NO: 1000513 - RNA, 14 nt, Mycobacterium avium subsp. paratuberculosis
gggccuuggcgagg

SEQ ID NO: 1000514 - RNA, 15 nt, Mycobacterium avium subsp. paratuberculosis
gggcgaagccgaggu

SEQ ID NO: 1000515 - RNA, 19 nt, Mycobacterium avium subsp. paratuberculosis
gggcgaccccggccaggau

SEQ ID NO: 1000516 - RNA, 21 nt, Mycobacterium avium subsp. paratuberculosis
gggcgaccacguccagcuggg

SEQ ID NO: 1000517 - RNA, 12 nt, Mycobacterium avium subsp. paratuberculosis
gggcgaccuggu

SEQ ID NO: 1000518 - RNA, 17 nt, Mycobacterium avium subsp. paratuberculosis
gggcgaccuugcgcagc

SEQ ID NO: 1000519 - RNA, 14 nt, Mycobacterium avium subsp. paratuberculosis
gggcgacgucgggg

SEQ ID NO: 1000520 - RNA, 18 nt, Mycobacterium avium subsp. paratuberculosis
gggcgacuccggcgccgg

SEQ ID NO: 1000521 - RNA, 17 nt, Mycobacterium avium subsp. paratuberculosis
gggcgagaccgucggug

SEQ ID NO: 1000522 - RNA, 21 nt, Mycobacterium avium subsp. paratuberculosis
gggccugcucgcuugccagcc

SEQ ID NO: 1000523 - RNA, 14 nt, Mycobacterium avium subsp. paratuberculosis
gggccggcgccggu

SEQ ID NO: 1000524 - RNA, 16 nt, Mycobacterium avium subsp. paratuberculosis
gggccugcggcggccg

SEQ ID NO: 1000525 - RNA, 19 nt, Mycobacterium avium subsp. paratuberculosis
gggccugcggcggccgcag

SEQ ID NO: 1000526 - RNA, 20 nt, Mycobacterium avium subsp. paratuberculosis
gggccugcggcggccgcagc

SEQ ID NO: 1000527 - RNA, 21 nt, Mycobacterium avium subsp. paratuberculosis
gggccuucacgcuggccucca

SEQ ID NO: 1000528 - RNA, 20 nt, Mycobacterium avium subsp. paratuberculosis
gggccggcgaaggacagccg

SEQ ID NO: 1000529 - RNA, 13 nt, Mycobacterium avium subsp. paratuberculosis
gggccggccgccc

SEQ ID NO: 1000530 - RNA, 16 nt, Mycobacterium avium subsp. paratuberculosis
gggccggccggacagg

SEQ ID NO: 1000531 - RNA, 22 nt, Mycobacterium avium subsp. paratuberculosis
gggccggcacuucgaucaucuc

SEQ ID NO: 1000532 - RNA, 21 nt, Mycobacterium avium subsp. paratuberculosis
gggccggcagccggccaccuc

SEQ ID NO: 1000533 - RNA, 14 nt, Mycobacterium avium subsp. paratuberculosis
gggccggcacccgg

SEQ ID NO: 1000534 - RNA, 18 nt, Mycobacterium avium subsp. paratuberculosis
gggccgcuacgccgaggc

SEQ ID NO: 1000535 - RNA, 16 nt, Mycobacterium avium subsp. paratuberculosis
gggccggagccuucuu

SEQ ID NO: 1000536 - RNA, 21 nt, Mycobacterium avium subsp. paratuberculosis
gggcgauaaccucggcggcgg

SEQ ID NO: 1000537 - RNA, 22 nt, Mycobacterium avium subsp. paratuberculosis
gggcgauaaccucggcggcggc

SEQ ID NO: 1000538 - RNA, 20 nt, Mycobacterium avium subsp. paratuberculosis
gggcgaucuccagcggccgg

SEQ ID NO: 1000539 - RNA, 21 nt, Mycobacterium avium subsp. paratuberculosis
gggcgaggaacccgaccgcga

SEQ ID NO: 1000540 - RNA, 23 nt, Mycobacterium avium subsp. paratuberculosis
gggcgauggccauggccaggaac

SEQ ID NO: 1000541 - RNA, 14 nt, Mycobacterium avium subsp. paratuberculosis
gggcgauggcgggc

SEQ ID NO: 1000542 - RNA, 23 nt, Mycobacterium avium subsp. paratuberculosis
gggcgccagcccgcccagcgcca

SEQ ID NO: 1000543 - RNA, 14 nt, Mycobacterium avium subsp. paratuberculosis
gggcgcagcccggc

SEQ ID NO: 1000544 - RNA, 15 nt, Mycobacterium avium subsp. paratuberculosis
gggcgcagcccggcg

SEQ ID NO: 1000545 - RNA, 19 nt, Mycobacterium avium subsp. paratuberculosis
gggcgcagcugcagcuccu

SEQ ID NO: 1000546 - RNA, 13 nt, Mycobacterium avium subsp. paratuberculosis
gggcgccggccgg

SEQ ID NO: 1000547 - RNA, 14 nt, Mycobacterium avium subsp. paratuberculosis
gggcgccgccggcg

SEQ ID NO: 1000548 - RNA, 22 nt, Mycobacterium avium subsp. paratuberculosis
gggcgccgaacgucgagcgcgg

SEQ ID NO: 1000549 - RNA, 19 nt, Mycobacterium avium subsp. paratuberculosis
gggcgccauccgcagcccg

SEQ ID NO: 1000550 - RNA, 12 nt, Mycobacterium avium subsp. paratuberculosis
gggcgcccagca

SEQ ID NO: 1000551 - RNA, 18 nt, Mycobacterium avium subsp. paratuberculosis
gggcgcccgagccgcaca

SEQ ID NO: 1000552 - RNA, 22 nt, Mycobacterium avium subsp. paratuberculosis
gggcgcgcacccccuucuccac

SEQ ID NO: 1000553 - RNA, 13 nt, Mycobacterium avium subsp. paratuberculosis
gggcgcgcaccgg

SEQ ID NO: 1000554 - RNA, 16 nt, Mycobacterium avium subsp. paratuberculosis
gggcgcgaucggcagg

SEQ ID NO: 1000555 - RNA, 21 nt, Mycobacterium avium subsp. paratuberculosis
gggcgcgaagguggcgccggu

SEQ ID NO: 1000556 - RNA, 17 nt, Mycobacterium avium subsp. paratuberculosis
gggcgccgggucauccc

SEQ ID NO: 1000557 - RNA, 13 nt, Mycobacterium avium subsp. paratuberculosis
gggcgccucgccg

SEQ ID NO: 1000558 - RNA, 19 nt, Mycobacterium avium subsp. paratuberculosis
gggcgcggcguagccgccg

SEQ ID NO: 1000559 - RNA, 12 nt, Mycobacterium avium subsp. paratuberculosis
gggcgcggcggc

SEQ ID NO: 1000560 - RNA, 13 nt, Mycobacterium avium subsp. paratuberculosis
gggcgcggccagc

SEQ ID NO: 1000561 - RNA, 13 nt, Mycobacterium avium subsp. paratuberculosis
gggcgcgcccacc

SEQ ID NO: 1000562 - RNA, 23 nt, Mycobacterium avium subsp. paratuberculosis
gggcgcgcagccacgagcccagc

SEQ ID NO: 1000563 - RNA, 22 nt, Mycobacterium avium subsp. paratuberculosis
gggcuuuugcgucugcucgccg

SEQ ID NO: 1000564 - RNA, 12 nt, Mycobacterium avium subsp. paratuberculosis
ggggaacaccgg

SEQ ID NO: 1000565 - RNA, 13 nt, Mycobacterium avium subsp. paratuberculosis
ggggaagcccagc

SEQ ID NO: 1000566 - RNA, 23 nt, Mycobacterium avium subsp. paratuberculosis
ggggaaggacucaaucggucagg

SEQ ID NO: 1000567 - RNA, 23 nt, Mycobacterium avium subsp. paratuberculosis
gggcuggaguggucaggcccagg

SEQ ID NO: 1000568 - RNA, 14 nt, Mycobacterium avium subsp. paratuberculosis
gggcuuggcgacga

SEQ ID NO: 1000569 - RNA, 11 nt, Mycobacterium avium subsp. paratuberculosis
gggcugcagca

SEQ ID NO: 1000570 - RNA, 14 nt, Mycobacterium avium subsp. paratuberculosis
gggcugcccaccac

SEQ ID NO: 1000571 - RNA, 18 nt, Mycobacterium avium subsp. paratuberculosis
gggcugcccaccaccagg

SEQ ID NO: 1000572 - RNA, 13 nt, Mycobacterium avium subsp. paratuberculosis
gggcguccgagaa

SEQ ID NO: 1000573 - RNA, 15 nt, Mycobacterium avium subsp. paratuberculosis
gggcguacagcggcg

SEQ ID NO: 1000574 - RNA, 19 nt, Mycobacterium avium subsp. paratuberculosis
gggcguacugcucggcgcg

SEQ ID NO: 1000575 - RNA, 19 nt, Mycobacterium avium subsp. paratuberculosis
gggcggucgcgcagccgcc

SEQ ID NO: 1000576 - RNA, 20 nt, Mycobacterium avium subsp. paratuberculosis
gggcggucgcgucgucggcg

SEQ ID NO: 1000577 - RNA, 15 nt, Mycobacterium avium subsp. paratuberculosis
gggcgcgggccgcgu

SEQ ID NO: 1000578 - RNA, 16 nt, Mycobacterium avium subsp. paratuberculosis
gggcgcgggccgcguc

SEQ ID NO: 1000579 - RNA, 18 nt, Mycobacterium avium subsp. paratuberculosis
gggcgcgggcggcagguc

SEQ ID NO: 1000580 - RNA, 23 nt, Mycobacterium avium subsp. paratuberculosis
gggcgcucuucgggcugcgcuug

SEQ ID NO: 1000581 - RNA, 21 nt, Mycobacterium avium subsp. paratuberculosis
gggcgcucaucaggcggccgg

SEQ ID NO: 1000582 - RNA, 20 nt, Mycobacterium avium subsp. paratuberculosis
gggcgcguccgcgggcgggg

SEQ ID NO: 1000583 - RNA, 19 nt, Mycobacterium avium subsp. paratuberculosis
gggcgcguuggccggcugg

SEQ ID NO: 1000584 - RNA, 17 nt, Mycobacterium avium subsp. paratuberculosis
gggcguguugcaggcgg

SEQ ID NO: 1000585 - RNA, 15 nt, Mycobacterium avium subsp. paratuberculosis
gggcguugcccgccg

SEQ ID NO: 1000586 - RNA, 14 nt, Mycobacterium avium subsp. paratuberculosis
gggcguggucgccg

SEQ ID NO: 1000587 - RNA, 15 nt, Mycobacterium avium subsp. paratuberculosis
gggcguggcgucggu

SEQ ID NO: 1000588 - RNA, 16 nt, Mycobacterium avium subsp. paratuberculosis
gggcguggcgucggug

SEQ ID NO: 1000589 - RNA, 12 nt, Mycobacterium avium subsp. paratuberculosis
gggcguggcuug

SEQ ID NO: 1000590 - RNA, 14 nt, Mycobacterium avium subsp. paratuberculosis
gggcgugcccggcg

SEQ ID NO: 1000591 - RNA, 13 nt, Mycobacterium avium subsp. paratuberculosis
gggcgugccggcg

SEQ ID NO: 1000592 - RNA, 15 nt, Mycobacterium avium subsp. paratuberculosis
gggcgucggcggccu

SEQ ID NO: 1000593 - RNA, 13 nt, Mycobacterium avium subsp. paratuberculosis
gggcgucggcggu

SEQ ID NO: 1000594 - RNA, 14 nt, Mycobacterium avium subsp. paratuberculosis
gggcgucggcggug

SEQ ID NO: 1000595 - RNA, 13 nt, Mycobacterium avium subsp. paratuberculosis
gggcgucacucug

SEQ ID NO: 1000596 - RNA, 22 nt, Mycobacterium avium subsp. paratuberculosis
gggcgucaggcgcugggugcgg

SEQ ID NO: 1000597 - RNA, 17 nt, Mycobacterium avium subsp. paratuberculosis
gggcgugaucuguucgg

SEQ ID NO: 1000598 - RNA, 19 nt, Mycobacterium avium subsp. paratuberculosis
ggcuucgccgcgcuugcga

SEQ ID NO: 1000599 - RNA, 22 nt, Mycobacterium avium subsp. paratuberculosis
ggcuucguacggcccgggaagc

SEQ ID NO: 1000600 - RNA, 21 nt, Mycobacterium avium subsp. paratuberculosis
ggcuuggccgugcagggggcg

SEQ ID NO: 1000601 - RNA, 18 nt, Mycobacterium avium subsp. paratuberculosis
ggcuugggcccgucggcg

SEQ ID NO: 1000602 - RNA, 15 nt, Mycobacterium avium subsp. paratuberculosis
ggcuggugcagcagc

SEQ ID NO: 1000603 - RNA, 22 nt, Mycobacterium avium subsp. paratuberculosis
ggcugguccggaaccgcgccuu

SEQ ID NO: 1000604 - RNA, 16 nt, Mycobacterium avium subsp. paratuberculosis
ggcuggucggccuggc

SEQ ID NO: 1000605 - RNA, 14 nt, Mycobacterium avium subsp. paratuberculosis
ggcuggucggcggg

SEQ ID NO: 1000606 - RNA, 16 nt, Mycobacterium avium subsp. paratuberculosis
ggcuguugaccacggc

SEQ ID NO: 1000607 - RNA, 17 nt, Mycobacterium avium subsp. paratuberculosis
ggcugugggccagcagc

SEQ ID NO: 1000608 - RNA, 18 nt, Mycobacterium avium subsp. paratuberculosis
ggcuggaguaggugcccg

SEQ ID NO: 1000609 - RNA, 17 nt, Mycobacterium avium subsp. paratuberculosis
ggcuggcaucgucggcg

SEQ ID NO: 1000610 - RNA, 15 nt, Mycobacterium avium subsp. paratuberculosis
ggcuggccgucggcg

SEQ ID NO: 1000611 - RNA, 15 nt, Mycobacterium avium subsp. paratuberculosis
ggcuggccgcacggu

SEQ ID NO: 1000612 - RNA, 21 nt, Mycobacterium avium subsp. paratuberculosis
ggcuggccgcacggugcagca

SEQ ID NO: 1000613 - RNA, 14 nt, Mycobacterium avium subsp. paratuberculosis
ggcuggccgcggcg

SEQ ID NO: 1000614 - RNA, 22 nt, Mycobacterium avium subsp. paratuberculosis
ggcuggcccggcgcggcggcgc

SEQ ID NO: 1000615 - RNA, 13 nt, Mycobacterium avium subsp. paratuberculosis
ggcuggccgagcg

SEQ ID NO: 1000616 - RNA, 14 nt, Mycobacterium avium subsp. paratuberculosis
ggcuggcggguggu

SEQ ID NO: 1000617 - RNA, 20 nt, Mycobacterium avium subsp. paratuberculosis
ggcuggcguaggacagcagc

SEQ ID NO: 1000618 - RNA, 13 nt, Mycobacterium avium subsp. paratuberculosis
ggcugcccaccac

SEQ ID NO: 1000619 - RNA, 14 nt, Mycobacterium avium subsp. paratuberculosis
ggcugcccaccacc

SEQ ID NO: 1000620 - RNA, 22 nt, Mycobacterium avium subsp. paratuberculosis
ggcugcccggcccgccgcugca

SEQ ID NO: 1000621 - RNA, 20 nt, Mycobacterium avium subsp. paratuberculosis
ggcugcgcacguagcccagc

SEQ ID NO: 1000622 - RNA, 17 nt, Mycobacterium avium subsp. paratuberculosis
ggcugcgcagcgcagca

SEQ ID NO: 1000623 - RNA, 14 nt, Mycobacterium avium subsp. paratuberculosis
ggcugcgcggcuug

SEQ ID NO: 1000624 - RNA, 16 nt, Mycobacterium avium subsp. paratuberculosis
ggcugcgcggcuugcu

SEQ ID NO: 1000625 - RNA, 18 nt, Mycobacterium avium subsp. paratuberculosis
ggcugcgcguucggcgcc

SEQ ID NO: 1000626 - RNA, 20 nt, Mycobacterium avium subsp. paratuberculosis
ggcugcugcagcgcccgggc

SEQ ID NO: 1000627 - RNA, 15 nt, Mycobacterium avium subsp. paratuberculosis
ggcugcgggccagcg

SEQ ID NO: 1000628 - RNA, 19 nt, Mycobacterium avium subsp. paratuberculosis
ggcugcgggccaggcggga

SEQ ID NO: 1000629 - RNA, 13 nt, Mycobacterium avium subsp. paratuberculosis
ggcugauguucag

SEQ ID NO: 1000630 - RNA, 13 nt, Mycobacterium avium subsp. paratuberculosis
ggcugcagcagau

SEQ ID NO: 1000631 - RNA, 19 nt, Mycobacterium avium subsp. paratuberculosis
ggcugcagcagaugcgccu

SEQ ID NO: 1000632 - RNA, 15 nt, Mycobacterium avium subsp. paratuberculosis
ggcugcagccgggcg

SEQ ID NO: 1000633 - RNA, 22 nt, Mycobacterium avium subsp. paratuberculosis
ggcugcagccgggcggcggccu

SEQ ID NO: 1000634 - RNA, 21 nt, Mycobacterium avium subsp. paratuberculosis
ggcugcacccucugccacggc

SEQ ID NO: 1000635 - RNA, 16 nt, Mycobacterium avium subsp. paratuberculosis
ggcugaucagccggcg

SEQ ID NO: 1000636 - RNA, 14 nt, Mycobacterium avium subsp. paratuberculosis
ggcugaggcaaggc

SEQ ID NO: 1000637 - RNA, 11 nt, Mycobacterium avium subsp. paratuberculosis
ggcugaacacc

SEQ ID NO: 1000638 - RNA, 16 nt, Mycobacterium avium subsp. paratuberculosis
ggcugaacgccagcag

SEQ ID NO: 1000639 - RNA, 17 nt, Mycobacterium avium subsp. paratuberculosis
ggcugaacgccagcagc

SEQ ID NO: 1000640 - RNA, 18 nt, Mycobacterium avium subsp. paratuberculosis
ggcugaacgccagcagcc

SEQ ID NO: 1000641 - RNA, 14 nt, Mycobacterium avium subsp. paratuberculosis
ggcugaacagcgcg

SEQ ID NO: 1000642 - RNA, 18 nt, Mycobacterium avium subsp. paratuberculosis
ggcugaagaucaacagcc

SEQ ID NO: 1000643 - RNA, 14 nt, Mycobacterium avium subsp. paratuberculosis
ggcugaaucccucc

SEQ ID NO: 1000644 - RNA, 15 nt, Mycobacterium avium subsp. paratuberculosis
ggcugacugccggcg

SEQ ID NO: 1000645 - RNA, 14 nt, Mycobacterium avium subsp. paratuberculosis
ggcugaccgacggc

SEQ ID NO: 1000646 - RNA, 16 nt, Mycobacterium avium subsp. paratuberculosis
ggcugagcaccggggu

SEQ ID NO: 1000647 - RNA, 23 nt, Mycobacterium avium subsp. paratuberculosis
ggcugacggcgucguugagcagg

SEQ ID NO: 1000648 - RNA, 20 nt, Mycobacterium avium subsp. paratuberculosis
ggcucggaguugcgcagccg

SEQ ID NO: 1000649 - RNA, 11 nt, Mycobacterium avium subsp. paratuberculosis
ggcucgcugau

SEQ ID NO: 1000650 - RNA, 13 nt, Mycobacterium avium subsp. paratuberculosis
ggcucgcgagggc

SEQ ID NO: 1000651 - RNA, 22 nt, Mycobacterium avium subsp. paratuberculosis
ggcucgcccgggcuaucgcccg

SEQ ID NO: 1000652 - RNA, 16 nt, Mycobacterium avium subsp. paratuberculosis
ggcucgggcgguggcg

SEQ ID NO: 1000653 - RNA, 19 nt, Mycobacterium avium subsp. paratuberculosis
ggcucgguaugcggcgacg

SEQ ID NO: 1000654 - RNA, 12 nt, Mycobacterium avium subsp. paratuberculosis
ggcucggcggcg

SEQ ID NO: 1000655 - RNA, 18 nt, Mycobacterium avium subsp. paratuberculosis
ggcucggcucggccggcc

SEQ ID NO: 1000656 - RNA, 20 nt, Mycobacterium avium subsp. paratuberculosis
ggcucggcgacaacagcgcc

SEQ ID NO: 1000657 - RNA, 22 nt, Mycobacterium avium subsp. paratuberculosis
ggcucggcgccgaccucggcca

SEQ ID NO: 1000658 - RNA, 24 nt, Mycobacterium avium subsp. paratuberculosis
ggcucggcgccgaccucggccagc

SEQ ID NO: 1000659 - RNA, 20 nt, Mycobacterium avium subsp. paratuberculosis
ggcucggccgaugagccuca

SEQ ID NO: 1000660 - RNA, 16 nt, Mycobacterium avium subsp. paratuberculosis
ggcucuucgcggcggg

SEQ ID NO: 1000661 - RNA, 14 nt, Mycobacterium avium subsp. paratuberculosis
ggcucuucggcgcc

SEQ ID NO: 1000662 - RNA, 16 nt, Mycobacterium avium subsp. paratuberculosis
ggcucccagucccagc

SEQ ID NO: 1000663 - RNA, 24 nt, Mycobacterium avium subsp. paratuberculosis
ggcuccggccgcgccggccuuggc

SEQ ID NO: 1000664 - RNA, 13 nt, Mycobacterium avium subsp. paratuberculosis
ggcuccagcagcg

SEQ ID NO: 1000665 - RNA, 17 nt, Mycobacterium avium subsp. paratuberculosis
ggcuccagcgcccgccg

SEQ ID NO: 1000666 - RNA, 21 nt, Mycobacterium avium subsp. paratuberculosis
ggcuccgccgauguacuccug

SEQ ID NO: 1000667 - RNA, 22 nt, Mycobacterium avium subsp. paratuberculosis
ggcuccgccgauguacuccugg

SEQ ID NO: 1000668 - RNA, 21 nt, Mycobacterium avium subsp. paratuberculosis
ggcuccgcguucgaccuccac

SEQ ID NO: 1000669 - RNA, 23 nt, Mycobacterium avium subsp. paratuberculosis
ggcuccgcguucgaccuccacga

SEQ ID NO: 1000670 - RNA, 18 nt, Mycobacterium avium subsp. paratuberculosis
ggcucgagggcggcgacc

SEQ ID NO: 1000671 - RNA, 19 nt, Mycobacterium avium subsp. paratuberculosis
ggcucgagugccggcagcc

SEQ ID NO: 1000672 - RNA, 22 nt, Mycobacterium avium subsp. paratuberculosis
ggcucgagugccggcagcccgg

SEQ ID NO: 1000673 - RNA, 18 nt, Mycobacterium avium subsp. paratuberculosis
ggcucgaguuuggccagc

SEQ ID NO: 1000674 - RNA, 19 nt, Mycobacterium avium subsp. paratuberculosis
ggcucgaguuuggccagcu

SEQ ID NO: 1000675 - RNA, 15 nt, Mycobacterium avium subsp. paratuberculosis
ggcucgagcucgucg

SEQ ID NO: 1000676 - RNA, 22 nt, Mycobacterium avium subsp. paratuberculosis
ggcucgaaaugccuuggcggcg

SEQ ID NO: 1000677 - RNA, 19 nt, Mycobacterium avium subsp. paratuberculosis
ggcucgaaguggcagcgcu

SEQ ID NO: 1000678 - RNA, 15 nt, Mycobacterium avium subsp. paratuberculosis
ggcucaacggccggc

SEQ ID NO: 1000679 - RNA, 14 nt, Mycobacterium avium subsp. paratuberculosis
ggcucacagcgcgg

SEQ ID NO: 1000680 - RNA, 16 nt, Mycobacterium avium subsp. paratuberculosis
ggcucacgacuccugg

SEQ ID NO: 1000681 - RNA, 18 nt, Mycobacterium avium subsp. paratuberculosis
ggcucacuuuugacaggu

SEQ ID NO: 1000682 - RNA, 20 nt, Mycobacterium avium subsp. paratuberculosis
ggcucacuuuugacaggugg

SEQ ID NO: 1000683 - RNA, 15 nt, Mycobacterium avium subsp. paratuberculosis
ggcucagcaacccgc

SEQ ID NO: 1000684 - RNA, 21 nt, Mycobacterium avium subsp. paratuberculosis
ggcucagcaacccgccgagcg

SEQ ID NO: 1000685 - RNA, 19 nt, Mycobacterium avium subsp. paratuberculosis
ggcucagccgaagccggcg

SEQ ID NO: 1000686 - RNA, 21 nt, Mycobacterium avium subsp. paratuberculosis
ggcuccaccgcgccggcggcg

SEQ ID NO: 1000687 - RNA, 15 nt, Mycobacterium avium subsp. paratuberculosis
ggcucauacggcggc

SEQ ID NO: 1000688 - RNA, 20 nt, Mycobacterium avium subsp. paratuberculosis
ggcucaggaucagcagccgu

SEQ ID NO: 1000689 - RNA, 20 nt, Mycobacterium avium subsp. paratuberculosis
ggcucagcggcaacugcagg

SEQ ID NO: 1000690 - RNA, 18 nt, Mycobacterium avium subsp. paratuberculosis
ggcgaugucgggcaccug

SEQ ID NO: 1000691 - RNA, 20 nt, Mycobacterium avium subsp. paratuberculosis
ggcgaugucgggcaccugcu

SEQ ID NO: 1000692 - RNA, 19 nt, Mycobacterium avium subsp. paratuberculosis
ggcgaugugaucgcggccc

SEQ ID NO: 1000693 - RNA, 20 nt, Mycobacterium avium subsp. paratuberculosis
ggcgauggccauggccagga

SEQ ID NO: 1000694 - RNA, 23 nt, Mycobacterium avium subsp. paratuberculosis
ggcgauggugggcagccggcaac

SEQ ID NO: 1000695 - RNA, 13 nt, Mycobacterium avium subsp. paratuberculosis
ggcgauggcggcg

SEQ ID NO: 1000696 - RNA, 22 nt, Mycobacterium avium subsp. paratuberculosis
ggcgauggcgucggccagcggc

SEQ ID NO: 1000697 - RNA, 22 nt, Mycobacterium avium subsp. paratuberculosis
ggcgauggugaugugcggcgcg

SEQ ID NO: 1000698 - RNA, 14 nt, Mycobacterium avium subsp. paratuberculosis
ggcgauggugccga

SEQ ID NO: 1000699 - RNA, 15 nt, Mycobacterium avium subsp. paratuberculosis
ggcgaugauccgcgg

SEQ ID NO: 1000700 - RNA, 22 nt, Mycobacterium avium subsp. paratuberculosis
ggcgaugauccgcggcgccggg

SEQ ID NO: 1000701 - RNA, 16 nt, Mycobacterium avium subsp. paratuberculosis
ggcgaugaagccggcg

SEQ ID NO: 1000702 - RNA, 16 nt, Mycobacterium avium subsp. paratuberculosis
ggcgaugaccgccugc

SEQ ID NO: 1000703 - RNA, 17 nt, Mycobacterium avium subsp. paratuberculosis
ggcgaucugcuccucgg

SEQ ID NO: 1000704 - RNA, 22 nt, Mycobacterium avium subsp. paratuberculosis
ggcgaucucgccgaaggccggg

SEQ ID NO: 1000705 - RNA, 16 nt, Mycobacterium avium subsp. paratuberculosis
ggcgaucucggcggcc

SEQ ID NO: 1000706 - RNA, 15 nt, Mycobacterium avium subsp. paratuberculosis
ggcgaugcgcggccc

SEQ ID NO: 1000707 - RNA, 13 nt, Mycobacterium avium subsp. paratuberculosis
ggcgaugccgccg

SEQ ID NO: 1000708 - RNA, 13 nt, Mycobacterium avium subsp. paratuberculosis
ggcgaugcggccc

SEQ ID NO: 1000709 - RNA, 23 nt, Mycobacterium avium subsp. paratuberculosis
ggcgaguggaagucagcgcguga

SEQ ID NO: 1000710 - RNA, 18 nt, Mycobacterium avium subsp. paratuberculosis
ggcgaguccgcggaggcg

SEQ ID NO: 1000711 - RNA, 16 nt, Mycobacterium avium subsp. paratuberculosis
ggcgaguccggccagg

SEQ ID NO: 1000712 - RNA, 22 nt, Mycobacterium avium subsp. paratuberculosis
ggcgaguccggccaggucgccg

SEQ ID NO: 1000713 - RNA, 16 nt, Mycobacterium avium subsp. paratuberculosis
ggcgaguaaggccgag

SEQ ID NO: 1000714 - RNA, 22 nt, Mycobacterium avium subsp. paratuberculosis
ggcgagucccggcgcaccaggc

SEQ ID NO: 1000715 - RNA, 19 nt, Mycobacterium avium subsp. paratuberculosis
ggcgaguucggcggcccgc

SEQ ID NO: 1000716 - RNA, 19 nt, Mycobacterium avium subsp. paratuberculosis
ggcgaucaucgccccggag

SEQ ID NO: 1000717 - RNA, 14 nt, Mycobacterium avium subsp. paratuberculosis
ggcgauccgcagga

SEQ ID NO: 1000718 - RNA, 18 nt, Mycobacterium avium subsp. paratuberculosis
ggcgaucgaugcccagcg

SEQ ID NO: 1000719 - RNA, 12 nt, Mycobacterium avium subsp. paratuberculosis
ggcgaucuccag

SEQ ID NO: 1000720 - RNA, 19 nt, Mycobacterium avium subsp. paratuberculosis
ggcgaucgcggugcggggc

SEQ ID NO: 1000721 - RNA, 14 nt, Mycobacterium avium subsp. paratuberculosis
ggcgaucggccgcu

SEQ ID NO: 1000722 - RNA, 18 nt, Mycobacterium avium subsp. paratuberculosis
ggcgaucaccuugcggcc

SEQ ID NO: 1000723 - RNA, 16 nt, Mycobacterium avium subsp. paratuberculosis
ggcgaucagcccgccc

SEQ ID NO: 1000724 - RNA, 18 nt, Mycobacterium avium subsp. paratuberculosis
ggcgaucagcccgcccac

SEQ ID NO: 1000725 - RNA, 14 nt, Mycobacterium avium subsp. paratuberculosis
ggcgaucagcgcgc

SEQ ID NO: 1000726 - RNA, 15 nt, Mycobacterium avium subsp. paratuberculosis
ggcgaucagcuccuc

SEQ ID NO: 1000727 - RNA, 21 nt, Mycobacterium avium subsp. paratuberculosis
ggcgccacagcagcaccagcg

SEQ ID NO: 1000728 - RNA, 13 nt, Mycobacterium avium subsp. paratuberculosis
ggcgccaccagcc

SEQ ID NO: 1000729 - RNA, 16 nt, Mycobacterium avium subsp. paratuberculosis
ggcgccaccgggaccu

SEQ ID NO: 1000730 - RNA, 17 nt, Mycobacterium avium subsp. paratuberculosis
ggcgcaugaccgauccg

SEQ ID NO: 1000731 - RNA, 16 nt, Mycobacterium avium subsp. paratuberculosis
ggcgcaucagcggggc

SEQ ID NO: 1000732 - RNA, 13 nt, Mycobacterium avium subsp. paratuberculosis
ggcgcagcucgcg

SEQ ID NO: 1000733 - RNA, 20 nt, Mycobacterium avium subsp. paratuberculosis
ggcgcagcucgcgcagcugg

SEQ ID NO: 1000734 - RNA, 14 nt, Mycobacterium avium subsp. paratuberculosis
ggcgcagcucgucg

SEQ ID NO: 1000735 - RNA, 15 nt, Mycobacterium avium subsp. paratuberculosis
ggcgcaguccagggu

SEQ ID NO: 1000736 - RNA, 16 nt, Mycobacterium avium subsp. paratuberculosis
ggcgcaguccagggug

SEQ ID NO: 1000737 - RNA, 15 nt, Mycobacterium avium subsp. paratuberculosis
ggcgcaggugggcgg

SEQ ID NO: 1000738 - RNA, 11 nt, Mycobacterium avium subsp. paratuberculosis
ggcgcaggugu

SEQ ID NO: 1000739 - RNA, 17 nt, Mycobacterium avium subsp. paratuberculosis
ggcgcagguguccagcc

SEQ ID NO: 1000740 - RNA, 18 nt, Mycobacterium avium subsp. paratuberculosis
ggcgcagguuguccagcc

SEQ ID NO: 1000741 - RNA, 20 nt, Mycobacterium avium subsp. paratuberculosis
ggcgcagguuguccagccgg

SEQ ID NO: 1000742 - RNA, 15 nt, Mycobacterium avium subsp. paratuberculosis
ggcgcagguccggca

SEQ ID NO: 1000743 - RNA, 20 nt, Mycobacterium avium subsp. paratuberculosis
ggcgcagguccacccgcccc

SEQ ID NO: 1000744 - RNA, 14 nt, Mycobacterium avium subsp. paratuberculosis
ggcgcaggcgcugg

SEQ ID NO: 1000745 - RNA, 13 nt, Mycobacterium avium subsp. paratuberculosis
ggcgcacggcgcc

SEQ ID NO: 1000746 - RNA, 24 nt, Mycobacterium avium subsp. paratuberculosis
ggcgcacgcagugccgcaccagca

SEQ ID NO: 1000747 - RNA, 14 nt, Mycobacterium avium subsp. paratuberculosis
ggcgcacuccauca

SEQ ID NO: 1000748 - RNA, 21 nt, Mycobacterium avium subsp. paratuberculosis
ggcgcagaagcuaacgccagc

SEQ ID NO: 1000749 - RNA, 13 nt, Mycobacterium avium subsp. paratuberculosis
ggcgcagcaccga

SEQ ID NO: 1000750 - RNA, 21 nt, Mycobacterium avium subsp. paratuberculosis
ggcgcagcgccgcgccgaccu

SEQ ID NO: 1000751 - RNA, 16 nt, Mycobacterium avium subsp. paratuberculosis
ggcgcagccggccacc

SEQ ID NO: 1000752 - RNA, 19 nt, Mycobacterium avium subsp. paratuberculosis
ggcgcagccggccaccgcc

SEQ ID NO: 1000753 - RNA, 19 nt, Mycobacterium avium subsp. paratuberculosis
ggcgcagcgcacgucgccg

SEQ ID NO: 1000754 - RNA, 19 nt, Mycobacterium avium subsp. paratuberculosis
ggcgcaccgccgggcaucc

SEQ ID NO: 1000755 - RNA, 23 nt, Mycobacterium avium subsp. paratuberculosis
ggcgcaccgccugugcgacggcg

SEQ ID NO: 1000756 - RNA, 17 nt, Mycobacterium avium subsp. paratuberculosis
ggcgcaccccguccagg

SEQ ID NO: 1000757 - RNA, 17 nt, Mycobacterium avium subsp. paratuberculosis
ggcgcacccgggcagcu

SEQ ID NO: 1000758 - RNA, 12 nt, Mycobacterium avium subsp. paratuberculosis
ggcgcaccagcu

SEQ ID NO: 1000759 - RNA, 14 nt, Mycobacterium avium subsp. paratuberculosis
ggcgcaccagcuga

SEQ ID NO: 1000760 - RNA, 14 nt, Mycobacterium avium subsp. paratuberculosis
ggcgcgacggcggc

SEQ ID NO: 1000761 - RNA, 15 nt, Mycobacterium avium subsp. paratuberculosis
ggcgcgaggcgcggg

SEQ ID NO: 1000762 - RNA, 15 nt, Mycobacterium avium subsp. paratuberculosis
ggcgcgaucaggcug

SEQ ID NO: 1000763 - RNA, 18 nt, Mycobacterium avium subsp. paratuberculosis
ggcgcgaucaggcugccg

SEQ ID NO: 1000764 - RNA, 16 nt, Mycobacterium avium subsp. paratuberculosis
ggcgcgcacggcagcc

SEQ ID NO: 1000765 - RNA, 19 nt, Mycobacterium avium subsp. paratuberculosis
ggcgcgcagguagccgccg

SEQ ID NO: 1000766 - RNA, 14 nt, Mycobacterium avium subsp. paratuberculosis
ggcgcgcaggcugg

SEQ ID NO: 1000767 - RNA, 20 nt, Mycobacterium avium subsp. paratuberculosis
ggcgcgcaggcgcaccacca

SEQ ID NO: 1000768 - RNA, 20 nt, Mycobacterium avium subsp. paratuberculosis
ggcgcgcagcucgcgcagcc

SEQ ID NO: 1000769 - RNA, 21 nt, Mycobacterium avium subsp. paratuberculosis
ggcgcgcagcucgcgcagccg

SEQ ID NO: 1000770 - RNA, 12 nt, Mycobacterium avium subsp. paratuberculosis
ggcgcgcagcag

SEQ ID NO: 1000771 - RNA, 20 nt, Mycobacterium avium subsp. paratuberculosis
ggcgcgcagccggccgucca

SEQ ID NO: 1000772 - RNA, 13 nt, Mycobacterium avium subsp. paratuberculosis
ggcgcgcaccgcg

SEQ ID NO: 1000773 - RNA, 22 nt, Mycobacterium avium subsp. paratuberculosis
ggcgcgcaccagcucggcgcug

SEQ ID NO: 1000774 - RNA, 21 nt, Mycobacterium avium subsp. paratuberculosis
ggcgccugguagggguccucc

SEQ ID NO: 1000775 - RNA, 16 nt, Mycobacterium avium subsp. paratuberculosis
ggcgccugauccgcgg

SEQ ID NO: 1000776 - RNA, 19 nt, Mycobacterium avium subsp. paratuberculosis
ggcgccuccgcccgggugc

SEQ ID NO: 1000777 - RNA, 21 nt, Mycobacterium avium subsp. paratuberculosis
ggcgccuaccggguggccagc

SEQ ID NO: 1000778 - RNA, 22 nt, Mycobacterium avium subsp. paratuberculosis
ggcgccuaccggguggccagca

SEQ ID NO: 1000779 - RNA, 22 nt, Mycobacterium avium subsp. paratuberculosis
ggcgcgaccagcggcagcagca

SEQ ID NO: 1000780 - RNA, 18 nt, Mycobacterium avium subsp. paratuberculosis
ggcgcgaaucccggccuc

SEQ ID NO: 1000781 - RNA, 17 nt, Mycobacterium avium subsp. paratuberculosis
ggcgcgacaccgcggcg

SEQ ID NO: 1000782 - RNA, 16 nt, Mycobacterium avium subsp. paratuberculosis
ggcgcgaacgcagucc

SEQ ID NO: 1000783 - RNA, 19 nt, Mycobacterium avium subsp. paratuberculosis
ggcgcgaagguggcgccgg

SEQ ID NO: 1000784 - RNA, 22 nt, Mycobacterium avium subsp. paratuberculosis
ggcgccugcacgcaggccucua

SEQ ID NO: 1000785 - RNA, 18 nt, Mycobacterium avium subsp. paratuberculosis
ggcgccuucuuggcggcg

SEQ ID NO: 1000786 - RNA, 21 nt, Mycobacterium avium subsp. paratuberculosis
ggcgccguuguaggccgcgcg

SEQ ID NO: 1000787 - RNA, 18 nt, Mycobacterium avium subsp. paratuberculosis
ggcgccguccagcucgcg

SEQ ID NO: 1000788 - RNA, 19 nt, Mycobacterium avium subsp. paratuberculosis
ggcgccguccagcucgcgu

SEQ ID NO: 1000789 - RNA, 18 nt, Mycobacterium avium subsp. paratuberculosis
ggcgccguccgcggcggc

SEQ ID NO: 1000790 - RNA, 21 nt, Mycobacterium avium subsp. paratuberculosis
ggcgccguccgcggcggccag

SEQ ID NO: 1000791 - RNA, 16 nt, Mycobacterium avium subsp. paratuberculosis
ggcgccgucgaccagc

SEQ ID NO: 1000792 - RNA, 17 nt, Mycobacterium avium subsp. paratuberculosis
ggcgccgucgaccagcu

SEQ ID NO: 1000793 - RNA, 21 nt, Mycobacterium avium subsp. paratuberculosis
ggcgccgucgauggcgcggcc

SEQ ID NO: 1000794 - RNA, 13 nt, Mycobacterium avium subsp. paratuberculosis
ggcgccgucgccg

SEQ ID NO: 1000795 - RNA, 18 nt, Mycobacterium avium subsp. paratuberculosis
ggcgccggugccgcagcc

SEQ ID NO: 1000796 - RNA, 19 nt, Mycobacterium avium subsp. paratuberculosis
ggcgccggugccgcagccg

SEQ ID NO: 1000797 - RNA, 23 nt, Mycobacterium avium subsp. paratuberculosis
ggcgccggaucggcccccgggcc

SEQ ID NO: 1000798 - RNA, 20 nt, Mycobacterium avium subsp. paratuberculosis
ggcgccgggcggcccgccuc

SEQ ID NO: 1000799 - RNA, 14 nt, Mycobacterium avium subsp. paratuberculosis
ggcgccggggcggg

SEQ ID NO: 1000800 - RNA, 21 nt, Mycobacterium avium subsp. paratuberculosis
ggcgccggggcgggcggcggc

SEQ ID NO: 1000801 - RNA, 12 nt, Mycobacterium avium subsp. paratuberculosis
ggcgccggggcu

SEQ ID NO: 1000802 - RNA, 17 nt, Mycobacterium avium subsp. paratuberculosis
ggcgccgguaggcgcgg

SEQ ID NO: 1000803 - RNA, 18 nt, Mycobacterium avium subsp. paratuberculosis
ggcgccggcggccacgcu

SEQ ID NO: 1000804 - RNA, 17 nt, Mycobacterium avium subsp. paratuberculosis
ggcgccggcgcgggggc

SEQ ID NO: 1000805 - RNA, 18 nt, Mycobacterium avium subsp. paratuberculosis
ggcgccggcgcgggggcg

SEQ ID NO: 1000806 - RNA, 20 nt, Mycobacterium avium subsp. paratuberculosis
ggcgccggcgcguccggagg

SEQ ID NO: 1000807 - RNA, 17 nt, Mycobacterium avium subsp. paratuberculosis
ggcgccggcauccagca

SEQ ID NO: 1000808 - RNA, 14 nt, Mycobacterium avium subsp. paratuberculosis
ggcgccggcgauga

SEQ ID NO: 1000809 - RNA, 13 nt, Mycobacterium avium subsp. paratuberculosis
ggcgccggccagc

SEQ ID NO: 1000810 - RNA, 14 nt, Mycobacterium avium subsp. paratuberculosis
ggcgccggccagca

SEQ ID NO: 1000811 - RNA, 23 nt, Mycobacterium avium subsp. paratuberculosis
ggcgccggccagcacggccagcc

SEQ ID NO: 1000812 - RNA, 20 nt, Mycobacterium avium subsp. paratuberculosis
ggcgccgcgguagcggaccu

SEQ ID NO: 1000813 - RNA, 16 nt, Mycobacterium avium subsp. paratuberculosis
ggcgccggaggccagc

SEQ ID NO: 1000814 - RNA, 23 nt, Mycobacterium avium subsp. paratuberculosis
ggcgccggaggccagcucgaccg

SEQ ID NO: 1000815 - RNA, 22 nt, Mycobacterium avium subsp. paratuberculosis
ggcgccggaggggcgacgggcc

SEQ ID NO: 1000816 - RNA, 16 nt, Mycobacterium avium subsp. paratuberculosis
ggcgccgcugcgggcc

SEQ ID NO: 1000817 - RNA, 14 nt, Mycobacterium avium subsp. paratuberculosis
ggcgccgcggggcg

SEQ ID NO: 1000818 - RNA, 23 nt, Mycobacterium avium subsp. paratuberculosis
ggcgccgcgggcggucgcgcagc

SEQ ID NO: 1000819 - RNA, 18 nt, Mycobacterium avium subsp. paratuberculosis
ggcgccagcccgcccagc

SEQ ID NO: 1000820 - RNA, 19 nt, Mycobacterium avium subsp. paratuberculosis
ggcgccagcccgcccagcg

SEQ ID NO: 1000821 - RNA, 13 nt, Mycobacterium avium subsp. paratuberculosis
ggcgccagcagca

SEQ ID NO: 1000822 - RNA, 16 nt, Mycobacterium avium subsp. paratuberculosis
ggcgccagcagcaccu

SEQ ID NO: 1000823 - RNA, 16 nt, Mycobacterium avium subsp. paratuberculosis
ggcgccacugccgccg

SEQ ID NO: 1000824 - RNA, 24 nt, Mycobacterium avium subsp. paratuberculosis
ggcgccacgacugcgcggccggcg

SEQ ID NO: 1000825 - RNA, 12 nt, Mycobacterium avium subsp. paratuberculosis
ggcgccagcagc

SEQ ID NO: 1000826 - RNA, 15 nt, Mycobacterium avium subsp. paratuberculosis
ggcgccagcccgccg

SEQ ID NO: 1000827 - RNA, 13 nt, Mycobacterium avium subsp. paratuberculosis
ggcgccagcccgg

SEQ ID NO: 1000828 - RNA, 22 nt, Mycobacterium avium subsp. paratuberculosis
ggcgccagcccggugaucgccg

SEQ ID NO: 1000829 - RNA, 16 nt, Mycobacterium avium subsp. paratuberculosis
ggcgcccacagcaggu

SEQ ID NO: 1000830 - RNA, 23 nt, Mycobacterium avium subsp. paratuberculosis
ggcgcccacccguuggcaggccc

SEQ ID NO: 1000831 - RNA, 14 nt, Mycobacterium avium subsp. paratuberculosis
ggcgcccaccgcgg

SEQ ID NO: 1000832 - RNA, 16 nt, Mycobacterium avium subsp. paratuberculosis
ggcgcccaccgcggcg

SEQ ID NO: 1000833 - RNA, 15 nt, Mycobacterium avium subsp. paratuberculosis
ggcgccauccgcagc

SEQ ID NO: 1000834 - RNA, 16 nt, Mycobacterium avium subsp. paratuberculosis
ggcgcccggcuccccg

SEQ ID NO: 1000835 - RNA, 18 nt, Mycobacterium avium subsp. paratuberculosis
ggcgcccggcagccgcuc

SEQ ID NO: 1000836 - RNA, 20 nt, Mycobacterium avium subsp. paratuberculosis
ggcgcccggcccagccgcug

SEQ ID NO: 1000837 - RNA, 13 nt, Mycobacterium avium subsp. paratuberculosis
ggcgcccgcggcg

SEQ ID NO: 1000838 - RNA, 19 nt, Mycobacterium avium subsp. paratuberculosis
ggcgcccgcggcgcgcagg

SEQ ID NO: 1000839 - RNA, 17 nt, Mycobacterium avium subsp. paratuberculosis
ggcgcccgcggccucca

SEQ ID NO: 1000840 - RNA, 14 nt, Mycobacterium avium subsp. paratuberculosis
ggcgcccgcaggcc

SEQ ID NO: 1000841 - RNA, 12 nt, Mycobacterium avium subsp. paratuberculosis
ggcgcccccgcg

SEQ ID NO: 1000842 - RNA, 16 nt, Mycobacterium avium subsp. paratuberculosis
ggcgccccgcccgcga

SEQ ID NO: 1000843 - RNA, 16 nt, Mycobacterium avium subsp. paratuberculosis
ggcgccccgggcagcg

SEQ ID NO: 1000844 - RNA, 14 nt, Mycobacterium avium subsp. paratuberculosis
ggcgcccagcggcg

SEQ ID NO: 1000845 - RNA, 22 nt, Mycobacterium avium subsp. paratuberculosis
ggcgcccagcgucucggcggcc

SEQ ID NO: 1000846 - RNA, 20 nt, Mycobacterium avium subsp. paratuberculosis
ggcgcccagcgagcugccgg

SEQ ID NO: 1000847 - RNA, 18 nt, Mycobacterium avium subsp. paratuberculosis
ggcgcccagaucggccag

SEQ ID NO: 1000848 - RNA, 20 nt, Mycobacterium avium subsp. paratuberculosis
ggcgcccagaucggccagcc

SEQ ID NO: 1000849 - RNA, 13 nt, Mycobacterium avium subsp. paratuberculosis
ggcgcccagcaaa

SEQ ID NO: 1000850 - RNA, 22 nt, Mycobacterium avium subsp. paratuberculosis
ggcgcccagcaaacccagcacc

SEQ ID NO: 1000851 - RNA, 12 nt, Mycobacterium avium subsp. paratuberculosis
ggcgccgcggcc

SEQ ID NO: 1000852 - RNA, 19 nt, Mycobacterium avium subsp. paratuberculosis
ggcgccgcggcccugcagc

SEQ ID NO: 1000853 - RNA, 14 nt, Mycobacterium avium subsp. paratuberculosis
ggcgccgcggcgcc

SEQ ID NO: 1000854 - RNA, 15 nt, Mycobacterium avium subsp. paratuberculosis
ggcgccgcggcggca

SEQ ID NO: 1000855 - RNA, 13 nt, Mycobacterium avium subsp. paratuberculosis
ggcgccgcgccgg

SEQ ID NO: 1000856 - RNA, 13 nt, Mycobacterium avium subsp. paratuberculosis
ggcgccgcgcagc

SEQ ID NO: 1000857 - RNA, 19 nt, Mycobacterium avium subsp. paratuberculosis
ggcgccgccggucgccccc

SEQ ID NO: 1000858 - RNA, 12 nt, Mycobacterium avium subsp. paratuberculosis
ggcgccgcccgg

SEQ ID NO: 1000859 - RNA, 20 nt, Mycobacterium avium subsp. paratuberculosis
ggcgccgccgaccgcccgcu

SEQ ID NO: 1000860 - RNA, 14 nt, Mycobacterium avium subsp. paratuberculosis
ggcgccgcagcagg

SEQ ID NO: 1000861 - RNA, 16 nt, Mycobacterium avium subsp. paratuberculosis
ggcgccgcagcggcgc

SEQ ID NO: 1000862 - RNA, 19 nt, Mycobacterium avium subsp. paratuberculosis
ggcgccgcagcggcgccgg

SEQ ID NO: 1000863 - RNA, 13 nt, Mycobacterium avium subsp. paratuberculosis
ggcgccgcccacc

SEQ ID NO: 1000864 - RNA, 21 nt, Mycobacterium avium subsp. paratuberculosis
ggcgccgaugcccgccccgga

SEQ ID NO: 1000865 - RNA, 22 nt, Mycobacterium avium subsp. paratuberculosis
ggcgccgauuccgucgguggcg

SEQ ID NO: 1000866 - RNA, 16 nt, Mycobacterium avium subsp. paratuberculosis
ggcgccgaucgcgcgc

SEQ ID NO: 1000867 - RNA, 19 nt, Mycobacterium avium subsp. paratuberculosis
ggcgccgaucugcucggcu

SEQ ID NO: 1000868 - RNA, 17 nt, Mycobacterium avium subsp. paratuberculosis
ggcgccgaguccgggcc

SEQ ID NO: 1000869 - RNA, 23 nt, Mycobacterium avium subsp. paratuberculosis
ggcgccgaguccgggccgccggc

SEQ ID NO: 1000870 - RNA, 14 nt, Mycobacterium avium subsp. paratuberculosis
ggcgccgacgggcc

SEQ ID NO: 1000871 - RNA, 22 nt, Mycobacterium avium subsp. paratuberculosis
ggcgccgagcacgaacgcggcc

SEQ ID NO: 1000872 - RNA, 11 nt, Mycobacterium avium subsp. paratuberculosis
ggcgccgagcg

SEQ ID NO: 1000873 - RNA, 20 nt, Mycobacterium avium subsp. paratuberculosis
ggcgccgagcgucacgcugg

SEQ ID NO: 1000874 - RNA, 16 nt, Mycobacterium avium subsp. paratuberculosis
ggcgccgaggaucuug

SEQ ID NO: 1000875 - RNA, 15 nt, Mycobacterium avium subsp. paratuberculosis
ggcgccgacggccag

SEQ ID NO: 1000876 - RNA, 19 nt, Mycobacterium avium subsp. paratuberculosis
ggcgccgaccucggccagc

SEQ ID NO: 1000877 - RNA, 14 nt, Mycobacterium avium subsp. paratuberculosis
ggcgccgacgacgu

SEQ ID NO: 1000878 - RNA, 22 nt, Mycobacterium avium subsp. paratuberculosis
ggcgccgacagucgcgggcagc

SEQ ID NO: 1000879 - RNA, 16 nt, Mycobacterium avium subsp. paratuberculosis
ggcgcccuuggccucc

SEQ ID NO: 1000880 - RNA, 22 nt, Mycobacterium avium subsp. paratuberculosis
ggcgccgaacagaugccugccc

SEQ ID NO: 1000881 - RNA, 23 nt, Mycobacterium avium subsp. paratuberculosis
ggcgccgaacucggcgccgccgg

SEQ ID NO: 1000882 - RNA, 22 nt, Mycobacterium avium subsp. paratuberculosis
ggcgccgaagauggccaggaac

SEQ ID NO: 1000883 - RNA, 19 nt, Mycobacterium avium subsp. paratuberculosis
ggcgccgaagcccgcagcg

SEQ ID NO: 1000884 - RNA, 18 nt, Mycobacterium avium subsp. paratuberculosis
ggcgcccugcacccagcc

SEQ ID NO: 1000885 - RNA, 12 nt, Mycobacterium avium subsp. paratuberculosis
ggcgcccugcgc

SEQ ID NO: 1000886 - RNA, 17 nt, Mycobacterium avium subsp. paratuberculosis
ggcgcccgucacgcugg

SEQ ID NO: 1000887 - RNA, 14 nt, Mycobacterium avium subsp. paratuberculosis
ggccucaccgcggg

SEQ ID NO: 1000888 - RNA, 16 nt, Mycobacterium avium subsp. paratuberculosis
ggccguugggccagcg

SEQ ID NO: 1000889 - RNA, 19 nt, Mycobacterium avium subsp. paratuberculosis
ggccguugggccagcggcg

SEQ ID NO: 1000890 - RNA, 14 nt, Mycobacterium avium subsp. paratuberculosis
ggccguucgccggc

SEQ ID NO: 1000891 - RNA, 15 nt, Mycobacterium avium subsp. paratuberculosis
ggccguucgccggcc

SEQ ID NO: 1000892 - RNA, 18 nt, Mycobacterium avium subsp. paratuberculosis
ggccguucgccggccagc

SEQ ID NO: 1000893 - RNA, 19 nt, Mycobacterium avium subsp. paratuberculosis
ggccguugaucgagcaccg

SEQ ID NO: 1000894 - RNA, 20 nt, Mycobacterium avium subsp. paratuberculosis
ggccguugcgggugucgccg

SEQ ID NO: 1000895 - RNA, 19 nt, Mycobacterium avium subsp. paratuberculosis
ggccguucaggucgaucag

SEQ ID NO: 1000896 - RNA, 16 nt, Mycobacterium avium subsp. paratuberculosis
ggccgucuugcccggc

SEQ ID NO: 1000897 - RNA, 20 nt, Mycobacterium avium subsp. paratuberculosis
ggccgugaucggccagccac

SEQ ID NO: 1000898 - RNA, 18 nt, Mycobacterium avium subsp. paratuberculosis
ggccgugaugcgccggcg

SEQ ID NO: 1000899 - RNA, 21 nt, Mycobacterium avium subsp. paratuberculosis
ggccgugaugcgccggcgguc

SEQ ID NO: 1000900 - RNA, 19 nt, Mycobacterium avium subsp. paratuberculosis
ggccgugcaccgucgccgg

SEQ ID NO: 1000901 - RNA, 21 nt, Mycobacterium avium subsp. paratuberculosis
ggccgugcaccgucgccggcg

SEQ ID NO: 1000902 - RNA, 20 nt, Mycobacterium avium subsp. paratuberculosis
ggccgugcacgaacagggug

SEQ ID NO: 1000903 - RNA, 22 nt, Mycobacterium avium subsp. paratuberculosis
ggccgugcagggggcgcagccg

SEQ ID NO: 1000904 - RNA, 14 nt, Mycobacterium avium subsp. paratuberculosis
ggccgucggcgccg

SEQ ID NO: 1000905 - RNA, 18 nt, Mycobacterium avium subsp. paratuberculosis
ggccgucggcgccgccga

SEQ ID NO: 1000906 - RNA, 16 nt, Mycobacterium avium subsp. paratuberculosis
ggccucgccgucgcga

SEQ ID NO: 1000907 - RNA, 23 nt, Mycobacterium avium subsp. paratuberculosis
ggccucccacagcggaucggccu

SEQ ID NO: 1000908 - RNA, 20 nt, Mycobacterium avium subsp. paratuberculosis
ggccuccgugcuggccgggu

SEQ ID NO: 1000909 - RNA, 21 nt, Mycobacterium avium subsp. paratuberculosis
ggccuccuccucgcugccggc

SEQ ID NO: 1000910 - RNA, 20 nt, Mycobacterium avium subsp. paratuberculosis
ggccuccagccagcgcgcga

SEQ ID NO: 1000911 - RNA, 21 nt, Mycobacterium avium subsp. paratuberculosis
ggccuccagcuuugccagcag

SEQ ID NO: 1000912 - RNA, 22 nt, Mycobacterium avium subsp. paratuberculosis
ggccugacugagucaagccggc

SEQ ID NO: 1000913 - RNA, 14 nt, Mycobacterium avium subsp. paratuberculosis
ggccucgucgccgc

SEQ ID NO: 1000914 - RNA, 17 nt, Mycobacterium avium subsp. paratuberculosis
ggccucgucgucgucga

SEQ ID NO: 1000915 - RNA, 16 nt, Mycobacterium avium subsp. paratuberculosis
ggccucucgucgacga

SEQ ID NO: 1000916 - RNA, 23 nt, Mycobacterium avium subsp. paratuberculosis
ggccucguggaaaucgagcgcgc

SEQ ID NO: 1000917 - RNA, 14 nt, Mycobacterium avium subsp. paratuberculosis
ggccucguggaaca

SEQ ID NO: 1000918 - RNA, 17 nt, Mycobacterium avium subsp. paratuberculosis
ggccucguugaccgggu

SEQ ID NO: 1000919 - RNA, 23 nt, Mycobacterium avium subsp. paratuberculosis
ggccucguugaccgggucgccga

SEQ ID NO: 1000920 - RNA, 14 nt, Mycobacterium avium subsp. paratuberculosis
ggccucguccaggg

SEQ ID NO: 1000921 - RNA, 13 nt, Mycobacterium avium subsp. paratuberculosis
ggccucgcccagc

SEQ ID NO: 1000922 - RNA, 20 nt, Mycobacterium avium subsp. paratuberculosis
ggccugccggccgccgcgca

SEQ ID NO: 1000923 - RNA, 18 nt, Mycobacterium avium subsp. paratuberculosis
ggccugcccgccgcggcc

SEQ ID NO: 1000924 - RNA, 21 nt, Mycobacterium avium subsp. paratuberculosis
ggccugcccgcggguggccuu

SEQ ID NO: 1000925 - RNA, 20 nt, Mycobacterium avium subsp. paratuberculosis
ggccugcccggcggugccga

SEQ ID NO: 1000926 - RNA, 23 nt, Mycobacterium avium subsp. paratuberculosis
ggccugcacgucggcgcgcaggc

SEQ ID NO: 1000927 - RNA, 18 nt, Mycobacterium avium subsp. paratuberculosis
ggccugcacccaggucau

SEQ ID NO: 1000928 - RNA, 16 nt, Mycobacterium avium subsp. paratuberculosis
ggccuggaugccgccc

SEQ ID NO: 1000929 - RNA, 19 nt, Mycobacterium avium subsp. paratuberculosis
ggccugcuugggcagcagc

SEQ ID NO: 1000930 - RNA, 20 nt, Mycobacterium avium subsp. paratuberculosis
ggccugcuugggcagcagcu

SEQ ID NO: 1000931 - RNA, 15 nt, Mycobacterium avium subsp. paratuberculosis
ggccugcucgucggg

SEQ ID NO: 1000932 - RNA, 23 nt, Mycobacterium avium subsp. paratuberculosis
ggccugcucgucggggcagccgu

SEQ ID NO: 1000933 - RNA, 19 nt, Mycobacterium avium subsp. paratuberculosis
ggccugcgucacuccucga

SEQ ID NO: 1000934 - RNA, 17 nt, Mycobacterium avium subsp. paratuberculosis
ggccugcgccuuggccu

SEQ ID NO: 1000935 - RNA, 22 nt, Mycobacterium avium subsp. paratuberculosis
ggccugcgacuucuacggcggg

SEQ ID NO: 1000936 - RNA, 23 nt, Mycobacterium avium subsp. paratuberculosis
ggccugcgacuucuacggcgggc

SEQ ID NO: 1000937 - RNA, 14 nt, Mycobacterium avium subsp. paratuberculosis
ggccugcgcgccga

SEQ ID NO: 1000938 - RNA, 16 nt, Mycobacterium avium subsp. paratuberculosis
ggccugcgcggccgcg

SEQ ID NO: 1000939 - RNA, 14 nt, Mycobacterium avium subsp. paratuberculosis
ggccugcggcggcc

SEQ ID NO: 1000940 - RNA, 21 nt, Mycobacterium avium subsp. paratuberculosis
ggccugcgggcgccggcugcc

SEQ ID NO: 1000941 - RNA, 15 nt, Mycobacterium avium subsp. paratuberculosis
ggccuugcgagccgg

SEQ ID NO: 1000942 - RNA, 16 nt, Mycobacterium avium subsp. paratuberculosis
ggccuugcgagccgga

SEQ ID NO: 1000943 - RNA, 22 nt, Mycobacterium avium subsp. paratuberculosis
ggccuugcgagccggagccuug

SEQ ID NO: 1000944 - RNA, 22 nt, Mycobacterium avium subsp. paratuberculosis
ggccuugcgcaccggagccuug

SEQ ID NO: 1000945 - RNA, 14 nt, Mycobacterium avium subsp. paratuberculosis
ggccuuccgcaaca

SEQ ID NO: 1000946 - RNA, 15 nt, Mycobacterium avium subsp. paratuberculosis
ggccuucacgcuggc

SEQ ID NO: 1000947 - RNA, 18 nt, Mycobacterium avium subsp. paratuberculosis
ggccuucagcguccacga

SEQ ID NO: 1000948 - RNA, 18 nt, Mycobacterium avium subsp. paratuberculosis
ggccugguaggccgccuu

SEQ ID NO: 1000949 - RNA, 18 nt, Mycobacterium avium subsp. paratuberculosis
ggccuggucgaacagcac

SEQ ID NO: 1000950 - RNA, 23 nt, Mycobacterium avium subsp. paratuberculosis
ggccuggccgucgcggcgcgggu

SEQ ID NO: 1000951 - RNA, 14 nt, Mycobacterium avium subsp. paratuberculosis
ggccuggcccagcc

SEQ ID NO: 1000952 - RNA, 21 nt, Mycobacterium avium subsp. paratuberculosis
ggcgagauuggccucggcgcg

SEQ ID NO: 1000953 - RNA, 13 nt, Mycobacterium avium subsp. paratuberculosis
ggcgagcaauuaa

SEQ ID NO: 1000954 - RNA, 22 nt, Mycobacterium avium subsp. paratuberculosis
ggcgagcaccgugccgucggcg

SEQ ID NO: 1000955 - RNA, 14 nt, Mycobacterium avium subsp. paratuberculosis
ggcgagcagccgcg

SEQ ID NO: 1000956 - RNA, 21 nt, Mycobacterium avium subsp. paratuberculosis
ggcgagcagccgcgccgggcg

SEQ ID NO: 1000957 - RNA, 14 nt, Mycobacterium avium subsp. paratuberculosis
ggcgagcagcgccc

SEQ ID NO: 1000958 - RNA, 14 nt, Mycobacterium avium subsp. paratuberculosis
ggcgagcagcgcga

SEQ ID NO: 1000959 - RNA, 15 nt, Mycobacterium avium subsp. paratuberculosis
ggcgagccgggccgg

SEQ ID NO: 1000960 - RNA, 12 nt, Mycobacterium avium subsp. paratuberculosis
ggcgagcggccc

SEQ ID NO: 1000961 - RNA, 14 nt, Mycobacterium avium subsp. paratuberculosis
ggcgagcgucgccg

SEQ ID NO: 1000962 - RNA, 20 nt, Mycobacterium avium subsp. paratuberculosis
ggcgagcgucgccgcguggg

SEQ ID NO: 1000963 - RNA, 12 nt, Mycobacterium avium subsp. paratuberculosis
ggcgagcucgcg

SEQ ID NO: 1000964 - RNA, 15 nt, Mycobacterium avium subsp. paratuberculosis
ggcgagcucgcggcc

SEQ ID NO: 1000965 - RNA, 14 nt, Mycobacterium avium subsp. paratuberculosis
ggcgaggccaggcg

SEQ ID NO: 1000966 - RNA, 15 nt, Mycobacterium avium subsp. paratuberculosis
ggcgaggccaggcgu

SEQ ID NO: 1000967 - RNA, 16 nt, Mycobacterium avium subsp. paratuberculosis
ggcgagcuggccgccc

SEQ ID NO: 1000968 - RNA, 18 nt, Mycobacterium avium subsp. paratuberculosis
ggcgagcuggccgcccac

SEQ ID NO: 1000969 - RNA, 17 nt, Mycobacterium avium subsp. paratuberculosis
ggcgagcugaccggcca

SEQ ID NO: 1000970 - RNA, 19 nt, Mycobacterium avium subsp. paratuberculosis
ggcgagcuuggcgggcguc

SEQ ID NO: 1000971 - RNA, 18 nt, Mycobacterium avium subsp. paratuberculosis
ggcgaggaacccgaccgc

SEQ ID NO: 1000972 - RNA, 20 nt, Mycobacterium avium subsp. paratuberculosis
ggcgacgccggcgaggcggu

SEQ ID NO: 1000973 - RNA, 21 nt, Mycobacterium avium subsp. paratuberculosis
ggcgacgccgcgcuggccggg

SEQ ID NO: 1000974 - RNA, 14 nt, Mycobacterium avium subsp. paratuberculosis
ggcgacgcggcggg

SEQ ID NO: 1000975 - RNA, 16 nt, Mycobacterium avium subsp. paratuberculosis
ggcgacgcugugcucg

SEQ ID NO: 1000976 - RNA, 18 nt, Mycobacterium avium subsp. paratuberculosis
ggcgacggcaccgccggc

SEQ ID NO: 1000977 - RNA, 16 nt, Mycobacterium avium subsp. paratuberculosis
ggcgacggcagcgcga

SEQ ID NO: 1000978 - RNA, 13 nt, Mycobacterium avium subsp. paratuberculosis
ggcgacggccagc

SEQ ID NO: 1000979 - RNA, 23 nt, Mycobacterium avium subsp. paratuberculosis
ggcgacgauaucggccgcggggc

SEQ ID NO: 1000980 - RNA, 22 nt, Mycobacterium avium subsp. paratuberculosis
ggcgacgauggccaggcccagc

SEQ ID NO: 1000981 - RNA, 16 nt, Mycobacterium avium subsp. paratuberculosis
ggcgacgacggcggag

SEQ ID NO: 1000982 - RNA, 17 nt, Mycobacterium avium subsp. paratuberculosis
ggcgacggccagcgcgg

SEQ ID NO: 1000983 - RNA, 18 nt, Mycobacterium avium subsp. paratuberculosis
ggcgacggcgacggccag

SEQ ID NO: 1000984 - RNA, 19 nt, Mycobacterium avium subsp. paratuberculosis
ggcgacggcgacggccaga

SEQ ID NO: 1000985 - RNA, 12 nt, Mycobacterium avium subsp. paratuberculosis
ggcgacggcgcu

SEQ ID NO: 1000986 - RNA, 21 nt, Mycobacterium avium subsp. paratuberculosis
ggcgacggcggccgucuugcc

SEQ ID NO: 1000987 - RNA, 16 nt, Mycobacterium avium subsp. paratuberculosis
ggcgacggcgucggcg

SEQ ID NO: 1000988 - RNA, 18 nt, Mycobacterium avium subsp. paratuberculosis
ggcgacggcguccgggcg

SEQ ID NO: 1000989 - RNA, 13 nt, Mycobacterium avium subsp. paratuberculosis
ggcgacgucgccg

SEQ ID NO: 1000990 - RNA, 16 nt, Mycobacterium avium subsp. paratuberculosis
ggcgacgucgccggcc

SEQ ID NO: 1000991 - RNA, 19 nt, Mycobacterium avium subsp. paratuberculosis
ggcgacgucggucggcagg

SEQ ID NO: 1000992 - RNA, 23 nt, Mycobacterium avium subsp. paratuberculosis
ggcgacgucgucgaugccgaucg

SEQ ID NO: 1000993 - RNA, 19 nt, Mycobacterium avium subsp. paratuberculosis
ggcgacgucgucgcccacc

SEQ ID NO: 1000994 - RNA, 17 nt, Mycobacterium avium subsp. paratuberculosis
ggcgacgugaucggcgg

SEQ ID NO: 1000995 - RNA, 20 nt, Mycobacterium avium subsp. paratuberculosis
ggcgacgguguccgcggcgu

SEQ ID NO: 1000996 - RNA, 18 nt, Mycobacterium avium subsp. paratuberculosis
ggcgacgguggcgcccag

SEQ ID NO: 1000997 - RNA, 16 nt, Mycobacterium avium subsp. paratuberculosis
ggcgaccggggcggug

SEQ ID NO: 1000998 - RNA, 15 nt, Mycobacterium avium subsp. paratuberculosis
ggcgaccugcgggcc

SEQ ID NO: 1000999 - RNA, 19 nt, Mycobacterium avium subsp. paratuberculosis
ggcgaccugcgggcccacc

SEQ ID NO: 1001000 - RNA, 20 nt, Mycobacterium avium subsp. paratuberculosis
ggcgaccuguuuggccagcc

SEQ ID NO: 1001001 - RNA, 16 nt, Mycobacterium avium subsp. paratuberculosis
ggcgacgaagcagcuc

SEQ ID NO: 1001002 - RNA, 18 nt, Mycobacterium avium subsp. paratuberculosis
ggcgacgaagcagcucgc

SEQ ID NO: 1001003 - RNA, 23 nt, Mycobacterium avium subsp. paratuberculosis
ggcgacgaagcagcucgcguagc

SEQ ID NO: 1001004 - RNA, 17 nt, Mycobacterium avium subsp. paratuberculosis
ggcgaccaugcccagca

SEQ ID NO: 1001005 - RNA, 16 nt, Mycobacterium avium subsp. paratuberculosis
ggcgaccaugccgcgg

SEQ ID NO: 1001006 - RNA, 18 nt, Mycobacterium avium subsp. paratuberculosis
ggcgacccccggugucug

SEQ ID NO: 1001007 - RNA, 13 nt, Mycobacterium avium subsp. paratuberculosis
ggcgaccggcccc

SEQ ID NO: 1001008 - RNA, 15 nt, Mycobacterium avium subsp. paratuberculosis
ggcgaccggccccaa

SEQ ID NO: 1001009 - RNA, 19 nt, Mycobacterium avium subsp. paratuberculosis
ggcgaccgcccggggcgcg

SEQ ID NO: 1001010 - RNA, 22 nt, Mycobacterium avium subsp. paratuberculosis
ggcgaccgcgacgguggacccg

SEQ ID NO: 1001011 - RNA, 19 nt, Mycobacterium avium subsp. paratuberculosis
ggcgaccgcgcaggcggcg

SEQ ID NO: 1001012 - RNA, 13 nt, Mycobacterium avium subsp. paratuberculosis
ggcgaccgcgcgc

SEQ ID NO: 1001013 - RNA, 17 nt, Mycobacterium avium subsp. paratuberculosis
ggcgaccgcgcgcggcg

SEQ ID NO: 1001014 - RNA, 13 nt, Mycobacterium avium subsp. paratuberculosis
ggcgaccgcggcc

SEQ ID NO: 1001015 - RNA, 16 nt, Mycobacterium avium subsp. paratuberculosis
ggcgaagucgccggcc

SEQ ID NO: 1001016 - RNA, 19 nt, Mycobacterium avium subsp. paratuberculosis
ggcgaagucgccggccagg

SEQ ID NO: 1001017 - RNA, 13 nt, Mycobacterium avium subsp. paratuberculosis
ggcgaagucgccg

SEQ ID NO: 1001018 - RNA, 23 nt, Mycobacterium avium subsp. paratuberculosis
ggcgaagguguccucgagcugca

SEQ ID NO: 1001019 - RNA, 16 nt, Mycobacterium avium subsp. paratuberculosis
ggcgaaguagccggcg

SEQ ID NO: 1001020 - RNA, 14 nt, Mycobacterium avium subsp. paratuberculosis
ggcgaauauuucgu

SEQ ID NO: 1001021 - RNA, 21 nt, Mycobacterium avium subsp. paratuberculosis
ggcgaaucugucgauggcgga

SEQ ID NO: 1001022 - RNA, 14 nt, Mycobacterium avium subsp. paratuberculosis
ggcgaagcucgacg

SEQ ID NO: 1001023 - RNA, 13 nt, Mycobacterium avium subsp. paratuberculosis
ggcgaagccgagg

SEQ ID NO: 1001024 - RNA, 16 nt, Mycobacterium avium subsp. paratuberculosis
ggcgaaggagaagaca

SEQ ID NO: 1001025 - RNA, 13 nt, Mycobacterium avium subsp. paratuberculosis
ggcgaagccggcg

SEQ ID NO: 1001026 - RNA, 14 nt, Mycobacterium avium subsp. paratuberculosis
ggcgaagcaggcca

SEQ ID NO: 1001027 - RNA, 23 nt, Mycobacterium avium subsp. paratuberculosis
ggcgaagcaggccaggugcagcu

SEQ ID NO: 1001028 - RNA, 13 nt, Mycobacterium avium subsp. paratuberculosis
ggcgaaugcggcc

SEQ ID NO: 1001029 - RNA, 21 nt, Mycobacterium avium subsp. paratuberculosis
ggcgacaccgcauggccggcg

SEQ ID NO: 1001030 - RNA, 16 nt, Mycobacterium avium subsp. paratuberculosis
ggcgacacguccagcu

SEQ ID NO: 1001031 - RNA, 22 nt, Mycobacterium avium subsp. paratuberculosis
ggcgaccaccacggccgcagcg

SEQ ID NO: 1001032 - RNA, 22 nt, Mycobacterium avium subsp. paratuberculosis
ggcgacaugcgcagcgcccagg

SEQ ID NO: 1001033 - RNA, 18 nt, Mycobacterium avium subsp. paratuberculosis
ggcgaccaccgaccccug

SEQ ID NO: 1001034 - RNA, 18 nt, Mycobacterium avium subsp. paratuberculosis
ggcgaccaccucggcgac

SEQ ID NO: 1001035 - RNA, 19 nt, Mycobacterium avium subsp. paratuberculosis
ggcgaccacguccagcugg

SEQ ID NO: 1001036 - RNA, 20 nt, Mycobacterium avium subsp. paratuberculosis
ggcgaccagauaggccagcg

SEQ ID NO: 1001037 - RNA, 22 nt, Mycobacterium avium subsp. paratuberculosis
ggcgaccagcgagcccagcugc

SEQ ID NO: 1001038 - RNA, 22 nt, Mycobacterium avium subsp. paratuberculosis
ggcgaacagcggggugcccacc

SEQ ID NO: 1001039 - RNA, 17 nt, Mycobacterium avium subsp. paratuberculosis
ggcgaaccgcggcggca

SEQ ID NO: 1001040 - RNA, 15 nt, Mycobacterium avium subsp. paratuberculosis
ggcgaaccgggcccg

SEQ ID NO: 1001041 - RNA, 11 nt, Mycobacterium avium subsp. paratuberculosis
ggcgaaccagc

SEQ ID NO: 1001042 - RNA, 14 nt, Mycobacterium avium subsp. paratuberculosis
ggcgaaccagcaug

SEQ ID NO: 1001043 - RNA, 16 nt, Mycobacterium avium subsp. paratuberculosis
ggcgaacccggcgccc

SEQ ID NO: 1001044 - RNA, 20 nt, Mycobacterium avium subsp. paratuberculosis
ggcgaacccggcgcccggcc

SEQ ID NO: 1001045 - RNA, 20 nt, Mycobacterium avium subsp. paratuberculosis
ggcgaacggcaacggcggcg

SEQ ID NO: 1001046 - RNA, 22 nt, Mycobacterium avium subsp. paratuberculosis
ggcgaacgucgggucgaagugc

SEQ ID NO: 1001047 - RNA, 15 nt, Mycobacterium avium subsp. paratuberculosis
ggcgaacgaccgggu

SEQ ID NO: 1001048 - RNA, 16 nt, Mycobacterium avium subsp. paratuberculosis
ggcgaagacgucggcg

SEQ ID NO: 1001049 - RNA, 19 nt, Mycobacterium avium subsp. paratuberculosis
ggcgaacuccagaucgccg

SEQ ID NO: 1001050 - RNA, 19 nt, Mycobacterium avium subsp. paratuberculosis
ggcgaacaccagcccggcc

SEQ ID NO: 1001051 - RNA, 18 nt, Mycobacterium avium subsp. paratuberculosis
ggcgaacacgucggccag

SEQ ID NO: 1001052 - RNA, 20 nt, Mycobacterium avium subsp. paratuberculosis
ggcgaacacgucggccagcg

SEQ ID NO: 1001053 - RNA, 18 nt, Mycobacterium avium subsp. paratuberculosis
ggcuaccagccccaggag

SEQ ID NO: 1001054 - RNA, 19 nt, Mycobacterium avium subsp. paratuberculosis
ggcuaccaguugagccgga

SEQ ID NO: 1001055 - RNA, 22 nt, Mycobacterium avium subsp. paratuberculosis
ggcuaccuaggcgucgucggcc

SEQ ID NO: 1001056 - RNA, 18 nt, Mycobacterium avium subsp. paratuberculosis
ggcuaccugaccagcggc

SEQ ID NO: 1001057 - RNA, 17 nt, Mycobacterium avium subsp. paratuberculosis
ggcuaucgcccggcgcc

SEQ ID NO: 1001058 - RNA, 17 nt, Mycobacterium avium subsp. paratuberculosis
ggcuaggcucggcagcc

SEQ ID NO: 1001059 - RNA, 20 nt, Mycobacterium avium subsp. paratuberculosis
ggcuaaacaauggccccggc

SEQ ID NO: 1001060 - RNA, 20 nt, Mycobacterium avium subsp. paratuberculosis
ggcguuugccacugagcgca

SEQ ID NO: 1001061 - RNA, 17 nt, Mycobacterium avium subsp. paratuberculosis
ggcguucaucaccuggu

SEQ ID NO: 1001062 - RNA, 16 nt, Mycobacterium avium subsp. paratuberculosis
ggcguugaugcgggcg

SEQ ID NO: 1001063 - RNA, 23 nt, Mycobacterium avium subsp. paratuberculosis
ggcguugcgccgcgagcgcagca

SEQ ID NO: 1001064 - RNA, 19 nt, Mycobacterium avium subsp. paratuberculosis
ggcguugcggguggagaag

SEQ ID NO: 1001065 - RNA, 15 nt, Mycobacterium avium subsp. paratuberculosis
ggcguuggacagcuc

SEQ ID NO: 1001066 - RNA, 17 nt, Mycobacterium avium subsp. paratuberculosis
ggcguuggacuccaccg

SEQ ID NO: 1001067 - RNA, 16 nt, Mycobacterium avium subsp. paratuberculosis
ggcguuggcggcgucg

SEQ ID NO: 1001068 - RNA, 21 nt, Mycobacterium avium subsp. paratuberculosis
ggcguugagggcggggcagca

SEQ ID NO: 1001069 - RNA, 19 nt, Mycobacterium avium subsp. paratuberculosis
ggcguucgauugccggacg

SEQ ID NO: 1001070 - RNA, 13 nt, Mycobacterium avium subsp. paratuberculosis
ggcgugcacaggc

SEQ ID NO: 1001071 - RNA, 20 nt, Mycobacterium avium subsp. paratuberculosis
ggcgugcacaggccgccgca

SEQ ID NO: 1001072 - RNA, 16 nt, Mycobacterium avium subsp. paratuberculosis
ggcgugcagucccaga

SEQ ID NO: 1001073 - RNA, 14 nt, Mycobacterium avium subsp. paratuberculosis
ggcgugccacagca

SEQ ID NO: 1001074 - RNA, 17 nt, Mycobacterium avium subsp. paratuberculosis
ggcgugccaccgcuggg

SEQ ID NO: 1001075 - RNA, 17 nt, Mycobacterium avium subsp. paratuberculosis
ggcgugccagggcagcg

SEQ ID NO: 1001076 - RNA, 23 nt, Mycobacterium avium subsp. paratuberculosis
ggcgugacgcucgacggccggcg

SEQ ID NO: 1001077 - RNA, 16 nt, Mycobacterium avium subsp. paratuberculosis
ggcgugacgcucgccg

SEQ ID NO: 1001078 - RNA, 19 nt, Mycobacterium avium subsp. paratuberculosis
ggcgugacgcucggcgccg

SEQ ID NO: 1001079 - RNA, 16 nt, Mycobacterium avium subsp. paratuberculosis
ggcgugcuccagcagg

SEQ ID NO: 1001080 - RNA, 17 nt, Mycobacterium avium subsp. paratuberculosis
ggcgugcuccagcaggc

SEQ ID NO: 1001081 - RNA, 15 nt, Mycobacterium avium subsp. paratuberculosis
ggcgugcccggcgca

SEQ ID NO: 1001082 - RNA, 15 nt, Mycobacterium avium subsp. paratuberculosis
ggcgugcgguuggcc

SEQ ID NO: 1001083 - RNA, 16 nt, Mycobacterium avium subsp. paratuberculosis
ggcgugcugcgcagca

SEQ ID NO: 1001084 - RNA, 20 nt, Mycobacterium avium subsp. paratuberculosis
ggcgugcuugaacgccgccc

SEQ ID NO: 1001085 - RNA, 17 nt, Mycobacterium avium subsp. paratuberculosis
ggcgugcggccgcagcg

SEQ ID NO: 1001086 - RNA, 13 nt, Mycobacterium avium subsp. paratuberculosis
ggcgugcggcgcg

SEQ ID NO: 1001087 - RNA, 14 nt, Mycobacterium avium subsp. paratuberculosis
ggcgugccgcuggg

SEQ ID NO: 1001088 - RNA, 15 nt, Mycobacterium avium subsp. paratuberculosis
ggcgugccggcggcg

SEQ ID NO: 1001089 - RNA, 19 nt, Mycobacterium avium subsp. paratuberculosis
ggcguguagccugcggccu

SEQ ID NO: 1001090 - RNA, 21 nt, Mycobacterium avium subsp. paratuberculosis
ggcguguaguacugcucgacg

SEQ ID NO: 1001091 - RNA, 17 nt, Mycobacterium avium subsp. paratuberculosis
ggcgugugggcucgccc

SEQ ID NO: 1001092 - RNA, 18 nt, Mycobacterium avium subsp. paratuberculosis
ggcgugcucgucgcggag

SEQ ID NO: 1001093 - RNA, 15 nt, Mycobacterium avium subsp. paratuberculosis
ggcguggcgccggcg

SEQ ID NO: 1001094 - RNA, 18 nt, Mycobacterium avium subsp. paratuberculosis
ggcguggcgcucagcggc

SEQ ID NO: 1001095 - RNA, 22 nt, Mycobacterium avium subsp. paratuberculosis
ggcguggcgcucagcggcagcg

SEQ ID NO: 1001096 - RNA, 16 nt, Mycobacterium avium subsp. paratuberculosis
ggcguggcggaagcgc

SEQ ID NO: 1001097 - RNA, 16 nt, Mycobacterium avium subsp. paratuberculosis
ggcgugggccgcagcg

SEQ ID NO: 1001098 - RNA, 21 nt, Mycobacterium avium subsp. paratuberculosis
ggcgugggccgcagcgcggcg

SEQ ID NO: 1001099 - RNA, 15 nt, Mycobacterium avium subsp. paratuberculosis
ggcguggcugaggcc

SEQ ID NO: 1001100 - RNA, 23 nt, Mycobacterium avium subsp. paratuberculosis
ggcguggcggucggugcgcagca

SEQ ID NO: 1001101 - RNA, 15 nt, Mycobacterium avium subsp. paratuberculosis
ggcguggcgguggcg

SEQ ID NO: 1001102 - RNA, 18 nt, Mycobacterium avium subsp. paratuberculosis
ggcguggcgguggcggcg

SEQ ID NO: 1001103 - RNA, 21 nt, Mycobacterium avium subsp. paratuberculosis
ggcgucuugaucucggcggcg

SEQ ID NO: 1001104 - RNA, 21 nt, Mycobacterium avium subsp. paratuberculosis
ggcgugaauccucagcacggc

SEQ ID NO: 1001105 - RNA, 20 nt, Mycobacterium avium subsp. paratuberculosis
ggcgugaaucuuggccagca

SEQ ID NO: 1001106 - RNA, 21 nt, Mycobacterium avium subsp. paratuberculosis
ggcgugaaucuuggccagcag

SEQ ID NO: 1001107 - RNA, 21 nt, Mycobacterium avium subsp. paratuberculosis
ggcgucucggcgucucggccc

SEQ ID NO: 1001108 - RNA, 21 nt, Mycobacterium avium subsp. paratuberculosis
ggcgucgucgccguggcggcc

SEQ ID NO: 1001109 - RNA, 15 nt, Mycobacterium avium subsp. paratuberculosis
ggcgucgucggcggc

SEQ ID NO: 1001110 - RNA, 16 nt, Mycobacterium avium subsp. paratuberculosis
ggcgucgucggcggcg

SEQ ID NO: 1001111 - RNA, 20 nt, Mycobacterium avium subsp. paratuberculosis
ggcgucgucgucgagccgcu

SEQ ID NO: 1001112 - RNA, 19 nt, Mycobacterium avium subsp. paratuberculosis
ggcgucgguggcggcggcg

SEQ ID NO: 1001113 - RNA, 17 nt, Mycobacterium avium subsp. paratuberculosis
ggcgucguagacgcugc

SEQ ID NO: 1001114 - RNA, 22 nt, Mycobacterium avium subsp. paratuberculosis
ggcgucguaguugcggccggcg

SEQ ID NO: 1001115 - RNA, 16 nt, Mycobacterium avium subsp. paratuberculosis
ggcgucggcggccugc

SEQ ID NO: 1001116 - RNA, 20 nt, Mycobacterium avium subsp. paratuberculosis
ggcgucggcguagggcagcc

SEQ ID NO: 1001117 - RNA, 22 nt, Mycobacterium avium subsp. paratuberculosis
ggcgucggcguagggcagcccg

SEQ ID NO: 1001118 - RNA, 19 nt, Mycobacterium avium subsp. paratuberculosis
ggcgucggcgucgaacggc

SEQ ID NO: 1001119 - RNA, 15 nt, Mycobacterium avium subsp. paratuberculosis
ggcgucgggcggggu

SEQ ID NO: 1001120 - RNA, 16 nt, Mycobacterium avium subsp. paratuberculosis
ggcgucggggcccucc

SEQ ID NO: 1001121 - RNA, 22 nt, Mycobacterium avium subsp. paratuberculosis
ggcgucggggcccuccgcggcg

SEQ ID NO: 1001122 - RNA, 18 nt, Mycobacterium avium subsp. paratuberculosis
ggcgucgcgcagcagcgg

SEQ ID NO: 1001123 - RNA, 11 nt, Mycobacterium avium subsp. paratuberculosis
ggcgucgccgc

SEQ ID NO: 1001124 - RNA, 19 nt, Mycobacterium avium subsp. paratuberculosis
ggcgucgaugaugccggcg

SEQ ID NO: 1001125 - RNA, 14 nt, Mycobacterium avium subsp. paratuberculosis
ggcgucggccagcg

SEQ ID NO: 1001126 - RNA, 21 nt, Mycobacterium avium subsp. paratuberculosis
ggcgucggacaugccggcgcc

SEQ ID NO: 1001127 - RNA, 19 nt, Mycobacterium avium subsp. paratuberculosis
ggcgucggagaugcgggcc

SEQ ID NO: 1001128 - RNA, 16 nt, Mycobacterium avium subsp. paratuberculosis
ggcgucggaggcggcg

SEQ ID NO: 1001129 - RNA, 14 nt, Mycobacterium avium subsp. paratuberculosis
ggcgucggccgggg

SEQ ID NO: 1001130 - RNA, 16 nt, Mycobacterium avium subsp. paratuberculosis
ggcgucggccgggggc

SEQ ID NO: 1001131 - RNA, 16 nt, Mycobacterium avium subsp. paratuberculosis
ggcgucggccugcccg

SEQ ID NO: 1001132 - RNA, 16 nt, Mycobacterium avium subsp. paratuberculosis
ggcgucggcgagcggu

SEQ ID NO: 1001133 - RNA, 19 nt, Mycobacterium avium subsp. paratuberculosis
ggcgucggcgagcgguucg

SEQ ID NO: 1001134 - RNA, 15 nt, Mycobacterium avium subsp. paratuberculosis
ggcgucggcgcgcac

SEQ ID NO: 1001135 - RNA, 19 nt, Mycobacterium avium subsp. paratuberculosis
ggcgucgacgugcgcggcg

SEQ ID NO: 1001136 - RNA, 18 nt, Mycobacterium avium subsp. paratuberculosis
ggcgucgacgacggcgcc

SEQ ID NO: 1001137 - RNA, 16 nt, Mycobacterium avium subsp. paratuberculosis
ggcgucgacgcgcugc

SEQ ID NO: 1001138 - RNA, 19 nt, Mycobacterium avium subsp. paratuberculosis
ggcgucgaucagcgcgccg

SEQ ID NO: 1001139 - RNA, 20 nt, Mycobacterium avium subsp. paratuberculosis
ggcgucgaucagcgcgccgc

SEQ ID NO: 1001140 - RNA, 20 nt, Mycobacterium avium subsp. paratuberculosis
ggcguccuugaccagcugcg

SEQ ID NO: 1001141 - RNA, 19 nt, Mycobacterium avium subsp. paratuberculosis
ggcgucgaacgggccgggc

SEQ ID NO: 1001142 - RNA, 14 nt, Mycobacterium avium subsp. paratuberculosis
ggcgucgaagcgca

SEQ ID NO: 1001143 - RNA, 13 nt, Mycobacterium avium subsp. paratuberculosis
ggcguccuccucg

SEQ ID NO: 1001144 - RNA, 14 nt, Mycobacterium avium subsp. paratuberculosis
ggcguccuccucgu

SEQ ID NO: 1001145 - RNA, 17 nt, Mycobacterium avium subsp. paratuberculosis
ggcguaccgcggcggcg

SEQ ID NO: 1001146 - RNA, 16 nt, Mycobacterium avium subsp. paratuberculosis
ggcguacagcccgcgg

SEQ ID NO: 1001147 - RNA, 16 nt, Mycobacterium avium subsp. paratuberculosis
ggcguacagcggcgcc

SEQ ID NO: 1001148 - RNA, 20 nt, Mycobacterium avium subsp. paratuberculosis
ggcguacagcggcgccaggu

SEQ ID NO: 1001149 - RNA, 16 nt, Mycobacterium avium subsp. paratuberculosis
ggcgguuccgguggcg

SEQ ID NO: 1001150 - RNA, 20 nt, Mycobacterium avium subsp. paratuberculosis
ggcgguuggacaggccggcg

SEQ ID NO: 1001151 - RNA, 17 nt, Mycobacterium avium subsp. paratuberculosis
ggcggugaugcgcgccg

SEQ ID NO: 1001152 - RNA, 12 nt, Mycobacterium avium subsp. paratuberculosis
ggcggugcagcc

SEQ ID NO: 1001153 - RNA, 14 nt, Mycobacterium avium subsp. paratuberculosis
ggcggugaucgccg

SEQ ID NO: 1001154 - RNA, 15 nt, Mycobacterium avium subsp. paratuberculosis
ggcggugccgcaggc

SEQ ID NO: 1001155 - RNA, 12 nt, Mycobacterium avium subsp. paratuberculosis
ggcggugccggc

SEQ ID NO: 1001156 - RNA, 15 nt, Mycobacterium avium subsp. paratuberculosis
ggcggugcgcagccg

SEQ ID NO: 1001157 - RNA, 19 nt, Mycobacterium avium subsp. paratuberculosis
ggcggugcgcagucgcugg

SEQ ID NO: 1001158 - RNA, 16 nt, Mycobacterium avium subsp. paratuberculosis
ggcggugucggcggca

SEQ ID NO: 1001159 - RNA, 20 nt, Mycobacterium avium subsp. paratuberculosis
ggcggugucggugccgagca

SEQ ID NO: 1001160 - RNA, 22 nt, Mycobacterium avium subsp. paratuberculosis
ggcggugucguaguugcgcgcc

SEQ ID NO: 1001161 - RNA, 17 nt, Mycobacterium avium subsp. paratuberculosis
ggcgguggcgccggggc

SEQ ID NO: 1001162 - RNA, 15 nt, Mycobacterium avium subsp. paratuberculosis
ggcggugcggguggu

SEQ ID NO: 1001163 - RNA, 13 nt, Mycobacterium avium subsp. paratuberculosis
ggcggugcggacc

SEQ ID NO: 1001164 - RNA, 16 nt, Mycobacterium avium subsp. paratuberculosis
ggcggugcggacccgu

SEQ ID NO: 1001165 - RNA, 18 nt, Mycobacterium avium subsp. paratuberculosis
ggcguaugccuccucggu

SEQ ID NO: 1001166 - RNA, 22 nt, Mycobacterium avium subsp. paratuberculosis
ggcguauucgucgucggccucg

SEQ ID NO: 1001167 - RNA, 22 nt, Mycobacterium avium subsp. paratuberculosis
ggcgucacauacgccucacccc

SEQ ID NO: 1001168 - RNA, 14 nt, Mycobacterium avium subsp. paratuberculosis
ggcguagugcagcu

SEQ ID NO: 1001169 - RNA, 21 nt, Mycobacterium avium subsp. paratuberculosis
ggcguagugggucggcggcug

SEQ ID NO: 1001170 - RNA, 15 nt, Mycobacterium avium subsp. paratuberculosis
ggcguagggcagccc

SEQ ID NO: 1001171 - RNA, 17 nt, Mycobacterium avium subsp. paratuberculosis
ggcguagcagucggccu

SEQ ID NO: 1001172 - RNA, 19 nt, Mycobacterium avium subsp. paratuberculosis
ggcguagcggaagcugccg

SEQ ID NO: 1001173 - RNA, 19 nt, Mycobacterium avium subsp. paratuberculosis
ggcguacgcgcugccgacg

SEQ ID NO: 1001174 - RNA, 16 nt, Mycobacterium avium subsp. paratuberculosis
ggcguacugcucggcg

SEQ ID NO: 1001175 - RNA, 14 nt, Mycobacterium avium subsp. paratuberculosis
ggcguagagccgcu

SEQ ID NO: 1001176 - RNA, 20 nt, Mycobacterium avium subsp. paratuberculosis
ggcgucaucguggacaggag

SEQ ID NO: 1001177 - RNA, 22 nt, Mycobacterium avium subsp. paratuberculosis
ggcguccaguagccgccgggcg

SEQ ID NO: 1001178 - RNA, 20 nt, Mycobacterium avium subsp. paratuberculosis
ggcguccaguucggccagcg

SEQ ID NO: 1001179 - RNA, 13 nt, Mycobacterium avium subsp. paratuberculosis
ggcguccagcgcg

SEQ ID NO: 1001180 - RNA, 14 nt, Mycobacterium avium subsp. paratuberculosis
ggcguccagcugcg

SEQ ID NO: 1001181 - RNA, 20 nt, Mycobacterium avium subsp. paratuberculosis
ggcguccgcgaacgggugcg

SEQ ID NO: 1001182 - RNA, 14 nt, Mycobacterium avium subsp. paratuberculosis
ggcgucccagugcu

SEQ ID NO: 1001183 - RNA, 15 nt, Mycobacterium avium subsp. paratuberculosis
ggcgucaggcgcugg

SEQ ID NO: 1001184 - RNA, 20 nt, Mycobacterium avium subsp. paratuberculosis
ggcgucaggcgcugggugcg

SEQ ID NO: 1001185 - RNA, 23 nt, Mycobacterium avium subsp. paratuberculosis
ggcgucagggguuggcgcgcaga

SEQ ID NO: 1001186 - RNA, 14 nt, Mycobacterium avium subsp. paratuberculosis
ggcgucacucuggc

SEQ ID NO: 1001187 - RNA, 15 nt, Mycobacterium avium subsp. paratuberculosis
ggcgucacucuggcg

SEQ ID NO: 1001188 - RNA, 18 nt, Mycobacterium avium subsp. paratuberculosis
ggcgucacguccaucaug

SEQ ID NO: 1001189 - RNA, 22 nt, Mycobacterium avium subsp. paratuberculosis
ggcgucaccaggcugcucggcg

SEQ ID NO: 1001190 - RNA, 19 nt, Mycobacterium avium subsp. paratuberculosis
ggcgucaccgcgggugauc

SEQ ID NO: 1001191 - RNA, 18 nt, Mycobacterium avium subsp. paratuberculosis
ggcggucggugcgcagca

SEQ ID NO: 1001192 - RNA, 15 nt, Mycobacterium avium subsp. paratuberculosis
ggcggucgcgcgccg

SEQ ID NO: 1001193 - RNA, 19 nt, Mycobacterium avium subsp. paratuberculosis
ggcggucgcugaccccgcu

SEQ ID NO: 1001194 - RNA, 18 nt, Mycobacterium avium subsp. paratuberculosis
ggcggucgcugcagcggc

SEQ ID NO: 1001195 - RNA, 14 nt, Mycobacterium avium subsp. paratuberculosis
ggcggucggcggag

SEQ ID NO: 1001196 - RNA, 22 nt, Mycobacterium avium subsp. paratuberculosis
ggcgguauucgucaccccacca

SEQ ID NO: 1001197 - RNA, 14 nt, Mycobacterium avium subsp. paratuberculosis
ggcggucccgcaug

SEQ ID NO: 1001198 - RNA, 17 nt, Mycobacterium avium subsp. paratuberculosis
ggcggucgaacgcggcg

SEQ ID NO: 1001199 - RNA, 18 nt, Mycobacterium avium subsp. paratuberculosis
ggcggucgaacgcggcgc

SEQ ID NO: 1001200 - RNA, 22 nt, Mycobacterium avium subsp. paratuberculosis
ggcggucgacacgaucggcaug

SEQ ID NO: 1001201 - RNA, 14 nt, Mycobacterium avium subsp. paratuberculosis
ggcggucgccagcg

SEQ ID NO: 1001202 - RNA, 17 nt, Mycobacterium avium subsp. paratuberculosis
ggcggggugugcggcac

SEQ ID NO: 1001203 - RNA, 12 nt, Mycobacterium avium subsp. paratuberculosis
ggcgggucagca

SEQ ID NO: 1001204 - RNA, 14 nt, Mycobacterium avium subsp. paratuberculosis
ggcgggugagccgg

SEQ ID NO: 1001205 - RNA, 23 nt, Mycobacterium avium subsp. paratuberculosis
ggcgggugaggacgcccggcgag

SEQ ID NO: 1001206 - RNA, 20 nt, Mycobacterium avium subsp. paratuberculosis
ggcggguugcugagccgccg

SEQ ID NO: 1001207 - RNA, 17 nt, Mycobacterium avium subsp. paratuberculosis
ggcgggggaucggcggg

SEQ ID NO: 1001208 - RNA, 15 nt, Mycobacterium avium subsp. paratuberculosis
ggcgggggcggcggg

SEQ ID NO: 1001209 - RNA, 21 nt, Mycobacterium avium subsp. paratuberculosis
ggcggggggagaggcgcggcg

SEQ ID NO: 1001210 - RNA, 14 nt, Mycobacterium avium subsp. paratuberculosis
ggcggggucguugc

SEQ ID NO: 1001211 - RNA, 11 nt, Mycobacterium avium subsp. paratuberculosis
ggcggggucuc

SEQ ID NO: 1001212 - RNA, 13 nt, Mycobacterium avium subsp. paratuberculosis
ggcggggcagcag

SEQ ID NO: 1001213 - RNA, 18 nt, Mycobacterium avium subsp. paratuberculosis
ggcggggccggugauggu

SEQ ID NO: 1001214 - RNA, 22 nt, Mycobacterium avium subsp. paratuberculosis
ggcggggccuccaccagcggcg

SEQ ID NO: 1001215 - RNA, 20 nt, Mycobacterium avium subsp. paratuberculosis
ggcggggacgugucggggug

SEQ ID NO: 1001216 - RNA, 21 nt, Mycobacterium avium subsp. paratuberculosis
ggcgggacguggcucagcggc

SEQ ID NO: 1001217 - RNA, 23 nt, Mycobacterium avium subsp. paratuberculosis
ggcgggagcuaggcggccgggcg

SEQ ID NO: 1001218 - RNA, 16 nt, Mycobacterium avium subsp. paratuberculosis
ggcggcucggcggcgu

SEQ ID NO: 1001219 - RNA, 15 nt, Mycobacterium avium subsp. paratuberculosis
ggcggcucgggggug

SEQ ID NO: 1001220 - RNA, 17 nt, Mycobacterium avium subsp. paratuberculosis
ggcggcucggggguguc

SEQ ID NO: 1001221 - RNA, 17 nt, Mycobacterium avium subsp. paratuberculosis
ggcgggcgugccgaacg

SEQ ID NO: 1001222 - RNA, 23 nt, Mycobacterium avium subsp. paratuberculosis
ggcgggcgugcgaaugacgcgca

SEQ ID NO: 1001223 - RNA, 15 nt, Mycobacterium avium subsp. paratuberculosis
ggcgggcucgcgcug

SEQ ID NO: 1001224 - RNA, 16 nt, Mycobacterium avium subsp. paratuberculosis
ggcgggcucgcgcugg

SEQ ID NO: 1001225 - RNA, 14 nt, Mycobacterium avium subsp. paratuberculosis
ggcgggcggcggcu

SEQ ID NO: 1001226 - RNA, 18 nt, Mycobacterium avium subsp. paratuberculosis
ggcgggcgccggucggcg

SEQ ID NO: 1001227 - RNA, 12 nt, Mycobacterium avium subsp. paratuberculosis
ggcgggcgcgcc

SEQ ID NO: 1001228 - RNA, 16 nt, Mycobacterium avium subsp. paratuberculosis
ggcgggcgcgccggcg

SEQ ID NO: 1001229 - RNA, 23 nt, Mycobacterium avium subsp. paratuberculosis
ggcgggcgacuucuucgccggcg

SEQ ID NO: 1001230 - RNA, 14 nt, Mycobacterium avium subsp. paratuberculosis
ggcgggcgaagcga

SEQ ID NO: 1001231 - RNA, 14 nt, Mycobacterium avium subsp. paratuberculosis
ggcgggccgccggg

SEQ ID NO: 1001232 - RNA, 16 nt, Mycobacterium avium subsp. paratuberculosis
ggcgggcccgucgccg

SEQ ID NO: 1001233 - RNA, 14 nt, Mycobacterium avium subsp. paratuberculosis
ggcgggccgcagca

SEQ ID NO: 1001234 - RNA, 20 nt, Mycobacterium avium subsp. paratuberculosis
ggcgggccgccagguuggcg

SEQ ID NO: 1001235 - RNA, 23 nt, Mycobacterium avium subsp. paratuberculosis
ggcgggccgccagguuggcggcg

SEQ ID NO: 1001236 - RNA, 14 nt, Mycobacterium avium subsp. paratuberculosis
ggcgggccgcccgg

SEQ ID NO: 1001237 - RNA, 12 nt, Mycobacterium avium subsp. paratuberculosis
ggcgggccgccg

SEQ ID NO: 1001238 - RNA, 20 nt, Mycobacterium avium subsp. paratuberculosis
ggcgggcccggcgaugcgca

SEQ ID NO: 1001239 - RNA, 19 nt, Mycobacterium avium subsp. paratuberculosis
ggcgggcccgggcgcugag

SEQ ID NO: 1001240 - RNA, 11 nt, Mycobacterium avium subsp. paratuberculosis
ggcgggcaggu

SEQ ID NO: 1001241 - RNA, 15 nt, Mycobacterium avium subsp. paratuberculosis
ggcgggauggguggu

SEQ ID NO: 1001242 - RNA, 11 nt, Mycobacterium avium subsp. paratuberculosis
ggcgggcaccu

SEQ ID NO: 1001243 - RNA, 22 nt, Mycobacterium avium subsp. paratuberculosis
ggcgggcacgucgcgcgggguc

SEQ ID NO: 1001244 - RNA, 23 nt, Mycobacterium avium subsp. paratuberculosis
ggcgggcacgucgcgcggggucg

SEQ ID NO: 1001245 - RNA, 19 nt, Mycobacterium avium subsp. paratuberculosis
ggcgggcagcaccagcggc

SEQ ID NO: 1001246 - RNA, 13 nt, Mycobacterium avium subsp. paratuberculosis
ggcgcgggcggcg

SEQ ID NO: 1001247 - RNA, 18 nt, Mycobacterium avium subsp. paratuberculosis
ggcgcggcguagccgccg

SEQ ID NO: 1001248 - RNA, 18 nt, Mycobacterium avium subsp. paratuberculosis
ggcgcggagccggccgcc

SEQ ID NO: 1001249 - RNA, 19 nt, Mycobacterium avium subsp. paratuberculosis
ggcgcggagccggccgccg

SEQ ID NO: 1001250 - RNA, 12 nt, Mycobacterium avium subsp. paratuberculosis
ggcgcggccagc

SEQ ID NO: 1001251 - RNA, 13 nt, Mycobacterium avium subsp. paratuberculosis
ggcgcggccagcg

SEQ ID NO: 1001252 - RNA, 15 nt, Mycobacterium avium subsp. paratuberculosis
ggcgcggccagcgcg

SEQ ID NO: 1001253 - RNA, 22 nt, Mycobacterium avium subsp. paratuberculosis
ggcgcggccgcccagcccgcgc

SEQ ID NO: 1001254 - RNA, 14 nt, Mycobacterium avium subsp. paratuberculosis
ggcgcggcccaggg

SEQ ID NO: 1001255 - RNA, 18 nt, Mycobacterium avium subsp. paratuberculosis
ggcgcgugcacaccggcc

SEQ ID NO: 1001256 - RNA, 16 nt, Mycobacterium avium subsp. paratuberculosis
ggcgcgucguagccgg

SEQ ID NO: 1001257 - RNA, 18 nt, Mycobacterium avium subsp. paratuberculosis
ggcgcgucguagccggca

SEQ ID NO: 1001258 - RNA, 14 nt, Mycobacterium avium subsp. paratuberculosis
ggcgcgucgcuggg

SEQ ID NO: 1001259 - RNA, 21 nt, Mycobacterium avium subsp. paratuberculosis
ggcgcgucgcugggcagccgu

SEQ ID NO: 1001260 - RNA, 21 nt, Mycobacterium avium subsp. paratuberculosis
ggcgcguccgcgggcggggcc

SEQ ID NO: 1001261 - RNA, 20 nt, Mycobacterium avium subsp. paratuberculosis
ggcgcguccggaggugccgg

SEQ ID NO: 1001262 - RNA, 13 nt, Mycobacterium avium subsp. paratuberculosis
ggcgcgggcgucc

SEQ ID NO: 1001263 - RNA, 15 nt, Mycobacterium avium subsp. paratuberculosis
ggcgcggucgcaggc

SEQ ID NO: 1001264 - RNA, 16 nt, Mycobacterium avium subsp. paratuberculosis
ggcgcggucgguggcg

SEQ ID NO: 1001265 - RNA, 22 nt, Mycobacterium avium subsp. paratuberculosis
ggcgcgggggcggccugagccg

SEQ ID NO: 1001266 - RNA, 19 nt, Mycobacterium avium subsp. paratuberculosis
ggcgcgcaucgucgcggcg

SEQ ID NO: 1001267 - RNA, 19 nt, Mycobacterium avium subsp. paratuberculosis
ggcgcgcaucugcucggcg

SEQ ID NO: 1001268 - RNA, 23 nt, Mycobacterium avium subsp. paratuberculosis
ggcgcgcaucugcucggcgucca

SEQ ID NO: 1001269 - RNA, 21 nt, Mycobacterium avium subsp. paratuberculosis
ggcgcgccgcguucggcggcg

SEQ ID NO: 1001270 - RNA, 21 nt, Mycobacterium avium subsp. paratuberculosis
ggcgcgccgaagauggccagc

SEQ ID NO: 1001271 - RNA, 22 nt, Mycobacterium avium subsp. paratuberculosis
ggcgcgccgaagauggccagcg

SEQ ID NO: 1001272 - RNA, 18 nt, Mycobacterium avium subsp. paratuberculosis
ggcgcgccgagcgcuggu

SEQ ID NO: 1001273 - RNA, 20 nt, Mycobacterium avium subsp. paratuberculosis
ggcgcgcccggaaagcgcgg

SEQ ID NO: 1001274 - RNA, 21 nt, Mycobacterium avium subsp. paratuberculosis
ggcgcgcccggaaagcgcggg

SEQ ID NO: 1001275 - RNA, 16 nt, Mycobacterium avium subsp. paratuberculosis
ggcgcgcgccgcagcg

SEQ ID NO: 1001276 - RNA, 18 nt, Mycobacterium avium subsp. paratuberculosis
ggcgcgcgcgccccagcc

SEQ ID NO: 1001277 - RNA, 14 nt, Mycobacterium avium subsp. paratuberculosis
ggcgcgcaucgccg

SEQ ID NO: 1001278 - RNA, 17 nt, Mycobacterium avium subsp. paratuberculosis
ggcgcgccgucccagcc

SEQ ID NO: 1001279 - RNA, 14 nt, Mycobacterium avium subsp. paratuberculosis
ggcgcgccggccgg

SEQ ID NO: 1001280 - RNA, 19 nt, Mycobacterium avium subsp. paratuberculosis
ggcgcgccggcgcgcagcc

SEQ ID NO: 1001281 - RNA, 19 nt, Mycobacterium avium subsp. paratuberculosis
ggcgcgccgcaccucgccg

SEQ ID NO: 1001282 - RNA, 18 nt, Mycobacterium avium subsp. paratuberculosis
ggcgcggaccgcaccccc

SEQ ID NO: 1001283 - RNA, 17 nt, Mycobacterium avium subsp. paratuberculosis
ggcgcggaacgcgccgg

SEQ ID NO: 1001284 - RNA, 13 nt, Mycobacterium avium subsp. paratuberculosis
ggcgcgcucgucg

SEQ ID NO: 1001285 - RNA, 17 nt, Mycobacterium avium subsp. paratuberculosis
ggcgcgcguagcgcagc

SEQ ID NO: 1001286 - RNA, 22 nt, Mycobacterium avium subsp. paratuberculosis
ggcgcgcuaacggcgcggcagu

SEQ ID NO: 1001287 - RNA, 13 nt, Mycobacterium avium subsp. paratuberculosis
ggcgcgcggggcc

SEQ ID NO: 1001288 - RNA, 14 nt, Mycobacterium avium subsp. paratuberculosis
ggcgcgcggggccg

SEQ ID NO: 1001289 - RNA, 13 nt, Mycobacterium avium subsp. paratuberculosis
ggcgcgcggggug

SEQ ID NO: 1001290 - RNA, 21 nt, Mycobacterium avium subsp. paratuberculosis
ggcgcgcggagaucaccccug

SEQ ID NO: 1001291 - RNA, 14 nt, Mycobacterium avium subsp. paratuberculosis
ggcgcgcggccagc

SEQ ID NO: 1001292 - RNA, 17 nt, Mycobacterium avium subsp. paratuberculosis
ggcgcuugaccucgccg

SEQ ID NO: 1001293 - RNA, 23 nt, Mycobacterium avium subsp. paratuberculosis
ggcgcuugaccucgccgagcagc

SEQ ID NO: 1001294 - RNA, 21 nt, Mycobacterium avium subsp. paratuberculosis
ggcgcuugacgaacgccacca

SEQ ID NO: 1001295 - RNA, 15 nt, Mycobacterium avium subsp. paratuberculosis
ggcgcugucggcggg

SEQ ID NO: 1001296 - RNA, 21 nt, Mycobacterium avium subsp. paratuberculosis
ggcgcuuuccaccucgagcaa

SEQ ID NO: 1001297 - RNA, 17 nt, Mycobacterium avium subsp. paratuberculosis
ggcggaacccggguggc

SEQ ID NO: 1001298 - RNA, 22 nt, Mycobacterium avium subsp. paratuberculosis
ggcggaaccgggccgcuggccg

SEQ ID NO: 1001299 - RNA, 18 nt, Mycobacterium avium subsp. paratuberculosis
ggcggaacggucggggcg

SEQ ID NO: 1001300 - RNA, 14 nt, Mycobacterium avium subsp. paratuberculosis
ggcgcuggccagcg

SEQ ID NO: 1001301 - RNA, 15 nt, Mycobacterium avium subsp. paratuberculosis
ggcgcugggugcggg

SEQ ID NO: 1001302 - RNA, 15 nt, Mycobacterium avium subsp. paratuberculosis
ggcgcugguccucgg

SEQ ID NO: 1001303 - RNA, 15 nt, Mycobacterium avium subsp. paratuberculosis
ggcgcuggcgcgccg

SEQ ID NO: 1001304 - RNA, 13 nt, Mycobacterium avium subsp. paratuberculosis
ggcgcugccgccg

SEQ ID NO: 1001305 - RNA, 17 nt, Mycobacterium avium subsp. paratuberculosis
ggcgcugcgcgguggcg

SEQ ID NO: 1001306 - RNA, 20 nt, Mycobacterium avium subsp. paratuberculosis
ggcgcugcgcuucgagcaga

SEQ ID NO: 1001307 - RNA, 17 nt, Mycobacterium avium subsp. paratuberculosis
ggcgcugccccagccac

SEQ ID NO: 1001308 - RNA, 11 nt, Mycobacterium avium subsp. paratuberculosis
ggcgcucgccg

SEQ ID NO: 1001309 - RNA, 15 nt, Mycobacterium avium subsp. paratuberculosis
ggcgcucgcgggugc

SEQ ID NO: 1001310 - RNA, 16 nt, Mycobacterium avium subsp. paratuberculosis
ggcgcucgcgggugcg

SEQ ID NO: 1001311 - RNA, 22 nt, Mycobacterium avium subsp. paratuberculosis
ggcgcgugcgccgcggcggcuc

SEQ ID NO: 1001312 - RNA, 16 nt, Mycobacterium avium subsp. paratuberculosis
ggcgcuaaagccgacc

SEQ ID NO: 1001313 - RNA, 21 nt, Mycobacterium avium subsp. paratuberculosis
ggcgcuacgccggcucggucu

SEQ ID NO: 1001314 - RNA, 23 nt, Mycobacterium avium subsp. paratuberculosis
ggcgcuacgccggcucggucucc

SEQ ID NO: 1001315 - RNA, 16 nt, Mycobacterium avium subsp. paratuberculosis
ggcgcuagcugcgccg

SEQ ID NO: 1001316 - RNA, 14 nt, Mycobacterium avium subsp. paratuberculosis
ggcgcucagcgcgg

SEQ ID NO: 1001317 - RNA, 12 nt, Mycobacterium avium subsp. paratuberculosis
ggcgcuccagcg

SEQ ID NO: 1001318 - RNA, 22 nt, Mycobacterium avium subsp. paratuberculosis
ggcggcgucgugaccgaccucc

SEQ ID NO: 1001319 - RNA, 22 nt, Mycobacterium avium subsp. paratuberculosis
ggcggcgucggcguagggcagc

SEQ ID NO: 1001320 - RNA, 21 nt, Mycobacterium avium subsp. paratuberculosis
ggcggcgucguaguugcggcc

SEQ ID NO: 1001321 - RNA, 16 nt, Mycobacterium avium subsp. paratuberculosis
ggcggcgucgucgccg

SEQ ID NO: 1001322 - RNA, 14 nt, Mycobacterium avium subsp. paratuberculosis
ggcggcgugccagg

SEQ ID NO: 1001323 - RNA, 19 nt, Mycobacterium avium subsp. paratuberculosis
ggcggcgucgagcaccucc

SEQ ID NO: 1001324 - RNA, 21 nt, Mycobacterium avium subsp. paratuberculosis
ggcggcguagucggcgcagcg

SEQ ID NO: 1001325 - RNA, 12 nt, Mycobacterium avium subsp. paratuberculosis
ggcggcgguguc

SEQ ID NO: 1001326 - RNA, 16 nt, Mycobacterium avium subsp. paratuberculosis
ggcggcgguggccugg

SEQ ID NO: 1001327 - RNA, 13 nt, Mycobacterium avium subsp. paratuberculosis
ggcggcggugagc

SEQ ID NO: 1001328 - RNA, 22 nt, Mycobacterium avium subsp. paratuberculosis
ggcggcggugaucucgucggcg

SEQ ID NO: 1001329 - RNA, 13 nt, Mycobacterium avium subsp. paratuberculosis
ggcggcgggcucg

SEQ ID NO: 1001330 - RNA, 13 nt, Mycobacterium avium subsp. paratuberculosis
ggcggcggcugcc

SEQ ID NO: 1001331 - RNA, 15 nt, Mycobacterium avium subsp. paratuberculosis
ggcggcgggccagcu

SEQ ID NO: 1001332 - RNA, 21 nt, Mycobacterium avium subsp. paratuberculosis
ggcggcgggccagggcgagga

SEQ ID NO: 1001333 - RNA, 14 nt, Mycobacterium avium subsp. paratuberculosis
ggcggcgggggcga

SEQ ID NO: 1001334 - RNA, 16 nt, Mycobacterium avium subsp. paratuberculosis
ggcggcgggggcgaga

SEQ ID NO: 1001335 - RNA, 15 nt, Mycobacterium avium subsp. paratuberculosis
ggcggcgcgguugcg

SEQ ID NO: 1001336 - RNA, 12 nt, Mycobacterium avium subsp. paratuberculosis
ggcggcgcggcg

SEQ ID NO: 1001337 - RNA, 14 nt, Mycobacterium avium subsp. paratuberculosis
ggcggcgcgcugcg

SEQ ID NO: 1001338 - RNA, 13 nt, Mycobacterium avium subsp. paratuberculosis
ggcggcgcggccc

SEQ ID NO: 1001339 - RNA, 12 nt, Mycobacterium avium subsp. paratuberculosis
ggcggcgcgcug

SEQ ID NO: 1001340 - RNA, 19 nt, Mycobacterium avium subsp. paratuberculosis
ggcggcgcgcugcaggccc

SEQ ID NO: 1001341 - RNA, 21 nt, Mycobacterium avium subsp. paratuberculosis
ggcggcgcgccggccggagcg

SEQ ID NO: 1001342 - RNA, 14 nt, Mycobacterium avium subsp. paratuberculosis
ggcggcgcgcgcca

SEQ ID NO: 1001343 - RNA, 17 nt, Mycobacterium avium subsp. paratuberculosis
ggcggcgcgcgccagcg

SEQ ID NO: 1001344 - RNA, 17 nt, Mycobacterium avium subsp. paratuberculosis
ggcggcggcccguccgc

SEQ ID NO: 1001345 - RNA, 12 nt, Mycobacterium avium subsp. paratuberculosis
ggcggcggccug

SEQ ID NO: 1001346 - RNA, 12 nt, Mycobacterium avium subsp. paratuberculosis
ggcggcggccuu

SEQ ID NO: 1001347 - RNA, 15 nt, Mycobacterium avium subsp. paratuberculosis
ggcggcggcgcgccg

SEQ ID NO: 1001348 - RNA, 14 nt, Mycobacterium avium subsp. paratuberculosis
ggcggcggcgggaa

SEQ ID NO: 1001349 - RNA, 18 nt, Mycobacterium avium subsp. paratuberculosis
ggcggcgacgugccggcg

SEQ ID NO: 1001350 - RNA, 16 nt, Mycobacterium avium subsp. paratuberculosis
ggcggcgacggcaccg

SEQ ID NO: 1001351 - RNA, 22 nt, Mycobacterium avium subsp. paratuberculosis
ggcggcgaccuguuuggccagc

SEQ ID NO: 1001352 - RNA, 17 nt, Mycobacterium avium subsp. paratuberculosis
ggcggccggcggcagug

SEQ ID NO: 1001353 - RNA, 21 nt, Mycobacterium avium subsp. paratuberculosis
ggcggcgaagccggccccgcc

SEQ ID NO: 1001354 - RNA, 23 nt, Mycobacterium avium subsp. paratuberculosis
ggcggcgaccaaugcccugaccc

SEQ ID NO: 1001355 - RNA, 22 nt, Mycobacterium avium subsp. paratuberculosis
ggcggcgccgucgaccagcuug

SEQ ID NO: 1001356 - RNA, 15 nt, Mycobacterium avium subsp. paratuberculosis
ggcggcgccgucguc

SEQ ID NO: 1001357 - RNA, 12 nt, Mycobacterium avium subsp. paratuberculosis
ggcggcgcaggc

SEQ ID NO: 1001358 - RNA, 16 nt, Mycobacterium avium subsp. paratuberculosis
ggcggcgaugaucggg

SEQ ID NO: 1001359 - RNA, 14 nt, Mycobacterium avium subsp. paratuberculosis
ggcggcgcccagga

SEQ ID NO: 1001360 - RNA, 16 nt, Mycobacterium avium subsp. paratuberculosis
ggcggcgccgcggccc

SEQ ID NO: 1001361 - RNA, 18 nt, Mycobacterium avium subsp. paratuberculosis
ggcggcgccgcggcccug

SEQ ID NO: 1001362 - RNA, 16 nt, Mycobacterium avium subsp. paratuberculosis
ggcggcgcagccagcg

SEQ ID NO: 1001363 - RNA, 22 nt, Mycobacterium avium subsp. paratuberculosis
ggcggcgauccggccggcggcg

SEQ ID NO: 1001364 - RNA, 14 nt, Mycobacterium avium subsp. paratuberculosis
ggcggccugcagga

SEQ ID NO: 1001365 - RNA, 13 nt, Mycobacterium avium subsp. paratuberculosis
ggcggccucgccg

SEQ ID NO: 1001366 - RNA, 23 nt, Mycobacterium avium subsp. paratuberculosis
ggcggccggguguagcugggccc

SEQ ID NO: 1001367 - RNA, 16 nt, Mycobacterium avium subsp. paratuberculosis
ggcggccugcggcggc

SEQ ID NO: 1001368 - RNA, 15 nt, Mycobacterium avium subsp. paratuberculosis
ggcggccugcuccag

SEQ ID NO: 1001369 - RNA, 23 nt, Mycobacterium avium subsp. paratuberculosis
ggcggccugcuccagcgagucga

SEQ ID NO: 1001370 - RNA, 16 nt, Mycobacterium avium subsp. paratuberculosis
ggcggccugcucgcag

SEQ ID NO: 1001371 - RNA, 13 nt, Mycobacterium avium subsp. paratuberculosis
ggcggccgggggg

SEQ ID NO: 1001372 - RNA, 12 nt, Mycobacterium avium subsp. paratuberculosis
ggcggccgggau

SEQ ID NO: 1001373 - RNA, 15 nt, Mycobacterium avium subsp. paratuberculosis
ggcggccgggcggcc

SEQ ID NO: 1001374 - RNA, 15 nt, Mycobacterium avium subsp. paratuberculosis
ggcggccggccagca

SEQ ID NO: 1001375 - RNA, 14 nt, Mycobacterium avium subsp. paratuberculosis
ggcggccggccagu

SEQ ID NO: 1001376 - RNA, 13 nt, Mycobacterium avium subsp. paratuberculosis
ggcggccggcccc

SEQ ID NO: 1001377 - RNA, 16 nt, Mycobacterium avium subsp. paratuberculosis
ggcggccggccgcgcg

SEQ ID NO: 1001378 - RNA, 22 nt, Mycobacterium avium subsp. paratuberculosis
ggcggccgcgacggaccagugc

SEQ ID NO: 1001379 - RNA, 13 nt, Mycobacterium avium subsp. paratuberculosis
ggcggccgcgagc

SEQ ID NO: 1001380 - RNA, 16 nt, Mycobacterium avium subsp. paratuberculosis
ggcggccgcgucgccg

SEQ ID NO: 1001381 - RNA, 13 nt, Mycobacterium avium subsp. paratuberculosis
ggcggccgcccgg

SEQ ID NO: 1001382 - RNA, 14 nt, Mycobacterium avium subsp. paratuberculosis
ggcggccgccgccc

SEQ ID NO: 1001383 - RNA, 18 nt, Mycobacterium avium subsp. paratuberculosis
ggcggccgccgcccgcgc

SEQ ID NO: 1001384 - RNA, 22 nt, Mycobacterium avium subsp. paratuberculosis
ggcggccgccgcccgcgcggcg

SEQ ID NO: 1001385 - RNA, 16 nt, Mycobacterium avium subsp. paratuberculosis
ggcggauggcgcccuu

SEQ ID NO: 1001386 - RNA, 22 nt, Mycobacterium avium subsp. paratuberculosis
ggcggaucuucucgcugcucug

SEQ ID NO: 1001387 - RNA, 20 nt, Mycobacterium avium subsp. paratuberculosis
ggcggauuggugccgaucac

SEQ ID NO: 1001388 - RNA, 19 nt, Mycobacterium avium subsp. paratuberculosis
ggcggcaaaacgcugggcg

SEQ ID NO: 1001389 - RNA, 20 nt, Mycobacterium avium subsp. paratuberculosis
ggcggacuggcugagcagca

SEQ ID NO: 1001390 - RNA, 17 nt, Mycobacterium avium subsp. paratuberculosis
ggcggaggucagcggcc

SEQ ID NO: 1001391 - RNA, 18 nt, Mycobacterium avium subsp. paratuberculosis
ggcggaggucagcggccc

SEQ ID NO: 1001392 - RNA, 24 nt, Mycobacterium avium subsp. paratuberculosis
ggcggauccagguggggcacgggc

SEQ ID NO: 1001393 - RNA, 17 nt, Mycobacterium avium subsp. paratuberculosis
ggcggauccccgcgcug

SEQ ID NO: 1001394 - RNA, 19 nt, Mycobacterium avium subsp. paratuberculosis
ggcggauccccgcgcuggg

SEQ ID NO: 1001395 - RNA, 16 nt, Mycobacterium avium subsp. paratuberculosis
ggcggacccagcuccu

SEQ ID NO: 1001396 - RNA, 17 nt, Mycobacterium avium subsp. paratuberculosis
ggcggacccagcuccuc

SEQ ID NO: 1001397 - RNA, 20 nt, Mycobacterium avium subsp. paratuberculosis
ggcggacccagcuccucggc

SEQ ID NO: 1001398 - RNA, 16 nt, Mycobacterium avium subsp. paratuberculosis
ggcggacccgcucccg

SEQ ID NO: 1001399 - RNA, 17 nt, Mycobacterium avium subsp. paratuberculosis
ggcggacgcggccagcg

SEQ ID NO: 1001400 - RNA, 22 nt, Mycobacterium avium subsp. paratuberculosis
ggcggacgcggccagcgcccgc

SEQ ID NO: 1001401 - RNA, 23 nt, Mycobacterium avium subsp. paratuberculosis
ggcggacucguuggggccaccag

SEQ ID NO: 1001402 - RNA, 20 nt, Mycobacterium avium subsp. paratuberculosis
ggcggcagguggggcagcac

SEQ ID NO: 1001403 - RNA, 16 nt, Mycobacterium avium subsp. paratuberculosis
ggcggcagggccagca

SEQ ID NO: 1001404 - RNA, 16 nt, Mycobacterium avium subsp. paratuberculosis
ggcggcacgguuggcc

SEQ ID NO: 1001405 - RNA, 17 nt, Mycobacterium avium subsp. paratuberculosis
ggcggcaccgccgcggu

SEQ ID NO: 1001406 - RNA, 20 nt, Mycobacterium avium subsp. paratuberculosis
ggcggcaccgccgcgguggg

SEQ ID NO: 1001407 - RNA, 16 nt, Mycobacterium avium subsp. paratuberculosis
ggcggcaccgcugccg

SEQ ID NO: 1001408 - RNA, 16 nt, Mycobacterium avium subsp. paratuberculosis
ggcggcagcagcugcg

SEQ ID NO: 1001409 - RNA, 19 nt, Mycobacterium avium subsp. paratuberculosis
ggcggcauccccagcuggg

SEQ ID NO: 1001410 - RNA, 19 nt, Mycobacterium avium subsp. paratuberculosis
ggcggcaucgcgccgcaug

SEQ ID NO: 1001411 - RNA, 14 nt, Mycobacterium avium subsp. paratuberculosis
ggcggccaccagcc

SEQ ID NO: 1001412 - RNA, 22 nt, Mycobacterium avium subsp. paratuberculosis
ggcggccaccaucuccgcggcg

SEQ ID NO: 1001413 - RNA, 22 nt, Mycobacterium avium subsp. paratuberculosis
ggcggccaccgcgccgugggcg

SEQ ID NO: 1001414 - RNA, 19 nt, Mycobacterium avium subsp. paratuberculosis
ggcggccaccgcggccagc

SEQ ID NO: 1001415 - RNA, 21 nt, Mycobacterium avium subsp. paratuberculosis
ggcggccaccgcggccagcug

SEQ ID NO: 1001416 - RNA, 16 nt, Mycobacterium avium subsp. paratuberculosis
ggcggccacgacggcg

SEQ ID NO: 1001417 - RNA, 17 nt, Mycobacterium avium subsp. paratuberculosis
ggcggccacgacggcgc

SEQ ID NO: 1001418 - RNA, 18 nt, Mycobacterium avium subsp. paratuberculosis
ggcggccacgacggcgcu

SEQ ID NO: 1001419 - RNA, 11 nt, Mycobacterium avium subsp. paratuberculosis
ggcggccagca

SEQ ID NO: 1001420 - RNA, 14 nt, Mycobacterium avium subsp. paratuberculosis
ggcggccgccagcg

SEQ ID NO: 1001421 - RNA, 17 nt, Mycobacterium avium subsp. paratuberculosis
ggcggccgccacgcugg

SEQ ID NO: 1001422 - RNA, 20 nt, Mycobacterium avium subsp. paratuberculosis
ggcggccgccacgcuggugu

SEQ ID NO: 1001423 - RNA, 15 nt, Mycobacterium avium subsp. paratuberculosis
ggcggcccgcuugcc

SEQ ID NO: 1001424 - RNA, 20 nt, Mycobacterium avium subsp. paratuberculosis
ggcggcccguccgccccgcu

SEQ ID NO: 1001425 - RNA, 19 nt, Mycobacterium avium subsp. paratuberculosis
ggcggccccgguagccagc

SEQ ID NO: 1001426 - RNA, 22 nt, Mycobacterium avium subsp. paratuberculosis
ggcggccccuucgaugucgccg

SEQ ID NO: 1001427 - RNA, 17 nt, Mycobacterium avium subsp. paratuberculosis
ggcggcccgccgcgccc

SEQ ID NO: 1001428 - RNA, 21 nt, Mycobacterium avium subsp. paratuberculosis
ggcggcccgcgccggcguguc

SEQ ID NO: 1001429 - RNA, 18 nt, Mycobacterium avium subsp. paratuberculosis
ggcggcccgcgcgggguc

SEQ ID NO: 1001430 - RNA, 19 nt, Mycobacterium avium subsp. paratuberculosis
ggcggccaugucggagcug

SEQ ID NO: 1001431 - RNA, 20 nt, Mycobacterium avium subsp. paratuberculosis
ggcggccaguucgagcgccg

SEQ ID NO: 1001432 - RNA, 18 nt, Mycobacterium avium subsp. paratuberculosis
ggcggccaucgccgcggu

SEQ ID NO: 1001433 - RNA, 22 nt, Mycobacterium avium subsp. paratuberculosis
ggcggccaucgccgcgguggcg

SEQ ID NO: 1001434 - RNA, 20 nt, Mycobacterium avium subsp. paratuberculosis
ggcggccaucucgugcccgg

SEQ ID NO: 1001435 - RNA, 15 nt, Mycobacterium avium subsp. paratuberculosis
ggcggccaggguguc

SEQ ID NO: 1001436 - RNA, 20 nt, Mycobacterium avium subsp. paratuberculosis
ggcggccagcgaggacccgu

SEQ ID NO: 1001437 - RNA, 13 nt, Mycobacterium avium subsp. paratuberculosis
ggcggccagcgcc

SEQ ID NO: 1001438 - RNA, 14 nt, Mycobacterium avium subsp. paratuberculosis
ggcggccagcuccc

SEQ ID NO: 1001439 - RNA, 22 nt, Mycobacterium avium subsp. paratuberculosis
ggcggccagcucccgggcggcg

SEQ ID NO: 1001440 - RNA, 20 nt, Mycobacterium avium subsp. paratuberculosis
ggcggccagccgcgcggcgu

SEQ ID NO: 1001441 - RNA, 14 nt, Mycobacterium avium subsp. paratuberculosis
ggcaguuccucgcc

SEQ ID NO: 1001442 - RNA, 15 nt, Mycobacterium avium subsp. paratuberculosis
ggcaguuccucgccg

SEQ ID NO: 1001443 - RNA, 17 nt, Mycobacterium avium subsp. paratuberculosis
ggcaguucgaugccggg

SEQ ID NO: 1001444 - RNA, 14 nt, Mycobacterium avium subsp. paratuberculosis
ggcagugcgcggcg

SEQ ID NO: 1001445 - RNA, 19 nt, Mycobacterium avium subsp. paratuberculosis
ggcaucaucggcacgccgg

SEQ ID NO: 1001446 - RNA, 21 nt, Mycobacterium avium subsp. paratuberculosis
ggcaucccuuccugggacagc

SEQ ID NO: 1001447 - RNA, 17 nt, Mycobacterium avium subsp. paratuberculosis
ggcaucccgcgccugcc

SEQ ID NO: 1001448 - RNA, 16 nt, Mycobacterium avium subsp. paratuberculosis
ggcaucccggagaaca

SEQ ID NO: 1001449 - RNA, 22 nt, Mycobacterium avium subsp. paratuberculosis
ggcacuucgaucaucuccaccc

SEQ ID NO: 1001450 - RNA, 13 nt, Mycobacterium avium subsp. paratuberculosis
ggcagggccagca

SEQ ID NO: 1001451 - RNA, 21 nt, Mycobacterium avium subsp. paratuberculosis
ggcagaagcuccacgccgccg

SEQ ID NO: 1001452 - RNA, 19 nt, Mycobacterium avium subsp. paratuberculosis
ggcagggucgcggagcggg

SEQ ID NO: 1001453 - RNA, 20 nt, Mycobacterium avium subsp. paratuberculosis
ggcaggugaaggugccccac

SEQ ID NO: 1001454 - RNA, 16 nt, Mycobacterium avium subsp. paratuberculosis
ggcaggucggccagcg

SEQ ID NO: 1001455 - RNA, 17 nt, Mycobacterium avium subsp. paratuberculosis
ggcaggucgggcucgcg

SEQ ID NO: 1001456 - RNA, 21 nt, Mycobacterium avium subsp. paratuberculosis
ggcaggucgaggccggccagc

SEQ ID NO: 1001457 - RNA, 18 nt, Mycobacterium avium subsp. paratuberculosis
ggcaggucgcgccggagc

SEQ ID NO: 1001458 - RNA, 22 nt, Mycobacterium avium subsp. paratuberculosis
ggcagguggauugucggccgcc

SEQ ID NO: 1001459 - RNA, 15 nt, Mycobacterium avium subsp. paratuberculosis
ggcagguugcgcugg

SEQ ID NO: 1001460 - RNA, 22 nt, Mycobacterium avium subsp. paratuberculosis
ggcaggguuuucacgucgagcg

SEQ ID NO: 1001461 - RNA, 21 nt, Mycobacterium avium subsp. paratuberculosis
ggcagggugaccgaggccgcc

SEQ ID NO: 1001462 - RNA, 22 nt, Mycobacterium avium subsp. paratuberculosis
ggcagggugaccgaggccgccc

SEQ ID NO: 1001463 - RNA, 12 nt, Mycobacterium avium subsp. paratuberculosis
ggcagggccagg

SEQ ID NO: 1001464 - RNA, 14 nt, Mycobacterium avium subsp. paratuberculosis
ggcauuccagugcu

SEQ ID NO: 1001465 - RNA, 19 nt, Mycobacterium avium subsp. paratuberculosis
ggcaugaaccaggccgcgc

SEQ ID NO: 1001466 - RNA, 13 nt, Mycobacterium avium subsp. paratuberculosis
ggcauccgcccgu

SEQ ID NO: 1001467 - RNA, 18 nt, Mycobacterium avium subsp. paratuberculosis
ggcauccgggaggccagc

SEQ ID NO: 1001468 - RNA, 19 nt, Mycobacterium avium subsp. paratuberculosis
ggcauccgggaggccagca

SEQ ID NO: 1001469 - RNA, 19 nt, Mycobacterium avium subsp. paratuberculosis
ggcauccugcuggccgggc

SEQ ID NO: 1001470 - RNA, 20 nt, Mycobacterium avium subsp. paratuberculosis
ggccaacagugcgcaggcgg

SEQ ID NO: 1001471 - RNA, 14 nt, Mycobacterium avium subsp. paratuberculosis
ggccaagacacgcu

SEQ ID NO: 1001472 - RNA, 16 nt, Mycobacterium avium subsp. paratuberculosis
ggccaaggccagcaac

SEQ ID NO: 1001473 - RNA, 13 nt, Mycobacterium avium subsp. paratuberculosis
ggccaagugcggu

SEQ ID NO: 1001474 - RNA, 19 nt, Mycobacterium avium subsp. paratuberculosis
ggccaacgguucggccgcu

SEQ ID NO: 1001475 - RNA, 21 nt, Mycobacterium avium subsp. paratuberculosis
ggccaacugcaucgccagcac

SEQ ID NO: 1001476 - RNA, 16 nt, Mycobacterium avium subsp. paratuberculosis
ggccaacuccggcggc

SEQ ID NO: 1001477 - RNA, 17 nt, Mycobacterium avium subsp. paratuberculosis
ggccaacuccggcggca

SEQ ID NO: 1001478 - RNA, 20 nt, Mycobacterium avium subsp. paratuberculosis
ggccaacugggugggugcgg

SEQ ID NO: 1001479 - RNA, 17 nt, Mycobacterium avium subsp. paratuberculosis
ggccaacgagcgcgccg

SEQ ID NO: 1001480 - RNA, 18 nt, Mycobacterium avium subsp. paratuberculosis
ggccaacgagcgcgccga

SEQ ID NO: 1001481 - RNA, 23 nt, Mycobacterium avium subsp. paratuberculosis
ggccaacgagcgcgccgaggugg

SEQ ID NO: 1001482 - RNA, 18 nt, Mycobacterium avium subsp. paratuberculosis
ggccaaccgcccggcgcc

SEQ ID NO: 1001483 - RNA, 18 nt, Mycobacterium avium subsp. paratuberculosis
ggccacgucgaagcccgg

SEQ ID NO: 1001484 - RNA, 16 nt, Mycobacterium avium subsp. paratuberculosis
ggccacguugccgggu

SEQ ID NO: 1001485 - RNA, 17 nt, Mycobacterium avium subsp. paratuberculosis
ggccacguaguccgacg

SEQ ID NO: 1001486 - RNA, 16 nt, Mycobacterium avium subsp. paratuberculosis
ggccacucgcgucccc

SEQ ID NO: 1001487 - RNA, 21 nt, Mycobacterium avium subsp. paratuberculosis
ggccacgaugaucgucggcag

SEQ ID NO: 1001488 - RNA, 15 nt, Mycobacterium avium subsp. paratuberculosis
ggccacugccccggc

SEQ ID NO: 1001489 - RNA, 15 nt, Mycobacterium avium subsp. paratuberculosis
ggccagcacggcggc

SEQ ID NO: 1001490 - RNA, 20 nt, Mycobacterium avium subsp. paratuberculosis
ggccagcacggucagcggcc

SEQ ID NO: 1001491 - RNA, 21 nt, Mycobacterium avium subsp. paratuberculosis
ggccagcagauacuccucgcg

SEQ ID NO: 1001492 - RNA, 18 nt, Mycobacterium avium subsp. paratuberculosis
ggccagacugcgcaccgc

SEQ ID NO: 1001493 - RNA, 21 nt, Mycobacterium avium subsp. paratuberculosis
ggccagcaccgucagccaggu

SEQ ID NO: 1001494 - RNA, 22 nt, Mycobacterium avium subsp. paratuberculosis
ggccagcacgaccccgcccacg

SEQ ID NO: 1001495 - RNA, 17 nt, Mycobacterium avium subsp. paratuberculosis
ggccagcacgcaggcgu

SEQ ID NO: 1001496 - RNA, 17 nt, Mycobacterium avium subsp. paratuberculosis
ggccagcacgcccccgc

SEQ ID NO: 1001497 - RNA, 19 nt, Mycobacterium avium subsp. paratuberculosis
ggccagccgaugcgcccgc

SEQ ID NO: 1001498 - RNA, 12 nt, Mycobacterium avium subsp. paratuberculosis
ggccagccgcgc

SEQ ID NO: 1001499 - RNA, 15 nt, Mycobacterium avium subsp. paratuberculosis
ggccagccgcgcggc

SEQ ID NO: 1001500 - RNA, 22 nt, Mycobacterium avium subsp. paratuberculosis
ggccagccgcgcggcgucggcc

SEQ ID NO: 1001501 - RNA, 14 nt, Mycobacterium avium subsp. paratuberculosis
ggccagcgaauggc

SEQ ID NO: 1001502 - RNA, 15 nt, Mycobacterium avium subsp. paratuberculosis
ggccagccgcucccg

SEQ ID NO: 1001503 - RNA, 16 nt, Mycobacterium avium subsp. paratuberculosis
ggccagccgggcggcc

SEQ ID NO: 1001504 - RNA, 21 nt, Mycobacterium avium subsp. paratuberculosis
ggccagccgggguagggcggc

SEQ ID NO: 1001505 - RNA, 14 nt, Mycobacterium avium subsp. paratuberculosis
ggccagcagcgcgu

SEQ ID NO: 1001506 - RNA, 20 nt, Mycobacterium avium subsp. paratuberculosis
ggccagcagcgcgucgcggg

SEQ ID NO: 1001507 - RNA, 16 nt, Mycobacterium avium subsp. paratuberculosis
ggccagcagcgucguc

SEQ ID NO: 1001508 - RNA, 16 nt, Mycobacterium avium subsp. paratuberculosis
ggccagcagccgcgcg

SEQ ID NO: 1001509 - RNA, 20 nt, Mycobacterium avium subsp. paratuberculosis
ggccagcagccgcgcgagca

SEQ ID NO: 1001510 - RNA, 23 nt, Mycobacterium avium subsp. paratuberculosis
ggccagcagcagcaggucgucga

SEQ ID NO: 1001511 - RNA, 19 nt, Mycobacterium avium subsp. paratuberculosis
ggccagcagcagcccgccg

SEQ ID NO: 1001512 - RNA, 13 nt, Mycobacterium avium subsp. paratuberculosis
ggccagcagcagg

SEQ ID NO: 1001513 - RNA, 11 nt, Mycobacterium avium subsp. paratuberculosis
ggccagcagcc

SEQ ID NO: 1001514 - RNA, 16 nt, Mycobacterium avium subsp. paratuberculosis
ggccagcagccagcug

SEQ ID NO: 1001515 - RNA, 17 nt, Mycobacterium avium subsp. paratuberculosis
ggccagcagccagcugg

SEQ ID NO: 1001516 - RNA, 22 nt, Mycobacterium avium subsp. paratuberculosis
ggccagcagcccggguccuggc

SEQ ID NO: 1001517 - RNA, 15 nt, Mycobacterium avium subsp. paratuberculosis
ggccagcagccgcga

SEQ ID NO: 1001518 - RNA, 19 nt, Mycobacterium avium subsp. paratuberculosis
ggccacaccggggccaggu

SEQ ID NO: 1001519 - RNA, 21 nt, Mycobacterium avium subsp. paratuberculosis
ggccacaacgucucugucguc

SEQ ID NO: 1001520 - RNA, 20 nt, Mycobacterium avium subsp. paratuberculosis
ggccaauuacgcugcggcgc

SEQ ID NO: 1001521 - RNA, 21 nt, Mycobacterium avium subsp. paratuberculosis
ggccaauuacgcugcggcgcc

SEQ ID NO: 1001522 - RNA, 22 nt, Mycobacterium avium subsp. paratuberculosis
ggccaaucccaccaugagcaga

SEQ ID NO: 1001523 - RNA, 19 nt, Mycobacterium avium subsp. paratuberculosis
ggccaccaacggcagcagc

SEQ ID NO: 1001524 - RNA, 23 nt, Mycobacterium avium subsp. paratuberculosis
ggccaccaccacggccaugcaga

SEQ ID NO: 1001525 - RNA, 19 nt, Mycobacterium avium subsp. paratuberculosis
ggccaccaccacggccgcc

SEQ ID NO: 1001526 - RNA, 23 nt, Mycobacterium avium subsp. paratuberculosis
ggccaccgucagcgucagcacgu

SEQ ID NO: 1001527 - RNA, 22 nt, Mycobacterium avium subsp. paratuberculosis
ggccaccgucccggugucgccg

SEQ ID NO: 1001528 - RNA, 23 nt, Mycobacterium avium subsp. paratuberculosis
ggccaccgucccggugucgccgu

SEQ ID NO: 1001529 - RNA, 18 nt, Mycobacterium avium subsp. paratuberculosis
ggccaccucgccgcaggc

SEQ ID NO: 1001530 - RNA, 12 nt, Mycobacterium avium subsp. paratuberculosis
ggccaccucguc

SEQ ID NO: 1001531 - RNA, 14 nt, Mycobacterium avium subsp. paratuberculosis
ggccaccucguccc

SEQ ID NO: 1001532 - RNA, 22 nt, Mycobacterium avium subsp. paratuberculosis
ggccacgauccggggcagcagc

SEQ ID NO: 1001533 - RNA, 20 nt, Mycobacterium avium subsp. paratuberculosis
ggccacgaucgcgaucgccg

SEQ ID NO: 1001534 - RNA, 19 nt, Mycobacterium avium subsp. paratuberculosis
ggccacgcaggcguccagg

SEQ ID NO: 1001535 - RNA, 19 nt, Mycobacterium avium subsp. paratuberculosis
ggccacgaccucggggucg

SEQ ID NO: 1001536 - RNA, 20 nt, Mycobacterium avium subsp. paratuberculosis
ggccacgacggcgcuggccg

SEQ ID NO: 1001537 - RNA, 15 nt, Mycobacterium avium subsp. paratuberculosis
ggccaccugggcggg

SEQ ID NO: 1001538 - RNA, 19 nt, Mycobacterium avium subsp. paratuberculosis
ggccaccgucuucggggcc

SEQ ID NO: 1001539 - RNA, 23 nt, Mycobacterium avium subsp. paratuberculosis
ggccaccuuggacaggcccagcg

SEQ ID NO: 1001540 - RNA, 18 nt, Mycobacterium avium subsp. paratuberculosis
ggccaccuugucggcgcc

SEQ ID NO: 1001541 - RNA, 23 nt, Mycobacterium avium subsp. paratuberculosis
ggccaccuugucggcgcccagga

SEQ ID NO: 1001542 - RNA, 23 nt, Mycobacterium avium subsp. paratuberculosis
ggcccaaccgcauucggccgcca

SEQ ID NO: 1001543 - RNA, 22 nt, Mycobacterium avium subsp. paratuberculosis
ggcccaauaccguuccgccccu

SEQ ID NO: 1001544 - RNA, 16 nt, Mycobacterium avium subsp. paratuberculosis
ggccaugcagaccagc

SEQ ID NO: 1001545 - RNA, 22 nt, Mycobacterium avium subsp. paratuberculosis
ggccaugaacugguuccacacc

SEQ ID NO: 1001546 - RNA, 22 nt, Mycobacterium avium subsp. paratuberculosis
ggccaugaagccguugccgccg

SEQ ID NO: 1001547 - RNA, 15 nt, Mycobacterium avium subsp. paratuberculosis
ggccaucucggcggc

SEQ ID NO: 1001548 - RNA, 20 nt, Mycobacterium avium subsp. paratuberculosis
ggcccacccacucggacagg

SEQ ID NO: 1001549 - RNA, 21 nt, Mycobacterium avium subsp. paratuberculosis
ggcccacccacucggacaggu

SEQ ID NO: 1001550 - RNA, 18 nt, Mycobacterium avium subsp. paratuberculosis
ggcccaccgcgacccggc

SEQ ID NO: 1001551 - RNA, 16 nt, Mycobacterium avium subsp. paratuberculosis
ggcccaccgcgcgcug

SEQ ID NO: 1001552 - RNA, 16 nt, Mycobacterium avium subsp. paratuberculosis
ggcccaccggcccggc

SEQ ID NO: 1001553 - RNA, 23 nt, Mycobacterium avium subsp. paratuberculosis
ggcccacgaaccgguugcgggcc

SEQ ID NO: 1001554 - RNA, 14 nt, Mycobacterium avium subsp. paratuberculosis
ggcccaccaccgcc

SEQ ID NO: 1001555 - RNA, 20 nt, Mycobacterium avium subsp. paratuberculosis
ggccaguccugggccagauc

SEQ ID NO: 1001556 - RNA, 20 nt, Mycobacterium avium subsp. paratuberculosis
ggccaguccggcagcagcga

SEQ ID NO: 1001557 - RNA, 22 nt, Mycobacterium avium subsp. paratuberculosis
ggccaguccggcagcagcgagu

SEQ ID NO: 1001558 - RNA, 13 nt, Mycobacterium avium subsp. paratuberculosis
ggccaucgcggcc

SEQ ID NO: 1001559 - RNA, 22 nt, Mycobacterium avium subsp. paratuberculosis
ggccaucgcggcccccacgcag

SEQ ID NO: 1001560 - RNA, 15 nt, Mycobacterium avium subsp. paratuberculosis
ggccaucgcggguga

SEQ ID NO: 1001561 - RNA, 16 nt, Mycobacterium avium subsp. paratuberculosis
ggccagcucggcggcc

SEQ ID NO: 1001562 - RNA, 17 nt, Mycobacterium avium subsp. paratuberculosis
ggccauccgcugcgcgu

SEQ ID NO: 1001563 - RNA, 22 nt, Mycobacterium avium subsp. paratuberculosis
ggccauccccgcguuggccagc

SEQ ID NO: 1001564 - RNA, 14 nt, Mycobacterium avium subsp. paratuberculosis
ggccaucgccagga

SEQ ID NO: 1001565 - RNA, 17 nt, Mycobacterium avium subsp. paratuberculosis
ggccaucgacuccacca

SEQ ID NO: 1001566 - RNA, 16 nt, Mycobacterium avium subsp. paratuberculosis
ggccaucgacuccagc

SEQ ID NO: 1001567 - RNA, 17 nt, Mycobacterium avium subsp. paratuberculosis
ggccagguucaggcuga

SEQ ID NO: 1001568 - RNA, 17 nt, Mycobacterium avium subsp. paratuberculosis
ggccagguucgcgccga

SEQ ID NO: 1001569 - RNA, 19 nt, Mycobacterium avium subsp. paratuberculosis
ggccagguuggucagcagc

SEQ ID NO: 1001570 - RNA, 20 nt, Mycobacterium avium subsp. paratuberculosis
ggccagguugucgucgggca

SEQ ID NO: 1001571 - RNA, 23 nt, Mycobacterium avium subsp. paratuberculosis
ggccagguugucgucgggcacca

SEQ ID NO: 1001572 - RNA, 22 nt, Mycobacterium avium subsp. paratuberculosis
ggccaggugcacgccgagcagc

SEQ ID NO: 1001573 - RNA, 23 nt, Mycobacterium avium subsp. paratuberculosis
ggccaggugcacgccgagcagca

SEQ ID NO: 1001574 - RNA, 20 nt, Mycobacterium avium subsp. paratuberculosis
ggccagguggccgcuuucca

SEQ ID NO: 1001575 - RNA, 15 nt, Mycobacterium avium subsp. paratuberculosis
ggccagggcccgcag

SEQ ID NO: 1001576 - RNA, 16 nt, Mycobacterium avium subsp. paratuberculosis
ggccagggcccgcagc

SEQ ID NO: 1001577 - RNA, 18 nt, Mycobacterium avium subsp. paratuberculosis
ggccagggcccgcagccg

SEQ ID NO: 1001578 - RNA, 12 nt, Mycobacterium avium subsp. paratuberculosis
ggccaggcgggc

SEQ ID NO: 1001579 - RNA, 14 nt, Mycobacterium avium subsp. paratuberculosis
ggccaggcggguga

SEQ ID NO: 1001580 - RNA, 13 nt, Mycobacterium avium subsp. paratuberculosis
ggccaggccuccc

SEQ ID NO: 1001581 - RNA, 14 nt, Mycobacterium avium subsp. paratuberculosis
ggccaggcgcgcgc

SEQ ID NO: 1001582 - RNA, 14 nt, Mycobacterium avium subsp. paratuberculosis
ggccaggcgcgcgu

SEQ ID NO: 1001583 - RNA, 13 nt, Mycobacterium avium subsp. paratuberculosis
ggccaggccggcg

SEQ ID NO: 1001584 - RNA, 18 nt, Mycobacterium avium subsp. paratuberculosis
ggccaggcccugccagcg

SEQ ID NO: 1001585 - RNA, 19 nt, Mycobacterium avium subsp. paratuberculosis
ggccaggcccugccagcgc

SEQ ID NO: 1001586 - RNA, 14 nt, Mycobacterium avium subsp. paratuberculosis
ggccagcucccggg

SEQ ID NO: 1001587 - RNA, 19 nt, Mycobacterium avium subsp. paratuberculosis
ggccagcucccgggcggcg

SEQ ID NO: 1001588 - RNA, 21 nt, Mycobacterium avium subsp. paratuberculosis
ggccagcucccgggcggcgcc

SEQ ID NO: 1001589 - RNA, 13 nt, Mycobacterium avium subsp. paratuberculosis
ggccagcucgccg

SEQ ID NO: 1001590 - RNA, 14 nt, Mycobacterium avium subsp. paratuberculosis
ggccagcucggccc

SEQ ID NO: 1001591 - RNA, 13 nt, Mycobacterium avium subsp. paratuberculosis
ggccagcucaccg

SEQ ID NO: 1001592 - RNA, 18 nt, Mycobacterium avium subsp. paratuberculosis
ggccagcguuuccagcgc

SEQ ID NO: 1001593 - RNA, 22 nt, Mycobacterium avium subsp. paratuberculosis
ggccagcguuuccagcgccggc

SEQ ID NO: 1001594 - RNA, 12 nt, Mycobacterium avium subsp. paratuberculosis
ggccagcucccg

SEQ ID NO: 1001595 - RNA, 15 nt, Mycobacterium avium subsp. paratuberculosis
ggccagcgcccgcgc

SEQ ID NO: 1001596 - RNA, 19 nt, Mycobacterium avium subsp. paratuberculosis
ggccagcgcccgcgggugc

SEQ ID NO: 1001597 - RNA, 12 nt, Mycobacterium avium subsp. paratuberculosis
ggccagcgccga

SEQ ID NO: 1001598 - RNA, 15 nt, Mycobacterium avium subsp. paratuberculosis
ggccagcgccgagcc

SEQ ID NO: 1001599 - RNA, 18 nt, Mycobacterium avium subsp. paratuberculosis
ggccagcgccgcccgggc

SEQ ID NO: 1001600 - RNA, 22 nt, Mycobacterium avium subsp. paratuberculosis
ggccagcgccgcccgggcggcc

SEQ ID NO: 1001601 - RNA, 14 nt, Mycobacterium avium subsp. paratuberculosis
ggccagcgccagcg

SEQ ID NO: 1001602 - RNA, 17 nt, Mycobacterium avium subsp. paratuberculosis
ggccagcgccagcgcca

SEQ ID NO: 1001603 - RNA, 22 nt, Mycobacterium avium subsp. paratuberculosis
ggccagcgcagugcggacgcca

SEQ ID NO: 1001604 - RNA, 16 nt, Mycobacterium avium subsp. paratuberculosis
ggccagcggcaucccu

SEQ ID NO: 1001605 - RNA, 12 nt, Mycobacterium avium subsp. paratuberculosis
ggccagcggcgc

SEQ ID NO: 1001606 - RNA, 19 nt, Mycobacterium avium subsp. paratuberculosis
ggccagcgucuccggcggg

SEQ ID NO: 1001607 - RNA, 23 nt, Mycobacterium avium subsp. paratuberculosis
ggccagcgucuccggcgggcugg

SEQ ID NO: 1001608 - RNA, 20 nt, Mycobacterium avium subsp. paratuberculosis
ggccagcgugaacaccgcgu

SEQ ID NO: 1001609 - RNA, 21 nt, Mycobacterium avium subsp. paratuberculosis
ggccgacccugcguccggccc

SEQ ID NO: 1001610 - RNA, 14 nt, Mycobacterium avium subsp. paratuberculosis
ggccgaccggccgg

SEQ ID NO: 1001611 - RNA, 16 nt, Mycobacterium avium subsp. paratuberculosis
ggccgaccuggcggcc

SEQ ID NO: 1001612 - RNA, 14 nt, Mycobacterium avium subsp. paratuberculosis
ggccgacgcccagc

SEQ ID NO: 1001613 - RNA, 16 nt, Mycobacterium avium subsp. paratuberculosis
ggccgacgcccagcac

SEQ ID NO: 1001614 - RNA, 20 nt, Mycobacterium avium subsp. paratuberculosis
ggccgacucgaugcgcguga

SEQ ID NO: 1001615 - RNA, 17 nt, Mycobacterium avium subsp. paratuberculosis
ggccgacugauccacca

SEQ ID NO: 1001616 - RNA, 19 nt, Mycobacterium avium subsp. paratuberculosis
ggccgacugauccaccauc

SEQ ID NO: 1001617 - RNA, 23 nt, Mycobacterium avium subsp. paratuberculosis
ggccgacgggauaguccggcaug

SEQ ID NO: 1001618 - RNA, 18 nt, Mycobacterium avium subsp. paratuberculosis
ggccgacgcgccgucggc

SEQ ID NO: 1001619 - RNA, 15 nt, Mycobacterium avium subsp. paratuberculosis
ggccgacgcuggccg

SEQ ID NO: 1001620 - RNA, 15 nt, Mycobacterium avium subsp. paratuberculosis
ggccgcauccagcgc

SEQ ID NO: 1001621 - RNA, 16 nt, Mycobacterium avium subsp. paratuberculosis
ggccgcauccagcgcc

SEQ ID NO: 1001622 - RNA, 21 nt, Mycobacterium avium subsp. paratuberculosis
ggccgcauccgcgagccgagc

SEQ ID NO: 1001623 - RNA, 22 nt, Mycobacterium avium subsp. paratuberculosis
ggccgcauccgcgagccgagcc

SEQ ID NO: 1001624 - RNA, 21 nt, Mycobacterium avium subsp. paratuberculosis
ggccgcaucguugguccaggc

SEQ ID NO: 1001625 - RNA, 22 nt, Mycobacterium avium subsp. paratuberculosis
ggccgccaaaucgaucacccaa

SEQ ID NO: 1001626 - RNA, 18 nt, Mycobacterium avium subsp. paratuberculosis
ggccgcaggguggccagc

SEQ ID NO: 1001627 - RNA, 19 nt, Mycobacterium avium subsp. paratuberculosis
ggccgccgcgcauccgcac

SEQ ID NO: 1001628 - RNA, 13 nt, Mycobacterium avium subsp. paratuberculosis
ggccgccgcccgc

SEQ ID NO: 1001629 - RNA, 16 nt, Mycobacterium avium subsp. paratuberculosis
ggccgccgccgcggcc

SEQ ID NO: 1001630 - RNA, 23 nt, Mycobacterium avium subsp. paratuberculosis
ggccgccgaugcgcccgcugcgg

SEQ ID NO: 1001631 - RNA, 20 nt, Mycobacterium avium subsp. paratuberculosis
ggccgccgacgucgugggcg

SEQ ID NO: 1001632 - RNA, 15 nt, Mycobacterium avium subsp. paratuberculosis
ggccgccgaggacac

SEQ ID NO: 1001633 - RNA, 17 nt, Mycobacterium avium subsp. paratuberculosis
ggccgcccgcuggggcg

SEQ ID NO: 1001634 - RNA, 13 nt, Mycobacterium avium subsp. paratuberculosis
ggccgcccgggcg

SEQ ID NO: 1001635 - RNA, 14 nt, Mycobacterium avium subsp. paratuberculosis
ggccgcccgguccg

SEQ ID NO: 1001636 - RNA, 15 nt, Mycobacterium avium subsp. paratuberculosis
ggccgcccguccggg

SEQ ID NO: 1001637 - RNA, 17 nt, Mycobacterium avium subsp. paratuberculosis
ggccgcccguccgggcc

SEQ ID NO: 1001638 - RNA, 17 nt, Mycobacterium avium subsp. paratuberculosis
ggccgcccgucggggcc

SEQ ID NO: 1001639 - RNA, 17 nt, Mycobacterium avium subsp. paratuberculosis
ggccgcccucgcugccg

SEQ ID NO: 1001640 - RNA, 17 nt, Mycobacterium avium subsp. paratuberculosis
ggccgcccgcuccugca

SEQ ID NO: 1001641 - RNA, 18 nt, Mycobacterium avium subsp. paratuberculosis
ggccgcccgcuccugcag

SEQ ID NO: 1001642 - RNA, 20 nt, Mycobacterium avium subsp. paratuberculosis
ggccgcccgcuccugcaggc

SEQ ID NO: 1001643 - RNA, 12 nt, Mycobacterium avium subsp. paratuberculosis
ggccgccagcgc

SEQ ID NO: 1001644 - RNA, 13 nt, Mycobacterium avium subsp. paratuberculosis
ggccgccagcagc

SEQ ID NO: 1001645 - RNA, 14 nt, Mycobacterium avium subsp. paratuberculosis
ggccgccagcagca

SEQ ID NO: 1001646 - RNA, 19 nt, Mycobacterium avium subsp. paratuberculosis
ggccgccagcagcacggca

SEQ ID NO: 1001647 - RNA, 12 nt, Mycobacterium avium subsp. paratuberculosis
ggccgccagcac

SEQ ID NO: 1001648 - RNA, 14 nt, Mycobacterium avium subsp. paratuberculosis
ggccgccagcaccu

SEQ ID NO: 1001649 - RNA, 18 nt, Mycobacterium avium subsp. paratuberculosis
ggccgcgcgugcccgcgg

SEQ ID NO: 1001650 - RNA, 13 nt, Mycobacterium avium subsp. paratuberculosis
ggccgcgcgcggc

SEQ ID NO: 1001651 - RNA, 14 nt, Mycobacterium avium subsp. paratuberculosis
ggccgcgcgcaggc

SEQ ID NO: 1001652 - RNA, 19 nt, Mycobacterium avium subsp. paratuberculosis
ggccgcgccgugcgccagc

SEQ ID NO: 1001653 - RNA, 20 nt, Mycobacterium avium subsp. paratuberculosis
ggccgcgccgugcgccagcg

SEQ ID NO: 1001654 - RNA, 13 nt, Mycobacterium avium subsp. paratuberculosis
ggccgcgccgccg

SEQ ID NO: 1001655 - RNA, 23 nt, Mycobacterium avium subsp. paratuberculosis
ggccgcgccguagcggcccaggu

SEQ ID NO: 1001656 - RNA, 12 nt, Mycobacterium avium subsp. paratuberculosis
ggccgcgccggc

SEQ ID NO: 1001657 - RNA, 13 nt, Mycobacterium avium subsp. paratuberculosis
ggccgcgccggcc

SEQ ID NO: 1001658 - RNA, 22 nt, Mycobacterium avium subsp. paratuberculosis
ggccgcgcccaucgcggccgcc

SEQ ID NO: 1001659 - RNA, 19 nt, Mycobacterium avium subsp. paratuberculosis
ggccgcgauccagcgcugg

SEQ ID NO: 1001660 - RNA, 19 nt, Mycobacterium avium subsp. paratuberculosis
ggccgccucgaagucgccg

SEQ ID NO: 1001661 - RNA, 13 nt, Mycobacterium avium subsp. paratuberculosis
ggccgcgacgggc

SEQ ID NO: 1001662 - RNA, 22 nt, Mycobacterium avium subsp. paratuberculosis
ggccgcgacgggcugucccggc

SEQ ID NO: 1001663 - RNA, 17 nt, Mycobacterium avium subsp. paratuberculosis
ggccgcgauccagcgcu

SEQ ID NO: 1001664 - RNA, 23 nt, Mycobacterium avium subsp. paratuberculosis
ggccgcgaugucggugggccgca

SEQ ID NO: 1001665 - RNA, 13 nt, Mycobacterium avium subsp. paratuberculosis
ggccgcgcaccgc

SEQ ID NO: 1001666 - RNA, 15 nt, Mycobacterium avium subsp. paratuberculosis
ggccgcgcagcucgg

SEQ ID NO: 1001667 - RNA, 13 nt, Mycobacterium avium subsp. paratuberculosis
ggccgccugcggg

SEQ ID NO: 1001668 - RNA, 20 nt, Mycobacterium avium subsp. paratuberculosis
ggccgccucccgcagcgcca

SEQ ID NO: 1001669 - RNA, 15 nt, Mycobacterium avium subsp. paratuberculosis
ggccgccuccagcac

SEQ ID NO: 1001670 - RNA, 18 nt, Mycobacterium avium subsp. paratuberculosis
ggccgccguggcccacgc

SEQ ID NO: 1001671 - RNA, 18 nt, Mycobacterium avium subsp. paratuberculosis
ggccgccgggccggcggc

SEQ ID NO: 1001672 - RNA, 22 nt, Mycobacterium avium subsp. paratuberculosis
ggccgccgggccggcggccagu

SEQ ID NO: 1001673 - RNA, 18 nt, Mycobacterium avium subsp. paratuberculosis
ggccgccgcauuccucgg

SEQ ID NO: 1001674 - RNA, 19 nt, Mycobacterium avium subsp. paratuberculosis
ggccgccggaucguguccc

SEQ ID NO: 1001675 - RNA, 14 nt, Mycobacterium avium subsp. paratuberculosis
ggccgccggccgcg

SEQ ID NO: 1001676 - RNA, 14 nt, Mycobacterium avium subsp. paratuberculosis
ggccgccggccagc

SEQ ID NO: 1001677 - RNA, 21 nt, Mycobacterium avium subsp. paratuberculosis
ggccgccgcuagucgcccagc

SEQ ID NO: 1001678 - RNA, 13 nt, Mycobacterium avium subsp. paratuberculosis
ggcccgacccggu

SEQ ID NO: 1001679 - RNA, 23 nt, Mycobacterium avium subsp. paratuberculosis
ggcccgacccggucagcucgccg

SEQ ID NO: 1001680 - RNA, 22 nt, Mycobacterium avium subsp. paratuberculosis
ggcccgaacaucgccucggccg

SEQ ID NO: 1001681 - RNA, 10 nt, Mycobacterium avium subsp. paratuberculosis
ggcccacagc

SEQ ID NO: 1001682 - RNA, 15 nt, Mycobacterium avium subsp. paratuberculosis
ggcccacgcagccgu

SEQ ID NO: 1001683 - RNA, 15 nt, Mycobacterium avium subsp. paratuberculosis
ggcccacgcucgacg

SEQ ID NO: 1001684 - RNA, 22 nt, Mycobacterium avium subsp. paratuberculosis
ggcccgaucaccaggcccaggc

SEQ ID NO: 1001685 - RNA, 12 nt, Mycobacterium avium subsp. paratuberculosis
ggcccgcccggc

SEQ ID NO: 1001686 - RNA, 16 nt, Mycobacterium avium subsp. paratuberculosis
ggcccgcccggcggcg

SEQ ID NO: 1001687 - RNA, 17 nt, Mycobacterium avium subsp. paratuberculosis
ggcccgcccggcggcgc

SEQ ID NO: 1001688 - RNA, 14 nt, Mycobacterium avium subsp. paratuberculosis
ggcccgcccgggca

SEQ ID NO: 1001689 - RNA, 19 nt, Mycobacterium avium subsp. paratuberculosis
ggcccgccgaacgccuccg

SEQ ID NO: 1001690 - RNA, 20 nt, Mycobacterium avium subsp. paratuberculosis
ggcccgccgaacgccuccgc

SEQ ID NO: 1001691 - RNA, 21 nt, Mycobacterium avium subsp. paratuberculosis
ggcccgagcccgacggcagca

SEQ ID NO: 1001692 - RNA, 18 nt, Mycobacterium avium subsp. paratuberculosis
ggcccgcgcaccgucauc

SEQ ID NO: 1001693 - RNA, 22 nt, Mycobacterium avium subsp. paratuberculosis
ggcccgcgcaccgucaucgcgg

SEQ ID NO: 1001694 - RNA, 20 nt, Mycobacterium avium subsp. paratuberculosis
ggcccgcgcaucccgucgac

SEQ ID NO: 1001695 - RNA, 22 nt, Mycobacterium avium subsp. paratuberculosis
ggcccgcgccccggcggccacg

SEQ ID NO: 1001696 - RNA, 13 nt, Mycobacterium avium subsp. paratuberculosis
ggcccgcgcccgc

SEQ ID NO: 1001697 - RNA, 14 nt, Mycobacterium avium subsp. paratuberculosis
ggcccgccgucgac

SEQ ID NO: 1001698 - RNA, 16 nt, Mycobacterium avium subsp. paratuberculosis
ggcccgccucggcggc

SEQ ID NO: 1001699 - RNA, 16 nt, Mycobacterium avium subsp. paratuberculosis
ggcccgccggagccga

SEQ ID NO: 1001700 - RNA, 21 nt, Mycobacterium avium subsp. paratuberculosis
ggcccgccgggcgucgcgcuc

SEQ ID NO: 1001701 - RNA, 21 nt, Mycobacterium avium subsp. paratuberculosis
ggcccgccgcggcuccagcag

SEQ ID NO: 1001702 - RNA, 13 nt, Mycobacterium avium subsp. paratuberculosis
ggcccgccgcggc

SEQ ID NO: 1001703 - RNA, 17 nt, Mycobacterium avium subsp. paratuberculosis
ggcccgccgcgcccggc

SEQ ID NO: 1001704 - RNA, 17 nt, Mycobacterium avium subsp. paratuberculosis
ggcccgccgccggcggc

SEQ ID NO: 1001705 - RNA, 14 nt, Mycobacterium avium subsp. paratuberculosis
ggcccgcccagcgc

SEQ ID NO: 1001706 - RNA, 19 nt, Mycobacterium avium subsp. paratuberculosis
ggcccggcguuccagcgca

SEQ ID NO: 1001707 - RNA, 12 nt, Mycobacterium avium subsp. paratuberculosis
ggcccggcggcc

SEQ ID NO: 1001708 - RNA, 14 nt, Mycobacterium avium subsp. paratuberculosis
ggcccggcggccgg

SEQ ID NO: 1001709 - RNA, 13 nt, Mycobacterium avium subsp. paratuberculosis
ggcccggcgcggc

SEQ ID NO: 1001710 - RNA, 14 nt, Mycobacterium avium subsp. paratuberculosis
ggcccggcgcggcg

SEQ ID NO: 1001711 - RNA, 17 nt, Mycobacterium avium subsp. paratuberculosis
ggcccggcgcggcggcg

SEQ ID NO: 1001712 - RNA, 20 nt, Mycobacterium avium subsp. paratuberculosis
ggcccggcgcggcggcgccg

SEQ ID NO: 1001713 - RNA, 14 nt, Mycobacterium avium subsp. paratuberculosis
ggcccgcgcgcuga

SEQ ID NO: 1001714 - RNA, 12 nt, Mycobacterium avium subsp. paratuberculosis
ggcccgcgcggc

SEQ ID NO: 1001715 - RNA, 23 nt, Mycobacterium avium subsp. paratuberculosis
ggcccggucggaguccagcacgc

SEQ ID NO: 1001716 - RNA, 20 nt, Mycobacterium avium subsp. paratuberculosis
ggcccggucgucgagcaccg

SEQ ID NO: 1001717 - RNA, 22 nt, Mycobacterium avium subsp. paratuberculosis
ggcccggucgucgagcaccggc

SEQ ID NO: 1001718 - RNA, 16 nt, Mycobacterium avium subsp. paratuberculosis
ggcccggucgucgccg

SEQ ID NO: 1001719 - RNA, 16 nt, Mycobacterium avium subsp. paratuberculosis
ggcccggucccgcguc

SEQ ID NO: 1001720 - RNA, 18 nt, Mycobacterium avium subsp. paratuberculosis
ggcccggugagccucagg

SEQ ID NO: 1001721 - RNA, 16 nt, Mycobacterium avium subsp. paratuberculosis
ggcccgguacagcgcc

SEQ ID NO: 1001722 - RNA, 21 nt, Mycobacterium avium subsp. paratuberculosis
ggcccgguacagcgccgcggc

SEQ ID NO: 1001723 - RNA, 22 nt, Mycobacterium avium subsp. paratuberculosis
ggcccgguacagcgccgcggcc

SEQ ID NO: 1001724 - RNA, 12 nt, Mycobacterium avium subsp. paratuberculosis
ggcccgggcggc

SEQ ID NO: 1001725 - RNA, 16 nt, Mycobacterium avium subsp. paratuberculosis
ggcccgggaagccgca

SEQ ID NO: 1001726 - RNA, 22 nt, Mycobacterium avium subsp. paratuberculosis
ggcccgggaagccgcagcaggu

SEQ ID NO: 1001727 - RNA, 20 nt, Mycobacterium avium subsp. paratuberculosis
ggcccggggacacccucggg

SEQ ID NO: 1001728 - RNA, 13 nt, Mycobacterium avium subsp. paratuberculosis
ggcccgucgccga

SEQ ID NO: 1001729 - RNA, 22 nt, Mycobacterium avium subsp. paratuberculosis
ggcccgucgccggcgcgcagcg

SEQ ID NO: 1001730 - RNA, 18 nt, Mycobacterium avium subsp. paratuberculosis
ggcccgucgccgugcguc

SEQ ID NO: 1001731 - RNA, 20 nt, Mycobacterium avium subsp. paratuberculosis
ggcccguccagaucggccag

SEQ ID NO: 1001732 - RNA, 22 nt, Mycobacterium avium subsp. paratuberculosis
ggcccguccagaucggccagcg

SEQ ID NO: 1001733 - RNA, 17 nt, Mycobacterium avium subsp. paratuberculosis
ggcccgucaggccucga

SEQ ID NO: 1001734 - RNA, 17 nt, Mycobacterium avium subsp. paratuberculosis
ggcccgguuccagcggc

SEQ ID NO: 1001735 - RNA, 23 nt, Mycobacterium avium subsp. paratuberculosis
ggcccugcucuucgcgcgcggcg

SEQ ID NO: 1001736 - RNA, 21 nt, Mycobacterium avium subsp. paratuberculosis
ggcccuugccccaccaccgcc

SEQ ID NO: 1001737 - RNA, 14 nt, Mycobacterium avium subsp. paratuberculosis
ggccgaaaucaacg

SEQ ID NO: 1001738 - RNA, 16 nt, Mycobacterium avium subsp. paratuberculosis
ggccggacagcggccc

SEQ ID NO: 1001739 - RNA, 22 nt, Mycobacterium avium subsp. paratuberculosis
ggccggaucgaauccggcggcg

SEQ ID NO: 1001740 - RNA, 19 nt, Mycobacterium avium subsp. paratuberculosis
ggccggagcggugcggcuc

SEQ ID NO: 1001741 - RNA, 12 nt, Mycobacterium avium subsp. paratuberculosis
ggccggcagcgg

SEQ ID NO: 1001742 - RNA, 15 nt, Mycobacterium avium subsp. paratuberculosis
ggccggcaggccgcc

SEQ ID NO: 1001743 - RNA, 15 nt, Mycobacterium avium subsp. paratuberculosis
ggccggcacucgccu

SEQ ID NO: 1001744 - RNA, 16 nt, Mycobacterium avium subsp. paratuberculosis
ggccggauggccagca

SEQ ID NO: 1001745 - RNA, 19 nt, Mycobacterium avium subsp. paratuberculosis
ggccggauguuguccggaa

SEQ ID NO: 1001746 - RNA, 13 nt, Mycobacterium avium subsp. paratuberculosis
ggccggcgccggc

SEQ ID NO: 1001747 - RNA, 14 nt, Mycobacterium avium subsp. paratuberculosis
ggccggcgccggcg

SEQ ID NO: 1001748 - RNA, 17 nt, Mycobacterium avium subsp. paratuberculosis
ggccggccuugcucgcc

SEQ ID NO: 1001749 - RNA, 18 nt, Mycobacterium avium subsp. paratuberculosis
ggccggccuugcucgccg

SEQ ID NO: 1001750 - RNA, 12 nt, Mycobacterium avium subsp. paratuberculosis
ggccggcgaggu

SEQ ID NO: 1001751 - RNA, 14 nt, Mycobacterium avium subsp. paratuberculosis
ggccggcgcagccg

SEQ ID NO: 1001752 - RNA, 21 nt, Mycobacterium avium subsp. paratuberculosis
ggccggcgacgccgcgcuggc

SEQ ID NO: 1001753 - RNA, 13 nt, Mycobacterium avium subsp. paratuberculosis
ggccggcgacggc

SEQ ID NO: 1001754 - RNA, 13 nt, Mycobacterium avium subsp. paratuberculosis
ggccggccggccg

SEQ ID NO: 1001755 - RNA, 17 nt, Mycobacterium avium subsp. paratuberculosis
ggccggccggccgagcc

SEQ ID NO: 1001756 - RNA, 12 nt, Mycobacterium avium subsp. paratuberculosis
ggccggccgcag

SEQ ID NO: 1001757 - RNA, 13 nt, Mycobacterium avium subsp. paratuberculosis
ggccggccgcagc

SEQ ID NO: 1001758 - RNA, 14 nt, Mycobacterium avium subsp. paratuberculosis
ggccggccgcccgc

SEQ ID NO: 1001759 - RNA, 13 nt, Mycobacterium avium subsp. paratuberculosis
ggccggccgccgg

SEQ ID NO: 1001760 - RNA, 14 nt, Mycobacterium avium subsp. paratuberculosis
ggccggccgagccg

SEQ ID NO: 1001761 - RNA, 15 nt, Mycobacterium avium subsp. paratuberculosis
ggccggccgagccga

SEQ ID NO: 1001762 - RNA, 16 nt, Mycobacterium avium subsp. paratuberculosis
ggccggccccgcccgg

SEQ ID NO: 1001763 - RNA, 17 nt, Mycobacterium avium subsp. paratuberculosis
ggccggccccgcccggc

SEQ ID NO: 1001764 - RNA, 20 nt, Mycobacterium avium subsp. paratuberculosis
ggccggccccgcccggcgcg

SEQ ID NO: 1001765 - RNA, 19 nt, Mycobacterium avium subsp. paratuberculosis
ggccggccccggccgggcg

SEQ ID NO: 1001766 - RNA, 16 nt, Mycobacterium avium subsp. paratuberculosis
ggccggcccgcccggc

SEQ ID NO: 1001767 - RNA, 20 nt, Mycobacterium avium subsp. paratuberculosis
ggccggcccgcccggcggcg

SEQ ID NO: 1001768 - RNA, 15 nt, Mycobacterium avium subsp. paratuberculosis
ggccggcccugcacg

SEQ ID NO: 1001769 - RNA, 15 nt, Mycobacterium avium subsp. paratuberculosis
ggccggccagcagcc

SEQ ID NO: 1001770 - RNA, 12 nt, Mycobacterium avium subsp. paratuberculosis
ggccggccagcg

SEQ ID NO: 1001771 - RNA, 14 nt, Mycobacterium avium subsp. paratuberculosis
ggccggccagcgcg

SEQ ID NO: 1001772 - RNA, 12 nt, Mycobacterium avium subsp. paratuberculosis
ggccggcccagc

SEQ ID NO: 1001773 - RNA, 14 nt, Mycobacterium avium subsp. paratuberculosis
ggccggcccagcgc

SEQ ID NO: 1001774 - RNA, 16 nt, Mycobacterium avium subsp. paratuberculosis
ggccggcccagcgcgc

SEQ ID NO: 1001775 - RNA, 20 nt, Mycobacterium avium subsp. paratuberculosis
ggccggcccagcgcgcggcg

SEQ ID NO: 1001776 - RNA, 17 nt, Mycobacterium avium subsp. paratuberculosis
ggccggccaccagcggc

SEQ ID NO: 1001777 - RNA, 18 nt, Mycobacterium avium subsp. paratuberculosis
ggccggccaccagcggcc

SEQ ID NO: 1001778 - RNA, 12 nt, Mycobacterium avium subsp. paratuberculosis
ggccggcagccg

SEQ ID NO: 1001779 - RNA, 23 nt, Mycobacterium avium subsp. paratuberculosis
ggccgcuuuccaccccggcgguc

SEQ ID NO: 1001780 - RNA, 24 nt, Mycobacterium avium subsp. paratuberculosis
ggccgcuuuccaccccggcggucg

SEQ ID NO: 1001781 - RNA, 15 nt, Mycobacterium avium subsp. paratuberculosis
ggccggaacagcugg

SEQ ID NO: 1001782 - RNA, 19 nt, Mycobacterium avium subsp. paratuberculosis
ggccgcuucggggugguug

SEQ ID NO: 1001783 - RNA, 14 nt, Mycobacterium avium subsp. paratuberculosis
ggccgcucagcggg

SEQ ID NO: 1001784 - RNA, 13 nt, Mycobacterium avium subsp. paratuberculosis
ggccgcgucggcc

SEQ ID NO: 1001785 - RNA, 18 nt, Mycobacterium avium subsp. paratuberculosis
ggccgcgucggcggcggc

SEQ ID NO: 1001786 - RNA, 15 nt, Mycobacterium avium subsp. paratuberculosis
ggccgcgucggcggu

SEQ ID NO: 1001787 - RNA, 19 nt, Mycobacterium avium subsp. paratuberculosis
ggccgcguuccaggaccug

SEQ ID NO: 1001788 - RNA, 20 nt, Mycobacterium avium subsp. paratuberculosis
ggccgcugcgcccagcgcgc

SEQ ID NO: 1001789 - RNA, 14 nt, Mycobacterium avium subsp. paratuberculosis
ggccgcugcccggc

SEQ ID NO: 1001790 - RNA, 19 nt, Mycobacterium avium subsp. paratuberculosis
ggccgcucgggugucgccg

SEQ ID NO: 1001791 - RNA, 14 nt, Mycobacterium avium subsp. paratuberculosis
ggccgcgucgccga

SEQ ID NO: 1001792 - RNA, 19 nt, Mycobacterium avium subsp. paratuberculosis
ggccgcgucgccgaccagc

SEQ ID NO: 1001793 - RNA, 23 nt, Mycobacterium avium subsp. paratuberculosis
ggccgcguacuucgcgcccugga

SEQ ID NO: 1001794 - RNA, 17 nt, Mycobacterium avium subsp. paratuberculosis
ggccgcggugugcccgg

SEQ ID NO: 1001795 - RNA, 12 nt, Mycobacterium avium subsp. paratuberculosis
ggccgcggggcc

SEQ ID NO: 1001796 - RNA, 13 nt, Mycobacterium avium subsp. paratuberculosis
ggccgcggggccg

SEQ ID NO: 1001797 - RNA, 13 nt, Mycobacterium avium subsp. paratuberculosis
ggccgcggcgucg

SEQ ID NO: 1001798 - RNA, 14 nt, Mycobacterium avium subsp. paratuberculosis
ggccgcggccagcg

SEQ ID NO: 1001799 - RNA, 17 nt, Mycobacterium avium subsp. paratuberculosis
ggccgcggccagcugcc

SEQ ID NO: 1001800 - RNA, 22 nt, Mycobacterium avium subsp. paratuberculosis
ggccgcggaauucgcgggugcg

SEQ ID NO: 1001801 - RNA, 14 nt, Mycobacterium avium subsp. paratuberculosis
ggccgcgcuggcca

SEQ ID NO: 1001802 - RNA, 16 nt, Mycobacterium avium subsp. paratuberculosis
ggccgcgcuggccagc

SEQ ID NO: 1001803 - RNA, 14 nt, Mycobacterium avium subsp. paratuberculosis
ggccgcggccggcg

SEQ ID NO: 1001804 - RNA, 20 nt, Mycobacterium avium subsp. paratuberculosis
ggccgcggcgaucggcgguc

SEQ ID NO: 1001805 - RNA, 12 nt, Mycobacterium avium subsp. paratuberculosis
ggccgcggcgcc

SEQ ID NO: 1001806 - RNA, 16 nt, Mycobacterium avium subsp. paratuberculosis
ggccgcggcgcggccc

SEQ ID NO: 1001807 - RNA, 13 nt, Mycobacterium avium subsp. paratuberculosis
ggccgcggcggcc

SEQ ID NO: 1001808 - RNA, 17 nt, Mycobacterium avium subsp. paratuberculosis
ggccgguuggcggccgg

SEQ ID NO: 1001809 - RNA, 18 nt, Mycobacterium avium subsp. paratuberculosis
ggccgguuguugcggucc

SEQ ID NO: 1001810 - RNA, 22 nt, Mycobacterium avium subsp. paratuberculosis
ggccggugcgugaugaccaggg

SEQ ID NO: 1001811 - RNA, 20 nt, Mycobacterium avium subsp. paratuberculosis
ggccgguggcgacaacaggc

SEQ ID NO: 1001812 - RNA, 17 nt, Mycobacterium avium subsp. paratuberculosis
ggccggugggcggcgcc

SEQ ID NO: 1001813 - RNA, 14 nt, Mycobacterium avium subsp. paratuberculosis
ggccgguuccacga

SEQ ID NO: 1001814 - RNA, 24 nt, Mycobacterium avium subsp. paratuberculosis
ggccgguugccuuuccgcgcggcg

SEQ ID NO: 1001815 - RNA, 23 nt, Mycobacterium avium subsp. paratuberculosis
ggccggugauggugaucucgccg

SEQ ID NO: 1001816 - RNA, 13 nt, Mycobacterium avium subsp. paratuberculosis
ggccggugcagca

SEQ ID NO: 1001817 - RNA, 16 nt, Mycobacterium avium subsp. paratuberculosis
ggccggugcagcacgu

SEQ ID NO: 1001818 - RNA, 16 nt, Mycobacterium avium subsp. paratuberculosis
ggccggucggucggcc

SEQ ID NO: 1001819 - RNA, 23 nt, Mycobacterium avium subsp. paratuberculosis
ggccggucggucggccgcacguc

SEQ ID NO: 1001820 - RNA, 15 nt, Mycobacterium avium subsp. paratuberculosis
ggccggucagcgcga

SEQ ID NO: 1001821 - RNA, 20 nt, Mycobacterium avium subsp. paratuberculosis
ggccgguccgugcacggcca

SEQ ID NO: 1001822 - RNA, 18 nt, Mycobacterium avium subsp. paratuberculosis
ggccgguccccggcgacc

SEQ ID NO: 1001823 - RNA, 17 nt, Mycobacterium avium subsp. paratuberculosis
ggccgguccgcccagac

SEQ ID NO: 1001824 - RNA, 16 nt, Mycobacterium avium subsp. paratuberculosis
ggccguagccggaccg

SEQ ID NO: 1001825 - RNA, 23 nt, Mycobacterium avium subsp. paratuberculosis
ggccguagcgagcgcuggccuug

SEQ ID NO: 1001826 - RNA, 13 nt, Mycobacterium avium subsp. paratuberculosis
ggccguagcggcu

SEQ ID NO: 1001827 - RNA, 15 nt, Mycobacterium avium subsp. paratuberculosis
ggccgucaucgccga

SEQ ID NO: 1001828 - RNA, 22 nt, Mycobacterium avium subsp. paratuberculosis
ggccgucacaggccgccugcgg

SEQ ID NO: 1001829 - RNA, 14 nt, Mycobacterium avium subsp. paratuberculosis
ggccguccgggugc

SEQ ID NO: 1001830 - RNA, 19 nt, Mycobacterium avium subsp. paratuberculosis
ggccgucgaacugcagccg

SEQ ID NO: 1001831 - RNA, 13 nt, Mycobacterium avium subsp. paratuberculosis
ggccgucgcggcg

SEQ ID NO: 1001832 - RNA, 15 nt, Mycobacterium avium subsp. paratuberculosis
ggccggcgugcuggg

SEQ ID NO: 1001833 - RNA, 20 nt, Mycobacterium avium subsp. paratuberculosis
ggccgggaaguuggccuccc

SEQ ID NO: 1001834 - RNA, 22 nt, Mycobacterium avium subsp. paratuberculosis
ggccgggaucuggccggugagc

SEQ ID NO: 1001835 - RNA, 22 nt, Mycobacterium avium subsp. paratuberculosis
ggccggcggugauccgcccggc

SEQ ID NO: 1001836 - RNA, 18 nt, Mycobacterium avium subsp. paratuberculosis
ggccggcggggcgggggc

SEQ ID NO: 1001837 - RNA, 15 nt, Mycobacterium avium subsp. paratuberculosis
ggccggcguccaggc

SEQ ID NO: 1001838 - RNA, 22 nt, Mycobacterium avium subsp. paratuberculosis
ggccggcguccaguugcggcac

SEQ ID NO: 1001839 - RNA, 14 nt, Mycobacterium avium subsp. paratuberculosis
ggccggcgggggcg

SEQ ID NO: 1001840 - RNA, 13 nt, Mycobacterium avium subsp. paratuberculosis
ggccggcggguuc

SEQ ID NO: 1001841 - RNA, 20 nt, Mycobacterium avium subsp. paratuberculosis
ggccggcggguuggucccga

SEQ ID NO: 1001842 - RNA, 15 nt, Mycobacterium avium subsp. paratuberculosis
ggccggcgccgcggg

SEQ ID NO: 1001843 - RNA, 23 nt, Mycobacterium avium subsp. paratuberculosis
ggccggcgccgcgggugcggcac

SEQ ID NO: 1001844 - RNA, 13 nt, Mycobacterium avium subsp. paratuberculosis
ggccggcggcggc

SEQ ID NO: 1001845 - RNA, 18 nt, Mycobacterium avium subsp. paratuberculosis
ggccggcggcggccagcg

SEQ ID NO: 1001846 - RNA, 21 nt, Mycobacterium avium subsp. paratuberculosis
ggccggcggcggccagcgagu

SEQ ID NO: 1001847 - RNA, 21 nt, Mycobacterium avium subsp. paratuberculosis
ggccggcggacgcggccagcg

SEQ ID NO: 1001848 - RNA, 22 nt, Mycobacterium avium subsp. paratuberculosis
ggccggcggacgcggccagcgc

SEQ ID NO: 1001849 - RNA, 16 nt, Mycobacterium avium subsp. paratuberculosis
ggccggcgcgaccagc

SEQ ID NO: 1001850 - RNA, 16 nt, Mycobacterium avium subsp. paratuberculosis
ggccggcgcgcacggc

SEQ ID NO: 1001851 - RNA, 15 nt, Mycobacterium avium subsp. paratuberculosis
ggccgggccgcggcg

SEQ ID NO: 1001852 - RNA, 14 nt, Mycobacterium avium subsp. paratuberculosis
ggccgggcgcuggc

SEQ ID NO: 1001853 - RNA, 16 nt, Mycobacterium avium subsp. paratuberculosis
ggccgggcgcuggccg

SEQ ID NO: 1001854 - RNA, 13 nt, Mycobacterium avium subsp. paratuberculosis
ggccgggcggaag

SEQ ID NO: 1001855 - RNA, 13 nt, Mycobacterium avium subsp. paratuberculosis
ggccggggccagc

SEQ ID NO: 1001856 - RNA, 20 nt, Mycobacterium avium subsp. paratuberculosis
ggccggggcgaccaguaggc

SEQ ID NO: 1001857 - RNA, 13 nt, Mycobacterium avium subsp. paratuberculosis
ggccggggcgggc

SEQ ID NO: 1001858 - RNA, 14 nt, Mycobacterium avium subsp. paratuberculosis
ggccgggggcgcgg

SEQ ID NO: 1001859 - RNA, 13 nt, Mycobacterium avium subsp. paratuberculosis
ggccgggcucccg

SEQ ID NO: 1001860 - RNA, 17 nt, Mycobacterium avium subsp. paratuberculosis
ggccgggcugcccacca

SEQ ID NO: 1001861 - RNA, 17 nt, Mycobacterium avium subsp. paratuberculosis
ggccgggcgugcccggc

SEQ ID NO: 1001862 - RNA, 17 nt, Mycobacterium avium subsp. paratuberculosis
ggccgggcugguccgga

SEQ ID NO: 1001863 - RNA, 23 nt, Mycobacterium avium subsp. paratuberculosis
ggccgguaaaacuggccagcaua

SEQ ID NO: 1001864 - RNA, 18 nt, Mycobacterium avium subsp. paratuberculosis
ggccggguuuucgggccg

SEQ ID NO: 1001865 - RNA, 15 nt, Mycobacterium avium subsp. paratuberculosis
ggccgggucgcaggc

SEQ ID NO: 1001866 - RNA, 16 nt, Mycobacterium avium subsp. paratuberculosis
ggccgggucgcaggca

SEQ ID NO: 1001867 - RNA, 14 nt, Mycobacterium avium subsp. paratuberculosis
ggccgggucgccgu

SEQ ID NO: 1001868 - RNA, 16 nt, Mycobacterium avium subsp. paratuberculosis
ggccggguguagcugg

SEQ ID NO: 1001869 - RNA, 16 nt, Mycobacterium avium subsp. paratuberculosis
ggccgggucgaacggc

SEQ ID NO: 1001870 - RNA, 16 nt, Mycobacterium avium subsp. paratuberculosis
ggccgggggcggcggc

SEQ ID NO: 1001871 - RNA, 14 nt, Mycobacterium avium subsp. paratuberculosis
ggcaaggccagcaa

SEQ ID NO: 1001872 - RNA, 13 nt, Mycobacterium avium subsp. paratuberculosis
ggcaagcagcggc

SEQ ID NO: 1001873 - RNA, 18 nt, Mycobacterium avium subsp. paratuberculosis
ggcaaucgagcgggcggg

SEQ ID NO: 1001874 - RNA, 22 nt, Mycobacterium avium subsp. paratuberculosis
ggcaaugaugucggcgggccgg

SEQ ID NO: 1001875 - RNA, 23 nt, Mycobacterium avium subsp. paratuberculosis
ggcaaucgguuaagugcccgccu

SEQ ID NO: 1001876 - RNA, 15 nt, Mycobacterium avium subsp. paratuberculosis
ggcaagggcaaagac

SEQ ID NO: 1001877 - RNA, 18 nt, Mycobacterium avium subsp. paratuberculosis
ggcaaugguugcggcggg

SEQ ID NO: 1001878 - RNA, 14 nt, Mycobacterium avium subsp. paratuberculosis
ggcacccgccagcc

SEQ ID NO: 1001879 - RNA, 15 nt, Mycobacterium avium subsp. paratuberculosis
ggcacccgccagccc

SEQ ID NO: 1001880 - RNA, 22 nt, Mycobacterium avium subsp. paratuberculosis
ggcacccgcgcgucgcgcagcg

SEQ ID NO: 1001881 - RNA, 16 nt, Mycobacterium avium subsp. paratuberculosis
ggcacccggcgcggcc

SEQ ID NO: 1001882 - RNA, 19 nt, Mycobacterium avium subsp. paratuberculosis
ggcacccccaauugccggg

SEQ ID NO: 1001883 - RNA, 14 nt, Mycobacterium avium subsp. paratuberculosis
ggcaccccgaucag

SEQ ID NO: 1001884 - RNA, 17 nt, Mycobacterium avium subsp. paratuberculosis
ggcaccggugcggcggu

SEQ ID NO: 1001885 - RNA, 16 nt, Mycobacterium avium subsp. paratuberculosis
ggcaccgaacgccagc

SEQ ID NO: 1001886 - RNA, 19 nt, Mycobacterium avium subsp. paratuberculosis
ggcaccgaacgccagcagc

SEQ ID NO: 1001887 - RNA, 18 nt, Mycobacterium avium subsp. paratuberculosis
ggcaccgacagggccagc

SEQ ID NO: 1001888 - RNA, 21 nt, Mycobacterium avium subsp. paratuberculosis
ggcaccgacaucagaucgccg

SEQ ID NO: 1001889 - RNA, 12 nt, Mycobacterium avium subsp. paratuberculosis
ggcaccgucguc

SEQ ID NO: 1001890 - RNA, 16 nt, Mycobacterium avium subsp. paratuberculosis
ggcaccuggccgucgg

SEQ ID NO: 1001891 - RNA, 19 nt, Mycobacterium avium subsp. paratuberculosis
ggcaccuucaccgaccagc

SEQ ID NO: 1001892 - RNA, 21 nt, Mycobacterium avium subsp. paratuberculosis
ggcaccucgaagggcgccagc

SEQ ID NO: 1001893 - RNA, 16 nt, Mycobacterium avium subsp. paratuberculosis
ggcaccucggccaggu

SEQ ID NO: 1001894 - RNA, 23 nt, Mycobacterium avium subsp. paratuberculosis
ggcaccucggccuugaccacggu

SEQ ID NO: 1001895 - RNA, 19 nt, Mycobacterium avium subsp. paratuberculosis
ggcacgcgagacgagccgc

SEQ ID NO: 1001896 - RNA, 14 nt, Mycobacterium avium subsp. paratuberculosis
ggcacgcgcgccgg

SEQ ID NO: 1001897 - RNA, 13 nt, Mycobacterium avium subsp. paratuberculosis
ggcacggugggac

SEQ ID NO: 1001898 - RNA, 19 nt, Mycobacterium avium subsp. paratuberculosis
ggcacggugggacggcggg

SEQ ID NO: 1001899 - RNA, 22 nt, Mycobacterium avium subsp. paratuberculosis
ggcacggccggccggccgagcc

SEQ ID NO: 1001900 - RNA, 13 nt, Mycobacterium avium subsp. paratuberculosis
ggcacggcccgcu

SEQ ID NO: 1001901 - RNA, 16 nt, Mycobacterium avium subsp. paratuberculosis
ggcacggcccgcucgg

SEQ ID NO: 1001902 - RNA, 15 nt, Mycobacterium avium subsp. paratuberculosis
ggcacgggcccgcgg

SEQ ID NO: 1001903 - RNA, 16 nt, Mycobacterium avium subsp. paratuberculosis
ggcacgggcccgcggg

SEQ ID NO: 1001904 - RNA, 16 nt, Mycobacterium avium subsp. paratuberculosis
ggcaacacgaccagga

SEQ ID NO: 1001905 - RNA, 18 nt, Mycobacterium avium subsp. paratuberculosis
ggcaacacgccggcggcc

SEQ ID NO: 1001906 - RNA, 19 nt, Mycobacterium avium subsp. paratuberculosis
ggcaacacguagucgccga

SEQ ID NO: 1001907 - RNA, 18 nt, Mycobacterium avium subsp. paratuberculosis
ggcaacagcgcgccggcc

SEQ ID NO: 1001908 - RNA, 19 nt, Mycobacterium avium subsp. paratuberculosis
ggcaaccugggcggcggcg

SEQ ID NO: 1001909 - RNA, 17 nt, Mycobacterium avium subsp. paratuberculosis
ggcaacccgaccucguc

SEQ ID NO: 1001910 - RNA, 14 nt, Mycobacterium avium subsp. paratuberculosis
ggcaaagggcuagg

SEQ ID NO: 1001911 - RNA, 19 nt, Mycobacterium avium subsp. paratuberculosis
ggcaaagcguugccgcgcg

SEQ ID NO: 1001912 - RNA, 20 nt, Mycobacterium avium subsp. paratuberculosis
ggcaaagcguugccgcgcgc

SEQ ID NO: 1001913 - RNA, 20 nt, Mycobacterium avium subsp. paratuberculosis
ggauuucacgucugcucggc

SEQ ID NO: 1001914 - RNA, 16 nt, Mycobacterium avium subsp. paratuberculosis
ggauuucgcucagccg

SEQ ID NO: 1001915 - RNA, 19 nt, Mycobacterium avium subsp. paratuberculosis
ggaugccgaaccgcugcgg

SEQ ID NO: 1001916 - RNA, 16 nt, Mycobacterium avium subsp. paratuberculosis
ggaugccgcgcggcgc

SEQ ID NO: 1001917 - RNA, 12 nt, Mycobacterium avium subsp. paratuberculosis
ggauggccagca

SEQ ID NO: 1001918 - RNA, 13 nt, Mycobacterium avium subsp. paratuberculosis
ggauggccagcag

SEQ ID NO: 1001919 - RNA, 14 nt, Mycobacterium avium subsp. paratuberculosis
ggauggcgcccuug

SEQ ID NO: 1001920 - RNA, 14 nt, Mycobacterium avium subsp. paratuberculosis
ggauggcccgccag

SEQ ID NO: 1001921 - RNA, 15 nt, Mycobacterium avium subsp. paratuberculosis
ggauugcgagccggu

SEQ ID NO: 1001922 - RNA, 22 nt, Mycobacterium avium subsp. paratuberculosis
ggauuggugccgaucaccucgc

SEQ ID NO: 1001923 - RNA, 20 nt, Mycobacterium avium subsp. paratuberculosis
ggauuacucgccggcggcgc

SEQ ID NO: 1001924 - RNA, 23 nt, Mycobacterium avium subsp. paratuberculosis
ggaucacaucggacaucggcagc

SEQ ID NO: 1001925 - RNA, 14 nt, Mycobacterium avium subsp. paratuberculosis
ggaucuccagcagc

SEQ ID NO: 1001926 - RNA, 23 nt, Mycobacterium avium subsp. paratuberculosis
ggaucucgaccucgucggcggcg

SEQ ID NO: 1001927 - RNA, 14 nt, Mycobacterium avium subsp. paratuberculosis
ggaucugggcggcg

SEQ ID NO: 1001928 - RNA, 16 nt, Mycobacterium avium subsp. paratuberculosis
ggaucugcgcaagaag

SEQ ID NO: 1001929 - RNA, 15 nt, Mycobacterium avium subsp. paratuberculosis
ggaucugcucggcgu

SEQ ID NO: 1001930 - RNA, 18 nt, Mycobacterium avium subsp. paratuberculosis
ggaugcaccggcagccag

SEQ ID NO: 1001931 - RNA, 15 nt, Mycobacterium avium subsp. paratuberculosis
ggaugccgaaccgcu

SEQ ID NO: 1001932 - RNA, 12 nt, Mycobacterium avium subsp. paratuberculosis
ggagugcucggc

SEQ ID NO: 1001933 - RNA, 21 nt, Mycobacterium avium subsp. paratuberculosis
ggagucgcuguuggcgacggu

SEQ ID NO: 1001934 - RNA, 13 nt, Mycobacterium avium subsp. paratuberculosis
ggaguggucaggc

SEQ ID NO: 1001935 - RNA, 18 nt, Mycobacterium avium subsp. paratuberculosis
ggauagccgagcggcgcc

SEQ ID NO: 1001936 - RNA, 16 nt, Mycobacterium avium subsp. paratuberculosis
ggagcggugcggcucg

SEQ ID NO: 1001937 - RNA, 15 nt, Mycobacterium avium subsp. paratuberculosis
ggaggacgaggcccg

SEQ ID NO: 1001938 - RNA, 14 nt, Mycobacterium avium subsp. paratuberculosis
ggagcggcccagcu

SEQ ID NO: 1001939 - RNA, 18 nt, Mycobacterium avium subsp. paratuberculosis
ggagccuuggucgcggcc

SEQ ID NO: 1001940 - RNA, 17 nt, Mycobacterium avium subsp. paratuberculosis
ggagcgaaggugccgcg

SEQ ID NO: 1001941 - RNA, 13 nt, Mycobacterium avium subsp. paratuberculosis
ggagcgcggcaug

SEQ ID NO: 1001942 - RNA, 13 nt, Mycobacterium avium subsp. paratuberculosis
ggagcggauggcg

SEQ ID NO: 1001943 - RNA, 16 nt, Mycobacterium avium subsp. paratuberculosis
ggagcgcuggucggcg

SEQ ID NO: 1001944 - RNA, 18 nt, Mycobacterium avium subsp. paratuberculosis
ggagcggcggaggggccc

SEQ ID NO: 1001945 - RNA, 11 nt, Mycobacterium avium subsp. paratuberculosis
ggagcggcggu

SEQ ID NO: 1001946 - RNA, 20 nt, Mycobacterium avium subsp. paratuberculosis
ggagguucgccggaauggca

SEQ ID NO: 1001947 - RNA, 15 nt, Mycobacterium avium subsp. paratuberculosis
ggaggcggcgggggc

SEQ ID NO: 1001948 - RNA, 14 nt, Mycobacterium avium subsp. paratuberculosis
ggaggcgagcagcc

SEQ ID NO: 1001949 - RNA, 20 nt, Mycobacterium avium subsp. paratuberculosis
ggaggcgagcagccgggugc

SEQ ID NO: 1001950 - RNA, 16 nt, Mycobacterium avium subsp. paratuberculosis
ggaggccuccaggcug

SEQ ID NO: 1001951 - RNA, 13 nt, Mycobacterium avium subsp. paratuberculosis
ggaggcagcgcgg

SEQ ID NO: 1001952 - RNA, 16 nt, Mycobacterium avium subsp. paratuberculosis
ggaggccagcucgacc

SEQ ID NO: 1001953 - RNA, 23 nt, Mycobacterium avium subsp. paratuberculosis
ggaggccagcugcaccggggccg

SEQ ID NO: 1001954 - RNA, 20 nt, Mycobacterium avium subsp. paratuberculosis
ggaguaguccagcaccgcca

SEQ ID NO: 1001955 - RNA, 22 nt, Mycobacterium avium subsp. paratuberculosis
ggaguaguccagcaccgccacg

SEQ ID NO: 1001956 - RNA, 23 nt, Mycobacterium avium subsp. paratuberculosis
ggacuugcgucgcgaugcccaag

SEQ ID NO: 1001957 - RNA, 22 nt, Mycobacterium avium subsp. paratuberculosis
ggacuuucgcgucugcucgccg

SEQ ID NO: 1001958 - RNA, 19 nt, Mycobacterium avium subsp. paratuberculosis
ggacuugacgauccccugg

SEQ ID NO: 1001959 - RNA, 18 nt, Mycobacterium avium subsp. paratuberculosis
ggacugggcgccgccggc

SEQ ID NO: 1001960 - RNA, 19 nt, Mycobacterium avium subsp. paratuberculosis
ggacugcgccggggccgcg

SEQ ID NO: 1001961 - RNA, 16 nt, Mycobacterium avium subsp. paratuberculosis
ggacuggugggcgucg

SEQ ID NO: 1001962 - RNA, 19 nt, Mycobacterium avium subsp. paratuberculosis
ggagccuugcuggcggccu

SEQ ID NO: 1001963 - RNA, 23 nt, Mycobacterium avium subsp. paratuberculosis
ggagccuugcuggcggccuucuu

SEQ ID NO: 1001964 - RNA, 20 nt, Mycobacterium avium subsp. paratuberculosis
ggagaugauggccgcgccgc

SEQ ID NO: 1001965 - RNA, 20 nt, Mycobacterium avium subsp. paratuberculosis
ggagaaaugggccagguccu

SEQ ID NO: 1001966 - RNA, 20 nt, Mycobacterium avium subsp. paratuberculosis
ggacucgggguugacccggc

SEQ ID NO: 1001967 - RNA, 14 nt, Mycobacterium avium subsp. paratuberculosis
ggacguggcucagc

SEQ ID NO: 1001968 - RNA, 23 nt, Mycobacterium avium subsp. paratuberculosis
ggacuccuccugcgacggcagca

SEQ ID NO: 1001969 - RNA, 21 nt, Mycobacterium avium subsp. paratuberculosis
ggacucgaagaucgccugcag

SEQ ID NO: 1001970 - RNA, 20 nt, Mycobacterium avium subsp. paratuberculosis
ggacgucgacgugggcggcc

SEQ ID NO: 1001971 - RNA, 21 nt, Mycobacterium avium subsp. paratuberculosis
ggacgucggccggcugcagcc

SEQ ID NO: 1001972 - RNA, 24 nt, Mycobacterium avium subsp. paratuberculosis
ggacgucagcccgcgucgcgcagc

SEQ ID NO: 1001973 - RNA, 13 nt, Mycobacterium avium subsp. paratuberculosis
ggacggugcagcc

SEQ ID NO: 1001974 - RNA, 17 nt, Mycobacterium avium subsp. paratuberculosis
ggacggugcagccgggg

SEQ ID NO: 1001975 - RNA, 22 nt, Mycobacterium avium subsp. paratuberculosis
ggacgggcauccggcucagaag

SEQ ID NO: 1001976 - RNA, 20 nt, Mycobacterium avium subsp. paratuberculosis
ggacgggccuagugccgggg

SEQ ID NO: 1001977 - RNA, 17 nt, Mycobacterium avium subsp. paratuberculosis
ggacgggggccggugcg

SEQ ID NO: 1001978 - RNA, 17 nt, Mycobacterium avium subsp. paratuberculosis
ggacgggucggcggcga

SEQ ID NO: 1001979 - RNA, 23 nt, Mycobacterium avium subsp. paratuberculosis
ggacggguugggcgccagcagca

SEQ ID NO: 1001980 - RNA, 17 nt, Mycobacterium avium subsp. paratuberculosis
ggacgaugcgcaccccc

SEQ ID NO: 1001981 - RNA, 20 nt, Mycobacterium avium subsp. paratuberculosis
ggacgacgucgaugugcucg

SEQ ID NO: 1001982 - RNA, 19 nt, Mycobacterium avium subsp. paratuberculosis
ggacgacggcgccgcccgg

SEQ ID NO: 1001983 - RNA, 15 nt, Mycobacterium avium subsp. paratuberculosis
ggacgaggcggguga

SEQ ID NO: 1001984 - RNA, 19 nt, Mycobacterium avium subsp. paratuberculosis
ggacgagucccaugggcug

SEQ ID NO: 1001985 - RNA, 12 nt, Mycobacterium avium subsp. paratuberculosis
ggacgcccgcga

SEQ ID NO: 1001986 - RNA, 15 nt, Mycobacterium avium subsp. paratuberculosis
ggacgccacaacaua

SEQ ID NO: 1001987 - RNA, 13 nt, Mycobacterium avium subsp. paratuberculosis
ggacgccacggcg

SEQ ID NO: 1001988 - RNA, 19 nt, Mycobacterium avium subsp. paratuberculosis
ggacgauguccgccggccg

SEQ ID NO: 1001989 - RNA, 22 nt, Mycobacterium avium subsp. paratuberculosis
ggaaucgcggaucgaacagggc

SEQ ID NO: 1001990 - RNA, 19 nt, Mycobacterium avium subsp. paratuberculosis
ggaaucgcccgggccaggu

SEQ ID NO: 1001991 - RNA, 18 nt, Mycobacterium avium subsp. paratuberculosis
ggaauaggccgcguaggc

SEQ ID NO: 1001992 - RNA, 19 nt, Mycobacterium avium subsp. paratuberculosis
ggacaacacgaucgucacc

SEQ ID NO: 1001993 - RNA, 19 nt, Mycobacterium avium subsp. paratuberculosis
ggacaacgcagguuucucg

SEQ ID NO: 1001994 - RNA, 23 nt, Mycobacterium avium subsp. paratuberculosis
ggacaacgcagguuucucgacca

SEQ ID NO: 1001995 - RNA, 23 nt, Mycobacterium avium subsp. paratuberculosis
ggacaacgcgucgaacagccggg

SEQ ID NO: 1001996 - RNA, 14 nt, Mycobacterium avium subsp. paratuberculosis
gcucgguggccggu

SEQ ID NO: 1001997 - RNA, 19 nt, Mycobacterium avium subsp. paratuberculosis
gcucgguggcgucggcggc

SEQ ID NO: 1001998 - RNA, 22 nt, Mycobacterium avium subsp. paratuberculosis
ggaagucgccguccggggccgg

SEQ ID NO: 1001999 - RNA, 15 nt, Mycobacterium avium subsp. paratuberculosis
ggaaguagcccggag

SEQ ID NO: 1002000 - RNA, 21 nt, Mycobacterium avium subsp. paratuberculosis
gcucggucaagccggccagca

SEQ ID NO: 1002001 - RNA, 15 nt, Mycobacterium avium subsp. paratuberculosis
gcucggucagcaccg

SEQ ID NO: 1002002 - RNA, 22 nt, Mycobacterium avium subsp. paratuberculosis
gcucggucagccgggcggccuc

SEQ ID NO: 1002003 - RNA, 23 nt, Mycobacterium avium subsp. paratuberculosis
gcucggugaugccgagcgccgcg

SEQ ID NO: 1002004 - RNA, 21 nt, Mycobacterium avium subsp. paratuberculosis
gcucggugaucaccaugauca

SEQ ID NO: 1002005 - RNA, 14 nt, Mycobacterium avium subsp. paratuberculosis
gcucggucgcggcg

SEQ ID NO: 1002006 - RNA, 18 nt, Mycobacterium avium subsp. paratuberculosis
gcucggucgcggucggcg

SEQ ID NO: 1002007 - RNA, 23 nt, Mycobacterium avium subsp. paratuberculosis
gcucgggcgguggcgccggggcg

SEQ ID NO: 1002008 - RNA, 14 nt, Mycobacterium avium subsp. paratuberculosis
gcucgggcagcccg

SEQ ID NO: 1002009 - RNA, 14 nt, Mycobacterium avium subsp. paratuberculosis
gcucgggcccgcgc

SEQ ID NO: 1002010 - RNA, 19 nt, Mycobacterium avium subsp. paratuberculosis
gcucgggcgcgaacagcgc

SEQ ID NO: 1002011 - RNA, 16 nt, Mycobacterium avium subsp. paratuberculosis
gcucggcguggcgcuc

SEQ ID NO: 1002012 - RNA, 13 nt, Mycobacterium avium subsp. paratuberculosis
gcucggcggccuc

SEQ ID NO: 1002013 - RNA, 23 nt, Mycobacterium avium subsp. paratuberculosis
gcucggcguauucgucgucggcc

SEQ ID NO: 1002014 - RNA, 14 nt, Mycobacterium avium subsp. paratuberculosis
ggacagcaccacca

SEQ ID NO: 1002015 - RNA, 17 nt, Mycobacterium avium subsp. paratuberculosis
ggacagccacagcucgg

SEQ ID NO: 1002016 - RNA, 11 nt, Mycobacterium avium subsp. paratuberculosis
ggacagcagca

SEQ ID NO: 1002017 - RNA, 17 nt, Mycobacterium avium subsp. paratuberculosis
ggacagcagcagcuccc

SEQ ID NO: 1002018 - RNA, 11 nt, Mycobacterium avium subsp. paratuberculosis
ggacagcagcc

SEQ ID NO: 1002019 - RNA, 14 nt, Mycobacterium avium subsp. paratuberculosis
ggacagccggggca

SEQ ID NO: 1002020 - RNA, 23 nt, Mycobacterium avium subsp. paratuberculosis
ggacagccggggcagcugcuggg

SEQ ID NO: 1002021 - RNA, 17 nt, Mycobacterium avium subsp. paratuberculosis
ggacagcgucagccccg

SEQ ID NO: 1002022 - RNA, 19 nt, Mycobacterium avium subsp. paratuberculosis
ggacagcucaccgggcucg

SEQ ID NO: 1002023 - RNA, 13 nt, Mycobacterium avium subsp. paratuberculosis
ggacagcucgccg

SEQ ID NO: 1002024 - RNA, 14 nt, Mycobacterium avium subsp. paratuberculosis
ggacagcugcgcgg

SEQ ID NO: 1002025 - RNA, 16 nt, Mycobacterium avium subsp. paratuberculosis
ggacaugugagguggc

SEQ ID NO: 1002026 - RNA, 17 nt, Mycobacterium avium subsp. paratuberculosis
ggacaggaacgggccgg

SEQ ID NO: 1002027 - RNA, 20 nt, Mycobacterium avium subsp. paratuberculosis
ggacaucgucgcgcccagga

SEQ ID NO: 1002028 - RNA, 16 nt, Mycobacterium avium subsp. paratuberculosis
ggacaucuccggcacg

SEQ ID NO: 1002029 - RNA, 18 nt, Mycobacterium avium subsp. paratuberculosis
ggaccacccacucccagc

SEQ ID NO: 1002030 - RNA, 19 nt, Mycobacterium avium subsp. paratuberculosis
ggaccacccacucccagcc

SEQ ID NO: 1002031 - RNA, 22 nt, Mycobacterium avium subsp. paratuberculosis
ggaccacccacucccagccgcc

SEQ ID NO: 1002032 - RNA, 23 nt, Mycobacterium avium subsp. paratuberculosis
ggaccacccacucccagccgccg

SEQ ID NO: 1002033 - RNA, 14 nt, Mycobacterium avium subsp. paratuberculosis
ggacauucugcacg

SEQ ID NO: 1002034 - RNA, 17 nt, Mycobacterium avium subsp. paratuberculosis
ggacaugccgagcagca

SEQ ID NO: 1002035 - RNA, 11 nt, Mycobacterium avium subsp. paratuberculosis
ggaccagcgcc

SEQ ID NO: 1002036 - RNA, 22 nt, Mycobacterium avium subsp. paratuberculosis
ggaccagcgggucgauggcgac

SEQ ID NO: 1002037 - RNA, 14 nt, Mycobacterium avium subsp. paratuberculosis
ggaccagggcggug

SEQ ID NO: 1002038 - RNA, 16 nt, Mycobacterium avium subsp. paratuberculosis
ggaccagggcgguggc

SEQ ID NO: 1002039 - RNA, 18 nt, Mycobacterium avium subsp. paratuberculosis
ggaccaggguggccccag

SEQ ID NO: 1002040 - RNA, 18 nt, Mycobacterium avium subsp. paratuberculosis
ggaccuuggugucggcga

SEQ ID NO: 1002041 - RNA, 21 nt, Mycobacterium avium subsp. paratuberculosis
ggaccuuggugucggcgagcu

SEQ ID NO: 1002042 - RNA, 17 nt, Mycobacterium avium subsp. paratuberculosis
ggacgaagugcccgccu

SEQ ID NO: 1002043 - RNA, 20 nt, Mycobacterium avium subsp. paratuberculosis
ggacgaaacccggcggacgg

SEQ ID NO: 1002044 - RNA, 14 nt, Mycobacterium avium subsp. paratuberculosis
ggaccucgaagcag

SEQ ID NO: 1002045 - RNA, 13 nt, Mycobacterium avium subsp. paratuberculosis
ggaccgugccgga

SEQ ID NO: 1002046 - RNA, 18 nt, Mycobacterium avium subsp. paratuberculosis
ggaccggugcggucccgg

SEQ ID NO: 1002047 - RNA, 19 nt, Mycobacterium avium subsp. paratuberculosis
ggaccccagugcaggcuga

SEQ ID NO: 1002048 - RNA, 16 nt, Mycobacterium avium subsp. paratuberculosis
ggacccggaggcggcg

SEQ ID NO: 1002049 - RNA, 18 nt, Mycobacterium avium subsp. paratuberculosis
ggacccggaggcggcggg

SEQ ID NO: 1002050 - RNA, 20 nt, Mycobacterium avium subsp. paratuberculosis
ggaccgccgcggcgcccggc

SEQ ID NO: 1002051 - RNA, 16 nt, Mycobacterium avium subsp. paratuberculosis
ggaccgccgcggcggc

SEQ ID NO: 1002052 - RNA, 14 nt, Mycobacterium avium subsp. paratuberculosis
ggacccuggccagc

SEQ ID NO: 1002053 - RNA, 15 nt, Mycobacterium avium subsp. paratuberculosis
ggacccuggccagca

SEQ ID NO: 1002054 - RNA, 17 nt, Mycobacterium avium subsp. paratuberculosis
ggacccuggccagcacc

SEQ ID NO: 1002055 - RNA, 15 nt, Mycobacterium avium subsp. paratuberculosis
ggaccgagcgcgcga

SEQ ID NO: 1002056 - RNA, 13 nt, Mycobacterium avium subsp. paratuberculosis
ggaccgcgcgccg

SEQ ID NO: 1002057 - RNA, 20 nt, Mycobacterium avium subsp. paratuberculosis
ggaccgcgcgggccagcgcc

SEQ ID NO: 1002058 - RNA, 12 nt, Mycobacterium avium subsp. paratuberculosis
ggaccggccagc

SEQ ID NO: 1002059 - RNA, 22 nt, Mycobacterium avium subsp. paratuberculosis
ggaccgcggucgggucccggca

SEQ ID NO: 1002060 - RNA, 19 nt, Mycobacterium avium subsp. paratuberculosis
ggaccgcgugugcccgccu

SEQ ID NO: 1002061 - RNA, 12 nt, Mycobacterium avium subsp. paratuberculosis
ggaccgggcggg

SEQ ID NO: 1002062 - RNA, 19 nt, Mycobacterium avium subsp. paratuberculosis
ggaccggggacuugacgau

SEQ ID NO: 1002063 - RNA, 14 nt, Mycobacterium avium subsp. paratuberculosis
ggaccgguaggcgc

SEQ ID NO: 1002064 - RNA, 21 nt, Mycobacterium avium subsp. paratuberculosis
cugccaagauugggccacaga

SEQ ID NO: 1002065 - RNA, 15 nt, Mycobacterium avium subsp. paratuberculosis
cugccagaucuguau

SEQ ID NO: 1002066 - RNA, 13 nt, Mycobacterium avium subsp. paratuberculosis
cugcccaggucca

SEQ ID NO: 1002067 - RNA, 16 nt, Mycobacterium avium subsp. paratuberculosis
cugcccagguccaccg

SEQ ID NO: 1002068 - RNA, 22 nt, Mycobacterium avium subsp. paratuberculosis
cugcccagcggcacgggcaccg

SEQ ID NO: 1002069 - RNA, 15 nt, Mycobacterium avium subsp. paratuberculosis
cugccccagggacca

SEQ ID NO: 1002070 - RNA, 21 nt, Mycobacterium avium subsp. paratuberculosis
cugccccagggaccaguggug

SEQ ID NO: 1002071 - RNA, 16 nt, Mycobacterium avium subsp. paratuberculosis
cugcccagccaucugc

SEQ ID NO: 1002072 - RNA, 18 nt, Mycobacterium avium subsp. paratuberculosis
cugcccgcgaucgccagc

SEQ ID NO: 1002073 - RNA, 14 nt, Mycobacterium avium subsp. paratuberculosis
cugcccgcggccgc

SEQ ID NO: 1002074 - RNA, 17 nt, Mycobacterium avium subsp. paratuberculosis
cugcccgcggccgccgc

SEQ ID NO: 1002075 - RNA, 17 nt, Mycobacterium avium subsp. paratuberculosis
cugcccgcggguggccu

SEQ ID NO: 1002076 - RNA, 19 nt, Mycobacterium avium subsp. paratuberculosis
cugcccgcggguggccuuc

SEQ ID NO: 1002077 - RNA, 13 nt, Mycobacterium avium subsp. paratuberculosis
cugcccggccagc

SEQ ID NO: 1002078 - RNA, 17 nt, Mycobacterium avium subsp. paratuberculosis
cugccgcaacgggccgc

SEQ ID NO: 1002079 - RNA, 18 nt, Mycobacterium avium subsp. paratuberculosis
cugcccgccgccgaugcu

SEQ ID NO: 1002080 - RNA, 14 nt, Mycobacterium avium subsp. paratuberculosis
cugcccgaccgcgc

SEQ ID NO: 1002081 - RNA, 15 nt, Mycobacterium avium subsp. paratuberculosis
cugcaguucgaucac

SEQ ID NO: 1002082 - RNA, 12 nt, Mycobacterium avium subsp. paratuberculosis
cugcaguagccg

SEQ ID NO: 1002083 - RNA, 20 nt, Mycobacterium avium subsp. paratuberculosis
cugcaguagccggccagcuc

SEQ ID NO: 1002084 - RNA, 23 nt, Mycobacterium avium subsp. paratuberculosis
cugcagguagguggccagccggg

SEQ ID NO: 1002085 - RNA, 16 nt, Mycobacterium avium subsp. paratuberculosis
cugcauccgcagcacc

SEQ ID NO: 1002086 - RNA, 20 nt, Mycobacterium avium subsp. paratuberculosis
cugcauccgcagcaccaggg

SEQ ID NO: 1002087 - RNA, 23 nt, Mycobacterium avium subsp. paratuberculosis
cugcaucaugccgcccaucaccc

SEQ ID NO: 1002088 - RNA, 22 nt, Mycobacterium avium subsp. paratuberculosis
cugcaugcgcugcuuagccccu

SEQ ID NO: 1002089 - RNA, 14 nt, Mycobacterium avium subsp. paratuberculosis
cugcaugccgggca

SEQ ID NO: 1002090 - RNA, 14 nt, Mycobacterium avium subsp. paratuberculosis
cugccuggccacgu

SEQ ID NO: 1002091 - RNA, 21 nt, Mycobacterium avium subsp. paratuberculosis
cugcgcacguagcccagcgcg

SEQ ID NO: 1002092 - RNA, 21 nt, Mycobacterium avium subsp. paratuberculosis
cugcgaucgccgacgccagca

SEQ ID NO: 1002093 - RNA, 18 nt, Mycobacterium avium subsp. paratuberculosis
cugcgaugauggucaccg

SEQ ID NO: 1002094 - RNA, 19 nt, Mycobacterium avium subsp. paratuberculosis
cugcgcaacaccucggcga

SEQ ID NO: 1002095 - RNA, 21 nt, Mycobacterium avium subsp. paratuberculosis
cugcgcaacaccucggcgacg

SEQ ID NO: 1002096 - RNA, 12 nt, Mycobacterium avium subsp. paratuberculosis
cugcgcaccgcc

SEQ ID NO: 1002097 - RNA, 15 nt, Mycobacterium avium subsp. paratuberculosis
cugcgcaccgccagc

SEQ ID NO: 1002098 - RNA, 20 nt, Mycobacterium avium subsp. paratuberculosis
cugccggggcgcagcugcag

SEQ ID NO: 1002099 - RNA, 22 nt, Mycobacterium avium subsp. paratuberculosis
cugccggggcgcagcugcagcu

SEQ ID NO: 1002100 - RNA, 17 nt, Mycobacterium avium subsp. paratuberculosis
cugccguucggccagcg

SEQ ID NO: 1002101 - RNA, 17 nt, Mycobacterium avium subsp. paratuberculosis
cugccggugcugcucga

SEQ ID NO: 1002102 - RNA, 18 nt, Mycobacterium avium subsp. paratuberculosis
cugccggugcugcucgag

SEQ ID NO: 1002103 - RNA, 19 nt, Mycobacterium avium subsp. paratuberculosis
cugccggggugcagcacca

SEQ ID NO: 1002104 - RNA, 13 nt, Mycobacterium avium subsp. paratuberculosis
cugcgccggcggu

SEQ ID NO: 1002105 - RNA, 19 nt, Mycobacterium avium subsp. paratuberculosis
cugcgccgucaucgacacc

SEQ ID NO: 1002106 - RNA, 20 nt, Mycobacterium avium subsp. paratuberculosis
cugcgccgugaagggcccgc

SEQ ID NO: 1002107 - RNA, 23 nt, Mycobacterium avium subsp. paratuberculosis
cugcgcgaacagcgaagccacgg

SEQ ID NO: 1002108 - RNA, 16 nt, Mycobacterium avium subsp. paratuberculosis
cugcgcgaccucuucg

SEQ ID NO: 1002109 - RNA, 15 nt, Mycobacterium avium subsp. paratuberculosis
cugcgcgacggcgcu

SEQ ID NO: 1002110 - RNA, 14 nt, Mycobacterium avium subsp. paratuberculosis
cugcgcggcacggg

SEQ ID NO: 1002111 - RNA, 10 nt, Mycobacterium avium subsp. paratuberculosis
cugcgcggcg

SEQ ID NO: 1002112 - RNA, 15 nt, Mycobacterium avium subsp. paratuberculosis
cugcgcggcggcggc

SEQ ID NO: 1002113 - RNA, 19 nt, Mycobacterium avium subsp. paratuberculosis
cugcgcgggcgcggacagc

SEQ ID NO: 1002114 - RNA, 16 nt, Mycobacterium avium subsp. paratuberculosis
cugcgcgggcgcggcc

SEQ ID NO: 1002115 - RNA, 16 nt, Mycobacterium avium subsp. paratuberculosis
cugcgcgucgagcagc

SEQ ID NO: 1002116 - RNA, 17 nt, Mycobacterium avium subsp. paratuberculosis
cugcgcgucggccgcac

SEQ ID NO: 1002117 - RNA, 20 nt, Mycobacterium avium subsp. paratuberculosis
cugcgcgccggcggccgccg

SEQ ID NO: 1002118 - RNA, 15 nt, Mycobacterium avium subsp. paratuberculosis
cugcgcgaccaaacg

SEQ ID NO: 1002119 - RNA, 14 nt, Mycobacterium avium subsp. paratuberculosis
cugcgcgccccggc

SEQ ID NO: 1002120 - RNA, 15 nt, Mycobacterium avium subsp. paratuberculosis
cugcgcgccccggcc

SEQ ID NO: 1002121 - RNA, 17 nt, Mycobacterium avium subsp. paratuberculosis
cugcgcccacaggucca

SEQ ID NO: 1002122 - RNA, 23 nt, Mycobacterium avium subsp. paratuberculosis
cugcgcccacagguccagcgucc

SEQ ID NO: 1002123 - RNA, 18 nt, Mycobacterium avium subsp. paratuberculosis
cugcgccggggccgcggc

SEQ ID NO: 1002124 - RNA, 19 nt, Mycobacterium avium subsp. paratuberculosis
cugcgccggggccgcggcu

SEQ ID NO: 1002125 - RNA, 22 nt, Mycobacterium avium subsp. paratuberculosis
cugcgccggggccgcggcucgc

SEQ ID NO: 1002126 - RNA, 14 nt, Mycobacterium avium subsp. paratuberculosis
cugcgccgcggugc

SEQ ID NO: 1002127 - RNA, 17 nt, Mycobacterium avium subsp. paratuberculosis
cugcgccgccuccgggc

SEQ ID NO: 1002128 - RNA, 17 nt, Mycobacterium avium subsp. paratuberculosis
cugcgccacaacuggcc

SEQ ID NO: 1002129 - RNA, 15 nt, Mycobacterium avium subsp. paratuberculosis
cugcgccagcagcag

SEQ ID NO: 1002130 - RNA, 14 nt, Mycobacterium avium subsp. paratuberculosis
cugcgccagcucca

SEQ ID NO: 1002131 - RNA, 15 nt, Mycobacterium avium subsp. paratuberculosis
cugcgccagcuccag

SEQ ID NO: 1002132 - RNA, 16 nt, Mycobacterium avium subsp. paratuberculosis
cugcgccagcugggug

SEQ ID NO: 1002133 - RNA, 15 nt, Mycobacterium avium subsp. paratuberculosis
cugcgucaucggcuc

SEQ ID NO: 1002134 - RNA, 17 nt, Mycobacterium avium subsp. paratuberculosis
cugcguccggcccggcg

SEQ ID NO: 1002135 - RNA, 14 nt, Mycobacterium avium subsp. paratuberculosis
cugcggugggcgcu

SEQ ID NO: 1002136 - RNA, 18 nt, Mycobacterium avium subsp. paratuberculosis
cugcggugugggcagcca

SEQ ID NO: 1002137 - RNA, 16 nt, Mycobacterium avium subsp. paratuberculosis
cugcgucacuccucga

SEQ ID NO: 1002138 - RNA, 18 nt, Mycobacterium avium subsp. paratuberculosis
cugcucaccgagcugggc

SEQ ID NO: 1002139 - RNA, 21 nt, Mycobacterium avium subsp. paratuberculosis
cugcucaccgagcugggccgg

SEQ ID NO: 1002140 - RNA, 23 nt, Mycobacterium avium subsp. paratuberculosis
cugcggcgucgucuuggccugcu

SEQ ID NO: 1002141 - RNA, 13 nt, Mycobacterium avium subsp. paratuberculosis
cugcggcgccggg

SEQ ID NO: 1002142 - RNA, 15 nt, Mycobacterium avium subsp. paratuberculosis
cugcggcgccgggca

SEQ ID NO: 1002143 - RNA, 13 nt, Mycobacterium avium subsp. paratuberculosis
cugcggcggccgc

SEQ ID NO: 1002144 - RNA, 14 nt, Mycobacterium avium subsp. paratuberculosis
cugcggcggccgca

SEQ ID NO: 1002145 - RNA, 16 nt, Mycobacterium avium subsp. paratuberculosis
cugcgggccaggcggg

SEQ ID NO: 1002146 - RNA, 14 nt, Mycobacterium avium subsp. paratuberculosis
cugcgggcccaccg

SEQ ID NO: 1002147 - RNA, 13 nt, Mycobacterium avium subsp. paratuberculosis
cugcgggcccagc

SEQ ID NO: 1002148 - RNA, 14 nt, Mycobacterium avium subsp. paratuberculosis
cugcggugcgccca

SEQ ID NO: 1002149 - RNA, 14 nt, Mycobacterium avium subsp. paratuberculosis
cugcgggaccagcg

SEQ ID NO: 1002150 - RNA, 21 nt, Mycobacterium avium subsp. paratuberculosis
cugcggcucgucggcgaacag

SEQ ID NO: 1002151 - RNA, 12 nt, Mycobacterium avium subsp. paratuberculosis
cugcgcuaccag

SEQ ID NO: 1002152 - RNA, 16 nt, Mycobacterium avium subsp. paratuberculosis
cugcgcucagcacgcg

SEQ ID NO: 1002153 - RNA, 13 nt, Mycobacterium avium subsp. paratuberculosis
cugcugcagcgcc

SEQ ID NO: 1002154 - RNA, 14 nt, Mycobacterium avium subsp. paratuberculosis
cugcugcagcgccc

SEQ ID NO: 1002155 - RNA, 19 nt, Mycobacterium avium subsp. paratuberculosis
cugcugcagcgcccgggcc

SEQ ID NO: 1002156 - RNA, 18 nt, Mycobacterium avium subsp. paratuberculosis
cugcugcacguccgccuc

SEQ ID NO: 1002157 - RNA, 19 nt, Mycobacterium avium subsp. paratuberculosis
cugcugcacguccgccucc

SEQ ID NO: 1002158 - RNA, 18 nt, Mycobacterium avium subsp. paratuberculosis
cugcugcacgucgccggc

SEQ ID NO: 1002159 - RNA, 15 nt, Mycobacterium avium subsp. paratuberculosis
cugcugccgccgcag

SEQ ID NO: 1002160 - RNA, 16 nt, Mycobacterium avium subsp. paratuberculosis
cugcugccgccgcagc

SEQ ID NO: 1002161 - RNA, 21 nt, Mycobacterium avium subsp. paratuberculosis
cugcugcgcggcacgggccgu

SEQ ID NO: 1002162 - RNA, 12 nt, Mycobacterium avium subsp. paratuberculosis
cugcucgaaggc

SEQ ID NO: 1002163 - RNA, 17 nt, Mycobacterium avium subsp. paratuberculosis
cugcucgaaggcaacuc

SEQ ID NO: 1002164 - RNA, 20 nt, Mycobacterium avium subsp. paratuberculosis
cugcucgagcaucuccagcc

SEQ ID NO: 1002165 - RNA, 23 nt, Mycobacterium avium subsp. paratuberculosis
cugcucgagggccuccaccacca

SEQ ID NO: 1002166 - RNA, 14 nt, Mycobacterium avium subsp. paratuberculosis
cugcucggugucga

SEQ ID NO: 1002167 - RNA, 17 nt, Mycobacterium avium subsp. paratuberculosis
cugcucgaucucggcca

SEQ ID NO: 1002168 - RNA, 22 nt, Mycobacterium avium subsp. paratuberculosis
cugcucguccuggcgcuggugc

SEQ ID NO: 1002169 - RNA, 14 nt, Mycobacterium avium subsp. paratuberculosis
cuggcauccgucgg

SEQ ID NO: 1002170 - RNA, 13 nt, Mycobacterium avium subsp. paratuberculosis
cuggccaggcuca

SEQ ID NO: 1002171 - RNA, 19 nt, Mycobacterium avium subsp. paratuberculosis
cuggccagcaccagcgcgc

SEQ ID NO: 1002172 - RNA, 14 nt, Mycobacterium avium subsp. paratuberculosis
cuggaucagccagu

SEQ ID NO: 1002173 - RNA, 22 nt, Mycobacterium avium subsp. paratuberculosis
cuggauccccucacuccagcgg

SEQ ID NO: 1002174 - RNA, 20 nt, Mycobacterium avium subsp. paratuberculosis
cuggaucccgaacugccgcg

SEQ ID NO: 1002175 - RNA, 15 nt, Mycobacterium avium subsp. paratuberculosis
cuggaucgcgcaggu

SEQ ID NO: 1002176 - RNA, 16 nt, Mycobacterium avium subsp. paratuberculosis
cuggacgccgcacgcg

SEQ ID NO: 1002177 - RNA, 20 nt, Mycobacterium avium subsp. paratuberculosis
cuggacguuggggugguugu

SEQ ID NO: 1002178 - RNA, 19 nt, Mycobacterium avium subsp. paratuberculosis
cuggacggcccgacgacgc

SEQ ID NO: 1002179 - RNA, 21 nt, Mycobacterium avium subsp. paratuberculosis
cugcuuugccuuagcccggcc

SEQ ID NO: 1002180 - RNA, 18 nt, Mycobacterium avium subsp. paratuberculosis
cuggaacagcgggccggc

SEQ ID NO: 1002181 - RNA, 21 nt, Mycobacterium avium subsp. paratuberculosis
cuggacauucacgaggccggg

SEQ ID NO: 1002182 - RNA, 13 nt, Mycobacterium avium subsp. paratuberculosis
cugcugcucggcc

SEQ ID NO: 1002183 - RNA, 15 nt, Mycobacterium avium subsp. paratuberculosis
cugcugcucggccgc

SEQ ID NO: 1002184 - RNA, 14 nt, Mycobacterium avium subsp. paratuberculosis
cugcugcuucuggg

SEQ ID NO: 1002185 - RNA, 23 nt, Mycobacterium avium subsp. paratuberculosis
cugcaacuggucgugcagcaccg

SEQ ID NO: 1002186 - RNA, 17 nt, Mycobacterium avium subsp. paratuberculosis
cugcaagggcuugggcg

SEQ ID NO: 1002187 - RNA, 14 nt, Mycobacterium avium subsp. paratuberculosis
cugcaaggcccccg

SEQ ID NO: 1002188 - RNA, 19 nt, Mycobacterium avium subsp. paratuberculosis
cugcaacgcgucggcgccg

SEQ ID NO: 1002189 - RNA, 14 nt, Mycobacterium avium subsp. paratuberculosis
cugaucugcggcac

SEQ ID NO: 1002190 - RNA, 16 nt, Mycobacterium avium subsp. paratuberculosis
cugaucugcggcacca

SEQ ID NO: 1002191 - RNA, 23 nt, Mycobacterium avium subsp. paratuberculosis
cugauugcccuuggacaccugca

SEQ ID NO: 1002192 - RNA, 20 nt, Mycobacterium avium subsp. paratuberculosis
cugaucgagcucggccuuga

SEQ ID NO: 1002193 - RNA, 23 nt, Mycobacterium avium subsp. paratuberculosis
cugaucgcgauccgggcgccggc

SEQ ID NO: 1002194 - RNA, 17 nt, Mycobacterium avium subsp. paratuberculosis
cugaucgcggcgagcag

SEQ ID NO: 1002195 - RNA, 22 nt, Mycobacterium avium subsp. paratuberculosis
cugaucgcggcgagcagcgcga

SEQ ID NO: 1002196 - RNA, 23 nt, Mycobacterium avium subsp. paratuberculosis
cugaucgcgucgacggcgccgga

SEQ ID NO: 1002197 - RNA, 14 nt, Mycobacterium avium subsp. paratuberculosis
cugaucgaguccuc

SEQ ID NO: 1002198 - RNA, 15 nt, Mycobacterium avium subsp. paratuberculosis
cugauccccagcggc

SEQ ID NO: 1002199 - RNA, 18 nt, Mycobacterium avium subsp. paratuberculosis
cugauccccagcggcacg

SEQ ID NO: 1002200 - RNA, 20 nt, Mycobacterium avium subsp. paratuberculosis
cugaucaccgcgcucggcga

SEQ ID NO: 1002201 - RNA, 16 nt, Mycobacterium avium subsp. paratuberculosis
cugaucacaugggcga

SEQ ID NO: 1002202 - RNA, 20 nt, Mycobacterium avium subsp. paratuberculosis
cugauacgacguccgggccg

SEQ ID NO: 1002203 - RNA, 13 nt, Mycobacterium avium subsp. paratuberculosis
cugaaggcgcggg

SEQ ID NO: 1002204 - RNA, 14 nt, Mycobacterium avium subsp. paratuberculosis
cugacaaagcacaa

SEQ ID NO: 1002205 - RNA, 19 nt, Mycobacterium avium subsp. paratuberculosis
cugacccgcacgaaaugcg

SEQ ID NO: 1002206 - RNA, 18 nt, Mycobacterium avium subsp. paratuberculosis
cugacccgccgcaacagc

SEQ ID NO: 1002207 - RNA, 24 nt, Mycobacterium avium subsp. paratuberculosis
cugaccgugcuuggcggcgcacuc

SEQ ID NO: 1002208 - RNA, 18 nt, Mycobacterium avium subsp. paratuberculosis
cugaccuucucccgcggc

SEQ ID NO: 1002209 - RNA, 20 nt, Mycobacterium avium subsp. paratuberculosis
cugaccuucucccgcggcag

SEQ ID NO: 1002210 - RNA, 13 nt, Mycobacterium avium subsp. paratuberculosis
cugaccagcguga

SEQ ID NO: 1002211 - RNA, 19 nt, Mycobacterium avium subsp. paratuberculosis
cugaccagcgugaccucga

SEQ ID NO: 1002212 - RNA, 21 nt, Mycobacterium avium subsp. paratuberculosis
cugaccagcccgcucagagcu

SEQ ID NO: 1002213 - RNA, 18 nt, Mycobacterium avium subsp. paratuberculosis
cugagcaaccgguucgga

SEQ ID NO: 1002214 - RNA, 17 nt, Mycobacterium avium subsp. paratuberculosis
cugagcaggcuggcaug

SEQ ID NO: 1002215 - RNA, 18 nt, Mycobacterium avium subsp. paratuberculosis
cugagcacggugggcgcc

SEQ ID NO: 1002216 - RNA, 16 nt, Mycobacterium avium subsp. paratuberculosis
cugagcaccggggucu

SEQ ID NO: 1002217 - RNA, 14 nt, Mycobacterium avium subsp. paratuberculosis
cugagcagcagguc

SEQ ID NO: 1002218 - RNA, 18 nt, Mycobacterium avium subsp. paratuberculosis
cugagcagcccgaccacc

SEQ ID NO: 1002219 - RNA, 19 nt, Mycobacterium avium subsp. paratuberculosis
cugagcagcccgaccaccu

SEQ ID NO: 1002220 - RNA, 16 nt, Mycobacterium avium subsp. paratuberculosis
cugacugagucaagcc

SEQ ID NO: 1002221 - RNA, 21 nt, Mycobacterium avium subsp. paratuberculosis
cugacugagucaagccggcau

SEQ ID NO: 1002222 - RNA, 13 nt, Mycobacterium avium subsp. paratuberculosis
cugacggccauga

SEQ ID NO: 1002223 - RNA, 13 nt, Mycobacterium avium subsp. paratuberculosis
cugacgcggcggg

SEQ ID NO: 1002224 - RNA, 14 nt, Mycobacterium avium subsp. paratuberculosis
cugacgcggcgggc

SEQ ID NO: 1002225 - RNA, 18 nt, Mycobacterium avium subsp. paratuberculosis
cugaagaagaugggcgcc

SEQ ID NO: 1002226 - RNA, 13 nt, Mycobacterium avium subsp. paratuberculosis
cugaacugcucga

SEQ ID NO: 1002227 - RNA, 16 nt, Mycobacterium avium subsp. paratuberculosis
cugaacgggcagccac

SEQ ID NO: 1002228 - RNA, 17 nt, Mycobacterium avium subsp. paratuberculosis
cugaaccgguagucguc

SEQ ID NO: 1002229 - RNA, 21 nt, Mycobacterium avium subsp. paratuberculosis
cugaacgcggugggcaccagc

SEQ ID NO: 1002230 - RNA, 12 nt, Mycobacterium avium subsp. paratuberculosis
cugaacgccagc

SEQ ID NO: 1002231 - RNA, 14 nt, Mycobacterium avium subsp. paratuberculosis
cugaacacgaaccc

SEQ ID NO: 1002232 - RNA, 16 nt, Mycobacterium avium subsp. paratuberculosis
cugaaccaccgcgccc

SEQ ID NO: 1002233 - RNA, 23 nt, Mycobacterium avium subsp. paratuberculosis
cucuucgacccgguagcgcagca

SEQ ID NO: 1002234 - RNA, 20 nt, Mycobacterium avium subsp. paratuberculosis
cucuucgcagcgcucagugu

SEQ ID NO: 1002235 - RNA, 15 nt, Mycobacterium avium subsp. paratuberculosis
cucuucgccggacag

SEQ ID NO: 1002236 - RNA, 19 nt, Mycobacterium avium subsp. paratuberculosis
cucuucgccggacagccgg

SEQ ID NO: 1002237 - RNA, 20 nt, Mycobacterium avium subsp. paratuberculosis
cucuucgcggauccgggccg

SEQ ID NO: 1002238 - RNA, 20 nt, Mycobacterium avium subsp. paratuberculosis
cucuucgucggccggcaguu

SEQ ID NO: 1002239 - RNA, 17 nt, Mycobacterium avium subsp. paratuberculosis
cucuucggggguggcca

SEQ ID NO: 1002240 - RNA, 20 nt, Mycobacterium avium subsp. paratuberculosis
cucuugaugcagcgccucgg

SEQ ID NO: 1002241 - RNA, 14 nt, Mycobacterium avium subsp. paratuberculosis
cucuucuuccugcu

SEQ ID NO: 1002242 - RNA, 13 nt, Mycobacterium avium subsp. paratuberculosis
cucuugggacugg

SEQ ID NO: 1002243 - RNA, 23 nt, Mycobacterium avium subsp. paratuberculosis
cucucgcguucgcuuucgccggg

SEQ ID NO: 1002244 - RNA, 14 nt, Mycobacterium avium subsp. paratuberculosis
cucucgccggucag

SEQ ID NO: 1002245 - RNA, 14 nt, Mycobacterium avium subsp. paratuberculosis
cucugccugcagga

SEQ ID NO: 1002246 - RNA, 17 nt, Mycobacterium avium subsp. paratuberculosis
cucugccugcaggaugg

SEQ ID NO: 1002247 - RNA, 22 nt, Mycobacterium avium subsp. paratuberculosis
cucugcgaccacccggacgaug

SEQ ID NO: 1002248 - RNA, 17 nt, Mycobacterium avium subsp. paratuberculosis
cucgucggcgagcagca

SEQ ID NO: 1002249 - RNA, 24 nt, Mycobacterium avium subsp. paratuberculosis
cucgucgcggaggaugccggccag

SEQ ID NO: 1002250 - RNA, 19 nt, Mycobacterium avium subsp. paratuberculosis
cucgucgcgguugaucaca

SEQ ID NO: 1002251 - RNA, 13 nt, Mycobacterium avium subsp. paratuberculosis
cucgucgcccggc

SEQ ID NO: 1002252 - RNA, 23 nt, Mycobacterium avium subsp. paratuberculosis
cucgucgcccggcguccagugca

SEQ ID NO: 1002253 - RNA, 14 nt, Mycobacterium avium subsp. paratuberculosis
cucucacggcggua

SEQ ID NO: 1002254 - RNA, 15 nt, Mycobacterium avium subsp. paratuberculosis
cucguagcggccgca

SEQ ID NO: 1002255 - RNA, 19 nt, Mycobacterium avium subsp. paratuberculosis
cucguaguuggggccggcc

SEQ ID NO: 1002256 - RNA, 23 nt, Mycobacterium avium subsp. paratuberculosis
cucguaguuggggccggccgccc

SEQ ID NO: 1002257 - RNA, 19 nt, Mycobacterium avium subsp. paratuberculosis
cucggugaucugcaccagc

SEQ ID NO: 1002258 - RNA, 14 nt, Mycobacterium avium subsp. paratuberculosis
cucggugagcagaa

SEQ ID NO: 1002259 - RNA, 14 nt, Mycobacterium avium subsp. paratuberculosis
cucggugagcagcu

SEQ ID NO: 1002260 - RNA, 14 nt, Mycobacterium avium subsp. paratuberculosis
cucggugagccgcu

SEQ ID NO: 1002261 - RNA, 17 nt, Mycobacterium avium subsp. paratuberculosis
cucgucagcgcgggcca

SEQ ID NO: 1002262 - RNA, 21 nt, Mycobacterium avium subsp. paratuberculosis
cucgucagcgcgggccagcag

SEQ ID NO: 1002263 - RNA, 22 nt, Mycobacterium avium subsp. paratuberculosis
cucgucagcgcgggccagcagu

SEQ ID NO: 1002264 - RNA, 14 nt, Mycobacterium avium subsp. paratuberculosis
cucguccagcccgg

SEQ ID NO: 1002265 - RNA, 18 nt, Mycobacterium avium subsp. paratuberculosis
cucguccagcgucgcggc

SEQ ID NO: 1002266 - RNA, 17 nt, Mycobacterium avium subsp. paratuberculosis
cucguccagggacuccg

SEQ ID NO: 1002267 - RNA, 17 nt, Mycobacterium avium subsp. paratuberculosis
cucguccaggguggcca

SEQ ID NO: 1002268 - RNA, 23 nt, Mycobacterium avium subsp. paratuberculosis
cucgucgagccggccggacaccg

SEQ ID NO: 1002269 - RNA, 20 nt, Mycobacterium avium subsp. paratuberculosis
cucguccucgaaagccgcug

SEQ ID NO: 1002270 - RNA, 14 nt, Mycobacterium avium subsp. paratuberculosis
cucguccugggccg

SEQ ID NO: 1002271 - RNA, 20 nt, Mycobacterium avium subsp. paratuberculosis
cucguccgacagcgccugcc

SEQ ID NO: 1002272 - RNA, 15 nt, Mycobacterium avium subsp. paratuberculosis
cucgucgaucgcggc

SEQ ID NO: 1002273 - RNA, 22 nt, Mycobacterium avium subsp. paratuberculosis
cucgucgaugucggcggcccgg

SEQ ID NO: 1002274 - RNA, 23 nt, Mycobacterium avium subsp. paratuberculosis
cucgucgcacaaccgggccaacg

SEQ ID NO: 1002275 - RNA, 23 nt, Mycobacterium avium subsp. paratuberculosis
cucgggauagccgagcggcgcca

SEQ ID NO: 1002276 - RNA, 16 nt, Mycobacterium avium subsp. paratuberculosis
cucgggaaaugcgucg

SEQ ID NO: 1002277 - RNA, 19 nt, Mycobacterium avium subsp. paratuberculosis
cucggcgagguagaccgcc

SEQ ID NO: 1002278 - RNA, 16 nt, Mycobacterium avium subsp. paratuberculosis
cucggccuucggggug

SEQ ID NO: 1002279 - RNA, 20 nt, Mycobacterium avium subsp. paratuberculosis
cucggcgaccagcgacggca

SEQ ID NO: 1002280 - RNA, 21 nt, Mycobacterium avium subsp. paratuberculosis
cucggcgaccgcccggggcgc

SEQ ID NO: 1002281 - RNA, 22 nt, Mycobacterium avium subsp. paratuberculosis
cucggcgaccgccgguggggug

SEQ ID NO: 1002282 - RNA, 13 nt, Mycobacterium avium subsp. paratuberculosis
cucggcgaccugc

SEQ ID NO: 1002283 - RNA, 14 nt, Mycobacterium avium subsp. paratuberculosis
cucggcgagcaccg

SEQ ID NO: 1002284 - RNA, 17 nt, Mycobacterium avium subsp. paratuberculosis
cucggcgagcaccgugc

SEQ ID NO: 1002285 - RNA, 22 nt, Mycobacterium avium subsp. paratuberculosis
cucggcgagcaccgugccgucg

SEQ ID NO: 1002286 - RNA, 16 nt, Mycobacterium avium subsp. paratuberculosis
cucggucuccuccagg

SEQ ID NO: 1002287 - RNA, 16 nt, Mycobacterium avium subsp. paratuberculosis
cucggucucguccagu

SEQ ID NO: 1002288 - RNA, 17 nt, Mycobacterium avium subsp. paratuberculosis
cucggucuugaucaggu

SEQ ID NO: 1002289 - RNA, 13 nt, Mycobacterium avium subsp. paratuberculosis
cucggugaagccg

SEQ ID NO: 1002290 - RNA, 18 nt, Mycobacterium avium subsp. paratuberculosis
cucggugaagccgcggac

SEQ ID NO: 1002291 - RNA, 20 nt, Mycobacterium avium subsp. paratuberculosis
cucggucgccacggccggca

SEQ ID NO: 1002292 - RNA, 16 nt, Mycobacterium avium subsp. paratuberculosis
cucggucgccagcacc

SEQ ID NO: 1002293 - RNA, 13 nt, Mycobacterium avium subsp. paratuberculosis
cucggucagccgg

SEQ ID NO: 1002294 - RNA, 18 nt, Mycobacterium avium subsp. paratuberculosis
cucggucagccgggcggc

SEQ ID NO: 1002295 - RNA, 13 nt, Mycobacterium avium subsp. paratuberculosis
cucggucaggauc

SEQ ID NO: 1002296 - RNA, 13 nt, Mycobacterium avium subsp. paratuberculosis
cucggucaggccg

SEQ ID NO: 1002297 - RNA, 15 nt, Mycobacterium avium subsp. paratuberculosis
cucgggcggccgcgg

SEQ ID NO: 1002298 - RNA, 20 nt, Mycobacterium avium subsp. paratuberculosis
cucgggcgcgaacagcgccg

SEQ ID NO: 1002299 - RNA, 15 nt, Mycobacterium avium subsp. paratuberculosis
cucgggcgacgacgc

SEQ ID NO: 1002300 - RNA, 13 nt, Mycobacterium avium subsp. paratuberculosis
cucgggcaccacg

SEQ ID NO: 1002301 - RNA, 17 nt, Mycobacterium avium subsp. paratuberculosis
cucggaggaaccgugcg

SEQ ID NO: 1002302 - RNA, 20 nt, Mycobacterium avium subsp. paratuberculosis
cucggaggugccgcgcggca

SEQ ID NO: 1002303 - RNA, 18 nt, Mycobacterium avium subsp. paratuberculosis
cucggcaccagagcgccg

SEQ ID NO: 1002304 - RNA, 20 nt, Mycobacterium avium subsp. paratuberculosis
cucggcaccagagcgccgga

SEQ ID NO: 1002305 - RNA, 22 nt, Mycobacterium avium subsp. paratuberculosis
cucggcaggcggggaaggacuc

SEQ ID NO: 1002306 - RNA, 14 nt, Mycobacterium avium subsp. paratuberculosis
cucggccaaccggg

SEQ ID NO: 1002307 - RNA, 14 nt, Mycobacterium avium subsp. paratuberculosis
cucggccaccaccu

SEQ ID NO: 1002308 - RNA, 13 nt, Mycobacterium avium subsp. paratuberculosis
cucggccaccaga

SEQ ID NO: 1002309 - RNA, 13 nt, Mycobacterium avium subsp. paratuberculosis
cucggccaccagc

SEQ ID NO: 1002310 - RNA, 18 nt, Mycobacterium avium subsp. paratuberculosis
cucggccaccagcgcccg

SEQ ID NO: 1002311 - RNA, 19 nt, Mycobacterium avium subsp. paratuberculosis
cucggccaccaugucggcg

SEQ ID NO: 1002312 - RNA, 23 nt, Mycobacterium avium subsp. paratuberculosis
cucggccaccgcgcggugcacca

SEQ ID NO: 1002313 - RNA, 21 nt, Mycobacterium avium subsp. paratuberculosis
cucggccaccgucagcgucag

SEQ ID NO: 1002314 - RNA, 17 nt, Mycobacterium avium subsp. paratuberculosis
cucggcccgccgggcgc

SEQ ID NO: 1002315 - RNA, 13 nt, Mycobacterium avium subsp. paratuberculosis
cucggccaggcuc

SEQ ID NO: 1002316 - RNA, 13 nt, Mycobacterium avium subsp. paratuberculosis
cucggccagggug

SEQ ID NO: 1002317 - RNA, 16 nt, Mycobacterium avium subsp. paratuberculosis
cucggccagcagcacc

SEQ ID NO: 1002318 - RNA, 12 nt, Mycobacterium avium subsp. paratuberculosis
cucggccggcac

SEQ ID NO: 1002319 - RNA, 19 nt, Mycobacterium avium subsp. paratuberculosis
cucggccauccgggcggca

SEQ ID NO: 1002320 - RNA, 19 nt, Mycobacterium avium subsp. paratuberculosis
cucggccggguccuggaag

SEQ ID NO: 1002321 - RNA, 21 nt, Mycobacterium avium subsp. paratuberculosis
cucggccaccagcgcccgccc

SEQ ID NO: 1002322 - RNA, 23 nt, Mycobacterium avium subsp. paratuberculosis
cucggccaccuugcgcgggucgc

SEQ ID NO: 1002323 - RNA, 20 nt, Mycobacterium avium subsp. paratuberculosis
cucggccaggaugaaccggg

SEQ ID NO: 1002324 - RNA, 16 nt, Mycobacterium avium subsp. paratuberculosis
cucggccagccaggcc

SEQ ID NO: 1002325 - RNA, 12 nt, Mycobacterium avium subsp. paratuberculosis
cucggccagccc

SEQ ID NO: 1002326 - RNA, 14 nt, Mycobacterium avium subsp. paratuberculosis
cucggccagcgccg

SEQ ID NO: 1002327 - RNA, 18 nt, Mycobacterium avium subsp. paratuberculosis
cucggccagcgcgccgca

SEQ ID NO: 1002328 - RNA, 21 nt, Mycobacterium avium subsp. paratuberculosis
cucggccagcgcgccgcacag

SEQ ID NO: 1002329 - RNA, 23 nt, Mycobacterium avium subsp. paratuberculosis
cucggccagcgcgccgcacagcc

SEQ ID NO: 1002330 - RNA, 12 nt, Mycobacterium avium subsp. paratuberculosis
cucggccagcgg

SEQ ID NO: 1002331 - RNA, 18 nt, Mycobacterium avium subsp. paratuberculosis
cucggccagcgggcggcc

SEQ ID NO: 1002332 - RNA, 20 nt, Mycobacterium avium subsp. paratuberculosis
cucggccagcgggcggcccc

SEQ ID NO: 1002333 - RNA, 19 nt, Mycobacterium avium subsp. paratuberculosis
cucggacgcccgucgcgca

SEQ ID NO: 1002334 - RNA, 16 nt, Mycobacterium avium subsp. paratuberculosis
cucgcucugccgggcc

SEQ ID NO: 1002335 - RNA, 19 nt, Mycobacterium avium subsp. paratuberculosis
cucgcuaaucgccgcgcgu

SEQ ID NO: 1002336 - RNA, 22 nt, Mycobacterium avium subsp. paratuberculosis
cucgcucaacccgucgcggguc

SEQ ID NO: 1002337 - RNA, 21 nt, Mycobacterium avium subsp. paratuberculosis
cucgcuacgcgagcugcuucg

SEQ ID NO: 1002338 - RNA, 16 nt, Mycobacterium avium subsp. paratuberculosis
cucgaucggcgcgccg

SEQ ID NO: 1002339 - RNA, 20 nt, Mycobacterium avium subsp. paratuberculosis
cucgaucggggaauccuggc

SEQ ID NO: 1002340 - RNA, 22 nt, Mycobacterium avium subsp. paratuberculosis
cucgaucgcguucugcaccagc

SEQ ID NO: 1002341 - RNA, 14 nt, Mycobacterium avium subsp. paratuberculosis
cucgaucgccaccg

SEQ ID NO: 1002342 - RNA, 14 nt, Mycobacterium avium subsp. paratuberculosis
cucgaucgccgcgc

SEQ ID NO: 1002343 - RNA, 21 nt, Mycobacterium avium subsp. paratuberculosis
cucgaucgccgcgcccagcac

SEQ ID NO: 1002344 - RNA, 18 nt, Mycobacterium avium subsp. paratuberculosis
cucgaucaccgggcggcc

SEQ ID NO: 1002345 - RNA, 19 nt, Mycobacterium avium subsp. paratuberculosis
cucgaucagagcgggccga

SEQ ID NO: 1002346 - RNA, 22 nt, Mycobacterium avium subsp. paratuberculosis
cucgaucagagcgggccgaccg

SEQ ID NO: 1002347 - RNA, 18 nt, Mycobacterium avium subsp. paratuberculosis
cucgaucaucaccaccgc

SEQ ID NO: 1002348 - RNA, 19 nt, Mycobacterium avium subsp. paratuberculosis
cucgacaggcagcccggcu

SEQ ID NO: 1002349 - RNA, 14 nt, Mycobacterium avium subsp. paratuberculosis
cucgaaagccgcug

SEQ ID NO: 1002350 - RNA, 15 nt, Mycobacterium avium subsp. paratuberculosis
cuccuuggguucggc

SEQ ID NO: 1002351 - RNA, 20 nt, Mycobacterium avium subsp. paratuberculosis
cuccuugcgccgcaacaggu

SEQ ID NO: 1002352 - RNA, 12 nt, Mycobacterium avium subsp. paratuberculosis
cucgagcaccac

SEQ ID NO: 1002353 - RNA, 23 nt, Mycobacterium avium subsp. paratuberculosis
cucgagcaacggccgcagcgacu

SEQ ID NO: 1002354 - RNA, 16 nt, Mycobacterium avium subsp. paratuberculosis
cucgacguccaggccg

SEQ ID NO: 1002355 - RNA, 19 nt, Mycobacterium avium subsp. paratuberculosis
cucgacacgggccgcgccg

SEQ ID NO: 1002356 - RNA, 18 nt, Mycobacterium avium subsp. paratuberculosis
cucgaccacgcacaccac

SEQ ID NO: 1002357 - RNA, 14 nt, Mycobacterium avium subsp. paratuberculosis
cucgaccagcgccg

SEQ ID NO: 1002358 - RNA, 16 nt, Mycobacterium avium subsp. paratuberculosis
cucgacguaggccaga

SEQ ID NO: 1002359 - RNA, 19 nt, Mycobacterium avium subsp. paratuberculosis
cucgacgccgggcagcgcg

SEQ ID NO: 1002360 - RNA, 20 nt, Mycobacterium avium subsp. paratuberculosis
cucgacgccgggcagcgcgc

SEQ ID NO: 1002361 - RNA, 14 nt, Mycobacterium avium subsp. paratuberculosis
cucgaccagcgcgc

SEQ ID NO: 1002362 - RNA, 16 nt, Mycobacterium avium subsp. paratuberculosis
cucgaccagcgcgccg

SEQ ID NO: 1002363 - RNA, 18 nt, Mycobacterium avium subsp. paratuberculosis
cucgagugccggcagccc

SEQ ID NO: 1002364 - RNA, 13 nt, Mycobacterium avium subsp. paratuberculosis
cucgaucacccag

SEQ ID NO: 1002365 - RNA, 20 nt, Mycobacterium avium subsp. paratuberculosis
cucgauaauggcggccgccg

SEQ ID NO: 1002366 - RNA, 19 nt, Mycobacterium avium subsp. paratuberculosis
cucgagcgcgucgaccagc

SEQ ID NO: 1002367 - RNA, 21 nt, Mycobacterium avium subsp. paratuberculosis
cucgagggccuccaccaccau

SEQ ID NO: 1002368 - RNA, 14 nt, Mycobacterium avium subsp. paratuberculosis
cucgagccggcgca

SEQ ID NO: 1002369 - RNA, 17 nt, Mycobacterium avium subsp. paratuberculosis
cucgagccggcgcacuc

SEQ ID NO: 1002370 - RNA, 16 nt, Mycobacterium avium subsp. paratuberculosis
cucgagccccaguucg

SEQ ID NO: 1002371 - RNA, 22 nt, Mycobacterium avium subsp. paratuberculosis
cucgagcaggaacagacacagc

SEQ ID NO: 1002372 - RNA, 14 nt, Mycobacterium avium subsp. paratuberculosis
cucgagcaucucga

SEQ ID NO: 1002373 - RNA, 20 nt, Mycobacterium avium subsp. paratuberculosis
cuccuggccccgaucaucaa

SEQ ID NO: 1002374 - RNA, 13 nt, Mycobacterium avium subsp. paratuberculosis
cuccuggccgccg

SEQ ID NO: 1002375 - RNA, 14 nt, Mycobacterium avium subsp. paratuberculosis
cuccuggccgccgu

SEQ ID NO: 1002376 - RNA, 15 nt, Mycobacterium avium subsp. paratuberculosis
cuccugcgacggcag

SEQ ID NO: 1002377 - RNA, 19 nt, Mycobacterium avium subsp. paratuberculosis
cuccugcaggaucagcacu

SEQ ID NO: 1002378 - RNA, 17 nt, Mycobacterium avium subsp. paratuberculosis
cuccugcacccguccga

SEQ ID NO: 1002379 - RNA, 16 nt, Mycobacterium avium subsp. paratuberculosis
cuccggcgccggucag

SEQ ID NO: 1002380 - RNA, 23 nt, Mycobacterium avium subsp. paratuberculosis
cuccucgaagaacgcgucccaca

SEQ ID NO: 1002381 - RNA, 21 nt, Mycobacterium avium subsp. paratuberculosis
cuccucgaucugggccaggau

SEQ ID NO: 1002382 - RNA, 13 nt, Mycobacterium avium subsp. paratuberculosis
cuccggcaggccg

SEQ ID NO: 1002383 - RNA, 20 nt, Mycobacterium avium subsp. paratuberculosis
cuccggcaggccgcggccgu

SEQ ID NO: 1002384 - RNA, 15 nt, Mycobacterium avium subsp. paratuberculosis
cuccggcccgagcac

SEQ ID NO: 1002385 - RNA, 19 nt, Mycobacterium avium subsp. paratuberculosis
cuccggcccgagcaccacc

SEQ ID NO: 1002386 - RNA, 13 nt, Mycobacterium avium subsp. paratuberculosis
cuccggcccggcg

SEQ ID NO: 1002387 - RNA, 23 nt, Mycobacterium avium subsp. paratuberculosis
cuccggcgacacguccagcucuc

SEQ ID NO: 1002388 - RNA, 14 nt, Mycobacterium avium subsp. paratuberculosis
cuccucggcggccu

SEQ ID NO: 1002389 - RNA, 16 nt, Mycobacterium avium subsp. paratuberculosis
cuccucggugaccucg

SEQ ID NO: 1002390 - RNA, 14 nt, Mycobacterium avium subsp. paratuberculosis
cuccucggccccaa

SEQ ID NO: 1002391 - RNA, 13 nt, Mycobacterium avium subsp. paratuberculosis
cuccucggccagc

SEQ ID NO: 1002392 - RNA, 15 nt, Mycobacterium avium subsp. paratuberculosis
cuccucgcugccggc

SEQ ID NO: 1002393 - RNA, 16 nt, Mycobacterium avium subsp. paratuberculosis
cuccucgcugccggcc

SEQ ID NO: 1002394 - RNA, 20 nt, Mycobacterium avium subsp. paratuberculosis
cucauguugugcaggcagcc

SEQ ID NO: 1002395 - RNA, 21 nt, Mycobacterium avium subsp. paratuberculosis
cucaugucaaugccgcagccg

SEQ ID NO: 1002396 - RNA, 17 nt, Mycobacterium avium subsp. paratuberculosis
cucaugugauuacuccu

SEQ ID NO: 1002397 - RNA, 16 nt, Mycobacterium avium subsp. paratuberculosis
cucaugguguuccacc

SEQ ID NO: 1002398 - RNA, 12 nt, Mycobacterium avium subsp. paratuberculosis
cucaugcccgcc

SEQ ID NO: 1002399 - RNA, 14 nt, Mycobacterium avium subsp. paratuberculosis
cucaugcccgccac

SEQ ID NO: 1002400 - RNA, 14 nt, Mycobacterium avium subsp. paratuberculosis
cuccagcggccgca

SEQ ID NO: 1002401 - RNA, 15 nt, Mycobacterium avium subsp. paratuberculosis
cuccagcggccgcag

SEQ ID NO: 1002402 - RNA, 19 nt, Mycobacterium avium subsp. paratuberculosis
cuccagcggccgcagcgcg

SEQ ID NO: 1002403 - RNA, 16 nt, Mycobacterium avium subsp. paratuberculosis
cuccagcggcggcccu

SEQ ID NO: 1002404 - RNA, 19 nt, Mycobacterium avium subsp. paratuberculosis
cuccagcggcggcccuucu

SEQ ID NO: 1002405 - RNA, 20 nt, Mycobacterium avium subsp. paratuberculosis
cuccagcuccgcggccagcu

SEQ ID NO: 1002406 - RNA, 18 nt, Mycobacterium avium subsp. paratuberculosis
cuccagcuaggagccugc

SEQ ID NO: 1002407 - RNA, 13 nt, Mycobacterium avium subsp. paratuberculosis
cuccagcuccucg

SEQ ID NO: 1002408 - RNA, 11 nt, Mycobacterium avium subsp. paratuberculosis
cuccaggaugu

SEQ ID NO: 1002409 - RNA, 16 nt, Mycobacterium avium subsp. paratuberculosis
cuccauccgggcggcc

SEQ ID NO: 1002410 - RNA, 17 nt, Mycobacterium avium subsp. paratuberculosis
cuccauccgggcggcca

SEQ ID NO: 1002411 - RNA, 14 nt, Mycobacterium avium subsp. paratuberculosis
cuccaguugacggc

SEQ ID NO: 1002412 - RNA, 20 nt, Mycobacterium avium subsp. paratuberculosis
cuccaguugcgaccccgccg

SEQ ID NO: 1002413 - RNA, 16 nt, Mycobacterium avium subsp. paratuberculosis
cuccagguucgccgcc

SEQ ID NO: 1002414 - RNA, 21 nt, Mycobacterium avium subsp. paratuberculosis
cuccagguucgccgcccagau

SEQ ID NO: 1002415 - RNA, 19 nt, Mycobacterium avium subsp. paratuberculosis
cuccagcuuugccagcaga

SEQ ID NO: 1002416 - RNA, 21 nt, Mycobacterium avium subsp. paratuberculosis
cuccaggguucucgcggcggc

SEQ ID NO: 1002417 - RNA, 23 nt, Mycobacterium avium subsp. paratuberculosis
cuccagguagacgaugcccagcc

SEQ ID NO: 1002418 - RNA, 14 nt, Mycobacterium avium subsp. paratuberculosis
cucccagccgccgg

SEQ ID NO: 1002419 - RNA, 19 nt, Mycobacterium avium subsp. paratuberculosis
cucccagccgccggccacc

SEQ ID NO: 1002420 - RNA, 16 nt, Mycobacterium avium subsp. paratuberculosis
cucccaacgcagcgca

SEQ ID NO: 1002421 - RNA, 21 nt, Mycobacterium avium subsp. paratuberculosis
cucccgccaauaagaucgugc

SEQ ID NO: 1002422 - RNA, 15 nt, Mycobacterium avium subsp. paratuberculosis
cucccgcgccgcggc

SEQ ID NO: 1002423 - RNA, 20 nt, Mycobacterium avium subsp. paratuberculosis
cucccgcggcagccgggcga

SEQ ID NO: 1002424 - RNA, 17 nt, Mycobacterium avium subsp. paratuberculosis
cucccgcgcgcaggcac

SEQ ID NO: 1002425 - RNA, 16 nt, Mycobacterium avium subsp. paratuberculosis
cuccgcaugcccgggc

SEQ ID NO: 1002426 - RNA, 16 nt, Mycobacterium avium subsp. paratuberculosis
cuccgccaccuccucc

SEQ ID NO: 1002427 - RNA, 14 nt, Mycobacterium avium subsp. paratuberculosis
cuccgcgcagccag

SEQ ID NO: 1002428 - RNA, 22 nt, Mycobacterium avium subsp. paratuberculosis
cuccggauggcggucgcgccag

SEQ ID NO: 1002429 - RNA, 18 nt, Mycobacterium avium subsp. paratuberculosis
cuccgcggccgcgcgccc

SEQ ID NO: 1002430 - RNA, 16 nt, Mycobacterium avium subsp. paratuberculosis
cuccgcgauggccucc

SEQ ID NO: 1002431 - RNA, 22 nt, Mycobacterium avium subsp. paratuberculosis
cuccgccuucgaguuuggccug

SEQ ID NO: 1002432 - RNA, 23 nt, Mycobacterium avium subsp. paratuberculosis
cucagauucuucuucagccccuc

SEQ ID NO: 1002433 - RNA, 14 nt, Mycobacterium avium subsp. paratuberculosis
cucagaggcgggca

SEQ ID NO: 1002434 - RNA, 19 nt, Mycobacterium avium subsp. paratuberculosis
cucaggcguccagccagcg

SEQ ID NO: 1002435 - RNA, 20 nt, Mycobacterium avium subsp. paratuberculosis
cucagacugccgagcaucag

SEQ ID NO: 1002436 - RNA, 17 nt, Mycobacterium avium subsp. paratuberculosis
cucagguugcgcagcag

SEQ ID NO: 1002437 - RNA, 14 nt, Mycobacterium avium subsp. paratuberculosis
cucaggucggccgc

SEQ ID NO: 1002438 - RNA, 18 nt, Mycobacterium avium subsp. paratuberculosis
cucaggucggccgcggcc

SEQ ID NO: 1002439 - RNA, 19 nt, Mycobacterium avium subsp. paratuberculosis
cucaggucggccgcggccg

SEQ ID NO: 1002440 - RNA, 17 nt, Mycobacterium avium subsp. paratuberculosis
cucagggugcgcuggcc

SEQ ID NO: 1002441 - RNA, 17 nt, Mycobacterium avium subsp. paratuberculosis
cucauaucccgucaggu

SEQ ID NO: 1002442 - RNA, 14 nt, Mycobacterium avium subsp. paratuberculosis
cucaucaggcggcc

SEQ ID NO: 1002443 - RNA, 23 nt, Mycobacterium avium subsp. paratuberculosis
cucaucaggcggccggcccggcc

SEQ ID NO: 1002444 - RNA, 18 nt, Mycobacterium avium subsp. paratuberculosis
cucaugagcccuccagcu

SEQ ID NO: 1002445 - RNA, 21 nt, Mycobacterium avium subsp. paratuberculosis
cucaugagcccuccagcuggu

SEQ ID NO: 1002446 - RNA, 13 nt, Mycobacterium avium subsp. paratuberculosis
cucaucgcccagc

SEQ ID NO: 1002447 - RNA, 21 nt, Mycobacterium avium subsp. paratuberculosis
cucaccgucgcggucagcucg

SEQ ID NO: 1002448 - RNA, 22 nt, Mycobacterium avium subsp. paratuberculosis
cucaccgcgggccaggcccacc

SEQ ID NO: 1002449 - RNA, 14 nt, Mycobacterium avium subsp. paratuberculosis
cucaccgagcuggg

SEQ ID NO: 1002450 - RNA, 20 nt, Mycobacterium avium subsp. paratuberculosis
cucaccgagcugggccggcg

SEQ ID NO: 1002451 - RNA, 23 nt, Mycobacterium avium subsp. paratuberculosis
cucaccgagcugggccggcgccg

SEQ ID NO: 1002452 - RNA, 17 nt, Mycobacterium avium subsp. paratuberculosis
cucacacggggcagacc

SEQ ID NO: 1002453 - RNA, 22 nt, Mycobacterium avium subsp. paratuberculosis
cucacagcgacaacgggccgcc

SEQ ID NO: 1002454 - RNA, 14 nt, Mycobacterium avium subsp. paratuberculosis
cucacagcgcggcg

SEQ ID NO: 1002455 - RNA, 14 nt, Mycobacterium avium subsp. paratuberculosis
cuaggccagcagcg

SEQ ID NO: 1002456 - RNA, 19 nt, Mycobacterium avium subsp. paratuberculosis
cuaggccagcagcgcggcg

SEQ ID NO: 1002457 - RNA, 15 nt, Mycobacterium avium subsp. paratuberculosis
cuaggcucggcagcc

SEQ ID NO: 1002458 - RNA, 16 nt, Mycobacterium avium subsp. paratuberculosis
cuaggcucggcagccg

SEQ ID NO: 1002459 - RNA, 14 nt, Mycobacterium avium subsp. paratuberculosis
cuagcuugggugag

SEQ ID NO: 1002460 - RNA, 23 nt, Mycobacterium avium subsp. paratuberculosis
cuagcuucacggucggagcccag

SEQ ID NO: 1002461 - RNA, 22 nt, Mycobacterium avium subsp. paratuberculosis
cuagcgugacagucgaccucgc

SEQ ID NO: 1002462 - RNA, 17 nt, Mycobacterium avium subsp. paratuberculosis
cuagcgcggcggccucg

SEQ ID NO: 1002463 - RNA, 19 nt, Mycobacterium avium subsp. paratuberculosis
cuacgccgaggcgcaggag

SEQ ID NO: 1002464 - RNA, 19 nt, Mycobacterium avium subsp. paratuberculosis
cuacgcacccgacacgccg

SEQ ID NO: 1002465 - RNA, 18 nt, Mycobacterium avium subsp. paratuberculosis
cuacucggacgccggcag

SEQ ID NO: 1002466 - RNA, 20 nt, Mycobacterium avium subsp. paratuberculosis
cuacugcugguagacccggg

SEQ ID NO: 1002467 - RNA, 12 nt, Mycobacterium avium subsp. paratuberculosis
cguuuccagcgc

SEQ ID NO: 1002468 - RNA, 17 nt, Mycobacterium avium subsp. paratuberculosis
cguuggcccgcacccgc

SEQ ID NO: 1002469 - RNA, 21 nt, Mycobacterium avium subsp. paratuberculosis
cguuggcccgcacccgccgcc

SEQ ID NO: 1002470 - RNA, 15 nt, Mycobacterium avium subsp. paratuberculosis
cguuggccugguagc

SEQ ID NO: 1002471 - RNA, 16 nt, Mycobacterium avium subsp. paratuberculosis
cguuggcggccagcgc

SEQ ID NO: 1002472 - RNA, 17 nt, Mycobacterium avium subsp. paratuberculosis
cguuggcggccagcgcg

SEQ ID NO: 1002473 - RNA, 21 nt, Mycobacterium avium subsp. paratuberculosis
cguuggcggccagcgcgccgc

SEQ ID NO: 1002474 - RNA, 23 nt, Mycobacterium avium subsp. paratuberculosis
cguuggcggcggugggcugggcg

SEQ ID NO: 1002475 - RNA, 18 nt, Mycobacterium avium subsp. paratuberculosis
cguugguggucgacgcgc

SEQ ID NO: 1002476 - RNA, 15 nt, Mycobacterium avium subsp. paratuberculosis
cguugggggcgccgc

SEQ ID NO: 1002477 - RNA, 16 nt, Mycobacterium avium subsp. paratuberculosis
cguugggggcgccgcg

SEQ ID NO: 1002478 - RNA, 18 nt, Mycobacterium avium subsp. paratuberculosis
cguugggggucgacuggg

SEQ ID NO: 1002479 - RNA, 22 nt, Mycobacterium avium subsp. paratuberculosis
cguugggguccucgauggcggc

SEQ ID NO: 1002480 - RNA, 13 nt, Mycobacterium avium subsp. paratuberculosis
cguugccggcccg

SEQ ID NO: 1002481 - RNA, 18 nt, Mycobacterium avium subsp. paratuberculosis
cguugccggcccgcagcg

SEQ ID NO: 1002482 - RNA, 18 nt, Mycobacterium avium subsp. paratuberculosis
cguugccggcggccagca

SEQ ID NO: 1002483 - RNA, 13 nt, Mycobacterium avium subsp. paratuberculosis
cguugccgguccc

SEQ ID NO: 1002484 - RNA, 15 nt, Mycobacterium avium subsp. paratuberculosis
cguugccggugccga

SEQ ID NO: 1002485 - RNA, 20 nt, Mycobacterium avium subsp. paratuberculosis
cguugccgcacaccgcgcag

SEQ ID NO: 1002486 - RNA, 21 nt, Mycobacterium avium subsp. paratuberculosis
cguugccgcacaccgcgcaga

SEQ ID NO: 1002487 - RNA, 16 nt, Mycobacterium avium subsp. paratuberculosis
cguugccgccgcgcgc

SEQ ID NO: 1002488 - RNA, 20 nt, Mycobacterium avium subsp. paratuberculosis
cguugccgccgcgcgcggcc

SEQ ID NO: 1002489 - RNA, 14 nt, Mycobacterium avium subsp. paratuberculosis
cguugcgccgccag

SEQ ID NO: 1002490 - RNA, 20 nt, Mycobacterium avium subsp. paratuberculosis
cguugcgccgcgagcgcagc

SEQ ID NO: 1002491 - RNA, 21 nt, Mycobacterium avium subsp. paratuberculosis
cguugcgcguucaagccgccg

SEQ ID NO: 1002492 - RNA, 14 nt, Mycobacterium avium subsp. paratuberculosis
cguugcgccagcag

SEQ ID NO: 1002493 - RNA, 15 nt, Mycobacterium avium subsp. paratuberculosis
cguugcgccagcagg

SEQ ID NO: 1002494 - RNA, 23 nt, Mycobacterium avium subsp. paratuberculosis
cguugcgccccacggucuuugcc

SEQ ID NO: 1002495 - RNA, 14 nt, Mycobacterium avium subsp. paratuberculosis
cguugcgggccagg

SEQ ID NO: 1002496 - RNA, 20 nt, Mycobacterium avium subsp. paratuberculosis
cguugcggaucucgaccucg

SEQ ID NO: 1002497 - RNA, 22 nt, Mycobacterium avium subsp. paratuberculosis
cguuggcacccgaccgacgccc

SEQ ID NO: 1002498 - RNA, 20 nt, Mycobacterium avium subsp. paratuberculosis
cguuggcaggcccgguagau

SEQ ID NO: 1002499 - RNA, 15 nt, Mycobacterium avium subsp. paratuberculosis
cguuggccagcaccg

SEQ ID NO: 1002500 - RNA, 16 nt, Mycobacterium avium subsp. paratuberculosis
cguuggccgagcagcc

SEQ ID NO: 1002501 - RNA, 18 nt, Mycobacterium avium subsp. paratuberculosis
cguuggccgagcagccgg

SEQ ID NO: 1002502 - RNA, 19 nt, Mycobacterium avium subsp. paratuberculosis
cguuggagccgaccagcgc

SEQ ID NO: 1002503 - RNA, 17 nt, Mycobacterium avium subsp. paratuberculosis
cguuccagguccgcggu

SEQ ID NO: 1002504 - RNA, 16 nt, Mycobacterium avium subsp. paratuberculosis
cguuccaucagcgccc

SEQ ID NO: 1002505 - RNA, 18 nt, Mycobacterium avium subsp. paratuberculosis
cguuccaucgggcccagc

SEQ ID NO: 1002506 - RNA, 18 nt, Mycobacterium avium subsp. paratuberculosis
cguuccagcacccggccc

SEQ ID NO: 1002507 - RNA, 22 nt, Mycobacterium avium subsp. paratuberculosis
cguuccagcacccggcccacgc

SEQ ID NO: 1002508 - RNA, 19 nt, Mycobacterium avium subsp. paratuberculosis
cguuccagcacgcccagau

SEQ ID NO: 1002509 - RNA, 15 nt, Mycobacterium avium subsp. paratuberculosis
cguuccacgcagauc

SEQ ID NO: 1002510 - RNA, 21 nt, Mycobacterium avium subsp. paratuberculosis
cguucgaguucgucgaccagc

SEQ ID NO: 1002511 - RNA, 22 nt, Mycobacterium avium subsp. paratuberculosis
cguucgccggcguagaccagcg

SEQ ID NO: 1002512 - RNA, 16 nt, Mycobacterium avium subsp. paratuberculosis
cguugaccaacgccgc

SEQ ID NO: 1002513 - RNA, 19 nt, Mycobacterium avium subsp. paratuberculosis
cguugaccaacgccgccuc

SEQ ID NO: 1002514 - RNA, 20 nt, Mycobacterium avium subsp. paratuberculosis
cguugaccaacgccgccucc

SEQ ID NO: 1002515 - RNA, 14 nt, Mycobacterium avium subsp. paratuberculosis
cguugaccaccagg

SEQ ID NO: 1002516 - RNA, 20 nt, Mycobacterium avium subsp. paratuberculosis
cguugaaaguccuugcugcc

SEQ ID NO: 1002517 - RNA, 18 nt, Mycobacterium avium subsp. paratuberculosis
cguugaccccgacggcgc

SEQ ID NO: 1002518 - RNA, 15 nt, Mycobacterium avium subsp. paratuberculosis
cguugaccgcggcga

SEQ ID NO: 1002519 - RNA, 14 nt, Mycobacterium avium subsp. paratuberculosis
cguugaccagaccg

SEQ ID NO: 1002520 - RNA, 16 nt, Mycobacterium avium subsp. paratuberculosis
cguugcccgucgccuc

SEQ ID NO: 1002521 - RNA, 15 nt, Mycobacterium avium subsp. paratuberculosis
cguugagcaccacga

SEQ ID NO: 1002522 - RNA, 18 nt, Mycobacterium avium subsp. paratuberculosis
cguugcccgaucagccgg

SEQ ID NO: 1002523 - RNA, 21 nt, Mycobacterium avium subsp. paratuberculosis
cguucuccgaggcguccuccu

SEQ ID NO: 1002524 - RNA, 22 nt, Mycobacterium avium subsp. paratuberculosis
cguucuccgaggcguccuccuc

SEQ ID NO: 1002525 - RNA, 14 nt, Mycobacterium avium subsp. paratuberculosis
cguucggcgaguga

SEQ ID NO: 1002526 - RNA, 19 nt, Mycobacterium avium subsp. paratuberculosis
cguucggcgaucagcugga

SEQ ID NO: 1002527 - RNA, 13 nt, Mycobacterium avium subsp. paratuberculosis
cguguucaccagc

SEQ ID NO: 1002528 - RNA, 22 nt, Mycobacterium avium subsp. paratuberculosis
cgugugguacagcgccagcggc

SEQ ID NO: 1002529 - RNA, 21 nt, Mycobacterium avium subsp. paratuberculosis
cgugucccggauggagcgcga

SEQ ID NO: 1002530 - RNA, 15 nt, Mycobacterium avium subsp. paratuberculosis
cgugucccggcgccc

SEQ ID NO: 1002531 - RNA, 15 nt, Mycobacterium avium subsp. paratuberculosis
cguguccgaugacga

SEQ ID NO: 1002532 - RNA, 15 nt, Mycobacterium avium subsp. paratuberculosis
cguguccgcgccggc

SEQ ID NO: 1002533 - RNA, 21 nt, Mycobacterium avium subsp. paratuberculosis
cguguccgucgccggaggcga

SEQ ID NO: 1002534 - RNA, 19 nt, Mycobacterium avium subsp. paratuberculosis
cgugugcuagcgagcgggc

SEQ ID NO: 1002535 - RNA, 14 nt, Mycobacterium avium subsp. paratuberculosis
cgugugcucagcuc

SEQ ID NO: 1002536 - RNA, 20 nt, Mycobacterium avium subsp. paratuberculosis
cgugugcucagcucccgagc

SEQ ID NO: 1002537 - RNA, 21 nt, Mycobacterium avium subsp. paratuberculosis
cgugugacgaugcugagcaga

SEQ ID NO: 1002538 - RNA, 16 nt, Mycobacterium avium subsp. paratuberculosis
cgugguaccggcgcca

SEQ ID NO: 1002539 - RNA, 19 nt, Mycobacterium avium subsp. paratuberculosis
cgugguaccggcgccaggc

SEQ ID NO: 1002540 - RNA, 14 nt, Mycobacterium avium subsp. paratuberculosis
cgugguccagcacg

SEQ ID NO: 1002541 - RNA, 22 nt, Mycobacterium avium subsp. paratuberculosis
cgugguccagcacgugcccagc

SEQ ID NO: 1002542 - RNA, 15 nt, Mycobacterium avium subsp. paratuberculosis
cguggucacccgcag

SEQ ID NO: 1002543 - RNA, 16 nt, Mycobacterium avium subsp. paratuberculosis
cguggucgcgcagcau

SEQ ID NO: 1002544 - RNA, 16 nt, Mycobacterium avium subsp. paratuberculosis
cguggucgcugcucau

SEQ ID NO: 1002545 - RNA, 18 nt, Mycobacterium avium subsp. paratuberculosis
cguggucggcagcaccgg

SEQ ID NO: 1002546 - RNA, 20 nt, Mycobacterium avium subsp. paratuberculosis
cguggucggcgaacgcccgg

SEQ ID NO: 1002547 - RNA, 20 nt, Mycobacterium avium subsp. paratuberculosis
cguggucucguugugcaccg

SEQ ID NO: 1002548 - RNA, 13 nt, Mycobacterium avium subsp. paratuberculosis
cguggugcccuca

SEQ ID NO: 1002549 - RNA, 14 nt, Mycobacterium avium subsp. paratuberculosis
cgugguggaaggug

SEQ ID NO: 1002550 - RNA, 16 nt, Mycobacterium avium subsp. paratuberculosis
cguggugugcaccagc

SEQ ID NO: 1002551 - RNA, 15 nt, Mycobacterium avium subsp. paratuberculosis
cguggugugcccgcg

SEQ ID NO: 1002552 - RNA, 23 nt, Mycobacterium avium subsp. paratuberculosis
cgugguguugaucauccggcggg

SEQ ID NO: 1002553 - RNA, 16 nt, Mycobacterium avium subsp. paratuberculosis
cguggugggcgaacag

SEQ ID NO: 1002554 - RNA, 14 nt, Mycobacterium avium subsp. paratuberculosis
cgugucaccgccca

SEQ ID NO: 1002555 - RNA, 15 nt, Mycobacterium avium subsp. paratuberculosis
cguguaguccagguc

SEQ ID NO: 1002556 - RNA, 12 nt, Mycobacterium avium subsp. paratuberculosis
cguguacagcag

SEQ ID NO: 1002557 - RNA, 20 nt, Mycobacterium avium subsp. paratuberculosis
cguguagccugcggccugca

SEQ ID NO: 1002558 - RNA, 22 nt, Mycobacterium avium subsp. paratuberculosis
cguggccugcgacuucuacggc

SEQ ID NO: 1002559 - RNA, 20 nt, Mycobacterium avium subsp. paratuberculosis
cguggccgucacgcuggcgu

SEQ ID NO: 1002560 - RNA, 16 nt, Mycobacterium avium subsp. paratuberculosis
cguggccccagccacc

SEQ ID NO: 1002561 - RNA, 23 nt, Mycobacterium avium subsp. paratuberculosis
cguggcccggucggaguccagca

SEQ ID NO: 1002562 - RNA, 12 nt, Mycobacterium avium subsp. paratuberculosis
cguggcgcacag

SEQ ID NO: 1002563 - RNA, 15 nt, Mycobacterium avium subsp. paratuberculosis
cgugcuuggccagcu

SEQ ID NO: 1002564 - RNA, 16 nt, Mycobacterium avium subsp. paratuberculosis
cguggaauccuuccuc

SEQ ID NO: 1002565 - RNA, 22 nt, Mycobacterium avium subsp. paratuberculosis
cguggaacacgcccagcgccgc

SEQ ID NO: 1002566 - RNA, 14 nt, Mycobacterium avium subsp. paratuberculosis
cguggacaccgcac

SEQ ID NO: 1002567 - RNA, 20 nt, Mycobacterium avium subsp. paratuberculosis
cguggaggcguagugcgccc

SEQ ID NO: 1002568 - RNA, 23 nt, Mycobacterium avium subsp. paratuberculosis
cguggaggcguagugcgcccaga

SEQ ID NO: 1002569 - RNA, 22 nt, Mycobacterium avium subsp. paratuberculosis
cgugggcaacacgucguccggc

SEQ ID NO: 1002570 - RNA, 13 nt, Mycobacterium avium subsp. paratuberculosis
cgugggccaacgc

SEQ ID NO: 1002571 - RNA, 22 nt, Mycobacterium avium subsp. paratuberculosis
cgugggccaccacguacuccug

SEQ ID NO: 1002572 - RNA, 17 nt, Mycobacterium avium subsp. paratuberculosis
cgugggcggccaccaac

SEQ ID NO: 1002573 - RNA, 16 nt, Mycobacterium avium subsp. paratuberculosis
cgugggcgauccgcag

SEQ ID NO: 1002574 - RNA, 20 nt, Mycobacterium avium subsp. paratuberculosis
cgugggcgauccgcaggccg

SEQ ID NO: 1002575 - RNA, 22 nt, Mycobacterium avium subsp. paratuberculosis
cgugggccgcagcgcggcgaca

SEQ ID NO: 1002576 - RNA, 18 nt, Mycobacterium avium subsp. paratuberculosis
cgugggaaugcggcuggg

SEQ ID NO: 1002577 - RNA, 16 nt, Mycobacterium avium subsp. paratuberculosis
cguggggcgucgccgc

SEQ ID NO: 1002578 - RNA, 17 nt, Mycobacterium avium subsp. paratuberculosis
cgugggggucgacccgc

SEQ ID NO: 1002579 - RNA, 23 nt, Mycobacterium avium subsp. paratuberculosis
cguggcuuuggucgccagcacca

SEQ ID NO: 1002580 - RNA, 15 nt, Mycobacterium avium subsp. paratuberculosis
cgugggaaccaccaa

SEQ ID NO: 1002581 - RNA, 16 nt, Mycobacterium avium subsp. paratuberculosis
cguggcgucggcgcgc

SEQ ID NO: 1002582 - RNA, 17 nt, Mycobacterium avium subsp. paratuberculosis
cguggcgucggcgcgca

SEQ ID NO: 1002583 - RNA, 14 nt, Mycobacterium avium subsp. paratuberculosis
cguggcggugcucu

SEQ ID NO: 1002584 - RNA, 17 nt, Mycobacterium avium subsp. paratuberculosis
cguggcucagcggcagg

SEQ ID NO: 1002585 - RNA, 17 nt, Mycobacterium avium subsp. paratuberculosis
cguggcugaacagcgcg

SEQ ID NO: 1002586 - RNA, 20 nt, Mycobacterium avium subsp. paratuberculosis
cguggcugaacagcgcgccg

SEQ ID NO: 1002587 - RNA, 17 nt, Mycobacterium avium subsp. paratuberculosis
cguggcugaggccgccc

SEQ ID NO: 1002588 - RNA, 23 nt, Mycobacterium avium subsp. paratuberculosis
cguggcgggggagccgugcagcg

SEQ ID NO: 1002589 - RNA, 16 nt, Mycobacterium avium subsp. paratuberculosis
cguggcgccggcgcgc

SEQ ID NO: 1002590 - RNA, 14 nt, Mycobacterium avium subsp. paratuberculosis
cguggcgggccagg

SEQ ID NO: 1002591 - RNA, 18 nt, Mycobacterium avium subsp. paratuberculosis
cguggcggucggugcgca

SEQ ID NO: 1002592 - RNA, 19 nt, Mycobacterium avium subsp. paratuberculosis
cguggcggucggugcgcag

SEQ ID NO: 1002593 - RNA, 22 nt, Mycobacterium avium subsp. paratuberculosis
cguggcggucggugcgcagcac

SEQ ID NO: 1002594 - RNA, 18 nt, Mycobacterium avium subsp. paratuberculosis
cguggcggcccgaccagc

SEQ ID NO: 1002595 - RNA, 19 nt, Mycobacterium avium subsp. paratuberculosis
cguggcggcccgaccagcg

SEQ ID NO: 1002596 - RNA, 20 nt, Mycobacterium avium subsp. paratuberculosis
cgugaguucgcugaccgcca

SEQ ID NO: 1002597 - RNA, 20 nt, Mycobacterium avium subsp. paratuberculosis
cgugcaaaccggaccgccgc

SEQ ID NO: 1002598 - RNA, 19 nt, Mycobacterium avium subsp. paratuberculosis
cgugcaacucccgcgccgc

SEQ ID NO: 1002599 - RNA, 21 nt, Mycobacterium avium subsp. paratuberculosis
cgugcaaggccugcgccuugg

SEQ ID NO: 1002600 - RNA, 20 nt, Mycobacterium avium subsp. paratuberculosis
cgugcacacccgcagcgacc

SEQ ID NO: 1002601 - RNA, 14 nt, Mycobacterium avium subsp. paratuberculosis
cgugcacaccggcc

SEQ ID NO: 1002602 - RNA, 12 nt, Mycobacterium avium subsp. paratuberculosis
cgugcaccaccg

SEQ ID NO: 1002603 - RNA, 20 nt, Mycobacterium avium subsp. paratuberculosis
cgugcacgaucgcggugacg

SEQ ID NO: 1002604 - RNA, 24 nt, Mycobacterium avium subsp. paratuberculosis
cgugcaccugugaggcaccgaacg

SEQ ID NO: 1002605 - RNA, 17 nt, Mycobacterium avium subsp. paratuberculosis
cgugcacgaacgcggcc

SEQ ID NO: 1002606 - RNA, 23 nt, Mycobacterium avium subsp. paratuberculosis
cgugcacgaacgcggccagcggg

SEQ ID NO: 1002607 - RNA, 20 nt, Mycobacterium avium subsp. paratuberculosis
cgugcacccacgccagccgg

SEQ ID NO: 1002608 - RNA, 14 nt, Mycobacterium avium subsp. paratuberculosis
cgugcaccgcggcc

SEQ ID NO: 1002609 - RNA, 22 nt, Mycobacterium avium subsp. paratuberculosis
cgugcaccgucgccggcggggc

SEQ ID NO: 1002610 - RNA, 12 nt, Mycobacterium avium subsp. paratuberculosis
cgugcagaacag

SEQ ID NO: 1002611 - RNA, 13 nt, Mycobacterium avium subsp. paratuberculosis
cgugcagaacagc

SEQ ID NO: 1002612 - RNA, 16 nt, Mycobacterium avium subsp. paratuberculosis
cgugccaccgcugggc

SEQ ID NO: 1002613 - RNA, 21 nt, Mycobacterium avium subsp. paratuberculosis
cgugccaccgcugggcggcgc

SEQ ID NO: 1002614 - RNA, 15 nt, Mycobacterium avium subsp. paratuberculosis
cgugccacggccgcg

SEQ ID NO: 1002615 - RNA, 23 nt, Mycobacterium avium subsp. paratuberculosis
cgugccaagcguauccggccagc

SEQ ID NO: 1002616 - RNA, 17 nt, Mycobacterium avium subsp. paratuberculosis
cgugcgccgcggcggcu

SEQ ID NO: 1002617 - RNA, 21 nt, Mycobacterium avium subsp. paratuberculosis
cgugcgccgcggcggcucggc

SEQ ID NO: 1002618 - RNA, 17 nt, Mycobacterium avium subsp. paratuberculosis
cgugccagggcagcgcg

SEQ ID NO: 1002619 - RNA, 15 nt, Mycobacterium avium subsp. paratuberculosis
cgugccagccggccg

SEQ ID NO: 1002620 - RNA, 17 nt, Mycobacterium avium subsp. paratuberculosis
cgugccagccggccgcu

SEQ ID NO: 1002621 - RNA, 15 nt, Mycobacterium avium subsp. paratuberculosis
cgugcgccagcgacc

SEQ ID NO: 1002622 - RNA, 19 nt, Mycobacterium avium subsp. paratuberculosis
cgugcgccagcgaccgcag

SEQ ID NO: 1002623 - RNA, 19 nt, Mycobacterium avium subsp. paratuberculosis
cgugcgggaugccgagcag

SEQ ID NO: 1002624 - RNA, 22 nt, Mycobacterium avium subsp. paratuberculosis
cgugcgggaugccgagcagcuc

SEQ ID NO: 1002625 - RNA, 17 nt, Mycobacterium avium subsp. paratuberculosis
cgugcgugcgcucgacc

SEQ ID NO: 1002626 - RNA, 14 nt, Mycobacterium avium subsp. paratuberculosis
cgugcgcggcuggc

SEQ ID NO: 1002627 - RNA, 15 nt, Mycobacterium avium subsp. paratuberculosis
cgugcggccgcagcg

SEQ ID NO: 1002628 - RNA, 24 nt, Mycobacterium avium subsp. paratuberculosis
cgucgccguggcggcccgaccagc

SEQ ID NO: 1002629 - RNA, 20 nt, Mycobacterium avium subsp. paratuberculosis
cgucgcacaaccgggccaac

SEQ ID NO: 1002630 - RNA, 16 nt, Mycobacterium avium subsp. paratuberculosis
cgucgcacagcgccgc

SEQ ID NO: 1002631 - RNA, 17 nt, Mycobacterium avium subsp. paratuberculosis
cgucgccggccugcccg

SEQ ID NO: 1002632 - RNA, 20 nt, Mycobacterium avium subsp. paratuberculosis
cgucgccggcgaccgccacc

SEQ ID NO: 1002633 - RNA, 14 nt, Mycobacterium avium subsp. paratuberculosis
cgucgccggcgcgc

SEQ ID NO: 1002634 - RNA, 17 nt, Mycobacterium avium subsp. paratuberculosis
cgucgccggcgcgcagc

SEQ ID NO: 1002635 - RNA, 23 nt, Mycobacterium avium subsp. paratuberculosis
cgucgccggcgcgggccgcagcg

SEQ ID NO: 1002636 - RNA, 19 nt, Mycobacterium avium subsp. paratuberculosis
cgucucuuccucgggcagu

SEQ ID NO: 1002637 - RNA, 14 nt, Mycobacterium avium subsp. paratuberculosis
cgucgcgcaccacc

SEQ ID NO: 1002638 - RNA, 15 nt, Mycobacterium avium subsp. paratuberculosis
cgucgcgccagcggu

SEQ ID NO: 1002639 - RNA, 14 nt, Mycobacterium avium subsp. paratuberculosis
cgucgcgccgccac

SEQ ID NO: 1002640 - RNA, 19 nt, Mycobacterium avium subsp. paratuberculosis
cgucgcgauagggccggcc

SEQ ID NO: 1002641 - RNA, 19 nt, Mycobacterium avium subsp. paratuberculosis
cgugacaggggcagcagca

SEQ ID NO: 1002642 - RNA, 23 nt, Mycobacterium avium subsp. paratuberculosis
cgugacaggggcagcagcagauc

SEQ ID NO: 1002643 - RNA, 21 nt, Mycobacterium avium subsp. paratuberculosis
cgugaccccggcgaccagcag

SEQ ID NO: 1002644 - RNA, 20 nt, Mycobacterium avium subsp. paratuberculosis
cgugacgaccuggucgccgc

SEQ ID NO: 1002645 - RNA, 22 nt, Mycobacterium avium subsp. paratuberculosis
cgugacgccgauccgcugcgga

SEQ ID NO: 1002646 - RNA, 17 nt, Mycobacterium avium subsp. paratuberculosis
cgugacggccgcggcgc

SEQ ID NO: 1002647 - RNA, 20 nt, Mycobacterium avium subsp. paratuberculosis
cgugaaaucccccgacccgc

SEQ ID NO: 1002648 - RNA, 23 nt, Mycobacterium avium subsp. paratuberculosis
cgguuuucccgcgagcugccccu

SEQ ID NO: 1002649 - RNA, 22 nt, Mycobacterium avium subsp. paratuberculosis
cgguuugcgccggcuccaccgc

SEQ ID NO: 1002650 - RNA, 20 nt, Mycobacterium avium subsp. paratuberculosis
cguaaaggaugucgccgcag

SEQ ID NO: 1002651 - RNA, 21 nt, Mycobacterium avium subsp. paratuberculosis
cgguugaugaucuuggugaag

SEQ ID NO: 1002652 - RNA, 16 nt, Mycobacterium avium subsp. paratuberculosis
cgguucgugcgcaacg

SEQ ID NO: 1002653 - RNA, 17 nt, Mycobacterium avium subsp. paratuberculosis
cgguugaccccggcccc

SEQ ID NO: 1002654 - RNA, 20 nt, Mycobacterium avium subsp. paratuberculosis
cgguugagcaccagcccggc

SEQ ID NO: 1002655 - RNA, 13 nt, Mycobacterium avium subsp. paratuberculosis
cgguugagcaccg

SEQ ID NO: 1002656 - RNA, 17 nt, Mycobacterium avium subsp. paratuberculosis
cgguuccggcgugcagc

SEQ ID NO: 1002657 - RNA, 17 nt, Mycobacterium avium subsp. paratuberculosis
cgguuccgggcgacccc

SEQ ID NO: 1002658 - RNA, 19 nt, Mycobacterium avium subsp. paratuberculosis
cgguuaagugcccgccuca

SEQ ID NO: 1002659 - RNA, 11 nt, Mycobacterium avium subsp. paratuberculosis
cgguuccaacc

SEQ ID NO: 1002660 - RNA, 22 nt, Mycobacterium avium subsp. paratuberculosis
cgguuccaaccaccguggcccc

SEQ ID NO: 1002661 - RNA, 21 nt, Mycobacterium avium subsp. paratuberculosis
cgguuccaccgggccgccauc

SEQ ID NO: 1002662 - RNA, 21 nt, Mycobacterium avium subsp. paratuberculosis
cgguucagguggcgucggcgu

SEQ ID NO: 1002663 - RNA, 22 nt, Mycobacterium avium subsp. paratuberculosis
cgguucauccacucggccacca

SEQ ID NO: 1002664 - RNA, 19 nt, Mycobacterium avium subsp. paratuberculosis
cgguuguugcgguccagga

SEQ ID NO: 1002665 - RNA, 17 nt, Mycobacterium avium subsp. paratuberculosis
cgguuucugccggccgc

SEQ ID NO: 1002666 - RNA, 13 nt, Mycobacterium avium subsp. paratuberculosis
cgguuggccggcc

SEQ ID NO: 1002667 - RNA, 14 nt, Mycobacterium avium subsp. paratuberculosis
cgguuggccggccc

SEQ ID NO: 1002668 - RNA, 12 nt, Mycobacterium avium subsp. paratuberculosis
cgguugcccgga

SEQ ID NO: 1002669 - RNA, 14 nt, Mycobacterium avium subsp. paratuberculosis
cgguugccucggcc

SEQ ID NO: 1002670 - RNA, 20 nt, Mycobacterium avium subsp. paratuberculosis
cgguugccucggccagcacc

SEQ ID NO: 1002671 - RNA, 14 nt, Mycobacterium avium subsp. paratuberculosis
cgguugcgggccga

SEQ ID NO: 1002672 - RNA, 22 nt, Mycobacterium avium subsp. paratuberculosis
cgguuggacaggccggcgacgg

SEQ ID NO: 1002673 - RNA, 19 nt, Mycobacterium avium subsp. paratuberculosis
cgguuggacaugaagcccc

SEQ ID NO: 1002674 - RNA, 21 nt, Mycobacterium avium subsp. paratuberculosis
cggugcaguacgcaucggcgc

SEQ ID NO: 1002675 - RNA, 14 nt, Mycobacterium avium subsp. paratuberculosis
cggugcagccgcgg

SEQ ID NO: 1002676 - RNA, 24 nt, Mycobacterium avium subsp. paratuberculosis
cggugcagacgugacgugccccuc

SEQ ID NO: 1002677 - RNA, 15 nt, Mycobacterium avium subsp. paratuberculosis
cggugcccagccagg

SEQ ID NO: 1002678 - RNA, 13 nt, Mycobacterium avium subsp. paratuberculosis
cggugcccagccg

SEQ ID NO: 1002679 - RNA, 14 nt, Mycobacterium avium subsp. paratuberculosis
cggugcccagccgc

SEQ ID NO: 1002680 - RNA, 15 nt, Mycobacterium avium subsp. paratuberculosis
cggugcccagcgcga

SEQ ID NO: 1002681 - RNA, 20 nt, Mycobacterium avium subsp. paratuberculosis
cggugccaucgugggcgccg

SEQ ID NO: 1002682 - RNA, 20 nt, Mycobacterium avium subsp. paratuberculosis
cggugcccggaacggcgggc

SEQ ID NO: 1002683 - RNA, 22 nt, Mycobacterium avium subsp. paratuberculosis
cggugcccgggguccaccggcc

SEQ ID NO: 1002684 - RNA, 13 nt, Mycobacterium avium subsp. paratuberculosis
cggugccgaccug

SEQ ID NO: 1002685 - RNA, 18 nt, Mycobacterium avium subsp. paratuberculosis
cggugccgacgauccggg

SEQ ID NO: 1002686 - RNA, 23 nt, Mycobacterium avium subsp. paratuberculosis
cggugccgacgauccgggcgccc

SEQ ID NO: 1002687 - RNA, 15 nt, Mycobacterium avium subsp. paratuberculosis
cggugcaccgcgcgc

SEQ ID NO: 1002688 - RNA, 16 nt, Mycobacterium avium subsp. paratuberculosis
cggugcaccgcggcgc

SEQ ID NO: 1002689 - RNA, 20 nt, Mycobacterium avium subsp. paratuberculosis
cggugcaccgcggcgcgcau

SEQ ID NO: 1002690 - RNA, 18 nt, Mycobacterium avium subsp. paratuberculosis
cggugaucugcaccagcg

SEQ ID NO: 1002691 - RNA, 18 nt, Mycobacterium avium subsp. paratuberculosis
cggugaugugcaggaccu

SEQ ID NO: 1002692 - RNA, 21 nt, Mycobacterium avium subsp. paratuberculosis
cggugaucucaccggcggcgg

SEQ ID NO: 1002693 - RNA, 15 nt, Mycobacterium avium subsp. paratuberculosis
cggugaucgccgccc

SEQ ID NO: 1002694 - RNA, 12 nt, Mycobacterium avium subsp. paratuberculosis
cggugaugacgu

SEQ ID NO: 1002695 - RNA, 19 nt, Mycobacterium avium subsp. paratuberculosis
cggugaugacgucgcccac

SEQ ID NO: 1002696 - RNA, 15 nt, Mycobacterium avium subsp. paratuberculosis
cggugaugccggcca

SEQ ID NO: 1002697 - RNA, 17 nt, Mycobacterium avium subsp. paratuberculosis
cggugaugccggccagc

SEQ ID NO: 1002698 - RNA, 20 nt, Mycobacterium avium subsp. paratuberculosis
cggugaugccggccagccgc

SEQ ID NO: 1002699 - RNA, 13 nt, Mycobacterium avium subsp. paratuberculosis
cggugaucccagg

SEQ ID NO: 1002700 - RNA, 16 nt, Mycobacterium avium subsp. paratuberculosis
cggugauccgcccggc

SEQ ID NO: 1002701 - RNA, 23 nt, Mycobacterium avium subsp. paratuberculosis
cggugcguucgcguucgggcagc

SEQ ID NO: 1002702 - RNA, 16 nt, Mycobacterium avium subsp. paratuberculosis
cggugcucgcgccggg

SEQ ID NO: 1002703 - RNA, 17 nt, Mycobacterium avium subsp. paratuberculosis
cggugcucgcgccgggc

SEQ ID NO: 1002704 - RNA, 15 nt, Mycobacterium avium subsp. paratuberculosis
cggugcucggcgcgc

SEQ ID NO: 1002705 - RNA, 20 nt, Mycobacterium avium subsp. paratuberculosis
cggugcucggcgcgcggggc

SEQ ID NO: 1002706 - RNA, 16 nt, Mycobacterium avium subsp. paratuberculosis
cggugcucgucgagca

SEQ ID NO: 1002707 - RNA, 17 nt, Mycobacterium avium subsp. paratuberculosis
cggugcucuccugcuug

SEQ ID NO: 1002708 - RNA, 15 nt, Mycobacterium avium subsp. paratuberculosis
cggugcugacccggu

SEQ ID NO: 1002709 - RNA, 23 nt, Mycobacterium avium subsp. paratuberculosis
cggugcugcagauccgcucgccg

SEQ ID NO: 1002710 - RNA, 21 nt, Mycobacterium avium subsp. paratuberculosis
cggugcugcagcgcgaggcgc

SEQ ID NO: 1002711 - RNA, 22 nt, Mycobacterium avium subsp. paratuberculosis
cggugcgguaggugccggccgc

SEQ ID NO: 1002712 - RNA, 23 nt, Mycobacterium avium subsp. paratuberculosis
cggugcgguaggugccggccgcg

SEQ ID NO: 1002713 - RNA, 15 nt, Mycobacterium avium subsp. paratuberculosis
cggugcgugccagca

SEQ ID NO: 1002714 - RNA, 17 nt, Mycobacterium avium subsp. paratuberculosis
cggugcgugccagcagc

SEQ ID NO: 1002715 - RNA, 15 nt, Mycobacterium avium subsp. paratuberculosis
cggugcggggccgcg

SEQ ID NO: 1002716 - RNA, 18 nt, Mycobacterium avium subsp. paratuberculosis
cggugcggaacaccgccu

SEQ ID NO: 1002717 - RNA, 14 nt, Mycobacterium avium subsp. paratuberculosis
cggugcggacccgu

SEQ ID NO: 1002718 - RNA, 13 nt, Mycobacterium avium subsp. paratuberculosis
cggugcggccgca

SEQ ID NO: 1002719 - RNA, 15 nt, Mycobacterium avium subsp. paratuberculosis
cggugcggcucgggc

SEQ ID NO: 1002720 - RNA, 14 nt, Mycobacterium avium subsp. paratuberculosis
cggugcggaacacc

SEQ ID NO: 1002721 - RNA, 16 nt, Mycobacterium avium subsp. paratuberculosis
cggugcggaacaccgc

SEQ ID NO: 1002722 - RNA, 17 nt, Mycobacterium avium subsp. paratuberculosis
cggugcgccagaucagc

SEQ ID NO: 1002723 - RNA, 16 nt, Mycobacterium avium subsp. paratuberculosis
cggugcgcagucgcug

SEQ ID NO: 1002724 - RNA, 16 nt, Mycobacterium avium subsp. paratuberculosis
cggugccgggccaggu

SEQ ID NO: 1002725 - RNA, 14 nt, Mycobacterium avium subsp. paratuberculosis
cggugccgcggcgc

SEQ ID NO: 1002726 - RNA, 15 nt, Mycobacterium avium subsp. paratuberculosis
cggugccgcggcggc

SEQ ID NO: 1002727 - RNA, 16 nt, Mycobacterium avium subsp. paratuberculosis
cggugccgcggcggcg

SEQ ID NO: 1002728 - RNA, 20 nt, Mycobacterium avium subsp. paratuberculosis
cggugcgcagccgcugcagc

SEQ ID NO: 1002729 - RNA, 20 nt, Mycobacterium avium subsp. paratuberculosis
cggugccgagcacgcggccg

SEQ ID NO: 1002730 - RNA, 17 nt, Mycobacterium avium subsp. paratuberculosis
cggugccgaggcaguuc

SEQ ID NO: 1002731 - RNA, 13 nt, Mycobacterium avium subsp. paratuberculosis
cggugccgcagcc

SEQ ID NO: 1002732 - RNA, 17 nt, Mycobacterium avium subsp. paratuberculosis
cggugguuuugcggccc

SEQ ID NO: 1002733 - RNA, 17 nt, Mycobacterium avium subsp. paratuberculosis
cggugguguggcaggug

SEQ ID NO: 1002734 - RNA, 15 nt, Mycobacterium avium subsp. paratuberculosis
cgguguagagcaccu

SEQ ID NO: 1002735 - RNA, 14 nt, Mycobacterium avium subsp. paratuberculosis
cgguguagcggcgg

SEQ ID NO: 1002736 - RNA, 16 nt, Mycobacterium avium subsp. paratuberculosis
cgguguagcggcggcu

SEQ ID NO: 1002737 - RNA, 20 nt, Mycobacterium avium subsp. paratuberculosis
cgguguagcggcggcugaag

SEQ ID NO: 1002738 - RNA, 12 nt, Mycobacterium avium subsp. paratuberculosis
cgguggugaucg

SEQ ID NO: 1002739 - RNA, 14 nt, Mycobacterium avium subsp. paratuberculosis
cgguggugcggccc

SEQ ID NO: 1002740 - RNA, 22 nt, Mycobacterium avium subsp. paratuberculosis
cgguggugcucgccccgcccga

SEQ ID NO: 1002741 - RNA, 14 nt, Mycobacterium avium subsp. paratuberculosis
cgguggucaacgcg

SEQ ID NO: 1002742 - RNA, 20 nt, Mycobacterium avium subsp. paratuberculosis
cgguggucgacgagcccgcg

SEQ ID NO: 1002743 - RNA, 13 nt, Mycobacterium avium subsp. paratuberculosis
cgguggucggcgu

SEQ ID NO: 1002744 - RNA, 14 nt, Mycobacterium avium subsp. paratuberculosis
cgguguugcgcacc

SEQ ID NO: 1002745 - RNA, 19 nt, Mycobacterium avium subsp. paratuberculosis
cgguguugcgcacccgcgg

SEQ ID NO: 1002746 - RNA, 18 nt, Mycobacterium avium subsp. paratuberculosis
cgguguggaccgcgcagu

SEQ ID NO: 1002747 - RNA, 23 nt, Mycobacterium avium subsp. paratuberculosis
cgguguucggcgccagccgcacc

SEQ ID NO: 1002748 - RNA, 17 nt, Mycobacterium avium subsp. paratuberculosis
cgguguucgggucggug

SEQ ID NO: 1002749 - RNA, 14 nt, Mycobacterium avium subsp. paratuberculosis
cggugucgcacagc

SEQ ID NO: 1002750 - RNA, 20 nt, Mycobacterium avium subsp. paratuberculosis
cgguguccacgucgcccagc

SEQ ID NO: 1002751 - RNA, 22 nt, Mycobacterium avium subsp. paratuberculosis
cgguguccacgucgcccagcgu

SEQ ID NO: 1002752 - RNA, 16 nt, Mycobacterium avium subsp. paratuberculosis
cgguguccagccgcac

SEQ ID NO: 1002753 - RNA, 14 nt, Mycobacterium avium subsp. paratuberculosis
cgguguccgcgggc

SEQ ID NO: 1002754 - RNA, 20 nt, Mycobacterium avium subsp. paratuberculosis
cggugucgcuguaggccagc

SEQ ID NO: 1002755 - RNA, 18 nt, Mycobacterium avium subsp. paratuberculosis
cggugucggcgccccggc

SEQ ID NO: 1002756 - RNA, 18 nt, Mycobacterium avium subsp. paratuberculosis
cggugucggugcccaggu

SEQ ID NO: 1002757 - RNA, 17 nt, Mycobacterium avium subsp. paratuberculosis
cggugucguagacgacg

SEQ ID NO: 1002758 - RNA, 21 nt, Mycobacterium avium subsp. paratuberculosis
cggugucugaccucgcgccgc

SEQ ID NO: 1002759 - RNA, 13 nt, Mycobacterium avium subsp. paratuberculosis
cggugggcugggc

SEQ ID NO: 1002760 - RNA, 16 nt, Mycobacterium avium subsp. paratuberculosis
cgguggguccgccggg

SEQ ID NO: 1002761 - RNA, 17 nt, Mycobacterium avium subsp. paratuberculosis
cgguggcgugcagcgcg

SEQ ID NO: 1002762 - RNA, 17 nt, Mycobacterium avium subsp. paratuberculosis
cggugggcgcgggccgc

SEQ ID NO: 1002763 - RNA, 16 nt, Mycobacterium avium subsp. paratuberculosis
cgguggcggccacgau

SEQ ID NO: 1002764 - RNA, 21 nt, Mycobacterium avium subsp. paratuberculosis
cgguggcgcccgcgguggaac

SEQ ID NO: 1002765 - RNA, 15 nt, Mycobacterium avium subsp. paratuberculosis
cgguggcgccgcggg

SEQ ID NO: 1002766 - RNA, 19 nt, Mycobacterium avium subsp. paratuberculosis
cgguggcgccggggcgggc

SEQ ID NO: 1002767 - RNA, 17 nt, Mycobacterium avium subsp. paratuberculosis
cgguggcgaagcacgac

SEQ ID NO: 1002768 - RNA, 15 nt, Mycobacterium avium subsp. paratuberculosis
cgguggccgccacca

SEQ ID NO: 1002769 - RNA, 20 nt, Mycobacterium avium subsp. paratuberculosis
cgguggccucggcgcugccc

SEQ ID NO: 1002770 - RNA, 23 nt, Mycobacterium avium subsp. paratuberculosis
cgguggccgguauacccccggug

SEQ ID NO: 1002771 - RNA, 14 nt, Mycobacterium avium subsp. paratuberculosis
cgguggagcggccc

SEQ ID NO: 1002772 - RNA, 22 nt, Mycobacterium avium subsp. paratuberculosis
cgguggacuccagcaccagcac

SEQ ID NO: 1002773 - RNA, 16 nt, Mycobacterium avium subsp. paratuberculosis
cgguggacagcgcgac

SEQ ID NO: 1002774 - RNA, 18 nt, Mycobacterium avium subsp. paratuberculosis
cgguggacagcgcgacgg

SEQ ID NO: 1002775 - RNA, 23 nt, Mycobacterium avium subsp. paratuberculosis
cgguggacgaggugaccggcgag

SEQ ID NO: 1002776 - RNA, 12 nt, Mycobacterium avium subsp. paratuberculosis
cgguggccaccg

SEQ ID NO: 1002777 - RNA, 20 nt, Mycobacterium avium subsp. paratuberculosis
cgguggccaccgcgacgccc

SEQ ID NO: 1002778 - RNA, 15 nt, Mycobacterium avium subsp. paratuberculosis
cgguggcccagccgg

SEQ ID NO: 1002779 - RNA, 13 nt, Mycobacterium avium subsp. paratuberculosis
cgguggccccggg

SEQ ID NO: 1002780 - RNA, 12 nt, Mycobacterium avium subsp. paratuberculosis
cgguggccaugc

SEQ ID NO: 1002781 - RNA, 12 nt, Mycobacterium avium subsp. paratuberculosis
cgguggcccggu

SEQ ID NO: 1002782 - RNA, 14 nt, Mycobacterium avium subsp. paratuberculosis
cguaguccagcacg

SEQ ID NO: 1002783 - RNA, 19 nt, Mycobacterium avium subsp. paratuberculosis
cguaguccgacgauccggg

SEQ ID NO: 1002784 - RNA, 23 nt, Mycobacterium avium subsp. paratuberculosis
cguaguccgacgauccgggccgg

SEQ ID NO: 1002785 - RNA, 16 nt, Mycobacterium avium subsp. paratuberculosis
cguagcggaagcugcc

SEQ ID NO: 1002786 - RNA, 18 nt, Mycobacterium avium subsp. paratuberculosis
cguagcgggucagcucca

SEQ ID NO: 1002787 - RNA, 20 nt, Mycobacterium avium subsp. paratuberculosis
cguagcgggucagcuccacc

SEQ ID NO: 1002788 - RNA, 13 nt, Mycobacterium avium subsp. paratuberculosis
cguagcucagcgg

SEQ ID NO: 1002789 - RNA, 16 nt, Mycobacterium avium subsp. paratuberculosis
cguagugggucggcgg

SEQ ID NO: 1002790 - RNA, 15 nt, Mycobacterium avium subsp. paratuberculosis
cguagugcuucuuga

SEQ ID NO: 1002791 - RNA, 13 nt, Mycobacterium avium subsp. paratuberculosis
cgucaacaccgug

SEQ ID NO: 1002792 - RNA, 15 nt, Mycobacterium avium subsp. paratuberculosis
cgucacgccagcgug

SEQ ID NO: 1002793 - RNA, 15 nt, Mycobacterium avium subsp. paratuberculosis
cgucacgcccguccc

SEQ ID NO: 1002794 - RNA, 20 nt, Mycobacterium avium subsp. paratuberculosis
cgucacgcccguugacgccc

SEQ ID NO: 1002795 - RNA, 22 nt, Mycobacterium avium subsp. paratuberculosis
cgucaccaaugcgccggcggcc

SEQ ID NO: 1002796 - RNA, 20 nt, Mycobacterium avium subsp. paratuberculosis
cgucaaugauggucagccgc

SEQ ID NO: 1002797 - RNA, 22 nt, Mycobacterium avium subsp. paratuberculosis
cgucacaccgcggccagcgcgc

SEQ ID NO: 1002798 - RNA, 23 nt, Mycobacterium avium subsp. paratuberculosis
cgucacguagcgcggccgcccgu

SEQ ID NO: 1002799 - RNA, 22 nt, Mycobacterium avium subsp. paratuberculosis
cgucacgucauuucggucggca

SEQ ID NO: 1002800 - RNA, 20 nt, Mycobacterium avium subsp. paratuberculosis
cgucacgucgacggccgccg

SEQ ID NO: 1002801 - RNA, 14 nt, Mycobacterium avium subsp. paratuberculosis
cgucacgcuggcgu

SEQ ID NO: 1002802 - RNA, 19 nt, Mycobacterium avium subsp. paratuberculosis
cgucacgcuggcguggcgc

SEQ ID NO: 1002803 - RNA, 24 nt, Mycobacterium avium subsp. paratuberculosis
cgucacgcuggcguggcucggccc

SEQ ID NO: 1002804 - RNA, 16 nt, Mycobacterium avium subsp. paratuberculosis
cgucacgggccaggcg

SEQ ID NO: 1002805 - RNA, 19 nt, Mycobacterium avium subsp. paratuberculosis
cgucacgggccaggcgcgc

SEQ ID NO: 1002806 - RNA, 21 nt, Mycobacterium avium subsp. paratuberculosis
cgucacgggcugaccgccagg

SEQ ID NO: 1002807 - RNA, 22 nt, Mycobacterium avium subsp. paratuberculosis
cgucaguucguagaucacggcg

SEQ ID NO: 1002808 - RNA, 12 nt, Mycobacterium avium subsp. paratuberculosis
cgucagcgccgc

SEQ ID NO: 1002809 - RNA, 15 nt, Mycobacterium avium subsp. paratuberculosis
cgucagcgccgcccg

SEQ ID NO: 1002810 - RNA, 19 nt, Mycobacterium avium subsp. paratuberculosis
cgucagcgcgggccagcag

SEQ ID NO: 1002811 - RNA, 16 nt, Mycobacterium avium subsp. paratuberculosis
cguccccgcgccgggc

SEQ ID NO: 1002812 - RNA, 14 nt, Mycobacterium avium subsp. paratuberculosis
cguccccgcgcggc

SEQ ID NO: 1002813 - RNA, 14 nt, Mycobacterium avium subsp. paratuberculosis
cguccccgugcagc

SEQ ID NO: 1002814 - RNA, 22 nt, Mycobacterium avium subsp. paratuberculosis
cguccgcggccgcggcgcgcau

SEQ ID NO: 1002815 - RNA, 12 nt, Mycobacterium avium subsp. paratuberculosis
cguccgcggcgg

SEQ ID NO: 1002816 - RNA, 14 nt, Mycobacterium avium subsp. paratuberculosis
cguccgcggcggcc

SEQ ID NO: 1002817 - RNA, 19 nt, Mycobacterium avium subsp. paratuberculosis
cguccgcgggcggggccug

SEQ ID NO: 1002818 - RNA, 17 nt, Mycobacterium avium subsp. paratuberculosis
cguccgcgucggcgccg

SEQ ID NO: 1002819 - RNA, 19 nt, Mycobacterium avium subsp. paratuberculosis
cgucccagcacaacgccuc

SEQ ID NO: 1002820 - RNA, 18 nt, Mycobacterium avium subsp. paratuberculosis
cguccggaggugccggcc

SEQ ID NO: 1002821 - RNA, 13 nt, Mycobacterium avium subsp. paratuberculosis
cguccggcccggc

SEQ ID NO: 1002822 - RNA, 16 nt, Mycobacterium avium subsp. paratuberculosis
cguccggguccggcuu

SEQ ID NO: 1002823 - RNA, 14 nt, Mycobacterium avium subsp. paratuberculosis
cguccggcgcgcag

SEQ ID NO: 1002824 - RNA, 12 nt, Mycobacterium avium subsp. paratuberculosis
cguccucccggu

SEQ ID NO: 1002825 - RNA, 19 nt, Mycobacterium avium subsp. paratuberculosis
cguccucgaccacccgcug

SEQ ID NO: 1002826 - RNA, 17 nt, Mycobacterium avium subsp. paratuberculosis
cguccucgacgccgcgc

SEQ ID NO: 1002827 - RNA, 15 nt, Mycobacterium avium subsp. paratuberculosis
cguccucgacggugg

SEQ ID NO: 1002828 - RNA, 18 nt, Mycobacterium avium subsp. paratuberculosis
cguccgugcugccggccg

SEQ ID NO: 1002829 - RNA, 21 nt, Mycobacterium avium subsp. paratuberculosis
cguccgugcugccggccggca

SEQ ID NO: 1002830 - RNA, 19 nt, Mycobacterium avium subsp. paratuberculosis
cguccggguucgacgccuc

SEQ ID NO: 1002831 - RNA, 23 nt, Mycobacterium avium subsp. paratuberculosis
cguccaugaaccacugcggcaga

SEQ ID NO: 1002832 - RNA, 18 nt, Mycobacterium avium subsp. paratuberculosis
cguccauggucgagccgc

SEQ ID NO: 1002833 - RNA, 22 nt, Mycobacterium avium subsp. paratuberculosis
cguccauguaguucagcagccg

SEQ ID NO: 1002834 - RNA, 18 nt, Mycobacterium avium subsp. paratuberculosis
cguccaggugcacccgcg

SEQ ID NO: 1002835 - RNA, 14 nt, Mycobacterium avium subsp. paratuberculosis
cguccaggugcgcc

SEQ ID NO: 1002836 - RNA, 16 nt, Mycobacterium avium subsp. paratuberculosis
cguccaggugcgccgc

SEQ ID NO: 1002837 - RNA, 15 nt, Mycobacterium avium subsp. paratuberculosis
cguccagucgauguc

SEQ ID NO: 1002838 - RNA, 22 nt, Mycobacterium avium subsp. paratuberculosis
cguccaggguggccagcacgcu

SEQ ID NO: 1002839 - RNA, 16 nt, Mycobacterium avium subsp. paratuberculosis
cguccagcgccgccac

SEQ ID NO: 1002840 - RNA, 14 nt, Mycobacterium avium subsp. paratuberculosis
cgucaucaccgccg

SEQ ID NO: 1002841 - RNA, 17 nt, Mycobacterium avium subsp. paratuberculosis
cguccagccgugcggca

SEQ ID NO: 1002842 - RNA, 17 nt, Mycobacterium avium subsp. paratuberculosis
cguccagcgugccgcgc

SEQ ID NO: 1002843 - RNA, 21 nt, Mycobacterium avium subsp. paratuberculosis
cguccagcgugugcguggugg

SEQ ID NO: 1002844 - RNA, 14 nt, Mycobacterium avium subsp. paratuberculosis
cguccagcucagcg

SEQ ID NO: 1002845 - RNA, 17 nt, Mycobacterium avium subsp. paratuberculosis
cguccagcucagcgcgc

SEQ ID NO: 1002846 - RNA, 16 nt, Mycobacterium avium subsp. paratuberculosis
cguccagcuccgccga

SEQ ID NO: 1002847 - RNA, 17 nt, Mycobacterium avium subsp. paratuberculosis
cguccagcugcgcgccg

SEQ ID NO: 1002848 - RNA, 13 nt, Mycobacterium avium subsp. paratuberculosis
cguccaggccggc

SEQ ID NO: 1002849 - RNA, 15 nt, Mycobacterium avium subsp. paratuberculosis
cguccaggccggcgc

SEQ ID NO: 1002850 - RNA, 18 nt, Mycobacterium avium subsp. paratuberculosis
cguccaggccggcgccgc

SEQ ID NO: 1002851 - RNA, 19 nt, Mycobacterium avium subsp. paratuberculosis
cgucgaaggucugcagcag

SEQ ID NO: 1002852 - RNA, 21 nt, Mycobacterium avium subsp. paratuberculosis
cgucgaaggucugcagcagcc

SEQ ID NO: 1002853 - RNA, 22 nt, Mycobacterium avium subsp. paratuberculosis
cgucgaaggucugcagcagccg

SEQ ID NO: 1002854 - RNA, 19 nt, Mycobacterium avium subsp. paratuberculosis
cgucgaacugccaucccuc

SEQ ID NO: 1002855 - RNA, 17 nt, Mycobacterium avium subsp. paratuberculosis
cgucgaccgucacgcug

SEQ ID NO: 1002856 - RNA, 13 nt, Mycobacterium avium subsp. paratuberculosis
cgucgaccgccgc

SEQ ID NO: 1002857 - RNA, 17 nt, Mycobacterium avium subsp. paratuberculosis
cgucgaccgcggccugg

SEQ ID NO: 1002858 - RNA, 15 nt, Mycobacterium avium subsp. paratuberculosis
cgucgaccccgccgg

SEQ ID NO: 1002859 - RNA, 19 nt, Mycobacterium avium subsp. paratuberculosis
cgucgacccggccgcgccg

SEQ ID NO: 1002860 - RNA, 15 nt, Mycobacterium avium subsp. paratuberculosis
cgucgaccaccgccg

SEQ ID NO: 1002861 - RNA, 16 nt, Mycobacterium avium subsp. paratuberculosis
cgucgaccaccgccgg

SEQ ID NO: 1002862 - RNA, 14 nt, Mycobacterium avium subsp. paratuberculosis
cgucgaccagccgc

SEQ ID NO: 1002863 - RNA, 12 nt, Mycobacterium avium subsp. paratuberculosis
cgucgaccacca

SEQ ID NO: 1002864 - RNA, 13 nt, Mycobacterium avium subsp. paratuberculosis
cgucgaccaccac

SEQ ID NO: 1002865 - RNA, 19 nt, Mycobacterium avium subsp. paratuberculosis
cgucgaccaccacgaccag

SEQ ID NO: 1002866 - RNA, 21 nt, Mycobacterium avium subsp. paratuberculosis
cgucgacagccggucgcgcau

SEQ ID NO: 1002867 - RNA, 14 nt, Mycobacterium avium subsp. paratuberculosis
cgucgacacccggg

SEQ ID NO: 1002868 - RNA, 13 nt, Mycobacterium avium subsp. paratuberculosis
cgucgacacgccg

SEQ ID NO: 1002869 - RNA, 23 nt, Mycobacterium avium subsp. paratuberculosis
cguccugauuuuggggacgcuga

SEQ ID NO: 1002870 - RNA, 15 nt, Mycobacterium avium subsp. paratuberculosis
cguccugcagcagcc

SEQ ID NO: 1002871 - RNA, 20 nt, Mycobacterium avium subsp. paratuberculosis
cguccugcagcagccggacc

SEQ ID NO: 1002872 - RNA, 17 nt, Mycobacterium avium subsp. paratuberculosis
cguccucggucaggccg

SEQ ID NO: 1002873 - RNA, 20 nt, Mycobacterium avium subsp. paratuberculosis
cguccucgccguacgcgccg

SEQ ID NO: 1002874 - RNA, 22 nt, Mycobacterium avium subsp. paratuberculosis
cguccucguucuggcccgccau

SEQ ID NO: 1002875 - RNA, 14 nt, Mycobacterium avium subsp. paratuberculosis
cguccuugagcccc

SEQ ID NO: 1002876 - RNA, 14 nt, Mycobacterium avium subsp. paratuberculosis
cgucgaacgcggcg

SEQ ID NO: 1002877 - RNA, 20 nt, Mycobacterium avium subsp. paratuberculosis
cgucgaacgcggcgaagcag

SEQ ID NO: 1002878 - RNA, 21 nt, Mycobacterium avium subsp. paratuberculosis
cgucgaacgggccgggcaccg

SEQ ID NO: 1002879 - RNA, 19 nt, Mycobacterium avium subsp. paratuberculosis
cgucgaaaccgucuccggc

SEQ ID NO: 1002880 - RNA, 21 nt, Mycobacterium avium subsp. paratuberculosis
cgucgaacagccgggccgccc

SEQ ID NO: 1002881 - RNA, 20 nt, Mycobacterium avium subsp. paratuberculosis
cguccuuggugacggccucc

SEQ ID NO: 1002882 - RNA, 22 nt, Mycobacterium avium subsp. paratuberculosis
cguccuuggugauuucgcgcac

SEQ ID NO: 1002883 - RNA, 19 nt, Mycobacterium avium subsp. paratuberculosis
cguccuugucgcgcaccgc

SEQ ID NO: 1002884 - RNA, 20 nt, Mycobacterium avium subsp. paratuberculosis
cguccuugucgcgcaccgcg

SEQ ID NO: 1002885 - RNA, 14 nt, Mycobacterium avium subsp. paratuberculosis
cguccugggccggg

SEQ ID NO: 1002886 - RNA, 18 nt, Mycobacterium avium subsp. paratuberculosis
cguccuucuccgccgggc

SEQ ID NO: 1002887 - RNA, 20 nt, Mycobacterium avium subsp. paratuberculosis
cguccuucucgaaccggggc

SEQ ID NO: 1002888 - RNA, 15 nt, Mycobacterium avium subsp. paratuberculosis
cguccuugacccggc

SEQ ID NO: 1002889 - RNA, 17 nt, Mycobacterium avium subsp. paratuberculosis
cgucgaucucggugagc

SEQ ID NO: 1002890 - RNA, 14 nt, Mycobacterium avium subsp. paratuberculosis
cgucgaugaacagc

SEQ ID NO: 1002891 - RNA, 15 nt, Mycobacterium avium subsp. paratuberculosis
cgucgaucgcccgcu

SEQ ID NO: 1002892 - RNA, 15 nt, Mycobacterium avium subsp. paratuberculosis
cgucgaucgcggcga

SEQ ID NO: 1002893 - RNA, 22 nt, Mycobacterium avium subsp. paratuberculosis
cgucgaugaccucgcgcagccc

SEQ ID NO: 1002894 - RNA, 12 nt, Mycobacterium avium subsp. paratuberculosis
cgucgaugacga

SEQ ID NO: 1002895 - RNA, 13 nt, Mycobacterium avium subsp. paratuberculosis
cgucgaugacgau

SEQ ID NO: 1002896 - RNA, 13 nt, Mycobacterium avium subsp. paratuberculosis
cgucgaugacguc

SEQ ID NO: 1002897 - RNA, 19 nt, Mycobacterium avium subsp. paratuberculosis
cgucgaugaugccggcgga

SEQ ID NO: 1002898 - RNA, 15 nt, Mycobacterium avium subsp. paratuberculosis
cgucgaugcgcagca

SEQ ID NO: 1002899 - RNA, 15 nt, Mycobacterium avium subsp. paratuberculosis
cgucgaugcgcgcca

SEQ ID NO: 1002900 - RNA, 18 nt, Mycobacterium avium subsp. paratuberculosis
cgucgaugugcucggggc

SEQ ID NO: 1002901 - RNA, 19 nt, Mycobacterium avium subsp. paratuberculosis
cgucgaugugcucggggca

SEQ ID NO: 1002902 - RNA, 15 nt, Mycobacterium avium subsp. paratuberculosis
cgucgauggaaggug

SEQ ID NO: 1002903 - RNA, 17 nt, Mycobacterium avium subsp. paratuberculosis
cgucgauggacagggcg

SEQ ID NO: 1002904 - RNA, 16 nt, Mycobacterium avium subsp. paratuberculosis
cgucgauggcgcggcc

SEQ ID NO: 1002905 - RNA, 15 nt, Mycobacterium avium subsp. paratuberculosis
cgucgaucacgccgc

SEQ ID NO: 1002906 - RNA, 21 nt, Mycobacterium avium subsp. paratuberculosis
cgucgaucacgccgccggggc

SEQ ID NO: 1002907 - RNA, 14 nt, Mycobacterium avium subsp. paratuberculosis
cgucgaucagcgcg

SEQ ID NO: 1002908 - RNA, 15 nt, Mycobacterium avium subsp. paratuberculosis
cgucgagccagcggg

SEQ ID NO: 1002909 - RNA, 15 nt, Mycobacterium avium subsp. paratuberculosis
cgucgauccccgcag

SEQ ID NO: 1002910 - RNA, 18 nt, Mycobacterium avium subsp. paratuberculosis
cgucgaucagcgcgccgc

SEQ ID NO: 1002911 - RNA, 16 nt, Mycobacterium avium subsp. paratuberculosis
cgucgaggcgcugcag

SEQ ID NO: 1002912 - RNA, 15 nt, Mycobacterium avium subsp. paratuberculosis
cgucgacgacggcgc

SEQ ID NO: 1002913 - RNA, 19 nt, Mycobacterium avium subsp. paratuberculosis
cgucgacgacggcgccgcg

SEQ ID NO: 1002914 - RNA, 19 nt, Mycobacterium avium subsp. paratuberculosis
cgucgacgggccaccagcg

SEQ ID NO: 1002915 - RNA, 18 nt, Mycobacterium avium subsp. paratuberculosis
cgucgagcagcaccaccc

SEQ ID NO: 1002916 - RNA, 12 nt, Mycobacterium avium subsp. paratuberculosis
cgucgagcaccg

SEQ ID NO: 1002917 - RNA, 18 nt, Mycobacterium avium subsp. paratuberculosis
cgucgagcaccggcagcc

SEQ ID NO: 1002918 - RNA, 18 nt, Mycobacterium avium subsp. paratuberculosis
cgucgagcgcggcccgcc

SEQ ID NO: 1002919 - RNA, 13 nt, Mycobacterium avium subsp. paratuberculosis
cgucgagcggccc

SEQ ID NO: 1002920 - RNA, 12 nt, Mycobacterium avium subsp. paratuberculosis
cgggcugggucc

SEQ ID NO: 1002921 - RNA, 14 nt, Mycobacterium avium subsp. paratuberculosis
cgggcugucccggc

SEQ ID NO: 1002922 - RNA, 18 nt, Mycobacterium avium subsp. paratuberculosis
cgggcugucccggccgcg

SEQ ID NO: 1002923 - RNA, 16 nt, Mycobacterium avium subsp. paratuberculosis
cgggcugugccggcgg

SEQ ID NO: 1002924 - RNA, 21 nt, Mycobacterium avium subsp. paratuberculosis
cgggcugugggcgcagggccg

SEQ ID NO: 1002925 - RNA, 16 nt, Mycobacterium avium subsp. paratuberculosis
cgggcuaucgcccggc

SEQ ID NO: 1002926 - RNA, 18 nt, Mycobacterium avium subsp. paratuberculosis
cgggcuagacgcgcacca

SEQ ID NO: 1002927 - RNA, 18 nt, Mycobacterium avium subsp. paratuberculosis
cgggcuaggcucggcagc

SEQ ID NO: 1002928 - RNA, 22 nt, Mycobacterium avium subsp. paratuberculosis
cgggcucgaacaacccggccgc

SEQ ID NO: 1002929 - RNA, 14 nt, Mycobacterium avium subsp. paratuberculosis
cgggcucgagcacc

SEQ ID NO: 1002930 - RNA, 15 nt, Mycobacterium avium subsp. paratuberculosis
cgggcucgagcccca

SEQ ID NO: 1002931 - RNA, 20 nt, Mycobacterium avium subsp. paratuberculosis
cgggcucgagccccaguucg

SEQ ID NO: 1002932 - RNA, 16 nt, Mycobacterium avium subsp. paratuberculosis
cgggcucccgcucgcc

SEQ ID NO: 1002933 - RNA, 16 nt, Mycobacterium avium subsp. paratuberculosis
cgggcuccgcacgacc

SEQ ID NO: 1002934 - RNA, 14 nt, Mycobacterium avium subsp. paratuberculosis
cgggcuggccaggc

SEQ ID NO: 1002935 - RNA, 16 nt, Mycobacterium avium subsp. paratuberculosis
cgggcuggccaggcuc

SEQ ID NO: 1002936 - RNA, 17 nt, Mycobacterium avium subsp. paratuberculosis
cgggcugcgguuccggg

SEQ ID NO: 1002937 - RNA, 14 nt, Mycobacterium avium subsp. paratuberculosis
cgggcugcccacca

SEQ ID NO: 1002938 - RNA, 17 nt, Mycobacterium avium subsp. paratuberculosis
cgggcugcccaccacca

SEQ ID NO: 1002939 - RNA, 16 nt, Mycobacterium avium subsp. paratuberculosis
cgggcugcagcgacug

SEQ ID NO: 1002940 - RNA, 19 nt, Mycobacterium avium subsp. paratuberculosis
cgggcucgucguugcgcag

SEQ ID NO: 1002941 - RNA, 19 nt, Mycobacterium avium subsp. paratuberculosis
cgggcugaccucgcgcacc

SEQ ID NO: 1002942 - RNA, 16 nt, Mycobacterium avium subsp. paratuberculosis
cggggccagcacgccc

SEQ ID NO: 1002943 - RNA, 18 nt, Mycobacterium avium subsp. paratuberculosis
cggggccagguacuccuc

SEQ ID NO: 1002944 - RNA, 13 nt, Mycobacterium avium subsp. paratuberculosis
cggggcccacccc

SEQ ID NO: 1002945 - RNA, 17 nt, Mycobacterium avium subsp. paratuberculosis
cggggcccaccccggac

SEQ ID NO: 1002946 - RNA, 18 nt, Mycobacterium avium subsp. paratuberculosis
cggggcauggugucagga

SEQ ID NO: 1002947 - RNA, 18 nt, Mycobacterium avium subsp. paratuberculosis
cggggccaacuccggcgg

SEQ ID NO: 1002948 - RNA, 22 nt, Mycobacterium avium subsp. paratuberculosis
cggggccaacuccggcggcagc

SEQ ID NO: 1002949 - RNA, 15 nt, Mycobacterium avium subsp. paratuberculosis
cggggccaccaggcc

SEQ ID NO: 1002950 - RNA, 16 nt, Mycobacterium avium subsp. paratuberculosis
cggggccaccaggccg

SEQ ID NO: 1002951 - RNA, 15 nt, Mycobacterium avium subsp. paratuberculosis
cggggcagcaguguc

SEQ ID NO: 1002952 - RNA, 17 nt, Mycobacterium avium subsp. paratuberculosis
cggggccgcggccggca

SEQ ID NO: 1002953 - RNA, 21 nt, Mycobacterium avium subsp. paratuberculosis
cggggcgaccaguaggccagc

SEQ ID NO: 1002954 - RNA, 12 nt, Mycobacterium avium subsp. paratuberculosis
cggggccuucuu

SEQ ID NO: 1002955 - RNA, 21 nt, Mycobacterium avium subsp. paratuberculosis
cggggccuucuuggcggcggc

SEQ ID NO: 1002956 - RNA, 14 nt, Mycobacterium avium subsp. paratuberculosis
cggggccuccacca

SEQ ID NO: 1002957 - RNA, 20 nt, Mycobacterium avium subsp. paratuberculosis
cggggccuccaccagcggcg

SEQ ID NO: 1002958 - RNA, 13 nt, Mycobacterium avium subsp. paratuberculosis
cggggccuccagc

SEQ ID NO: 1002959 - RNA, 15 nt, Mycobacterium avium subsp. paratuberculosis
cggggccuccagcca

SEQ ID NO: 1002960 - RNA, 14 nt, Mycobacterium avium subsp. paratuberculosis
cggggcccgggccg

SEQ ID NO: 1002961 - RNA, 22 nt, Mycobacterium avium subsp. paratuberculosis
cggggcccguccccaccaccga

SEQ ID NO: 1002962 - RNA, 19 nt, Mycobacterium avium subsp. paratuberculosis
cggggccggcgaugcccgu

SEQ ID NO: 1002963 - RNA, 13 nt, Mycobacterium avium subsp. paratuberculosis
cggggccggcgcg

SEQ ID NO: 1002964 - RNA, 12 nt, Mycobacterium avium subsp. paratuberculosis
cggggccggcgg

SEQ ID NO: 1002965 - RNA, 14 nt, Mycobacterium avium subsp. paratuberculosis
cggggccggcggcg

SEQ ID NO: 1002966 - RNA, 16 nt, Mycobacterium avium subsp. paratuberculosis
cggggccggcggcggc

SEQ ID NO: 1002967 - RNA, 16 nt, Mycobacterium avium subsp. paratuberculosis
cggggccggcgggggc

SEQ ID NO: 1002968 - RNA, 16 nt, Mycobacterium avium subsp. paratuberculosis
cggggacggugcagcc

SEQ ID NO: 1002969 - RNA, 17 nt, Mycobacterium avium subsp. paratuberculosis
cggggacgucgucgucc

SEQ ID NO: 1002970 - RNA, 13 nt, Mycobacterium avium subsp. paratuberculosis
cggggacccgcac

SEQ ID NO: 1002971 - RNA, 14 nt, Mycobacterium avium subsp. paratuberculosis
cggggaauuccggc

SEQ ID NO: 1002972 - RNA, 17 nt, Mycobacterium avium subsp. paratuberculosis
cggggcaagcagcggca

SEQ ID NO: 1002973 - RNA, 19 nt, Mycobacterium avium subsp. paratuberculosis
cggggcaagcagcggcagc

SEQ ID NO: 1002974 - RNA, 20 nt, Mycobacterium avium subsp. paratuberculosis
cggggcaagcagcggcagcc

SEQ ID NO: 1002975 - RNA, 22 nt, Mycobacterium avium subsp. paratuberculosis
cggggcaccauugcgggaaggg

SEQ ID NO: 1002976 - RNA, 15 nt, Mycobacterium avium subsp. paratuberculosis
cggggaggucgucgc

SEQ ID NO: 1002977 - RNA, 14 nt, Mycobacterium avium subsp. paratuberculosis
cggggaugcccggg

SEQ ID NO: 1002978 - RNA, 16 nt, Mycobacterium avium subsp. paratuberculosis
cgggggcgggccccac

SEQ ID NO: 1002979 - RNA, 18 nt, Mycobacterium avium subsp. paratuberculosis
cgggggcgggccccacgc

SEQ ID NO: 1002980 - RNA, 12 nt, Mycobacterium avium subsp. paratuberculosis
cgggggcgggca

SEQ ID NO: 1002981 - RNA, 16 nt, Mycobacterium avium subsp. paratuberculosis
cgggggaucggcggga

SEQ ID NO: 1002982 - RNA, 16 nt, Mycobacterium avium subsp. paratuberculosis
cgggggccgccgcgau

SEQ ID NO: 1002983 - RNA, 14 nt, Mycobacterium avium subsp. paratuberculosis
cggggguggccagc

SEQ ID NO: 1002984 - RNA, 18 nt, Mycobacterium avium subsp. paratuberculosis
cgggggugaaggcggcca

SEQ ID NO: 1002985 - RNA, 22 nt, Mycobacterium avium subsp. paratuberculosis
cgggggugaaggcggccaccgc

SEQ ID NO: 1002986 - RNA, 22 nt, Mycobacterium avium subsp. paratuberculosis
cggggguggcggucccggcgga

SEQ ID NO: 1002987 - RNA, 16 nt, Mycobacterium avium subsp. paratuberculosis
cgggggugggcuccca

SEQ ID NO: 1002988 - RNA, 23 nt, Mycobacterium avium subsp. paratuberculosis
cgggggugucguagcggcugucg

SEQ ID NO: 1002989 - RNA, 23 nt, Mycobacterium avium subsp. paratuberculosis
cgggguacucggcggcgggcagg

SEQ ID NO: 1002990 - RNA, 15 nt, Mycobacterium avium subsp. paratuberculosis
cgggguagggcggcg

SEQ ID NO: 1002991 - RNA, 20 nt, Mycobacterium avium subsp. paratuberculosis
cggggcgccccgcugguagc

SEQ ID NO: 1002992 - RNA, 14 nt, Mycobacterium avium subsp. paratuberculosis
cggggcgcgcaggc

SEQ ID NO: 1002993 - RNA, 17 nt, Mycobacterium avium subsp. paratuberculosis
cggggcgcggaccgcac

SEQ ID NO: 1002994 - RNA, 21 nt, Mycobacterium avium subsp. paratuberculosis
cggggcgccgcugcgggccau

SEQ ID NO: 1002995 - RNA, 18 nt, Mycobacterium avium subsp. paratuberculosis
cggggcgcagcccggcgg

SEQ ID NO: 1002996 - RNA, 18 nt, Mycobacterium avium subsp. paratuberculosis
cggggcgcugagcagguc

SEQ ID NO: 1002997 - RNA, 18 nt, Mycobacterium avium subsp. paratuberculosis
cggggcggcggcgccggg

SEQ ID NO: 1002998 - RNA, 20 nt, Mycobacterium avium subsp. paratuberculosis
cggggcggcggcgccggggc

SEQ ID NO: 1002999 - RNA, 13 nt, Mycobacterium avium subsp. paratuberculosis
cggggcggcggga

SEQ ID NO: 1003000 - RNA, 15 nt, Mycobacterium avium subsp. paratuberculosis
cggggcggcgggcga

SEQ ID NO: 1003001 - RNA, 13 nt, Mycobacterium avium subsp. paratuberculosis
cggggcggcggua

SEQ ID NO: 1003002 - RNA, 16 nt, Mycobacterium avium subsp. paratuberculosis
cggggcgggcacgucg

SEQ ID NO: 1003003 - RNA, 13 nt, Mycobacterium avium subsp. paratuberculosis
cggggcgggcagc

SEQ ID NO: 1003004 - RNA, 20 nt, Mycobacterium avium subsp. paratuberculosis
cggggcguugguugcggccc

SEQ ID NO: 1003005 - RNA, 19 nt, Mycobacterium avium subsp. paratuberculosis
cggggcguggcggaagcgc

SEQ ID NO: 1003006 - RNA, 15 nt, Mycobacterium avium subsp. paratuberculosis
cggggucgucgacgg

SEQ ID NO: 1003007 - RNA, 18 nt, Mycobacterium avium subsp. paratuberculosis
cggggucgucgcggucca

SEQ ID NO: 1003008 - RNA, 14 nt, Mycobacterium avium subsp. paratuberculosis
cggggucugcacga

SEQ ID NO: 1003009 - RNA, 16 nt, Mycobacterium avium subsp. paratuberculosis
cggggugagcaccgcg

SEQ ID NO: 1003010 - RNA, 22 nt, Mycobacterium avium subsp. paratuberculosis
cggggugagcaccgcgaccagc

SEQ ID NO: 1003011 - RNA, 17 nt, Mycobacterium avium subsp. paratuberculosis
cggggugagcagggcca

SEQ ID NO: 1003012 - RNA, 22 nt, Mycobacterium avium subsp. paratuberculosis
cggggucggcgcccucggcgau

SEQ ID NO: 1003013 - RNA, 18 nt, Mycobacterium avium subsp. paratuberculosis
cggggucggcgccgcgcg

SEQ ID NO: 1003014 - RNA, 15 nt, Mycobacterium avium subsp. paratuberculosis
cgggguccucucggc

SEQ ID NO: 1003015 - RNA, 21 nt, Mycobacterium avium subsp. paratuberculosis
cgggguaguucuugacgccga

SEQ ID NO: 1003016 - RNA, 14 nt, Mycobacterium avium subsp. paratuberculosis
cgggguccaccggc

SEQ ID NO: 1003017 - RNA, 15 nt, Mycobacterium avium subsp. paratuberculosis
cgggguccacgcagu

SEQ ID NO: 1003018 - RNA, 14 nt, Mycobacterium avium subsp. paratuberculosis
cggggugucgaccc

SEQ ID NO: 1003019 - RNA, 22 nt, Mycobacterium avium subsp. paratuberculosis
cgggguguagcggauggcgacg

SEQ ID NO: 1003020 - RNA, 14 nt, Mycobacterium avium subsp. paratuberculosis
cggggugguggaag

SEQ ID NO: 1003021 - RNA, 13 nt, Mycobacterium avium subsp. paratuberculosis
cggggugggcacg

SEQ ID NO: 1003022 - RNA, 14 nt, Mycobacterium avium subsp. paratuberculosis
cggggugggccauc

SEQ ID NO: 1003023 - RNA, 20 nt, Mycobacterium avium subsp. paratuberculosis
cggggugggccaucggcaga

SEQ ID NO: 1003024 - RNA, 14 nt, Mycobacterium avium subsp. paratuberculosis
cggggugggcugca

SEQ ID NO: 1003025 - RNA, 17 nt, Mycobacterium avium subsp. paratuberculosis
cggggugggcugcaucu

SEQ ID NO: 1003026 - RNA, 12 nt, Mycobacterium avium subsp. paratuberculosis
cgggguggugga

SEQ ID NO: 1003027 - RNA, 13 nt, Mycobacterium avium subsp. paratuberculosis
cggggugcaccgu

SEQ ID NO: 1003028 - RNA, 12 nt, Mycobacterium avium subsp. paratuberculosis
cggggugcagca

SEQ ID NO: 1003029 - RNA, 16 nt, Mycobacterium avium subsp. paratuberculosis
cggggugcccaccacc

SEQ ID NO: 1003030 - RNA, 13 nt, Mycobacterium avium subsp. paratuberculosis
cggggugccgccc

SEQ ID NO: 1003031 - RNA, 16 nt, Mycobacterium avium subsp. paratuberculosis
cggguaacccuccggc

SEQ ID NO: 1003032 - RNA, 11 nt, Mycobacterium avium subsp. paratuberculosis
cggguacaccg

SEQ ID NO: 1003033 - RNA, 20 nt, Mycobacterium avium subsp. paratuberculosis
cggguacaccgagccggggc

SEQ ID NO: 1003034 - RNA, 13 nt, Mycobacterium avium subsp. paratuberculosis
cggguacagccgc

SEQ ID NO: 1003035 - RNA, 15 nt, Mycobacterium avium subsp. paratuberculosis
cggguaccacuugaa

SEQ ID NO: 1003036 - RNA, 20 nt, Mycobacterium avium subsp. paratuberculosis
cgggguuuugaucagcccgg

SEQ ID NO: 1003037 - RNA, 20 nt, Mycobacterium avium subsp. paratuberculosis
cgggguucaguagcagcguc

SEQ ID NO: 1003038 - RNA, 18 nt, Mycobacterium avium subsp. paratuberculosis
cggggugugcggcacggc

SEQ ID NO: 1003039 - RNA, 21 nt, Mycobacterium avium subsp. paratuberculosis
cgggguguucaccgcgccggg

SEQ ID NO: 1003040 - RNA, 20 nt, Mycobacterium avium subsp. paratuberculosis
cgguaaauugaacgccgcca

SEQ ID NO: 1003041 - RNA, 16 nt, Mycobacterium avium subsp. paratuberculosis
cggguuuucgggccgg

SEQ ID NO: 1003042 - RNA, 16 nt, Mycobacterium avium subsp. paratuberculosis
cggguuggcgcgcacc

SEQ ID NO: 1003043 - RNA, 16 nt, Mycobacterium avium subsp. paratuberculosis
cggguuucggcccggc

SEQ ID NO: 1003044 - RNA, 16 nt, Mycobacterium avium subsp. paratuberculosis
cggguuucgaagacgc

SEQ ID NO: 1003045 - RNA, 21 nt, Mycobacterium avium subsp. paratuberculosis
cggguuucgaagacgccccag

SEQ ID NO: 1003046 - RNA, 19 nt, Mycobacterium avium subsp. paratuberculosis
cggguugggcgccagcagc

SEQ ID NO: 1003047 - RNA, 21 nt, Mycobacterium avium subsp. paratuberculosis
cggguugggcgccugcgguga

SEQ ID NO: 1003048 - RNA, 14 nt, Mycobacterium avium subsp. paratuberculosis
cggguugggcggcg

SEQ ID NO: 1003049 - RNA, 21 nt, Mycobacterium avium subsp. paratuberculosis
cggguugggcggcggccaccu

SEQ ID NO: 1003050 - RNA, 20 nt, Mycobacterium avium subsp. paratuberculosis
cggguugucgucgucggcga

SEQ ID NO: 1003051 - RNA, 18 nt, Mycobacterium avium subsp. paratuberculosis
cggguugcgaaagcccag

SEQ ID NO: 1003052 - RNA, 21 nt, Mycobacterium avium subsp. paratuberculosis
cggguugcaggccacgcccac

SEQ ID NO: 1003053 - RNA, 20 nt, Mycobacterium avium subsp. paratuberculosis
cggguugcgugcagccgcaa

SEQ ID NO: 1003054 - RNA, 17 nt, Mycobacterium avium subsp. paratuberculosis
cggguugcugagccgcc

SEQ ID NO: 1003055 - RNA, 19 nt, Mycobacterium avium subsp. paratuberculosis
cggguucgacgccucggug

SEQ ID NO: 1003056 - RNA, 14 nt, Mycobacterium avium subsp. paratuberculosis
cggguugcgggcca

SEQ ID NO: 1003057 - RNA, 17 nt, Mycobacterium avium subsp. paratuberculosis
cggguugcgggccaggc

SEQ ID NO: 1003058 - RNA, 19 nt, Mycobacterium avium subsp. paratuberculosis
cggguugcgguccccggag

SEQ ID NO: 1003059 - RNA, 21 nt, Mycobacterium avium subsp. paratuberculosis
cggguguauucgcccaccccg

SEQ ID NO: 1003060 - RNA, 19 nt, Mycobacterium avium subsp. paratuberculosis
cgggugucgagccaccacu

SEQ ID NO: 1003061 - RNA, 20 nt, Mycobacterium avium subsp. paratuberculosis
cgggugucgagccaccacug

SEQ ID NO: 1003062 - RNA, 19 nt, Mycobacterium avium subsp. paratuberculosis
cggguuccgguuggccagg

SEQ ID NO: 1003063 - RNA, 20 nt, Mycobacterium avium subsp. paratuberculosis
cggguguugcggcagggcca

SEQ ID NO: 1003064 - RNA, 18 nt, Mycobacterium avium subsp. paratuberculosis
cggguguuggcgcacagc

SEQ ID NO: 1003065 - RNA, 23 nt, Mycobacterium avium subsp. paratuberculosis
cggguuacguggacgcgcgcggc

SEQ ID NO: 1003066 - RNA, 17 nt, Mycobacterium avium subsp. paratuberculosis
cggguucacccuggcga

SEQ ID NO: 1003067 - RNA, 14 nt, Mycobacterium avium subsp. paratuberculosis
cgggugcggccagc

SEQ ID NO: 1003068 - RNA, 22 nt, Mycobacterium avium subsp. paratuberculosis
cgggugcgacggcaauccggcc

SEQ ID NO: 1003069 - RNA, 15 nt, Mycobacterium avium subsp. paratuberculosis
cgggugcggcgcucg

SEQ ID NO: 1003070 - RNA, 22 nt, Mycobacterium avium subsp. paratuberculosis
cgggugcucagguugcgcagca

SEQ ID NO: 1003071 - RNA, 22 nt, Mycobacterium avium subsp. paratuberculosis
cgggugcgggccagcagccgcg

SEQ ID NO: 1003072 - RNA, 16 nt, Mycobacterium avium subsp. paratuberculosis
cggguggccagcacca

SEQ ID NO: 1003073 - RNA, 22 nt, Mycobacterium avium subsp. paratuberculosis
cggguggaucuugacggcgacg

SEQ ID NO: 1003074 - RNA, 15 nt, Mycobacterium avium subsp. paratuberculosis
cggguggccuucauc

SEQ ID NO: 1003075 - RNA, 18 nt, Mycobacterium avium subsp. paratuberculosis
cggguggccuucaucacc

SEQ ID NO: 1003076 - RNA, 19 nt, Mycobacterium avium subsp. paratuberculosis
cggguggccuucaucaccg

SEQ ID NO: 1003077 - RNA, 16 nt, Mycobacterium avium subsp. paratuberculosis
cggguggccggggcca

SEQ ID NO: 1003078 - RNA, 13 nt, Mycobacterium avium subsp. paratuberculosis
cggguggcggggc

SEQ ID NO: 1003079 - RNA, 17 nt, Mycobacterium avium subsp. paratuberculosis
cggguggcguccagaug

SEQ ID NO: 1003080 - RNA, 18 nt, Mycobacterium avium subsp. paratuberculosis
cggguggcgucgccgccg

SEQ ID NO: 1003081 - RNA, 16 nt, Mycobacterium avium subsp. paratuberculosis
cgggugggcggcacac

SEQ ID NO: 1003082 - RNA, 19 nt, Mycobacterium avium subsp. paratuberculosis
cgggucgggaggcagcgcg

SEQ ID NO: 1003083 - RNA, 15 nt, Mycobacterium avium subsp. paratuberculosis
cgggucggcgagcag

SEQ ID NO: 1003084 - RNA, 16 nt, Mycobacterium avium subsp. paratuberculosis
cgggucggcgagcagc

SEQ ID NO: 1003085 - RNA, 17 nt, Mycobacterium avium subsp. paratuberculosis
cgggucggcgagcagcc

SEQ ID NO: 1003086 - RNA, 20 nt, Mycobacterium avium subsp. paratuberculosis
cgggucggcgagcagccgcg

SEQ ID NO: 1003087 - RNA, 21 nt, Mycobacterium avium subsp. paratuberculosis
cgggucggcgagcagccgcgc

SEQ ID NO: 1003088 - RNA, 17 nt, Mycobacterium avium subsp. paratuberculosis
cgggucgcugugcagcg

SEQ ID NO: 1003089 - RNA, 18 nt, Mycobacterium avium subsp. paratuberculosis
cgggucgcggcccaccgc

SEQ ID NO: 1003090 - RNA, 22 nt, Mycobacterium avium subsp. paratuberculosis
cgggucucagcgcccgcccggc

SEQ ID NO: 1003091 - RNA, 21 nt, Mycobacterium avium subsp. paratuberculosis
cgggucgucggccuguccggu

SEQ ID NO: 1003092 - RNA, 18 nt, Mycobacterium avium subsp. paratuberculosis
cgggucguccgcgacgcu

SEQ ID NO: 1003093 - RNA, 18 nt, Mycobacterium avium subsp. paratuberculosis
cgggucggucggcccgcu

SEQ ID NO: 1003094 - RNA, 21 nt, Mycobacterium avium subsp. paratuberculosis
cgggucggugggcagcucguc

SEQ ID NO: 1003095 - RNA, 21 nt, Mycobacterium avium subsp. paratuberculosis
cgggucguagccgaagccgcc

SEQ ID NO: 1003096 - RNA, 24 nt, Mycobacterium avium subsp. paratuberculosis
cgggucguagccgaagccgccguc

SEQ ID NO: 1003097 - RNA, 17 nt, Mycobacterium avium subsp. paratuberculosis
cgggucguagccgucga

SEQ ID NO: 1003098 - RNA, 18 nt, Mycobacterium avium subsp. paratuberculosis
cgggucugccacgcccac

SEQ ID NO: 1003099 - RNA, 18 nt, Mycobacterium avium subsp. paratuberculosis
cgggugaacgaggccgcg

SEQ ID NO: 1003100 - RNA, 19 nt, Mycobacterium avium subsp. paratuberculosis
cgggugauaccggcccagc

SEQ ID NO: 1003101 - RNA, 16 nt, Mycobacterium avium subsp. paratuberculosis
cgggugauccagcccu

SEQ ID NO: 1003102 - RNA, 20 nt, Mycobacterium avium subsp. paratuberculosis
cgggugaaucgacaccgcac

SEQ ID NO: 1003103 - RNA, 17 nt, Mycobacterium avium subsp. paratuberculosis
cgggugagacggccagc

SEQ ID NO: 1003104 - RNA, 12 nt, Mycobacterium avium subsp. paratuberculosis
cgggugcccggc

SEQ ID NO: 1003105 - RNA, 17 nt, Mycobacterium avium subsp. paratuberculosis
cgggugcccggcugggc

SEQ ID NO: 1003106 - RNA, 16 nt, Mycobacterium avium subsp. paratuberculosis
cgggugcaggcccagc

SEQ ID NO: 1003107 - RNA, 13 nt, Mycobacterium avium subsp. paratuberculosis
cgggugaggacgc

SEQ ID NO: 1003108 - RNA, 18 nt, Mycobacterium avium subsp. paratuberculosis
cgggugaggacgcccggc

SEQ ID NO: 1003109 - RNA, 22 nt, Mycobacterium avium subsp. paratuberculosis
cgggugaucuuggccuccaccg

SEQ ID NO: 1003110 - RNA, 21 nt, Mycobacterium avium subsp. paratuberculosis
cgggugauggccgccgcaggc

SEQ ID NO: 1003111 - RNA, 19 nt, Mycobacterium avium subsp. paratuberculosis
cgggugaugucgccgacca

SEQ ID NO: 1003112 - RNA, 19 nt, Mycobacterium avium subsp. paratuberculosis
cggguagugcacggacagc

SEQ ID NO: 1003113 - RNA, 18 nt, Mycobacterium avium subsp. paratuberculosis
cgggucacacccucggcc

SEQ ID NO: 1003114 - RNA, 15 nt, Mycobacterium avium subsp. paratuberculosis
cgggucaccggccga

SEQ ID NO: 1003115 - RNA, 18 nt, Mycobacterium avium subsp. paratuberculosis
cgggucaccggccgagcc

SEQ ID NO: 1003116 - RNA, 22 nt, Mycobacterium avium subsp. paratuberculosis
cgggucaccgugcgggucgcgc

SEQ ID NO: 1003117 - RNA, 20 nt, Mycobacterium avium subsp. paratuberculosis
cggguagggcagccacaucu

SEQ ID NO: 1003118 - RNA, 18 nt, Mycobacterium avium subsp. paratuberculosis
cggguaggugcccggguc

SEQ ID NO: 1003119 - RNA, 13 nt, Mycobacterium avium subsp. paratuberculosis
cggguagcccgcg

SEQ ID NO: 1003120 - RNA, 21 nt, Mycobacterium avium subsp. paratuberculosis
cggguagcccgcgugcacacc

SEQ ID NO: 1003121 - RNA, 19 nt, Mycobacterium avium subsp. paratuberculosis
cggguagacgaucaccggc

SEQ ID NO: 1003122 - RNA, 16 nt, Mycobacterium avium subsp. paratuberculosis
cggguagacgucgggc

SEQ ID NO: 1003123 - RNA, 18 nt, Mycobacterium avium subsp. paratuberculosis
cgggucaguucgcggcgc

SEQ ID NO: 1003124 - RNA, 21 nt, Mycobacterium avium subsp. paratuberculosis
cgggucauccccgugcggggc

SEQ ID NO: 1003125 - RNA, 18 nt, Mycobacterium avium subsp. paratuberculosis
cgggucagcacccgcagc

SEQ ID NO: 1003126 - RNA, 18 nt, Mycobacterium avium subsp. paratuberculosis
cgggucagcaccgcggag

SEQ ID NO: 1003127 - RNA, 13 nt, Mycobacterium avium subsp. paratuberculosis
cgggucagcacca

SEQ ID NO: 1003128 - RNA, 15 nt, Mycobacterium avium subsp. paratuberculosis
cgggucagcaccacc

SEQ ID NO: 1003129 - RNA, 15 nt, Mycobacterium avium subsp. paratuberculosis
cgggucccagaugcg

SEQ ID NO: 1003130 - RNA, 13 nt, Mycobacterium avium subsp. paratuberculosis
cgggucccccgcc

SEQ ID NO: 1003131 - RNA, 18 nt, Mycobacterium avium subsp. paratuberculosis
cgggucccccgccgaccg

SEQ ID NO: 1003132 - RNA, 22 nt, Mycobacterium avium subsp. paratuberculosis
cggguccgcacccgggcccggu

SEQ ID NO: 1003133 - RNA, 17 nt, Mycobacterium avium subsp. paratuberculosis
cggguccagccgccggc

SEQ ID NO: 1003134 - RNA, 14 nt, Mycobacterium avium subsp. paratuberculosis
cggguccagccgcg

SEQ ID NO: 1003135 - RNA, 22 nt, Mycobacterium avium subsp. paratuberculosis
cggguccacgccgagggcggcg

SEQ ID NO: 1003136 - RNA, 14 nt, Mycobacterium avium subsp. paratuberculosis
cggguccuggcccc

SEQ ID NO: 1003137 - RNA, 19 nt, Mycobacterium avium subsp. paratuberculosis
cggguccuggcccccgccc

SEQ ID NO: 1003138 - RNA, 17 nt, Mycobacterium avium subsp. paratuberculosis
cggguccuugcgccccg

SEQ ID NO: 1003139 - RNA, 19 nt, Mycobacterium avium subsp. paratuberculosis
cggguccuugcgccccggc

SEQ ID NO: 1003140 - RNA, 20 nt, Mycobacterium avium subsp. paratuberculosis
cggguccuugcgccccggcg

SEQ ID NO: 1003141 - RNA, 16 nt, Mycobacterium avium subsp. paratuberculosis
cgggucgaccgccucg

SEQ ID NO: 1003142 - RNA, 15 nt, Mycobacterium avium subsp. paratuberculosis
cgggucgacgagcag

SEQ ID NO: 1003143 - RNA, 16 nt, Mycobacterium avium subsp. paratuberculosis
cgggucgagcgcgccg

SEQ ID NO: 1003144 - RNA, 22 nt, Mycobacterium avium subsp. paratuberculosis
cgggucgcacagccgcagcagc

SEQ ID NO: 1003145 - RNA, 16 nt, Mycobacterium avium subsp. paratuberculosis
cgggucgcaggcagca

SEQ ID NO: 1003146 - RNA, 22 nt, Mycobacterium avium subsp. paratuberculosis
cgggucgcaggcagcagcaccc

SEQ ID NO: 1003147 - RNA, 18 nt, Mycobacterium avium subsp. paratuberculosis
cggucagcgucuggcggg

SEQ ID NO: 1003148 - RNA, 12 nt, Mycobacterium avium subsp. paratuberculosis
cggucagcaccg

SEQ ID NO: 1003149 - RNA, 14 nt, Mycobacterium avium subsp. paratuberculosis
cggucagcacgcug

SEQ ID NO: 1003150 - RNA, 13 nt, Mycobacterium avium subsp. paratuberculosis
cggucagcgcauc

SEQ ID NO: 1003151 - RNA, 17 nt, Mycobacterium avium subsp. paratuberculosis
cggucagcgccagcaug

SEQ ID NO: 1003152 - RNA, 15 nt, Mycobacterium avium subsp. paratuberculosis
cggucagccgcggcu

SEQ ID NO: 1003153 - RNA, 18 nt, Mycobacterium avium subsp. paratuberculosis
cggucagcgcgucggcga

SEQ ID NO: 1003154 - RNA, 15 nt, Mycobacterium avium subsp. paratuberculosis
cggucacggucuggc

SEQ ID NO: 1003155 - RNA, 23 nt, Mycobacterium avium subsp. paratuberculosis
cggucagcggcgucaggauggug

SEQ ID NO: 1003156 - RNA, 18 nt, Mycobacterium avium subsp. paratuberculosis
cggucacggcgucggcgu

SEQ ID NO: 1003157 - RNA, 21 nt, Mycobacterium avium subsp. paratuberculosis
cggucagaccuucgcgaucac

SEQ ID NO: 1003158 - RNA, 20 nt, Mycobacterium avium subsp. paratuberculosis
cggucacgcugaucgaccgg

SEQ ID NO: 1003159 - RNA, 15 nt, Mycobacterium avium subsp. paratuberculosis
cggucacgcuggcgu

SEQ ID NO: 1003160 - RNA, 22 nt, Mycobacterium avium subsp. paratuberculosis
cggucaccggucggugcccagc

SEQ ID NO: 1003161 - RNA, 20 nt, Mycobacterium avium subsp. paratuberculosis
cggucaccggugucacgcug

SEQ ID NO: 1003162 - RNA, 14 nt, Mycobacterium avium subsp. paratuberculosis
cgguauuggccacg

SEQ ID NO: 1003163 - RNA, 13 nt, Mycobacterium avium subsp. paratuberculosis
cggucacagccgc

SEQ ID NO: 1003164 - RNA, 13 nt, Mycobacterium avium subsp. paratuberculosis
cggucacccaggc

SEQ ID NO: 1003165 - RNA, 18 nt, Mycobacterium avium subsp. paratuberculosis
cggucaccccggccauca

SEQ ID NO: 1003166 - RNA, 21 nt, Mycobacterium avium subsp. paratuberculosis
cggucacccgugggccgaccg

SEQ ID NO: 1003167 - RNA, 17 nt, Mycobacterium avium subsp. paratuberculosis
cgguaugcggcgacgau

SEQ ID NO: 1003168 - RNA, 15 nt, Mycobacterium avium subsp. paratuberculosis
cgguagcguggguuc

SEQ ID NO: 1003169 - RNA, 13 nt, Mycobacterium avium subsp. paratuberculosis
cgguaggcggcca

SEQ ID NO: 1003170 - RNA, 15 nt, Mycobacterium avium subsp. paratuberculosis
cgguaggcggccagc

SEQ ID NO: 1003171 - RNA, 13 nt, Mycobacterium avium subsp. paratuberculosis
cgguaggccgccg

SEQ ID NO: 1003172 - RNA, 17 nt, Mycobacterium avium subsp. paratuberculosis
cgguaggccggccgcag

SEQ ID NO: 1003173 - RNA, 14 nt, Mycobacterium avium subsp. paratuberculosis
cgguaggcgcaccg

SEQ ID NO: 1003174 - RNA, 23 nt, Mycobacterium avium subsp. paratuberculosis
cgguaggcgcaccgccgggcauc

SEQ ID NO: 1003175 - RNA, 21 nt, Mycobacterium avium subsp. paratuberculosis
cgguaggugaucgccucgacc

SEQ ID NO: 1003176 - RNA, 18 nt, Mycobacterium avium subsp. paratuberculosis
cgguagccagcaccgccc

SEQ ID NO: 1003177 - RNA, 15 nt, Mycobacterium avium subsp. paratuberculosis
cgguagcgcagcacc

SEQ ID NO: 1003178 - RNA, 17 nt, Mycobacterium avium subsp. paratuberculosis
cgguagcgcagcaccag

SEQ ID NO: 1003179 - RNA, 16 nt, Mycobacterium avium subsp. paratuberculosis
cgguagccgcucgccc

SEQ ID NO: 1003180 - RNA, 19 nt, Mycobacterium avium subsp. paratuberculosis
cgguagccgcucgcccagc

SEQ ID NO: 1003181 - RNA, 16 nt, Mycobacterium avium subsp. paratuberculosis
cgguagccugcagugu

SEQ ID NO: 1003182 - RNA, 20 nt, Mycobacterium avium subsp. paratuberculosis
cgguagaaccaacgcggcgc

SEQ ID NO: 1003183 - RNA, 18 nt, Mycobacterium avium subsp. paratuberculosis
cgguagagcggcaccagg

SEQ ID NO: 1003184 - RNA, 17 nt, Mycobacterium avium subsp. paratuberculosis
cgguagauauggcccuc

SEQ ID NO: 1003185 - RNA, 21 nt, Mycobacterium avium subsp. paratuberculosis
cgguaccgaugaccaccgcug

SEQ ID NO: 1003186 - RNA, 23 nt, Mycobacterium avium subsp. paratuberculosis
cgguaccagggcagcgccucggc

SEQ ID NO: 1003187 - RNA, 18 nt, Mycobacterium avium subsp. paratuberculosis
cgguaacugcguguggcg

SEQ ID NO: 1003188 - RNA, 14 nt, Mycobacterium avium subsp. paratuberculosis
aaacuagcuucacg

SEQ ID NO: 1003189 - RNA, 20 nt, Mycobacterium avium subsp. paratuberculosis
cggucaggaacccggcccgg

SEQ ID NO: 1003190 - RNA, 11 nt, Mycobacterium avium subsp. paratuberculosis
cggucaggccg

SEQ ID NO: 1003191 - RNA, 20 nt, Mycobacterium avium subsp. paratuberculosis
cggucagucgcgccgccagc

SEQ ID NO: 1003192 - RNA, 23 nt, Mycobacterium avium subsp. paratuberculosis
cgguccaacguggguggccccuc

SEQ ID NO: 1003193 - RNA, 22 nt, Mycobacterium avium subsp. paratuberculosis
cggucauccucgccgcgccagc

SEQ ID NO: 1003194 - RNA, 18 nt, Mycobacterium avium subsp. paratuberculosis
cgguccagaucggcgcgc

SEQ ID NO: 1003195 - RNA, 24 nt, Mycobacterium avium subsp. paratuberculosis
cgguccacggugucgcuguaggcc

SEQ ID NO: 1003196 - RNA, 19 nt, Mycobacterium avium subsp. paratuberculosis
cgguccacuuccgcgcagg

SEQ ID NO: 1003197 - RNA, 14 nt, Mycobacterium avium subsp. paratuberculosis
cgguccaccaccac

SEQ ID NO: 1003198 - RNA, 20 nt, Mycobacterium avium subsp. paratuberculosis
cgguccaccaccacacccgc

SEQ ID NO: 1003199 - RNA, 13 nt, Mycobacterium avium subsp. paratuberculosis
cgguccaccagaa

SEQ ID NO: 1003200 - RNA, 13 nt, Mycobacterium avium subsp. paratuberculosis
cggucccgacagg

SEQ ID NO: 1003201 - RNA, 17 nt, Mycobacterium avium subsp. paratuberculosis
cggucccgacgcggcgc

SEQ ID NO: 1003202 - RNA, 14 nt, Mycobacterium avium subsp. paratuberculosis
cggucccgcggcgg

SEQ ID NO: 1003203 - RNA, 13 nt, Mycobacterium avium subsp. paratuberculosis
cggucccggcggg

SEQ ID NO: 1003204 - RNA, 20 nt, Mycobacterium avium subsp. paratuberculosis
cggucccggggcucgacagg

SEQ ID NO: 1003205 - RNA, 15 nt, Mycobacterium avium subsp. paratuberculosis
cgguccgaccgccac

SEQ ID NO: 1003206 - RNA, 20 nt, Mycobacterium avium subsp. paratuberculosis
cgguccgaccgccaccaccc

SEQ ID NO: 1003207 - RNA, 20 nt, Mycobacterium avium subsp. paratuberculosis
cgguccgaucguccggcgcc

SEQ ID NO: 1003208 - RNA, 19 nt, Mycobacterium avium subsp. paratuberculosis
cgguccaguacaccgcgag

SEQ ID NO: 1003209 - RNA, 16 nt, Mycobacterium avium subsp. paratuberculosis
cgguccaucagcaccg

SEQ ID NO: 1003210 - RNA, 17 nt, Mycobacterium avium subsp. paratuberculosis
cgguccauccagcgccg

SEQ ID NO: 1003211 - RNA, 21 nt, Mycobacterium avium subsp. paratuberculosis
cgguccauccagcgccgcagc

SEQ ID NO: 1003212 - RNA, 20 nt, Mycobacterium avium subsp. paratuberculosis
cgguccaucuccagcuccgc

SEQ ID NO: 1003213 - RNA, 16 nt, Mycobacterium avium subsp. paratuberculosis
cggucgaugugcgcgc

SEQ ID NO: 1003214 - RNA, 23 nt, Mycobacterium avium subsp. paratuberculosis
cggucgcaccgcggcguggacgu

SEQ ID NO: 1003215 - RNA, 15 nt, Mycobacterium avium subsp. paratuberculosis
cggucgccaccacca

SEQ ID NO: 1003216 - RNA, 21 nt, Mycobacterium avium subsp. paratuberculosis
cggucgccaccaccacggggc

SEQ ID NO: 1003217 - RNA, 16 nt, Mycobacterium avium subsp. paratuberculosis
cggucgccaccaccag

SEQ ID NO: 1003218 - RNA, 18 nt, Mycobacterium avium subsp. paratuberculosis
cggucgccaccaccagcg

SEQ ID NO: 1003219 - RNA, 20 nt, Mycobacterium avium subsp. paratuberculosis
cggucgccaccaccagcggg

SEQ ID NO: 1003220 - RNA, 15 nt, Mycobacterium avium subsp. paratuberculosis
cggucgccgcgccgc

SEQ ID NO: 1003221 - RNA, 18 nt, Mycobacterium avium subsp. paratuberculosis
cggucgcaggccgcccgg

SEQ ID NO: 1003222 - RNA, 20 nt, Mycobacterium avium subsp. paratuberculosis
cggucgccacggccggcagc

SEQ ID NO: 1003223 - RNA, 14 nt, Mycobacterium avium subsp. paratuberculosis
cggucgccagcacc

SEQ ID NO: 1003224 - RNA, 15 nt, Mycobacterium avium subsp. paratuberculosis
cggucgccagcaccg

SEQ ID NO: 1003225 - RNA, 14 nt, Mycobacterium avium subsp. paratuberculosis
cggucgccccagaa

SEQ ID NO: 1003226 - RNA, 19 nt, Mycobacterium avium subsp. paratuberculosis
cggucgcggaaccggccgg

SEQ ID NO: 1003227 - RNA, 21 nt, Mycobacterium avium subsp. paratuberculosis
cggucgcggucggcgcccggc

SEQ ID NO: 1003228 - RNA, 19 nt, Mycobacterium avium subsp. paratuberculosis
cggucgcggugcccagccg

SEQ ID NO: 1003229 - RNA, 13 nt, Mycobacterium avium subsp. paratuberculosis
cggucgcgcagcc

SEQ ID NO: 1003230 - RNA, 14 nt, Mycobacterium avium subsp. paratuberculosis
cggucgcgcagccg

SEQ ID NO: 1003231 - RNA, 20 nt, Mycobacterium avium subsp. paratuberculosis
cggucgcgcaucgccucggc

SEQ ID NO: 1003232 - RNA, 15 nt, Mycobacterium avium subsp. paratuberculosis
cggucgcgcgccggc

SEQ ID NO: 1003233 - RNA, 17 nt, Mycobacterium avium subsp. paratuberculosis
cgguccuuggccugcuu

SEQ ID NO: 1003234 - RNA, 14 nt, Mycobacterium avium subsp. paratuberculosis
cgguccuccccgcu

SEQ ID NO: 1003235 - RNA, 15 nt, Mycobacterium avium subsp. paratuberculosis
cgguccuccccgcug

SEQ ID NO: 1003236 - RNA, 15 nt, Mycobacterium avium subsp. paratuberculosis
cgguccgccgucggg

SEQ ID NO: 1003237 - RNA, 15 nt, Mycobacterium avium subsp. paratuberculosis
cgguccgcuccacca

SEQ ID NO: 1003238 - RNA, 12 nt, Mycobacterium avium subsp. paratuberculosis
cgguccgcccgg

SEQ ID NO: 1003239 - RNA, 19 nt, Mycobacterium avium subsp. paratuberculosis
cgguccgcccggaccaggg

SEQ ID NO: 1003240 - RNA, 14 nt, Mycobacterium avium subsp. paratuberculosis
cgguccgccgcagc

SEQ ID NO: 1003241 - RNA, 21 nt, Mycobacterium avium subsp. paratuberculosis
cgguccggcgaauccgaccgg

SEQ ID NO: 1003242 - RNA, 20 nt, Mycobacterium avium subsp. paratuberculosis
cgguccggcugaacgccagc

SEQ ID NO: 1003243 - RNA, 20 nt, Mycobacterium avium subsp. paratuberculosis
cgguccggucacgcccgggg

SEQ ID NO: 1003244 - RNA, 16 nt, Mycobacterium avium subsp. paratuberculosis
cgguccgugccacggc

SEQ ID NO: 1003245 - RNA, 13 nt, Mycobacterium avium subsp. paratuberculosis
cggucgaucaccu

SEQ ID NO: 1003246 - RNA, 23 nt, Mycobacterium avium subsp. paratuberculosis
cggucgaugacgccgcgccgccc

SEQ ID NO: 1003247 - RNA, 22 nt, Mycobacterium avium subsp. paratuberculosis
cggucgaugagcuggugcagcg

SEQ ID NO: 1003248 - RNA, 19 nt, Mycobacterium avium subsp. paratuberculosis
cggucgaccagcuccugga

SEQ ID NO: 1003249 - RNA, 19 nt, Mycobacterium avium subsp. paratuberculosis
cggucgacgcggggcggcg

SEQ ID NO: 1003250 - RNA, 17 nt, Mycobacterium avium subsp. paratuberculosis
cggugaacgucgauccc

SEQ ID NO: 1003251 - RNA, 15 nt, Mycobacterium avium subsp. paratuberculosis
cggugaacugcagcc

SEQ ID NO: 1003252 - RNA, 18 nt, Mycobacterium avium subsp. paratuberculosis
cggugaaguuggcggcgg

SEQ ID NO: 1003253 - RNA, 15 nt, Mycobacterium avium subsp. paratuberculosis
cggugaacgggccgc

SEQ ID NO: 1003254 - RNA, 18 nt, Mycobacterium avium subsp. paratuberculosis
cggugaagcgggacagca

SEQ ID NO: 1003255 - RNA, 18 nt, Mycobacterium avium subsp. paratuberculosis
cggugaccgucgccgacc

SEQ ID NO: 1003256 - RNA, 21 nt, Mycobacterium avium subsp. paratuberculosis
cggugaauucaucguccccuc

SEQ ID NO: 1003257 - RNA, 21 nt, Mycobacterium avium subsp. paratuberculosis
cggugacaucgccaccuggaa

SEQ ID NO: 1003258 - RNA, 19 nt, Mycobacterium avium subsp. paratuberculosis
cggugaccacgccgugccc

SEQ ID NO: 1003259 - RNA, 22 nt, Mycobacterium avium subsp. paratuberculosis
cggugaccacgccgugcccggc

SEQ ID NO: 1003260 - RNA, 14 nt, Mycobacterium avium subsp. paratuberculosis
cggugaccacgcug

SEQ ID NO: 1003261 - RNA, 15 nt, Mycobacterium avium subsp. paratuberculosis
cggugaccacggucg

SEQ ID NO: 1003262 - RNA, 16 nt, Mycobacterium avium subsp. paratuberculosis
cggugacgaugauguc

SEQ ID NO: 1003263 - RNA, 14 nt, Mycobacterium avium subsp. paratuberculosis
cggugaccgcccgc

SEQ ID NO: 1003264 - RNA, 18 nt, Mycobacterium avium subsp. paratuberculosis
cggugaccggaucggcca

SEQ ID NO: 1003265 - RNA, 22 nt, Mycobacterium avium subsp. paratuberculosis
cggugaccggaucggccagcag

SEQ ID NO: 1003266 - RNA, 18 nt, Mycobacterium avium subsp. paratuberculosis
cggugaccucgagcaccg

SEQ ID NO: 1003267 - RNA, 17 nt, Mycobacterium avium subsp. paratuberculosis
cggugacgaccggcagc

SEQ ID NO: 1003268 - RNA, 17 nt, Mycobacterium avium subsp. paratuberculosis
cggugacgaggagggug

SEQ ID NO: 1003269 - RNA, 19 nt, Mycobacterium avium subsp. paratuberculosis
cggugagcuggccgcgcag

SEQ ID NO: 1003270 - RNA, 13 nt, Mycobacterium avium subsp. paratuberculosis
cggugaggcuggg

SEQ ID NO: 1003271 - RNA, 14 nt, Mycobacterium avium subsp. paratuberculosis
cggugagcaccgcc

SEQ ID NO: 1003272 - RNA, 18 nt, Mycobacterium avium subsp. paratuberculosis
cggugagcacgaccgcca

SEQ ID NO: 1003273 - RNA, 20 nt, Mycobacterium avium subsp. paratuberculosis
cggugagcacgaccgccagc

SEQ ID NO: 1003274 - RNA, 15 nt, Mycobacterium avium subsp. paratuberculosis
cggugagcagcaugc

SEQ ID NO: 1003275 - RNA, 23 nt, Mycobacterium avium subsp. paratuberculosis
cggugagcagcucggucaccagc

SEQ ID NO: 1003276 - RNA, 12 nt, Mycobacterium avium subsp. paratuberculosis
cggugagccgcc

SEQ ID NO: 1003277 - RNA, 18 nt, Mycobacterium avium subsp. paratuberculosis
cggugagccgcuggaugu

SEQ ID NO: 1003278 - RNA, 17 nt, Mycobacterium avium subsp. paratuberculosis
cggugagcgccaccccg

SEQ ID NO: 1003279 - RNA, 18 nt, Mycobacterium avium subsp. paratuberculosis
cggucucgaccgcggcgc

SEQ ID NO: 1003280 - RNA, 19 nt, Mycobacterium avium subsp. paratuberculosis
cggucucgaccgcggcgcc

SEQ ID NO: 1003281 - RNA, 18 nt, Mycobacterium avium subsp. paratuberculosis
cggucucgacguuggaga

SEQ ID NO: 1003282 - RNA, 18 nt, Mycobacterium avium subsp. paratuberculosis
cggucucgaucugcacca

SEQ ID NO: 1003283 - RNA, 15 nt, Mycobacterium avium subsp. paratuberculosis
cggucucgccccggc

SEQ ID NO: 1003284 - RNA, 16 nt, Mycobacterium avium subsp. paratuberculosis
cggucuuguugugcug

SEQ ID NO: 1003285 - RNA, 15 nt, Mycobacterium avium subsp. paratuberculosis
cggucuucccgccgc

SEQ ID NO: 1003286 - RNA, 15 nt, Mycobacterium avium subsp. paratuberculosis
cggucuuggacagca

SEQ ID NO: 1003287 - RNA, 19 nt, Mycobacterium avium subsp. paratuberculosis
cggucuuggcggccagcgc

SEQ ID NO: 1003288 - RNA, 22 nt, Mycobacterium avium subsp. paratuberculosis
cggucuuggcggccagcgccuu

SEQ ID NO: 1003289 - RNA, 21 nt, Mycobacterium avium subsp. paratuberculosis
cggucgucgagcaccggcugg

SEQ ID NO: 1003290 - RNA, 19 nt, Mycobacterium avium subsp. paratuberculosis
cggucgugcgacuccuggg

SEQ ID NO: 1003291 - RNA, 17 nt, Mycobacterium avium subsp. paratuberculosis
cggucguuggccuccuc

SEQ ID NO: 1003292 - RNA, 17 nt, Mycobacterium avium subsp. paratuberculosis
cggucggugcccagcac

SEQ ID NO: 1003293 - RNA, 19 nt, Mycobacterium avium subsp. paratuberculosis
cggucggugcccagcaccg

SEQ ID NO: 1003294 - RNA, 16 nt, Mycobacterium avium subsp. paratuberculosis
cggucggugcgcagca

SEQ ID NO: 1003295 - RNA, 21 nt, Mycobacterium avium subsp. paratuberculosis
cggucggggaauuccggcgcg

SEQ ID NO: 1003296 - RNA, 14 nt, Mycobacterium avium subsp. paratuberculosis
cggucggucggccg

SEQ ID NO: 1003297 - RNA, 16 nt, Mycobacterium avium subsp. paratuberculosis
cggucggucggccgca

SEQ ID NO: 1003298 - RNA, 17 nt, Mycobacterium avium subsp. paratuberculosis
cggucggcauagcgccg

SEQ ID NO: 1003299 - RNA, 19 nt, Mycobacterium avium subsp. paratuberculosis
cggucggcauagcgccgcu

SEQ ID NO: 1003300 - RNA, 13 nt, Mycobacterium avium subsp. paratuberculosis
cggucggcccgcu

SEQ ID NO: 1003301 - RNA, 21 nt, Mycobacterium avium subsp. paratuberculosis
cggucggcgcccggcccagcc

SEQ ID NO: 1003302 - RNA, 22 nt, Mycobacterium avium subsp. paratuberculosis
cggucggcgcccggcccagccg

SEQ ID NO: 1003303 - RNA, 23 nt, Mycobacterium avium subsp. paratuberculosis
cggucggcgcccggcccagccgc

SEQ ID NO: 1003304 - RNA, 14 nt, Mycobacterium avium subsp. paratuberculosis
cggucggcgccgau

SEQ ID NO: 1003305 - RNA, 15 nt, Mycobacterium avium subsp. paratuberculosis
cggucggcgcggggc

SEQ ID NO: 1003306 - RNA, 19 nt, Mycobacterium avium subsp. paratuberculosis
cggucggcgcucgcgggug

SEQ ID NO: 1003307 - RNA, 22 nt, Mycobacterium avium subsp. paratuberculosis
cgggcacgacggucagcacgcu

SEQ ID NO: 1003308 - RNA, 22 nt, Mycobacterium avium subsp. paratuberculosis
cgggcaccugauaggggucggc

SEQ ID NO: 1003309 - RNA, 15 nt, Mycobacterium avium subsp. paratuberculosis
cgggcaccucggcca

SEQ ID NO: 1003310 - RNA, 18 nt, Mycobacterium avium subsp. paratuberculosis
cgggcaccucggccaggu

SEQ ID NO: 1003311 - RNA, 18 nt, Mycobacterium avium subsp. paratuberculosis
cgggcaccucggcgucgg

SEQ ID NO: 1003312 - RNA, 13 nt, Mycobacterium avium subsp. paratuberculosis
cgggcacggcgau

SEQ ID NO: 1003313 - RNA, 15 nt, Mycobacterium avium subsp. paratuberculosis
cgggcacguccagcc

SEQ ID NO: 1003314 - RNA, 15 nt, Mycobacterium avium subsp. paratuberculosis
cgggcacgucgacgc

SEQ ID NO: 1003315 - RNA, 15 nt, Mycobacterium avium subsp. paratuberculosis
cgggcacgccgccgc

SEQ ID NO: 1003316 - RNA, 16 nt, Mycobacterium avium subsp. paratuberculosis
cgggcacgccgccgcg

SEQ ID NO: 1003317 - RNA, 13 nt, Mycobacterium avium subsp. paratuberculosis
cgggcacgcgaga

SEQ ID NO: 1003318 - RNA, 15 nt, Mycobacterium avium subsp. paratuberculosis
cgggcaaucggaccc

SEQ ID NO: 1003319 - RNA, 14 nt, Mycobacterium avium subsp. paratuberculosis
cgggcaccccugcc

SEQ ID NO: 1003320 - RNA, 15 nt, Mycobacterium avium subsp. paratuberculosis
cgggcacccgcgcgu

SEQ ID NO: 1003321 - RNA, 18 nt, Mycobacterium avium subsp. paratuberculosis
cgggcacccggcgcggcc

SEQ ID NO: 1003322 - RNA, 22 nt, Mycobacterium avium subsp. paratuberculosis
cgggcacccggguggacaccgc

SEQ ID NO: 1003323 - RNA, 22 nt, Mycobacterium avium subsp. paratuberculosis
cgggcacacgcgguccacuucc

SEQ ID NO: 1003324 - RNA, 21 nt, Mycobacterium avium subsp. paratuberculosis
cgggcacagccagcgcccggc

SEQ ID NO: 1003325 - RNA, 16 nt, Mycobacterium avium subsp. paratuberculosis
cgggcacauagcucag

SEQ ID NO: 1003326 - RNA, 13 nt, Mycobacterium avium subsp. paratuberculosis
cgggcaccacgcc

SEQ ID NO: 1003327 - RNA, 14 nt, Mycobacterium avium subsp. paratuberculosis
cgggcaccacgccg

SEQ ID NO: 1003328 - RNA, 14 nt, Mycobacterium avium subsp. paratuberculosis
cgggcaccagcacc

SEQ ID NO: 1003329 - RNA, 19 nt, Mycobacterium avium subsp. paratuberculosis
cgggauugaggcuggcgau

SEQ ID NO: 1003330 - RNA, 16 nt, Mycobacterium avium subsp. paratuberculosis
cgggcaacagcgcgcc

SEQ ID NO: 1003331 - RNA, 17 nt, Mycobacterium avium subsp. paratuberculosis
cgggcagcuuccgccuc

SEQ ID NO: 1003332 - RNA, 14 nt, Mycobacterium avium subsp. paratuberculosis
cgggcaggcggcgc

SEQ ID NO: 1003333 - RNA, 18 nt, Mycobacterium avium subsp. paratuberculosis
cgggcagguggucggcga

SEQ ID NO: 1003334 - RNA, 14 nt, Mycobacterium avium subsp. paratuberculosis
cgggcagcgcgcga

SEQ ID NO: 1003335 - RNA, 24 nt, Mycobacterium avium subsp. paratuberculosis
cgggcagccgcacaccgcggcggc

SEQ ID NO: 1003336 - RNA, 18 nt, Mycobacterium avium subsp. paratuberculosis
cgggcagcgagcacagcg

SEQ ID NO: 1003337 - RNA, 14 nt, Mycobacterium avium subsp. paratuberculosis
cgggcagcccaggu

SEQ ID NO: 1003338 - RNA, 12 nt, Mycobacterium avium subsp. paratuberculosis
cgggcagcagca

SEQ ID NO: 1003339 - RNA, 15 nt, Mycobacterium avium subsp. paratuberculosis
cgggcagcagcacca

SEQ ID NO: 1003340 - RNA, 21 nt, Mycobacterium avium subsp. paratuberculosis
cgggcagcccgccgaccaccu

SEQ ID NO: 1003341 - RNA, 17 nt, Mycobacterium avium subsp. paratuberculosis
cgggcagcccgccgcgg

SEQ ID NO: 1003342 - RNA, 20 nt, Mycobacterium avium subsp. paratuberculosis
cgggcacuuaacaccucgcc

SEQ ID NO: 1003343 - RNA, 15 nt, Mycobacterium avium subsp. paratuberculosis
cgggccacacacugc

SEQ ID NO: 1003344 - RNA, 22 nt, Mycobacterium avium subsp. paratuberculosis
cgggccacacacugcugcgcag

SEQ ID NO: 1003345 - RNA, 20 nt, Mycobacterium avium subsp. paratuberculosis
cgggcauuggcagcucgggc

SEQ ID NO: 1003346 - RNA, 21 nt, Mycobacterium avium subsp. paratuberculosis
cgggccaacgguucggccgcu

SEQ ID NO: 1003347 - RNA, 22 nt, Mycobacterium avium subsp. paratuberculosis
cgggccaacgguucggccgcuc

SEQ ID NO: 1003348 - RNA, 18 nt, Mycobacterium avium subsp. paratuberculosis
cgggcaugaaccaggccg

SEQ ID NO: 1003349 - RNA, 13 nt, Mycobacterium avium subsp. paratuberculosis
cgggcaugcccgu

SEQ ID NO: 1003350 - RNA, 15 nt, Mycobacterium avium subsp. paratuberculosis
cgggcaugccggccg

SEQ ID NO: 1003351 - RNA, 18 nt, Mycobacterium avium subsp. paratuberculosis
cgggcaugccgucggcgc

SEQ ID NO: 1003352 - RNA, 24 nt, Mycobacterium avium subsp. paratuberculosis
cgggcaucucguugucgucggggc

SEQ ID NO: 1003353 - RNA, 17 nt, Mycobacterium avium subsp. paratuberculosis
cgggcauacugcuugcc

SEQ ID NO: 1003354 - RNA, 20 nt, Mycobacterium avium subsp. paratuberculosis
cgggcauccggcucagaagg

SEQ ID NO: 1003355 - RNA, 19 nt, Mycobacterium avium subsp. paratuberculosis
cgggcauccgggccgccgc

SEQ ID NO: 1003356 - RNA, 21 nt, Mycobacterium avium subsp. paratuberculosis
cgggcauccgggccgccgcgg

SEQ ID NO: 1003357 - RNA, 19 nt, Mycobacterium avium subsp. paratuberculosis
cgggcaguuccuugcgcag

SEQ ID NO: 1003358 - RNA, 20 nt, Mycobacterium avium subsp. paratuberculosis
cgggcaguuccuugcgcagc

SEQ ID NO: 1003359 - RNA, 21 nt, Mycobacterium avium subsp. paratuberculosis
cgggcaguuccuugcgcagca

SEQ ID NO: 1003360 - RNA, 14 nt, Mycobacterium avium subsp. paratuberculosis
cgggaaucacgccc

SEQ ID NO: 1003361 - RNA, 21 nt, Mycobacterium avium subsp. paratuberculosis
cgggaaucgagggcgcgcagc

SEQ ID NO: 1003362 - RNA, 15 nt, Mycobacterium avium subsp. paratuberculosis
cgggaagggcccggg

SEQ ID NO: 1003363 - RNA, 16 nt, Mycobacterium avium subsp. paratuberculosis
cgggaaggugucggcc

SEQ ID NO: 1003364 - RNA, 18 nt, Mycobacterium avium subsp. paratuberculosis
cgggaaugucgcgcagca

SEQ ID NO: 1003365 - RNA, 19 nt, Mycobacterium avium subsp. paratuberculosis
cgggaccgaggugccgcgg

SEQ ID NO: 1003366 - RNA, 16 nt, Mycobacterium avium subsp. paratuberculosis
cgggacaacaccaccu

SEQ ID NO: 1003367 - RNA, 18 nt, Mycobacterium avium subsp. paratuberculosis
cgggacagguagcgcagc

SEQ ID NO: 1003368 - RNA, 19 nt, Mycobacterium avium subsp. paratuberculosis
cgggacagguagcgcagcc

SEQ ID NO: 1003369 - RNA, 22 nt, Mycobacterium avium subsp. paratuberculosis
cgggacaucgucgcgcccagga

SEQ ID NO: 1003370 - RNA, 13 nt, Mycobacterium avium subsp. paratuberculosis
cgggaccacccgc

SEQ ID NO: 1003371 - RNA, 14 nt, Mycobacterium avium subsp. paratuberculosis
cgggaccacccgca

SEQ ID NO: 1003372 - RNA, 17 nt, Mycobacterium avium subsp. paratuberculosis
cgggaccacccgcagcg

SEQ ID NO: 1003373 - RNA, 19 nt, Mycobacterium avium subsp. paratuberculosis
cgggaccagcgccucggcc

SEQ ID NO: 1003374 - RNA, 12 nt, Mycobacterium avium subsp. paratuberculosis
cgggacccgcga

SEQ ID NO: 1003375 - RNA, 17 nt, Mycobacterium avium subsp. paratuberculosis
cgggacccgcgaccccu

SEQ ID NO: 1003376 - RNA, 18 nt, Mycobacterium avium subsp. paratuberculosis
cgggagcaaggucgucgc

SEQ ID NO: 1003377 - RNA, 19 nt, Mycobacterium avium subsp. paratuberculosis
cgggagaaaugggccaggu

SEQ ID NO: 1003378 - RNA, 16 nt, Mycobacterium avium subsp. paratuberculosis
cgggacggccagcagg

SEQ ID NO: 1003379 - RNA, 17 nt, Mycobacterium avium subsp. paratuberculosis
cgggacgucggcgcgcu

SEQ ID NO: 1003380 - RNA, 16 nt, Mycobacterium avium subsp. paratuberculosis
cgggaccgucgcgcag

SEQ ID NO: 1003381 - RNA, 19 nt, Mycobacterium avium subsp. paratuberculosis
cgggaccgucgcgcagccc

SEQ ID NO: 1003382 - RNA, 14 nt, Mycobacterium avium subsp. paratuberculosis
cgggacgccugccg

SEQ ID NO: 1003383 - RNA, 16 nt, Mycobacterium avium subsp. paratuberculosis
cgggacgccugccgcc

SEQ ID NO: 1003384 - RNA, 19 nt, Mycobacterium avium subsp. paratuberculosis
cgggacgccugccgccuug

SEQ ID NO: 1003385 - RNA, 13 nt, Mycobacterium avium subsp. paratuberculosis
cgggacgcgcaga

SEQ ID NO: 1003386 - RNA, 15 nt, Mycobacterium avium subsp. paratuberculosis
cgggaccgaugccgc

SEQ ID NO: 1003387 - RNA, 16 nt, Mycobacterium avium subsp. paratuberculosis
cgggaccgcgggcgca

SEQ ID NO: 1003388 - RNA, 17 nt, Mycobacterium avium subsp. paratuberculosis
cgggaccgcgggcgcau

SEQ ID NO: 1003389 - RNA, 20 nt, Mycobacterium avium subsp. paratuberculosis
cgggaccgcgggcgcauacc

SEQ ID NO: 1003390 - RNA, 20 nt, Mycobacterium avium subsp. paratuberculosis
cgggaauuggcaccggaccg

SEQ ID NO: 1003391 - RNA, 18 nt, Mycobacterium avium subsp. paratuberculosis
cgggacgaggggcagcag

SEQ ID NO: 1003392 - RNA, 20 nt, Mycobacterium avium subsp. paratuberculosis
cgggacgaggggcagcagcg

SEQ ID NO: 1003393 - RNA, 17 nt, Mycobacterium avium subsp. paratuberculosis
cgggauagggcgcgucg

SEQ ID NO: 1003394 - RNA, 17 nt, Mycobacterium avium subsp. paratuberculosis
cgggauaguccggcaug

SEQ ID NO: 1003395 - RNA, 22 nt, Mycobacterium avium subsp. paratuberculosis
cgggauaguucgccgccgccag

SEQ ID NO: 1003396 - RNA, 23 nt, Mycobacterium avium subsp. paratuberculosis
cgggauaguucgccgccgccagc

SEQ ID NO: 1003397 - RNA, 19 nt, Mycobacterium avium subsp. paratuberculosis
cgggauacucguccucccg

SEQ ID NO: 1003398 - RNA, 16 nt, Mycobacterium avium subsp. paratuberculosis
cgggauccaggaacgg

SEQ ID NO: 1003399 - RNA, 17 nt, Mycobacterium avium subsp. paratuberculosis
cgggauccggcgcgccg

SEQ ID NO: 1003400 - RNA, 18 nt, Mycobacterium avium subsp. paratuberculosis
cgggauccggcgcgccgc

SEQ ID NO: 1003401 - RNA, 19 nt, Mycobacterium avium subsp. paratuberculosis
cgggagugcuggacggccc

SEQ ID NO: 1003402 - RNA, 18 nt, Mycobacterium avium subsp. paratuberculosis
cgggauaacccagcacca

SEQ ID NO: 1003403 - RNA, 22 nt, Mycobacterium avium subsp. paratuberculosis
cgggauacccaugaucgccagu

SEQ ID NO: 1003404 - RNA, 18 nt, Mycobacterium avium subsp. paratuberculosis
cgggagucgggcccgccc

SEQ ID NO: 1003405 - RNA, 20 nt, Mycobacterium avium subsp. paratuberculosis
cgggaugccugcccgcgcag

SEQ ID NO: 1003406 - RNA, 14 nt, Mycobacterium avium subsp. paratuberculosis
cgggaugaagccgc

SEQ ID NO: 1003407 - RNA, 16 nt, Mycobacterium avium subsp. paratuberculosis
cgggaugaagccgccc

SEQ ID NO: 1003408 - RNA, 19 nt, Mycobacterium avium subsp. paratuberculosis
cgggaucguguggccgccc

SEQ ID NO: 1003409 - RNA, 16 nt, Mycobacterium avium subsp. paratuberculosis
cgggauggagccgccc

SEQ ID NO: 1003410 - RNA, 20 nt, Mycobacterium avium subsp. paratuberculosis
cgggauggcguucugcaccg

SEQ ID NO: 1003411 - RNA, 13 nt, Mycobacterium avium subsp. paratuberculosis
cgggauggcucag

SEQ ID NO: 1003412 - RNA, 18 nt, Mycobacterium avium subsp. paratuberculosis
cgggaucggugccgacgg

SEQ ID NO: 1003413 - RNA, 14 nt, Mycobacterium avium subsp. paratuberculosis
cgggaucgcggcgg

SEQ ID NO: 1003414 - RNA, 14 nt, Mycobacterium avium subsp. paratuberculosis
cgggaucggcagcg

SEQ ID NO: 1003415 - RNA, 19 nt, Mycobacterium avium subsp. paratuberculosis
cgggaucggccggcgaggu

SEQ ID NO: 1003416 - RNA, 14 nt, Mycobacterium avium subsp. paratuberculosis
cgggaucggcgccc

SEQ ID NO: 1003417 - RNA, 19 nt, Mycobacterium avium subsp. paratuberculosis
cgggaucggcgcccaccgc

SEQ ID NO: 1003418 - RNA, 16 nt, Mycobacterium avium subsp. paratuberculosis
cgggaucggcgcgucg

SEQ ID NO: 1003419 - RNA, 14 nt, Mycobacterium avium subsp. paratuberculosis
cgggaucggcggcg

SEQ ID NO: 1003420 - RNA, 17 nt, Mycobacterium avium subsp. paratuberculosis
cgggauccucgccgcgg

SEQ ID NO: 1003421 - RNA, 19 nt, Mycobacterium avium subsp. paratuberculosis
cgggauccucgccgcgggc

SEQ ID NO: 1003422 - RNA, 21 nt, Mycobacterium avium subsp. paratuberculosis
cgggauccucgccgcgggcca

SEQ ID NO: 1003423 - RNA, 16 nt, Mycobacterium avium subsp. paratuberculosis
cgggcgaucgccucgg

SEQ ID NO: 1003424 - RNA, 19 nt, Mycobacterium avium subsp. paratuberculosis
cgggcgaucagcccgccca

SEQ ID NO: 1003425 - RNA, 20 nt, Mycobacterium avium subsp. paratuberculosis
cgggcgaugcggcccggcca

SEQ ID NO: 1003426 - RNA, 19 nt, Mycobacterium avium subsp. paratuberculosis
cgggcgauucccggaugcu

SEQ ID NO: 1003427 - RNA, 19 nt, Mycobacterium avium subsp. paratuberculosis
cgggcgauuucgucggcgg

SEQ ID NO: 1003428 - RNA, 19 nt, Mycobacterium avium subsp. paratuberculosis
cgggcgaccccggccagga

SEQ ID NO: 1003429 - RNA, 19 nt, Mycobacterium avium subsp. paratuberculosis
cgggcgacccgcuggaaca

SEQ ID NO: 1003430 - RNA, 21 nt, Mycobacterium avium subsp. paratuberculosis
cgggcgacccgcuggaacagc

SEQ ID NO: 1003431 - RNA, 15 nt, Mycobacterium avium subsp. paratuberculosis
cgggcgaccugcggg

SEQ ID NO: 1003432 - RNA, 22 nt, Mycobacterium avium subsp. paratuberculosis
cgggcgacgucggggucgucgc

SEQ ID NO: 1003433 - RNA, 15 nt, Mycobacterium avium subsp. paratuberculosis
cgggcgacuucuucg

SEQ ID NO: 1003434 - RNA, 19 nt, Mycobacterium avium subsp. paratuberculosis
cgggcgacuucuucgccgg

SEQ ID NO: 1003435 - RNA, 14 nt, Mycobacterium avium subsp. paratuberculosis
cgggcgagcagcgc

SEQ ID NO: 1003436 - RNA, 19 nt, Mycobacterium avium subsp. paratuberculosis
cgggcgcggugugggcgau

SEQ ID NO: 1003437 - RNA, 14 nt, Mycobacterium avium subsp. paratuberculosis
cgggcgcggcggca

SEQ ID NO: 1003438 - RNA, 13 nt, Mycobacterium avium subsp. paratuberculosis
cgggcgcgcgcgc

SEQ ID NO: 1003439 - RNA, 14 nt, Mycobacterium avium subsp. paratuberculosis
cgggcgcgccggcg

SEQ ID NO: 1003440 - RNA, 16 nt, Mycobacterium avium subsp. paratuberculosis
cgggcgcgccggcgcg

SEQ ID NO: 1003441 - RNA, 16 nt, Mycobacterium avium subsp. paratuberculosis
cgggcgcgcccacccg

SEQ ID NO: 1003442 - RNA, 23 nt, Mycobacterium avium subsp. paratuberculosis
cgggcgcgcccacccgcgccggc

SEQ ID NO: 1003443 - RNA, 14 nt, Mycobacterium avium subsp. paratuberculosis
cgggcgccgucggg

SEQ ID NO: 1003444 - RNA, 14 nt, Mycobacterium avium subsp. paratuberculosis
cgggcgccggcgcg

SEQ ID NO: 1003445 - RNA, 17 nt, Mycobacterium avium subsp. paratuberculosis
cgggcgccggcgcgucc

SEQ ID NO: 1003446 - RNA, 17 nt, Mycobacterium avium subsp. paratuberculosis
cgggcgccgaagauggc

SEQ ID NO: 1003447 - RNA, 18 nt, Mycobacterium avium subsp. paratuberculosis
cgggcgccgagaacaggc

SEQ ID NO: 1003448 - RNA, 20 nt, Mycobacterium avium subsp. paratuberculosis
cgggcgccgagaacaggccg

SEQ ID NO: 1003449 - RNA, 14 nt, Mycobacterium avium subsp. paratuberculosis
cgggcgccauccgc

SEQ ID NO: 1003450 - RNA, 16 nt, Mycobacterium avium subsp. paratuberculosis
cgggcgccauccgcag

SEQ ID NO: 1003451 - RNA, 15 nt, Mycobacterium avium subsp. paratuberculosis
cgggcgccauccgcc

SEQ ID NO: 1003452 - RNA, 21 nt, Mycobacterium avium subsp. paratuberculosis
cgggcgccauccgccacccgc

SEQ ID NO: 1003453 - RNA, 17 nt, Mycobacterium avium subsp. paratuberculosis
cgggcgcccagaagccc

SEQ ID NO: 1003454 - RNA, 16 nt, Mycobacterium avium subsp. paratuberculosis
cgggcgcccagcaaac

SEQ ID NO: 1003455 - RNA, 21 nt, Mycobacterium avium subsp. paratuberculosis
cgggcgcccagcaaacccagc

SEQ ID NO: 1003456 - RNA, 16 nt, Mycobacterium avium subsp. paratuberculosis
cgggcguagugcagcu

SEQ ID NO: 1003457 - RNA, 15 nt, Mycobacterium avium subsp. paratuberculosis
cgggcggucgcgcag

SEQ ID NO: 1003458 - RNA, 22 nt, Mycobacterium avium subsp. paratuberculosis
cgggcgucacucuggcgugacg

SEQ ID NO: 1003459 - RNA, 13 nt, Mycobacterium avium subsp. paratuberculosis
cgggcggucagca

SEQ ID NO: 1003460 - RNA, 18 nt, Mycobacterium avium subsp. paratuberculosis
cgggcggucagcauggcg

SEQ ID NO: 1003461 - RNA, 20 nt, Mycobacterium avium subsp. paratuberculosis
cgggcgggguggccaccaca

SEQ ID NO: 1003462 - RNA, 21 nt, Mycobacterium avium subsp. paratuberculosis
cgggcgggguggccaccacau

SEQ ID NO: 1003463 - RNA, 23 nt, Mycobacterium avium subsp. paratuberculosis
cgggcggggugugcggcacggcg

SEQ ID NO: 1003464 - RNA, 13 nt, Mycobacterium avium subsp. paratuberculosis
cgggcgucgcaga

SEQ ID NO: 1003465 - RNA, 15 nt, Mycobacterium avium subsp. paratuberculosis
cgggcgucgggcagc

SEQ ID NO: 1003466 - RNA, 16 nt, Mycobacterium avium subsp. paratuberculosis
cgggcgucgggcagca

SEQ ID NO: 1003467 - RNA, 16 nt, Mycobacterium avium subsp. paratuberculosis
cgggcguggcggucgg

SEQ ID NO: 1003468 - RNA, 18 nt, Mycobacterium avium subsp. paratuberculosis
cgggcgugccgaacggcg

SEQ ID NO: 1003469 - RNA, 23 nt, Mycobacterium avium subsp. paratuberculosis
cgggcgugcgaaugacgcgcauc

SEQ ID NO: 1003470 - RNA, 17 nt, Mycobacterium avium subsp. paratuberculosis
cgggcguucaucaccug

SEQ ID NO: 1003471 - RNA, 19 nt, Mycobacterium avium subsp. paratuberculosis
cgggcguccugcggggagg

SEQ ID NO: 1003472 - RNA, 19 nt, Mycobacterium avium subsp. paratuberculosis
cgggcguugcccgccgcgg

SEQ ID NO: 1003473 - RNA, 17 nt, Mycobacterium avium subsp. paratuberculosis
cgggcguugcgccgcga

SEQ ID NO: 1003474 - RNA, 16 nt, Mycobacterium avium subsp. paratuberculosis
cgggcggcgucggcga

SEQ ID NO: 1003475 - RNA, 20 nt, Mycobacterium avium subsp. paratuberculosis
cgggcggcgucggcgacggc

SEQ ID NO: 1003476 - RNA, 21 nt, Mycobacterium avium subsp. paratuberculosis
cgggcggcgucggcgacggcg

SEQ ID NO: 1003477 - RNA, 13 nt, Mycobacterium avium subsp. paratuberculosis
cgggcgggcaccc

SEQ ID NO: 1003478 - RNA, 17 nt, Mycobacterium avium subsp. paratuberculosis
cgggcgggccgcagcac

SEQ ID NO: 1003479 - RNA, 13 nt, Mycobacterium avium subsp. paratuberculosis
cgggcgggccgcc

SEQ ID NO: 1003480 - RNA, 15 nt, Mycobacterium avium subsp. paratuberculosis
cgggcggggcccggg

SEQ ID NO: 1003481 - RNA, 16 nt, Mycobacterium avium subsp. paratuberculosis
cgggcggggcccgggc

SEQ ID NO: 1003482 - RNA, 17 nt, Mycobacterium avium subsp. paratuberculosis
cgggcggggccugcggg

SEQ ID NO: 1003483 - RNA, 16 nt, Mycobacterium avium subsp. paratuberculosis
cgggcgggggcugucc

SEQ ID NO: 1003484 - RNA, 22 nt, Mycobacterium avium subsp. paratuberculosis
cgggcggggggcgagccggccc

SEQ ID NO: 1003485 - RNA, 14 nt, Mycobacterium avium subsp. paratuberculosis
cgggcggcgcggcg

SEQ ID NO: 1003486 - RNA, 13 nt, Mycobacterium avium subsp. paratuberculosis
cgggcggcggcug

SEQ ID NO: 1003487 - RNA, 13 nt, Mycobacterium avium subsp. paratuberculosis
cgggcggcggggc

SEQ ID NO: 1003488 - RNA, 14 nt, Mycobacterium avium subsp. paratuberculosis
cgggcggcgggggc

SEQ ID NO: 1003489 - RNA, 18 nt, Mycobacterium avium subsp. paratuberculosis
cgggcggccccgggcgcu

SEQ ID NO: 1003490 - RNA, 13 nt, Mycobacterium avium subsp. paratuberculosis
cgggcggccugcu

SEQ ID NO: 1003491 - RNA, 16 nt, Mycobacterium avium subsp. paratuberculosis
cgggcggccugcugca

SEQ ID NO: 1003492 - RNA, 14 nt, Mycobacterium avium subsp. paratuberculosis
cgggcgcggacagc

SEQ ID NO: 1003493 - RNA, 15 nt, Mycobacterium avium subsp. paratuberculosis
cgggcggccagccgc

SEQ ID NO: 1003494 - RNA, 17 nt, Mycobacterium avium subsp. paratuberculosis
cgggcggaagucggugc

SEQ ID NO: 1003495 - RNA, 15 nt, Mycobacterium avium subsp. paratuberculosis
cgggcgcugcaaggg

SEQ ID NO: 1003496 - RNA, 15 nt, Mycobacterium avium subsp. paratuberculosis
cgggcggcagcagcu

SEQ ID NO: 1003497 - RNA, 16 nt, Mycobacterium avium subsp. paratuberculosis
cgggccuaugccgcgu

SEQ ID NO: 1003498 - RNA, 17 nt, Mycobacterium avium subsp. paratuberculosis
cgggccguggcaccggg

SEQ ID NO: 1003499 - RNA, 15 nt, Mycobacterium avium subsp. paratuberculosis
cgggccguccgggug

SEQ ID NO: 1003500 - RNA, 17 nt, Mycobacterium avium subsp. paratuberculosis
cgggccuugagcaccgc

SEQ ID NO: 1003501 - RNA, 15 nt, Mycobacterium avium subsp. paratuberculosis
cgggccugcgcgccg

SEQ ID NO: 1003502 - RNA, 19 nt, Mycobacterium avium subsp. paratuberculosis
cgggccugcgcgccgaugu

SEQ ID NO: 1003503 - RNA, 19 nt, Mycobacterium avium subsp. paratuberculosis
cgggccugcagcaacucgc

SEQ ID NO: 1003504 - RNA, 14 nt, Mycobacterium avium subsp. paratuberculosis
cgggccgggcgggc

SEQ ID NO: 1003505 - RNA, 14 nt, Mycobacterium avium subsp. paratuberculosis
cgggccguccgccg

SEQ ID NO: 1003506 - RNA, 15 nt, Mycobacterium avium subsp. paratuberculosis
cgggccguccgccgg

SEQ ID NO: 1003507 - RNA, 16 nt, Mycobacterium avium subsp. paratuberculosis
cgggccguaucggccc

SEQ ID NO: 1003508 - RNA, 20 nt, Mycobacterium avium subsp. paratuberculosis
cgggccguaucggccccggc

SEQ ID NO: 1003509 - RNA, 17 nt, Mycobacterium avium subsp. paratuberculosis
cgggccgggcaccgcgc

SEQ ID NO: 1003510 - RNA, 16 nt, Mycobacterium avium subsp. paratuberculosis
cgggccgggcacgucg

SEQ ID NO: 1003511 - RNA, 14 nt, Mycobacterium avium subsp. paratuberculosis
cgggccgggggcgg

SEQ ID NO: 1003512 - RNA, 16 nt, Mycobacterium avium subsp. paratuberculosis
cgggccgggggcggcg

SEQ ID NO: 1003513 - RNA, 18 nt, Mycobacterium avium subsp. paratuberculosis
cgggccgggggcggcggc

SEQ ID NO: 1003514 - RNA, 11 nt, Mycobacterium avium subsp. paratuberculosis
cgggccggccc

SEQ ID NO: 1003515 - RNA, 17 nt, Mycobacterium avium subsp. paratuberculosis
cgggccgcuggccgccc

SEQ ID NO: 1003516 - RNA, 12 nt, Mycobacterium avium subsp. paratuberculosis
cgggccggcagc

SEQ ID NO: 1003517 - RNA, 22 nt, Mycobacterium avium subsp. paratuberculosis
cgggccggcagccggccaccuc

SEQ ID NO: 1003518 - RNA, 16 nt, Mycobacterium avium subsp. paratuberculosis
cgggccggccagaccg

SEQ ID NO: 1003519 - RNA, 18 nt, Mycobacterium avium subsp. paratuberculosis
cgggccggaacgcccgau

SEQ ID NO: 1003520 - RNA, 16 nt, Mycobacterium avium subsp. paratuberculosis
cgggccggacacggcu

SEQ ID NO: 1003521 - RNA, 24 nt, Mycobacterium avium subsp. paratuberculosis
cgggccggacacggcugcacccuc

SEQ ID NO: 1003522 - RNA, 15 nt, Mycobacterium avium subsp. paratuberculosis
cgggccggaucgcgc

SEQ ID NO: 1003523 - RNA, 18 nt, Mycobacterium avium subsp. paratuberculosis
cgggccggaucgcgcagu

SEQ ID NO: 1003524 - RNA, 13 nt, Mycobacterium avium subsp. paratuberculosis
cgggccgcggcca

SEQ ID NO: 1003525 - RNA, 15 nt, Mycobacterium avium subsp. paratuberculosis
cgggccgcggccagc

SEQ ID NO: 1003526 - RNA, 21 nt, Mycobacterium avium subsp. paratuberculosis
cgggccgcggccagcuccggg

SEQ ID NO: 1003527 - RNA, 13 nt, Mycobacterium avium subsp. paratuberculosis
cgggccgccgcgc

SEQ ID NO: 1003528 - RNA, 12 nt, Mycobacterium avium subsp. paratuberculosis
cgggccgccucg

SEQ ID NO: 1003529 - RNA, 21 nt, Mycobacterium avium subsp. paratuberculosis
cgggccaggucgaagcgcagc

SEQ ID NO: 1003530 - RNA, 14 nt, Mycobacterium avium subsp. paratuberculosis
cgggccaggcgcgc

SEQ ID NO: 1003531 - RNA, 16 nt, Mycobacterium avium subsp. paratuberculosis
cgggccaggcgcgcgc

SEQ ID NO: 1003532 - RNA, 17 nt, Mycobacterium avium subsp. paratuberculosis
cgggccaggcgcgcgcu

SEQ ID NO: 1003533 - RNA, 13 nt, Mycobacterium avium subsp. paratuberculosis
cgggccagcugcu

SEQ ID NO: 1003534 - RNA, 14 nt, Mycobacterium avium subsp. paratuberculosis
cgggccagcugcuc

SEQ ID NO: 1003535 - RNA, 23 nt, Mycobacterium avium subsp. paratuberculosis
cgggccaggaugaccgcccagga

SEQ ID NO: 1003536 - RNA, 12 nt, Mycobacterium avium subsp. paratuberculosis
cgggccagccca

SEQ ID NO: 1003537 - RNA, 15 nt, Mycobacterium avium subsp. paratuberculosis
cgggccagcagcagc

SEQ ID NO: 1003538 - RNA, 14 nt, Mycobacterium avium subsp. paratuberculosis
cgggccagcagccg

SEQ ID NO: 1003539 - RNA, 17 nt, Mycobacterium avium subsp. paratuberculosis
cgggccagcagccgcgc

SEQ ID NO: 1003540 - RNA, 18 nt, Mycobacterium avium subsp. paratuberculosis
cgggccagcagccgcgcg

SEQ ID NO: 1003541 - RNA, 21 nt, Mycobacterium avium subsp. paratuberculosis
cgggccagcagccgcgcgagc

SEQ ID NO: 1003542 - RNA, 22 nt, Mycobacterium avium subsp. paratuberculosis
cgggccagacugcgcaccgcca

SEQ ID NO: 1003543 - RNA, 20 nt, Mycobacterium avium subsp. paratuberculosis
cgggccacagcggcgacagc

SEQ ID NO: 1003544 - RNA, 24 nt, Mycobacterium avium subsp. paratuberculosis
cgggccagcaacagcagcggcaug

SEQ ID NO: 1003545 - RNA, 17 nt, Mycobacterium avium subsp. paratuberculosis
cgggccaccgucccggu

SEQ ID NO: 1003546 - RNA, 17 nt, Mycobacterium avium subsp. paratuberculosis
cgggcccagcaccacca

SEQ ID NO: 1003547 - RNA, 21 nt, Mycobacterium avium subsp. paratuberculosis
cgggcccagcagccugccccc

SEQ ID NO: 1003548 - RNA, 17 nt, Mycobacterium avium subsp. paratuberculosis
cgggcccaccgccacca

SEQ ID NO: 1003549 - RNA, 20 nt, Mycobacterium avium subsp. paratuberculosis
cgggcccaccgcgcgcugca

SEQ ID NO: 1003550 - RNA, 19 nt, Mycobacterium avium subsp. paratuberculosis
cgggccaucgacuccagca

SEQ ID NO: 1003551 - RNA, 21 nt, Mycobacterium avium subsp. paratuberculosis
cgggccaucgacuccagcacc

SEQ ID NO: 1003552 - RNA, 22 nt, Mycobacterium avium subsp. paratuberculosis
cgggccaucgacuccagcaccg

SEQ ID NO: 1003553 - RNA, 21 nt, Mycobacterium avium subsp. paratuberculosis
cgggccagcucgucgagccgg

SEQ ID NO: 1003554 - RNA, 17 nt, Mycobacterium avium subsp. paratuberculosis
cgggcccggccgccagc

SEQ ID NO: 1003555 - RNA, 20 nt, Mycobacterium avium subsp. paratuberculosis
cgggccgaacugccgaugcu

SEQ ID NO: 1003556 - RNA, 23 nt, Mycobacterium avium subsp. paratuberculosis
cgggcccgcgccuucuugcugcc

SEQ ID NO: 1003557 - RNA, 14 nt, Mycobacterium avium subsp. paratuberculosis
cgggcccgcgcggc

SEQ ID NO: 1003558 - RNA, 18 nt, Mycobacterium avium subsp. paratuberculosis
cgggcccgggccacccgc

SEQ ID NO: 1003559 - RNA, 18 nt, Mycobacterium avium subsp. paratuberculosis
cgggcccgggcugcccgg

SEQ ID NO: 1003560 - RNA, 19 nt, Mycobacterium avium subsp. paratuberculosis
cgggcccgggcugcccggg

SEQ ID NO: 1003561 - RNA, 16 nt, Mycobacterium avium subsp. paratuberculosis
cgggcccgcccgcagc

SEQ ID NO: 1003562 - RNA, 22 nt, Mycobacterium avium subsp. paratuberculosis
cgggcccgagguccucgcgcaa

SEQ ID NO: 1003563 - RNA, 13 nt, Mycobacterium avium subsp. paratuberculosis
cgggcccgcgcac

SEQ ID NO: 1003564 - RNA, 16 nt, Mycobacterium avium subsp. paratuberculosis
cgggccgcagccgcgc

SEQ ID NO: 1003565 - RNA, 19 nt, Mycobacterium avium subsp. paratuberculosis
cgggccgcagccgcgcggc

SEQ ID NO: 1003566 - RNA, 20 nt, Mycobacterium avium subsp. paratuberculosis
cgggccgcagcucgcccagc

SEQ ID NO: 1003567 - RNA, 23 nt, Mycobacterium avium subsp. paratuberculosis
cgggccgcagcucgcccagcacc

SEQ ID NO: 1003568 - RNA, 14 nt, Mycobacterium avium subsp. paratuberculosis
cgggccgacccggc

SEQ ID NO: 1003569 - RNA, 21 nt, Mycobacterium avium subsp. paratuberculosis
cgggccgacagcacgccgggc

SEQ ID NO: 1003570 - RNA, 14 nt, Mycobacterium avium subsp. paratuberculosis
cgggccgagcgcgc

SEQ ID NO: 1003571 - RNA, 17 nt, Mycobacterium avium subsp. paratuberculosis
cgggccgagcgcgccgc

SEQ ID NO: 1003572 - RNA, 20 nt, Mycobacterium avium subsp. paratuberculosis
cgggccgaucagugccgcgc

SEQ ID NO: 1003573 - RNA, 23 nt, Mycobacterium avium subsp. paratuberculosis
cgggccgcaggguggccagcacc

SEQ ID NO: 1003574 - RNA, 18 nt, Mycobacterium avium subsp. paratuberculosis
cgggccgcauccagcgcc

SEQ ID NO: 1003575 - RNA, 20 nt, Mycobacterium avium subsp. paratuberculosis
cgggccgcauccagcgccgc

SEQ ID NO: 1003576 - RNA, 10 nt, Mycobacterium avium subsp. paratuberculosis
cgggccgcag

SEQ ID NO: 1003577 - RNA, 14 nt, Mycobacterium avium subsp. paratuberculosis
cgggccgcagcacg

SEQ ID NO: 1003578 - RNA, 13 nt, Mycobacterium avium subsp. paratuberculosis
cgggccgcccggc

SEQ ID NO: 1003579 - RNA, 14 nt, Mycobacterium avium subsp. paratuberculosis
cgggccgcccggcg

SEQ ID NO: 1003580 - RNA, 20 nt, Mycobacterium avium subsp. paratuberculosis
cgggccgcccggcgcgccgc

SEQ ID NO: 1003581 - RNA, 16 nt, Mycobacterium avium subsp. paratuberculosis
cggcucaggggaucuc

SEQ ID NO: 1003582 - RNA, 13 nt, Mycobacterium avium subsp. paratuberculosis
cggcucagggugc

SEQ ID NO: 1003583 - RNA, 17 nt, Mycobacterium avium subsp. paratuberculosis
cggcucagggugcgcug

SEQ ID NO: 1003584 - RNA, 19 nt, Mycobacterium avium subsp. paratuberculosis
cggcucacaugggcgcguu

SEQ ID NO: 1003585 - RNA, 21 nt, Mycobacterium avium subsp. paratuberculosis
cggcucagcaacccgccgagc

SEQ ID NO: 1003586 - RNA, 16 nt, Mycobacterium avium subsp. paratuberculosis
cggcuccaccgcgccg

SEQ ID NO: 1003587 - RNA, 17 nt, Mycobacterium avium subsp. paratuberculosis
cggcuccaccgcgccgg

SEQ ID NO: 1003588 - RNA, 14 nt, Mycobacterium avium subsp. paratuberculosis
cggcuccacagcag

SEQ ID NO: 1003589 - RNA, 14 nt, Mycobacterium avium subsp. paratuberculosis
cggcuccagcgccc

SEQ ID NO: 1003590 - RNA, 13 nt, Mycobacterium avium subsp. paratuberculosis
cggcuccagcagc

SEQ ID NO: 1003591 - RNA, 14 nt, Mycobacterium avium subsp. paratuberculosis
cggcuccagcagcg

SEQ ID NO: 1003592 - RNA, 15 nt, Mycobacterium avium subsp. paratuberculosis
cggcuccagcagcgg

SEQ ID NO: 1003593 - RNA, 17 nt, Mycobacterium avium subsp. paratuberculosis
cggcucgagcucgucgg

SEQ ID NO: 1003594 - RNA, 19 nt, Mycobacterium avium subsp. paratuberculosis
cggcucgauggacgccagc

SEQ ID NO: 1003595 - RNA, 13 nt, Mycobacterium avium subsp. paratuberculosis
cggcucgccaccu

SEQ ID NO: 1003596 - RNA, 16 nt, Mycobacterium avium subsp. paratuberculosis
cggcuccggccgcgcc

SEQ ID NO: 1003597 - RNA, 19 nt, Mycobacterium avium subsp. paratuberculosis
cggcuccggccgcgccggc

SEQ ID NO: 1003598 - RNA, 19 nt, Mycobacterium avium subsp. paratuberculosis
cggcguuggccgccgccug

SEQ ID NO: 1003599 - RNA, 15 nt, Mycobacterium avium subsp. paratuberculosis
cggcuaagccggcgu

SEQ ID NO: 1003600 - RNA, 17 nt, Mycobacterium avium subsp. paratuberculosis
cggcuaauucgggccgc

SEQ ID NO: 1003601 - RNA, 14 nt, Mycobacterium avium subsp. paratuberculosis
cggcuaccggcgcu

SEQ ID NO: 1003602 - RNA, 21 nt, Mycobacterium avium subsp. paratuberculosis
cggcuaccuaggcgucgucgg

SEQ ID NO: 1003603 - RNA, 22 nt, Mycobacterium avium subsp. paratuberculosis
cggcuacucggacgccggcagc

SEQ ID NO: 1003604 - RNA, 16 nt, Mycobacterium avium subsp. paratuberculosis
cggcgugucgggugcu

SEQ ID NO: 1003605 - RNA, 22 nt, Mycobacterium avium subsp. paratuberculosis
cggcguuacccgaacccagcgc

SEQ ID NO: 1003606 - RNA, 23 nt, Mycobacterium avium subsp. paratuberculosis
cggcguuacccgaacccagcgcc

SEQ ID NO: 1003607 - RNA, 18 nt, Mycobacterium avium subsp. paratuberculosis
cggcguucuccagcaccc

SEQ ID NO: 1003608 - RNA, 15 nt, Mycobacterium avium subsp. paratuberculosis
cggcguuguccaggu

SEQ ID NO: 1003609 - RNA, 16 nt, Mycobacterium avium subsp. paratuberculosis
cggcguuguggccacc

SEQ ID NO: 1003610 - RNA, 22 nt, Mycobacterium avium subsp. paratuberculosis
cggcguugaccaacgccgccuc

SEQ ID NO: 1003611 - RNA, 23 nt, Mycobacterium avium subsp. paratuberculosis
cggcguugguccacacguccugg

SEQ ID NO: 1003612 - RNA, 16 nt, Mycobacterium avium subsp. paratuberculosis
cggcguugagccggcg

SEQ ID NO: 1003613 - RNA, 17 nt, Mycobacterium avium subsp. paratuberculosis
cggcguugagccggcgc

SEQ ID NO: 1003614 - RNA, 15 nt, Mycobacterium avium subsp. paratuberculosis
cggcguugccgccgg

SEQ ID NO: 1003615 - RNA, 18 nt, Mycobacterium avium subsp. paratuberculosis
cggcguugccgccggcgc

SEQ ID NO: 1003616 - RNA, 21 nt, Mycobacterium avium subsp. paratuberculosis
cggcgugggguucccggccgg

SEQ ID NO: 1003617 - RNA, 22 nt, Mycobacterium avium subsp. paratuberculosis
cggcguguuccuugcggccgcc

SEQ ID NO: 1003618 - RNA, 23 nt, Mycobacterium avium subsp. paratuberculosis
cggcguguuccuugcggccgccg

SEQ ID NO: 1003619 - RNA, 20 nt, Mycobacterium avium subsp. paratuberculosis
cggcguggcugaggccgccc

SEQ ID NO: 1003620 - RNA, 21 nt, Mycobacterium avium subsp. paratuberculosis
cggcguggcugaggccgcccc

SEQ ID NO: 1003621 - RNA, 16 nt, Mycobacterium avium subsp. paratuberculosis
cggcguggcgcucagc

SEQ ID NO: 1003622 - RNA, 17 nt, Mycobacterium avium subsp. paratuberculosis
cggcgugcucggccacg

SEQ ID NO: 1003623 - RNA, 15 nt, Mycobacterium avium subsp. paratuberculosis
cggcgugccgcccgg

SEQ ID NO: 1003624 - RNA, 17 nt, Mycobacterium avium subsp. paratuberculosis
cggcgugcugcgcagca

SEQ ID NO: 1003625 - RNA, 15 nt, Mycobacterium avium subsp. paratuberculosis
cggcgugcugggcca

SEQ ID NO: 1003626 - RNA, 19 nt, Mycobacterium avium subsp. paratuberculosis
cggcgugcggucgcgggac

SEQ ID NO: 1003627 - RNA, 14 nt, Mycobacterium avium subsp. paratuberculosis
cggcgugcaguccc

SEQ ID NO: 1003628 - RNA, 17 nt, Mycobacterium avium subsp. paratuberculosis
cggcgugcagcacgccc

SEQ ID NO: 1003629 - RNA, 12 nt, Mycobacterium avium subsp. paratuberculosis
cggcgugcagcc

SEQ ID NO: 1003630 - RNA, 19 nt, Mycobacterium avium subsp. paratuberculosis
cggcgugcaccgcccgcgc

SEQ ID NO: 1003631 - RNA, 13 nt, Mycobacterium avium subsp. paratuberculosis
cggcgucuugcug

SEQ ID NO: 1003632 - RNA, 20 nt, Mycobacterium avium subsp. paratuberculosis
cggcgucgucgagcaccggc

SEQ ID NO: 1003633 - RNA, 23 nt, Mycobacterium avium subsp. paratuberculosis
cggcgucgucgagcaccggcagc

SEQ ID NO: 1003634 - RNA, 22 nt, Mycobacterium avium subsp. paratuberculosis
cggcgucgucgucgagaagacc

SEQ ID NO: 1003635 - RNA, 21 nt, Mycobacterium avium subsp. paratuberculosis
cggcgucgucuuggccugcug

SEQ ID NO: 1003636 - RNA, 18 nt, Mycobacterium avium subsp. paratuberculosis
cggcgucgugaccgaccu

SEQ ID NO: 1003637 - RNA, 14 nt, Mycobacterium avium subsp. paratuberculosis
cggcgucgggccgg

SEQ ID NO: 1003638 - RNA, 18 nt, Mycobacterium avium subsp. paratuberculosis
cggcgucgggccgggggc

SEQ ID NO: 1003639 - RNA, 16 nt, Mycobacterium avium subsp. paratuberculosis
cggcgucggugucccg

SEQ ID NO: 1003640 - RNA, 18 nt, Mycobacterium avium subsp. paratuberculosis
cggcgucguacagcagcc

SEQ ID NO: 1003641 - RNA, 16 nt, Mycobacterium avium subsp. paratuberculosis
cggcgucguagacgcu

SEQ ID NO: 1003642 - RNA, 15 nt, Mycobacterium avium subsp. paratuberculosis
cggcgucggccaccg

SEQ ID NO: 1003643 - RNA, 16 nt, Mycobacterium avium subsp. paratuberculosis
cggcgucggccaccgc

SEQ ID NO: 1003644 - RNA, 20 nt, Mycobacterium avium subsp. paratuberculosis
cggcgucggccgggcugccc

SEQ ID NO: 1003645 - RNA, 18 nt, Mycobacterium avium subsp. paratuberculosis
cggcgucggccugcccgc

SEQ ID NO: 1003646 - RNA, 12 nt, Mycobacterium avium subsp. paratuberculosis
cggcgucggcga

SEQ ID NO: 1003647 - RNA, 15 nt, Mycobacterium avium subsp. paratuberculosis
cggcgucggcggccu

SEQ ID NO: 1003648 - RNA, 20 nt, Mycobacterium avium subsp. paratuberculosis
cggcgucggcguagggcagc

SEQ ID NO: 1003649 - RNA, 21 nt, Mycobacterium avium subsp. paratuberculosis
cggcgucacucuggcgugacg

SEQ ID NO: 1003650 - RNA, 17 nt, Mycobacterium avium subsp. paratuberculosis
cggcgucacugcccagc

SEQ ID NO: 1003651 - RNA, 18 nt, Mycobacterium avium subsp. paratuberculosis
cggcgucacccuggaacu

SEQ ID NO: 1003652 - RNA, 17 nt, Mycobacterium avium subsp. paratuberculosis
cggcgucaccgcgggug

SEQ ID NO: 1003653 - RNA, 19 nt, Mycobacterium avium subsp. paratuberculosis
cggcgucacgcccucuucu

SEQ ID NO: 1003654 - RNA, 16 nt, Mycobacterium avium subsp. paratuberculosis
cggcguagucggcgca

SEQ ID NO: 1003655 - RNA, 18 nt, Mycobacterium avium subsp. paratuberculosis
cggcguagucggcgcagc

SEQ ID NO: 1003656 - RNA, 14 nt, Mycobacterium avium subsp. paratuberculosis
cggcguaguucguc

SEQ ID NO: 1003657 - RNA, 21 nt, Mycobacterium avium subsp. paratuberculosis
cggcguagaccagcgacgcca

SEQ ID NO: 1003658 - RNA, 17 nt, Mycobacterium avium subsp. paratuberculosis
cggcgccgcccgggccc

SEQ ID NO: 1003659 - RNA, 14 nt, Mycobacterium avium subsp. paratuberculosis
cggcgccgccgggg

SEQ ID NO: 1003660 - RNA, 15 nt, Mycobacterium avium subsp. paratuberculosis
cggcgccgccggucg

SEQ ID NO: 1003661 - RNA, 13 nt, Mycobacterium avium subsp. paratuberculosis
cggcgccgcgacc

SEQ ID NO: 1003662 - RNA, 19 nt, Mycobacterium avium subsp. paratuberculosis
cggcgccgcgaccccggac

SEQ ID NO: 1003663 - RNA, 23 nt, Mycobacterium avium subsp. paratuberculosis
cggcgucccacguggugaucagc

SEQ ID NO: 1003664 - RNA, 15 nt, Mycobacterium avium subsp. paratuberculosis
cggcguccccggcgg

SEQ ID NO: 1003665 - RNA, 20 nt, Mycobacterium avium subsp. paratuberculosis
cggcguauucgucgucggcc

SEQ ID NO: 1003666 - RNA, 19 nt, Mycobacterium avium subsp. paratuberculosis
cggcgucaucccccgcagc

SEQ ID NO: 1003667 - RNA, 14 nt, Mycobacterium avium subsp. paratuberculosis
cggcguccagcugc

SEQ ID NO: 1003668 - RNA, 22 nt, Mycobacterium avium subsp. paratuberculosis
cggcguccagcugcgcgccggc

SEQ ID NO: 1003669 - RNA, 15 nt, Mycobacterium avium subsp. paratuberculosis
cggcguccagugcau

SEQ ID NO: 1003670 - RNA, 16 nt, Mycobacterium avium subsp. paratuberculosis
cggcgucccggcgucu

SEQ ID NO: 1003671 - RNA, 17 nt, Mycobacterium avium subsp. paratuberculosis
cggcguccugcagcagc

SEQ ID NO: 1003672 - RNA, 20 nt, Mycobacterium avium subsp. paratuberculosis
cggcguccucgaccacccgc

SEQ ID NO: 1003673 - RNA, 22 nt, Mycobacterium avium subsp. paratuberculosis
cggcguccucgacgccgcgcac

SEQ ID NO: 1003674 - RNA, 15 nt, Mycobacterium avium subsp. paratuberculosis
cggcgucgccgcucu

SEQ ID NO: 1003675 - RNA, 23 nt, Mycobacterium avium subsp. paratuberculosis
cggcgucgaugaccucgcgcagc

SEQ ID NO: 1003676 - RNA, 23 nt, Mycobacterium avium subsp. paratuberculosis
cggcgucgaugucgcccggcgcg

SEQ ID NO: 1003677 - RNA, 14 nt, Mycobacterium avium subsp. paratuberculosis
cggcgucgcggcgc

SEQ ID NO: 1003678 - RNA, 15 nt, Mycobacterium avium subsp. paratuberculosis
cggcgucgcggcgca

SEQ ID NO: 1003679 - RNA, 17 nt, Mycobacterium avium subsp. paratuberculosis
cggcgucgaccgccccg

SEQ ID NO: 1003680 - RNA, 14 nt, Mycobacterium avium subsp. paratuberculosis
cggcgucggccacc

SEQ ID NO: 1003681 - RNA, 15 nt, Mycobacterium avium subsp. paratuberculosis
cggcgucgagcaccu

SEQ ID NO: 1003682 - RNA, 16 nt, Mycobacterium avium subsp. paratuberculosis
cggcgucgacagccgg

SEQ ID NO: 1003683 - RNA, 20 nt, Mycobacterium avium subsp. paratuberculosis
cggcgucgaaauagcggcgc

SEQ ID NO: 1003684 - RNA, 21 nt, Mycobacterium avium subsp. paratuberculosis
cggcgucgaaauagcggcgca

SEQ ID NO: 1003685 - RNA, 20 nt, Mycobacterium avium subsp. paratuberculosis
cgggaaaucggacccagccc

SEQ ID NO: 1003686 - RNA, 16 nt, Mycobacterium avium subsp. paratuberculosis
cgggaacucggccagc

SEQ ID NO: 1003687 - RNA, 20 nt, Mycobacterium avium subsp. paratuberculosis
cgggaacucggccagcuggu

SEQ ID NO: 1003688 - RNA, 17 nt, Mycobacterium avium subsp. paratuberculosis
cgggaaccagcccaggu

SEQ ID NO: 1003689 - RNA, 15 nt, Mycobacterium avium subsp. paratuberculosis
cgggaacagccaggc

SEQ ID NO: 1003690 - RNA, 15 nt, Mycobacterium avium subsp. paratuberculosis
cgggaacagcccgcc

SEQ ID NO: 1003691 - RNA, 16 nt, Mycobacterium avium subsp. paratuberculosis
cgggaacagcccgccc

SEQ ID NO: 1003692 - RNA, 20 nt, Mycobacterium avium subsp. paratuberculosis
cgggaacagcccgcccuggc

SEQ ID NO: 1003693 - RNA, 16 nt, Mycobacterium avium subsp. paratuberculosis
cgggaagccgccgccc

SEQ ID NO: 1003694 - RNA, 16 nt, Mycobacterium avium subsp. paratuberculosis
cgggaagccgcagcag

SEQ ID NO: 1003695 - RNA, 19 nt, Mycobacterium avium subsp. paratuberculosis
cgggaacgaucggcuccag

SEQ ID NO: 1003696 - RNA, 22 nt, Mycobacterium avium subsp. paratuberculosis
cggcuuggugggcgccggcguc

SEQ ID NO: 1003697 - RNA, 20 nt, Mycobacterium avium subsp. paratuberculosis
cggcuuggucaccagcucgc

SEQ ID NO: 1003698 - RNA, 23 nt, Mycobacterium avium subsp. paratuberculosis
cggcuugagcgccagcgcggugc

SEQ ID NO: 1003699 - RNA, 14 nt, Mycobacterium avium subsp. paratuberculosis
cggcuuccuccucg

SEQ ID NO: 1003700 - RNA, 16 nt, Mycobacterium avium subsp. paratuberculosis
cggcuuccuccucggc

SEQ ID NO: 1003701 - RNA, 15 nt, Mycobacterium avium subsp. paratuberculosis
cggcuucgccgccgc

SEQ ID NO: 1003702 - RNA, 22 nt, Mycobacterium avium subsp. paratuberculosis
cggcuugccccggucccggggc

SEQ ID NO: 1003703 - RNA, 19 nt, Mycobacterium avium subsp. paratuberculosis
cggcuugcgucgcugucgg

SEQ ID NO: 1003704 - RNA, 22 nt, Mycobacterium avium subsp. paratuberculosis
cggcuugaugaugcugucggug

SEQ ID NO: 1003705 - RNA, 18 nt, Mycobacterium avium subsp. paratuberculosis
cggcugucguagcggccc

SEQ ID NO: 1003706 - RNA, 21 nt, Mycobacterium avium subsp. paratuberculosis
cggcugucguagcggcccagg

SEQ ID NO: 1003707 - RNA, 20 nt, Mycobacterium avium subsp. paratuberculosis
cggcuguagcacccggccgg

SEQ ID NO: 1003708 - RNA, 22 nt, Mycobacterium avium subsp. paratuberculosis
cggcuucauaugacgccggccu

SEQ ID NO: 1003709 - RNA, 17 nt, Mycobacterium avium subsp. paratuberculosis
cggcuuaccgaccucga

SEQ ID NO: 1003710 - RNA, 14 nt, Mycobacterium avium subsp. paratuberculosis
cggcuggucggcgg

SEQ ID NO: 1003711 - RNA, 17 nt, Mycobacterium avium subsp. paratuberculosis
cggcugggccgcggcgc

SEQ ID NO: 1003712 - RNA, 16 nt, Mycobacterium avium subsp. paratuberculosis
cggcuggugccgccgg

SEQ ID NO: 1003713 - RNA, 17 nt, Mycobacterium avium subsp. paratuberculosis
cggcuggugcagcagcu

SEQ ID NO: 1003714 - RNA, 24 nt, Mycobacterium avium subsp. paratuberculosis
cggcuggccgcacaccugcaucac

SEQ ID NO: 1003715 - RNA, 13 nt, Mycobacterium avium subsp. paratuberculosis
cggcuggccgucg

SEQ ID NO: 1003716 - RNA, 22 nt, Mycobacterium avium subsp. paratuberculosis
cggcuggcaggucgcgccggag

SEQ ID NO: 1003717 - RNA, 16 nt, Mycobacterium avium subsp. paratuberculosis
cggcuggcccggcgcg

SEQ ID NO: 1003718 - RNA, 18 nt, Mycobacterium avium subsp. paratuberculosis
cggcugcgcagcgcagca

SEQ ID NO: 1003719 - RNA, 18 nt, Mycobacterium avium subsp. paratuberculosis
cggcugcgcguucggcgc

SEQ ID NO: 1003720 - RNA, 13 nt, Mycobacterium avium subsp. paratuberculosis
cggcugcccuggg

SEQ ID NO: 1003721 - RNA, 21 nt, Mycobacterium avium subsp. paratuberculosis
cggcugcccugggaggaagug

SEQ ID NO: 1003722 - RNA, 19 nt, Mycobacterium avium subsp. paratuberculosis
cggcugcaucaugccgccc

SEQ ID NO: 1003723 - RNA, 13 nt, Mycobacterium avium subsp. paratuberculosis
cggcugcccagga

SEQ ID NO: 1003724 - RNA, 14 nt, Mycobacterium avium subsp. paratuberculosis
cggcugccccaggg

SEQ ID NO: 1003725 - RNA, 20 nt, Mycobacterium avium subsp. paratuberculosis
cggcugcccgacccgcacca

SEQ ID NO: 1003726 - RNA, 16 nt, Mycobacterium avium subsp. paratuberculosis
cggcugcccggcccgc

SEQ ID NO: 1003727 - RNA, 20 nt, Mycobacterium avium subsp. paratuberculosis
cggcugaaccaccgcgccca

SEQ ID NO: 1003728 - RNA, 16 nt, Mycobacterium avium subsp. paratuberculosis
cggcugaacgccagca

SEQ ID NO: 1003729 - RNA, 19 nt, Mycobacterium avium subsp. paratuberculosis
cggcucuucgcggcggggc

SEQ ID NO: 1003730 - RNA, 14 nt, Mycobacterium avium subsp. paratuberculosis
cggcugaccgagcg

SEQ ID NO: 1003731 - RNA, 19 nt, Mycobacterium avium subsp. paratuberculosis
cggcugaccgagcggcgcu

SEQ ID NO: 1003732 - RNA, 24 nt, Mycobacterium avium subsp. paratuberculosis
cggcugaccgagcggcgcugcagc

SEQ ID NO: 1003733 - RNA, 12 nt, Mycobacterium avium subsp. paratuberculosis
cggcugcagcag

SEQ ID NO: 1003734 - RNA, 15 nt, Mycobacterium avium subsp. paratuberculosis
cggcucggucuccuc

SEQ ID NO: 1003735 - RNA, 22 nt, Mycobacterium avium subsp. paratuberculosis
cggcucguagcuggugcgcagc

SEQ ID NO: 1003736 - RNA, 24 nt, Mycobacterium avium subsp. paratuberculosis
cggcucguagcuggugcgcagccc

SEQ ID NO: 1003737 - RNA, 13 nt, Mycobacterium avium subsp. paratuberculosis
cggcucgugggug

SEQ ID NO: 1003738 - RNA, 19 nt, Mycobacterium avium subsp. paratuberculosis
cggcucguguccgaugacg

SEQ ID NO: 1003739 - RNA, 20 nt, Mycobacterium avium subsp. paratuberculosis
cggcucguguccgaugacga

SEQ ID NO: 1003740 - RNA, 16 nt, Mycobacterium avium subsp. paratuberculosis
cggcucggugccgcgg

SEQ ID NO: 1003741 - RNA, 15 nt, Mycobacterium avium subsp. paratuberculosis
cggcucgggggccgc

SEQ ID NO: 1003742 - RNA, 16 nt, Mycobacterium avium subsp. paratuberculosis
cggcucgggggccgcu

SEQ ID NO: 1003743 - RNA, 17 nt, Mycobacterium avium subsp. paratuberculosis
cggcucggggucggccg

SEQ ID NO: 1003744 - RNA, 13 nt, Mycobacterium avium subsp. paratuberculosis
cggcucggcgaca

SEQ ID NO: 1003745 - RNA, 14 nt, Mycobacterium avium subsp. paratuberculosis
cggcucggcgcccc

SEQ ID NO: 1003746 - RNA, 22 nt, Mycobacterium avium subsp. paratuberculosis
cggcucggcgccccacgccugg

SEQ ID NO: 1003747 - RNA, 15 nt, Mycobacterium avium subsp. paratuberculosis
cggcucgccgauccg

SEQ ID NO: 1003748 - RNA, 17 nt, Mycobacterium avium subsp. paratuberculosis
cggcuccuugcgccgca

SEQ ID NO: 1003749 - RNA, 14 nt, Mycobacterium avium subsp. paratuberculosis
cggcucgccgggcu

SEQ ID NO: 1003750 - RNA, 15 nt, Mycobacterium avium subsp. paratuberculosis
cggcucgccguugcg

SEQ ID NO: 1003751 - RNA, 17 nt, Mycobacterium avium subsp. paratuberculosis
cggcucgccucaacggu

SEQ ID NO: 1003752 - RNA, 23 nt, Mycobacterium avium subsp. paratuberculosis
cggcucgcugaucugcggcacca

SEQ ID NO: 1003753 - RNA, 18 nt, Mycobacterium avium subsp. paratuberculosis
cggcucgcgggcgaugcg

SEQ ID NO: 1003754 - RNA, 14 nt, Mycobacterium avium subsp. paratuberculosis
cggcucgcgggugc

SEQ ID NO: 1003755 - RNA, 17 nt, Mycobacterium avium subsp. paratuberculosis
cggcucgcgacgcggcu

SEQ ID NO: 1003756 - RNA, 13 nt, Mycobacterium avium subsp. paratuberculosis
cuucaccgcgccg

SEQ ID NO: 1003757 - RNA, 21 nt, Mycobacterium avium subsp. paratuberculosis
cuucacgcucgcaggcgagcc

SEQ ID NO: 1003758 - RNA, 15 nt, Mycobacterium avium subsp. paratuberculosis
cuucacgcucggcga

SEQ ID NO: 1003759 - RNA, 17 nt, Mycobacterium avium subsp. paratuberculosis
cuucacgcucggcgccg

SEQ ID NO: 1003760 - RNA, 13 nt, Mycobacterium avium subsp. paratuberculosis
cuucacgcuggcc

SEQ ID NO: 1003761 - RNA, 23 nt, Mycobacterium avium subsp. paratuberculosis
cuucacgcuggccuccagcuuug

SEQ ID NO: 1003762 - RNA, 18 nt, Mycobacterium avium subsp. paratuberculosis
cuucacccccacccaggu

SEQ ID NO: 1003763 - RNA, 10 nt, Mycobacterium avium subsp. paratuberculosis
cuucaucacc

SEQ ID NO: 1003764 - RNA, 14 nt, Mycobacterium avium subsp. paratuberculosis
cuucaucagcaccg

SEQ ID NO: 1003765 - RNA, 21 nt, Mycobacterium avium subsp. paratuberculosis
cuucgggucgccggucuggua

SEQ ID NO: 1003766 - RNA, 22 nt, Mycobacterium avium subsp. paratuberculosis
cuucgcgaagaacgacgccacc

SEQ ID NO: 1003767 - RNA, 21 nt, Mycobacterium avium subsp. paratuberculosis
cuucgccgcagccuucuuggc

SEQ ID NO: 1003768 - RNA, 18 nt, Mycobacterium avium subsp. paratuberculosis
cuucgccgccgcaccggc

SEQ ID NO: 1003769 - RNA, 19 nt, Mycobacterium avium subsp. paratuberculosis
cuucgaggugcacgcccag

SEQ ID NO: 1003770 - RNA, 21 nt, Mycobacterium avium subsp. paratuberculosis
cuucgaaugcgaugagcucgc

SEQ ID NO: 1003771 - RNA, 16 nt, Mycobacterium avium subsp. paratuberculosis
cuuccacgaccuggcg

SEQ ID NO: 1003772 - RNA, 17 nt, Mycobacterium avium subsp. paratuberculosis
cuuccccggcggccggc

SEQ ID NO: 1003773 - RNA, 15 nt, Mycobacterium avium subsp. paratuberculosis
cuuaccggccggccg

SEQ ID NO: 1003774 - RNA, 19 nt, Mycobacterium avium subsp. paratuberculosis
cuguucgccgucgcgggug

SEQ ID NO: 1003775 - RNA, 15 nt, Mycobacterium avium subsp. paratuberculosis
cuggccgaccgccgc

SEQ ID NO: 1003776 - RNA, 15 nt, Mycobacterium avium subsp. paratuberculosis
cuggcccccgcccca

SEQ ID NO: 1003777 - RNA, 22 nt, Mycobacterium avium subsp. paratuberculosis
cuggcccccgccccagcccggc

SEQ ID NO: 1003778 - RNA, 16 nt, Mycobacterium avium subsp. paratuberculosis
cuggccgagcggcugc

SEQ ID NO: 1003779 - RNA, 19 nt, Mycobacterium avium subsp. paratuberculosis
cuggcccgguuccagcggc

SEQ ID NO: 1003780 - RNA, 17 nt, Mycobacterium avium subsp. paratuberculosis
cuugcuggcggccuucu

SEQ ID NO: 1003781 - RNA, 22 nt, Mycobacterium avium subsp. paratuberculosis
cuugcuggcggccuucuuggcc

SEQ ID NO: 1003782 - RNA, 14 nt, Mycobacterium avium subsp. paratuberculosis
cuugcugccgucgg

SEQ ID NO: 1003783 - RNA, 21 nt, Mycobacterium avium subsp. paratuberculosis
cuugcguugcgcggcggccaa

SEQ ID NO: 1003784 - RNA, 15 nt, Mycobacterium avium subsp. paratuberculosis
cuugcugagcugcgc

SEQ ID NO: 1003785 - RNA, 16 nt, Mycobacterium avium subsp. paratuberculosis
cuugcggcgcagccag

SEQ ID NO: 1003786 - RNA, 18 nt, Mycobacterium avium subsp. paratuberculosis
cuugcggaaccgcugcau

SEQ ID NO: 1003787 - RNA, 20 nt, Mycobacterium avium subsp. paratuberculosis
cuugcguucccagcccggcc

SEQ ID NO: 1003788 - RNA, 19 nt, Mycobacterium avium subsp. paratuberculosis
cuugcgggugauccagccc

SEQ ID NO: 1003789 - RNA, 21 nt, Mycobacterium avium subsp. paratuberculosis
cuugcgggccggagccuucuu

SEQ ID NO: 1003790 - RNA, 20 nt, Mycobacterium avium subsp. paratuberculosis
cuugcgcaccggagccuugg

SEQ ID NO: 1003791 - RNA, 14 nt, Mycobacterium avium subsp. paratuberculosis
cuugcgcagcagca

SEQ ID NO: 1003792 - RNA, 14 nt, Mycobacterium avium subsp. paratuberculosis
cuugcgagccggag

SEQ ID NO: 1003793 - RNA, 15 nt, Mycobacterium avium subsp. paratuberculosis
cuugcgccgcaacag

SEQ ID NO: 1003794 - RNA, 19 nt, Mycobacterium avium subsp. paratuberculosis
cuugcccugguacgcgccg

SEQ ID NO: 1003795 - RNA, 16 nt, Mycobacterium avium subsp. paratuberculosis
cuugcccggcucggug

SEQ ID NO: 1003796 - RNA, 17 nt, Mycobacterium avium subsp. paratuberculosis
cuugcccggcucggugc

SEQ ID NO: 1003797 - RNA, 22 nt, Mycobacterium avium subsp. paratuberculosis
cuugccccaccaccgccggccc

SEQ ID NO: 1003798 - RNA, 23 nt, Mycobacterium avium subsp. paratuberculosis
cuugccgaagaugucggugccga

SEQ ID NO: 1003799 - RNA, 15 nt, Mycobacterium avium subsp. paratuberculosis
cuugccggagcccag

SEQ ID NO: 1003800 - RNA, 23 nt, Mycobacterium avium subsp. paratuberculosis
cuugccggagugcggauuaccgu

SEQ ID NO: 1003801 - RNA, 21 nt, Mycobacterium avium subsp. paratuberculosis
cuugccgcugaaauccggggu

SEQ ID NO: 1003802 - RNA, 23 nt, Mycobacterium avium subsp. paratuberculosis
cuugccgaucagcgucagcaccg

SEQ ID NO: 1003803 - RNA, 13 nt, Mycobacterium avium subsp. paratuberculosis
cuugccgccgcag

SEQ ID NO: 1003804 - RNA, 18 nt, Mycobacterium avium subsp. paratuberculosis
cuugccgccgcagcgcag

SEQ ID NO: 1003805 - RNA, 23 nt, Mycobacterium avium subsp. paratuberculosis
cuugccgucguugacgcccuccu

SEQ ID NO: 1003806 - RNA, 15 nt, Mycobacterium avium subsp. paratuberculosis
cuugccgucgagcag

SEQ ID NO: 1003807 - RNA, 17 nt, Mycobacterium avium subsp. paratuberculosis
cuugcgaccgccgcuag

SEQ ID NO: 1003808 - RNA, 23 nt, Mycobacterium avium subsp. paratuberculosis
cuugaugaacgcguugaccagac

SEQ ID NO: 1003809 - RNA, 19 nt, Mycobacterium avium subsp. paratuberculosis
cuugaugaugucggcggcc

SEQ ID NO: 1003810 - RNA, 14 nt, Mycobacterium avium subsp. paratuberculosis
cuugaugucggggc

SEQ ID NO: 1003811 - RNA, 23 nt, Mycobacterium avium subsp. paratuberculosis
cuugaucgcacccauccccagga

SEQ ID NO: 1003812 - RNA, 18 nt, Mycobacterium avium subsp. paratuberculosis
cuugagcgccagcgcggu

SEQ ID NO: 1003813 - RNA, 24 nt, Mycobacterium avium subsp. paratuberculosis
cuugagcgcgucgucgccgaaaag

SEQ ID NO: 1003814 - RNA, 18 nt, Mycobacterium avium subsp. paratuberculosis
cuugagguagucgcgcag

SEQ ID NO: 1003815 - RNA, 20 nt, Mycobacterium avium subsp. paratuberculosis
cuugagguagucgcgcagcu

SEQ ID NO: 1003816 - RNA, 17 nt, Mycobacterium avium subsp. paratuberculosis
cuugacgaguuccaccu

SEQ ID NO: 1003817 - RNA, 17 nt, Mycobacterium avium subsp. paratuberculosis
cuugacgauccccuggu

SEQ ID NO: 1003818 - RNA, 20 nt, Mycobacterium avium subsp. paratuberculosis
cuugacguacuggcgccggu

SEQ ID NO: 1003819 - RNA, 13 nt, Mycobacterium avium subsp. paratuberculosis
cuugacucccucg

SEQ ID NO: 1003820 - RNA, 14 nt, Mycobacterium avium subsp. paratuberculosis
cuugaccgcagccu

SEQ ID NO: 1003821 - RNA, 18 nt, Mycobacterium avium subsp. paratuberculosis
cuugaccgggcuccagcg

SEQ ID NO: 1003822 - RNA, 15 nt, Mycobacterium avium subsp. paratuberculosis
cuugagcccccaccu

SEQ ID NO: 1003823 - RNA, 16 nt, Mycobacterium avium subsp. paratuberculosis
cuugagcccccaccug

SEQ ID NO: 1003824 - RNA, 12 nt, Mycobacterium avium subsp. paratuberculosis
cuugaccagcaa

SEQ ID NO: 1003825 - RNA, 14 nt, Mycobacterium avium subsp. paratuberculosis
cuugacccggccca

SEQ ID NO: 1003826 - RNA, 16 nt, Mycobacterium avium subsp. paratuberculosis
cuugacccggccgcac

SEQ ID NO: 1003827 - RNA, 17 nt, Mycobacterium avium subsp. paratuberculosis
cuugaccagcagcugga

SEQ ID NO: 1003828 - RNA, 20 nt, Mycobacterium avium subsp. paratuberculosis
cuugaacucggccagggcuc

SEQ ID NO: 1003829 - RNA, 16 nt, Mycobacterium avium subsp. paratuberculosis
cuugaacgccgccccc

SEQ ID NO: 1003830 - RNA, 22 nt, Mycobacterium avium subsp. paratuberculosis
cuugaacgcguacagcgcccgg

SEQ ID NO: 1003831 - RNA, 10 nt, Mycobacterium avium subsp. paratuberculosis
cuugaacagc

SEQ ID NO: 1003832 - RNA, 21 nt, Mycobacterium avium subsp. paratuberculosis
cuucuugaccgcagccuucuu

SEQ ID NO: 1003833 - RNA, 22 nt, Mycobacterium avium subsp. paratuberculosis
cuucuugaccgcagccuucuuc

SEQ ID NO: 1003834 - RNA, 11 nt, Mycobacterium avium subsp. paratuberculosis
cuucuuggccg

SEQ ID NO: 1003835 - RNA, 21 nt, Mycobacterium avium subsp. paratuberculosis
cuucuuggccggagccuucuu

SEQ ID NO: 1003836 - RNA, 22 nt, Mycobacterium avium subsp. paratuberculosis
cuucuuggccggagccuucuuc

SEQ ID NO: 1003837 - RNA, 21 nt, Mycobacterium avium subsp. paratuberculosis
cuucuuggcggcggccuucuu

SEQ ID NO: 1003838 - RNA, 21 nt, Mycobacterium avium subsp. paratuberculosis
cuucuuggcggcggucuucuu

SEQ ID NO: 1003839 - RNA, 21 nt, Mycobacterium avium subsp. paratuberculosis
cuucuuggcgggcgccuucuu

SEQ ID NO: 1003840 - RNA, 20 nt, Mycobacterium avium subsp. paratuberculosis
cuucuucgccgcagccuucu

SEQ ID NO: 1003841 - RNA, 21 nt, Mycobacterium avium subsp. paratuberculosis
cuucuucgccgcagccuucuu

SEQ ID NO: 1003842 - RNA, 14 nt, Mycobacterium avium subsp. paratuberculosis
cuucuucgccggcg

SEQ ID NO: 1003843 - RNA, 21 nt, Mycobacterium avium subsp. paratuberculosis
cuucuucgcgggugccuucuu

SEQ ID NO: 1003844 - RNA, 16 nt, Mycobacterium avium subsp. paratuberculosis
cuucuggguguagguc

SEQ ID NO: 1003845 - RNA, 15 nt, Mycobacterium avium subsp. paratuberculosis
cuucuggcgcugcuc

SEQ ID NO: 1003846 - RNA, 20 nt, Mycobacterium avium subsp. paratuberculosis
cuucuggcgcugcucggagg

SEQ ID NO: 1003847 - RNA, 17 nt, Mycobacterium avium subsp. paratuberculosis
cuucuggcucaacacgu

SEQ ID NO: 1003848 - RNA, 23 nt, Mycobacterium avium subsp. paratuberculosis
cuucgugguggugcgggugaucu

SEQ ID NO: 1003849 - RNA, 23 nt, Mycobacterium avium subsp. paratuberculosis
cuucggugguguggaucuccagc

SEQ ID NO: 1003850 - RNA, 19 nt, Mycobacterium avium subsp. paratuberculosis
cuucuacggcgggccggcg

SEQ ID NO: 1003851 - RNA, 13 nt, Mycobacterium avium subsp. paratuberculosis
cuucuccacgccg

SEQ ID NO: 1003852 - RNA, 20 nt, Mycobacterium avium subsp. paratuberculosis
cuucucccgcggcagccggg

SEQ ID NO: 1003853 - RNA, 15 nt, Mycobacterium avium subsp. paratuberculosis
cuucuccgccggcag

SEQ ID NO: 1003854 - RNA, 22 nt, Mycobacterium avium subsp. paratuberculosis
cuucuccgcggccgcgcgcccg

SEQ ID NO: 1003855 - RNA, 13 nt, Mycobacterium avium subsp. paratuberculosis
cuucuccgggucg

SEQ ID NO: 1003856 - RNA, 22 nt, Mycobacterium avium subsp. paratuberculosis
cuucucgaaccggggcaccacg

SEQ ID NO: 1003857 - RNA, 15 nt, Mycobacterium avium subsp. paratuberculosis
cuucucgaccaggcu

SEQ ID NO: 1003858 - RNA, 17 nt, Mycobacterium avium subsp. paratuberculosis
cuucugcccggccagca

SEQ ID NO: 1003859 - RNA, 18 nt, Mycobacterium avium subsp. paratuberculosis
cuucugcccggccagcag

SEQ ID NO: 1003860 - RNA, 20 nt, Mycobacterium avium subsp. paratuberculosis
cuuugaaccuggccaccagc

SEQ ID NO: 1003861 - RNA, 15 nt, Mycobacterium avium subsp. paratuberculosis
cuuucgcgucugcuc

SEQ ID NO: 1003862 - RNA, 16 nt, Mycobacterium avium subsp. paratuberculosis
cuuugccguuccagcc

SEQ ID NO: 1003863 - RNA, 20 nt, Mycobacterium avium subsp. paratuberculosis
cuuugccuuagcccggccgc

SEQ ID NO: 1003864 - RNA, 19 nt, Mycobacterium avium subsp. paratuberculosis
cuuuuaaggagcaaucgcu

SEQ ID NO: 1003865 - RNA, 18 nt, Mycobacterium avium subsp. paratuberculosis
cuuggacucccccaccac

SEQ ID NO: 1003866 - RNA, 19 nt, Mycobacterium avium subsp. paratuberculosis
cuuggacucccccaccacg

SEQ ID NO: 1003867 - RNA, 12 nt, Mycobacterium avium subsp. paratuberculosis
cuuggacagcag

SEQ ID NO: 1003868 - RNA, 19 nt, Mycobacterium avium subsp. paratuberculosis
cuuggagccgagcaccggg

SEQ ID NO: 1003869 - RNA, 17 nt, Mycobacterium avium subsp. paratuberculosis
cuuggcauuuccggcua

SEQ ID NO: 1003870 - RNA, 14 nt, Mycobacterium avium subsp. paratuberculosis
cuuggccagcugcg

SEQ ID NO: 1003871 - RNA, 14 nt, Mycobacterium avium subsp. paratuberculosis
cuuggccgcgccgc

SEQ ID NO: 1003872 - RNA, 15 nt, Mycobacterium avium subsp. paratuberculosis
cuuggccgcggccuu

SEQ ID NO: 1003873 - RNA, 18 nt, Mycobacterium avium subsp. paratuberculosis
cuuggccggagccuucuu

SEQ ID NO: 1003874 - RNA, 18 nt, Mycobacterium avium subsp. paratuberculosis
cuuggcccgcgcggccgc

SEQ ID NO: 1003875 - RNA, 15 nt, Mycobacterium avium subsp. paratuberculosis
cuugggagacuucca

SEQ ID NO: 1003876 - RNA, 14 nt, Mycobacterium avium subsp. paratuberculosis
cuugggcagcagcu

SEQ ID NO: 1003877 - RNA, 21 nt, Mycobacterium avium subsp. paratuberculosis
cuugggcauggugaagcccag

SEQ ID NO: 1003878 - RNA, 20 nt, Mycobacterium avium subsp. paratuberculosis
cuuggcguugaugucggcca

SEQ ID NO: 1003879 - RNA, 23 nt, Mycobacterium avium subsp. paratuberculosis
cuuggcgucgaucagcgcgccgc

SEQ ID NO: 1003880 - RNA, 18 nt, Mycobacterium avium subsp. paratuberculosis
cuuggcgggcgccuucuu

SEQ ID NO: 1003881 - RNA, 19 nt, Mycobacterium avium subsp. paratuberculosis
cuuggcgggcgccuucuug

SEQ ID NO: 1003882 - RNA, 23 nt, Mycobacterium avium subsp. paratuberculosis
cuuggcgggcgccuucuuggccg

SEQ ID NO: 1003883 - RNA, 20 nt, Mycobacterium avium subsp. paratuberculosis
cuuggcguaugccuccucgg

SEQ ID NO: 1003884 - RNA, 20 nt, Mycobacterium avium subsp. paratuberculosis
cuuggcguauucggcgcgca

SEQ ID NO: 1003885 - RNA, 16 nt, Mycobacterium avium subsp. paratuberculosis
cuuggcguaguggugc

SEQ ID NO: 1003886 - RNA, 18 nt, Mycobacterium avium subsp. paratuberculosis
cuuggcggccugcucgaa

SEQ ID NO: 1003887 - RNA, 19 nt, Mycobacterium avium subsp. paratuberculosis
cuuggcggcggucuucuug

SEQ ID NO: 1003888 - RNA, 20 nt, Mycobacterium avium subsp. paratuberculosis
cuuggcggcggucuucuugg

SEQ ID NO: 1003889 - RNA, 23 nt, Mycobacterium avium subsp. paratuberculosis
cuuggcggcggucuucuuggccg

SEQ ID NO: 1003890 - RNA, 14 nt, Mycobacterium avium subsp. paratuberculosis
cuuggccugcuugg

SEQ ID NO: 1003891 - RNA, 19 nt, Mycobacterium avium subsp. paratuberculosis
cuuggccugcuugggcagc

SEQ ID NO: 1003892 - RNA, 14 nt, Mycobacterium avium subsp. paratuberculosis
cuuggccuccaccg

SEQ ID NO: 1003893 - RNA, 18 nt, Mycobacterium avium subsp. paratuberculosis
cuuguaggugaucguguu

SEQ ID NO: 1003894 - RNA, 20 nt, Mycobacterium avium subsp. paratuberculosis
cuugucagguaucucugauu

SEQ ID NO: 1003895 - RNA, 19 nt, Mycobacterium avium subsp. paratuberculosis
cuuguccaccauggcuucc

SEQ ID NO: 1003896 - RNA, 17 nt, Mycobacterium avium subsp. paratuberculosis
cuuggugaaggacucca

SEQ ID NO: 1003897 - RNA, 17 nt, Mycobacterium avium subsp. paratuberculosis
cuuggugaugggcagcg

SEQ ID NO: 1003898 - RNA, 20 nt, Mycobacterium avium subsp. paratuberculosis
cuuggugaugggcagcgccc

SEQ ID NO: 1003899 - RNA, 23 nt, Mycobacterium avium subsp. paratuberculosis
cuuggugauuucgcgcaccaccu

SEQ ID NO: 1003900 - RNA, 20 nt, Mycobacterium avium subsp. paratuberculosis
cuuggucgcggccuucuugg

SEQ ID NO: 1003901 - RNA, 22 nt, Mycobacterium avium subsp. paratuberculosis
cuuggucgcggcguugcccgcu

SEQ ID NO: 1003902 - RNA, 12 nt, Mycobacterium avium subsp. paratuberculosis
cuuggugguggu

SEQ ID NO: 1003903 - RNA, 15 nt, Mycobacterium avium subsp. paratuberculosis
cuugguagaugcguu

SEQ ID NO: 1003904 - RNA, 21 nt, Mycobacterium avium subsp. paratuberculosis
cuugguagaugcguuccaggu

SEQ ID NO: 1003905 - RNA, 22 nt, Mycobacterium avium subsp. paratuberculosis
cuuggggaugguccccgggccc

SEQ ID NO: 1003906 - RNA, 16 nt, Mycobacterium avium subsp. paratuberculosis
cuugggggccgacgcu

SEQ ID NO: 1003907 - RNA, 13 nt, Mycobacterium avium subsp. paratuberculosis
cuuggucagccgc

SEQ ID NO: 1003908 - RNA, 19 nt, Mycobacterium avium subsp. paratuberculosis
cuuggucagcgcggcccgc

SEQ ID NO: 1003909 - RNA, 17 nt, Mycobacterium avium subsp. paratuberculosis
cuuggucagcucccggc

SEQ ID NO: 1003910 - RNA, 17 nt, Mycobacterium avium subsp. paratuberculosis
cuuggucacaaagcccg

SEQ ID NO: 1003911 - RNA, 16 nt, Mycobacterium avium subsp. paratuberculosis
cuuggguucggcggcg

SEQ ID NO: 1003912 - RNA, 14 nt, Mycobacterium avium subsp. paratuberculosis
cuugucccagugcu

SEQ ID NO: 1003913 - RNA, 16 nt, Mycobacterium avium subsp. paratuberculosis
cuugucggcgcccagg

SEQ ID NO: 1003914 - RNA, 18 nt, Mycobacterium avium subsp. paratuberculosis
cuugucguagcggcgcca

SEQ ID NO: 1003915 - RNA, 13 nt, Mycobacterium avium subsp. paratuberculosis
cuugucgggccgc

SEQ ID NO: 1003916 - RNA, 18 nt, Mycobacterium avium subsp. paratuberculosis
cuugucggggaagggcgc

SEQ ID NO: 1003917 - RNA, 12 nt, Mycobacterium avium subsp. paratuberculosis
cuuguggcccag

SEQ ID NO: 1003918 - RNA, 15 nt, Mycobacterium avium subsp. paratuberculosis
cuuguggcccaggcc

SEQ ID NO: 1003919 - RNA, 19 nt, Mycobacterium avium subsp. paratuberculosis
cuuguggaaggcgccggcg

SEQ ID NO: 1003920 - RNA, 18 nt, Mycobacterium avium subsp. paratuberculosis
cuuguuggucagccugau

SEQ ID NO: 1003921 - RNA, 20 nt, Mycobacterium avium subsp. paratuberculosis
cuuguugagggugacggugg

SEQ ID NO: 1003922 - RNA, 16 nt, Mycobacterium avium subsp. paratuberculosis
cuuguugcggcgcacc

SEQ ID NO: 1003923 - RNA, 15 nt, Mycobacterium avium subsp. paratuberculosis
gaaaaacgcgacggc

SEQ ID NO: 1003924 - RNA, 21 nt, Mycobacterium avium subsp. paratuberculosis
gaaaaacggcuuaaucgccca

SEQ ID NO: 1003925 - RNA, 17 nt, Mycobacterium avium subsp. paratuberculosis
gaaaccauugcaccgca

SEQ ID NO: 1003926 - RNA, 16 nt, Mycobacterium avium subsp. paratuberculosis
gaaaccccagccggcc

SEQ ID NO: 1003927 - RNA, 13 nt, Mycobacterium avium subsp. paratuberculosis
gaaacccccggga

SEQ ID NO: 1003928 - RNA, 18 nt, Mycobacterium avium subsp. paratuberculosis
gaaaccguggaagucgcc

SEQ ID NO: 1003929 - RNA, 22 nt, Mycobacterium avium subsp. paratuberculosis
gaaaccuccggagaucgccccg

SEQ ID NO: 1003930 - RNA, 12 nt, Mycobacterium avium subsp. paratuberculosis
gaaacccggcgg

SEQ ID NO: 1003931 - RNA, 14 nt, Mycobacterium avium subsp. paratuberculosis
gaaacacagcagca

SEQ ID NO: 1003932 - RNA, 16 nt, Mycobacterium avium subsp. paratuberculosis
gaaacacagcagcacg

SEQ ID NO: 1003933 - RNA, 16 nt, Mycobacterium avium subsp. paratuberculosis
gaaacaccaagcacca

SEQ ID NO: 1003934 - RNA, 18 nt, Mycobacterium avium subsp. paratuberculosis
gaaaaguucggcgggggc

SEQ ID NO: 1003935 - RNA, 13 nt, Mycobacterium avium subsp. paratuberculosis
gaaacggcugcug

SEQ ID NO: 1003936 - RNA, 15 nt, Mycobacterium avium subsp. paratuberculosis
gaaagcccccagcuc

SEQ ID NO: 1003937 - RNA, 14 nt, Mycobacterium avium subsp. paratuberculosis
gaaagcccaggccc

SEQ ID NO: 1003938 - RNA, 23 nt, Mycobacterium avium subsp. paratuberculosis
gaaagaucgucuugaccgcccgg

SEQ ID NO: 1003939 - RNA, 21 nt, Mycobacterium avium subsp. paratuberculosis
gaaauaggccgggcagugcgc

SEQ ID NO: 1003940 - RNA, 16 nt, Mycobacterium avium subsp. paratuberculosis
gaaauccacgaugccg

SEQ ID NO: 1003941 - RNA, 20 nt, Mycobacterium avium subsp. paratuberculosis
gaaauccacgaugccgggca

SEQ ID NO: 1003942 - RNA, 21 nt, Mycobacterium avium subsp. paratuberculosis
gaaaguuguagcgcagcauca

SEQ ID NO: 1003943 - RNA, 13 nt, Mycobacterium avium subsp. paratuberculosis
gaaaggcagcagc

SEQ ID NO: 1003944 - RNA, 18 nt, Mycobacterium avium subsp. paratuberculosis
gaaaggccagcacgcagg

SEQ ID NO: 1003945 - RNA, 12 nt, Mycobacterium avium subsp. paratuberculosis
gaaaggaucuga

SEQ ID NO: 1003946 - RNA, 16 nt, Mycobacterium avium subsp. paratuberculosis
gaaagggucugcgaag

SEQ ID NO: 1003947 - RNA, 14 nt, Mycobacterium avium subsp. paratuberculosis
gaacaccccgcggg

SEQ ID NO: 1003948 - RNA, 17 nt, Mycobacterium avium subsp. paratuberculosis
gaacaccacggccggca

SEQ ID NO: 1003949 - RNA, 23 nt, Mycobacterium avium subsp. paratuberculosis
gaacaccacgguguagcggcggc

SEQ ID NO: 1003950 - RNA, 13 nt, Mycobacterium avium subsp. paratuberculosis
gaacagacacagc

SEQ ID NO: 1003951 - RNA, 18 nt, Mycobacterium avium subsp. paratuberculosis
gaacagacacagcacgcc

SEQ ID NO: 1003952 - RNA, 17 nt, Mycobacterium avium subsp. paratuberculosis
gaacaacgcgcacaaca

SEQ ID NO: 1003953 - RNA, 23 nt, Mycobacterium avium subsp. paratuberculosis
gaacaacgcgcacaacagccaug

SEQ ID NO: 1003954 - RNA, 12 nt, Mycobacterium avium subsp. paratuberculosis
gaacaacagggc

SEQ ID NO: 1003955 - RNA, 21 nt, Mycobacterium avium subsp. paratuberculosis
gaacaacggcggaccggcggc

SEQ ID NO: 1003956 - RNA, 20 nt, Mycobacterium avium subsp. paratuberculosis
gaacagugcacugccgaccc

SEQ ID NO: 1003957 - RNA, 15 nt, Mycobacterium avium subsp. paratuberculosis
gaacagggcggcggg

SEQ ID NO: 1003958 - RNA, 19 nt, Mycobacterium avium subsp. paratuberculosis
gaacagggugacgauccac

SEQ ID NO: 1003959 - RNA, 22 nt, Mycobacterium avium subsp. paratuberculosis
gaacagguccuugcccagcagu

SEQ ID NO: 1003960 - RNA, 13 nt, Mycobacterium avium subsp. paratuberculosis
gaacagccgaccg

SEQ ID NO: 1003961 - RNA, 16 nt, Mycobacterium avium subsp. paratuberculosis
gaacagccgggccagc

SEQ ID NO: 1003962 - RNA, 19 nt, Mycobacterium avium subsp. paratuberculosis
gaacagccgggccgcccgc

SEQ ID NO: 1003963 - RNA, 15 nt, Mycobacterium avium subsp. paratuberculosis
gaacagcgacgucug

SEQ ID NO: 1003964 - RNA, 20 nt, Mycobacterium avium subsp. paratuberculosis
gaacagcgacgucugcggcu

SEQ ID NO: 1003965 - RNA, 16 nt, Mycobacterium avium subsp. paratuberculosis
gaaaucucgaagugga

SEQ ID NO: 1003966 - RNA, 16 nt, Mycobacterium avium subsp. paratuberculosis
gaaaucggguccagcg

SEQ ID NO: 1003967 - RNA, 22 nt, Mycobacterium avium subsp. paratuberculosis
gaaaucuucgccgucagugcgc

SEQ ID NO: 1003968 - RNA, 23 nt, Mycobacterium avium subsp. paratuberculosis
gaaaugggccagguccucgcugg

SEQ ID NO: 1003969 - RNA, 22 nt, Mycobacterium avium subsp. paratuberculosis
gaaaugggccaugccggccuga

SEQ ID NO: 1003970 - RNA, 16 nt, Mycobacterium avium subsp. paratuberculosis
gaaaugcgucgccagu

SEQ ID NO: 1003971 - RNA, 14 nt, Mycobacterium avium subsp. paratuberculosis
gaaaugccgugcca

SEQ ID NO: 1003972 - RNA, 17 nt, Mycobacterium avium subsp. paratuberculosis
gaaaugccgugccagcc

SEQ ID NO: 1003973 - RNA, 21 nt, Mycobacterium avium subsp. paratuberculosis
gauauugaucgagagcuucau

SEQ ID NO: 1003974 - RNA, 17 nt, Mycobacterium avium subsp. paratuberculosis
gauagccccgccaggcg

SEQ ID NO: 1003975 - RNA, 15 nt, Mycobacterium avium subsp. paratuberculosis
gauagcccagccagc

SEQ ID NO: 1003976 - RNA, 16 nt, Mycobacterium avium subsp. paratuberculosis
gauagcccagccagcc

SEQ ID NO: 1003977 - RNA, 17 nt, Mycobacterium avium subsp. paratuberculosis
gauagcccaggccuugu

SEQ ID NO: 1003978 - RNA, 22 nt, Mycobacterium avium subsp. paratuberculosis
gauacgucuugucggggaaggg

SEQ ID NO: 1003979 - RNA, 20 nt, Mycobacterium avium subsp. paratuberculosis
gauaccguccgcgcccaccc

SEQ ID NO: 1003980 - RNA, 13 nt, Mycobacterium avium subsp. paratuberculosis
gauacccgcggcc

SEQ ID NO: 1003981 - RNA, 15 nt, Mycobacterium avium subsp. paratuberculosis
gauacccgcggccuc

SEQ ID NO: 1003982 - RNA, 19 nt, Mycobacterium avium subsp. paratuberculosis
gauacccaugaucgccagu

SEQ ID NO: 1003983 - RNA, 20 nt, Mycobacterium avium subsp. paratuberculosis
gaguuuuucgggguggugga

SEQ ID NO: 1003984 - RNA, 19 nt, Mycobacterium avium subsp. paratuberculosis
gaguucagaagucgcccgc

SEQ ID NO: 1003985 - RNA, 15 nt, Mycobacterium avium subsp. paratuberculosis
gagugcggcccaccc

SEQ ID NO: 1003986 - RNA, 19 nt, Mycobacterium avium subsp. paratuberculosis
gaguugcgcagccgggcgg

SEQ ID NO: 1003987 - RNA, 22 nt, Mycobacterium avium subsp. paratuberculosis
gaguugcgcagccgggcgguga

SEQ ID NO: 1003988 - RNA, 17 nt, Mycobacterium avium subsp. paratuberculosis
gaguugccccguguggu

SEQ ID NO: 1003989 - RNA, 18 nt, Mycobacterium avium subsp. paratuberculosis
gaguucacccguggcuga

SEQ ID NO: 1003990 - RNA, 14 nt, Mycobacterium avium subsp. paratuberculosis
gaguccagccagcc

SEQ ID NO: 1003991 - RNA, 16 nt, Mycobacterium avium subsp. paratuberculosis
gaguccagccagccgc

SEQ ID NO: 1003992 - RNA, 22 nt, Mycobacterium avium subsp. paratuberculosis
gaguccgcggaggcgagcagcc

SEQ ID NO: 1003993 - RNA, 17 nt, Mycobacterium avium subsp. paratuberculosis
gagucuacuuggccagc

SEQ ID NO: 1003994 - RNA, 18 nt, Mycobacterium avium subsp. paratuberculosis
gagugcgccgugcagcac

SEQ ID NO: 1003995 - RNA, 16 nt, Mycobacterium avium subsp. paratuberculosis
gagugcgcugugguga

SEQ ID NO: 1003996 - RNA, 13 nt, Mycobacterium avium subsp. paratuberculosis
gaguaguccagca

SEQ ID NO: 1003997 - RNA, 17 nt, Mycobacterium avium subsp. paratuberculosis
gaguagcgcgcgaaggc

SEQ ID NO: 1003998 - RNA, 16 nt, Mycobacterium avium subsp. paratuberculosis
gaggugugaggagucg

SEQ ID NO: 1003999 - RNA, 13 nt, Mycobacterium avium subsp. paratuberculosis
gagguggcccgcc

SEQ ID NO: 1004000 - RNA, 16 nt, Mycobacterium avium subsp. paratuberculosis
gagcuuguccugcacc

SEQ ID NO: 1004001 - RNA, 22 nt, Mycobacterium avium subsp. paratuberculosis
gagcuugggccggugcagcacg

SEQ ID NO: 1004002 - RNA, 15 nt, Mycobacterium avium subsp. paratuberculosis
gagcugggccggcgc

SEQ ID NO: 1004003 - RNA, 17 nt, Mycobacterium avium subsp. paratuberculosis
gagcugggcggcgcgcu

SEQ ID NO: 1004004 - RNA, 14 nt, Mycobacterium avium subsp. paratuberculosis
gagcuggugcagcg

SEQ ID NO: 1004005 - RNA, 20 nt, Mycobacterium avium subsp. paratuberculosis
gagcuggugggccaucgcca

SEQ ID NO: 1004006 - RNA, 16 nt, Mycobacterium avium subsp. paratuberculosis
gagcuucaugcccuug

SEQ ID NO: 1004007 - RNA, 22 nt, Mycobacterium avium subsp. paratuberculosis
gagcuggccguugauggaagcg

SEQ ID NO: 1004008 - RNA, 16 nt, Mycobacterium avium subsp. paratuberculosis
gaggacgaggcccgca

SEQ ID NO: 1004009 - RNA, 21 nt, Mycobacterium avium subsp. paratuberculosis
gaggauggggucgcgggcgcc

SEQ ID NO: 1004010 - RNA, 10 nt, Mycobacterium avium subsp. paratuberculosis
gaggaucugg

SEQ ID NO: 1004011 - RNA, 22 nt, Mycobacterium avium subsp. paratuberculosis
gaggaucugggcggcgggacgg

SEQ ID NO: 1004012 - RNA, 23 nt, Mycobacterium avium subsp. paratuberculosis
gaggcugcggguggggaagacgu

SEQ ID NO: 1004013 - RNA, 15 nt, Mycobacterium avium subsp. paratuberculosis
gaggcuguccagcag

SEQ ID NO: 1004014 - RNA, 16 nt, Mycobacterium avium subsp. paratuberculosis
gaggcuguccagcagc

SEQ ID NO: 1004015 - RNA, 17 nt, Mycobacterium avium subsp. paratuberculosis
gaggcuguccagcagcg

SEQ ID NO: 1004016 - RNA, 22 nt, Mycobacterium avium subsp. paratuberculosis
gaggcguuggcccgcacccgcc

SEQ ID NO: 1004017 - RNA, 15 nt, Mycobacterium avium subsp. paratuberculosis
gaggcgugcagcccg

SEQ ID NO: 1004018 - RNA, 18 nt, Mycobacterium avium subsp. paratuberculosis
gaggcgguuccgguggcg

SEQ ID NO: 1004019 - RNA, 19 nt, Mycobacterium avium subsp. paratuberculosis
gaggcgguuccgguggcgc

SEQ ID NO: 1004020 - RNA, 20 nt, Mycobacterium avium subsp. paratuberculosis
gaggcguagcugcaggcgac

SEQ ID NO: 1004021 - RNA, 19 nt, Mycobacterium avium subsp. paratuberculosis
gaggcgucagggguuggcg

SEQ ID NO: 1004022 - RNA, 12 nt, Mycobacterium avium subsp. paratuberculosis
gaggcguccucc

SEQ ID NO: 1004023 - RNA, 10 nt, Mycobacterium avium subsp. paratuberculosis
gaggcacccg

SEQ ID NO: 1004024 - RNA, 15 nt, Mycobacterium avium subsp. paratuberculosis
gaggcacccgcugca

SEQ ID NO: 1004025 - RNA, 21 nt, Mycobacterium avium subsp. paratuberculosis
gaggcaccgaacgccagcagc

SEQ ID NO: 1004026 - RNA, 17 nt, Mycobacterium avium subsp. paratuberculosis
gaggucggugaggcugg

SEQ ID NO: 1004027 - RNA, 19 nt, Mycobacterium avium subsp. paratuberculosis
gaggucggugaggcugggu

SEQ ID NO: 1004028 - RNA, 15 nt, Mycobacterium avium subsp. paratuberculosis
gaggucggccagcag

SEQ ID NO: 1004029 - RNA, 19 nt, Mycobacterium avium subsp. paratuberculosis
gaggucgucgagggccacc

SEQ ID NO: 1004030 - RNA, 19 nt, Mycobacterium avium subsp. paratuberculosis
gaggucgucgggcgccggu

SEQ ID NO: 1004031 - RNA, 23 nt, Mycobacterium avium subsp. paratuberculosis
gaggucgaaccacgcggcggcgg

SEQ ID NO: 1004032 - RNA, 19 nt, Mycobacterium avium subsp. paratuberculosis
gaggucgccgacgccgucg

SEQ ID NO: 1004033 - RNA, 19 nt, Mycobacterium avium subsp. paratuberculosis
gaggugcugucgucgcccu

SEQ ID NO: 1004034 - RNA, 16 nt, Mycobacterium avium subsp. paratuberculosis
gaggugccgcgcggca

SEQ ID NO: 1004035 - RNA, 17 nt, Mycobacterium avium subsp. paratuberculosis
gaggugccggccggucg

SEQ ID NO: 1004036 - RNA, 17 nt, Mycobacterium avium subsp. paratuberculosis
gaggugccgcgcagcac

SEQ ID NO: 1004037 - RNA, 20 nt, Mycobacterium avium subsp. paratuberculosis
gaggugccgcgcagcaccgu

SEQ ID NO: 1004038 - RNA, 22 nt, Mycobacterium avium subsp. paratuberculosis
gagggcgccguuguaggccgcg

SEQ ID NO: 1004039 - RNA, 23 nt, Mycobacterium avium subsp. paratuberculosis
gagggcgccguuguaggccgcgc

SEQ ID NO: 1004040 - RNA, 15 nt, Mycobacterium avium subsp. paratuberculosis
gagggcguccuucca

SEQ ID NO: 1004041 - RNA, 17 nt, Mycobacterium avium subsp. paratuberculosis
gagggccaccggcuccu

SEQ ID NO: 1004042 - RNA, 14 nt, Mycobacterium avium subsp. paratuberculosis
gagggccagcaguc

SEQ ID NO: 1004043 - RNA, 18 nt, Mycobacterium avium subsp. paratuberculosis
gagggcccgggcaggcau

SEQ ID NO: 1004044 - RNA, 16 nt, Mycobacterium avium subsp. paratuberculosis
gagggccuccaccacc

SEQ ID NO: 1004045 - RNA, 20 nt, Mycobacterium avium subsp. paratuberculosis
gagccaguucgccagcaugc

SEQ ID NO: 1004046 - RNA, 22 nt, Mycobacterium avium subsp. paratuberculosis
gagcaguucgaugcgcucggcg

SEQ ID NO: 1004047 - RNA, 20 nt, Mycobacterium avium subsp. paratuberculosis
gagcaucacgaacccgugga

SEQ ID NO: 1004048 - RNA, 14 nt, Mycobacterium avium subsp. paratuberculosis
gagcaucagcugcc

SEQ ID NO: 1004049 - RNA, 19 nt, Mycobacterium avium subsp. paratuberculosis
gagcauccggugccgagcg

SEQ ID NO: 1004050 - RNA, 19 nt, Mycobacterium avium subsp. paratuberculosis
gagcaucgaggaucgccaa

SEQ ID NO: 1004051 - RNA, 14 nt, Mycobacterium avium subsp. paratuberculosis
gagcaucgccgagc

SEQ ID NO: 1004052 - RNA, 21 nt, Mycobacterium avium subsp. paratuberculosis
gagcaucgccgagcgcaucga

SEQ ID NO: 1004053 - RNA, 20 nt, Mycobacterium avium subsp. paratuberculosis
gagccuucuucgccgcaacc

SEQ ID NO: 1004054 - RNA, 21 nt, Mycobacterium avium subsp. paratuberculosis
gagccuucuucgccgcaaccu

SEQ ID NO: 1004055 - RNA, 22 nt, Mycobacterium avium subsp. paratuberculosis
gagccuucuucgccgcagccuu

SEQ ID NO: 1004056 - RNA, 20 nt, Mycobacterium avium subsp. paratuberculosis
gagccuucuugaccgcagcc

SEQ ID NO: 1004057 - RNA, 21 nt, Mycobacterium avium subsp. paratuberculosis
gagccuucuugaccgcagccu

SEQ ID NO: 1004058 - RNA, 20 nt, Mycobacterium avium subsp. paratuberculosis
gagccgguccgaccagcggc

SEQ ID NO: 1004059 - RNA, 21 nt, Mycobacterium avium subsp. paratuberculosis
gagccgguccgaccagcggcc

SEQ ID NO: 1004060 - RNA, 14 nt, Mycobacterium avium subsp. paratuberculosis
gagccgguccgacg

SEQ ID NO: 1004061 - RNA, 16 nt, Mycobacterium avium subsp. paratuberculosis
gagccgguccgacggc

SEQ ID NO: 1004062 - RNA, 19 nt, Mycobacterium avium subsp. paratuberculosis
gagccggucgaacgccagc

SEQ ID NO: 1004063 - RNA, 16 nt, Mycobacterium avium subsp. paratuberculosis
gagccgggcggccagc

SEQ ID NO: 1004064 - RNA, 19 nt, Mycobacterium avium subsp. paratuberculosis
gagccgggcagcgcgacac

SEQ ID NO: 1004065 - RNA, 15 nt, Mycobacterium avium subsp. paratuberculosis
gagccggcccugcgg

SEQ ID NO: 1004066 - RNA, 17 nt, Mycobacterium avium subsp. paratuberculosis
gagccggccucgccggc

SEQ ID NO: 1004067 - RNA, 12 nt, Mycobacterium avium subsp. paratuberculosis
gagccggcggcg

SEQ ID NO: 1004068 - RNA, 14 nt, Mycobacterium avium subsp. paratuberculosis
gagccggcggcggu

SEQ ID NO: 1004069 - RNA, 14 nt, Mycobacterium avium subsp. paratuberculosis
gagccggcggcguu

SEQ ID NO: 1004070 - RNA, 19 nt, Mycobacterium avium subsp. paratuberculosis
gagccggcgucgccgcugg

SEQ ID NO: 1004071 - RNA, 17 nt, Mycobacterium avium subsp. paratuberculosis
gagccggacaucucccg

SEQ ID NO: 1004072 - RNA, 20 nt, Mycobacterium avium subsp. paratuberculosis
gagccgcuugguggcgccgg

SEQ ID NO: 1004073 - RNA, 18 nt, Mycobacterium avium subsp. paratuberculosis
gagccgcgcgccgagagc

SEQ ID NO: 1004074 - RNA, 17 nt, Mycobacterium avium subsp. paratuberculosis
gagcccagcgugaaacu

SEQ ID NO: 1004075 - RNA, 13 nt, Mycobacterium avium subsp. paratuberculosis
gagcccagcugcg

SEQ ID NO: 1004076 - RNA, 21 nt, Mycobacterium avium subsp. paratuberculosis
gagcccagcuuggcgcccuug

SEQ ID NO: 1004077 - RNA, 13 nt, Mycobacterium avium subsp. paratuberculosis
gagcccccaccug

SEQ ID NO: 1004078 - RNA, 14 nt, Mycobacterium avium subsp. paratuberculosis
gagcccccaccuga

SEQ ID NO: 1004079 - RNA, 15 nt, Mycobacterium avium subsp. paratuberculosis
gagcccugcgccagc

SEQ ID NO: 1004080 - RNA, 17 nt, Mycobacterium avium subsp. paratuberculosis
gagcccugcgccagcag

SEQ ID NO: 1004081 - RNA, 18 nt, Mycobacterium avium subsp. paratuberculosis
gagcccugcgccagcagc

SEQ ID NO: 1004082 - RNA, 19 nt, Mycobacterium avium subsp. paratuberculosis
gagcccgggcaggcggcgc

SEQ ID NO: 1004083 - RNA, 17 nt, Mycobacterium avium subsp. paratuberculosis
gagcccgacggcagcac

SEQ ID NO: 1004084 - RNA, 16 nt, Mycobacterium avium subsp. paratuberculosis
gagcccgccggcggcg

SEQ ID NO: 1004085 - RNA, 13 nt, Mycobacterium avium subsp. paratuberculosis
gagcccggccagu

SEQ ID NO: 1004086 - RNA, 23 nt, Mycobacterium avium subsp. paratuberculosis
gagcaggcuucgcagcagauccu

SEQ ID NO: 1004087 - RNA, 12 nt, Mycobacterium avium subsp. paratuberculosis
gagcagggugac

SEQ ID NO: 1004088 - RNA, 21 nt, Mycobacterium avium subsp. paratuberculosis
aaagcagcaacggcggcggca

SEQ ID NO: 1004089 - RNA, 19 nt, Mycobacterium avium subsp. paratuberculosis
gagcagugcaucgcugccg

SEQ ID NO: 1004090 - RNA, 18 nt, Mycobacterium avium subsp. paratuberculosis
gagcacucgcgggacggc

SEQ ID NO: 1004091 - RNA, 14 nt, Mycobacterium avium subsp. paratuberculosis
gagcacggugggcg

SEQ ID NO: 1004092 - RNA, 17 nt, Mycobacterium avium subsp. paratuberculosis
gagcacggugggcgccg

SEQ ID NO: 1004093 - RNA, 16 nt, Mycobacterium avium subsp. paratuberculosis
gagcacgcggccgcgc

SEQ ID NO: 1004094 - RNA, 15 nt, Mycobacterium avium subsp. paratuberculosis
gagcacgcagccgcg

SEQ ID NO: 1004095 - RNA, 15 nt, Mycobacterium avium subsp. paratuberculosis
gagcacagcacggca

SEQ ID NO: 1004096 - RNA, 13 nt, Mycobacterium avium subsp. paratuberculosis
gagcacagcggcg

SEQ ID NO: 1004097 - RNA, 14 nt, Mycobacterium avium subsp. paratuberculosis
gagcacagcggcgg

SEQ ID NO: 1004098 - RNA, 23 nt, Mycobacterium avium subsp. paratuberculosis
gagcacacccagcgagccgauga

SEQ ID NO: 1004099 - RNA, 19 nt, Mycobacterium avium subsp. paratuberculosis
gagcacacccucaccccgc

SEQ ID NO: 1004100 - RNA, 16 nt, Mycobacterium avium subsp. paratuberculosis
gagaugccgggaagcg

SEQ ID NO: 1004101 - RNA, 22 nt, Mycobacterium avium subsp. paratuberculosis
gagcaccacacgugcggauggc

SEQ ID NO: 1004102 - RNA, 12 nt, Mycobacterium avium subsp. paratuberculosis
gagcacccagaa

SEQ ID NO: 1004103 - RNA, 14 nt, Mycobacterium avium subsp. paratuberculosis
gagcaccagcccgg

SEQ ID NO: 1004104 - RNA, 19 nt, Mycobacterium avium subsp. paratuberculosis
gagcaccagcccggccagc

SEQ ID NO: 1004105 - RNA, 18 nt, Mycobacterium avium subsp. paratuberculosis
gagcacgaacgcggccgc

SEQ ID NO: 1004106 - RNA, 19 nt, Mycobacterium avium subsp. paratuberculosis
gagcacgaacgcggccgcc

SEQ ID NO: 1004107 - RNA, 18 nt, Mycobacterium avium subsp. paratuberculosis
gagcacgaccgccagcag

SEQ ID NO: 1004108 - RNA, 19 nt, Mycobacterium avium subsp. paratuberculosis
gagcacgaccgccagcagc

SEQ ID NO: 1004109 - RNA, 16 nt, Mycobacterium avium subsp. paratuberculosis
gagcaccgggcgucgg

SEQ ID NO: 1004110 - RNA, 22 nt, Mycobacterium avium subsp. paratuberculosis
gagcaccucuucgaaagccacc

SEQ ID NO: 1004111 - RNA, 22 nt, Mycobacterium avium subsp. paratuberculosis
gagcacccgcagcucgccgagc

SEQ ID NO: 1004112 - RNA, 22 nt, Mycobacterium avium subsp. paratuberculosis
gagcaccgcgaccacgccgcgg

SEQ ID NO: 1004113 - RNA, 20 nt, Mycobacterium avium subsp. paratuberculosis
gagcaccgcgaucugcucgg

SEQ ID NO: 1004114 - RNA, 22 nt, Mycobacterium avium subsp. paratuberculosis
gagcaccgcgucguagagcuga

SEQ ID NO: 1004115 - RNA, 17 nt, Mycobacterium avium subsp. paratuberculosis
gagcaccggcagccgca

SEQ ID NO: 1004116 - RNA, 23 nt, Mycobacterium avium subsp. paratuberculosis
gagcaccggcuggugcagcagcu

SEQ ID NO: 1004117 - RNA, 17 nt, Mycobacterium avium subsp. paratuberculosis
gagcaccgggaacagcc

SEQ ID NO: 1004118 - RNA, 20 nt, Mycobacterium avium subsp. paratuberculosis
gagcaccgggaacagccagg

SEQ ID NO: 1004119 - RNA, 21 nt, Mycobacterium avium subsp. paratuberculosis
gagcaccgggaacagccaggc

SEQ ID NO: 1004120 - RNA, 16 nt, Mycobacterium avium subsp. paratuberculosis
gagagcugcugccgcc

SEQ ID NO: 1004121 - RNA, 16 nt, Mycobacterium avium subsp. paratuberculosis
gagaguuugcccucgu

SEQ ID NO: 1004122 - RNA, 19 nt, Mycobacterium avium subsp. paratuberculosis
gagaucccagcgggacagc

SEQ ID NO: 1004123 - RNA, 19 nt, Mycobacterium avium subsp. paratuberculosis
gagaucccugcgcucagca

SEQ ID NO: 1004124 - RNA, 17 nt, Mycobacterium avium subsp. paratuberculosis
gagaugaagacccggcc

SEQ ID NO: 1004125 - RNA, 15 nt, Mycobacterium avium subsp. paratuberculosis
gagaucagcaccagg

SEQ ID NO: 1004126 - RNA, 22 nt, Mycobacterium avium subsp. paratuberculosis
gagaucaccgcguagcgccgcc

SEQ ID NO: 1004127 - RNA, 16 nt, Mycobacterium avium subsp. paratuberculosis
gagaucagcgccaugc

SEQ ID NO: 1004128 - RNA, 15 nt, Mycobacterium avium subsp. paratuberculosis
gagaucagggcgcgc

SEQ ID NO: 1004129 - RNA, 19 nt, Mycobacterium avium subsp. paratuberculosis
gagacugcgacccaccguc

SEQ ID NO: 1004130 - RNA, 17 nt, Mycobacterium avium subsp. paratuberculosis
gagacugaugguggcgc

SEQ ID NO: 1004131 - RNA, 17 nt, Mycobacterium avium subsp. paratuberculosis
gagacguaccagcugcc

SEQ ID NO: 1004132 - RNA, 18 nt, Mycobacterium avium subsp. paratuberculosis
gagacguccgaggucuug

SEQ ID NO: 1004133 - RNA, 15 nt, Mycobacterium avium subsp. paratuberculosis
gagaacgucaggccc

SEQ ID NO: 1004134 - RNA, 23 nt, Mycobacterium avium subsp. paratuberculosis
gagaacgucaggcccagcgaggc

SEQ ID NO: 1004135 - RNA, 22 nt, Mycobacterium avium subsp. paratuberculosis
gagaacucgaucugcagccggc

SEQ ID NO: 1004136 - RNA, 13 nt, Mycobacterium avium subsp. paratuberculosis
gagaaggcggcgu

SEQ ID NO: 1004137 - RNA, 23 nt, Mycobacterium avium subsp. paratuberculosis
gagaaggugucgcacugcuucgg

SEQ ID NO: 1004138 - RNA, 22 nt, Mycobacterium avium subsp. paratuberculosis
gagacgacgacgaacgcgguga

SEQ ID NO: 1004139 - RNA, 13 nt, Mycobacterium avium subsp. paratuberculosis
gagacgacgccac

SEQ ID NO: 1004140 - RNA, 15 nt, Mycobacterium avium subsp. paratuberculosis
gagacgacucuucca

SEQ ID NO: 1004141 - RNA, 12 nt, Mycobacterium avium subsp. paratuberculosis
gagaccucccgg

SEQ ID NO: 1004142 - RNA, 23 nt, Mycobacterium avium subsp. paratuberculosis
gagaccagccagaacgaacagau

SEQ ID NO: 1004143 - RNA, 20 nt, Mycobacterium avium subsp. paratuberculosis
gagaccgucggugcggggcg

SEQ ID NO: 1004144 - RNA, 22 nt, Mycobacterium avium subsp. paratuberculosis
gagaccgucggugcggggcggg

SEQ ID NO: 1004145 - RNA, 17 nt, Mycobacterium avium subsp. paratuberculosis
gagaaaggccagcacgc

SEQ ID NO: 1004146 - RNA, 23 nt, Mycobacterium avium subsp. paratuberculosis
gacuguuugaugccgucgguggu

SEQ ID NO: 1004147 - RNA, 21 nt, Mycobacterium avium subsp. paratuberculosis
gacuucuacggcgggccggcg

SEQ ID NO: 1004148 - RNA, 16 nt, Mycobacterium avium subsp. paratuberculosis
gacucguucgacgccg

SEQ ID NO: 1004149 - RNA, 16 nt, Mycobacterium avium subsp. paratuberculosis
gacucguuggccggcu

SEQ ID NO: 1004150 - RNA, 13 nt, Mycobacterium avium subsp. paratuberculosis
gacucggcgaagu

SEQ ID NO: 1004151 - RNA, 15 nt, Mycobacterium avium subsp. paratuberculosis
gacucgaucgccacc

SEQ ID NO: 1004152 - RNA, 19 nt, Mycobacterium avium subsp. paratuberculosis
gacucgaagaucgccugca

SEQ ID NO: 1004153 - RNA, 21 nt, Mycobacterium avium subsp. paratuberculosis
gacucgaagaucgccugcagg

SEQ ID NO: 1004154 - RNA, 14 nt, Mycobacterium avium subsp. paratuberculosis
gacuccucugccag

SEQ ID NO: 1004155 - RNA, 16 nt, Mycobacterium avium subsp. paratuberculosis
gacuccugacgcaccu

SEQ ID NO: 1004156 - RNA, 16 nt, Mycobacterium avium subsp. paratuberculosis
gacuccucacaccucg

SEQ ID NO: 1004157 - RNA, 15 nt, Mycobacterium avium subsp. paratuberculosis
gacuccucgguggcc

SEQ ID NO: 1004158 - RNA, 16 nt, Mycobacterium avium subsp. paratuberculosis
gacucugcacucagag

SEQ ID NO: 1004159 - RNA, 21 nt, Mycobacterium avium subsp. paratuberculosis
gacucugcacucagagcagcg

SEQ ID NO: 1004160 - RNA, 20 nt, Mycobacterium avium subsp. paratuberculosis
gacucuuccaggacaacgca

SEQ ID NO: 1004161 - RNA, 16 nt, Mycobacterium avium subsp. paratuberculosis
gacuccccgcccggca

SEQ ID NO: 1004162 - RNA, 15 nt, Mycobacterium avium subsp. paratuberculosis
gacuccggcgccggu

SEQ ID NO: 1004163 - RNA, 22 nt, Mycobacterium avium subsp. paratuberculosis
gacuccggcgccggucagcggc

SEQ ID NO: 1004164 - RNA, 12 nt, Mycobacterium avium subsp. paratuberculosis
gacguuggagaa

SEQ ID NO: 1004165 - RNA, 13 nt, Mycobacterium avium subsp. paratuberculosis
gacguugccgcac

SEQ ID NO: 1004166 - RNA, 18 nt, Mycobacterium avium subsp. paratuberculosis
gacgugccccucgacccg

SEQ ID NO: 1004167 - RNA, 22 nt, Mycobacterium avium subsp. paratuberculosis
gacgugcccuuccccggcggcc

SEQ ID NO: 1004168 - RNA, 14 nt, Mycobacterium avium subsp. paratuberculosis
gacgugauaucggg

SEQ ID NO: 1004169 - RNA, 17 nt, Mycobacterium avium subsp. paratuberculosis
gacgugaucgcgguggc

SEQ ID NO: 1004170 - RNA, 16 nt, Mycobacterium avium subsp. paratuberculosis
gacgugaucggcggcc

SEQ ID NO: 1004171 - RNA, 14 nt, Mycobacterium avium subsp. paratuberculosis
gacgugcaccaccg

SEQ ID NO: 1004172 - RNA, 16 nt, Mycobacterium avium subsp. paratuberculosis
gacguggagcugaagu

SEQ ID NO: 1004173 - RNA, 16 nt, Mycobacterium avium subsp. paratuberculosis
gacguggcggccgucg

SEQ ID NO: 1004174 - RNA, 19 nt, Mycobacterium avium subsp. paratuberculosis
gacguggcggccgucgcgc

SEQ ID NO: 1004175 - RNA, 14 nt, Mycobacterium avium subsp. paratuberculosis
gacguggcggcggu

SEQ ID NO: 1004176 - RNA, 15 nt, Mycobacterium avium subsp. paratuberculosis
gacguggcggcggug

SEQ ID NO: 1004177 - RNA, 13 nt, Mycobacterium avium subsp. paratuberculosis
gacguggcucagc

SEQ ID NO: 1004178 - RNA, 13 nt, Mycobacterium avium subsp. paratuberculosis
gacgugcgcggcg

SEQ ID NO: 1004179 - RNA, 23 nt, Mycobacterium avium subsp. paratuberculosis
gacgugccgguggacgaggugac

SEQ ID NO: 1004180 - RNA, 17 nt, Mycobacterium avium subsp. paratuberculosis
gacugaugaagccgccg

SEQ ID NO: 1004181 - RNA, 18 nt, Mycobacterium avium subsp. paratuberculosis
gacugaugaagccgccga

SEQ ID NO: 1004182 - RNA, 17 nt, Mycobacterium avium subsp. paratuberculosis
gacugcccgaccgcgcc

SEQ ID NO: 1004183 - RNA, 21 nt, Mycobacterium avium subsp. paratuberculosis
gacugccgagcaucagcugcc

SEQ ID NO: 1004184 - RNA, 16 nt, Mycobacterium avium subsp. paratuberculosis
gacugcgaugcuuccc

SEQ ID NO: 1004185 - RNA, 19 nt, Mycobacterium avium subsp. paratuberculosis
gacugcgcggccggcgugu

SEQ ID NO: 1004186 - RNA, 14 nt, Mycobacterium avium subsp. paratuberculosis
gacugcgcaccgcc

SEQ ID NO: 1004187 - RNA, 19 nt, Mycobacterium avium subsp. paratuberculosis
gacugcgcaccgccagcac

SEQ ID NO: 1004188 - RNA, 20 nt, Mycobacterium avium subsp. paratuberculosis
gacugcgcaccgccagcacc

SEQ ID NO: 1004189 - RNA, 17 nt, Mycobacterium avium subsp. paratuberculosis
gacuggcugagcagcac

SEQ ID NO: 1004190 - RNA, 14 nt, Mycobacterium avium subsp. paratuberculosis
gacugggcgcccac

SEQ ID NO: 1004191 - RNA, 21 nt, Mycobacterium avium subsp. paratuberculosis
gacuggcccacgcagccgucg

SEQ ID NO: 1004192 - RNA, 14 nt, Mycobacterium avium subsp. paratuberculosis
gacugcuugggcgc

SEQ ID NO: 1004193 - RNA, 19 nt, Mycobacterium avium subsp. paratuberculosis
gaccgucuccaacugcauu

SEQ ID NO: 1004194 - RNA, 15 nt, Mycobacterium avium subsp. paratuberculosis
gaccgucgcgcagcc

SEQ ID NO: 1004195 - RNA, 16 nt, Mycobacterium avium subsp. paratuberculosis
gaccgucacgcuggcg

SEQ ID NO: 1004196 - RNA, 18 nt, Mycobacterium avium subsp. paratuberculosis
gaccucccggcgccacgc

SEQ ID NO: 1004197 - RNA, 15 nt, Mycobacterium avium subsp. paratuberculosis
gaccuccucgacccc

SEQ ID NO: 1004198 - RNA, 19 nt, Mycobacterium avium subsp. paratuberculosis
gaccuccuugcccagcgcg

SEQ ID NO: 1004199 - RNA, 19 nt, Mycobacterium avium subsp. paratuberculosis
gaccgguccgccgccggcg

SEQ ID NO: 1004200 - RNA, 15 nt, Mycobacterium avium subsp. paratuberculosis
gaccgggucugccac

SEQ ID NO: 1004201 - RNA, 19 nt, Mycobacterium avium subsp. paratuberculosis
gaccgggugaccggcgcgc

SEQ ID NO: 1004202 - RNA, 13 nt, Mycobacterium avium subsp. paratuberculosis
gaccggguggugg

SEQ ID NO: 1004203 - RNA, 20 nt, Mycobacterium avium subsp. paratuberculosis
gaccggcucguagcuggugc

SEQ ID NO: 1004204 - RNA, 19 nt, Mycobacterium avium subsp. paratuberculosis
gaccggcucgccggcgcgc

SEQ ID NO: 1004205 - RNA, 16 nt, Mycobacterium avium subsp. paratuberculosis
gaccgggacgacggcg

SEQ ID NO: 1004206 - RNA, 20 nt, Mycobacterium avium subsp. paratuberculosis
gaccgggacgacggcgccgc

SEQ ID NO: 1004207 - RNA, 12 nt, Mycobacterium avium subsp. paratuberculosis
gaccgggcgcuc

SEQ ID NO: 1004208 - RNA, 14 nt, Mycobacterium avium subsp. paratuberculosis
gaccgggcuccagc

SEQ ID NO: 1004209 - RNA, 14 nt, Mycobacterium avium subsp. paratuberculosis
gaccgcagcaggcg

SEQ ID NO: 1004210 - RNA, 23 nt, Mycobacterium avium subsp. paratuberculosis
gaccgcacaugccgaggcacagc

SEQ ID NO: 1004211 - RNA, 17 nt, Mycobacterium avium subsp. paratuberculosis
gaccgauggcggcggcc

SEQ ID NO: 1004212 - RNA, 18 nt, Mycobacterium avium subsp. paratuberculosis
gaccucuucgcuggacag

SEQ ID NO: 1004213 - RNA, 19 nt, Mycobacterium avium subsp. paratuberculosis
gaccucuucgcuggacagc

SEQ ID NO: 1004214 - RNA, 18 nt, Mycobacterium avium subsp. paratuberculosis
gaccucuucggcgccggc

SEQ ID NO: 1004215 - RNA, 17 nt, Mycobacterium avium subsp. paratuberculosis
gaccucgucggcggcga

SEQ ID NO: 1004216 - RNA, 21 nt, Mycobacterium avium subsp. paratuberculosis
gaccucgucgggcgccagccc

SEQ ID NO: 1004217 - RNA, 23 nt, Mycobacterium avium subsp. paratuberculosis
gaccucgucgggcgccagcccgc

SEQ ID NO: 1004218 - RNA, 17 nt, Mycobacterium avium subsp. paratuberculosis
gaccucggcggccagcg

SEQ ID NO: 1004219 - RNA, 15 nt, Mycobacterium avium subsp. paratuberculosis
gaccucggccaccac

SEQ ID NO: 1004220 - RNA, 16 nt, Mycobacterium avium subsp. paratuberculosis
gaccucgcgcaccggc

SEQ ID NO: 1004221 - RNA, 21 nt, Mycobacterium avium subsp. paratuberculosis
gaccucgcgcaccggcugccc

SEQ ID NO: 1004222 - RNA, 20 nt, Mycobacterium avium subsp. paratuberculosis
gaccucgacacgggccgcgc

SEQ ID NO: 1004223 - RNA, 17 nt, Mycobacterium avium subsp. paratuberculosis
gaccucgaccagccggu

SEQ ID NO: 1004224 - RNA, 15 nt, Mycobacterium avium subsp. paratuberculosis
gaccucgcccgccgc

SEQ ID NO: 1004225 - RNA, 14 nt, Mycobacterium avium subsp. paratuberculosis
gaccucgccgacgg

SEQ ID NO: 1004226 - RNA, 20 nt, Mycobacterium avium subsp. paratuberculosis
gaccucgccgacgucccagc

SEQ ID NO: 1004227 - RNA, 14 nt, Mycobacterium avium subsp. paratuberculosis
gaccucgccgagca

SEQ ID NO: 1004228 - RNA, 21 nt, Mycobacterium avium subsp. paratuberculosis
gacgaccagguccaccccgcc

SEQ ID NO: 1004229 - RNA, 17 nt, Mycobacterium avium subsp. paratuberculosis
gaccuucuuggucagcg

SEQ ID NO: 1004230 - RNA, 17 nt, Mycobacterium avium subsp. paratuberculosis
gaccuucucgaccaggc

SEQ ID NO: 1004231 - RNA, 16 nt, Mycobacterium avium subsp. paratuberculosis
gaccuucugcugcacg

SEQ ID NO: 1004232 - RNA, 23 nt, Mycobacterium avium subsp. paratuberculosis
gaccuucuggccuugcagcccgc

SEQ ID NO: 1004233 - RNA, 23 nt, Mycobacterium avium subsp. paratuberculosis
gacgaagucggucagcgucgccg

SEQ ID NO: 1004234 - RNA, 14 nt, Mycobacterium avium subsp. paratuberculosis
gacgauggccaggc

SEQ ID NO: 1004235 - RNA, 22 nt, Mycobacterium avium subsp. paratuberculosis
gacgaugccguagagccguuug

SEQ ID NO: 1004236 - RNA, 22 nt, Mycobacterium avium subsp. paratuberculosis
gacgaugucgaaacccaggaac

SEQ ID NO: 1004237 - RNA, 16 nt, Mycobacterium avium subsp. paratuberculosis
gacgaugcggccguug

SEQ ID NO: 1004238 - RNA, 13 nt, Mycobacterium avium subsp. paratuberculosis
gacgaggcgggcg

SEQ ID NO: 1004239 - RNA, 15 nt, Mycobacterium avium subsp. paratuberculosis
gacgagcucaccgcc

SEQ ID NO: 1004240 - RNA, 23 nt, Mycobacterium avium subsp. paratuberculosis
gacgaugaugucgcccggcggca

SEQ ID NO: 1004241 - RNA, 20 nt, Mycobacterium avium subsp. paratuberculosis
gacgaugaugucggccggca

SEQ ID NO: 1004242 - RNA, 13 nt, Mycobacterium avium subsp. paratuberculosis
gacgagcccgcgc

SEQ ID NO: 1004243 - RNA, 19 nt, Mycobacterium avium subsp. paratuberculosis
gacgagccgucgaagauga

SEQ ID NO: 1004244 - RNA, 14 nt, Mycobacterium avium subsp. paratuberculosis
gacgagcagccgca

SEQ ID NO: 1004245 - RNA, 14 nt, Mycobacterium avium subsp. paratuberculosis
gacgacgaagacgu

SEQ ID NO: 1004246 - RNA, 21 nt, Mycobacterium avium subsp. paratuberculosis
gacgagagcggaucggcggcg

SEQ ID NO: 1004247 - RNA, 22 nt, Mycobacterium avium subsp. paratuberculosis
gacgaccgcaccgaccagcggg

SEQ ID NO: 1004248 - RNA, 23 nt, Mycobacterium avium subsp. paratuberculosis
gacgaccgcaccgaccagcggga

SEQ ID NO: 1004249 - RNA, 17 nt, Mycobacterium avium subsp. paratuberculosis
gacgaccuggucgccgc

SEQ ID NO: 1004250 - RNA, 15 nt, Mycobacterium avium subsp. paratuberculosis
gacgcaaaagccccc

SEQ ID NO: 1004251 - RNA, 22 nt, Mycobacterium avium subsp. paratuberculosis
gacgccguugcggugcucgucg

SEQ ID NO: 1004252 - RNA, 19 nt, Mycobacterium avium subsp. paratuberculosis
gacgcgaaagcagcguucg

SEQ ID NO: 1004253 - RNA, 15 nt, Mycobacterium avium subsp. paratuberculosis
gacgcgaagucgccg

SEQ ID NO: 1004254 - RNA, 17 nt, Mycobacterium avium subsp. paratuberculosis
gacgcgaccgcgcggcg

SEQ ID NO: 1004255 - RNA, 19 nt, Mycobacterium avium subsp. paratuberculosis
gacgcgacggucgugcugg

SEQ ID NO: 1004256 - RNA, 18 nt, Mycobacterium avium subsp. paratuberculosis
gacgcaccucgcucagcc

SEQ ID NO: 1004257 - RNA, 19 nt, Mycobacterium avium subsp. paratuberculosis
gacgcacgccggcgggggu

SEQ ID NO: 1004258 - RNA, 16 nt, Mycobacterium avium subsp. paratuberculosis
gacgcacgucggcagg

SEQ ID NO: 1004259 - RNA, 19 nt, Mycobacterium avium subsp. paratuberculosis
gacgcgauggcgcuggccg

SEQ ID NO: 1004260 - RNA, 20 nt, Mycobacterium avium subsp. paratuberculosis
gacgcgcaccagggccgcga

SEQ ID NO: 1004261 - RNA, 13 nt, Mycobacterium avium subsp. paratuberculosis
gacgcgcaccgcc

SEQ ID NO: 1004262 - RNA, 12 nt, Mycobacterium avium subsp. paratuberculosis
gacgcgccgucg

SEQ ID NO: 1004263 - RNA, 13 nt, Mycobacterium avium subsp. paratuberculosis
gacgcgcgcggcg

SEQ ID NO: 1004264 - RNA, 15 nt, Mycobacterium avium subsp. paratuberculosis
gacgcgccacgcccc

SEQ ID NO: 1004265 - RNA, 22 nt, Mycobacterium avium subsp. paratuberculosis
gacgcgccacgccccggcgccg

SEQ ID NO: 1004266 - RNA, 14 nt, Mycobacterium avium subsp. paratuberculosis
gacgcgggccggca

SEQ ID NO: 1004267 - RNA, 23 nt, Mycobacterium avium subsp. paratuberculosis
gacgcgggccggcacccgggccu

SEQ ID NO: 1004268 - RNA, 16 nt, Mycobacterium avium subsp. paratuberculosis
gacgcgggccugggca

SEQ ID NO: 1004269 - RNA, 12 nt, Mycobacterium avium subsp. paratuberculosis
gacgcgggcgcc

SEQ ID NO: 1004270 - RNA, 16 nt, Mycobacterium avium subsp. paratuberculosis
gacgcgggcgcccagc

SEQ ID NO: 1004271 - RNA, 16 nt, Mycobacterium avium subsp. paratuberculosis
gacgcgcucagcccca

SEQ ID NO: 1004272 - RNA, 14 nt, Mycobacterium avium subsp. paratuberculosis
gacgcggcacgccg

SEQ ID NO: 1004273 - RNA, 17 nt, Mycobacterium avium subsp. paratuberculosis
gacgcggcacgccgcuc

SEQ ID NO: 1004274 - RNA, 18 nt, Mycobacterium avium subsp. paratuberculosis
gacgcggcacgccgcucg

SEQ ID NO: 1004275 - RNA, 22 nt, Mycobacterium avium subsp. paratuberculosis
gacgcugaagaagaugggcgcc

SEQ ID NO: 1004276 - RNA, 23 nt, Mycobacterium avium subsp. paratuberculosis
gacgcugaagaagaugggcgccg

SEQ ID NO: 1004277 - RNA, 19 nt, Mycobacterium avium subsp. paratuberculosis
gacgcugagccgcucgucg

SEQ ID NO: 1004278 - RNA, 16 nt, Mycobacterium avium subsp. paratuberculosis
gacgcucggucgccac

SEQ ID NO: 1004279 - RNA, 14 nt, Mycobacterium avium subsp. paratuberculosis
gacgcuggccacga

SEQ ID NO: 1004280 - RNA, 22 nt, Mycobacterium avium subsp. paratuberculosis
gacgcuggccacgauccggggc

SEQ ID NO: 1004281 - RNA, 12 nt, Mycobacterium avium subsp. paratuberculosis
gacgcugcaggu

SEQ ID NO: 1004282 - RNA, 16 nt, Mycobacterium avium subsp. paratuberculosis
gacggauccgggcgcc

SEQ ID NO: 1004283 - RNA, 22 nt, Mycobacterium avium subsp. paratuberculosis
gacgcugugcgccuugccgucg

SEQ ID NO: 1004284 - RNA, 22 nt, Mycobacterium avium subsp. paratuberculosis
gacgcguccguagugcucggcg

SEQ ID NO: 1004285 - RNA, 14 nt, Mycobacterium avium subsp. paratuberculosis
gacgcgucgcggcg

SEQ ID NO: 1004286 - RNA, 16 nt, Mycobacterium avium subsp. paratuberculosis
gacgcgucgcggcggg

SEQ ID NO: 1004287 - RNA, 16 nt, Mycobacterium avium subsp. paratuberculosis
gacgcggggcggcggc

SEQ ID NO: 1004288 - RNA, 20 nt, Mycobacterium avium subsp. paratuberculosis
gacgcggugagcgcgccggc

SEQ ID NO: 1004289 - RNA, 13 nt, Mycobacterium avium subsp. paratuberculosis
gacgcgguggugc

SEQ ID NO: 1004290 - RNA, 14 nt, Mycobacterium avium subsp. paratuberculosis
gacgcgguggugcu

SEQ ID NO: 1004291 - RNA, 22 nt, Mycobacterium avium subsp. paratuberculosis
gacgcguuguugcucggcggcc

SEQ ID NO: 1004292 - RNA, 23 nt, Mycobacterium avium subsp. paratuberculosis
gacgcucacccggcccaccggcc

SEQ ID NO: 1004293 - RNA, 14 nt, Mycobacterium avium subsp. paratuberculosis
gacgcucgcguggc

SEQ ID NO: 1004294 - RNA, 15 nt, Mycobacterium avium subsp. paratuberculosis
gacgguuuuggucug

SEQ ID NO: 1004295 - RNA, 16 nt, Mycobacterium avium subsp. paratuberculosis
gacgguuuuggucugc

SEQ ID NO: 1004296 - RNA, 23 nt, Mycobacterium avium subsp. paratuberculosis
gacggugucgcccucgcgcaggg

SEQ ID NO: 1004297 - RNA, 20 nt, Mycobacterium avium subsp. paratuberculosis
gacggugucguagacgacgu

SEQ ID NO: 1004298 - RNA, 16 nt, Mycobacterium avium subsp. paratuberculosis
gacgguuguucagccc

SEQ ID NO: 1004299 - RNA, 14 nt, Mycobacterium avium subsp. paratuberculosis
gacgggucgguggu

SEQ ID NO: 1004300 - RNA, 13 nt, Mycobacterium avium subsp. paratuberculosis
gacgggugggugg

SEQ ID NO: 1004301 - RNA, 15 nt, Mycobacterium avium subsp. paratuberculosis
gacggguugggcgcc

SEQ ID NO: 1004302 - RNA, 18 nt, Mycobacterium avium subsp. paratuberculosis
gacggguuggucggcgcg

SEQ ID NO: 1004303 - RNA, 14 nt, Mycobacterium avium subsp. paratuberculosis
gacggugggcccgc

SEQ ID NO: 1004304 - RNA, 19 nt, Mycobacterium avium subsp. paratuberculosis
gacgguggggcuggccgca

SEQ ID NO: 1004305 - RNA, 17 nt, Mycobacterium avium subsp. paratuberculosis
gacgucauccggcugcc

SEQ ID NO: 1004306 - RNA, 14 nt, Mycobacterium avium subsp. paratuberculosis
gacguccugguuga

SEQ ID NO: 1004307 - RNA, 20 nt, Mycobacterium avium subsp. paratuberculosis
gacguccugguugaggaucu

SEQ ID NO: 1004308 - RNA, 22 nt, Mycobacterium avium subsp. paratuberculosis
gacguccuugacccggccgcac

SEQ ID NO: 1004309 - RNA, 16 nt, Mycobacterium avium subsp. paratuberculosis
gacgucgagggcgccg

SEQ ID NO: 1004310 - RNA, 20 nt, Mycobacterium avium subsp. paratuberculosis
gacgugaaaucccccgaccc

SEQ ID NO: 1004311 - RNA, 14 nt, Mycobacterium avium subsp. paratuberculosis
gacgucggccggcu

SEQ ID NO: 1004312 - RNA, 18 nt, Mycobacterium avium subsp. paratuberculosis
gacgucggucagcaucgg

SEQ ID NO: 1004313 - RNA, 20 nt, Mycobacterium avium subsp. paratuberculosis
gacgucguuuuccagccggc

SEQ ID NO: 1004314 - RNA, 14 nt, Mycobacterium avium subsp. paratuberculosis
gacgucugcggcuc

SEQ ID NO: 1004315 - RNA, 13 nt, Mycobacterium avium subsp. paratuberculosis
gacgucugggccg

SEQ ID NO: 1004316 - RNA, 22 nt, Mycobacterium avium subsp. paratuberculosis
gacggcaccgccggcggccucc

SEQ ID NO: 1004317 - RNA, 15 nt, Mycobacterium avium subsp. paratuberculosis
gacggcagcaccgcc

SEQ ID NO: 1004318 - RNA, 15 nt, Mycobacterium avium subsp. paratuberculosis
gacggaucugcucgu

SEQ ID NO: 1004319 - RNA, 14 nt, Mycobacterium avium subsp. paratuberculosis
gacggauucccgaa

SEQ ID NO: 1004320 - RNA, 20 nt, Mycobacterium avium subsp. paratuberculosis
gacgggaccacccgcagcgc

SEQ ID NO: 1004321 - RNA, 14 nt, Mycobacterium avium subsp. paratuberculosis
gacgggcgucggcg

SEQ ID NO: 1004322 - RNA, 18 nt, Mycobacterium avium subsp. paratuberculosis
gacgggcgucggcgggcg

SEQ ID NO: 1004323 - RNA, 21 nt, Mycobacterium avium subsp. paratuberculosis
gacgggcugucccggccgcga

SEQ ID NO: 1004324 - RNA, 15 nt, Mycobacterium avium subsp. paratuberculosis
gacgggcacccgcgc

SEQ ID NO: 1004325 - RNA, 15 nt, Mycobacterium avium subsp. paratuberculosis
gacgggcagggugac

SEQ ID NO: 1004326 - RNA, 15 nt, Mycobacterium avium subsp. paratuberculosis
gacgggcauccggcu

SEQ ID NO: 1004327 - RNA, 21 nt, Mycobacterium avium subsp. paratuberculosis
gacgggcauccggcucagaag

SEQ ID NO: 1004328 - RNA, 19 nt, Mycobacterium avium subsp. paratuberculosis
gacgggcaugccgucggcg

SEQ ID NO: 1004329 - RNA, 15 nt, Mycobacterium avium subsp. paratuberculosis
gacgggaucggcgcg

SEQ ID NO: 1004330 - RNA, 17 nt, Mycobacterium avium subsp. paratuberculosis
gacaguucgguggggcc

SEQ ID NO: 1004331 - RNA, 23 nt, Mycobacterium avium subsp. paratuberculosis
gacagcgucguccaugcccgccc

SEQ ID NO: 1004332 - RNA, 22 nt, Mycobacterium avium subsp. paratuberculosis
gacagcucgcgcugaagccgcu

SEQ ID NO: 1004333 - RNA, 20 nt, Mycobacterium avium subsp. paratuberculosis
gacagcgggccgacccggcc

SEQ ID NO: 1004334 - RNA, 17 nt, Mycobacterium avium subsp. paratuberculosis
gacaggaggacaaguca

SEQ ID NO: 1004335 - RNA, 24 nt, Mycobacterium avium subsp. paratuberculosis
gacagcguggucgcgcagcauggc

SEQ ID NO: 1004336 - RNA, 15 nt, Mycobacterium avium subsp. paratuberculosis
gacagcgcgacgcac

SEQ ID NO: 1004337 - RNA, 13 nt, Mycobacterium avium subsp. paratuberculosis
gacagcgccugcc

SEQ ID NO: 1004338 - RNA, 21 nt, Mycobacterium avium subsp. paratuberculosis
gacaucucgacggugaccggc

SEQ ID NO: 1004339 - RNA, 16 nt, Mycobacterium avium subsp. paratuberculosis
gacaucggcagcaggg

SEQ ID NO: 1004340 - RNA, 15 nt, Mycobacterium avium subsp. paratuberculosis
gacacguaggccgcc

SEQ ID NO: 1004341 - RNA, 13 nt, Mycobacterium avium subsp. paratuberculosis
gacacguccagcu

SEQ ID NO: 1004342 - RNA, 18 nt, Mycobacterium avium subsp. paratuberculosis
gacacgaacgacgcggca

SEQ ID NO: 1004343 - RNA, 21 nt, Mycobacterium avium subsp. paratuberculosis
gacacgcgccggcgcgggcau

SEQ ID NO: 1004344 - RNA, 15 nt, Mycobacterium avium subsp. paratuberculosis
gacacggaaaccgcu

SEQ ID NO: 1004345 - RNA, 22 nt, Mycobacterium avium subsp. paratuberculosis
gacacggaaaccgcugcggcac

SEQ ID NO: 1004346 - RNA, 13 nt, Mycobacterium avium subsp. paratuberculosis
gacacggcggcgc

SEQ ID NO: 1004347 - RNA, 17 nt, Mycobacterium avium subsp. paratuberculosis
gacacgggccgcgccga

SEQ ID NO: 1004348 - RNA, 19 nt, Mycobacterium avium subsp. paratuberculosis
gacaccgucgcgcacccag

SEQ ID NO: 1004349 - RNA, 18 nt, Mycobacterium avium subsp. paratuberculosis
gacaccucggccagcgcc

SEQ ID NO: 1004350 - RNA, 23 nt, Mycobacterium avium subsp. paratuberculosis
gacaccugcucaccgagcugggc

SEQ ID NO: 1004351 - RNA, 18 nt, Mycobacterium avium subsp. paratuberculosis
gacacgaccgccugucag

SEQ ID NO: 1004352 - RNA, 15 nt, Mycobacterium avium subsp. paratuberculosis
gacacgcccugguag

SEQ ID NO: 1004353 - RNA, 16 nt, Mycobacterium avium subsp. paratuberculosis
gacagcaacgccaggg

SEQ ID NO: 1004354 - RNA, 20 nt, Mycobacterium avium subsp. paratuberculosis
gacagccugaccgcggguga

SEQ ID NO: 1004355 - RNA, 18 nt, Mycobacterium avium subsp. paratuberculosis
gacagcagcagcucccac

SEQ ID NO: 1004356 - RNA, 17 nt, Mycobacterium avium subsp. paratuberculosis
gacagcgacgggccggg

SEQ ID NO: 1004357 - RNA, 17 nt, Mycobacterium avium subsp. paratuberculosis
gacagccggggcagcug

SEQ ID NO: 1004358 - RNA, 20 nt, Mycobacterium avium subsp. paratuberculosis
gacagccggggcagcugcug

SEQ ID NO: 1004359 - RNA, 13 nt, Mycobacterium avium subsp. paratuberculosis
gacagcagccgcu

SEQ ID NO: 1004360 - RNA, 15 nt, Mycobacterium avium subsp. paratuberculosis
gacagcacccgcugc

SEQ ID NO: 1004361 - RNA, 14 nt, Mycobacterium avium subsp. paratuberculosis
gacagcacccggcc

SEQ ID NO: 1004362 - RNA, 22 nt, Mycobacterium avium subsp. paratuberculosis
gacagcacguuguucaggucga

SEQ ID NO: 1004363 - RNA, 19 nt, Mycobacterium avium subsp. paratuberculosis
gaccagauaggccagcgcg

SEQ ID NO: 1004364 - RNA, 13 nt, Mycobacterium avium subsp. paratuberculosis
gaccacggcccca

SEQ ID NO: 1004365 - RNA, 16 nt, Mycobacterium avium subsp. paratuberculosis
gaccacggucacagcc

SEQ ID NO: 1004366 - RNA, 17 nt, Mycobacterium avium subsp. paratuberculosis
gaccacggugcgcucgu

SEQ ID NO: 1004367 - RNA, 20 nt, Mycobacterium avium subsp. paratuberculosis
gaccaggaugucuccgcgca

SEQ ID NO: 1004368 - RNA, 22 nt, Mycobacterium avium subsp. paratuberculosis
gaccaggaugucuccgcgcagc

SEQ ID NO: 1004369 - RNA, 20 nt, Mycobacterium avium subsp. paratuberculosis
gaccaggaugcccaggauga

SEQ ID NO: 1004370 - RNA, 19 nt, Mycobacterium avium subsp. paratuberculosis
gaccaggcuuggcccgccg

SEQ ID NO: 1004371 - RNA, 21 nt, Mycobacterium avium subsp. paratuberculosis
gaccagcgcccccgacaggcc

SEQ ID NO: 1004372 - RNA, 21 nt, Mycobacterium avium subsp. paratuberculosis
gaccagcgcaaccgcggcggc

SEQ ID NO: 1004373 - RNA, 15 nt, Mycobacterium avium subsp. paratuberculosis
gaccagccgguaggc

SEQ ID NO: 1004374 - RNA, 22 nt, Mycobacterium avium subsp. paratuberculosis
gaccagcccgcucagagcugca

SEQ ID NO: 1004375 - RNA, 20 nt, Mycobacterium avium subsp. paratuberculosis
gaccagcaggucgagcaugc

SEQ ID NO: 1004376 - RNA, 23 nt, Mycobacterium avium subsp. paratuberculosis
gaccagauccucgaauccgcggg

SEQ ID NO: 1004377 - RNA, 15 nt, Mycobacterium avium subsp. paratuberculosis
gacccuggccagcac

SEQ ID NO: 1004378 - RNA, 17 nt, Mycobacterium avium subsp. paratuberculosis
gacccuggccagcaccg

SEQ ID NO: 1004379 - RNA, 15 nt, Mycobacterium avium subsp. paratuberculosis
gacccguuccccggc

SEQ ID NO: 1004380 - RNA, 19 nt, Mycobacterium avium subsp. paratuberculosis
gacccucagcagggcggca

SEQ ID NO: 1004381 - RNA, 16 nt, Mycobacterium avium subsp. paratuberculosis
gacccgguagcgcagc

SEQ ID NO: 1004382 - RNA, 20 nt, Mycobacterium avium subsp. paratuberculosis
gacccgguagcgcagcacca

SEQ ID NO: 1004383 - RNA, 19 nt, Mycobacterium avium subsp. paratuberculosis
gacccggucagcucgccgu

SEQ ID NO: 1004384 - RNA, 23 nt, Mycobacterium avium subsp. paratuberculosis
gacccgggcgauggugccgccgg

SEQ ID NO: 1004385 - RNA, 23 nt, Mycobacterium avium subsp. paratuberculosis
gacccggucggccgcgugcaccu

SEQ ID NO: 1004386 - RNA, 20 nt, Mycobacterium avium subsp. paratuberculosis
gacccggaggcggcgggggc

SEQ ID NO: 1004387 - RNA, 15 nt, Mycobacterium avium subsp. paratuberculosis
gacccggccgagcgc

SEQ ID NO: 1004388 - RNA, 12 nt, Mycobacterium avium subsp. paratuberculosis
gacccggccgca

SEQ ID NO: 1004389 - RNA, 19 nt, Mycobacterium avium subsp. paratuberculosis
gacccggccgcacaccacc

SEQ ID NO: 1004390 - RNA, 21 nt, Mycobacterium avium subsp. paratuberculosis
gacccggccgcacaccaccac

SEQ ID NO: 1004391 - RNA, 19 nt, Mycobacterium avium subsp. paratuberculosis
gacccggccguugggccag

SEQ ID NO: 1004392 - RNA, 20 nt, Mycobacterium avium subsp. paratuberculosis
gacccggccguugggccagc

SEQ ID NO: 1004393 - RNA, 23 nt, Mycobacterium avium subsp. paratuberculosis
gacccggccguugggccagcggc

SEQ ID NO: 1004394 - RNA, 14 nt, Mycobacterium avium subsp. paratuberculosis
gacccggccaccgc

SEQ ID NO: 1004395 - RNA, 13 nt, Mycobacterium avium subsp. paratuberculosis
gacccggcucucc

SEQ ID NO: 1004396 - RNA, 16 nt, Mycobacterium avium subsp. paratuberculosis
gacccgggccagcagg

SEQ ID NO: 1004397 - RNA, 17 nt, Mycobacterium avium subsp. paratuberculosis
gacccgcuccagcggcc

SEQ ID NO: 1004398 - RNA, 21 nt, Mycobacterium avium subsp. paratuberculosis
gacccgcuccccgauccggcu

SEQ ID NO: 1004399 - RNA, 19 nt, Mycobacterium avium subsp. paratuberculosis
gacccgcuggaacagcggg

SEQ ID NO: 1004400 - RNA, 21 nt, Mycobacterium avium subsp. paratuberculosis
gacccgcuggaacagcgggcc

SEQ ID NO: 1004401 - RNA, 15 nt, Mycobacterium avium subsp. paratuberculosis
gacccgcggcgccgc

SEQ ID NO: 1004402 - RNA, 21 nt, Mycobacterium avium subsp. paratuberculosis
gacccgcgucaucgggcccga

SEQ ID NO: 1004403 - RNA, 17 nt, Mycobacterium avium subsp. paratuberculosis
gacccgccgcaacagcc

SEQ ID NO: 1004404 - RNA, 14 nt, Mycobacterium avium subsp. paratuberculosis
gacccgccgcagcc

SEQ ID NO: 1004405 - RNA, 15 nt, Mycobacterium avium subsp. paratuberculosis
gacccgccgugacau

SEQ ID NO: 1004406 - RNA, 21 nt, Mycobacterium avium subsp. paratuberculosis
gacccgacgggaacucggcca

SEQ ID NO: 1004407 - RNA, 14 nt, Mycobacterium avium subsp. paratuberculosis
gacccagcagcggc

SEQ ID NO: 1004408 - RNA, 15 nt, Mycobacterium avium subsp. paratuberculosis
gacccagcagcggcc

SEQ ID NO: 1004409 - RNA, 20 nt, Mycobacterium avium subsp. paratuberculosis
gacccagcagcggccggcgc

SEQ ID NO: 1004410 - RNA, 14 nt, Mycobacterium avium subsp. paratuberculosis
gaccagugcagagc

SEQ ID NO: 1004411 - RNA, 14 nt, Mycobacterium avium subsp. paratuberculosis
gaccagugguggcc

SEQ ID NO: 1004412 - RNA, 20 nt, Mycobacterium avium subsp. paratuberculosis
gaccaggugggcggccacca

SEQ ID NO: 1004413 - RNA, 21 nt, Mycobacterium avium subsp. paratuberculosis
gaccagguaggcgcccugcga

SEQ ID NO: 1004414 - RNA, 13 nt, Mycobacterium avium subsp. paratuberculosis
gaccaggguggcc

SEQ ID NO: 1004415 - RNA, 21 nt, Mycobacterium avium subsp. paratuberculosis
gaccaggguggccccagcccg

SEQ ID NO: 1004416 - RNA, 16 nt, Mycobacterium avium subsp. paratuberculosis
gaccaggguggucagc

SEQ ID NO: 1004417 - RNA, 17 nt, Mycobacterium avium subsp. paratuberculosis
gaccaggguggucagcg

SEQ ID NO: 1004418 - RNA, 21 nt, Mycobacterium avium subsp. paratuberculosis
gaauucggaacccugccccac

SEQ ID NO: 1004419 - RNA, 20 nt, Mycobacterium avium subsp. paratuberculosis
gaauucgcagguucgacacg

SEQ ID NO: 1004420 - RNA, 15 nt, Mycobacterium avium subsp. paratuberculosis
gaauuccucagcgcc

SEQ ID NO: 1004421 - RNA, 19 nt, Mycobacterium avium subsp. paratuberculosis
gaauucuggccgaccgccg

SEQ ID NO: 1004422 - RNA, 21 nt, Mycobacterium avium subsp. paratuberculosis
gaauggcagcagccggaaggc

SEQ ID NO: 1004423 - RNA, 16 nt, Mycobacterium avium subsp. paratuberculosis
gaauggcaaggccagc

SEQ ID NO: 1004424 - RNA, 12 nt, Mycobacterium avium subsp. paratuberculosis
gaauggccgcgc

SEQ ID NO: 1004425 - RNA, 12 nt, Mycobacterium avium subsp. paratuberculosis
gacaaaggaggg

SEQ ID NO: 1004426 - RNA, 17 nt, Mycobacterium avium subsp. paratuberculosis
gacaagccggagaaggc

SEQ ID NO: 1004427 - RNA, 16 nt, Mycobacterium avium subsp. paratuberculosis
aaagauguaucaggau

SEQ ID NO: 1004428 - RNA, 19 nt, Mycobacterium avium subsp. paratuberculosis
gaaucaccuugcccugcgu

SEQ ID NO: 1004429 - RNA, 14 nt, Mycobacterium avium subsp. paratuberculosis
gaaugcagcggcuc

SEQ ID NO: 1004430 - RNA, 14 nt, Mycobacterium avium subsp. paratuberculosis
gaaugcucagcggg

SEQ ID NO: 1004431 - RNA, 17 nt, Mycobacterium avium subsp. paratuberculosis
gaaucgccuacugcgcc

SEQ ID NO: 1004432 - RNA, 21 nt, Mycobacterium avium subsp. paratuberculosis
gaaucgcgggaucggccggcg

SEQ ID NO: 1004433 - RNA, 15 nt, Mycobacterium avium subsp. paratuberculosis
gaaucggucgaccag

SEQ ID NO: 1004434 - RNA, 14 nt, Mycobacterium avium subsp. paratuberculosis
gaaucccuccggca

SEQ ID NO: 1004435 - RNA, 18 nt, Mycobacterium avium subsp. paratuberculosis
gaaucccuccggcaggcc

SEQ ID NO: 1004436 - RNA, 19 nt, Mycobacterium avium subsp. paratuberculosis
gaaucccuccggcaggccg

SEQ ID NO: 1004437 - RNA, 17 nt, Mycobacterium avium subsp. paratuberculosis
gaauccgggccuccugu

SEQ ID NO: 1004438 - RNA, 20 nt, Mycobacterium avium subsp. paratuberculosis
gaauccgggugucgacgccg

SEQ ID NO: 1004439 - RNA, 17 nt, Mycobacterium avium subsp. paratuberculosis
gaauccgcgcagcagcg

SEQ ID NO: 1004440 - RNA, 21 nt, Mycobacterium avium subsp. paratuberculosis
gaauccgcgggcguggcgguc

SEQ ID NO: 1004441 - RNA, 21 nt, Mycobacterium avium subsp. paratuberculosis
gaauaacgccggccccggcga

SEQ ID NO: 1004442 - RNA, 15 nt, Mycobacterium avium subsp. paratuberculosis
gaaguuggccaccgg

SEQ ID NO: 1004443 - RNA, 13 nt, Mycobacterium avium subsp. paratuberculosis
gaaguuggccucc

SEQ ID NO: 1004444 - RNA, 18 nt, Mycobacterium avium subsp. paratuberculosis
gaaguugccggucaggca

SEQ ID NO: 1004445 - RNA, 17 nt, Mycobacterium avium subsp. paratuberculosis
gaaguugcgguugacgu

SEQ ID NO: 1004446 - RNA, 20 nt, Mycobacterium avium subsp. paratuberculosis
gaaggugaugaaaaccgggc

SEQ ID NO: 1004447 - RNA, 17 nt, Mycobacterium avium subsp. paratuberculosis
gaaggucugcagcagcc

SEQ ID NO: 1004448 - RNA, 16 nt, Mycobacterium avium subsp. paratuberculosis
gaaggugucggccggg

SEQ ID NO: 1004449 - RNA, 17 nt, Mycobacterium avium subsp. paratuberculosis
gaagguguuggugcggg

SEQ ID NO: 1004450 - RNA, 15 nt, Mycobacterium avium subsp. paratuberculosis
gaagguggcgccggu

SEQ ID NO: 1004451 - RNA, 13 nt, Mycobacterium avium subsp. paratuberculosis
gaaggugggguug

SEQ ID NO: 1004452 - RNA, 14 nt, Mycobacterium avium subsp. paratuberculosis
gaagucccacugcc

SEQ ID NO: 1004453 - RNA, 14 nt, Mycobacterium avium subsp. paratuberculosis
gaaguccgccaggg

SEQ ID NO: 1004454 - RNA, 14 nt, Mycobacterium avium subsp. paratuberculosis
gaagugcucgagca

SEQ ID NO: 1004455 - RNA, 21 nt, Mycobacterium avium subsp. paratuberculosis
gaagugcucgagcacaucggc

SEQ ID NO: 1004456 - RNA, 22 nt, Mycobacterium avium subsp. paratuberculosis
gaagugccggcgaaccucaccc

SEQ ID NO: 1004457 - RNA, 15 nt, Mycobacterium avium subsp. paratuberculosis
gaaggucauagggcu

SEQ ID NO: 1004458 - RNA, 20 nt, Mycobacterium avium subsp. paratuberculosis
gaaggucauagggcucgucc

SEQ ID NO: 1004459 - RNA, 15 nt, Mycobacterium avium subsp. paratuberculosis
gaaggucccggucag

SEQ ID NO: 1004460 - RNA, 22 nt, Mycobacterium avium subsp. paratuberculosis
gaaggucccggucagguugacg

SEQ ID NO: 1004461 - RNA, 16 nt, Mycobacterium avium subsp. paratuberculosis
gaagguccgguaggcg

SEQ ID NO: 1004462 - RNA, 19 nt, Mycobacterium avium subsp. paratuberculosis
gaagggaaaggcagcagcc

SEQ ID NO: 1004463 - RNA, 18 nt, Mycobacterium avium subsp. paratuberculosis
gaagcugaagcggcccug

SEQ ID NO: 1004464 - RNA, 17 nt, Mycobacterium avium subsp. paratuberculosis
gaagccgaacgcgcugu

SEQ ID NO: 1004465 - RNA, 23 nt, Mycobacterium avium subsp. paratuberculosis
gaagcccucuucgaucaggcgca

SEQ ID NO: 1004466 - RNA, 14 nt, Mycobacterium avium subsp. paratuberculosis
gaagcccugcucgg

SEQ ID NO: 1004467 - RNA, 15 nt, Mycobacterium avium subsp. paratuberculosis
gaagcccuucaccuc

SEQ ID NO: 1004468 - RNA, 13 nt, Mycobacterium avium subsp. paratuberculosis
gaagauggccagc

SEQ ID NO: 1004469 - RNA, 16 nt, Mycobacterium avium subsp. paratuberculosis
gaagauggccaggaac

SEQ ID NO: 1004470 - RNA, 15 nt, Mycobacterium avium subsp. paratuberculosis
gaagauggccaggua

SEQ ID NO: 1004471 - RNA, 19 nt, Mycobacterium avium subsp. paratuberculosis
gaagauggccagguagugg

SEQ ID NO: 1004472 - RNA, 17 nt, Mycobacterium avium subsp. paratuberculosis
gaagauguugcggcggc

SEQ ID NO: 1004473 - RNA, 18 nt, Mycobacterium avium subsp. paratuberculosis
gaagauguugcggcggcc

SEQ ID NO: 1004474 - RNA, 20 nt, Mycobacterium avium subsp. paratuberculosis
gaagccguugccgccgcgcg

SEQ ID NO: 1004475 - RNA, 15 nt, Mycobacterium avium subsp. paratuberculosis
gaagccggccccgcc

SEQ ID NO: 1004476 - RNA, 20 nt, Mycobacterium avium subsp. paratuberculosis
gaagccgccguccccgcgcg

SEQ ID NO: 1004477 - RNA, 14 nt, Mycobacterium avium subsp. paratuberculosis
gaagccgcagcagg

SEQ ID NO: 1004478 - RNA, 20 nt, Mycobacterium avium subsp. paratuberculosis
gaagccgccgcccugcggga

SEQ ID NO: 1004479 - RNA, 16 nt, Mycobacterium avium subsp. paratuberculosis
gaagccgacguccugg

SEQ ID NO: 1004480 - RNA, 18 nt, Mycobacterium avium subsp. paratuberculosis
gaagcuaaaccccacggc

SEQ ID NO: 1004481 - RNA, 18 nt, Mycobacterium avium subsp. paratuberculosis
gaagcguucguagaaccg

SEQ ID NO: 1004482 - RNA, 19 nt, Mycobacterium avium subsp. paratuberculosis
gaagcuaacgccagcuggg

SEQ ID NO: 1004483 - RNA, 21 nt, Mycobacterium avium subsp. paratuberculosis
gaagcuaacgccagcugggca

SEQ ID NO: 1004484 - RNA, 16 nt, Mycobacterium avium subsp. paratuberculosis
gaagcuagcuucacgc

SEQ ID NO: 1004485 - RNA, 24 nt, Mycobacterium avium subsp. paratuberculosis
gaacauggccuugaacucggccag

SEQ ID NO: 1004486 - RNA, 20 nt, Mycobacterium avium subsp. paratuberculosis
gaagaagauguugcggcggc

SEQ ID NO: 1004487 - RNA, 16 nt, Mycobacterium avium subsp. paratuberculosis
gaacaguucggugcac

SEQ ID NO: 1004488 - RNA, 13 nt, Mycobacterium avium subsp. paratuberculosis
gaacaucgccagc

SEQ ID NO: 1004489 - RNA, 20 nt, Mycobacterium avium subsp. paratuberculosis
gaacaucuugaucugggugc

SEQ ID NO: 1004490 - RNA, 20 nt, Mycobacterium avium subsp. paratuberculosis
gaagaucucggccaggauga

SEQ ID NO: 1004491 - RNA, 13 nt, Mycobacterium avium subsp. paratuberculosis
gaagaucgcccgc

SEQ ID NO: 1004492 - RNA, 23 nt, Mycobacterium avium subsp. paratuberculosis
gaagaucgucgucccgucggcgc

SEQ ID NO: 1004493 - RNA, 23 nt, Mycobacterium avium subsp. paratuberculosis
gaagaucagcaggcuggcggcga

SEQ ID NO: 1004494 - RNA, 22 nt, Mycobacterium avium subsp. paratuberculosis
gaagaccggugcgcgcaccagg

SEQ ID NO: 1004495 - RNA, 21 nt, Mycobacterium avium subsp. paratuberculosis
gaagacgaugaaaccccagcc

SEQ ID NO: 1004496 - RNA, 13 nt, Mycobacterium avium subsp. paratuberculosis
gaagagccggcgu

SEQ ID NO: 1004497 - RNA, 17 nt, Mycobacterium avium subsp. paratuberculosis
ggcgucacucuggcgug

SEQ ID NO: 1004498 - RNA, 14 nt, Mycobacterium avium subsp. paratuberculosis
ggcgucacgccagc

SEQ ID NO: 1004499 - RNA, 19 nt, Mycobacterium avium subsp. paratuberculosis
ggcgucaucccccgcagcu

SEQ ID NO: 1004500 - RNA, 20 nt, Mycobacterium avium subsp. paratuberculosis
ggcgucaucccccgcagcuu

SEQ ID NO: 1004501 - RNA, 19 nt, Mycobacterium avium subsp. paratuberculosis
ggcguccgcgaacgggugc

SEQ ID NO: 1004502 - RNA, 23 nt, Mycobacterium avium subsp. paratuberculosis
ggcguccgcgaacgggugcggcg

SEQ ID NO: 1004503 - RNA, 17 nt, Mycobacterium avium subsp. paratuberculosis
ggcguccagcggguugc

SEQ ID NO: 1004504 - RNA, 21 nt, Mycobacterium avium subsp. paratuberculosis
ggcgucaucguggacaggagg

SEQ ID NO: 1004505 - RNA, 17 nt, Mycobacterium avium subsp. paratuberculosis
ggcguccuugaccagcu

SEQ ID NO: 1004506 - RNA, 20 nt, Mycobacterium avium subsp. paratuberculosis
ggcguccucgaccacccgcu

SEQ ID NO: 1004507 - RNA, 15 nt, Mycobacterium avium subsp. paratuberculosis
ggcguccgcggcgga

SEQ ID NO: 1004508 - RNA, 18 nt, Mycobacterium avium subsp. paratuberculosis
ggcguccgcggcggaggg

SEQ ID NO: 1004509 - RNA, 15 nt, Mycobacterium avium subsp. paratuberculosis
ggcgucgacagccgg

SEQ ID NO: 1004510 - RNA, 19 nt, Mycobacterium avium subsp. paratuberculosis
ggcguacagcggcgccagg

SEQ ID NO: 1004511 - RNA, 22 nt, Mycobacterium avium subsp. paratuberculosis
ggcguacaccagggugccgccg

SEQ ID NO: 1004512 - RNA, 16 nt, Mycobacterium avium subsp. paratuberculosis
ggcguacgcgcugccg

SEQ ID NO: 1004513 - RNA, 15 nt, Mycobacterium avium subsp. paratuberculosis
ggcgguugcucgucg

SEQ ID NO: 1004514 - RNA, 23 nt, Mycobacterium avium subsp. paratuberculosis
ggcgguuggacaggccggcgacg

SEQ ID NO: 1004515 - RNA, 16 nt, Mycobacterium avium subsp. paratuberculosis
ggcgguggccugcccg

SEQ ID NO: 1004516 - RNA, 20 nt, Mycobacterium avium subsp. paratuberculosis
ggcggugcucgcgccgggcg

SEQ ID NO: 1004517 - RNA, 21 nt, Mycobacterium avium subsp. paratuberculosis
ggcggugcucuuggugguggu

SEQ ID NO: 1004518 - RNA, 21 nt, Mycobacterium avium subsp. paratuberculosis
ggcggugcgggugguguggcg

SEQ ID NO: 1004519 - RNA, 20 nt, Mycobacterium avium subsp. paratuberculosis
ggcggucuuggcggccagcg

SEQ ID NO: 1004520 - RNA, 22 nt, Mycobacterium avium subsp. paratuberculosis
ggcggugccgguguugccgacg

SEQ ID NO: 1004521 - RNA, 14 nt, Mycobacterium avium subsp. paratuberculosis
ggcggugccgagcc

SEQ ID NO: 1004522 - RNA, 19 nt, Mycobacterium avium subsp. paratuberculosis
ggcggugcagccgggugcg

SEQ ID NO: 1004523 - RNA, 21 nt, Mycobacterium avium subsp. paratuberculosis
ggcggugccgaaccggaucug

SEQ ID NO: 1004524 - RNA, 16 nt, Mycobacterium avium subsp. paratuberculosis
ggcggucgcgcagccg

SEQ ID NO: 1004525 - RNA, 18 nt, Mycobacterium avium subsp. paratuberculosis
ggcggucgcgcgccggcg

SEQ ID NO: 1004526 - RNA, 17 nt, Mycobacterium avium subsp. paratuberculosis
ggcggucggcggaggcg

SEQ ID NO: 1004527 - RNA, 23 nt, Mycobacterium avium subsp. paratuberculosis
ggcggucgcggugcccagccgca

SEQ ID NO: 1004528 - RNA, 18 nt, Mycobacterium avium subsp. paratuberculosis
ggcggucggacgcgggga

SEQ ID NO: 1004529 - RNA, 21 nt, Mycobacterium avium subsp. paratuberculosis
ggcggucggaucgagcucgca

SEQ ID NO: 1004530 - RNA, 22 nt, Mycobacterium avium subsp. paratuberculosis
ggcggucggaucgagcucgcag

SEQ ID NO: 1004531 - RNA, 12 nt, Mycobacterium avium subsp. paratuberculosis
ggcggucgccga

SEQ ID NO: 1004532 - RNA, 17 nt, Mycobacterium avium subsp. paratuberculosis
ggcgguccgccgcagcg

SEQ ID NO: 1004533 - RNA, 19 nt, Mycobacterium avium subsp. paratuberculosis
ggcgguccgccgcagcggc

SEQ ID NO: 1004534 - RNA, 15 nt, Mycobacterium avium subsp. paratuberculosis
ggcgguccgcuccac

SEQ ID NO: 1004535 - RNA, 15 nt, Mycobacterium avium subsp. paratuberculosis
ggcggucccggcgga

SEQ ID NO: 1004536 - RNA, 20 nt, Mycobacterium avium subsp. paratuberculosis
ggcggucccgugcgccgccc

SEQ ID NO: 1004537 - RNA, 22 nt, Mycobacterium avium subsp. paratuberculosis
ggcggucccgugcgccgcccac

SEQ ID NO: 1004538 - RNA, 14 nt, Mycobacterium avium subsp. paratuberculosis
ggcggucaggccgu

SEQ ID NO: 1004539 - RNA, 23 nt, Mycobacterium avium subsp. paratuberculosis
ggcggucauugaucuccgcggcg

SEQ ID NO: 1004540 - RNA, 19 nt, Mycobacterium avium subsp. paratuberculosis
ggcgguccagcgagcccuu

SEQ ID NO: 1004541 - RNA, 14 nt, Mycobacterium avium subsp. paratuberculosis
ggcggcugaagcgc

SEQ ID NO: 1004542 - RNA, 17 nt, Mycobacterium avium subsp. paratuberculosis
ggcgcuggugcagcagg

SEQ ID NO: 1004543 - RNA, 18 nt, Mycobacterium avium subsp. paratuberculosis
ggcgcuggugcagcaggg

SEQ ID NO: 1004544 - RNA, 16 nt, Mycobacterium avium subsp. paratuberculosis
ggcgcuguaggcggcg

SEQ ID NO: 1004545 - RNA, 20 nt, Mycobacterium avium subsp. paratuberculosis
ggcgcuguaggcggcgugcc

SEQ ID NO: 1004546 - RNA, 21 nt, Mycobacterium avium subsp. paratuberculosis
ggcgcuugaccucgccgagca

SEQ ID NO: 1004547 - RNA, 16 nt, Mycobacterium avium subsp. paratuberculosis
ggcgcuguugcccaau

SEQ ID NO: 1004548 - RNA, 15 nt, Mycobacterium avium subsp. paratuberculosis
ggcgcuucgggugcg

SEQ ID NO: 1004549 - RNA, 18 nt, Mycobacterium avium subsp. paratuberculosis
ggcggccccgggcgcugg

SEQ ID NO: 1004550 - RNA, 21 nt, Mycobacterium avium subsp. paratuberculosis
ggcggcccgaccagcgggccg

SEQ ID NO: 1004551 - RNA, 14 nt, Mycobacterium avium subsp. paratuberculosis
ggcggcccgcagga

SEQ ID NO: 1004552 - RNA, 19 nt, Mycobacterium avium subsp. paratuberculosis
ggcggcccguccgccccgc

SEQ ID NO: 1004553 - RNA, 22 nt, Mycobacterium avium subsp. paratuberculosis
ggcggcccgucgccaccacggc

SEQ ID NO: 1004554 - RNA, 12 nt, Mycobacterium avium subsp. paratuberculosis
ggcggccgagcg

SEQ ID NO: 1004555 - RNA, 15 nt, Mycobacterium avium subsp. paratuberculosis
ggcggcccgccucgg

SEQ ID NO: 1004556 - RNA, 23 nt, Mycobacterium avium subsp. paratuberculosis
ggcggcccgccucggcggccgcc

SEQ ID NO: 1004557 - RNA, 17 nt, Mycobacterium avium subsp. paratuberculosis
ggcggcccgcgccggcg

SEQ ID NO: 1004558 - RNA, 22 nt, Mycobacterium avium subsp. paratuberculosis
ggcggcccgccgcgcccggcuu

SEQ ID NO: 1004559 - RNA, 16 nt, Mycobacterium avium subsp. paratuberculosis
ggcggcccgcuugccg

SEQ ID NO: 1004560 - RNA, 19 nt, Mycobacterium avium subsp. paratuberculosis
ggcggcccgcuugccgacg

SEQ ID NO: 1004561 - RNA, 21 nt, Mycobacterium avium subsp. paratuberculosis
ggcggcgugggguucccggcc

SEQ ID NO: 1004562 - RNA, 19 nt, Mycobacterium avium subsp. paratuberculosis
ggcggcgugccagggcagc

SEQ ID NO: 1004563 - RNA, 20 nt, Mycobacterium avium subsp. paratuberculosis
ggcggcgugccagggcagcg

SEQ ID NO: 1004564 - RNA, 15 nt, Mycobacterium avium subsp. paratuberculosis
ggcggcgugccgccc

SEQ ID NO: 1004565 - RNA, 23 nt, Mycobacterium avium subsp. paratuberculosis
ggcggcuccgaucuccugguguc

SEQ ID NO: 1004566 - RNA, 15 nt, Mycobacterium avium subsp. paratuberculosis
ggcggcucgccggcg

SEQ ID NO: 1004567 - RNA, 15 nt, Mycobacterium avium subsp. paratuberculosis
ggcggcucggcggcg

SEQ ID NO: 1004568 - RNA, 15 nt, Mycobacterium avium subsp. paratuberculosis
ggcggcggucuucuu

SEQ ID NO: 1004569 - RNA, 13 nt, Mycobacterium avium subsp. paratuberculosis
ggcggcggggcug

SEQ ID NO: 1004570 - RNA, 13 nt, Mycobacterium avium subsp. paratuberculosis
ggcggcgggggcg

SEQ ID NO: 1004571 - RNA, 23 nt, Mycobacterium avium subsp. paratuberculosis
ggcggcgggggcgggccccacgc

SEQ ID NO: 1004572 - RNA, 16 nt, Mycobacterium avium subsp. paratuberculosis
ggcggcgucggcgucc

SEQ ID NO: 1004573 - RNA, 20 nt, Mycobacterium avium subsp. paratuberculosis
ggcggcguagucggcgcagc

SEQ ID NO: 1004574 - RNA, 23 nt, Mycobacterium avium subsp. paratuberculosis
ggcggccgccaucauccgcuggg

SEQ ID NO: 1004575 - RNA, 15 nt, Mycobacterium avium subsp. paratuberculosis
ggcggccgcgagccc

SEQ ID NO: 1004576 - RNA, 17 nt, Mycobacterium avium subsp. paratuberculosis
ggcggcgaacgcgcggu

SEQ ID NO: 1004577 - RNA, 23 nt, Mycobacterium avium subsp. paratuberculosis
ggcggcgaauaccagggcgagga

SEQ ID NO: 1004578 - RNA, 18 nt, Mycobacterium avium subsp. paratuberculosis
ggcggcgacacgccgacg

SEQ ID NO: 1004579 - RNA, 21 nt, Mycobacterium avium subsp. paratuberculosis
ggcggcgacaucgccgagacg

SEQ ID NO: 1004580 - RNA, 23 nt, Mycobacterium avium subsp. paratuberculosis
ggcggccgcuaguuggugcuggg

SEQ ID NO: 1004581 - RNA, 23 nt, Mycobacterium avium subsp. paratuberculosis
ggcggccgccgcgaucagggccc

SEQ ID NO: 1004582 - RNA, 13 nt, Mycobacterium avium subsp. paratuberculosis
ggcggccgccggg

SEQ ID NO: 1004583 - RNA, 15 nt, Mycobacterium avium subsp. paratuberculosis
ggcggcgccgucgcc

SEQ ID NO: 1004584 - RNA, 13 nt, Mycobacterium avium subsp. paratuberculosis
ggcggcgcgcagc

SEQ ID NO: 1004585 - RNA, 14 nt, Mycobacterium avium subsp. paratuberculosis
ggcggcgcgcaggc

SEQ ID NO: 1004586 - RNA, 14 nt, Mycobacterium avium subsp. paratuberculosis
ggcggcgcccgcgg

SEQ ID NO: 1004587 - RNA, 13 nt, Mycobacterium avium subsp. paratuberculosis
ggcggcgccgacg

SEQ ID NO: 1004588 - RNA, 15 nt, Mycobacterium avium subsp. paratuberculosis
ggcggcgccgcagca

SEQ ID NO: 1004589 - RNA, 21 nt, Mycobacterium avium subsp. paratuberculosis
ggcggcgccggaugccagcag

SEQ ID NO: 1004590 - RNA, 23 nt, Mycobacterium avium subsp. paratuberculosis
ggcggcgccggaugccagcaggu

SEQ ID NO: 1004591 - RNA, 16 nt, Mycobacterium avium subsp. paratuberculosis
ggcggcgccggggcuc

SEQ ID NO: 1004592 - RNA, 14 nt, Mycobacterium avium subsp. paratuberculosis
ggcggcgaucgccg

SEQ ID NO: 1004593 - RNA, 21 nt, Mycobacterium avium subsp. paratuberculosis
ggcggcgaugaucgggauguc

SEQ ID NO: 1004594 - RNA, 22 nt, Mycobacterium avium subsp. paratuberculosis
ggcggcgacggcaccgccggcg

SEQ ID NO: 1004595 - RNA, 17 nt, Mycobacterium avium subsp. paratuberculosis
ggcggcgacgugccggc

SEQ ID NO: 1004596 - RNA, 17 nt, Mycobacterium avium subsp. paratuberculosis
ggcuacagcaacauccu

SEQ ID NO: 1004597 - RNA, 16 nt, Mycobacterium avium subsp. paratuberculosis
ggcguuuuugugggug

SEQ ID NO: 1004598 - RNA, 17 nt, Mycobacterium avium subsp. paratuberculosis
ggcguuuuugugggugg

SEQ ID NO: 1004599 - RNA, 20 nt, Mycobacterium avium subsp. paratuberculosis
ggcguugcgccgcgagcgca

SEQ ID NO: 1004600 - RNA, 19 nt, Mycobacterium avium subsp. paratuberculosis
ggcguuggacagcucgacg

SEQ ID NO: 1004601 - RNA, 19 nt, Mycobacterium avium subsp. paratuberculosis
ggcguugagcacgcggacc

SEQ ID NO: 1004602 - RNA, 15 nt, Mycobacterium avium subsp. paratuberculosis
ggcguugagccggcg

SEQ ID NO: 1004603 - RNA, 19 nt, Mycobacterium avium subsp. paratuberculosis
ggcguugcccgccgcggcg

SEQ ID NO: 1004604 - RNA, 16 nt, Mycobacterium avium subsp. paratuberculosis
ggcguugccgccggcg

SEQ ID NO: 1004605 - RNA, 12 nt, Mycobacterium avium subsp. paratuberculosis
ggcuagcggcug

SEQ ID NO: 1004606 - RNA, 12 nt, Mycobacterium avium subsp. paratuberculosis
ggcuagcgggcg

SEQ ID NO: 1004607 - RNA, 15 nt, Mycobacterium avium subsp. paratuberculosis
ggcuagcgggcgcgc

SEQ ID NO: 1004608 - RNA, 16 nt, Mycobacterium avium subsp. paratuberculosis
ggcucaccagguccuc

SEQ ID NO: 1004609 - RNA, 14 nt, Mycobacterium avium subsp. paratuberculosis
ggcucagcaccaca

SEQ ID NO: 1004610 - RNA, 12 nt, Mycobacterium avium subsp. paratuberculosis
ggcucagcagca

SEQ ID NO: 1004611 - RNA, 14 nt, Mycobacterium avium subsp. paratuberculosis
ggcucagcagcacc

SEQ ID NO: 1004612 - RNA, 21 nt, Mycobacterium avium subsp. paratuberculosis
ggcucagcccggcgcucaccg

SEQ ID NO: 1004613 - RNA, 12 nt, Mycobacterium avium subsp. paratuberculosis
ggcucagcggca

SEQ ID NO: 1004614 - RNA, 22 nt, Mycobacterium avium subsp. paratuberculosis
ggcucagcgcgacgugccggcg

SEQ ID NO: 1004615 - RNA, 21 nt, Mycobacterium avium subsp. paratuberculosis
ggcgugaucuguucggcggcg

SEQ ID NO: 1004616 - RNA, 22 nt, Mycobacterium avium subsp. paratuberculosis
ggcgugaucuguucggcggcga

SEQ ID NO: 1004617 - RNA, 18 nt, Mycobacterium avium subsp. paratuberculosis
ggcgugaugacggcggcg

SEQ ID NO: 1004618 - RNA, 20 nt, Mycobacterium avium subsp. paratuberculosis
ggcgugaccggcugcucgcg

SEQ ID NO: 1004619 - RNA, 16 nt, Mycobacterium avium subsp. paratuberculosis
ggcgugacgcucgacg

SEQ ID NO: 1004620 - RNA, 19 nt, Mycobacterium avium subsp. paratuberculosis
ggcgugacgcucgccggcg

SEQ ID NO: 1004621 - RNA, 17 nt, Mycobacterium avium subsp. paratuberculosis
ggcgugacgcucggccg

SEQ ID NO: 1004622 - RNA, 16 nt, Mycobacterium avium subsp. paratuberculosis
ggcgugacgcucggcg

SEQ ID NO: 1004623 - RNA, 21 nt, Mycobacterium avium subsp. paratuberculosis
ggcgucucggcgucucggcgu

SEQ ID NO: 1004624 - RNA, 21 nt, Mycobacterium avium subsp. paratuberculosis
ggcgucgucgucgagccgcuc

SEQ ID NO: 1004625 - RNA, 18 nt, Mycobacterium avium subsp. paratuberculosis
ggcgucgucgagcaccgg

SEQ ID NO: 1004626 - RNA, 19 nt, Mycobacterium avium subsp. paratuberculosis
ggcgucggguagggcgccg

SEQ ID NO: 1004627 - RNA, 21 nt, Mycobacterium avium subsp. paratuberculosis
ggcgucguacagcagccccug

SEQ ID NO: 1004628 - RNA, 20 nt, Mycobacterium avium subsp. paratuberculosis
ggcgucguaguugcggccgg

SEQ ID NO: 1004629 - RNA, 19 nt, Mycobacterium avium subsp. paratuberculosis
ggcgucgaaauagcggcgc

SEQ ID NO: 1004630 - RNA, 19 nt, Mycobacterium avium subsp. paratuberculosis
ggcgucgaacgugcucgcg

SEQ ID NO: 1004631 - RNA, 13 nt, Mycobacterium avium subsp. paratuberculosis
ggcgucgaaggau

SEQ ID NO: 1004632 - RNA, 22 nt, Mycobacterium avium subsp. paratuberculosis
ggcgucgaugaugccggcggac

SEQ ID NO: 1004633 - RNA, 14 nt, Mycobacterium avium subsp. paratuberculosis
ggcgucgccgagcu

SEQ ID NO: 1004634 - RNA, 22 nt, Mycobacterium avium subsp. paratuberculosis
ggcgucgaugucgcccggcgcg

SEQ ID NO: 1004635 - RNA, 18 nt, Mycobacterium avium subsp. paratuberculosis
ggcgucgggccgggggcg

SEQ ID NO: 1004636 - RNA, 14 nt, Mycobacterium avium subsp. paratuberculosis
ggcgucgggcaccu

SEQ ID NO: 1004637 - RNA, 13 nt, Mycobacterium avium subsp. paratuberculosis
ggcgucgggcggg

SEQ ID NO: 1004638 - RNA, 20 nt, Mycobacterium avium subsp. paratuberculosis
ggcgucggccagcggcagcg

SEQ ID NO: 1004639 - RNA, 17 nt, Mycobacterium avium subsp. paratuberculosis
ggcgucggccgggggcg

SEQ ID NO: 1004640 - RNA, 16 nt, Mycobacterium avium subsp. paratuberculosis
ggcgucggcgcgugcc

SEQ ID NO: 1004641 - RNA, 13 nt, Mycobacterium avium subsp. paratuberculosis
ggcgucggcggcc

SEQ ID NO: 1004642 - RNA, 14 nt, Mycobacterium avium subsp. paratuberculosis
ggcgucggcggccu

SEQ ID NO: 1004643 - RNA, 15 nt, Mycobacterium avium subsp. paratuberculosis
ggcgucggcggccug

SEQ ID NO: 1004644 - RNA, 22 nt, Mycobacterium avium subsp. paratuberculosis
ggcgucggacaugccggcgccg

SEQ ID NO: 1004645 - RNA, 17 nt, Mycobacterium avium subsp. paratuberculosis
ggcgucggaggcggcgu

SEQ ID NO: 1004646 - RNA, 14 nt, Mycobacterium avium subsp. paratuberculosis
ggcgucggagucgc

SEQ ID NO: 1004647 - RNA, 13 nt, Mycobacterium avium subsp. paratuberculosis
ggcgucgcgcagc

SEQ ID NO: 1004648 - RNA, 14 nt, Mycobacterium avium subsp. paratuberculosis
ggcgucgcgcagca

SEQ ID NO: 1004649 - RNA, 19 nt, Mycobacterium avium subsp. paratuberculosis
ggcgucgcgcagcagcggg

SEQ ID NO: 1004650 - RNA, 23 nt, Mycobacterium avium subsp. paratuberculosis
ggcgucgcccgccgacggcugcc

SEQ ID NO: 1004651 - RNA, 16 nt, Mycobacterium avium subsp. paratuberculosis
ggcgucgcggucggcg

SEQ ID NO: 1004652 - RNA, 19 nt, Mycobacterium avium subsp. paratuberculosis
ggcgucgcggugaaguugc

SEQ ID NO: 1004653 - RNA, 16 nt, Mycobacterium avium subsp. paratuberculosis
ggcgugcgcguggggc

SEQ ID NO: 1004654 - RNA, 15 nt, Mycobacterium avium subsp. paratuberculosis
ggcgugcuccagcag

SEQ ID NO: 1004655 - RNA, 22 nt, Mycobacterium avium subsp. paratuberculosis
ggcgugccaccgcugggcggcg

SEQ ID NO: 1004656 - RNA, 13 nt, Mycobacterium avium subsp. paratuberculosis
ggcgugcagccga

SEQ ID NO: 1004657 - RNA, 21 nt, Mycobacterium avium subsp. paratuberculosis
ggcgugcagcacgcccucggc

SEQ ID NO: 1004658 - RNA, 17 nt, Mycobacterium avium subsp. paratuberculosis
ggcguggcccagccggu

SEQ ID NO: 1004659 - RNA, 18 nt, Mycobacterium avium subsp. paratuberculosis
ggcguggcgggccaggcg

SEQ ID NO: 1004660 - RNA, 19 nt, Mycobacterium avium subsp. paratuberculosis
ggcguggcgguggcggcga

SEQ ID NO: 1004661 - RNA, 16 nt, Mycobacterium avium subsp. paratuberculosis
ggcgugguagccgccg

SEQ ID NO: 1004662 - RNA, 15 nt, Mycobacterium avium subsp. paratuberculosis
ggcguggucggcgcg

SEQ ID NO: 1004663 - RNA, 19 nt, Mycobacterium avium subsp. paratuberculosis
ggcguguuccuugcggccg

SEQ ID NO: 1004664 - RNA, 22 nt, Mycobacterium avium subsp. paratuberculosis
ggcguguuccuugcggccgccg

SEQ ID NO: 1004665 - RNA, 14 nt, Mycobacterium avium subsp. paratuberculosis
ggcgugccgcccgg

SEQ ID NO: 1004666 - RNA, 14 nt, Mycobacterium avium subsp. paratuberculosis
ggcgugugggcucg

SEQ ID NO: 1004667 - RNA, 23 nt, Mycobacterium avium subsp. paratuberculosis
ggcguguaguacaggccguagcg

SEQ ID NO: 1004668 - RNA, 23 nt, Mycobacterium avium subsp. paratuberculosis
ggcguucaucaccuggucggguu

SEQ ID NO: 1004669 - RNA, 13 nt, Mycobacterium avium subsp. paratuberculosis
ggcguucaucguc

SEQ ID NO: 1004670 - RNA, 16 nt, Mycobacterium avium subsp. paratuberculosis
ggcgcagggcggccgg

SEQ ID NO: 1004671 - RNA, 21 nt, Mycobacterium avium subsp. paratuberculosis
ggcgcagggcggccggccagu

SEQ ID NO: 1004672 - RNA, 21 nt, Mycobacterium avium subsp. paratuberculosis
ggcgcagccggccaccgcccc

SEQ ID NO: 1004673 - RNA, 11 nt, Mycobacterium avium subsp. paratuberculosis
ggcgcagcccg

SEQ ID NO: 1004674 - RNA, 15 nt, Mycobacterium avium subsp. paratuberculosis
ggcgcagcccgagcg

SEQ ID NO: 1004675 - RNA, 18 nt, Mycobacterium avium subsp. paratuberculosis
ggcgcagcccgagcggca

SEQ ID NO: 1004676 - RNA, 14 nt, Mycobacterium avium subsp. paratuberculosis
ggcgcagccgaucg

SEQ ID NO: 1004677 - RNA, 20 nt, Mycobacterium avium subsp. paratuberculosis
ggcgcagaaaaaggccgccg

SEQ ID NO: 1004678 - RNA, 13 nt, Mycobacterium avium subsp. paratuberculosis
ggcgcagccagcg

SEQ ID NO: 1004679 - RNA, 16 nt, Mycobacterium avium subsp. paratuberculosis
ggcgcagccagcucgg

SEQ ID NO: 1004680 - RNA, 18 nt, Mycobacterium avium subsp. paratuberculosis
ggcgcagccagcucggcg

SEQ ID NO: 1004681 - RNA, 17 nt, Mycobacterium avium subsp. paratuberculosis
ggcgcagcacggccacu

SEQ ID NO: 1004682 - RNA, 17 nt, Mycobacterium avium subsp. paratuberculosis
ggcgcaucagcggggcg

SEQ ID NO: 1004683 - RNA, 17 nt, Mycobacterium avium subsp. paratuberculosis
ggcgcaucaccuucugc

SEQ ID NO: 1004684 - RNA, 19 nt, Mycobacterium avium subsp. paratuberculosis
ggcgcaucaccuucugcgu

SEQ ID NO: 1004685 - RNA, 13 nt, Mycobacterium avium subsp. paratuberculosis
ggcgcaguccagg

SEQ ID NO: 1004686 - RNA, 24 nt, Mycobacterium avium subsp. paratuberculosis
ggcgcaguucgaccggcaccagca

SEQ ID NO: 1004687 - RNA, 18 nt, Mycobacterium avium subsp. paratuberculosis
ggcgcagguccacccgcc

SEQ ID NO: 1004688 - RNA, 18 nt, Mycobacterium avium subsp. paratuberculosis
ggcgcagguccggcagcg

SEQ ID NO: 1004689 - RNA, 21 nt, Mycobacterium avium subsp. paratuberculosis
ggcgcagguccggcagcgcgc

SEQ ID NO: 1004690 - RNA, 12 nt, Mycobacterium avium subsp. paratuberculosis
ggcgcaggugau

SEQ ID NO: 1004691 - RNA, 20 nt, Mycobacterium avium subsp. paratuberculosis
ggcgccaugaacggcggggc

SEQ ID NO: 1004692 - RNA, 21 nt, Mycobacterium avium subsp. paratuberculosis
ggcgccaugaacggcggggcc

SEQ ID NO: 1004693 - RNA, 16 nt, Mycobacterium avium subsp. paratuberculosis
ggcgccauggcccacg

SEQ ID NO: 1004694 - RNA, 14 nt, Mycobacterium avium subsp. paratuberculosis
ggcgccacagccgg

SEQ ID NO: 1004695 - RNA, 14 nt, Mycobacterium avium subsp. paratuberculosis
ggcgcccgagccgc

SEQ ID NO: 1004696 - RNA, 13 nt, Mycobacterium avium subsp. paratuberculosis
ggcgcccgcggcc

SEQ ID NO: 1004697 - RNA, 15 nt, Mycobacterium avium subsp. paratuberculosis
ggcgcccgcggccuc

SEQ ID NO: 1004698 - RNA, 23 nt, Mycobacterium avium subsp. paratuberculosis
ggcgcccgcggccuccagccgcu

SEQ ID NO: 1004699 - RNA, 13 nt, Mycobacterium avium subsp. paratuberculosis
ggcgcccggcgcg

SEQ ID NO: 1004700 - RNA, 13 nt, Mycobacterium avium subsp. paratuberculosis
ggcgcccggcucc

SEQ ID NO: 1004701 - RNA, 13 nt, Mycobacterium avium subsp. paratuberculosis
ggcgcccggccgg

SEQ ID NO: 1004702 - RNA, 17 nt, Mycobacterium avium subsp. paratuberculosis
ggcgcccggccggcccc

SEQ ID NO: 1004703 - RNA, 13 nt, Mycobacterium avium subsp. paratuberculosis
ggcgcccggcagc

SEQ ID NO: 1004704 - RNA, 16 nt, Mycobacterium avium subsp. paratuberculosis
ggcgcccggcccagcc

SEQ ID NO: 1004705 - RNA, 19 nt, Mycobacterium avium subsp. paratuberculosis
ggcgcccggcccagccgcu

SEQ ID NO: 1004706 - RNA, 17 nt, Mycobacterium avium subsp. paratuberculosis
ggcgccccccugcucgc

SEQ ID NO: 1004707 - RNA, 18 nt, Mycobacterium avium subsp. paratuberculosis
ggcgccccccugcucgcu

SEQ ID NO: 1004708 - RNA, 18 nt, Mycobacterium avium subsp. paratuberculosis
ggcgccccagcuccucgg

SEQ ID NO: 1004709 - RNA, 18 nt, Mycobacterium avium subsp. paratuberculosis
ggcgcccagaagccccgg

SEQ ID NO: 1004710 - RNA, 23 nt, Mycobacterium avium subsp. paratuberculosis
ggcgcccagcccgagcaccagcg

SEQ ID NO: 1004711 - RNA, 15 nt, Mycobacterium avium subsp. paratuberculosis
ggcgcccagguccac

SEQ ID NO: 1004712 - RNA, 13 nt, Mycobacterium avium subsp. paratuberculosis
ggcgcccacagca

SEQ ID NO: 1004713 - RNA, 21 nt, Mycobacterium avium subsp. paratuberculosis
ggcgacaacagcgccgagacg

SEQ ID NO: 1004714 - RNA, 16 nt, Mycobacterium avium subsp. paratuberculosis
ggcgaggcggucggcg

SEQ ID NO: 1004715 - RNA, 13 nt, Mycobacterium avium subsp. paratuberculosis
ggcgagcuggccg

SEQ ID NO: 1004716 - RNA, 15 nt, Mycobacterium avium subsp. paratuberculosis
ggcgagcuuggcggg

SEQ ID NO: 1004717 - RNA, 19 nt, Mycobacterium avium subsp. paratuberculosis
ggcgaggaaguccggcgcg

SEQ ID NO: 1004718 - RNA, 21 nt, Mycobacterium avium subsp. paratuberculosis
ggcgaggaaguccggcgcgcc

SEQ ID NO: 1004719 - RNA, 19 nt, Mycobacterium avium subsp. paratuberculosis
ggcgauaaccucggcggcg

SEQ ID NO: 1004720 - RNA, 21 nt, Mycobacterium avium subsp. paratuberculosis
ggcgauaaccucggcggcggc

SEQ ID NO: 1004721 - RNA, 16 nt, Mycobacterium avium subsp. paratuberculosis
ggcgauccacgccucc

SEQ ID NO: 1004722 - RNA, 20 nt, Mycobacterium avium subsp. paratuberculosis
ggcgaucagguggggcagga

SEQ ID NO: 1004723 - RNA, 23 nt, Mycobacterium avium subsp. paratuberculosis
ggcgaucauccaggugaacagca

SEQ ID NO: 1004724 - RNA, 16 nt, Mycobacterium avium subsp. paratuberculosis
ggcgaucagcgcgcac

SEQ ID NO: 1004725 - RNA, 17 nt, Mycobacterium avium subsp. paratuberculosis
ggcgaguaaggccgagg

SEQ ID NO: 1004726 - RNA, 16 nt, Mycobacterium avium subsp. paratuberculosis
ggcgaguacccgccgc

SEQ ID NO: 1004727 - RNA, 19 nt, Mycobacterium avium subsp. paratuberculosis
ggcgaguccgcggaggcga

SEQ ID NO: 1004728 - RNA, 16 nt, Mycobacterium avium subsp. paratuberculosis
ggcgagugaggccgag

SEQ ID NO: 1004729 - RNA, 17 nt, Mycobacterium avium subsp. paratuberculosis
ggcgagugaggccgagg

SEQ ID NO: 1004730 - RNA, 23 nt, Mycobacterium avium subsp. paratuberculosis
ggcgagugcgaaacucaccgcgu

SEQ ID NO: 1004731 - RNA, 21 nt, Mycobacterium avium subsp. paratuberculosis
ggcgaguucugguaggcggcc

SEQ ID NO: 1004732 - RNA, 20 nt, Mycobacterium avium subsp. paratuberculosis
ggcgcacaucguggcgacga

SEQ ID NO: 1004733 - RNA, 14 nt, Mycobacterium avium subsp. paratuberculosis
ggcgcacagcuagg

SEQ ID NO: 1004734 - RNA, 22 nt, Mycobacterium avium subsp. paratuberculosis
ggcgcacagcuuucgggcggcc

SEQ ID NO: 1004735 - RNA, 21 nt, Mycobacterium avium subsp. paratuberculosis
ggcgcaaccucuucgggggug

SEQ ID NO: 1004736 - RNA, 22 nt, Mycobacterium avium subsp. paratuberculosis
ggcgcaaccucuucgggggugg

SEQ ID NO: 1004737 - RNA, 23 nt, Mycobacterium avium subsp. paratuberculosis
ggcgcaacggauuggucagagcc

SEQ ID NO: 1004738 - RNA, 16 nt, Mycobacterium avium subsp. paratuberculosis
ggcgcaacgggauggc

SEQ ID NO: 1004739 - RNA, 23 nt, Mycobacterium avium subsp. paratuberculosis
ggcgaugggcaauaccggcagca

SEQ ID NO: 1004740 - RNA, 19 nt, Mycobacterium avium subsp. paratuberculosis
ggcgaugguggcgcugccg

SEQ ID NO: 1004741 - RNA, 21 nt, Mycobacterium avium subsp. paratuberculosis
ggcgauggugggcagccggca

SEQ ID NO: 1004742 - RNA, 14 nt, Mycobacterium avium subsp. paratuberculosis
ggcgaugucgggca

SEQ ID NO: 1004743 - RNA, 18 nt, Mycobacterium avium subsp. paratuberculosis
ggcgauggugccgaagcg

SEQ ID NO: 1004744 - RNA, 19 nt, Mycobacterium avium subsp. paratuberculosis
ggcgauggugccgaagcgc

SEQ ID NO: 1004745 - RNA, 18 nt, Mycobacterium avium subsp. paratuberculosis
ggcgaucucggucaccga

SEQ ID NO: 1004746 - RNA, 21 nt, Mycobacterium avium subsp. paratuberculosis
ggcgaucucggucaccgagcg

SEQ ID NO: 1004747 - RNA, 23 nt, Mycobacterium avium subsp. paratuberculosis
ggcgaucucgaucgugggcaaca

SEQ ID NO: 1004748 - RNA, 21 nt, Mycobacterium avium subsp. paratuberculosis
ggcgaucucgauggccacgcu

SEQ ID NO: 1004749 - RNA, 22 nt, Mycobacterium avium subsp. paratuberculosis
ggcgaucucgauguagagcggg

SEQ ID NO: 1004750 - RNA, 13 nt, Mycobacterium avium subsp. paratuberculosis
ggcgaucucgccg

SEQ ID NO: 1004751 - RNA, 22 nt, Mycobacterium avium subsp. paratuberculosis
ggcgaucggcgugccggacucc

SEQ ID NO: 1004752 - RNA, 22 nt, Mycobacterium avium subsp. paratuberculosis
ggcgaucgggucaccggccgag

SEQ ID NO: 1004753 - RNA, 23 nt, Mycobacterium avium subsp. paratuberculosis
ggcgauccgcaggccgucgccgg

SEQ ID NO: 1004754 - RNA, 17 nt, Mycobacterium avium subsp. paratuberculosis
ggcgauccgggcacgca

SEQ ID NO: 1004755 - RNA, 19 nt, Mycobacterium avium subsp. paratuberculosis
ggcgauggcgucggccagc

SEQ ID NO: 1004756 - RNA, 18 nt, Mycobacterium avium subsp. paratuberculosis
ggcgauggccugcucgcg

SEQ ID NO: 1004757 - RNA, 22 nt, Mycobacterium avium subsp. paratuberculosis
ggcgauggccauggccaggaac

SEQ ID NO: 1004758 - RNA, 20 nt, Mycobacterium avium subsp. paratuberculosis
ggcgauggcccgcugcgccg

SEQ ID NO: 1004759 - RNA, 21 nt, Mycobacterium avium subsp. paratuberculosis
ggcgauggcccgcugcgccga

SEQ ID NO: 1004760 - RNA, 20 nt, Mycobacterium avium subsp. paratuberculosis
ggcgaugcgcuccagcaggc

SEQ ID NO: 1004761 - RNA, 15 nt, Mycobacterium avium subsp. paratuberculosis
ggcgcgcggccagcc

SEQ ID NO: 1004762 - RNA, 18 nt, Mycobacterium avium subsp. paratuberculosis
ggcgcgcgccgaucaggu

SEQ ID NO: 1004763 - RNA, 18 nt, Mycobacterium avium subsp. paratuberculosis
ggcgcgcgccgcccccgc

SEQ ID NO: 1004764 - RNA, 22 nt, Mycobacterium avium subsp. paratuberculosis
ggcgcgcgccgcccccgcggcg

SEQ ID NO: 1004765 - RNA, 23 nt, Mycobacterium avium subsp. paratuberculosis
ggcgcgcgauggacagcagccag

SEQ ID NO: 1004766 - RNA, 19 nt, Mycobacterium avium subsp. paratuberculosis
ggcgcgcaccagcucggcg

SEQ ID NO: 1004767 - RNA, 21 nt, Mycobacterium avium subsp. paratuberculosis
ggcgcgcgaaaaaacggcggc

SEQ ID NO: 1004768 - RNA, 22 nt, Mycobacterium avium subsp. paratuberculosis
ggcgcgcgaaaaaacggcggcg

SEQ ID NO: 1004769 - RNA, 14 nt, Mycobacterium avium subsp. paratuberculosis
ggcgcgggccagca

SEQ ID NO: 1004770 - RNA, 16 nt, Mycobacterium avium subsp. paratuberculosis
ggcgcgggccgcagcg

SEQ ID NO: 1004771 - RNA, 15 nt, Mycobacterium avium subsp. paratuberculosis
ggcgcgggcgcccuc

SEQ ID NO: 1004772 - RNA, 16 nt, Mycobacterium avium subsp. paratuberculosis
ggcgcgggcgcccucc

SEQ ID NO: 1004773 - RNA, 18 nt, Mycobacterium avium subsp. paratuberculosis
ggcgcgggucgcgguucg

SEQ ID NO: 1004774 - RNA, 14 nt, Mycobacterium avium subsp. paratuberculosis
ggcgcggggcgcga

SEQ ID NO: 1004775 - RNA, 17 nt, Mycobacterium avium subsp. paratuberculosis
ggcgcggggcgcgaggc

SEQ ID NO: 1004776 - RNA, 14 nt, Mycobacterium avium subsp. paratuberculosis
ggcgcuccagcggg

SEQ ID NO: 1004777 - RNA, 19 nt, Mycobacterium avium subsp. paratuberculosis
ggcgcuccagcgggcggcg

SEQ ID NO: 1004778 - RNA, 17 nt, Mycobacterium avium subsp. paratuberculosis
ggcgcucgucgucgccg

SEQ ID NO: 1004779 - RNA, 22 nt, Mycobacterium avium subsp. paratuberculosis
ggcgcugaacugcucgaccagc

SEQ ID NO: 1004780 - RNA, 18 nt, Mycobacterium avium subsp. paratuberculosis
ggcgcgugcgccgcggcg

SEQ ID NO: 1004781 - RNA, 12 nt, Mycobacterium avium subsp. paratuberculosis
ggcgcgguccac

SEQ ID NO: 1004782 - RNA, 20 nt, Mycobacterium avium subsp. paratuberculosis
ggcgcguuccaucagcgccc

SEQ ID NO: 1004783 - RNA, 20 nt, Mycobacterium avium subsp. paratuberculosis
ggcgcucaucaggcggccgg

SEQ ID NO: 1004784 - RNA, 15 nt, Mycobacterium avium subsp. paratuberculosis
ggcgcguuggccgag

SEQ ID NO: 1004785 - RNA, 15 nt, Mycobacterium avium subsp. paratuberculosis
ggcgcuaaagccacc

SEQ ID NO: 1004786 - RNA, 14 nt, Mycobacterium avium subsp. paratuberculosis
ggcgccgagcguca

SEQ ID NO: 1004787 - RNA, 15 nt, Mycobacterium avium subsp. paratuberculosis
ggcgccgaguccggg

SEQ ID NO: 1004788 - RNA, 21 nt, Mycobacterium avium subsp. paratuberculosis
ggcgccgaguccgggccgccg

SEQ ID NO: 1004789 - RNA, 22 nt, Mycobacterium avium subsp. paratuberculosis
ggcgccgaguccgggccgccgg

SEQ ID NO: 1004790 - RNA, 18 nt, Mycobacterium avium subsp. paratuberculosis
ggcgccgcagcggcgccg

SEQ ID NO: 1004791 - RNA, 13 nt, Mycobacterium avium subsp. paratuberculosis
ggcgccgcagcuc

SEQ ID NO: 1004792 - RNA, 17 nt, Mycobacterium avium subsp. paratuberculosis
ggcgccgaucugcucgg

SEQ ID NO: 1004793 - RNA, 17 nt, Mycobacterium avium subsp. paratuberculosis
ggcgccgacggccagca

SEQ ID NO: 1004794 - RNA, 21 nt, Mycobacterium avium subsp. paratuberculosis
ggcgccgacggccagcaggau

SEQ ID NO: 1004795 - RNA, 16 nt, Mycobacterium avium subsp. paratuberculosis
ggcgccgaccgagggc

SEQ ID NO: 1004796 - RNA, 20 nt, Mycobacterium avium subsp. paratuberculosis
ggcgccgaccucggccagcg

SEQ ID NO: 1004797 - RNA, 21 nt, Mycobacterium avium subsp. paratuberculosis
ggcgccgaccucggccagcgu

SEQ ID NO: 1004798 - RNA, 23 nt, Mycobacterium avium subsp. paratuberculosis
ggcgccgacgaucccggcgagca

SEQ ID NO: 1004799 - RNA, 19 nt, Mycobacterium avium subsp. paratuberculosis
ggcgccgacagucgcgggc

SEQ ID NO: 1004800 - RNA, 19 nt, Mycobacterium avium subsp. paratuberculosis
ggcgccgaagauggccagg

SEQ ID NO: 1004801 - RNA, 20 nt, Mycobacterium avium subsp. paratuberculosis
ggcgccgaagauggccagga

SEQ ID NO: 1004802 - RNA, 17 nt, Mycobacterium avium subsp. paratuberculosis
ggcgcccuuggccuccg

SEQ ID NO: 1004803 - RNA, 21 nt, Mycobacterium avium subsp. paratuberculosis
ggcgcccuucggcgcccgcuc

SEQ ID NO: 1004804 - RNA, 18 nt, Mycobacterium avium subsp. paratuberculosis
ggcgcccugcgagcccgg

SEQ ID NO: 1004805 - RNA, 21 nt, Mycobacterium avium subsp. paratuberculosis
ggcgcccgucacgcuggcgug

SEQ ID NO: 1004806 - RNA, 24 nt, Mycobacterium avium subsp. paratuberculosis
ggcgcccucgaugcgcaccgugcc

SEQ ID NO: 1004807 - RNA, 19 nt, Mycobacterium avium subsp. paratuberculosis
ggcgcccucgccggcggcg

SEQ ID NO: 1004808 - RNA, 17 nt, Mycobacterium avium subsp. paratuberculosis
ggcgccggcgcgcgagc

SEQ ID NO: 1004809 - RNA, 17 nt, Mycobacterium avium subsp. paratuberculosis
ggcgccggccggcgguc

SEQ ID NO: 1004810 - RNA, 19 nt, Mycobacterium avium subsp. paratuberculosis
ggcgccggccgucacgcug

SEQ ID NO: 1004811 - RNA, 20 nt, Mycobacterium avium subsp. paratuberculosis
ggcgccggccgucacgcugg

SEQ ID NO: 1004812 - RNA, 14 nt, Mycobacterium avium subsp. paratuberculosis
ggcgccggccggcg

SEQ ID NO: 1004813 - RNA, 15 nt, Mycobacterium avium subsp. paratuberculosis
ggcgccggcccgcgg

SEQ ID NO: 1004814 - RNA, 17 nt, Mycobacterium avium subsp. paratuberculosis
ggcgccggcccgcggcg

SEQ ID NO: 1004815 - RNA, 19 nt, Mycobacterium avium subsp. paratuberculosis
ggcgccggcccgcggcgga

SEQ ID NO: 1004816 - RNA, 15 nt, Mycobacterium avium subsp. paratuberculosis
ggcgccggccgccgg

SEQ ID NO: 1004817 - RNA, 14 nt, Mycobacterium avium subsp. paratuberculosis
ggcgccggccagcg

SEQ ID NO: 1004818 - RNA, 18 nt, Mycobacterium avium subsp. paratuberculosis
ggcgccggccagcggcuu

SEQ ID NO: 1004819 - RNA, 13 nt, Mycobacterium avium subsp. paratuberculosis
ggcgccgcccggc

SEQ ID NO: 1004820 - RNA, 14 nt, Mycobacterium avium subsp. paratuberculosis
ggcgccgcccgggc

SEQ ID NO: 1004821 - RNA, 15 nt, Mycobacterium avium subsp. paratuberculosis
ggcgccgcccgggcc

SEQ ID NO: 1004822 - RNA, 17 nt, Mycobacterium avium subsp. paratuberculosis
ggcgccgcccgggcccg

SEQ ID NO: 1004823 - RNA, 14 nt, Mycobacterium avium subsp. paratuberculosis
ggcgccgccgagcc

SEQ ID NO: 1004824 - RNA, 16 nt, Mycobacterium avium subsp. paratuberculosis
ggcgccgccgagccgc

SEQ ID NO: 1004825 - RNA, 18 nt, Mycobacterium avium subsp. paratuberculosis
ggcgccgccgagccgcgg

SEQ ID NO: 1004826 - RNA, 23 nt, Mycobacterium avium subsp. paratuberculosis
ggcgccgccgagccgcgggugac

SEQ ID NO: 1004827 - RNA, 16 nt, Mycobacterium avium subsp. paratuberculosis
ggcgccgccgcgcagg

SEQ ID NO: 1004828 - RNA, 17 nt, Mycobacterium avium subsp. paratuberculosis
ggcgccggaggccagcu

SEQ ID NO: 1004829 - RNA, 18 nt, Mycobacterium avium subsp. paratuberculosis
ggcgccggaggggcgacg

SEQ ID NO: 1004830 - RNA, 12 nt, Mycobacterium avium subsp. paratuberculosis
ggcgcgaggcgc

SEQ ID NO: 1004831 - RNA, 13 nt, Mycobacterium avium subsp. paratuberculosis
ggcgcgaggcgcg

SEQ ID NO: 1004832 - RNA, 18 nt, Mycobacterium avium subsp. paratuberculosis
ggcgcgaggcgcggggcg

SEQ ID NO: 1004833 - RNA, 22 nt, Mycobacterium avium subsp. paratuberculosis
ggcgccugguagggguccucca

SEQ ID NO: 1004834 - RNA, 20 nt, Mycobacterium avium subsp. paratuberculosis
ggcgccucgaugcggguguu

SEQ ID NO: 1004835 - RNA, 19 nt, Mycobacterium avium subsp. paratuberculosis
ggcgccugauccgcgguca

SEQ ID NO: 1004836 - RNA, 22 nt, Mycobacterium avium subsp. paratuberculosis
ggcgccgucggugggggccagg

SEQ ID NO: 1004837 - RNA, 16 nt, Mycobacterium avium subsp. paratuberculosis
ggcgccggcggccacg

SEQ ID NO: 1004838 - RNA, 15 nt, Mycobacterium avium subsp. paratuberculosis
ggcgccgucggcggg

SEQ ID NO: 1004839 - RNA, 19 nt, Mycobacterium avium subsp. paratuberculosis
ggcgccgugccgcgcggcg

SEQ ID NO: 1004840 - RNA, 21 nt, Mycobacterium avium subsp. paratuberculosis
ggcgccgugccgcgcggcgau

SEQ ID NO: 1004841 - RNA, 19 nt, Mycobacterium avium subsp. paratuberculosis
ggcgcgaugaucgccggcg

SEQ ID NO: 1004842 - RNA, 21 nt, Mycobacterium avium subsp. paratuberculosis
ggcgcgaugaucgccggcgcc

SEQ ID NO: 1004843 - RNA, 20 nt, Mycobacterium avium subsp. paratuberculosis
ggcgcgcagcaggcgccggu

SEQ ID NO: 1004844 - RNA, 19 nt, Mycobacterium avium subsp. paratuberculosis
ggcgcgccugcgcggcggc

SEQ ID NO: 1004845 - RNA, 20 nt, Mycobacterium avium subsp. paratuberculosis
ggcgcgccugcgcggcggcg

SEQ ID NO: 1004846 - RNA, 23 nt, Mycobacterium avium subsp. paratuberculosis
ggcgcgccugcgcggcggcgucc

SEQ ID NO: 1004847 - RNA, 12 nt, Mycobacterium avium subsp. paratuberculosis
ggcgcgcagcuc

SEQ ID NO: 1004848 - RNA, 19 nt, Mycobacterium avium subsp. paratuberculosis
ggcgcgcacguuggcggcc

SEQ ID NO: 1004849 - RNA, 22 nt, Mycobacterium avium subsp. paratuberculosis
ggcgcgcacguuggcggccagc

SEQ ID NO: 1004850 - RNA, 12 nt, Mycobacterium avium subsp. paratuberculosis
ggcgcgcagcac

SEQ ID NO: 1004851 - RNA, 23 nt, Mycobacterium avium subsp. paratuberculosis
ggcgcgcagccacgagcccagcc

SEQ ID NO: 1004852 - RNA, 16 nt, Mycobacterium avium subsp. paratuberculosis
ggccuggcccagccgc

SEQ ID NO: 1004853 - RNA, 17 nt, Mycobacterium avium subsp. paratuberculosis
ggccuggaugccgcccu

SEQ ID NO: 1004854 - RNA, 14 nt, Mycobacterium avium subsp. paratuberculosis
ggccugcagcgcgg

SEQ ID NO: 1004855 - RNA, 13 nt, Mycobacterium avium subsp. paratuberculosis
ggccugcagcacc

SEQ ID NO: 1004856 - RNA, 16 nt, Mycobacterium avium subsp. paratuberculosis
ggccugcagcaccagg

SEQ ID NO: 1004857 - RNA, 24 nt, Mycobacterium avium subsp. paratuberculosis
ggccugcccgccgcggccgcuggc

SEQ ID NO: 1004858 - RNA, 18 nt, Mycobacterium avium subsp. paratuberculosis
ggccugcccgcggguggc

SEQ ID NO: 1004859 - RNA, 16 nt, Mycobacterium avium subsp. paratuberculosis
ggccugcccggcggug

SEQ ID NO: 1004860 - RNA, 20 nt, Mycobacterium avium subsp. paratuberculosis
ggccugcacggugcgccggc

SEQ ID NO: 1004861 - RNA, 16 nt, Mycobacterium avium subsp. paratuberculosis
ggccugcacgucggcg

SEQ ID NO: 1004862 - RNA, 21 nt, Mycobacterium avium subsp. paratuberculosis
ggccugagccgccggggcgcc

SEQ ID NO: 1004863 - RNA, 13 nt, Mycobacterium avium subsp. paratuberculosis
ggccugcgcggcc

SEQ ID NO: 1004864 - RNA, 14 nt, Mycobacterium avium subsp. paratuberculosis
ggccugcgcugcgg

SEQ ID NO: 1004865 - RNA, 13 nt, Mycobacterium avium subsp. paratuberculosis
ggccugcgcgccg

SEQ ID NO: 1004866 - RNA, 17 nt, Mycobacterium avium subsp. paratuberculosis
ggccugcgggcgccggc

SEQ ID NO: 1004867 - RNA, 13 nt, Mycobacterium avium subsp. paratuberculosis
ggccugcggcggc

SEQ ID NO: 1004868 - RNA, 15 nt, Mycobacterium avium subsp. paratuberculosis
ggccugcgccuuggc

SEQ ID NO: 1004869 - RNA, 22 nt, Mycobacterium avium subsp. paratuberculosis
ggccugccggaugccgcgcggc

SEQ ID NO: 1004870 - RNA, 20 nt, Mycobacterium avium subsp. paratuberculosis
ggccugcuuuucggccgagu

SEQ ID NO: 1004871 - RNA, 17 nt, Mycobacterium avium subsp. paratuberculosis
ggccugguggcccaggc

SEQ ID NO: 1004872 - RNA, 17 nt, Mycobacterium avium subsp. paratuberculosis
ggccuggucgaacagca

SEQ ID NO: 1004873 - RNA, 22 nt, Mycobacterium avium subsp. paratuberculosis
ggccuggucgaacagcacgccg

SEQ ID NO: 1004874 - RNA, 15 nt, Mycobacterium avium subsp. paratuberculosis
ggccugguagcugag

SEQ ID NO: 1004875 - RNA, 20 nt, Mycobacterium avium subsp. paratuberculosis
ggccugguagcugagcagca

SEQ ID NO: 1004876 - RNA, 23 nt, Mycobacterium avium subsp. paratuberculosis
ggccugguagcugagcagcaggu

SEQ ID NO: 1004877 - RNA, 19 nt, Mycobacterium avium subsp. paratuberculosis
ggccuuacgcugcgcgacc

SEQ ID NO: 1004878 - RNA, 14 nt, Mycobacterium avium subsp. paratuberculosis
ggcgaacggccagu

SEQ ID NO: 1004879 - RNA, 14 nt, Mycobacterium avium subsp. paratuberculosis
ggccuuggccacca

SEQ ID NO: 1004880 - RNA, 22 nt, Mycobacterium avium subsp. paratuberculosis
ggcgaacuccagaucgccgccc

SEQ ID NO: 1004881 - RNA, 22 nt, Mycobacterium avium subsp. paratuberculosis
ggccuucuuggccggagccuug

SEQ ID NO: 1004882 - RNA, 18 nt, Mycobacterium avium subsp. paratuberculosis
ggccuucuuggcggcggc

SEQ ID NO: 1004883 - RNA, 19 nt, Mycobacterium avium subsp. paratuberculosis
ggccuucuuggcggcggcc

SEQ ID NO: 1004884 - RNA, 19 nt, Mycobacterium avium subsp. paratuberculosis
ggccuugaacucggccagg

SEQ ID NO: 1004885 - RNA, 15 nt, Mycobacterium avium subsp. paratuberculosis
ggccuugccgaucag

SEQ ID NO: 1004886 - RNA, 14 nt, Mycobacterium avium subsp. paratuberculosis
ggccuugaccagga

SEQ ID NO: 1004887 - RNA, 17 nt, Mycobacterium avium subsp. paratuberculosis
ggccuucacgcuggccu

SEQ ID NO: 1004888 - RNA, 19 nt, Mycobacterium avium subsp. paratuberculosis
ggccuucaucaccgccccg

SEQ ID NO: 1004889 - RNA, 18 nt, Mycobacterium avium subsp. paratuberculosis
ggccuucucgcgcaccgc

SEQ ID NO: 1004890 - RNA, 13 nt, Mycobacterium avium subsp. paratuberculosis
ggcgaaggcgcgc

SEQ ID NO: 1004891 - RNA, 16 nt, Mycobacterium avium subsp. paratuberculosis
ggcgaagccggccccg

SEQ ID NO: 1004892 - RNA, 23 nt, Mycobacterium avium subsp. paratuberculosis
ggcgaacugcuugaucagguccu

SEQ ID NO: 1004893 - RNA, 14 nt, Mycobacterium avium subsp. paratuberculosis
ggcgaauauuucgc

SEQ ID NO: 1004894 - RNA, 17 nt, Mycobacterium avium subsp. paratuberculosis
ggcgaaguucggcaucc

SEQ ID NO: 1004895 - RNA, 19 nt, Mycobacterium avium subsp. paratuberculosis
ggcgaaguagucggcgucc

SEQ ID NO: 1004896 - RNA, 15 nt, Mycobacterium avium subsp. paratuberculosis
ggcgaagucaucacc

SEQ ID NO: 1004897 - RNA, 21 nt, Mycobacterium avium subsp. paratuberculosis
ggcgaagucgccggccaggau

SEQ ID NO: 1004898 - RNA, 18 nt, Mycobacterium avium subsp. paratuberculosis
ggcgaaggugggcagcgc

SEQ ID NO: 1004899 - RNA, 18 nt, Mycobacterium avium subsp. paratuberculosis
ggccgugaucggccagcc

SEQ ID NO: 1004900 - RNA, 15 nt, Mycobacterium avium subsp. paratuberculosis
ggccgugaucggccu

SEQ ID NO: 1004901 - RNA, 18 nt, Mycobacterium avium subsp. paratuberculosis
ggccgugcagggggcgca

SEQ ID NO: 1004902 - RNA, 16 nt, Mycobacterium avium subsp. paratuberculosis
ggccgugaugcgccgg

SEQ ID NO: 1004903 - RNA, 16 nt, Mycobacterium avium subsp. paratuberculosis
ggccgucucgagccgg

SEQ ID NO: 1004904 - RNA, 19 nt, Mycobacterium avium subsp. paratuberculosis
ggccgucucgucggccgcg

SEQ ID NO: 1004905 - RNA, 14 nt, Mycobacterium avium subsp. paratuberculosis
ggccgucgguggcc

SEQ ID NO: 1004906 - RNA, 21 nt, Mycobacterium avium subsp. paratuberculosis
ggccgucgaggcgcugcagca

SEQ ID NO: 1004907 - RNA, 17 nt, Mycobacterium avium subsp. paratuberculosis
ggccgucgggucggcga

SEQ ID NO: 1004908 - RNA, 22 nt, Mycobacterium avium subsp. paratuberculosis
ggccgucgggucggcgagcagc

SEQ ID NO: 1004909 - RNA, 23 nt, Mycobacterium avium subsp. paratuberculosis
ggccgucgggucggcgagcagcc

SEQ ID NO: 1004910 - RNA, 17 nt, Mycobacterium avium subsp. paratuberculosis
ggccgucggcgccgccg

SEQ ID NO: 1004911 - RNA, 16 nt, Mycobacterium avium subsp. paratuberculosis
ggccgucggcgcggcc

SEQ ID NO: 1004912 - RNA, 18 nt, Mycobacterium avium subsp. paratuberculosis
ggccgucggcgcggccgg

SEQ ID NO: 1004913 - RNA, 14 nt, Mycobacterium avium subsp. paratuberculosis
ggccguccgccggc

SEQ ID NO: 1004914 - RNA, 22 nt, Mycobacterium avium subsp. paratuberculosis
ggccguccgggauaguucgccg

SEQ ID NO: 1004915 - RNA, 15 nt, Mycobacterium avium subsp. paratuberculosis
ggccguccgggugcg

SEQ ID NO: 1004916 - RNA, 18 nt, Mycobacterium avium subsp. paratuberculosis
ggccguauacgccagaug

SEQ ID NO: 1004917 - RNA, 14 nt, Mycobacterium avium subsp. paratuberculosis
ggccguaucggccc

SEQ ID NO: 1004918 - RNA, 15 nt, Mycobacterium avium subsp. paratuberculosis
ggccguaucggcccc

SEQ ID NO: 1004919 - RNA, 18 nt, Mycobacterium avium subsp. paratuberculosis
ggccgucacaggccgccu

SEQ ID NO: 1004920 - RNA, 13 nt, Mycobacterium avium subsp. paratuberculosis
ggccguccacggc

SEQ ID NO: 1004921 - RNA, 13 nt, Mycobacterium avium subsp. paratuberculosis
ggccguccagcag

SEQ ID NO: 1004922 - RNA, 15 nt, Mycobacterium avium subsp. paratuberculosis
ggccguccagcagca

SEQ ID NO: 1004923 - RNA, 13 nt, Mycobacterium avium subsp. paratuberculosis
ggccguccauccc

SEQ ID NO: 1004924 - RNA, 15 nt, Mycobacterium avium subsp. paratuberculosis
ggccggugggcggcg

SEQ ID NO: 1004925 - RNA, 20 nt, Mycobacterium avium subsp. paratuberculosis
ggccggugcgcgucagccgu

SEQ ID NO: 1004926 - RNA, 19 nt, Mycobacterium avium subsp. paratuberculosis
ggccggugcguccgccggc

SEQ ID NO: 1004927 - RNA, 20 nt, Mycobacterium avium subsp. paratuberculosis
ggccggugcguccgccggcg

SEQ ID NO: 1004928 - RNA, 21 nt, Mycobacterium avium subsp. paratuberculosis
ggccggugcguccgccggcgg

SEQ ID NO: 1004929 - RNA, 20 nt, Mycobacterium avium subsp. paratuberculosis
ggccguagcggacgacggcc

SEQ ID NO: 1004930 - RNA, 20 nt, Mycobacterium avium subsp. paratuberculosis
ggccguagcguugccggccg

SEQ ID NO: 1004931 - RNA, 15 nt, Mycobacterium avium subsp. paratuberculosis
ggccgguuggcggcc

SEQ ID NO: 1004932 - RNA, 19 nt, Mycobacterium avium subsp. paratuberculosis
ggccgguuggcggccgggu

SEQ ID NO: 1004933 - RNA, 20 nt, Mycobacterium avium subsp. paratuberculosis
ggccgggguguagcggaugg

SEQ ID NO: 1004934 - RNA, 15 nt, Mycobacterium avium subsp. paratuberculosis
ggccggggcggcggu

SEQ ID NO: 1004935 - RNA, 14 nt, Mycobacterium avium subsp. paratuberculosis
ggccggggccagca

SEQ ID NO: 1004936 - RNA, 17 nt, Mycobacterium avium subsp. paratuberculosis
ggccggggccagcaccc

SEQ ID NO: 1004937 - RNA, 17 nt, Mycobacterium avium subsp. paratuberculosis
ggccgggggcggcggcg

SEQ ID NO: 1004938 - RNA, 22 nt, Mycobacterium avium subsp. paratuberculosis
ggccgggucgaacggcaaccug

SEQ ID NO: 1004939 - RNA, 19 nt, Mycobacterium avium subsp. paratuberculosis
ggccgggucgagcgcgccg

SEQ ID NO: 1004940 - RNA, 17 nt, Mycobacterium avium subsp. paratuberculosis
ggccgggucgcaggcag

SEQ ID NO: 1004941 - RNA, 13 nt, Mycobacterium avium subsp. paratuberculosis
ggccgggucgccg

SEQ ID NO: 1004942 - RNA, 17 nt, Mycobacterium avium subsp. paratuberculosis
ggccggguuguccuggc

SEQ ID NO: 1004943 - RNA, 20 nt, Mycobacterium avium subsp. paratuberculosis
ggccggugacuccuccucgg

SEQ ID NO: 1004944 - RNA, 13 nt, Mycobacterium avium subsp. paratuberculosis
ggccggucgccga

SEQ ID NO: 1004945 - RNA, 15 nt, Mycobacterium avium subsp. paratuberculosis
ggccgguccgcccag

SEQ ID NO: 1004946 - RNA, 14 nt, Mycobacterium avium subsp. paratuberculosis
ggccgguccgugca

SEQ ID NO: 1004947 - RNA, 18 nt, Mycobacterium avium subsp. paratuberculosis
ggccgguccgugcacggc

SEQ ID NO: 1004948 - RNA, 14 nt, Mycobacterium avium subsp. paratuberculosis
ggccggucgaaggc

SEQ ID NO: 1004949 - RNA, 15 nt, Mycobacterium avium subsp. paratuberculosis
ggccguugggccagc

SEQ ID NO: 1004950 - RNA, 18 nt, Mycobacterium avium subsp. paratuberculosis
ggccguugggccagcggc

SEQ ID NO: 1004951 - RNA, 19 nt, Mycobacterium avium subsp. paratuberculosis
ggccguugcucucggccuc

SEQ ID NO: 1004952 - RNA, 21 nt, Mycobacterium avium subsp. paratuberculosis
ggccguugcgggugucgccgg

SEQ ID NO: 1004953 - RNA, 17 nt, Mycobacterium avium subsp. paratuberculosis
ggccguguacagcaggg

SEQ ID NO: 1004954 - RNA, 22 nt, Mycobacterium avium subsp. paratuberculosis
ggccgugugcgcaucggcgacg

SEQ ID NO: 1004955 - RNA, 20 nt, Mycobacterium avium subsp. paratuberculosis
ggccguggccgucacgcugg

SEQ ID NO: 1004956 - RNA, 22 nt, Mycobacterium avium subsp. paratuberculosis
ggccgugccgccauacccacaa

SEQ ID NO: 1004957 - RNA, 12 nt, Mycobacterium avium subsp. paratuberculosis
ggccgugccggc

SEQ ID NO: 1004958 - RNA, 20 nt, Mycobacterium avium subsp. paratuberculosis
ggccucaccgcgggccaggc

SEQ ID NO: 1004959 - RNA, 21 nt, Mycobacterium avium subsp. paratuberculosis
ggccucaccgcgggccaggcc

SEQ ID NO: 1004960 - RNA, 19 nt, Mycobacterium avium subsp. paratuberculosis
ggccuccagcuuugccagc

SEQ ID NO: 1004961 - RNA, 22 nt, Mycobacterium avium subsp. paratuberculosis
ggccuccagcuuugccagcaga

SEQ ID NO: 1004962 - RNA, 14 nt, Mycobacterium avium subsp. paratuberculosis
ggccuagugccggg

SEQ ID NO: 1004963 - RNA, 12 nt, Mycobacterium avium subsp. paratuberculosis
ggccucgccggc

SEQ ID NO: 1004964 - RNA, 18 nt, Mycobacterium avium subsp. paratuberculosis
ggccucgccgucgaaggc

SEQ ID NO: 1004965 - RNA, 23 nt, Mycobacterium avium subsp. paratuberculosis
ggccucgccgucgaaggccgggc

SEQ ID NO: 1004966 - RNA, 23 nt, Mycobacterium avium subsp. paratuberculosis
ggccucggcgaccgcccggggcg

SEQ ID NO: 1004967 - RNA, 17 nt, Mycobacterium avium subsp. paratuberculosis
ggccucgaugucgucga

SEQ ID NO: 1004968 - RNA, 21 nt, Mycobacterium avium subsp. paratuberculosis
ggccuccuguuggcccugcuc

SEQ ID NO: 1004969 - RNA, 17 nt, Mycobacterium avium subsp. paratuberculosis
ggccucgaggaucgcgg

SEQ ID NO: 1004970 - RNA, 20 nt, Mycobacterium avium subsp. paratuberculosis
ggccucgagugccugcgccc

SEQ ID NO: 1004971 - RNA, 19 nt, Mycobacterium avium subsp. paratuberculosis
ggccucccgguaggcggcg

SEQ ID NO: 1004972 - RNA, 20 nt, Mycobacterium avium subsp. paratuberculosis
ggccuccgagcggcgcaggc

SEQ ID NO: 1004973 - RNA, 19 nt, Mycobacterium avium subsp. paratuberculosis
ggccuccgccaccuccucc

SEQ ID NO: 1004974 - RNA, 14 nt, Mycobacterium avium subsp. paratuberculosis
ggccuccggcggca

SEQ ID NO: 1004975 - RNA, 13 nt, Mycobacterium avium subsp. paratuberculosis
ggccuccuccucg

SEQ ID NO: 1004976 - RNA, 23 nt, Mycobacterium avium subsp. paratuberculosis
ggccucgucggcgagcagcagcg

SEQ ID NO: 1004977 - RNA, 23 nt, Mycobacterium avium subsp. paratuberculosis
ggccucgucggcgccgucgcggg

SEQ ID NO: 1004978 - RNA, 22 nt, Mycobacterium avium subsp. paratuberculosis
ggccucgucgucgucgagcacg

SEQ ID NO: 1004979 - RNA, 23 nt, Mycobacterium avium subsp. paratuberculosis
ggccucgucgagguacugcagca

SEQ ID NO: 1004980 - RNA, 15 nt, Mycobacterium avium subsp. paratuberculosis
ggccucgguggcggu

SEQ ID NO: 1004981 - RNA, 12 nt, Mycobacterium avium subsp. paratuberculosis
ggccucguccag

SEQ ID NO: 1004982 - RNA, 15 nt, Mycobacterium avium subsp. paratuberculosis
ggccucggcgcgggc

SEQ ID NO: 1004983 - RNA, 15 nt, Mycobacterium avium subsp. paratuberculosis
ggccugacugaguca

SEQ ID NO: 1004984 - RNA, 20 nt, Mycobacterium avium subsp. paratuberculosis
ggccugagacgacgccacca

SEQ ID NO: 1004985 - RNA, 20 nt, Mycobacterium avium subsp. paratuberculosis
ggccgccaggaugucguccu

SEQ ID NO: 1004986 - RNA, 23 nt, Mycobacterium avium subsp. paratuberculosis
ggccgccaggaugucguccucgg

SEQ ID NO: 1004987 - RNA, 14 nt, Mycobacterium avium subsp. paratuberculosis
ggccgccagggcca

SEQ ID NO: 1004988 - RNA, 17 nt, Mycobacterium avium subsp. paratuberculosis
ggccgccagggccaggu

SEQ ID NO: 1004989 - RNA, 13 nt, Mycobacterium avium subsp. paratuberculosis
ggccgccagcagu

SEQ ID NO: 1004990 - RNA, 13 nt, Mycobacterium avium subsp. paratuberculosis
ggccgccagccgc

SEQ ID NO: 1004991 - RNA, 15 nt, Mycobacterium avium subsp. paratuberculosis
ggccgccagccgcgu

SEQ ID NO: 1004992 - RNA, 13 nt, Mycobacterium avium subsp. paratuberculosis
ggccgccagcacc

SEQ ID NO: 1004993 - RNA, 16 nt, Mycobacterium avium subsp. paratuberculosis
ggccgccagcaccucc

SEQ ID NO: 1004994 - RNA, 17 nt, Mycobacterium avium subsp. paratuberculosis
ggccgccagcagcacgg

SEQ ID NO: 1004995 - RNA, 14 nt, Mycobacterium avium subsp. paratuberculosis
ggccgccacgcugg

SEQ ID NO: 1004996 - RNA, 15 nt, Mycobacterium avium subsp. paratuberculosis
ggccgccacggcgcc

SEQ ID NO: 1004997 - RNA, 14 nt, Mycobacterium avium subsp. paratuberculosis
ggccgcaggcggcc

SEQ ID NO: 1004998 - RNA, 19 nt, Mycobacterium avium subsp. paratuberculosis
ggccgcaggguggccagca

SEQ ID NO: 1004999 - RNA, 21 nt, Mycobacterium avium subsp. paratuberculosis
ggccgccaucgaucgggcguc

SEQ ID NO: 1005000 - RNA, 18 nt, Mycobacterium avium subsp. paratuberculosis
ggccgcccgcaccagcag

SEQ ID NO: 1005001 - RNA, 21 nt, Mycobacterium avium subsp. paratuberculosis
ggccgcccgucggggcccggc

SEQ ID NO: 1005002 - RNA, 14 nt, Mycobacterium avium subsp. paratuberculosis
ggccgcccgcgcgu

SEQ ID NO: 1005003 - RNA, 22 nt, Mycobacterium avium subsp. paratuberculosis
ggccgcccgcgcguggucccac

SEQ ID NO: 1005004 - RNA, 14 nt, Mycobacterium avium subsp. paratuberculosis
ggccgccccggccg

SEQ ID NO: 1005005 - RNA, 16 nt, Mycobacterium avium subsp. paratuberculosis
ggccgccccggccgcg

SEQ ID NO: 1005006 - RNA, 17 nt, Mycobacterium avium subsp. paratuberculosis
ggccgccucccgcagcg

SEQ ID NO: 1005007 - RNA, 22 nt, Mycobacterium avium subsp. paratuberculosis
ggccgccucccgcagcgccagc

SEQ ID NO: 1005008 - RNA, 17 nt, Mycobacterium avium subsp. paratuberculosis
ggccgccugcccgggcg

SEQ ID NO: 1005009 - RNA, 22 nt, Mycobacterium avium subsp. paratuberculosis
ggccgccuccgguuugcgccgg

SEQ ID NO: 1005010 - RNA, 12 nt, Mycobacterium avium subsp. paratuberculosis
ggccgccgggac

SEQ ID NO: 1005011 - RNA, 18 nt, Mycobacterium avium subsp. paratuberculosis
ggccgccgggacgggcau

SEQ ID NO: 1005012 - RNA, 13 nt, Mycobacterium avium subsp. paratuberculosis
ggccgccgggccg

SEQ ID NO: 1005013 - RNA, 13 nt, Mycobacterium avium subsp. paratuberculosis
ggccgccggggcc

SEQ ID NO: 1005014 - RNA, 17 nt, Mycobacterium avium subsp. paratuberculosis
ggccgccggggccccaa

SEQ ID NO: 1005015 - RNA, 20 nt, Mycobacterium avium subsp. paratuberculosis
ggccgccggccgcucgcggg

SEQ ID NO: 1005016 - RNA, 15 nt, Mycobacterium avium subsp. paratuberculosis
ggccgccggccagcu

SEQ ID NO: 1005017 - RNA, 13 nt, Mycobacterium avium subsp. paratuberculosis
ggccgccgcggcc

SEQ ID NO: 1005018 - RNA, 20 nt, Mycobacterium avium subsp. paratuberculosis
ggccgccgcauaccgcccgc

SEQ ID NO: 1005019 - RNA, 14 nt, Mycobacterium avium subsp. paratuberculosis
ggccgccgcgcggg

SEQ ID NO: 1005020 - RNA, 15 nt, Mycobacterium avium subsp. paratuberculosis
ggccgccgcgacggc

SEQ ID NO: 1005021 - RNA, 20 nt, Mycobacterium avium subsp. paratuberculosis
ggccgccgcgaucagggccc

SEQ ID NO: 1005022 - RNA, 19 nt, Mycobacterium avium subsp. paratuberculosis
ggccgccgaugcgcccgcu

SEQ ID NO: 1005023 - RNA, 22 nt, Mycobacterium avium subsp. paratuberculosis
ggccgccgauucaaccccgcgc

SEQ ID NO: 1005024 - RNA, 21 nt, Mycobacterium avium subsp. paratuberculosis
ggccgccgauuccggccggcc

SEQ ID NO: 1005025 - RNA, 18 nt, Mycobacterium avium subsp. paratuberculosis
ggccgauggucagcugcc

SEQ ID NO: 1005026 - RNA, 19 nt, Mycobacterium avium subsp. paratuberculosis
ggccgauggugguaccgac

SEQ ID NO: 1005027 - RNA, 15 nt, Mycobacterium avium subsp. paratuberculosis
ggccgauucggcgcc

SEQ ID NO: 1005028 - RNA, 16 nt, Mycobacterium avium subsp. paratuberculosis
ggccgcaacggcgguc

SEQ ID NO: 1005029 - RNA, 17 nt, Mycobacterium avium subsp. paratuberculosis
ggccgcaacggcggucg

SEQ ID NO: 1005030 - RNA, 16 nt, Mycobacterium avium subsp. paratuberculosis
ggccgcacaccaccac

SEQ ID NO: 1005031 - RNA, 14 nt, Mycobacterium avium subsp. paratuberculosis
ggccgcacaccugc

SEQ ID NO: 1005032 - RNA, 20 nt, Mycobacterium avium subsp. paratuberculosis
ggccgcacggugcagcagcg

SEQ ID NO: 1005033 - RNA, 20 nt, Mycobacterium avium subsp. paratuberculosis
ggccgcacgucccgcccggc

SEQ ID NO: 1005034 - RNA, 18 nt, Mycobacterium avium subsp. paratuberculosis
ggccgcagcgacuccugg

SEQ ID NO: 1005035 - RNA, 22 nt, Mycobacterium avium subsp. paratuberculosis
ggccgcagcgggauuggcgcca

SEQ ID NO: 1005036 - RNA, 16 nt, Mycobacterium avium subsp. paratuberculosis
ggccgcagcgcccggc

SEQ ID NO: 1005037 - RNA, 22 nt, Mycobacterium avium subsp. paratuberculosis
ggccgcagcgcccggcagcggu

SEQ ID NO: 1005038 - RNA, 22 nt, Mycobacterium avium subsp. paratuberculosis
ggccgcagcgcgacgaacagca

SEQ ID NO: 1005039 - RNA, 13 nt, Mycobacterium avium subsp. paratuberculosis
ggccgcagcgcgc

SEQ ID NO: 1005040 - RNA, 14 nt, Mycobacterium avium subsp. paratuberculosis
ggccgcagcggcag

SEQ ID NO: 1005041 - RNA, 22 nt, Mycobacterium avium subsp. paratuberculosis
ggcccaaccgcauucggccgcc

SEQ ID NO: 1005042 - RNA, 19 nt, Mycobacterium avium subsp. paratuberculosis
ggcccaacacgcccugcag

SEQ ID NO: 1005043 - RNA, 20 nt, Mycobacterium avium subsp. paratuberculosis
ggcccaacacgcccugcagg

SEQ ID NO: 1005044 - RNA, 17 nt, Mycobacterium avium subsp. paratuberculosis
ggcccaagacccgcguc

SEQ ID NO: 1005045 - RNA, 21 nt, Mycobacterium avium subsp. paratuberculosis
ggcccaauaccguuccgcccc

SEQ ID NO: 1005046 - RNA, 23 nt, Mycobacterium avium subsp. paratuberculosis
ggcccaauaccguuccgccccug

SEQ ID NO: 1005047 - RNA, 14 nt, Mycobacterium avium subsp. paratuberculosis
ggccgagccgagcc

SEQ ID NO: 1005048 - RNA, 16 nt, Mycobacterium avium subsp. paratuberculosis
ggccgagccgaggccg

SEQ ID NO: 1005049 - RNA, 21 nt, Mycobacterium avium subsp. paratuberculosis
ggccgagccgaugcccagcag

SEQ ID NO: 1005050 - RNA, 14 nt, Mycobacterium avium subsp. paratuberculosis
ggccgagccgccgg

SEQ ID NO: 1005051 - RNA, 17 nt, Mycobacterium avium subsp. paratuberculosis
ggccgagccgggcggcc

SEQ ID NO: 1005052 - RNA, 21 nt, Mycobacterium avium subsp. paratuberculosis
ggccgagcgcgccgagcagcu

SEQ ID NO: 1005053 - RNA, 22 nt, Mycobacterium avium subsp. paratuberculosis
ggccgagcgcgccgagcagcug

SEQ ID NO: 1005054 - RNA, 24 nt, Mycobacterium avium subsp. paratuberculosis
ggccgagcgcgccgagcagcuggg

SEQ ID NO: 1005055 - RNA, 15 nt, Mycobacterium avium subsp. paratuberculosis
ggccgagcgcgcugg

SEQ ID NO: 1005056 - RNA, 14 nt, Mycobacterium avium subsp. paratuberculosis
ggccgagcggcugc

SEQ ID NO: 1005057 - RNA, 22 nt, Mycobacterium avium subsp. paratuberculosis
ggccgaucagcggcgggcccag

SEQ ID NO: 1005058 - RNA, 18 nt, Mycobacterium avium subsp. paratuberculosis
ggccgagcguucggcgcg

SEQ ID NO: 1005059 - RNA, 21 nt, Mycobacterium avium subsp. paratuberculosis
ggccgaucauggucggcgacg

SEQ ID NO: 1005060 - RNA, 20 nt, Mycobacterium avium subsp. paratuberculosis
ggccgaugaacaugcccugc

SEQ ID NO: 1005061 - RNA, 15 nt, Mycobacterium avium subsp. paratuberculosis
ggccgaucagcggcg

SEQ ID NO: 1005062 - RNA, 14 nt, Mycobacterium avium subsp. paratuberculosis
ggccgaggccucca

SEQ ID NO: 1005063 - RNA, 17 nt, Mycobacterium avium subsp. paratuberculosis
ggccgaggcgagugagg

SEQ ID NO: 1005064 - RNA, 13 nt, Mycobacterium avium subsp. paratuberculosis
ggccgaggggucc

SEQ ID NO: 1005065 - RNA, 14 nt, Mycobacterium avium subsp. paratuberculosis
ggccgcggacccga

SEQ ID NO: 1005066 - RNA, 17 nt, Mycobacterium avium subsp. paratuberculosis
ggccgcgcuggccagcg

SEQ ID NO: 1005067 - RNA, 18 nt, Mycobacterium avium subsp. paratuberculosis
ggccgcgcuggccagcgu

SEQ ID NO: 1005068 - RNA, 23 nt, Mycobacterium avium subsp. paratuberculosis
ggccgcggccaagugcggucggu

SEQ ID NO: 1005069 - RNA, 13 nt, Mycobacterium avium subsp. paratuberculosis
ggccgcggccagc

SEQ ID NO: 1005070 - RNA, 14 nt, Mycobacterium avium subsp. paratuberculosis
ggccgcggccagcu

SEQ ID NO: 1005071 - RNA, 22 nt, Mycobacterium avium subsp. paratuberculosis
ggccgcggccagcuccgggucg

SEQ ID NO: 1005072 - RNA, 15 nt, Mycobacterium avium subsp. paratuberculosis
ggccgcggccagcug

SEQ ID NO: 1005073 - RNA, 16 nt, Mycobacterium avium subsp. paratuberculosis
ggccgcggccagcugc

SEQ ID NO: 1005074 - RNA, 21 nt, Mycobacterium avium subsp. paratuberculosis
ggccgcgcugaacgcgguggg

SEQ ID NO: 1005075 - RNA, 19 nt, Mycobacterium avium subsp. paratuberculosis
ggccgcgcgcaggcgcuga

SEQ ID NO: 1005076 - RNA, 17 nt, Mycobacterium avium subsp. paratuberculosis
ggccgcgaaggcggcgu

SEQ ID NO: 1005077 - RNA, 19 nt, Mycobacterium avium subsp. paratuberculosis
ggccgcgccgccgcccugg

SEQ ID NO: 1005078 - RNA, 18 nt, Mycobacterium avium subsp. paratuberculosis
ggccgcgccggccuuggc

SEQ ID NO: 1005079 - RNA, 19 nt, Mycobacterium avium subsp. paratuberculosis
ggccgcgccguagcggccc

SEQ ID NO: 1005080 - RNA, 17 nt, Mycobacterium avium subsp. paratuberculosis
ggccgcgccgugcgcca

SEQ ID NO: 1005081 - RNA, 14 nt, Mycobacterium avium subsp. paratuberculosis
ggccgcgccggaug

SEQ ID NO: 1005082 - RNA, 14 nt, Mycobacterium avium subsp. paratuberculosis
ggccgcgccacagc

SEQ ID NO: 1005083 - RNA, 14 nt, Mycobacterium avium subsp. paratuberculosis
ggccgcgcaccgcc

SEQ ID NO: 1005084 - RNA, 22 nt, Mycobacterium avium subsp. paratuberculosis
ggccgcgcaccgccccgcccuu

SEQ ID NO: 1005085 - RNA, 14 nt, Mycobacterium avium subsp. paratuberculosis
ggccgcgauccagc

SEQ ID NO: 1005086 - RNA, 16 nt, Mycobacterium avium subsp. paratuberculosis
ggccgcgauccagcgc

SEQ ID NO: 1005087 - RNA, 20 nt, Mycobacterium avium subsp. paratuberculosis
ggccgcgauccagcgcuggc

SEQ ID NO: 1005088 - RNA, 21 nt, Mycobacterium avium subsp. paratuberculosis
ggccgcgaaaauaccgccggc

SEQ ID NO: 1005089 - RNA, 14 nt, Mycobacterium avium subsp. paratuberculosis
ggccgcgagcccgc

SEQ ID NO: 1005090 - RNA, 15 nt, Mycobacterium avium subsp. paratuberculosis
ggccgcgagcccgca

SEQ ID NO: 1005091 - RNA, 15 nt, Mycobacterium avium subsp. paratuberculosis
ggccgcgagcccggc

SEQ ID NO: 1005092 - RNA, 13 nt, Mycobacterium avium subsp. paratuberculosis
ggccgcgaacggc

SEQ ID NO: 1005093 - RNA, 17 nt, Mycobacterium avium subsp. paratuberculosis
ggccgcgaacgggugac

SEQ ID NO: 1005094 - RNA, 20 nt, Mycobacterium avium subsp. paratuberculosis
ggccgcgaagaugucgccgu

SEQ ID NO: 1005095 - RNA, 16 nt, Mycobacterium avium subsp. paratuberculosis
ggccgccuugaucuug

SEQ ID NO: 1005096 - RNA, 12 nt, Mycobacterium avium subsp. paratuberculosis
ggccgccuuggu

SEQ ID NO: 1005097 - RNA, 20 nt, Mycobacterium avium subsp. paratuberculosis
ggccgccuuggugauccggg

SEQ ID NO: 1005098 - RNA, 14 nt, Mycobacterium avium subsp. paratuberculosis
ggccgcggcccggc

SEQ ID NO: 1005099 - RNA, 20 nt, Mycobacterium avium subsp. paratuberculosis
ggccgcggcccggccaccag

SEQ ID NO: 1005100 - RNA, 17 nt, Mycobacterium avium subsp. paratuberculosis
ggccgcggcggcccggc

SEQ ID NO: 1005101 - RNA, 17 nt, Mycobacterium avium subsp. paratuberculosis
ggccgcggcgggcgcgu

SEQ ID NO: 1005102 - RNA, 13 nt, Mycobacterium avium subsp. paratuberculosis
ggccgcggccgcc

SEQ ID NO: 1005103 - RNA, 12 nt, Mycobacterium avium subsp. paratuberculosis
ggccgcggccuu

SEQ ID NO: 1005104 - RNA, 15 nt, Mycobacterium avium subsp. paratuberculosis
ggccgcggcgcggcc

SEQ ID NO: 1005105 - RNA, 19 nt, Mycobacterium avium subsp. paratuberculosis
ggccgcggcgcggcccggc

SEQ ID NO: 1005106 - RNA, 15 nt, Mycobacterium avium subsp. paratuberculosis
ggccgcucggguguc

SEQ ID NO: 1005107 - RNA, 20 nt, Mycobacterium avium subsp. paratuberculosis
ggccgcucgggugucgccga

SEQ ID NO: 1005108 - RNA, 23 nt, Mycobacterium avium subsp. paratuberculosis
ggccgcucgggugucgccgagcc

SEQ ID NO: 1005109 - RNA, 23 nt, Mycobacterium avium subsp. paratuberculosis
ggccgcucagcgggcggccagcc

SEQ ID NO: 1005110 - RNA, 23 nt, Mycobacterium avium subsp. paratuberculosis
ggccgcgucgccgaccagcagga

SEQ ID NO: 1005111 - RNA, 23 nt, Mycobacterium avium subsp. paratuberculosis
ggccgcguugucgaccaccaggu

SEQ ID NO: 1005112 - RNA, 14 nt, Mycobacterium avium subsp. paratuberculosis
ggccgcuacccggc

SEQ ID NO: 1005113 - RNA, 14 nt, Mycobacterium avium subsp. paratuberculosis
ggccgcgucgggca

SEQ ID NO: 1005114 - RNA, 20 nt, Mycobacterium avium subsp. paratuberculosis
ggccgcguuccaggaccuga

SEQ ID NO: 1005115 - RNA, 16 nt, Mycobacterium avium subsp. paratuberculosis
ggccgcgucgaccagc

SEQ ID NO: 1005116 - RNA, 22 nt, Mycobacterium avium subsp. paratuberculosis
ggccgcgggcccaccgccacca

SEQ ID NO: 1005117 - RNA, 21 nt, Mycobacterium avium subsp. paratuberculosis
ggccgcguagcucgccgcggc

SEQ ID NO: 1005118 - RNA, 14 nt, Mycobacterium avium subsp. paratuberculosis
ggccgcggucucga

SEQ ID NO: 1005119 - RNA, 14 nt, Mycobacterium avium subsp. paratuberculosis
ggccgcgggcgggc

SEQ ID NO: 1005120 - RNA, 20 nt, Mycobacterium avium subsp. paratuberculosis
ggccgcggucgccccggccg

SEQ ID NO: 1005121 - RNA, 18 nt, Mycobacterium avium subsp. paratuberculosis
ggccgcggguauccguga

SEQ ID NO: 1005122 - RNA, 21 nt, Mycobacterium avium subsp. paratuberculosis
ggccgcgggcgauucccggau

SEQ ID NO: 1005123 - RNA, 21 nt, Mycobacterium avium subsp. paratuberculosis
ggccgcuuuccaccccggcgg

SEQ ID NO: 1005124 - RNA, 21 nt, Mycobacterium avium subsp. paratuberculosis
ggccggaaggucauagggcuc

SEQ ID NO: 1005125 - RNA, 14 nt, Mycobacterium avium subsp. paratuberculosis
ggccggaaucgcgg

SEQ ID NO: 1005126 - RNA, 15 nt, Mycobacterium avium subsp. paratuberculosis
ggccggacagcggcc

SEQ ID NO: 1005127 - RNA, 16 nt, Mycobacterium avium subsp. paratuberculosis
ggccggaacagcuggu

SEQ ID NO: 1005128 - RNA, 20 nt, Mycobacterium avium subsp. paratuberculosis
ggccggaacagcugguccca

SEQ ID NO: 1005129 - RNA, 23 nt, Mycobacterium avium subsp. paratuberculosis
ggccggagccgaccucggcgacg

SEQ ID NO: 1005130 - RNA, 19 nt, Mycobacterium avium subsp. paratuberculosis
ggccggagaccgccguggc

SEQ ID NO: 1005131 - RNA, 16 nt, Mycobacterium avium subsp. paratuberculosis
ggccgcuggccgcccc

SEQ ID NO: 1005132 - RNA, 20 nt, Mycobacterium avium subsp. paratuberculosis
ggccgcucgcgggccacagc

SEQ ID NO: 1005133 - RNA, 16 nt, Mycobacterium avium subsp. paratuberculosis
ggccgcugaggauggu

SEQ ID NO: 1005134 - RNA, 13 nt, Mycobacterium avium subsp. paratuberculosis
ggccgcugcgccc

SEQ ID NO: 1005135 - RNA, 16 nt, Mycobacterium avium subsp. paratuberculosis
ggccgcugcgcccagc

SEQ ID NO: 1005136 - RNA, 18 nt, Mycobacterium avium subsp. paratuberculosis
ggccgcugcgcccagcgc

SEQ ID NO: 1005137 - RNA, 19 nt, Mycobacterium avium subsp. paratuberculosis
ggccgcugcgcccagcgcg

SEQ ID NO: 1005138 - RNA, 15 nt, Mycobacterium avium subsp. paratuberculosis
ggccggagcggaugg

SEQ ID NO: 1005139 - RNA, 22 nt, Mycobacterium avium subsp. paratuberculosis
ggccggagccuuggucgcggcc

SEQ ID NO: 1005140 - RNA, 21 nt, Mycobacterium avium subsp. paratuberculosis
ggccggaggugcgggucucga

SEQ ID NO: 1005141 - RNA, 21 nt, Mycobacterium avium subsp. paratuberculosis
ggccggaucgaacuugaucac

SEQ ID NO: 1005142 - RNA, 18 nt, Mycobacterium avium subsp. paratuberculosis
ggccggauggccagcagg

SEQ ID NO: 1005143 - RNA, 19 nt, Mycobacterium avium subsp. paratuberculosis
ggccggauucucgcccggc

SEQ ID NO: 1005144 - RNA, 13 nt, Mycobacterium avium subsp. paratuberculosis
ggccggcagcggu

SEQ ID NO: 1005145 - RNA, 18 nt, Mycobacterium avium subsp. paratuberculosis
ggccggcagccggccacc

SEQ ID NO: 1005146 - RNA, 15 nt, Mycobacterium avium subsp. paratuberculosis
ggccggcagccggcg

SEQ ID NO: 1005147 - RNA, 17 nt, Mycobacterium avium subsp. paratuberculosis
ggccggcagccggcgcg

SEQ ID NO: 1005148 - RNA, 23 nt, Mycobacterium avium subsp. paratuberculosis
ggccggcacucgccucggaggcc

SEQ ID NO: 1005149 - RNA, 15 nt, Mycobacterium avium subsp. paratuberculosis
ggccggccccggccg

SEQ ID NO: 1005150 - RNA, 22 nt, Mycobacterium avium subsp. paratuberculosis
ggccggccccuaccgccgagcg

SEQ ID NO: 1005151 - RNA, 12 nt, Mycobacterium avium subsp. paratuberculosis
ggccggcccggc

SEQ ID NO: 1005152 - RNA, 12 nt, Mycobacterium avium subsp. paratuberculosis
ggccggcccugc

SEQ ID NO: 1005153 - RNA, 13 nt, Mycobacterium avium subsp. paratuberculosis
ggccggccagcgc

SEQ ID NO: 1005154 - RNA, 14 nt, Mycobacterium avium subsp. paratuberculosis
ggccggccagcggg

SEQ ID NO: 1005155 - RNA, 15 nt, Mycobacterium avium subsp. paratuberculosis
ggccggccagcgggu

SEQ ID NO: 1005156 - RNA, 22 nt, Mycobacterium avium subsp. paratuberculosis
ggccggccaccagcggccggaa

SEQ ID NO: 1005157 - RNA, 21 nt, Mycobacterium avium subsp. paratuberculosis
ggccggccacgcucggcggcg

SEQ ID NO: 1005158 - RNA, 13 nt, Mycobacterium avium subsp. paratuberculosis
ggccggccagcac

SEQ ID NO: 1005159 - RNA, 14 nt, Mycobacterium avium subsp. paratuberculosis
ggccggccagcagc

SEQ ID NO: 1005160 - RNA, 13 nt, Mycobacterium avium subsp. paratuberculosis
ggccggcaguucc

SEQ ID NO: 1005161 - RNA, 17 nt, Mycobacterium avium subsp. paratuberculosis
ggccggcaguugcggcc

SEQ ID NO: 1005162 - RNA, 18 nt, Mycobacterium avium subsp. paratuberculosis
ggccgggauagagcaccg

SEQ ID NO: 1005163 - RNA, 17 nt, Mycobacterium avium subsp. paratuberculosis
ggccgggauuucccggg

SEQ ID NO: 1005164 - RNA, 16 nt, Mycobacterium avium subsp. paratuberculosis
ggccggcugcagccgg

SEQ ID NO: 1005165 - RNA, 19 nt, Mycobacterium avium subsp. paratuberculosis
ggccggcugcagccgggcg

SEQ ID NO: 1005166 - RNA, 13 nt, Mycobacterium avium subsp. paratuberculosis
ggccggcggggcg

SEQ ID NO: 1005167 - RNA, 13 nt, Mycobacterium avium subsp. paratuberculosis
ggccggcgggggc

SEQ ID NO: 1005168 - RNA, 13 nt, Mycobacterium avium subsp. paratuberculosis
ggccggcgguguc

SEQ ID NO: 1005169 - RNA, 20 nt, Mycobacterium avium subsp. paratuberculosis
ggccgggcucgagggcggcg

SEQ ID NO: 1005170 - RNA, 17 nt, Mycobacterium avium subsp. paratuberculosis
ggccgggcugcgcagca

SEQ ID NO: 1005171 - RNA, 13 nt, Mycobacterium avium subsp. paratuberculosis
ggccgggcgcugg

SEQ ID NO: 1005172 - RNA, 15 nt, Mycobacterium avium subsp. paratuberculosis
ggccgggcggacggc

SEQ ID NO: 1005173 - RNA, 19 nt, Mycobacterium avium subsp. paratuberculosis
ggccgggcggccggagccg

SEQ ID NO: 1005174 - RNA, 19 nt, Mycobacterium avium subsp. paratuberculosis
ggccgggcagugcgcggcg

SEQ ID NO: 1005175 - RNA, 14 nt, Mycobacterium avium subsp. paratuberculosis
ggccggcggcggcc

SEQ ID NO: 1005176 - RNA, 15 nt, Mycobacterium avium subsp. paratuberculosis
ggccggcgggcagca

SEQ ID NO: 1005177 - RNA, 15 nt, Mycobacterium avium subsp. paratuberculosis
ggccggcgcggcggc

SEQ ID NO: 1005178 - RNA, 16 nt, Mycobacterium avium subsp. paratuberculosis
ggccggcgcggcggcg

SEQ ID NO: 1005179 - RNA, 19 nt, Mycobacterium avium subsp. paratuberculosis
ggccggcgccggugccgca

SEQ ID NO: 1005180 - RNA, 13 nt, Mycobacterium avium subsp. paratuberculosis
ggccggcgcuggc

SEQ ID NO: 1005181 - RNA, 20 nt, Mycobacterium avium subsp. paratuberculosis
ggccggcgcgugcgcgacga

SEQ ID NO: 1005182 - RNA, 15 nt, Mycobacterium avium subsp. paratuberculosis
ggccggcgccgccgg

SEQ ID NO: 1005183 - RNA, 18 nt, Mycobacterium avium subsp. paratuberculosis
ggccggcgccgcgggugc

SEQ ID NO: 1005184 - RNA, 12 nt, Mycobacterium avium subsp. paratuberculosis
ggccggcgccgg

SEQ ID NO: 1005185 - RNA, 21 nt, Mycobacterium avium subsp. paratuberculosis
ggccggcgcccgucacgcugg

SEQ ID NO: 1005186 - RNA, 14 nt, Mycobacterium avium subsp. paratuberculosis
ggccggcgccgacg

SEQ ID NO: 1005187 - RNA, 15 nt, Mycobacterium avium subsp. paratuberculosis
ggccggccgcagcug

SEQ ID NO: 1005188 - RNA, 14 nt, Mycobacterium avium subsp. paratuberculosis
ggccggcgccgccg

SEQ ID NO: 1005189 - RNA, 20 nt, Mycobacterium avium subsp. paratuberculosis
ggccggcgcagccggccacc

SEQ ID NO: 1005190 - RNA, 19 nt, Mycobacterium avium subsp. paratuberculosis
ggccggcgauggcgcggcc

SEQ ID NO: 1005191 - RNA, 23 nt, Mycobacterium avium subsp. paratuberculosis
ggccggcgacgauaucggccgcg

SEQ ID NO: 1005192 - RNA, 20 nt, Mycobacterium avium subsp. paratuberculosis
ggccggcgaaacacagcagc

SEQ ID NO: 1005193 - RNA, 12 nt, Mycobacterium avium subsp. paratuberculosis
ggccggccgggu

SEQ ID NO: 1005194 - RNA, 15 nt, Mycobacterium avium subsp. paratuberculosis
ggccggccgccggcg

SEQ ID NO: 1005195 - RNA, 14 nt, Mycobacterium avium subsp. paratuberculosis
ggccggccgccggc

SEQ ID NO: 1005196 - RNA, 15 nt, Mycobacterium avium subsp. paratuberculosis
ggccggcccagcgcg

SEQ ID NO: 1005197 - RNA, 12 nt, Mycobacterium avium subsp. paratuberculosis
ggccggccgccg

SEQ ID NO: 1005198 - RNA, 17 nt, Mycobacterium avium subsp. paratuberculosis
ggcaaccugggcggcgg

SEQ ID NO: 1005199 - RNA, 18 nt, Mycobacterium avium subsp. paratuberculosis
ggcaaccugggcggcggc

SEQ ID NO: 1005200 - RNA, 17 nt, Mycobacterium avium subsp. paratuberculosis
ggcaacgugccacaggc

SEQ ID NO: 1005201 - RNA, 13 nt, Mycobacterium avium subsp. paratuberculosis
ggcaacggcggcg

SEQ ID NO: 1005202 - RNA, 22 nt, Mycobacterium avium subsp. paratuberculosis
ggaucgcaggauggccugcacg

SEQ ID NO: 1005203 - RNA, 18 nt, Mycobacterium avium subsp. paratuberculosis
ggaucgaauccggcggcg

SEQ ID NO: 1005204 - RNA, 21 nt, Mycobacterium avium subsp. paratuberculosis
ggaucgaccaacuccaccgcc

SEQ ID NO: 1005205 - RNA, 18 nt, Mycobacterium avium subsp. paratuberculosis
ggaucgccggacagcggg

SEQ ID NO: 1005206 - RNA, 14 nt, Mycobacterium avium subsp. paratuberculosis
ggaucgcggcgguc

SEQ ID NO: 1005207 - RNA, 20 nt, Mycobacterium avium subsp. paratuberculosis
ggaucgcgugcgucacgcug

SEQ ID NO: 1005208 - RNA, 18 nt, Mycobacterium avium subsp. paratuberculosis
ggaucgcgcugaccaggc

SEQ ID NO: 1005209 - RNA, 16 nt, Mycobacterium avium subsp. paratuberculosis
ggaucgcggccacgcc

SEQ ID NO: 1005210 - RNA, 17 nt, Mycobacterium avium subsp. paratuberculosis
ggauugaccagcacguu

SEQ ID NO: 1005211 - RNA, 21 nt, Mycobacterium avium subsp. paratuberculosis
ggauugccgggcaccagcgac

SEQ ID NO: 1005212 - RNA, 14 nt, Mycobacterium avium subsp. paratuberculosis
ggcaauccggcccc

SEQ ID NO: 1005213 - RNA, 18 nt, Mycobacterium avium subsp. paratuberculosis
ggcaaucgcugcgcccgc

SEQ ID NO: 1005214 - RNA, 16 nt, Mycobacterium avium subsp. paratuberculosis
ggcaaucggacccagc

SEQ ID NO: 1005215 - RNA, 14 nt, Mycobacterium avium subsp. paratuberculosis
ggcaaucgggacgc

SEQ ID NO: 1005216 - RNA, 24 nt, Mycobacterium avium subsp. paratuberculosis
ggcaaucugcccugcacuucggga

SEQ ID NO: 1005217 - RNA, 16 nt, Mycobacterium avium subsp. paratuberculosis
ggcaauaccggcagca

SEQ ID NO: 1005218 - RNA, 17 nt, Mycobacterium avium subsp. paratuberculosis
ggcaauaccggcagcag

SEQ ID NO: 1005219 - RNA, 18 nt, Mycobacterium avium subsp. paratuberculosis
ggcaauaccggcagcagg

SEQ ID NO: 1005220 - RNA, 19 nt, Mycobacterium avium subsp. paratuberculosis
ggcaauaccggcagcaggu

SEQ ID NO: 1005221 - RNA, 23 nt, Mycobacterium avium subsp. paratuberculosis
ggcaccaacccgaucggcccggc

SEQ ID NO: 1005222 - RNA, 17 nt, Mycobacterium avium subsp. paratuberculosis
ggcaccagcccgccguc

SEQ ID NO: 1005223 - RNA, 16 nt, Mycobacterium avium subsp. paratuberculosis
ggcaccacguccacca

SEQ ID NO: 1005224 - RNA, 17 nt, Mycobacterium avium subsp. paratuberculosis
ggcaccacguccaccag

SEQ ID NO: 1005225 - RNA, 18 nt, Mycobacterium avium subsp. paratuberculosis
ggcaccacgcugugcucg

SEQ ID NO: 1005226 - RNA, 22 nt, Mycobacterium avium subsp. paratuberculosis
ggcacaccagcguucgucgccg

SEQ ID NO: 1005227 - RNA, 22 nt, Mycobacterium avium subsp. paratuberculosis
ggcacaccagguaggcgguggc

SEQ ID NO: 1005228 - RNA, 15 nt, Mycobacterium avium subsp. paratuberculosis
ggcacagccagcgcc

SEQ ID NO: 1005229 - RNA, 23 nt, Mycobacterium avium subsp. paratuberculosis
ggcacagccagcgcccggcgacc

SEQ ID NO: 1005230 - RNA, 15 nt, Mycobacterium avium subsp. paratuberculosis
ggcagcgcggccagc

SEQ ID NO: 1005231 - RNA, 17 nt, Mycobacterium avium subsp. paratuberculosis
ggcagcgcuccugcagc

SEQ ID NO: 1005232 - RNA, 15 nt, Mycobacterium avium subsp. paratuberculosis
ggcagcgcgaccagc

SEQ ID NO: 1005233 - RNA, 16 nt, Mycobacterium avium subsp. paratuberculosis
ggcagccaaccgccgg

SEQ ID NO: 1005234 - RNA, 21 nt, Mycobacterium avium subsp. paratuberculosis
ggcagcaucgggacgccugcc

SEQ ID NO: 1005235 - RNA, 17 nt, Mycobacterium avium subsp. paratuberculosis
ggcagcagccaugacua

SEQ ID NO: 1005236 - RNA, 18 nt, Mycobacterium avium subsp. paratuberculosis
ggcacuucguccaucguc

SEQ ID NO: 1005237 - RNA, 18 nt, Mycobacterium avium subsp. paratuberculosis
ggcacuuaacaccucgcc

SEQ ID NO: 1005238 - RNA, 19 nt, Mycobacterium avium subsp. paratuberculosis
ggcacuuaacaccucgccu

SEQ ID NO: 1005239 - RNA, 20 nt, Mycobacterium avium subsp. paratuberculosis
ggcacuuaacaccucgccuc

SEQ ID NO: 1005240 - RNA, 21 nt, Mycobacterium avium subsp. paratuberculosis
ggcacuuaacaccucgccucc

SEQ ID NO: 1005241 - RNA, 17 nt, Mycobacterium avium subsp. paratuberculosis
ggcagcaccggccggau

SEQ ID NO: 1005242 - RNA, 12 nt, Mycobacterium avium subsp. paratuberculosis
ggcagcaccgcc

SEQ ID NO: 1005243 - RNA, 17 nt, Mycobacterium avium subsp. paratuberculosis
ggcagcaccgccgagcc

SEQ ID NO: 1005244 - RNA, 15 nt, Mycobacterium avium subsp. paratuberculosis
ggcacuggcgcugcg

SEQ ID NO: 1005245 - RNA, 22 nt, Mycobacterium avium subsp. paratuberculosis
ggcacgguuggccggcccgccc

SEQ ID NO: 1005246 - RNA, 13 nt, Mycobacterium avium subsp. paratuberculosis
ggcacgucgagcu

SEQ ID NO: 1005247 - RNA, 19 nt, Mycobacterium avium subsp. paratuberculosis
ggcacgucgagcuccucgg

SEQ ID NO: 1005248 - RNA, 16 nt, Mycobacterium avium subsp. paratuberculosis
ggcacguccagcccgc

SEQ ID NO: 1005249 - RNA, 22 nt, Mycobacterium avium subsp. paratuberculosis
ggcacguccccgugcagccggg

SEQ ID NO: 1005250 - RNA, 16 nt, Mycobacterium avium subsp. paratuberculosis
ggcacuaccgccucgc

SEQ ID NO: 1005251 - RNA, 15 nt, Mycobacterium avium subsp. paratuberculosis
ggcaccucgaagggc

SEQ ID NO: 1005252 - RNA, 22 nt, Mycobacterium avium subsp. paratuberculosis
ggcaccucgaagggcgccagcc

SEQ ID NO: 1005253 - RNA, 21 nt, Mycobacterium avium subsp. paratuberculosis
ggcaccucgaugccgugccgg

SEQ ID NO: 1005254 - RNA, 20 nt, Mycobacterium avium subsp. paratuberculosis
ggcaccuucaccgaccagcu

SEQ ID NO: 1005255 - RNA, 21 nt, Mycobacterium avium subsp. paratuberculosis
ggcaccuucaccgaccagcug

SEQ ID NO: 1005256 - RNA, 22 nt, Mycobacterium avium subsp. paratuberculosis
ggcaccuucaccgaccagcugu

SEQ ID NO: 1005257 - RNA, 16 nt, Mycobacterium avium subsp. paratuberculosis
ggcacgaacgcgacga

SEQ ID NO: 1005258 - RNA, 18 nt, Mycobacterium avium subsp. paratuberculosis
ggcacgaauucgguggcg

SEQ ID NO: 1005259 - RNA, 15 nt, Mycobacterium avium subsp. paratuberculosis
ggcacgacgccgccg

SEQ ID NO: 1005260 - RNA, 15 nt, Mycobacterium avium subsp. paratuberculosis
ggcacguacgcgcug

SEQ ID NO: 1005261 - RNA, 14 nt, Mycobacterium avium subsp. paratuberculosis
ggcacggcaccgcg

SEQ ID NO: 1005262 - RNA, 15 nt, Mycobacterium avium subsp. paratuberculosis
ggcacggucaggugg

SEQ ID NO: 1005263 - RNA, 16 nt, Mycobacterium avium subsp. paratuberculosis
ggcacggugcgggugc

SEQ ID NO: 1005264 - RNA, 15 nt, Mycobacterium avium subsp. paratuberculosis
ggcacggccggccgg

SEQ ID NO: 1005265 - RNA, 17 nt, Mycobacterium avium subsp. paratuberculosis
ggcacggccggccggcc

SEQ ID NO: 1005266 - RNA, 16 nt, Mycobacterium avium subsp. paratuberculosis
ggcacgcugcgccagc

SEQ ID NO: 1005267 - RNA, 13 nt, Mycobacterium avium subsp. paratuberculosis
ggcacgcagcggc

SEQ ID NO: 1005268 - RNA, 14 nt, Mycobacterium avium subsp. paratuberculosis
ggcacgcagcggcg

SEQ ID NO: 1005269 - RNA, 22 nt, Mycobacterium avium subsp. paratuberculosis
ggcacgccgaccacccccagcc

SEQ ID NO: 1005270 - RNA, 13 nt, Mycobacterium avium subsp. paratuberculosis
ggcacgccgccgc

SEQ ID NO: 1005271 - RNA, 15 nt, Mycobacterium avium subsp. paratuberculosis
ggcacgccgcucguc

SEQ ID NO: 1005272 - RNA, 17 nt, Mycobacterium avium subsp. paratuberculosis
ggcacgccgcucgucgg

SEQ ID NO: 1005273 - RNA, 13 nt, Mycobacterium avium subsp. paratuberculosis
ggcaccgccagcc

SEQ ID NO: 1005274 - RNA, 21 nt, Mycobacterium avium subsp. paratuberculosis
ggcaccgccaggaaggccagu

SEQ ID NO: 1005275 - RNA, 20 nt, Mycobacterium avium subsp. paratuberculosis
ggcaccgcccccgcggcggc

SEQ ID NO: 1005276 - RNA, 21 nt, Mycobacterium avium subsp. paratuberculosis
ggcaccgcccccgcggcggcc

SEQ ID NO: 1005277 - RNA, 19 nt, Mycobacterium avium subsp. paratuberculosis
ggcaccgauaguagccagc

SEQ ID NO: 1005278 - RNA, 17 nt, Mycobacterium avium subsp. paratuberculosis
ggcaccgacggccgcac

SEQ ID NO: 1005279 - RNA, 19 nt, Mycobacterium avium subsp. paratuberculosis
ggcaccgugccgcgcggcg

SEQ ID NO: 1005280 - RNA, 17 nt, Mycobacterium avium subsp. paratuberculosis
ggcaccgccgcgcggcc

SEQ ID NO: 1005281 - RNA, 21 nt, Mycobacterium avium subsp. paratuberculosis
ggcaccgccgcgcggccgggc

SEQ ID NO: 1005282 - RNA, 14 nt, Mycobacterium avium subsp. paratuberculosis
ggcaccauugcggg

SEQ ID NO: 1005283 - RNA, 20 nt, Mycobacterium avium subsp. paratuberculosis
ggcacccaggaaaaccagcg

SEQ ID NO: 1005284 - RNA, 11 nt, Mycobacterium avium subsp. paratuberculosis
ggcaccaggua

SEQ ID NO: 1005285 - RNA, 21 nt, Mycobacterium avium subsp. paratuberculosis
ggcaccagguaccggcgggcg

SEQ ID NO: 1005286 - RNA, 21 nt, Mycobacterium avium subsp. paratuberculosis
ggcaccagcagccagcccagc

SEQ ID NO: 1005287 - RNA, 13 nt, Mycobacterium avium subsp. paratuberculosis
ggcaccagcagcc

SEQ ID NO: 1005288 - RNA, 16 nt, Mycobacterium avium subsp. paratuberculosis
ggcaccagcagccagc

SEQ ID NO: 1005289 - RNA, 19 nt, Mycobacterium avium subsp. paratuberculosis
ggcaccgacagggccagcg

SEQ ID NO: 1005290 - RNA, 20 nt, Mycobacterium avium subsp. paratuberculosis
ggcaccgaacgccagcagcu

SEQ ID NO: 1005291 - RNA, 14 nt, Mycobacterium avium subsp. paratuberculosis
ggcacccgggcgcg

SEQ ID NO: 1005292 - RNA, 18 nt, Mycobacterium avium subsp. paratuberculosis
ggcacccgggugcccggc

SEQ ID NO: 1005293 - RNA, 16 nt, Mycobacterium avium subsp. paratuberculosis
ggcacccgcugcacca

SEQ ID NO: 1005294 - RNA, 19 nt, Mycobacterium avium subsp. paratuberculosis
ggcacccgcugcaccagcc

SEQ ID NO: 1005295 - RNA, 16 nt, Mycobacterium avium subsp. paratuberculosis
ggcaccccgcgccggg

SEQ ID NO: 1005296 - RNA, 13 nt, Mycobacterium avium subsp. paratuberculosis
ggcacccgcagcu

SEQ ID NO: 1005297 - RNA, 19 nt, Mycobacterium avium subsp. paratuberculosis
ggcacccgcagcuccagcg

SEQ ID NO: 1005298 - RNA, 14 nt, Mycobacterium avium subsp. paratuberculosis
ggcauaggccagca

SEQ ID NO: 1005299 - RNA, 20 nt, Mycobacterium avium subsp. paratuberculosis
ggcauagcgccgcucggccg

SEQ ID NO: 1005300 - RNA, 15 nt, Mycobacterium avium subsp. paratuberculosis
ggcauccccagcugg

SEQ ID NO: 1005301 - RNA, 15 nt, Mycobacterium avium subsp. paratuberculosis
ggcauaccgucugcu

SEQ ID NO: 1005302 - RNA, 23 nt, Mycobacterium avium subsp. paratuberculosis
ggcaugaaccaggccgcgcuggc

SEQ ID NO: 1005303 - RNA, 15 nt, Mycobacterium avium subsp. paratuberculosis
ggcauccgcucgccg

SEQ ID NO: 1005304 - RNA, 18 nt, Mycobacterium avium subsp. paratuberculosis
ggcauaguccagcucgcg

SEQ ID NO: 1005305 - RNA, 12 nt, Mycobacterium avium subsp. paratuberculosis
ggcaucccgccg

SEQ ID NO: 1005306 - RNA, 21 nt, Mycobacterium avium subsp. paratuberculosis
ggcaucgauggcgggcgcgcc

SEQ ID NO: 1005307 - RNA, 15 nt, Mycobacterium avium subsp. paratuberculosis
ggcaucgcagcgcgc

SEQ ID NO: 1005308 - RNA, 18 nt, Mycobacterium avium subsp. paratuberculosis
ggcauccugcuggccggg

SEQ ID NO: 1005309 - RNA, 17 nt, Mycobacterium avium subsp. paratuberculosis
ggcaguacgcgccggcc

SEQ ID NO: 1005310 - RNA, 13 nt, Mycobacterium avium subsp. paratuberculosis
ggcaguccggaca

SEQ ID NO: 1005311 - RNA, 22 nt, Mycobacterium avium subsp. paratuberculosis
ggcaguccggacacggccagcg

SEQ ID NO: 1005312 - RNA, 20 nt, Mycobacterium avium subsp. paratuberculosis
ggcagcgucgccagccgccg

SEQ ID NO: 1005313 - RNA, 19 nt, Mycobacterium avium subsp. paratuberculosis
ggcagcgucgggcucgccu

SEQ ID NO: 1005314 - RNA, 12 nt, Mycobacterium avium subsp. paratuberculosis
ggcagcgguguc

SEQ ID NO: 1005315 - RNA, 24 nt, Mycobacterium avium subsp. paratuberculosis
ggcagcggugucaccgacgccagc

SEQ ID NO: 1005316 - RNA, 18 nt, Mycobacterium avium subsp. paratuberculosis
ggcagcgucccgucggcc

SEQ ID NO: 1005317 - RNA, 21 nt, Mycobacterium avium subsp. paratuberculosis
ggcagcgucccgucggccagu

SEQ ID NO: 1005318 - RNA, 23 nt, Mycobacterium avium subsp. paratuberculosis
ggcagcggucggcggcugaggca

SEQ ID NO: 1005319 - RNA, 18 nt, Mycobacterium avium subsp. paratuberculosis
ggcaguuccucgccggag

SEQ ID NO: 1005320 - RNA, 17 nt, Mycobacterium avium subsp. paratuberculosis
ggcagugcgccgucccg

SEQ ID NO: 1005321 - RNA, 18 nt, Mycobacterium avium subsp. paratuberculosis
ggccaacagugcgcaggc

SEQ ID NO: 1005322 - RNA, 21 nt, Mycobacterium avium subsp. paratuberculosis
ggccaacagugcgcaggcggc

SEQ ID NO: 1005323 - RNA, 14 nt, Mycobacterium avium subsp. paratuberculosis
ggccaacagcagca

SEQ ID NO: 1005324 - RNA, 20 nt, Mycobacterium avium subsp. paratuberculosis
ggccaacagcagcagaacca

SEQ ID NO: 1005325 - RNA, 22 nt, Mycobacterium avium subsp. paratuberculosis
ggccaacagcagcagaaccagc

SEQ ID NO: 1005326 - RNA, 21 nt, Mycobacterium avium subsp. paratuberculosis
ggccaacagcagcgccgcggc

SEQ ID NO: 1005327 - RNA, 18 nt, Mycobacterium avium subsp. paratuberculosis
ggcaugggaucagcagca

SEQ ID NO: 1005328 - RNA, 20 nt, Mycobacterium avium subsp. paratuberculosis
ggcauggucaccggagagca

SEQ ID NO: 1005329 - RNA, 16 nt, Mycobacterium avium subsp. paratuberculosis
ggccacacccgucgac

SEQ ID NO: 1005330 - RNA, 15 nt, Mycobacterium avium subsp. paratuberculosis
ggccacaccggggcc

SEQ ID NO: 1005331 - RNA, 18 nt, Mycobacterium avium subsp. paratuberculosis
ggccacaccggggccagg

SEQ ID NO: 1005332 - RNA, 23 nt, Mycobacterium avium subsp. paratuberculosis
ggccaacgggaagagcggcguga

SEQ ID NO: 1005333 - RNA, 20 nt, Mycobacterium avium subsp. paratuberculosis
ggccaacgcguucuccucga

SEQ ID NO: 1005334 - RNA, 20 nt, Mycobacterium avium subsp. paratuberculosis
ggccaaccgcccggcgccga

SEQ ID NO: 1005335 - RNA, 18 nt, Mycobacterium avium subsp. paratuberculosis
ggccaaccgggcaggcac

SEQ ID NO: 1005336 - RNA, 18 nt, Mycobacterium avium subsp. paratuberculosis
ggccacacuggccaugcu

SEQ ID NO: 1005337 - RNA, 16 nt, Mycobacterium avium subsp. paratuberculosis
ggccacacuggcguga

SEQ ID NO: 1005338 - RNA, 18 nt, Mycobacterium avium subsp. paratuberculosis
ggccacaugggccacggc

SEQ ID NO: 1005339 - RNA, 17 nt, Mycobacterium avium subsp. paratuberculosis
ggccaccaacggcagca

SEQ ID NO: 1005340 - RNA, 15 nt, Mycobacterium avium subsp. paratuberculosis
ggccaccacauuggc

SEQ ID NO: 1005341 - RNA, 15 nt, Mycobacterium avium subsp. paratuberculosis
ggccaccaccacgga

SEQ ID NO: 1005342 - RNA, 16 nt, Mycobacterium avium subsp. paratuberculosis
ggccaccaccacggag

SEQ ID NO: 1005343 - RNA, 21 nt, Mycobacterium avium subsp. paratuberculosis
ggccaccaccacggagcgccc

SEQ ID NO: 1005344 - RNA, 24 nt, Mycobacterium avium subsp. paratuberculosis
ggccaccaccacggagcgcccggc

SEQ ID NO: 1005345 - RNA, 19 nt, Mycobacterium avium subsp. paratuberculosis
ggccaccaccacggccaug

SEQ ID NO: 1005346 - RNA, 20 nt, Mycobacterium avium subsp. paratuberculosis
ggccaccaccacggccgccg

SEQ ID NO: 1005347 - RNA, 21 nt, Mycobacterium avium subsp. paratuberculosis
ggccaccaccacggccgccga

SEQ ID NO: 1005348 - RNA, 21 nt, Mycobacterium avium subsp. paratuberculosis
ggccaccaccgcaucaauuac

SEQ ID NO: 1005349 - RNA, 14 nt, Mycobacterium avium subsp. paratuberculosis
ggccaccaggcgcc

SEQ ID NO: 1005350 - RNA, 16 nt, Mycobacterium avium subsp. paratuberculosis
ggccaccagcggccgg

SEQ ID NO: 1005351 - RNA, 13 nt, Mycobacterium avium subsp. paratuberculosis
ggccaccagcgca

SEQ ID NO: 1005352 - RNA, 17 nt, Mycobacterium avium subsp. paratuberculosis
ggccaccaccucgcggg

SEQ ID NO: 1005353 - RNA, 22 nt, Mycobacterium avium subsp. paratuberculosis
ggccaccacgggucggucggcc

SEQ ID NO: 1005354 - RNA, 22 nt, Mycobacterium avium subsp. paratuberculosis
ggccaccacguacuccugcgcg

SEQ ID NO: 1005355 - RNA, 11 nt, Mycobacterium avium subsp. paratuberculosis
ggccaccagca

SEQ ID NO: 1005356 - RNA, 13 nt, Mycobacterium avium subsp. paratuberculosis
ggccaccagcagc

SEQ ID NO: 1005357 - RNA, 17 nt, Mycobacterium avium subsp. paratuberculosis
ggccaccagccggccgg

SEQ ID NO: 1005358 - RNA, 22 nt, Mycobacterium avium subsp. paratuberculosis
ggccaggaucuugucggcggcc

SEQ ID NO: 1005359 - RNA, 22 nt, Mycobacterium avium subsp. paratuberculosis
ggccaggaugaccgcccaggac

SEQ ID NO: 1005360 - RNA, 17 nt, Mycobacterium avium subsp. paratuberculosis
ggccaggaugccgaacg

SEQ ID NO: 1005361 - RNA, 20 nt, Mycobacterium avium subsp. paratuberculosis
ggccaggaccggauccacca

SEQ ID NO: 1005362 - RNA, 16 nt, Mycobacterium avium subsp. paratuberculosis
ggccaggcgcccagca

SEQ ID NO: 1005363 - RNA, 17 nt, Mycobacterium avium subsp. paratuberculosis
ggccaggccggcgacga

SEQ ID NO: 1005364 - RNA, 19 nt, Mycobacterium avium subsp. paratuberculosis
ggccagcguuuccagcgcc

SEQ ID NO: 1005365 - RNA, 21 nt, Mycobacterium avium subsp. paratuberculosis
ggccagcucaccggccagggc

SEQ ID NO: 1005366 - RNA, 20 nt, Mycobacterium avium subsp. paratuberculosis
ggccagcgucuccggcgggc

SEQ ID NO: 1005367 - RNA, 13 nt, Mycobacterium avium subsp. paratuberculosis
ggccagcggcgcc

SEQ ID NO: 1005368 - RNA, 14 nt, Mycobacterium avium subsp. paratuberculosis
ggccagcgggcggc

SEQ ID NO: 1005369 - RNA, 15 nt, Mycobacterium avium subsp. paratuberculosis
ggccagcgggcggcc

SEQ ID NO: 1005370 - RNA, 22 nt, Mycobacterium avium subsp. paratuberculosis
ggccagcgggugauggccgccg

SEQ ID NO: 1005371 - RNA, 14 nt, Mycobacterium avium subsp. paratuberculosis
ggccagcggcaucc

SEQ ID NO: 1005372 - RNA, 13 nt, Mycobacterium avium subsp. paratuberculosis
ggccagcggcagc

SEQ ID NO: 1005373 - RNA, 22 nt, Mycobacterium avium subsp. paratuberculosis
ggccagcgcgucgcacagcgcc

SEQ ID NO: 1005374 - RNA, 20 nt, Mycobacterium avium subsp. paratuberculosis
ggccagcggcaacugggcgg

SEQ ID NO: 1005375 - RNA, 22 nt, Mycobacterium avium subsp. paratuberculosis
ggccagcggcaacugggcggcc

SEQ ID NO: 1005376 - RNA, 15 nt, Mycobacterium avium subsp. paratuberculosis
ggccagcgcgucggc

SEQ ID NO: 1005377 - RNA, 16 nt, Mycobacterium avium subsp. paratuberculosis
ggccagcgcgucggcc

SEQ ID NO: 1005378 - RNA, 21 nt, Mycobacterium avium subsp. paratuberculosis
ggccagcgcgucggccagcac

SEQ ID NO: 1005379 - RNA, 13 nt, Mycobacterium avium subsp. paratuberculosis
ggccagcgcguga

SEQ ID NO: 1005380 - RNA, 16 nt, Mycobacterium avium subsp. paratuberculosis
ggccagcgcggcggcc

SEQ ID NO: 1005381 - RNA, 20 nt, Mycobacterium avium subsp. paratuberculosis
ggccagcgcggcggccagcu

SEQ ID NO: 1005382 - RNA, 16 nt, Mycobacterium avium subsp. paratuberculosis
ggccagcgcggcgguc

SEQ ID NO: 1005383 - RNA, 14 nt, Mycobacterium avium subsp. paratuberculosis
ggccagcgcgguga

SEQ ID NO: 1005384 - RNA, 16 nt, Mycobacterium avium subsp. paratuberculosis
ggccagcgcgguggcc

SEQ ID NO: 1005385 - RNA, 22 nt, Mycobacterium avium subsp. paratuberculosis
ggccagcgcgguggccagcagg

SEQ ID NO: 1005386 - RNA, 22 nt, Mycobacterium avium subsp. paratuberculosis
ggccagcgcggugugcggcggc

SEQ ID NO: 1005387 - RNA, 18 nt, Mycobacterium avium subsp. paratuberculosis
ggccagcgcggccgggcg

SEQ ID NO: 1005388 - RNA, 13 nt, Mycobacterium avium subsp. paratuberculosis
ggccagcgcggcg

SEQ ID NO: 1005389 - RNA, 12 nt, Mycobacterium avium subsp. paratuberculosis
ggccaucgccag

SEQ ID NO: 1005390 - RNA, 18 nt, Mycobacterium avium subsp. paratuberculosis
ggccaucgccgcgguggc

SEQ ID NO: 1005391 - RNA, 14 nt, Mycobacterium avium subsp. paratuberculosis
ggccaucgccgagc

SEQ ID NO: 1005392 - RNA, 19 nt, Mycobacterium avium subsp. paratuberculosis
ggccaucggcagacccagc

SEQ ID NO: 1005393 - RNA, 14 nt, Mycobacterium avium subsp. paratuberculosis
ggccaucgcggccc

SEQ ID NO: 1005394 - RNA, 15 nt, Mycobacterium avium subsp. paratuberculosis
ggccaucgcggcccc

SEQ ID NO: 1005395 - RNA, 23 nt, Mycobacterium avium subsp. paratuberculosis
ggccaucgcggcccccacgcagc

SEQ ID NO: 1005396 - RNA, 12 nt, Mycobacterium avium subsp. paratuberculosis
ggccaucccggu

SEQ ID NO: 1005397 - RNA, 15 nt, Mycobacterium avium subsp. paratuberculosis
ggccaucgacuccag

SEQ ID NO: 1005398 - RNA, 17 nt, Mycobacterium avium subsp. paratuberculosis
ggccaucgacuccagca

SEQ ID NO: 1005399 - RNA, 18 nt, Mycobacterium avium subsp. paratuberculosis
ggccaucgacuccagcac

SEQ ID NO: 1005400 - RNA, 20 nt, Mycobacterium avium subsp. paratuberculosis
ggccauggucgcggccgugu

SEQ ID NO: 1005401 - RNA, 16 nt, Mycobacterium avium subsp. paratuberculosis
ggccauggugccgccg

SEQ ID NO: 1005402 - RNA, 23 nt, Mycobacterium avium subsp. paratuberculosis
ggccagguugcgccguccggcca

SEQ ID NO: 1005403 - RNA, 19 nt, Mycobacterium avium subsp. paratuberculosis
ggccagguugaccaccagc

SEQ ID NO: 1005404 - RNA, 15 nt, Mycobacterium avium subsp. paratuberculosis
ggccaggugcagcug

SEQ ID NO: 1005405 - RNA, 21 nt, Mycobacterium avium subsp. paratuberculosis
ggccaguccgcgugacaagcc

SEQ ID NO: 1005406 - RNA, 15 nt, Mycobacterium avium subsp. paratuberculosis
ggccaguccggcagc

SEQ ID NO: 1005407 - RNA, 18 nt, Mycobacterium avium subsp. paratuberculosis
ggccaucagcccggcguc

SEQ ID NO: 1005408 - RNA, 12 nt, Mycobacterium avium subsp. paratuberculosis
ggccagucgccg

SEQ ID NO: 1005409 - RNA, 16 nt, Mycobacterium avium subsp. paratuberculosis
ggccacggcgcgagga

SEQ ID NO: 1005410 - RNA, 17 nt, Mycobacterium avium subsp. paratuberculosis
ggccaccgcaucgccga

SEQ ID NO: 1005411 - RNA, 14 nt, Mycobacterium avium subsp. paratuberculosis
ggccacccucgccg

SEQ ID NO: 1005412 - RNA, 19 nt, Mycobacterium avium subsp. paratuberculosis
ggccaccaugccggcgucc

SEQ ID NO: 1005413 - RNA, 20 nt, Mycobacterium avium subsp. paratuberculosis
ggccacgucgaagcccgggu

SEQ ID NO: 1005414 - RNA, 19 nt, Mycobacterium avium subsp. paratuberculosis
ggccacguggucgcugacc

SEQ ID NO: 1005415 - RNA, 19 nt, Mycobacterium avium subsp. paratuberculosis
ggccagcagggcgccgacg

SEQ ID NO: 1005416 - RNA, 17 nt, Mycobacterium avium subsp. paratuberculosis
ggccagcaggucgucga

SEQ ID NO: 1005417 - RNA, 15 nt, Mycobacterium avium subsp. paratuberculosis
ggccagcagcgucgu

SEQ ID NO: 1005418 - RNA, 15 nt, Mycobacterium avium subsp. paratuberculosis
ggccagcagcguggg

SEQ ID NO: 1005419 - RNA, 20 nt, Mycobacterium avium subsp. paratuberculosis
ggccagcagcgugggauccg

SEQ ID NO: 1005420 - RNA, 21 nt, Mycobacterium avium subsp. paratuberculosis
ggccagcagguagaucgccag

SEQ ID NO: 1005421 - RNA, 15 nt, Mycobacterium avium subsp. paratuberculosis
ggccagcagcgcggc

SEQ ID NO: 1005422 - RNA, 17 nt, Mycobacterium avium subsp. paratuberculosis
ggccagcagcgcggcga

SEQ ID NO: 1005423 - RNA, 14 nt, Mycobacterium avium subsp. paratuberculosis
ggccagcagccgcu

SEQ ID NO: 1005424 - RNA, 11 nt, Mycobacterium avium subsp. paratuberculosis
ggccagcagcg

SEQ ID NO: 1005425 - RNA, 20 nt, Mycobacterium avium subsp. paratuberculosis
ggccacucgccgcgaacgac

SEQ ID NO: 1005426 - RNA, 20 nt, Mycobacterium avium subsp. paratuberculosis
ggccagcagcaccagggcgu

SEQ ID NO: 1005427 - RNA, 17 nt, Mycobacterium avium subsp. paratuberculosis
ggccagcagcaccgcgu

SEQ ID NO: 1005428 - RNA, 14 nt, Mycobacterium avium subsp. paratuberculosis
ggccagcagcagca

SEQ ID NO: 1005429 - RNA, 17 nt, Mycobacterium avium subsp. paratuberculosis
ggccagcagcagcccgc

SEQ ID NO: 1005430 - RNA, 15 nt, Mycobacterium avium subsp. paratuberculosis
ggccagcagcaggua

SEQ ID NO: 1005431 - RNA, 20 nt, Mycobacterium avium subsp. paratuberculosis
ggccagcagccagcugguga

SEQ ID NO: 1005432 - RNA, 13 nt, Mycobacterium avium subsp. paratuberculosis
ggccagcagcggc

SEQ ID NO: 1005433 - RNA, 22 nt, Mycobacterium avium subsp. paratuberculosis
ggccagccagccgcccagcauc

SEQ ID NO: 1005434 - RNA, 22 nt, Mycobacterium avium subsp. paratuberculosis
ggccagcaucucggcgaagguc

SEQ ID NO: 1005435 - RNA, 12 nt, Mycobacterium avium subsp. paratuberculosis
ggccagccaggu

SEQ ID NO: 1005436 - RNA, 20 nt, Mycobacterium avium subsp. paratuberculosis
ggccagccccaccaccgcca

SEQ ID NO: 1005437 - RNA, 23 nt, Mycobacterium avium subsp. paratuberculosis
ggccagccccaccaccgccacca

SEQ ID NO: 1005438 - RNA, 13 nt, Mycobacterium avium subsp. paratuberculosis
ggccagcccgcgg

SEQ ID NO: 1005439 - RNA, 20 nt, Mycobacterium avium subsp. paratuberculosis
ggccagccaggccgucggcg

SEQ ID NO: 1005440 - RNA, 17 nt, Mycobacterium avium subsp. paratuberculosis
ggccagccgcucccggc

SEQ ID NO: 1005441 - RNA, 20 nt, Mycobacterium avium subsp. paratuberculosis
ggccagccgguugcgguggc

SEQ ID NO: 1005442 - RNA, 21 nt, Mycobacterium avium subsp. paratuberculosis
ggccagccgguugcgguggcc

SEQ ID NO: 1005443 - RNA, 20 nt, Mycobacterium avium subsp. paratuberculosis
ggccagcgaguccagccagc

SEQ ID NO: 1005444 - RNA, 13 nt, Mycobacterium avium subsp. paratuberculosis
ggccagcgcagcg

SEQ ID NO: 1005445 - RNA, 15 nt, Mycobacterium avium subsp. paratuberculosis
ggccagcgcgacggc

SEQ ID NO: 1005446 - RNA, 15 nt, Mycobacterium avium subsp. paratuberculosis
ggccagcgcgccgca

SEQ ID NO: 1005447 - RNA, 14 nt, Mycobacterium avium subsp. paratuberculosis
ggccagcgcgcggg

SEQ ID NO: 1005448 - RNA, 15 nt, Mycobacterium avium subsp. paratuberculosis
ggccagcgcgcgggc

SEQ ID NO: 1005449 - RNA, 14 nt, Mycobacterium avium subsp. paratuberculosis
ggccagcgcgcggc

SEQ ID NO: 1005450 - RNA, 13 nt, Mycobacterium avium subsp. paratuberculosis
ggccagcgccucc

SEQ ID NO: 1005451 - RNA, 16 nt, Mycobacterium avium subsp. paratuberculosis
ggccagcgccuccagc

SEQ ID NO: 1005452 - RNA, 17 nt, Mycobacterium avium subsp. paratuberculosis
ggccagcgccuccagcc

SEQ ID NO: 1005453 - RNA, 16 nt, Mycobacterium avium subsp. paratuberculosis
ggccagcgccgccagc

SEQ ID NO: 1005454 - RNA, 16 nt, Mycobacterium avium subsp. paratuberculosis
ggccagcgccgcccgg

SEQ ID NO: 1005455 - RNA, 16 nt, Mycobacterium avium subsp. paratuberculosis
ggccagcgccgcgcgc

SEQ ID NO: 1005456 - RNA, 19 nt, Mycobacterium avium subsp. paratuberculosis
ggccagcgccaugccgccg

SEQ ID NO: 1005457 - RNA, 15 nt, Mycobacterium avium subsp. paratuberculosis
ggccagcgcccgcgg

SEQ ID NO: 1005458 - RNA, 16 nt, Mycobacterium avium subsp. paratuberculosis
ggagugaccgccagca

SEQ ID NO: 1005459 - RNA, 16 nt, Mycobacterium avium subsp. paratuberculosis
ggagucgcuguuggcg

SEQ ID NO: 1005460 - RNA, 23 nt, Mycobacterium avium subsp. paratuberculosis
ggaguagucggcgaucagcuccu

SEQ ID NO: 1005461 - RNA, 14 nt, Mycobacterium avium subsp. paratuberculosis
ggaggugccgcgca

SEQ ID NO: 1005462 - RNA, 14 nt, Mycobacterium avium subsp. paratuberculosis
ggaggucagcaggg

SEQ ID NO: 1005463 - RNA, 18 nt, Mycobacterium avium subsp. paratuberculosis
ggagggucgguggcccag

SEQ ID NO: 1005464 - RNA, 15 nt, Mycobacterium avium subsp. paratuberculosis
ggagggugucggcgg

SEQ ID NO: 1005465 - RNA, 23 nt, Mycobacterium avium subsp. paratuberculosis
ggaucaccaucacgucgcgcuug

SEQ ID NO: 1005466 - RNA, 18 nt, Mycobacterium avium subsp. paratuberculosis
ggaucacccucggcgucc

SEQ ID NO: 1005467 - RNA, 20 nt, Mycobacterium avium subsp. paratuberculosis
ggaucaccucaucgcccagc

SEQ ID NO: 1005468 - RNA, 18 nt, Mycobacterium avium subsp. paratuberculosis
ggauccccgcgcugggcu

SEQ ID NO: 1005469 - RNA, 18 nt, Mycobacterium avium subsp. paratuberculosis
ggauccccguccagccca

SEQ ID NO: 1005470 - RNA, 19 nt, Mycobacterium avium subsp. paratuberculosis
ggauccccucacuccagcg

SEQ ID NO: 1005471 - RNA, 21 nt, Mycobacterium avium subsp. paratuberculosis
ggauccccucacuccagcggc

SEQ ID NO: 1005472 - RNA, 15 nt, Mycobacterium avium subsp. paratuberculosis
ggaucccgcagccgc

SEQ ID NO: 1005473 - RNA, 17 nt, Mycobacterium avium subsp. paratuberculosis
ggaucccgcagccgcga

SEQ ID NO: 1005474 - RNA, 15 nt, Mycobacterium avium subsp. paratuberculosis
ggaucccggggcgcg

SEQ ID NO: 1005475 - RNA, 14 nt, Mycobacterium avium subsp. paratuberculosis
ggaucagacccagc

SEQ ID NO: 1005476 - RNA, 23 nt, Mycobacterium avium subsp. paratuberculosis
ggaucagcaccgacgcggcgacc

SEQ ID NO: 1005477 - RNA, 18 nt, Mycobacterium avium subsp. paratuberculosis
ggaucgaacagggcggcg

SEQ ID NO: 1005478 - RNA, 21 nt, Mycobacterium avium subsp. paratuberculosis
ggaucgaacagggcggcgggc

SEQ ID NO: 1005479 - RNA, 15 nt, Mycobacterium avium subsp. paratuberculosis
ggauccgggccgccu

SEQ ID NO: 1005480 - RNA, 13 nt, Mycobacterium avium subsp. paratuberculosis
ggauccucgccgc

SEQ ID NO: 1005481 - RNA, 17 nt, Mycobacterium avium subsp. paratuberculosis
ggauccgaucagcagca

SEQ ID NO: 1005482 - RNA, 21 nt, Mycobacterium avium subsp. paratuberculosis
ggauccgccugcgcgggcgcg

SEQ ID NO: 1005483 - RNA, 14 nt, Mycobacterium avium subsp. paratuberculosis
ggauccgaugacgc

SEQ ID NO: 1005484 - RNA, 14 nt, Mycobacterium avium subsp. paratuberculosis
ggauccgcaccggg

SEQ ID NO: 1005485 - RNA, 12 nt, Mycobacterium avium subsp. paratuberculosis
ggauccgcagcu

SEQ ID NO: 1005486 - RNA, 20 nt, Mycobacterium avium subsp. paratuberculosis
ggagaucaccggcaccccca

SEQ ID NO: 1005487 - RNA, 19 nt, Mycobacterium avium subsp. paratuberculosis
ggagaucggcgagugcacc

SEQ ID NO: 1005488 - RNA, 20 nt, Mycobacterium avium subsp. paratuberculosis
ggagaucggcgagugcaccu

SEQ ID NO: 1005489 - RNA, 13 nt, Mycobacterium avium subsp. paratuberculosis
ggagccgugcagc

SEQ ID NO: 1005490 - RNA, 11 nt, Mycobacterium avium subsp. paratuberculosis
ggagcgcggca

SEQ ID NO: 1005491 - RNA, 15 nt, Mycobacterium avium subsp. paratuberculosis
ggagcgggccacgca

SEQ ID NO: 1005492 - RNA, 14 nt, Mycobacterium avium subsp. paratuberculosis
ggagcgcuccacca

SEQ ID NO: 1005493 - RNA, 15 nt, Mycobacterium avium subsp. paratuberculosis
ggagcgcccggccag

SEQ ID NO: 1005494 - RNA, 14 nt, Mycobacterium avium subsp. paratuberculosis
ggagauggccagca

SEQ ID NO: 1005495 - RNA, 21 nt, Mycobacterium avium subsp. paratuberculosis
ggagccuucuucgccgcagcc

SEQ ID NO: 1005496 - RNA, 22 nt, Mycobacterium avium subsp. paratuberculosis
ggagccuucuugaccgcagccu

SEQ ID NO: 1005497 - RNA, 18 nt, Mycobacterium avium subsp. paratuberculosis
ggagccuugcuggcggcc

SEQ ID NO: 1005498 - RNA, 17 nt, Mycobacterium avium subsp. paratuberculosis
ggagccuuggucgcggc

SEQ ID NO: 1005499 - RNA, 13 nt, Mycobacterium avium subsp. paratuberculosis
ggaggacagcacc

SEQ ID NO: 1005500 - RNA, 14 nt, Mycobacterium avium subsp. paratuberculosis
ggaggacagcgcgg

SEQ ID NO: 1005501 - RNA, 20 nt, Mycobacterium avium subsp. paratuberculosis
ggaggaagugcacgccgagg

SEQ ID NO: 1005502 - RNA, 22 nt, Mycobacterium avium subsp. paratuberculosis
ggaggaagugcacgccgaggcg

SEQ ID NO: 1005503 - RNA, 21 nt, Mycobacterium avium subsp. paratuberculosis
ggaggacaagucaugccgcgc

SEQ ID NO: 1005504 - RNA, 13 nt, Mycobacterium avium subsp. paratuberculosis
ggagcugcgcgcc

SEQ ID NO: 1005505 - RNA, 17 nt, Mycobacterium avium subsp. paratuberculosis
ggagcuaggcggccggg

SEQ ID NO: 1005506 - RNA, 15 nt, Mycobacterium avium subsp. paratuberculosis
ggagcggugcggcuc

SEQ ID NO: 1005507 - RNA, 15 nt, Mycobacterium avium subsp. paratuberculosis
ggagcgucgcgauga

SEQ ID NO: 1005508 - RNA, 14 nt, Mycobacterium avium subsp. paratuberculosis
ggaggccaccgcgc

SEQ ID NO: 1005509 - RNA, 15 nt, Mycobacterium avium subsp. paratuberculosis
ggaggccaccgcgcc

SEQ ID NO: 1005510 - RNA, 23 nt, Mycobacterium avium subsp. paratuberculosis
ggaggccagcaccuucagcgggc

SEQ ID NO: 1005511 - RNA, 14 nt, Mycobacterium avium subsp. paratuberculosis
ggaggccagcucga

SEQ ID NO: 1005512 - RNA, 20 nt, Mycobacterium avium subsp. paratuberculosis
ggaggccagcugcaccgggg

SEQ ID NO: 1005513 - RNA, 19 nt, Mycobacterium avium subsp. paratuberculosis
ggaggcggcgggggcgggc

SEQ ID NO: 1005514 - RNA, 11 nt, Mycobacterium avium subsp. paratuberculosis
ggaggcggcgu

SEQ ID NO: 1005515 - RNA, 19 nt, Mycobacterium avium subsp. paratuberculosis
ggaggcgaucagguggggc

SEQ ID NO: 1005516 - RNA, 21 nt, Mycobacterium avium subsp. paratuberculosis
ggaggcgcacaacgaggcccg

SEQ ID NO: 1005517 - RNA, 16 nt, Mycobacterium avium subsp. paratuberculosis
ggaggggucggugcgg

SEQ ID NO: 1005518 - RNA, 23 nt, Mycobacterium avium subsp. paratuberculosis
ggagggagcacucgauggcggcg

SEQ ID NO: 1005519 - RNA, 19 nt, Mycobacterium avium subsp. paratuberculosis
ggaggcuucgcucaucccu

SEQ ID NO: 1005520 - RNA, 20 nt, Mycobacterium avium subsp. paratuberculosis
ggaggcuucgcucaucccua

SEQ ID NO: 1005521 - RNA, 18 nt, Mycobacterium avium subsp. paratuberculosis
ggagaacgucaggcccag

SEQ ID NO: 1005522 - RNA, 23 nt, Mycobacterium avium subsp. paratuberculosis
ggagaacgucaggcccagcgagg

SEQ ID NO: 1005523 - RNA, 13 nt, Mycobacterium avium subsp. paratuberculosis
ggacuccagcacc

SEQ ID NO: 1005524 - RNA, 15 nt, Mycobacterium avium subsp. paratuberculosis
ggacucccccaccac

SEQ ID NO: 1005525 - RNA, 20 nt, Mycobacterium avium subsp. paratuberculosis
ggacucccccaccacguagg

SEQ ID NO: 1005526 - RNA, 17 nt, Mycobacterium avium subsp. paratuberculosis
ggacucgaagaucgccu

SEQ ID NO: 1005527 - RNA, 18 nt, Mycobacterium avium subsp. paratuberculosis
ggacucgaagaucgccug

SEQ ID NO: 1005528 - RNA, 20 nt, Mycobacterium avium subsp. paratuberculosis
ggacgucggccggcugcagc

SEQ ID NO: 1005529 - RNA, 21 nt, Mycobacterium avium subsp. paratuberculosis
ggacgucgucgcuguccucga

SEQ ID NO: 1005530 - RNA, 16 nt, Mycobacterium avium subsp. paratuberculosis
ggacgguuucugccgg

SEQ ID NO: 1005531 - RNA, 19 nt, Mycobacterium avium subsp. paratuberculosis
ggacgguuucugccggccg

SEQ ID NO: 1005532 - RNA, 15 nt, Mycobacterium avium subsp. paratuberculosis
ggacgugaucgcggu

SEQ ID NO: 1005533 - RNA, 16 nt, Mycobacterium avium subsp. paratuberculosis
ggacgggucggcggcg

SEQ ID NO: 1005534 - RNA, 16 nt, Mycobacterium avium subsp. paratuberculosis
ggacggcgagcggccc

SEQ ID NO: 1005535 - RNA, 21 nt, Mycobacterium avium subsp. paratuberculosis
ggaccugaccgaacagcuuug

SEQ ID NO: 1005536 - RNA, 15 nt, Mycobacterium avium subsp. paratuberculosis
ggacgccgugcagga

SEQ ID NO: 1005537 - RNA, 14 nt, Mycobacterium avium subsp. paratuberculosis
ggacgccuccccca

SEQ ID NO: 1005538 - RNA, 15 nt, Mycobacterium avium subsp. paratuberculosis
ggacgccugccgccu

SEQ ID NO: 1005539 - RNA, 15 nt, Mycobacterium avium subsp. paratuberculosis
ggacgcgaccaggcc

SEQ ID NO: 1005540 - RNA, 22 nt, Mycobacterium avium subsp. paratuberculosis
ggacgcgaccaggcccagcgga

SEQ ID NO: 1005541 - RNA, 11 nt, Mycobacterium avium subsp. paratuberculosis
ggacgaugccg

SEQ ID NO: 1005542 - RNA, 21 nt, Mycobacterium avium subsp. paratuberculosis
ggacauucacgaggccgggcu

SEQ ID NO: 1005543 - RNA, 17 nt, Mycobacterium avium subsp. paratuberculosis
ggacaugccggcgccga

SEQ ID NO: 1005544 - RNA, 22 nt, Mycobacterium avium subsp. paratuberculosis
ggacaguucgguggggccgccg

SEQ ID NO: 1005545 - RNA, 19 nt, Mycobacterium avium subsp. paratuberculosis
ggaaucuuccuucuugaac

SEQ ID NO: 1005546 - RNA, 19 nt, Mycobacterium avium subsp. paratuberculosis
ggaaugaacugccgcggca

SEQ ID NO: 1005547 - RNA, 18 nt, Mycobacterium avium subsp. paratuberculosis
ggaaucgauuggugcgca

SEQ ID NO: 1005548 - RNA, 18 nt, Mycobacterium avium subsp. paratuberculosis
ggaaucgcccgggccagg

SEQ ID NO: 1005549 - RNA, 14 nt, Mycobacterium avium subsp. paratuberculosis
ggaccucgaccagc

SEQ ID NO: 1005550 - RNA, 22 nt, Mycobacterium avium subsp. paratuberculosis
ggacccagcuccucggccagca

SEQ ID NO: 1005551 - RNA, 16 nt, Mycobacterium avium subsp. paratuberculosis
ggacccccucggggcu

SEQ ID NO: 1005552 - RNA, 22 nt, Mycobacterium avium subsp. paratuberculosis
ggaccaccaggaaggucccggu

SEQ ID NO: 1005553 - RNA, 15 nt, Mycobacterium avium subsp. paratuberculosis
ggaccacccgcagcg

SEQ ID NO: 1005554 - RNA, 19 nt, Mycobacterium avium subsp. paratuberculosis
ggaccacccgcagcgcggc

SEQ ID NO: 1005555 - RNA, 12 nt, Mycobacterium avium subsp. paratuberculosis
ggaccagggugg

SEQ ID NO: 1005556 - RNA, 19 nt, Mycobacterium avium subsp. paratuberculosis
ggaccaggguggccccagc

SEQ ID NO: 1005557 - RNA, 21 nt, Mycobacterium avium subsp. paratuberculosis
ggaccaggguggccccagccc

SEQ ID NO: 1005558 - RNA, 20 nt, Mycobacterium avium subsp. paratuberculosis
ggaccagguauucaucgcgg

SEQ ID NO: 1005559 - RNA, 20 nt, Mycobacterium avium subsp. paratuberculosis
ggaagaaggacaagccggag

SEQ ID NO: 1005560 - RNA, 20 nt, Mycobacterium avium subsp. paratuberculosis
ggaaccgcccuuccagcacc

SEQ ID NO: 1005561 - RNA, 13 nt, Mycobacterium avium subsp. paratuberculosis
ggaacccugcccc

SEQ ID NO: 1005562 - RNA, 14 nt, Mycobacterium avium subsp. paratuberculosis
ggaaccggccgggg

SEQ ID NO: 1005563 - RNA, 16 nt, Mycobacterium avium subsp. paratuberculosis
ggaaccgggcacccgg

SEQ ID NO: 1005564 - RNA, 14 nt, Mycobacterium avium subsp. paratuberculosis
ggaaccgggccgcu

SEQ ID NO: 1005565 - RNA, 21 nt, Mycobacterium avium subsp. paratuberculosis
ggaacggcacccgcagcucca

SEQ ID NO: 1005566 - RNA, 14 nt, Mycobacterium avium subsp. paratuberculosis
ggaagaugacccgc

SEQ ID NO: 1005567 - RNA, 21 nt, Mycobacterium avium subsp. paratuberculosis
ggaagaugccgaucaggcugg

SEQ ID NO: 1005568 - RNA, 17 nt, Mycobacterium avium subsp. paratuberculosis
ggaaggacgucaggccg

SEQ ID NO: 1005569 - RNA, 13 nt, Mycobacterium avium subsp. paratuberculosis
ggaaggagguggu

SEQ ID NO: 1005570 - RNA, 18 nt, Mycobacterium avium subsp. paratuberculosis
ggaaggccaaggccagca

SEQ ID NO: 1005571 - RNA, 19 nt, Mycobacterium avium subsp. paratuberculosis
ggaaggccaaggccagcaa

SEQ ID NO: 1005572 - RNA, 23 nt, Mycobacterium avium subsp. paratuberculosis
ggaagggcccgggaugggccugg

SEQ ID NO: 1005573 - RNA, 23 nt, Mycobacterium avium subsp. paratuberculosis
ggaauagcuugggagacuuccac

SEQ ID NO: 1005574 - RNA, 23 nt, Mycobacterium avium subsp. paratuberculosis
ggaaagcgcuugucgcagacccu

SEQ ID NO: 1005575 - RNA, 19 nt, Mycobacterium avium subsp. paratuberculosis
ggaaaccguuuucacagcu

SEQ ID NO: 1005576 - RNA, 21 nt, Mycobacterium avium subsp. paratuberculosis
ggaaaauuuccuggccgauga

SEQ ID NO: 1005577 - RNA, 21 nt, Mycobacterium avium subsp. paratuberculosis
gcuuucgggucgacgagcagg

SEQ ID NO: 1005578 - RNA, 15 nt, Mycobacterium avium subsp. paratuberculosis
gcugugcgccuugcc

SEQ ID NO: 1005579 - RNA, 21 nt, Mycobacterium avium subsp. paratuberculosis
gcugugccgcggugcggcccg

SEQ ID NO: 1005580 - RNA, 22 nt, Mycobacterium avium subsp. paratuberculosis
gcuuucgcgcacgccaucgccu

SEQ ID NO: 1005581 - RNA, 15 nt, Mycobacterium avium subsp. paratuberculosis
gcuuugugaggcgcg

SEQ ID NO: 1005582 - RNA, 14 nt, Mycobacterium avium subsp. paratuberculosis
gcuuugcugccaag

SEQ ID NO: 1005583 - RNA, 21 nt, Mycobacterium avium subsp. paratuberculosis
gcuuuuccaccaucgggguga

SEQ ID NO: 1005584 - RNA, 15 nt, Mycobacterium avium subsp. paratuberculosis
ggaaaaccccacccc

SEQ ID NO: 1005585 - RNA, 21 nt, Mycobacterium avium subsp. paratuberculosis
gcuuuuugcggacccaggcag

SEQ ID NO: 1005586 - RNA, 15 nt, Mycobacterium avium subsp. paratuberculosis
gcuggaguggucagg

SEQ ID NO: 1005587 - RNA, 21 nt, Mycobacterium avium subsp. paratuberculosis
gcuggcaggacgggcaccagu

SEQ ID NO: 1005588 - RNA, 19 nt, Mycobacterium avium subsp. paratuberculosis
gcuggcaggucgcgccgga

SEQ ID NO: 1005589 - RNA, 15 nt, Mycobacterium avium subsp. paratuberculosis
gcuggccagguacac

SEQ ID NO: 1005590 - RNA, 21 nt, Mycobacterium avium subsp. paratuberculosis
gcuggccaucgcgggugacgg

SEQ ID NO: 1005591 - RNA, 13 nt, Mycobacterium avium subsp. paratuberculosis
gcuggccagcacc

SEQ ID NO: 1005592 - RNA, 17 nt, Mycobacterium avium subsp. paratuberculosis
gcuggccaccacggguc

SEQ ID NO: 1005593 - RNA, 21 nt, Mycobacterium avium subsp. paratuberculosis
gcuggccaccacgggucgguc

SEQ ID NO: 1005594 - RNA, 22 nt, Mycobacterium avium subsp. paratuberculosis
gcuggccgagagccgguagggc

SEQ ID NO: 1005595 - RNA, 11 nt, Mycobacterium avium subsp. paratuberculosis
gcuggcccggc

SEQ ID NO: 1005596 - RNA, 13 nt, Mycobacterium avium subsp. paratuberculosis
gcuggcccggcgu

SEQ ID NO: 1005597 - RNA, 15 nt, Mycobacterium avium subsp. paratuberculosis
gcuggccgugcaccg

SEQ ID NO: 1005598 - RNA, 18 nt, Mycobacterium avium subsp. paratuberculosis
gcuggccgagcggcugcu

SEQ ID NO: 1005599 - RNA, 19 nt, Mycobacterium avium subsp. paratuberculosis
gcuggccgcgugcaacaca

SEQ ID NO: 1005600 - RNA, 22 nt, Mycobacterium avium subsp. paratuberculosis
gcuggccggccaccagcggccg

SEQ ID NO: 1005601 - RNA, 23 nt, Mycobacterium avium subsp. paratuberculosis
gcuggccggccaccagcggccgg

SEQ ID NO: 1005602 - RNA, 22 nt, Mycobacterium avium subsp. paratuberculosis
gcuggcgaucaccuugcggccg

SEQ ID NO: 1005603 - RNA, 19 nt, Mycobacterium avium subsp. paratuberculosis
gcuggcgcugggagcgggc

SEQ ID NO: 1005604 - RNA, 15 nt, Mycobacterium avium subsp. paratuberculosis
gcuggcgcuguaggc

SEQ ID NO: 1005605 - RNA, 18 nt, Mycobacterium avium subsp. paratuberculosis
gcuggcgcaggcgcuggg

SEQ ID NO: 1005606 - RNA, 23 nt, Mycobacterium avium subsp. paratuberculosis
gcuggcgcaggcgcuggguguuc

SEQ ID NO: 1005607 - RNA, 13 nt, Mycobacterium avium subsp. paratuberculosis
gcuggcgcaggug

SEQ ID NO: 1005608 - RNA, 22 nt, Mycobacterium avium subsp. paratuberculosis
gcuggcgcaggugugcggcaag

SEQ ID NO: 1005609 - RNA, 23 nt, Mycobacterium avium subsp. paratuberculosis
gcuggcgccgaacagaugccugc

SEQ ID NO: 1005610 - RNA, 16 nt, Mycobacterium avium subsp. paratuberculosis
gcugcuucgucgccgg

SEQ ID NO: 1005611 - RNA, 22 nt, Mycobacterium avium subsp. paratuberculosis
gcugcucggccaccgcgcggug

SEQ ID NO: 1005612 - RNA, 14 nt, Mycobacterium avium subsp. paratuberculosis
gcugcucguccugg

SEQ ID NO: 1005613 - RNA, 15 nt, Mycobacterium avium subsp. paratuberculosis
gcugcugcccgcccg

SEQ ID NO: 1005614 - RNA, 22 nt, Mycobacterium avium subsp. paratuberculosis
gcugcuuagccccucccaccac

SEQ ID NO: 1005615 - RNA, 17 nt, Mycobacterium avium subsp. paratuberculosis
gcugcggcuccacgaag

SEQ ID NO: 1005616 - RNA, 15 nt, Mycobacterium avium subsp. paratuberculosis
gcugcggcugggaga

SEQ ID NO: 1005617 - RNA, 17 nt, Mycobacterium avium subsp. paratuberculosis
gcugcggccccggugga

SEQ ID NO: 1005618 - RNA, 22 nt, Mycobacterium avium subsp. paratuberculosis
gcugcggcgagucccggcgcac

SEQ ID NO: 1005619 - RNA, 17 nt, Mycobacterium avium subsp. paratuberculosis
gcugcccucggucgccg

SEQ ID NO: 1005620 - RNA, 17 nt, Mycobacterium avium subsp. paratuberculosis
gcugcccugaagcuggg

SEQ ID NO: 1005621 - RNA, 13 nt, Mycobacterium avium subsp. paratuberculosis
gcugcccucgguc

SEQ ID NO: 1005622 - RNA, 17 nt, Mycobacterium avium subsp. paratuberculosis
gcugcgucggcaccagc

SEQ ID NO: 1005623 - RNA, 23 nt, Mycobacterium avium subsp. paratuberculosis
gcugcgggccaucgacuccagca

SEQ ID NO: 1005624 - RNA, 18 nt, Mycobacterium avium subsp. paratuberculosis
gcugcgguuggccggccg

SEQ ID NO: 1005625 - RNA, 15 nt, Mycobacterium avium subsp. paratuberculosis
gcugguagacccggg

SEQ ID NO: 1005626 - RNA, 18 nt, Mycobacterium avium subsp. paratuberculosis
gcuggggugcccaccagc

SEQ ID NO: 1005627 - RNA, 21 nt, Mycobacterium avium subsp. paratuberculosis
gcuggguccgauuucccgacu

SEQ ID NO: 1005628 - RNA, 20 nt, Mycobacterium avium subsp. paratuberculosis
gcugggcuaccagccccagg

SEQ ID NO: 1005629 - RNA, 22 nt, Mycobacterium avium subsp. paratuberculosis
gcugggcgcuagcugcgccggc

SEQ ID NO: 1005630 - RNA, 14 nt, Mycobacterium avium subsp. paratuberculosis
gcugggcggcgcgc

SEQ ID NO: 1005631 - RNA, 13 nt, Mycobacterium avium subsp. paratuberculosis
gcugggcccgcgc

SEQ ID NO: 1005632 - RNA, 15 nt, Mycobacterium avium subsp. paratuberculosis
gcugggcccgcgcau

SEQ ID NO: 1005633 - RNA, 15 nt, Mycobacterium avium subsp. paratuberculosis
gcugggccgcggcgc

SEQ ID NO: 1005634 - RNA, 14 nt, Mycobacterium avium subsp. paratuberculosis
gcugggagagcagg

SEQ ID NO: 1005635 - RNA, 18 nt, Mycobacterium avium subsp. paratuberculosis
gcugggagcgggccacgc

SEQ ID NO: 1005636 - RNA, 16 nt, Mycobacterium avium subsp. paratuberculosis
gcugggccccuccagc

SEQ ID NO: 1005637 - RNA, 19 nt, Mycobacterium avium subsp. paratuberculosis
gcugggccccuccagccgc

SEQ ID NO: 1005638 - RNA, 19 nt, Mycobacterium avium subsp. paratuberculosis
gcuggcguagagccgcucg

SEQ ID NO: 1005639 - RNA, 16 nt, Mycobacterium avium subsp. paratuberculosis
gcuggcguaggacagc

SEQ ID NO: 1005640 - RNA, 18 nt, Mycobacterium avium subsp. paratuberculosis
gcuggcguaggacagcag

SEQ ID NO: 1005641 - RNA, 19 nt, Mycobacterium avium subsp. paratuberculosis
gcuggcgugaaucuuggcc

SEQ ID NO: 1005642 - RNA, 22 nt, Mycobacterium avium subsp. paratuberculosis
gcuggcgugaaucuuggccagc

SEQ ID NO: 1005643 - RNA, 14 nt, Mycobacterium avium subsp. paratuberculosis
gcuggcgugacgcu

SEQ ID NO: 1005644 - RNA, 17 nt, Mycobacterium avium subsp. paratuberculosis
gcuggcgugacgcucga

SEQ ID NO: 1005645 - RNA, 19 nt, Mycobacterium avium subsp. paratuberculosis
gcuggcgugacgcucggcc

SEQ ID NO: 1005646 - RNA, 20 nt, Mycobacterium avium subsp. paratuberculosis
gcuggcguugagcacgcgga

SEQ ID NO: 1005647 - RNA, 19 nt, Mycobacterium avium subsp. paratuberculosis
gcuggcgugcggcgcgguc

SEQ ID NO: 1005648 - RNA, 16 nt, Mycobacterium avium subsp. paratuberculosis
gcuggcguggcacccg

SEQ ID NO: 1005649 - RNA, 23 nt, Mycobacterium avium subsp. paratuberculosis
gcuggcguggcucggcccgccgg

SEQ ID NO: 1005650 - RNA, 18 nt, Mycobacterium avium subsp. paratuberculosis
gcugucgcgggcccgcgu

SEQ ID NO: 1005651 - RNA, 17 nt, Mycobacterium avium subsp. paratuberculosis
gcugucgucgaagagcu

SEQ ID NO: 1005652 - RNA, 17 nt, Mycobacterium avium subsp. paratuberculosis
gcuguaccgcgagauca

SEQ ID NO: 1005653 - RNA, 20 nt, Mycobacterium avium subsp. paratuberculosis
gcuguccucgucggaggcgu

SEQ ID NO: 1005654 - RNA, 16 nt, Mycobacterium avium subsp. paratuberculosis
gcuguccugccgggcg

SEQ ID NO: 1005655 - RNA, 19 nt, Mycobacterium avium subsp. paratuberculosis
gcuguccugccgggcgucg

SEQ ID NO: 1005656 - RNA, 19 nt, Mycobacterium avium subsp. paratuberculosis
aaagcuucuugcugccguc

SEQ ID NO: 1005657 - RNA, 14 nt, Mycobacterium avium subsp. paratuberculosis
gcugguggugauca

SEQ ID NO: 1005658 - RNA, 18 nt, Mycobacterium avium subsp. paratuberculosis
gcugguggugaucaccca

SEQ ID NO: 1005659 - RNA, 20 nt, Mycobacterium avium subsp. paratuberculosis
gcugguggugaucacccagc

SEQ ID NO: 1005660 - RNA, 18 nt, Mycobacterium avium subsp. paratuberculosis
gcugaugcgcaacagcau

SEQ ID NO: 1005661 - RNA, 13 nt, Mycobacterium avium subsp. paratuberculosis
gcugaugcggccg

SEQ ID NO: 1005662 - RNA, 21 nt, Mycobacterium avium subsp. paratuberculosis
gcugauggcggcggcccgccg

SEQ ID NO: 1005663 - RNA, 19 nt, Mycobacterium avium subsp. paratuberculosis
gcugcaguagccggccagc

SEQ ID NO: 1005664 - RNA, 17 nt, Mycobacterium avium subsp. paratuberculosis
gcugcaccagggcgucg

SEQ ID NO: 1005665 - RNA, 18 nt, Mycobacterium avium subsp. paratuberculosis
gcugcacgacgaccgcga

SEQ ID NO: 1005666 - RNA, 12 nt, Mycobacterium avium subsp. paratuberculosis
gcugcaccagcc

SEQ ID NO: 1005667 - RNA, 21 nt, Mycobacterium avium subsp. paratuberculosis
gcugcaccagcccgucggccu

SEQ ID NO: 1005668 - RNA, 15 nt, Mycobacterium avium subsp. paratuberculosis
gcugcaccggggccg

SEQ ID NO: 1005669 - RNA, 16 nt, Mycobacterium avium subsp. paratuberculosis
gcugcaccggggccgg

SEQ ID NO: 1005670 - RNA, 17 nt, Mycobacterium avium subsp. paratuberculosis
gcugcaccggggccggc

SEQ ID NO: 1005671 - RNA, 22 nt, Mycobacterium avium subsp. paratuberculosis
gcugcaucaugccgcccaucac

SEQ ID NO: 1005672 - RNA, 14 nt, Mycobacterium avium subsp. paratuberculosis
gcugcauccgcagc

SEQ ID NO: 1005673 - RNA, 15 nt, Mycobacterium avium subsp. paratuberculosis
gcugcauccgcagca

SEQ ID NO: 1005674 - RNA, 14 nt, Mycobacterium avium subsp. paratuberculosis
gcugcaucuccagc

SEQ ID NO: 1005675 - RNA, 17 nt, Mycobacterium avium subsp. paratuberculosis
gcugcaucuccagccgc

SEQ ID NO: 1005676 - RNA, 16 nt, Mycobacterium avium subsp. paratuberculosis
gcugcaucuccgugga

SEQ ID NO: 1005677 - RNA, 22 nt, Mycobacterium avium subsp. paratuberculosis
gcugcaucuccguggacggcga

SEQ ID NO: 1005678 - RNA, 21 nt, Mycobacterium avium subsp. paratuberculosis
gcugcccaccaccaggggcag

SEQ ID NO: 1005679 - RNA, 17 nt, Mycobacterium avium subsp. paratuberculosis
gcugcccaccagcaggu

SEQ ID NO: 1005680 - RNA, 13 nt, Mycobacterium avium subsp. paratuberculosis
gcugcccaaccgu

SEQ ID NO: 1005681 - RNA, 17 nt, Mycobacterium avium subsp. paratuberculosis
gcugcccgccgcggugc

SEQ ID NO: 1005682 - RNA, 19 nt, Mycobacterium avium subsp. paratuberculosis
gcugcccgccgcguacagc

SEQ ID NO: 1005683 - RNA, 17 nt, Mycobacterium avium subsp. paratuberculosis
gcugcccgcgacugucg

SEQ ID NO: 1005684 - RNA, 17 nt, Mycobacterium avium subsp. paratuberculosis
gcugcccgcggccgccg

SEQ ID NO: 1005685 - RNA, 11 nt, Mycobacterium avium subsp. paratuberculosis
gcugcccggca

SEQ ID NO: 1005686 - RNA, 17 nt, Mycobacterium avium subsp. paratuberculosis
gcugcccggcccgccgc

SEQ ID NO: 1005687 - RNA, 20 nt, Mycobacterium avium subsp. paratuberculosis
gcugcccggcgcuaaagccg

SEQ ID NO: 1005688 - RNA, 15 nt, Mycobacterium avium subsp. paratuberculosis
gcugcccgggcaucc

SEQ ID NO: 1005689 - RNA, 20 nt, Mycobacterium avium subsp. paratuberculosis
gcugcccgacccgcaccacc

SEQ ID NO: 1005690 - RNA, 16 nt, Mycobacterium avium subsp. paratuberculosis
gcugccccggcgaggc

SEQ ID NO: 1005691 - RNA, 20 nt, Mycobacterium avium subsp. paratuberculosis
gcugccccggcgaggccagg

SEQ ID NO: 1005692 - RNA, 21 nt, Mycobacterium avium subsp. paratuberculosis
gcugccccggcgaggccaggc

SEQ ID NO: 1005693 - RNA, 15 nt, Mycobacterium avium subsp. paratuberculosis
gcugaccagcgccuc

SEQ ID NO: 1005694 - RNA, 17 nt, Mycobacterium avium subsp. paratuberculosis
gcugacccggucgcggc

SEQ ID NO: 1005695 - RNA, 14 nt, Mycobacterium avium subsp. paratuberculosis
gcugacgcggcggg

SEQ ID NO: 1005696 - RNA, 18 nt, Mycobacterium avium subsp. paratuberculosis
gcugacggucgccgacuc

SEQ ID NO: 1005697 - RNA, 14 nt, Mycobacterium avium subsp. paratuberculosis
gcugacgccgagca

SEQ ID NO: 1005698 - RNA, 19 nt, Mycobacterium avium subsp. paratuberculosis
gcugaccggcgaucgucag

SEQ ID NO: 1005699 - RNA, 14 nt, Mycobacterium avium subsp. paratuberculosis
gcugaccgagcggc

SEQ ID NO: 1005700 - RNA, 14 nt, Mycobacterium avium subsp. paratuberculosis
gcugaccgccgcgc

SEQ ID NO: 1005701 - RNA, 12 nt, Mycobacterium avium subsp. paratuberculosis
gcugaguaugca

SEQ ID NO: 1005702 - RNA, 18 nt, Mycobacterium avium subsp. paratuberculosis
gcugagguagucccgcgc

SEQ ID NO: 1005703 - RNA, 21 nt, Mycobacterium avium subsp. paratuberculosis
gcugagguagucccgcgccug

SEQ ID NO: 1005704 - RNA, 22 nt, Mycobacterium avium subsp. paratuberculosis
gcugaggccgccccggccgcgc

SEQ ID NO: 1005705 - RNA, 24 nt, Mycobacterium avium subsp. paratuberculosis
gcugacuuucuugcugagcugcgc

SEQ ID NO: 1005706 - RNA, 14 nt, Mycobacterium avium subsp. paratuberculosis
gcugagcgggaagc

SEQ ID NO: 1005707 - RNA, 20 nt, Mycobacterium avium subsp. paratuberculosis
gcugagcgggucggccggcg

SEQ ID NO: 1005708 - RNA, 17 nt, Mycobacterium avium subsp. paratuberculosis
gcugacugcgaucgccg

SEQ ID NO: 1005709 - RNA, 15 nt, Mycobacterium avium subsp. paratuberculosis
gcucuucgguggugu

SEQ ID NO: 1005710 - RNA, 20 nt, Mycobacterium avium subsp. paratuberculosis
gcucugguuuuacacaccag

SEQ ID NO: 1005711 - RNA, 20 nt, Mycobacterium avium subsp. paratuberculosis
gcucuggaagauguccucgg

SEQ ID NO: 1005712 - RNA, 19 nt, Mycobacterium avium subsp. paratuberculosis
gcucuaacuccgcucgggc

SEQ ID NO: 1005713 - RNA, 14 nt, Mycobacterium avium subsp. paratuberculosis
gcucugccgggccg

SEQ ID NO: 1005714 - RNA, 19 nt, Mycobacterium avium subsp. paratuberculosis
gcucugccuacuugcggcc

SEQ ID NO: 1005715 - RNA, 20 nt, Mycobacterium avium subsp. paratuberculosis
gcucugccuacuugcggccg

SEQ ID NO: 1005716 - RNA, 18 nt, Mycobacterium avium subsp. paratuberculosis
gcucguucgucaugacga

SEQ ID NO: 1005717 - RNA, 17 nt, Mycobacterium avium subsp. paratuberculosis
gcucguugccggcggcc

SEQ ID NO: 1005718 - RNA, 23 nt, Mycobacterium avium subsp. paratuberculosis
gcucguagcuggugcgcagcccg

SEQ ID NO: 1005719 - RNA, 21 nt, Mycobacterium avium subsp. paratuberculosis
gcucguccaggguggccagca

SEQ ID NO: 1005720 - RNA, 16 nt, Mycobacterium avium subsp. paratuberculosis
gcucgucagcgcgggc

SEQ ID NO: 1005721 - RNA, 22 nt, Mycobacterium avium subsp. paratuberculosis
gcucgucagcgcgggccagcag

SEQ ID NO: 1005722 - RNA, 15 nt, Mycobacterium avium subsp. paratuberculosis
gcucguccuggcgcu

SEQ ID NO: 1005723 - RNA, 19 nt, Mycobacterium avium subsp. paratuberculosis
gcucguccuggcgcuggug

SEQ ID NO: 1005724 - RNA, 17 nt, Mycobacterium avium subsp. paratuberculosis
gcucguaguuggggccg

SEQ ID NO: 1005725 - RNA, 16 nt, Mycobacterium avium subsp. paratuberculosis
gcucguaacgccacgg

SEQ ID NO: 1005726 - RNA, 20 nt, Mycobacterium avium subsp. paratuberculosis
gcucguaacgccacggcggc

SEQ ID NO: 1005727 - RNA, 21 nt, Mycobacterium avium subsp. paratuberculosis
gcucguaacgccacggcggcc

SEQ ID NO: 1005728 - RNA, 17 nt, Mycobacterium avium subsp. paratuberculosis
gcucgguggcgucggcg

SEQ ID NO: 1005729 - RNA, 20 nt, Mycobacterium avium subsp. paratuberculosis
gcucgguggcgucggcggcc

SEQ ID NO: 1005730 - RNA, 16 nt, Mycobacterium avium subsp. paratuberculosis
gcucgggccggcgccg

SEQ ID NO: 1005731 - RNA, 14 nt, Mycobacterium avium subsp. paratuberculosis
gcucggcggccaug

SEQ ID NO: 1005732 - RNA, 16 nt, Mycobacterium avium subsp. paratuberculosis
gcucggcgcgcggggc

SEQ ID NO: 1005733 - RNA, 16 nt, Mycobacterium avium subsp. paratuberculosis
gcucggcgccgagcgu

SEQ ID NO: 1005734 - RNA, 14 nt, Mycobacterium avium subsp. paratuberculosis
gcucggcgccggcc

SEQ ID NO: 1005735 - RNA, 12 nt, Mycobacterium avium subsp. paratuberculosis
gcucggcggccg

SEQ ID NO: 1005736 - RNA, 15 nt, Mycobacterium avium subsp. paratuberculosis
gcucggcggccugcu

SEQ ID NO: 1005737 - RNA, 15 nt, Mycobacterium avium subsp. paratuberculosis
gcucggcggcucagc

SEQ ID NO: 1005738 - RNA, 15 nt, Mycobacterium avium subsp. paratuberculosis
gcucggcggggggag

SEQ ID NO: 1005739 - RNA, 21 nt, Mycobacterium avium subsp. paratuberculosis
gcucggcggggggagaggcgc

SEQ ID NO: 1005740 - RNA, 22 nt, Mycobacterium avium subsp. paratuberculosis
gcucggcggguugcugagccgc

SEQ ID NO: 1005741 - RNA, 18 nt, Mycobacterium avium subsp. paratuberculosis
gcucgggcagcccgccga

SEQ ID NO: 1005742 - RNA, 20 nt, Mycobacterium avium subsp. paratuberculosis
gcucggcguggucgaggccc

SEQ ID NO: 1005743 - RNA, 21 nt, Mycobacterium avium subsp. paratuberculosis
gcucggcguugagccggcgca

SEQ ID NO: 1005744 - RNA, 22 nt, Mycobacterium avium subsp. paratuberculosis
gcucggcguugagccggcgcac

SEQ ID NO: 1005745 - RNA, 14 nt, Mycobacterium avium subsp. paratuberculosis
gcucggcguccagc

SEQ ID NO: 1005746 - RNA, 14 nt, Mycobacterium avium subsp. paratuberculosis
gcucgcgggccaca

SEQ ID NO: 1005747 - RNA, 16 nt, Mycobacterium avium subsp. paratuberculosis
gcucgcgggccaccgc

SEQ ID NO: 1005748 - RNA, 14 nt, Mycobacterium avium subsp. paratuberculosis
gcucgcgggcccgc

SEQ ID NO: 1005749 - RNA, 21 nt, Mycobacterium avium subsp. paratuberculosis
gcucgcgggccugcucgucgg

SEQ ID NO: 1005750 - RNA, 20 nt, Mycobacterium avium subsp. paratuberculosis
gcucgcgggcgaugcggccc

SEQ ID NO: 1005751 - RNA, 21 nt, Mycobacterium avium subsp. paratuberculosis
gcucgcgggugcggcgcugcc

SEQ ID NO: 1005752 - RNA, 16 nt, Mycobacterium avium subsp. paratuberculosis
gcucggccagcgcagc

SEQ ID NO: 1005753 - RNA, 16 nt, Mycobacterium avium subsp. paratuberculosis
gcucggccagcgcgcc

SEQ ID NO: 1005754 - RNA, 23 nt, Mycobacterium avium subsp. paratuberculosis
gcucggaguugcgcagccgggcg

SEQ ID NO: 1005755 - RNA, 18 nt, Mycobacterium avium subsp. paratuberculosis
gcucggcaccagagcgcc

SEQ ID NO: 1005756 - RNA, 13 nt, Mycobacterium avium subsp. paratuberculosis
gcucggcagcccc

SEQ ID NO: 1005757 - RNA, 13 nt, Mycobacterium avium subsp. paratuberculosis
gcucggcgagugc

SEQ ID NO: 1005758 - RNA, 18 nt, Mycobacterium avium subsp. paratuberculosis
gcucggcgaccgccggug

SEQ ID NO: 1005759 - RNA, 19 nt, Mycobacterium avium subsp. paratuberculosis
gcucggcgaccugcggcuc

SEQ ID NO: 1005760 - RNA, 20 nt, Mycobacterium avium subsp. paratuberculosis
gcucggcgagcaaggcgagc

SEQ ID NO: 1005761 - RNA, 15 nt, Mycobacterium avium subsp. paratuberculosis
gcucggcgccccacg

SEQ ID NO: 1005762 - RNA, 23 nt, Mycobacterium avium subsp. paratuberculosis
gcucggccuuacgcugcgcgacc

SEQ ID NO: 1005763 - RNA, 14 nt, Mycobacterium avium subsp. paratuberculosis
gcucggccggccgg

SEQ ID NO: 1005764 - RNA, 18 nt, Mycobacterium avium subsp. paratuberculosis
gcucggccggccggccgu

SEQ ID NO: 1005765 - RNA, 17 nt, Mycobacterium avium subsp. paratuberculosis
gcuccccguugaucuug

SEQ ID NO: 1005766 - RNA, 20 nt, Mycobacterium avium subsp. paratuberculosis
gcucccggcagaucgcggcc

SEQ ID NO: 1005767 - RNA, 21 nt, Mycobacterium avium subsp. paratuberculosis
gcucgcgcagcuggccgugca

SEQ ID NO: 1005768 - RNA, 17 nt, Mycobacterium avium subsp. paratuberculosis
gcucgcgcagccggccg

SEQ ID NO: 1005769 - RNA, 13 nt, Mycobacterium avium subsp. paratuberculosis
gcucccgcucgcc

SEQ ID NO: 1005770 - RNA, 14 nt, Mycobacterium avium subsp. paratuberculosis
gcucccgcgcgggc

SEQ ID NO: 1005771 - RNA, 16 nt, Mycobacterium avium subsp. paratuberculosis
gcucgcgcuggcggcc

SEQ ID NO: 1005772 - RNA, 17 nt, Mycobacterium avium subsp. paratuberculosis
gcucgcggauccgcagc

SEQ ID NO: 1005773 - RNA, 18 nt, Mycobacterium avium subsp. paratuberculosis
gcucgcggccugcgggcg

SEQ ID NO: 1005774 - RNA, 21 nt, Mycobacterium avium subsp. paratuberculosis
gcucgcggcgcagcucgcgca

SEQ ID NO: 1005775 - RNA, 20 nt, Mycobacterium avium subsp. paratuberculosis
gcucgcgcaggaacuccagc

SEQ ID NO: 1005776 - RNA, 16 nt, Mycobacterium avium subsp. paratuberculosis
gcuagcgagcgggcac

SEQ ID NO: 1005777 - RNA, 23 nt, Mycobacterium avium subsp. paratuberculosis
gcuagcgagcgggcacgccgccg

SEQ ID NO: 1005778 - RNA, 17 nt, Mycobacterium avium subsp. paratuberculosis
gcuagacgcgcaccagg

SEQ ID NO: 1005779 - RNA, 15 nt, Mycobacterium avium subsp. paratuberculosis
gcuagucgcccagca

SEQ ID NO: 1005780 - RNA, 20 nt, Mycobacterium avium subsp. paratuberculosis
gcuaggucaccggauucggc

SEQ ID NO: 1005781 - RNA, 16 nt, Mycobacterium avium subsp. paratuberculosis
gcuaggcggccgggcg

SEQ ID NO: 1005782 - RNA, 11 nt, Mycobacterium avium subsp. paratuberculosis
gcuaggccagc

SEQ ID NO: 1005783 - RNA, 19 nt, Mycobacterium avium subsp. paratuberculosis
gcuaggacgcgggccuggg

SEQ ID NO: 1005784 - RNA, 23 nt, Mycobacterium avium subsp. paratuberculosis
gcuagcgugacgcucgcguggcc

SEQ ID NO: 1005785 - RNA, 20 nt, Mycobacterium avium subsp. paratuberculosis
gcuagcuucacgcucggcgc

SEQ ID NO: 1005786 - RNA, 19 nt, Mycobacterium avium subsp. paratuberculosis
gcuagguuuggccagcacc

SEQ ID NO: 1005787 - RNA, 18 nt, Mycobacterium avium subsp. paratuberculosis
gcuaguuggugcugggca

SEQ ID NO: 1005788 - RNA, 15 nt, Mycobacterium avium subsp. paratuberculosis
gcuaucgcccggcgc

SEQ ID NO: 1005789 - RNA, 18 nt, Mycobacterium avium subsp. paratuberculosis
gcucaaccgcccagcggc

SEQ ID NO: 1005790 - RNA, 14 nt, Mycobacterium avium subsp. paratuberculosis
gcucaacggccggc

SEQ ID NO: 1005791 - RNA, 14 nt, Mycobacterium avium subsp. paratuberculosis
gcucaacaggcgag

SEQ ID NO: 1005792 - RNA, 20 nt, Mycobacterium avium subsp. paratuberculosis
gcucccauccggaagcgggg

SEQ ID NO: 1005793 - RNA, 22 nt, Mycobacterium avium subsp. paratuberculosis
gcucccaggacggcgcgguggc

SEQ ID NO: 1005794 - RNA, 14 nt, Mycobacterium avium subsp. paratuberculosis
gcucccaggcgucg

SEQ ID NO: 1005795 - RNA, 13 nt, Mycobacterium avium subsp. paratuberculosis
gcucccccggcgu

SEQ ID NO: 1005796 - RNA, 16 nt, Mycobacterium avium subsp. paratuberculosis
gcucccccgucgggcc

SEQ ID NO: 1005797 - RNA, 19 nt, Mycobacterium avium subsp. paratuberculosis
gcuccccgaccacaccggc

SEQ ID NO: 1005798 - RNA, 16 nt, Mycobacterium avium subsp. paratuberculosis
gcuccagaugcggugg

SEQ ID NO: 1005799 - RNA, 18 nt, Mycobacterium avium subsp. paratuberculosis
gcuccaggaugucgacga

SEQ ID NO: 1005800 - RNA, 21 nt, Mycobacterium avium subsp. paratuberculosis
gcuccaggaugucgacgacac

SEQ ID NO: 1005801 - RNA, 22 nt, Mycobacterium avium subsp. paratuberculosis
gcuccaccgcgccggcggcggc

SEQ ID NO: 1005802 - RNA, 15 nt, Mycobacterium avium subsp. paratuberculosis
gcuccacgccgccgg

SEQ ID NO: 1005803 - RNA, 20 nt, Mycobacterium avium subsp. paratuberculosis
gcuccacgccgccgggaaca

SEQ ID NO: 1005804 - RNA, 17 nt, Mycobacterium avium subsp. paratuberculosis
gcuccacgcguagccga

SEQ ID NO: 1005805 - RNA, 14 nt, Mycobacterium avium subsp. paratuberculosis
gcuccaccugcggc

SEQ ID NO: 1005806 - RNA, 15 nt, Mycobacterium avium subsp. paratuberculosis
gcucagugcacgcuc

SEQ ID NO: 1005807 - RNA, 16 nt, Mycobacterium avium subsp. paratuberculosis
gcucaguccagcuccc

SEQ ID NO: 1005808 - RNA, 19 nt, Mycobacterium avium subsp. paratuberculosis
gcucagguugcgcagcagc

SEQ ID NO: 1005809 - RNA, 13 nt, Mycobacterium avium subsp. paratuberculosis
gcuccaccagcgc

SEQ ID NO: 1005810 - RNA, 21 nt, Mycobacterium avium subsp. paratuberculosis
gcucaugucaaugccgcagcc

SEQ ID NO: 1005811 - RNA, 22 nt, Mycobacterium avium subsp. paratuberculosis
gcucaugucguacgggcgcagc

SEQ ID NO: 1005812 - RNA, 17 nt, Mycobacterium avium subsp. paratuberculosis
gcucauguggggggucg

SEQ ID NO: 1005813 - RNA, 13 nt, Mycobacterium avium subsp. paratuberculosis
gcucagccccagc

SEQ ID NO: 1005814 - RNA, 15 nt, Mycobacterium avium subsp. paratuberculosis
gcucagccacgccgg

SEQ ID NO: 1005815 - RNA, 15 nt, Mycobacterium avium subsp. paratuberculosis
gcucagccgccuggc

SEQ ID NO: 1005816 - RNA, 18 nt, Mycobacterium avium subsp. paratuberculosis
gcucagcgauugcggccg

SEQ ID NO: 1005817 - RNA, 20 nt, Mycobacterium avium subsp. paratuberculosis
gcucagcgauugcggccgcc

SEQ ID NO: 1005818 - RNA, 21 nt, Mycobacterium avium subsp. paratuberculosis
gcucagcgauugcggccgccg

SEQ ID NO: 1005819 - RNA, 22 nt, Mycobacterium avium subsp. paratuberculosis
gcucagcgauugcggccgccgg

SEQ ID NO: 1005820 - RNA, 15 nt, Mycobacterium avium subsp. paratuberculosis
gcucagcgcaccgcc

SEQ ID NO: 1005821 - RNA, 21 nt, Mycobacterium avium subsp. paratuberculosis
gcucagcaacccgccgagcgu

SEQ ID NO: 1005822 - RNA, 14 nt, Mycobacterium avium subsp. paratuberculosis
gcucagcagcaccg

SEQ ID NO: 1005823 - RNA, 15 nt, Mycobacterium avium subsp. paratuberculosis
gcucaggccgguggc

SEQ ID NO: 1005824 - RNA, 21 nt, Mycobacterium avium subsp. paratuberculosis
gcucagcugcugcgcggcggc

SEQ ID NO: 1005825 - RNA, 19 nt, Mycobacterium avium subsp. paratuberculosis
gcucagcucccgagcaucg

SEQ ID NO: 1005826 - RNA, 22 nt, Mycobacterium avium subsp. paratuberculosis
gcucagcucccgagcaucgccg

SEQ ID NO: 1005827 - RNA, 19 nt, Mycobacterium avium subsp. paratuberculosis
gcucagcgggcggccagcc

SEQ ID NO: 1005828 - RNA, 17 nt, Mycobacterium avium subsp. paratuberculosis
gcucagcggcaacugca

SEQ ID NO: 1005829 - RNA, 18 nt, Mycobacterium avium subsp. paratuberculosis
gcucaaguccucgguggc

SEQ ID NO: 1005830 - RNA, 21 nt, Mycobacterium avium subsp. paratuberculosis
gcucacgcucggccaggguga

SEQ ID NO: 1005831 - RNA, 21 nt, Mycobacterium avium subsp. paratuberculosis
gcucacguagucgaccgggau

SEQ ID NO: 1005832 - RNA, 20 nt, Mycobacterium avium subsp. paratuberculosis
gcucacggugucggcgguga

SEQ ID NO: 1005833 - RNA, 14 nt, Mycobacterium avium subsp. paratuberculosis
gcucaccugcggcc

SEQ ID NO: 1005834 - RNA, 22 nt, Mycobacterium avium subsp. paratuberculosis
gcucaccgagcugggccggcgc

SEQ ID NO: 1005835 - RNA, 22 nt, Mycobacterium avium subsp. paratuberculosis
gcucaccgcaucgaaccgccgc

SEQ ID NO: 1005836 - RNA, 14 nt, Mycobacterium avium subsp. paratuberculosis
gcucaccgccgagc

SEQ ID NO: 1005837 - RNA, 24 nt, Mycobacterium avium subsp. paratuberculosis
gcucaccgccgaugaugguggcgg

SEQ ID NO: 1005838 - RNA, 22 nt, Mycobacterium avium subsp. paratuberculosis
gcucaccggccagggccgccgc

SEQ ID NO: 1005839 - RNA, 24 nt, Mycobacterium avium subsp. paratuberculosis
gcucaccggccagggccgccgcau

SEQ ID NO: 1005840 - RNA, 17 nt, Mycobacterium avium subsp. paratuberculosis
gcguucaucguccacac

SEQ ID NO: 1005841 - RNA, 15 nt, Mycobacterium avium subsp. paratuberculosis
gcguucagcggcacc

SEQ ID NO: 1005842 - RNA, 17 nt, Mycobacterium avium subsp. paratuberculosis
gcguucgaugcccugcc

SEQ ID NO: 1005843 - RNA, 13 nt, Mycobacterium avium subsp. paratuberculosis
gcguucggccgca

SEQ ID NO: 1005844 - RNA, 14 nt, Mycobacterium avium subsp. paratuberculosis
gcguucggcggcgc

SEQ ID NO: 1005845 - RNA, 16 nt, Mycobacterium avium subsp. paratuberculosis
gcguucggcggcgcgc

SEQ ID NO: 1005846 - RNA, 20 nt, Mycobacterium avium subsp. paratuberculosis
gcguucggcggcgcgcugca

SEQ ID NO: 1005847 - RNA, 16 nt, Mycobacterium avium subsp. paratuberculosis
gcguucgggcccggcc

SEQ ID NO: 1005848 - RNA, 20 nt, Mycobacterium avium subsp. paratuberculosis
gcguucgcguucgggcagcg

SEQ ID NO: 1005849 - RNA, 20 nt, Mycobacterium avium subsp. paratuberculosis
gcguucgcuuucgccgggcg

SEQ ID NO: 1005850 - RNA, 13 nt, Mycobacterium avium subsp. paratuberculosis
gcguuccagcauc

SEQ ID NO: 1005851 - RNA, 23 nt, Mycobacterium avium subsp. paratuberculosis
gcguuccaggugugccgcuggua

SEQ ID NO: 1005852 - RNA, 20 nt, Mycobacterium avium subsp. paratuberculosis
gcguuccagguucagcccgg

SEQ ID NO: 1005853 - RNA, 17 nt, Mycobacterium avium subsp. paratuberculosis
gcguuccagcacccggc

SEQ ID NO: 1005854 - RNA, 16 nt, Mycobacterium avium subsp. paratuberculosis
gcguuccagcgcacac

SEQ ID NO: 1005855 - RNA, 15 nt, Mycobacterium avium subsp. paratuberculosis
gcguucccagcccgg

SEQ ID NO: 1005856 - RNA, 13 nt, Mycobacterium avium subsp. paratuberculosis
gcguguggcccug

SEQ ID NO: 1005857 - RNA, 14 nt, Mycobacterium avium subsp. paratuberculosis
gcgugucgcgugcu

SEQ ID NO: 1005858 - RNA, 18 nt, Mycobacterium avium subsp. paratuberculosis
gcguggugcgcccgucgg

SEQ ID NO: 1005859 - RNA, 19 nt, Mycobacterium avium subsp. paratuberculosis
gcguguagccugcggccug

SEQ ID NO: 1005860 - RNA, 23 nt, Mycobacterium avium subsp. paratuberculosis
gcguggucuccuggccgccgugc

SEQ ID NO: 1005861 - RNA, 12 nt, Mycobacterium avium subsp. paratuberculosis
gcguggucccac

SEQ ID NO: 1005862 - RNA, 22 nt, Mycobacterium avium subsp. paratuberculosis
gcgugggcaccggcaccgcccc

SEQ ID NO: 1005863 - RNA, 15 nt, Mycobacterium avium subsp. paratuberculosis
gcgugggccgcagcg

SEQ ID NO: 1005864 - RNA, 16 nt, Mycobacterium avium subsp. paratuberculosis
gcgugggccgcagcgc

SEQ ID NO: 1005865 - RNA, 19 nt, Mycobacterium avium subsp. paratuberculosis
gcgugggguucccggccgg

SEQ ID NO: 1005866 - RNA, 14 nt, Mycobacterium avium subsp. paratuberculosis
gcguggcgucggcg

SEQ ID NO: 1005867 - RNA, 16 nt, Mycobacterium avium subsp. paratuberculosis
gcguggcucggcccgc

SEQ ID NO: 1005868 - RNA, 16 nt, Mycobacterium avium subsp. paratuberculosis
gcguggcucucguccu

SEQ ID NO: 1005869 - RNA, 18 nt, Mycobacterium avium subsp. paratuberculosis
gcguggcugaggccgccc

SEQ ID NO: 1005870 - RNA, 14 nt, Mycobacterium avium subsp. paratuberculosis
gcguggcgccggcg

SEQ ID NO: 1005871 - RNA, 17 nt, Mycobacterium avium subsp. paratuberculosis
gcguggcgggccaggcg

SEQ ID NO: 1005872 - RNA, 13 nt, Mycobacterium avium subsp. paratuberculosis
gcguggcggucgg

SEQ ID NO: 1005873 - RNA, 17 nt, Mycobacterium avium subsp. paratuberculosis
gcguggcgguggcggcg

SEQ ID NO: 1005874 - RNA, 13 nt, Mycobacterium avium subsp. paratuberculosis
gcguggcgccggc

SEQ ID NO: 1005875 - RNA, 14 nt, Mycobacterium avium subsp. paratuberculosis
gcguugugcaccaa

SEQ ID NO: 1005876 - RNA, 22 nt, Mycobacterium avium subsp. paratuberculosis
gcguuuccuggugcaccaggua

SEQ ID NO: 1005877 - RNA, 19 nt, Mycobacterium avium subsp. paratuberculosis
gcguuuugaaauccgggcg

SEQ ID NO: 1005878 - RNA, 17 nt, Mycobacterium avium subsp. paratuberculosis
gcguucuccacccgccc

SEQ ID NO: 1005879 - RNA, 18 nt, Mycobacterium avium subsp. paratuberculosis
gcguucugcaccagcucg

SEQ ID NO: 1005880 - RNA, 17 nt, Mycobacterium avium subsp. paratuberculosis
gcguucgucgccgguga

SEQ ID NO: 1005881 - RNA, 15 nt, Mycobacterium avium subsp. paratuberculosis
gcguucggcgccacc

SEQ ID NO: 1005882 - RNA, 15 nt, Mycobacterium avium subsp. paratuberculosis
gcguucggucagcac

SEQ ID NO: 1005883 - RNA, 17 nt, Mycobacterium avium subsp. paratuberculosis
gcguugaggcguugcgg

SEQ ID NO: 1005884 - RNA, 21 nt, Mycobacterium avium subsp. paratuberculosis
gcguugagggcggggcagcag

SEQ ID NO: 1005885 - RNA, 22 nt, Mycobacterium avium subsp. paratuberculosis
gcguuggccgagcagccgggcc

SEQ ID NO: 1005886 - RNA, 15 nt, Mycobacterium avium subsp. paratuberculosis
gcguuggccgccgcc

SEQ ID NO: 1005887 - RNA, 17 nt, Mycobacterium avium subsp. paratuberculosis
gcguuggccgccgccug

SEQ ID NO: 1005888 - RNA, 21 nt, Mycobacterium avium subsp. paratuberculosis
gcguugguccacacguccugg

SEQ ID NO: 1005889 - RNA, 20 nt, Mycobacterium avium subsp. paratuberculosis
gcguugucgaccaccaggug

SEQ ID NO: 1005890 - RNA, 14 nt, Mycobacterium avium subsp. paratuberculosis
gcguugccgccggc

SEQ ID NO: 1005891 - RNA, 19 nt, Mycobacterium avium subsp. paratuberculosis
gcguugcggaucgaacggc

SEQ ID NO: 1005892 - RNA, 15 nt, Mycobacterium avium subsp. paratuberculosis
gcguugcgcggaccg

SEQ ID NO: 1005893 - RNA, 16 nt, Mycobacterium avium subsp. paratuberculosis
gcguuggacuccaccg

SEQ ID NO: 1005894 - RNA, 16 nt, Mycobacterium avium subsp. paratuberculosis
gcuacugccgacgcau

SEQ ID NO: 1005895 - RNA, 18 nt, Mycobacterium avium subsp. paratuberculosis
gcuacucggacgccggca

SEQ ID NO: 1005896 - RNA, 16 nt, Mycobacterium avium subsp. paratuberculosis
gcuacgcgagcugcuu

SEQ ID NO: 1005897 - RNA, 12 nt, Mycobacterium avium subsp. paratuberculosis
gcuacccggcga

SEQ ID NO: 1005898 - RNA, 23 nt, Mycobacterium avium subsp. paratuberculosis
gcuacgccggcucggucuccucc

SEQ ID NO: 1005899 - RNA, 13 nt, Mycobacterium avium subsp. paratuberculosis
gcuaacaaaagcc

SEQ ID NO: 1005900 - RNA, 15 nt, Mycobacterium avium subsp. paratuberculosis
gcuaacgcgauguga

SEQ ID NO: 1005901 - RNA, 18 nt, Mycobacterium avium subsp. paratuberculosis
gcuaaugcaucgaugccg

SEQ ID NO: 1005902 - RNA, 14 nt, Mycobacterium avium subsp. paratuberculosis
gcguacagccagcc

SEQ ID NO: 1005903 - RNA, 16 nt, Mycobacterium avium subsp. paratuberculosis
gcguacagcggcgcca

SEQ ID NO: 1005904 - RNA, 15 nt, Mycobacterium avium subsp. paratuberculosis
gcguaccgcggcggc

SEQ ID NO: 1005905 - RNA, 16 nt, Mycobacterium avium subsp. paratuberculosis
gcguacagggcgucgg

SEQ ID NO: 1005906 - RNA, 21 nt, Mycobacterium avium subsp. paratuberculosis
gcggugugggcgauggcggcg

SEQ ID NO: 1005907 - RNA, 22 nt, Mycobacterium avium subsp. paratuberculosis
gcggugugggcgauggcggcgu

SEQ ID NO: 1005908 - RNA, 15 nt, Mycobacterium avium subsp. paratuberculosis
gcggugugcccggcg

SEQ ID NO: 1005909 - RNA, 16 nt, Mycobacterium avium subsp. paratuberculosis
gcggugucggcgcccc

SEQ ID NO: 1005910 - RNA, 18 nt, Mycobacterium avium subsp. paratuberculosis
gcggugucggcgccccgg

SEQ ID NO: 1005911 - RNA, 23 nt, Mycobacterium avium subsp. paratuberculosis
gcggugucggugccgagcacgcg

SEQ ID NO: 1005912 - RNA, 19 nt, Mycobacterium avium subsp. paratuberculosis
gcgguguaaccguggcagg

SEQ ID NO: 1005913 - RNA, 17 nt, Mycobacterium avium subsp. paratuberculosis
gcggugucgcccagcug

SEQ ID NO: 1005914 - RNA, 14 nt, Mycobacterium avium subsp. paratuberculosis
gcggugguuggggu

SEQ ID NO: 1005915 - RNA, 19 nt, Mycobacterium avium subsp. paratuberculosis
gcggugucgagaugaccgu

SEQ ID NO: 1005916 - RNA, 20 nt, Mycobacterium avium subsp. paratuberculosis
gcggugggcgcgggccgcgu

SEQ ID NO: 1005917 - RNA, 14 nt, Mycobacterium avium subsp. paratuberculosis
gcggugggcggcgg

SEQ ID NO: 1005918 - RNA, 13 nt, Mycobacterium avium subsp. paratuberculosis
gcgguggucgggg

SEQ ID NO: 1005919 - RNA, 13 nt, Mycobacterium avium subsp. paratuberculosis
gcgguggccucgg

SEQ ID NO: 1005920 - RNA, 21 nt, Mycobacterium avium subsp. paratuberculosis
gcgguggcgaacugcaccagc

SEQ ID NO: 1005921 - RNA, 19 nt, Mycobacterium avium subsp. paratuberculosis
gcgguggcgcacaacccgg

SEQ ID NO: 1005922 - RNA, 14 nt, Mycobacterium avium subsp. paratuberculosis
gcgguggcgcccgc

SEQ ID NO: 1005923 - RNA, 23 nt, Mycobacterium avium subsp. paratuberculosis
gcgguggcgccgcgggcggucgc

SEQ ID NO: 1005924 - RNA, 14 nt, Mycobacterium avium subsp. paratuberculosis
gcgguggccgggau

SEQ ID NO: 1005925 - RNA, 15 nt, Mycobacterium avium subsp. paratuberculosis
gcgguugcccucggu

SEQ ID NO: 1005926 - RNA, 23 nt, Mycobacterium avium subsp. paratuberculosis
gcgguugccccaccccggacggc

SEQ ID NO: 1005927 - RNA, 19 nt, Mycobacterium avium subsp. paratuberculosis
gcgguugcggguggcggcc

SEQ ID NO: 1005928 - RNA, 20 nt, Mycobacterium avium subsp. paratuberculosis
gcgguucggcgacgcuggug

SEQ ID NO: 1005929 - RNA, 15 nt, Mycobacterium avium subsp. paratuberculosis
gcgguugaacaggcu

SEQ ID NO: 1005930 - RNA, 22 nt, Mycobacterium avium subsp. paratuberculosis
gcgguugagcaccagcccggcc

SEQ ID NO: 1005931 - RNA, 16 nt, Mycobacterium avium subsp. paratuberculosis
gcgguugggccgccgg

SEQ ID NO: 1005932 - RNA, 17 nt, Mycobacterium avium subsp. paratuberculosis
gcgguugggccgccggc

SEQ ID NO: 1005933 - RNA, 19 nt, Mycobacterium avium subsp. paratuberculosis
gcgguugggccgccggccg

SEQ ID NO: 1005934 - RNA, 19 nt, Mycobacterium avium subsp. paratuberculosis
gcgguuggacaggccggcg

SEQ ID NO: 1005935 - RNA, 14 nt, Mycobacterium avium subsp. paratuberculosis
gcgguuggcccgcg

SEQ ID NO: 1005936 - RNA, 18 nt, Mycobacterium avium subsp. paratuberculosis
gcgguuggcccgcggcgc

SEQ ID NO: 1005937 - RNA, 14 nt, Mycobacterium avium subsp. paratuberculosis
gcgguuggccggaa

SEQ ID NO: 1005938 - RNA, 16 nt, Mycobacterium avium subsp. paratuberculosis
gcgguuggccggccgg

SEQ ID NO: 1005939 - RNA, 19 nt, Mycobacterium avium subsp. paratuberculosis
gcggugaccacgccgugcc

SEQ ID NO: 1005940 - RNA, 19 nt, Mycobacterium avium subsp. paratuberculosis
gcggugacaucgccaccug

SEQ ID NO: 1005941 - RNA, 16 nt, Mycobacterium avium subsp. paratuberculosis
gcggugagcgcgccgg

SEQ ID NO: 1005942 - RNA, 15 nt, Mycobacterium avium subsp. paratuberculosis
gcggugagcggccgc

SEQ ID NO: 1005943 - RNA, 17 nt, Mycobacterium avium subsp. paratuberculosis
gcggugaccgcccgcuc

SEQ ID NO: 1005944 - RNA, 15 nt, Mycobacterium avium subsp. paratuberculosis
gcggugaccgccgcc

SEQ ID NO: 1005945 - RNA, 17 nt, Mycobacterium avium subsp. paratuberculosis
gcggugaccgcggccuc

SEQ ID NO: 1005946 - RNA, 18 nt, Mycobacterium avium subsp. paratuberculosis
gcggugaccuugcgggcg

SEQ ID NO: 1005947 - RNA, 14 nt, Mycobacterium avium subsp. paratuberculosis
gcggugcagcagga

SEQ ID NO: 1005948 - RNA, 14 nt, Mycobacterium avium subsp. paratuberculosis
gcggugcagccccg

SEQ ID NO: 1005949 - RNA, 14 nt, Mycobacterium avium subsp. paratuberculosis
gcggugcagccggg

SEQ ID NO: 1005950 - RNA, 15 nt, Mycobacterium avium subsp. paratuberculosis
gcggugcagccgggu

SEQ ID NO: 1005951 - RNA, 20 nt, Mycobacterium avium subsp. paratuberculosis
gcggugcaucgucgcggcgg

SEQ ID NO: 1005952 - RNA, 13 nt, Mycobacterium avium subsp. paratuberculosis
gcggugcaccacc

SEQ ID NO: 1005953 - RNA, 16 nt, Mycobacterium avium subsp. paratuberculosis
gcggugauggucaccg

SEQ ID NO: 1005954 - RNA, 22 nt, Mycobacterium avium subsp. paratuberculosis
gcggugaucucgucggcggcgg

SEQ ID NO: 1005955 - RNA, 20 nt, Mycobacterium avium subsp. paratuberculosis
gcgguggagcacagcacggc

SEQ ID NO: 1005956 - RNA, 14 nt, Mycobacterium avium subsp. paratuberculosis
gcgguggccacggc

SEQ ID NO: 1005957 - RNA, 19 nt, Mycobacterium avium subsp. paratuberculosis
gcggugcguuugaugacgc

SEQ ID NO: 1005958 - RNA, 16 nt, Mycobacterium avium subsp. paratuberculosis
gcggugcucgcgccgg

SEQ ID NO: 1005959 - RNA, 21 nt, Mycobacterium avium subsp. paratuberculosis
gcggugcuuaccggccggccg

SEQ ID NO: 1005960 - RNA, 17 nt, Mycobacterium avium subsp. paratuberculosis
gcggugcggugcgccgc

SEQ ID NO: 1005961 - RNA, 18 nt, Mycobacterium avium subsp. paratuberculosis
gcggugcgucgggcgccg

SEQ ID NO: 1005962 - RNA, 20 nt, Mycobacterium avium subsp. paratuberculosis
gcggugcgucgggcgccggc

SEQ ID NO: 1005963 - RNA, 22 nt, Mycobacterium avium subsp. paratuberculosis
gcggugcgcccagguacuccuc

SEQ ID NO: 1005964 - RNA, 12 nt, Mycobacterium avium subsp. paratuberculosis
gcggugcggccg

SEQ ID NO: 1005965 - RNA, 15 nt, Mycobacterium avium subsp. paratuberculosis
gcggugcgcgcgcgc

SEQ ID NO: 1005966 - RNA, 13 nt, Mycobacterium avium subsp. paratuberculosis
gcggugccgcagc

SEQ ID NO: 1005967 - RNA, 15 nt, Mycobacterium avium subsp. paratuberculosis
gcggugccgcagcuc

SEQ ID NO: 1005968 - RNA, 14 nt, Mycobacterium avium subsp. paratuberculosis
gcggugccgcaggc

SEQ ID NO: 1005969 - RNA, 17 nt, Mycobacterium avium subsp. paratuberculosis
gcggugccgggugcuga

SEQ ID NO: 1005970 - RNA, 18 nt, Mycobacterium avium subsp. paratuberculosis
gcggugcccagccgcagg

SEQ ID NO: 1005971 - RNA, 21 nt, Mycobacterium avium subsp. paratuberculosis
gcggugcccggaacggcgggc

SEQ ID NO: 1005972 - RNA, 21 nt, Mycobacterium avium subsp. paratuberculosis
gcggugccgaccugggcggcc

SEQ ID NO: 1005973 - RNA, 16 nt, Mycobacterium avium subsp. paratuberculosis
gcggugccgagcccgc

SEQ ID NO: 1005974 - RNA, 14 nt, Mycobacterium avium subsp. paratuberculosis
gcggucgaugacgc

SEQ ID NO: 1005975 - RNA, 16 nt, Mycobacterium avium subsp. paratuberculosis
gcggucgaugagcugg

SEQ ID NO: 1005976 - RNA, 18 nt, Mycobacterium avium subsp. paratuberculosis
gcggucgaugagcuggug

SEQ ID NO: 1005977 - RNA, 16 nt, Mycobacterium avium subsp. paratuberculosis
gcggucgaaaaaugcg

SEQ ID NO: 1005978 - RNA, 19 nt, Mycobacterium avium subsp. paratuberculosis
gcggucgaacaacgcggug

SEQ ID NO: 1005979 - RNA, 20 nt, Mycobacterium avium subsp. paratuberculosis
gcggucgccccggccgcggu

SEQ ID NO: 1005980 - RNA, 21 nt, Mycobacterium avium subsp. paratuberculosis
gcggucgccccggccgcggug

SEQ ID NO: 1005981 - RNA, 22 nt, Mycobacterium avium subsp. paratuberculosis
gcggucgccccggccgcgguga

SEQ ID NO: 1005982 - RNA, 22 nt, Mycobacterium avium subsp. paratuberculosis
gcggucgaccaagacggugggc

SEQ ID NO: 1005983 - RNA, 20 nt, Mycobacterium avium subsp. paratuberculosis
gcggucgcaggccgcccggc

SEQ ID NO: 1005984 - RNA, 19 nt, Mycobacterium avium subsp. paratuberculosis
gcggucgcaggcgagccgg

SEQ ID NO: 1005985 - RNA, 17 nt, Mycobacterium avium subsp. paratuberculosis
gcgguccucgaaccgcu

SEQ ID NO: 1005986 - RNA, 18 nt, Mycobacterium avium subsp. paratuberculosis
gcgguccgcuccaccagc

SEQ ID NO: 1005987 - RNA, 16 nt, Mycobacterium avium subsp. paratuberculosis
gcggucccgugcgccg

SEQ ID NO: 1005988 - RNA, 20 nt, Mycobacterium avium subsp. paratuberculosis
gcgguccaggaucugcagca

SEQ ID NO: 1005989 - RNA, 21 nt, Mycobacterium avium subsp. paratuberculosis
gcgguccagcguuuccuggug

SEQ ID NO: 1005990 - RNA, 13 nt, Mycobacterium avium subsp. paratuberculosis
gcgguccagcuug

SEQ ID NO: 1005991 - RNA, 17 nt, Mycobacterium avium subsp. paratuberculosis
gcgguccaccaccacac

SEQ ID NO: 1005992 - RNA, 16 nt, Mycobacterium avium subsp. paratuberculosis
gcgguccacgguggcg

SEQ ID NO: 1005993 - RNA, 18 nt, Mycobacterium avium subsp. paratuberculosis
gcgguccacuuccgcgca

SEQ ID NO: 1005994 - RNA, 15 nt, Mycobacterium avium subsp. paratuberculosis
gcggucgugucaggg

SEQ ID NO: 1005995 - RNA, 15 nt, Mycobacterium avium subsp. paratuberculosis
gcggucugcgcccga

SEQ ID NO: 1005996 - RNA, 18 nt, Mycobacterium avium subsp. paratuberculosis
gcggucuucuuggcgggc

SEQ ID NO: 1005997 - RNA, 21 nt, Mycobacterium avium subsp. paratuberculosis
gcggucucgaucugcaccagc

SEQ ID NO: 1005998 - RNA, 19 nt, Mycobacterium avium subsp. paratuberculosis
gcggucgucgucgucggug

SEQ ID NO: 1005999 - RNA, 16 nt, Mycobacterium avium subsp. paratuberculosis
gcggucgggucccggc

SEQ ID NO: 1006000 - RNA, 17 nt, Mycobacterium avium subsp. paratuberculosis
gcggucggugcgcagca

SEQ ID NO: 1006001 - RNA, 22 nt, Mycobacterium avium subsp. paratuberculosis
gcggucgcgcagccgccgggcu

SEQ ID NO: 1006002 - RNA, 17 nt, Mycobacterium avium subsp. paratuberculosis
gcggucgcgcagccggg

SEQ ID NO: 1006003 - RNA, 22 nt, Mycobacterium avium subsp. paratuberculosis
gcggucgcgccagacguccagc

SEQ ID NO: 1006004 - RNA, 21 nt, Mycobacterium avium subsp. paratuberculosis
gcggucgccagcgccacgcuc

SEQ ID NO: 1006005 - RNA, 19 nt, Mycobacterium avium subsp. paratuberculosis
gcggucgccgaaaggaucu

SEQ ID NO: 1006006 - RNA, 16 nt, Mycobacterium avium subsp. paratuberculosis
gcggucgcugcagcgg

SEQ ID NO: 1006007 - RNA, 11 nt, Mycobacterium avium subsp. paratuberculosis
gcggucggcgc

SEQ ID NO: 1006008 - RNA, 17 nt, Mycobacterium avium subsp. paratuberculosis
gcggucggcgcccggcc

SEQ ID NO: 1006009 - RNA, 22 nt, Mycobacterium avium subsp. paratuberculosis
gcggguaccacuugaaggaggc

SEQ ID NO: 1006010 - RNA, 15 nt, Mycobacterium avium subsp. paratuberculosis
gcggguguccgagcg

SEQ ID NO: 1006011 - RNA, 14 nt, Mycobacterium avium subsp. paratuberculosis
gcggguggcggccg

SEQ ID NO: 1006012 - RNA, 16 nt, Mycobacterium avium subsp. paratuberculosis
gcggguggcggccggg

SEQ ID NO: 1006013 - RNA, 16 nt, Mycobacterium avium subsp. paratuberculosis
gcgggugguccaccca

SEQ ID NO: 1006014 - RNA, 16 nt, Mycobacterium avium subsp. paratuberculosis
gcggguguugaccuug

SEQ ID NO: 1006015 - RNA, 21 nt, Mycobacterium avium subsp. paratuberculosis
gcggguuguucuccagcggcc

SEQ ID NO: 1006016 - RNA, 16 nt, Mycobacterium avium subsp. paratuberculosis
gcggguaaccgcagcc

SEQ ID NO: 1006017 - RNA, 21 nt, Mycobacterium avium subsp. paratuberculosis
gcggggugucgacccaggucg

SEQ ID NO: 1006018 - RNA, 16 nt, Mycobacterium avium subsp. paratuberculosis
gcggggugugcucggc

SEQ ID NO: 1006019 - RNA, 16 nt, Mycobacterium avium subsp. paratuberculosis
gcgggguggcgccggc

SEQ ID NO: 1006020 - RNA, 16 nt, Mycobacterium avium subsp. paratuberculosis
gcggggugggcaccug

SEQ ID NO: 1006021 - RNA, 18 nt, Mycobacterium avium subsp. paratuberculosis
gcggggucaagcggcaga

SEQ ID NO: 1006022 - RNA, 12 nt, Mycobacterium avium subsp. paratuberculosis
gcggggucggga

SEQ ID NO: 1006023 - RNA, 18 nt, Mycobacterium avium subsp. paratuberculosis
gcggggugagcaccgcga

SEQ ID NO: 1006024 - RNA, 16 nt, Mycobacterium avium subsp. paratuberculosis
gcggggcgucgcccgc

SEQ ID NO: 1006025 - RNA, 19 nt, Mycobacterium avium subsp. paratuberculosis
gcggggcgucgcccgccga

SEQ ID NO: 1006026 - RNA, 21 nt, Mycobacterium avium subsp. paratuberculosis
gcgggggagccgugcagcgcc

SEQ ID NO: 1006027 - RNA, 19 nt, Mycobacterium avium subsp. paratuberculosis
gcgggggauccgccugcgc

SEQ ID NO: 1006028 - RNA, 13 nt, Mycobacterium avium subsp. paratuberculosis
gcgggggcggccu

SEQ ID NO: 1006029 - RNA, 14 nt, Mycobacterium avium subsp. paratuberculosis
gcgggggucggagc

SEQ ID NO: 1006030 - RNA, 12 nt, Mycobacterium avium subsp. paratuberculosis
gcgggcggcgcg

SEQ ID NO: 1006031 - RNA, 16 nt, Mycobacterium avium subsp. paratuberculosis
gcgggcggcggcuggg

SEQ ID NO: 1006032 - RNA, 16 nt, Mycobacterium avium subsp. paratuberculosis
gcgggcgggcggggga

SEQ ID NO: 1006033 - RNA, 13 nt, Mycobacterium avium subsp. paratuberculosis
gcgggcgggcuca

SEQ ID NO: 1006034 - RNA, 14 nt, Mycobacterium avium subsp. paratuberculosis
gcgggcggggcccg

SEQ ID NO: 1006035 - RNA, 16 nt, Mycobacterium avium subsp. paratuberculosis
gcgggcggcgcggcgc

SEQ ID NO: 1006036 - RNA, 17 nt, Mycobacterium avium subsp. paratuberculosis
gcgggcggcgcggcgca

SEQ ID NO: 1006037 - RNA, 17 nt, Mycobacterium avium subsp. paratuberculosis
gcgggcggcgcgguuga

SEQ ID NO: 1006038 - RNA, 22 nt, Mycobacterium avium subsp. paratuberculosis
gcgggcggcgaacaccagcacc

SEQ ID NO: 1006039 - RNA, 17 nt, Mycobacterium avium subsp. paratuberculosis
gcgggcggcaggucggc

SEQ ID NO: 1006040 - RNA, 19 nt, Mycobacterium avium subsp. paratuberculosis
gcgggcggcaucgcgccgc

SEQ ID NO: 1006041 - RNA, 22 nt, Mycobacterium avium subsp. paratuberculosis
gcgggcggcaucgcgccgcaug

SEQ ID NO: 1006042 - RNA, 23 nt, Mycobacterium avium subsp. paratuberculosis
gcgggcggcaucgcgccgcauga

SEQ ID NO: 1006043 - RNA, 18 nt, Mycobacterium avium subsp. paratuberculosis
gcgggcggccagccgcuc

SEQ ID NO: 1006044 - RNA, 13 nt, Mycobacterium avium subsp. paratuberculosis
gcggggcggcggc

SEQ ID NO: 1006045 - RNA, 17 nt, Mycobacterium avium subsp. paratuberculosis
gcggggcgcgaggcgcg

SEQ ID NO: 1006046 - RNA, 20 nt, Mycobacterium avium subsp. paratuberculosis
gcggggcggaugcgcuggug

SEQ ID NO: 1006047 - RNA, 15 nt, Mycobacterium avium subsp. paratuberculosis
gcggggcgaccuugc

SEQ ID NO: 1006048 - RNA, 14 nt, Mycobacterium avium subsp. paratuberculosis
gcggggcgaguuca

SEQ ID NO: 1006049 - RNA, 21 nt, Mycobacterium avium subsp. paratuberculosis
gcggggcaagcagcggcagcc

SEQ ID NO: 1006050 - RNA, 13 nt, Mycobacterium avium subsp. paratuberculosis
gcggggcagcagu

SEQ ID NO: 1006051 - RNA, 21 nt, Mycobacterium avium subsp. paratuberculosis
gcggggcauggugucaggauc

SEQ ID NO: 1006052 - RNA, 14 nt, Mycobacterium avium subsp. paratuberculosis
gcgggcggucgcgc

SEQ ID NO: 1006053 - RNA, 12 nt, Mycobacterium avium subsp. paratuberculosis
gcggggccggcg

SEQ ID NO: 1006054 - RNA, 20 nt, Mycobacterium avium subsp. paratuberculosis
gcggggccggcgcggugggc

SEQ ID NO: 1006055 - RNA, 14 nt, Mycobacterium avium subsp. paratuberculosis
gcggggccggcgcu

SEQ ID NO: 1006056 - RNA, 22 nt, Mycobacterium avium subsp. paratuberculosis
gcggcuucauaugacgccggcc

SEQ ID NO: 1006057 - RNA, 19 nt, Mycobacterium avium subsp. paratuberculosis
gcggcugucguagcggccc

SEQ ID NO: 1006058 - RNA, 14 nt, Mycobacterium avium subsp. paratuberculosis
gcgggauggguggu

SEQ ID NO: 1006059 - RNA, 20 nt, Mycobacterium avium subsp. paratuberculosis
gcgggaugcuuggucgcggc

SEQ ID NO: 1006060 - RNA, 15 nt, Mycobacterium avium subsp. paratuberculosis
gcgggaucgcggcgg

SEQ ID NO: 1006061 - RNA, 16 nt, Mycobacterium avium subsp. paratuberculosis
gcgggaucggccggcg

SEQ ID NO: 1006062 - RNA, 14 nt, Mycobacterium avium subsp. paratuberculosis
gcgggaucggugcc

SEQ ID NO: 1006063 - RNA, 19 nt, Mycobacterium avium subsp. paratuberculosis
gcggcugggcagccgcgcg

SEQ ID NO: 1006064 - RNA, 18 nt, Mycobacterium avium subsp. paratuberculosis
gcggcugggccgcggcgc

SEQ ID NO: 1006065 - RNA, 19 nt, Mycobacterium avium subsp. paratuberculosis
gcggcgccguuucggacga

SEQ ID NO: 1006066 - RNA, 14 nt, Mycobacterium avium subsp. paratuberculosis
gcggcgccugguca

SEQ ID NO: 1006067 - RNA, 13 nt, Mycobacterium avium subsp. paratuberculosis
gcggcgccgggca

SEQ ID NO: 1006068 - RNA, 13 nt, Mycobacterium avium subsp. paratuberculosis
gcggcgccgggcg

SEQ ID NO: 1006069 - RNA, 14 nt, Mycobacterium avium subsp. paratuberculosis
gcggcgccggggcu

SEQ ID NO: 1006070 - RNA, 12 nt, Mycobacterium avium subsp. paratuberculosis
gcggcgccgucg

SEQ ID NO: 1006071 - RNA, 20 nt, Mycobacterium avium subsp. paratuberculosis
gcggcgccgucgccgaucac

SEQ ID NO: 1006072 - RNA, 12 nt, Mycobacterium avium subsp. paratuberculosis
gcggcgccguug

SEQ ID NO: 1006073 - RNA, 15 nt, Mycobacterium avium subsp. paratuberculosis
gcggcgccgcccggc

SEQ ID NO: 1006074 - RNA, 16 nt, Mycobacterium avium subsp. paratuberculosis
gcggcgccgcccggcg

SEQ ID NO: 1006075 - RNA, 16 nt, Mycobacterium avium subsp. paratuberculosis
gcggcgccgcggcggc

SEQ ID NO: 1006076 - RNA, 18 nt, Mycobacterium avium subsp. paratuberculosis
gcggcgccgacgggcccg

SEQ ID NO: 1006077 - RNA, 19 nt, Mycobacterium avium subsp. paratuberculosis
gcggcgccgacgggcccgc

SEQ ID NO: 1006078 - RNA, 16 nt, Mycobacterium avium subsp. paratuberculosis
gcgggcaagggcaaag

SEQ ID NO: 1006079 - RNA, 19 nt, Mycobacterium avium subsp. paratuberculosis
gcgggcaaucgcugcgccc

SEQ ID NO: 1006080 - RNA, 17 nt, Mycobacterium avium subsp. paratuberculosis
gcgggcacacgcggucc

SEQ ID NO: 1006081 - RNA, 24 nt, Mycobacterium avium subsp. paratuberculosis
gcgggcaccgucgucgcaccggca

SEQ ID NO: 1006082 - RNA, 16 nt, Mycobacterium avium subsp. paratuberculosis
gcgggcaucggcuggu

SEQ ID NO: 1006083 - RNA, 23 nt, Mycobacterium avium subsp. paratuberculosis
gcgggcaucggcuggucggcggc

SEQ ID NO: 1006084 - RNA, 14 nt, Mycobacterium avium subsp. paratuberculosis
gcgggcaggcccga

SEQ ID NO: 1006085 - RNA, 15 nt, Mycobacterium avium subsp. paratuberculosis
gcgggcagggggacg

SEQ ID NO: 1006086 - RNA, 14 nt, Mycobacterium avium subsp. paratuberculosis
gcgggcacgccgcc

SEQ ID NO: 1006087 - RNA, 18 nt, Mycobacterium avium subsp. paratuberculosis
gcgggcacgccgccgcga

SEQ ID NO: 1006088 - RNA, 20 nt, Mycobacterium avium subsp. paratuberculosis
gcgggcacgucgcgcggggu

SEQ ID NO: 1006089 - RNA, 16 nt, Mycobacterium avium subsp. paratuberculosis
gcgggcagagcugcug

SEQ ID NO: 1006090 - RNA, 19 nt, Mycobacterium avium subsp. paratuberculosis
gcgggcacuuaacaccucg

SEQ ID NO: 1006091 - RNA, 13 nt, Mycobacterium avium subsp. paratuberculosis
gcgggcagccgcu

SEQ ID NO: 1006092 - RNA, 14 nt, Mycobacterium avium subsp. paratuberculosis
gcgggcagccgcuu

SEQ ID NO: 1006093 - RNA, 14 nt, Mycobacterium avium subsp. paratuberculosis
gcgggcagccggcg

SEQ ID NO: 1006094 - RNA, 19 nt, Mycobacterium avium subsp. paratuberculosis
gcgggcagccggcgcccgc

SEQ ID NO: 1006095 - RNA, 22 nt, Mycobacterium avium subsp. paratuberculosis
gcgggcaugaaccaggccgcgc

SEQ ID NO: 1006096 - RNA, 11 nt, Mycobacterium avium subsp. paratuberculosis
gcgggcccggg

SEQ ID NO: 1006097 - RNA, 17 nt, Mycobacterium avium subsp. paratuberculosis
gcgggcccgucgccggc

SEQ ID NO: 1006098 - RNA, 18 nt, Mycobacterium avium subsp. paratuberculosis
gcgggcccgucgccggcg

SEQ ID NO: 1006099 - RNA, 23 nt, Mycobacterium avium subsp. paratuberculosis
gcgggccgaaccggaagaucagc

SEQ ID NO: 1006100 - RNA, 23 nt, Mycobacterium avium subsp. paratuberculosis
gcgggccgacccggccgauggug

SEQ ID NO: 1006101 - RNA, 23 nt, Mycobacterium avium subsp. paratuberculosis
gcgggccgcaauacggugcccgc

SEQ ID NO: 1006102 - RNA, 14 nt, Mycobacterium avium subsp. paratuberculosis
gcgggccgcagcgc

SEQ ID NO: 1006103 - RNA, 21 nt, Mycobacterium avium subsp. paratuberculosis
gcgggccgcccggcgcgccgc

SEQ ID NO: 1006104 - RNA, 20 nt, Mycobacterium avium subsp. paratuberculosis
gcgggccgcuucgaggugca

SEQ ID NO: 1006105 - RNA, 15 nt, Mycobacterium avium subsp. paratuberculosis
gcgggccgccgggug

SEQ ID NO: 1006106 - RNA, 14 nt, Mycobacterium avium subsp. paratuberculosis
gcgggcgcggacag

SEQ ID NO: 1006107 - RNA, 12 nt, Mycobacterium avium subsp. paratuberculosis
gcgggcgcgcgc

SEQ ID NO: 1006108 - RNA, 14 nt, Mycobacterium avium subsp. paratuberculosis
gcgggcgcgccggc

SEQ ID NO: 1006109 - RNA, 22 nt, Mycobacterium avium subsp. paratuberculosis
gcgggcgcgccggcgcgcagcc

SEQ ID NO: 1006110 - RNA, 12 nt, Mycobacterium avium subsp. paratuberculosis
gcgggccucgcc

SEQ ID NO: 1006111 - RNA, 23 nt, Mycobacterium avium subsp. paratuberculosis
gcgggccuaggaccccggcugcu

SEQ ID NO: 1006112 - RNA, 17 nt, Mycobacterium avium subsp. paratuberculosis
gcgucuccggcgggcug

SEQ ID NO: 1006113 - RNA, 20 nt, Mycobacterium avium subsp. paratuberculosis
gcgucuccggcgggcuggug

SEQ ID NO: 1006114 - RNA, 18 nt, Mycobacterium avium subsp. paratuberculosis
gcgucucagucggccacc

SEQ ID NO: 1006115 - RNA, 19 nt, Mycobacterium avium subsp. paratuberculosis
gcgucucagucggccaccg

SEQ ID NO: 1006116 - RNA, 18 nt, Mycobacterium avium subsp. paratuberculosis
gcgucgucgucgagccgc

SEQ ID NO: 1006117 - RNA, 21 nt, Mycobacterium avium subsp. paratuberculosis
gcgucguugaacgcgcgggug

SEQ ID NO: 1006118 - RNA, 23 nt, Mycobacterium avium subsp. paratuberculosis
gcgucucgaucgacgacgccagc

SEQ ID NO: 1006119 - RNA, 16 nt, Mycobacterium avium subsp. paratuberculosis
gcgucucgccggggaa

SEQ ID NO: 1006120 - RNA, 22 nt, Mycobacterium avium subsp. paratuberculosis
gcgucucggcggccgagcgcac

SEQ ID NO: 1006121 - RNA, 20 nt, Mycobacterium avium subsp. paratuberculosis
gcgucuggcagccggccggc

SEQ ID NO: 1006122 - RNA, 19 nt, Mycobacterium avium subsp. paratuberculosis
gcgucugcgccagcugggu

SEQ ID NO: 1006123 - RNA, 16 nt, Mycobacterium avium subsp. paratuberculosis
gcgucugcgccccggc

SEQ ID NO: 1006124 - RNA, 17 nt, Mycobacterium avium subsp. paratuberculosis
gcgucugcucgccagac

SEQ ID NO: 1006125 - RNA, 15 nt, Mycobacterium avium subsp. paratuberculosis
gcgucugcucgccgg

SEQ ID NO: 1006126 - RNA, 16 nt, Mycobacterium avium subsp. paratuberculosis
gcgucugcucgccggc

SEQ ID NO: 1006127 - RNA, 15 nt, Mycobacterium avium subsp. paratuberculosis
gcgucugcugcgcca

SEQ ID NO: 1006128 - RNA, 22 nt, Mycobacterium avium subsp. paratuberculosis
gcgucgccgugccggaccgcgc

SEQ ID NO: 1006129 - RNA, 15 nt, Mycobacterium avium subsp. paratuberculosis
gcgucgcgcagcagc

SEQ ID NO: 1006130 - RNA, 16 nt, Mycobacterium avium subsp. paratuberculosis
gcgucgcgcagcagcg

SEQ ID NO: 1006131 - RNA, 14 nt, Mycobacterium avium subsp. paratuberculosis
gcgucgcgcccggc

SEQ ID NO: 1006132 - RNA, 14 nt, Mycobacterium avium subsp. paratuberculosis
gcgucgcgccgcca

SEQ ID NO: 1006133 - RNA, 23 nt, Mycobacterium avium subsp. paratuberculosis
gcgucgcgcgguuccggcgugca

SEQ ID NO: 1006134 - RNA, 13 nt, Mycobacterium avium subsp. paratuberculosis
gcgucgcggcggg

SEQ ID NO: 1006135 - RNA, 14 nt, Mycobacterium avium subsp. paratuberculosis
gcgucgcgggcccg

SEQ ID NO: 1006136 - RNA, 22 nt, Mycobacterium avium subsp. paratuberculosis
gcgucgcgggcccgggccaccc

SEQ ID NO: 1006137 - RNA, 15 nt, Mycobacterium avium subsp. paratuberculosis
gcgucgcgguggagc

SEQ ID NO: 1006138 - RNA, 17 nt, Mycobacterium avium subsp. paratuberculosis
gcgucgcgguggagcac

SEQ ID NO: 1006139 - RNA, 18 nt, Mycobacterium avium subsp. paratuberculosis
gcgucggaauacagcagc

SEQ ID NO: 1006140 - RNA, 18 nt, Mycobacterium avium subsp. paratuberculosis
gcgucggacaugccggcg

SEQ ID NO: 1006141 - RNA, 21 nt, Mycobacterium avium subsp. paratuberculosis
gcgucggacaugccggcgccg

SEQ ID NO: 1006142 - RNA, 22 nt, Mycobacterium avium subsp. paratuberculosis
gcgucggagaugcgggccaccg

SEQ ID NO: 1006143 - RNA, 18 nt, Mycobacterium avium subsp. paratuberculosis
gcgucggagucgcuguug

SEQ ID NO: 1006144 - RNA, 17 nt, Mycobacterium avium subsp. paratuberculosis
gcgucggcaccagcggc

SEQ ID NO: 1006145 - RNA, 13 nt, Mycobacterium avium subsp. paratuberculosis
gcgucggccgggg

SEQ ID NO: 1006146 - RNA, 12 nt, Mycobacterium avium subsp. paratuberculosis
gcgucggccugc

SEQ ID NO: 1006147 - RNA, 15 nt, Mycobacterium avium subsp. paratuberculosis
gcgucggccagcggc

SEQ ID NO: 1006148 - RNA, 19 nt, Mycobacterium avium subsp. paratuberculosis
gcgucguccgacaccaccu

SEQ ID NO: 1006149 - RNA, 12 nt, Mycobacterium avium subsp. paratuberculosis
gcgucguccaug

SEQ ID NO: 1006150 - RNA, 21 nt, Mycobacterium avium subsp. paratuberculosis
gcgucguccaugcccgcccac

SEQ ID NO: 1006151 - RNA, 20 nt, Mycobacterium avium subsp. paratuberculosis
gcgucguaguugcggccggc

SEQ ID NO: 1006152 - RNA, 21 nt, Mycobacterium avium subsp. paratuberculosis
gcgucguaguugcggccggcg

SEQ ID NO: 1006153 - RNA, 15 nt, Mycobacterium avium subsp. paratuberculosis
gcgucguacagcagc

SEQ ID NO: 1006154 - RNA, 16 nt, Mycobacterium avium subsp. paratuberculosis
gcgucguacagcagcc

SEQ ID NO: 1006155 - RNA, 20 nt, Mycobacterium avium subsp. paratuberculosis
gcgucguacagcagccccug

SEQ ID NO: 1006156 - RNA, 19 nt, Mycobacterium avium subsp. paratuberculosis
gcgucguaguaacgcgaga

SEQ ID NO: 1006157 - RNA, 22 nt, Mycobacterium avium subsp. paratuberculosis
gcgucguaguaacgcgagauga

SEQ ID NO: 1006158 - RNA, 18 nt, Mycobacterium avium subsp. paratuberculosis
gcgucguagucgcucggc

SEQ ID NO: 1006159 - RNA, 22 nt, Mycobacterium avium subsp. paratuberculosis
gcgucgugcaacucccgcgccg

SEQ ID NO: 1006160 - RNA, 23 nt, Mycobacterium avium subsp. paratuberculosis
gcgucgugcaacucccgcgccgc

SEQ ID NO: 1006161 - RNA, 23 nt, Mycobacterium avium subsp. paratuberculosis
gcgucgugccgagcgugaagcua

SEQ ID NO: 1006162 - RNA, 15 nt, Mycobacterium avium subsp. paratuberculosis
gcgucgugcggccgg

SEQ ID NO: 1006163 - RNA, 17 nt, Mycobacterium avium subsp. paratuberculosis
gcgucgugcggccggcg

SEQ ID NO: 1006164 - RNA, 21 nt, Mycobacterium avium subsp. paratuberculosis
gcgucgucgagcaccggcagc

SEQ ID NO: 1006165 - RNA, 18 nt, Mycobacterium avium subsp. paratuberculosis
gcgucggguagggcgccg

SEQ ID NO: 1006166 - RNA, 13 nt, Mycobacterium avium subsp. paratuberculosis
gcgucgggcgccg

SEQ ID NO: 1006167 - RNA, 15 nt, Mycobacterium avium subsp. paratuberculosis
gcgucgggcgccggc

SEQ ID NO: 1006168 - RNA, 15 nt, Mycobacterium avium subsp. paratuberculosis
gcgucggcggccugc

SEQ ID NO: 1006169 - RNA, 16 nt, Mycobacterium avium subsp. paratuberculosis
gcgucggcguccaugc

SEQ ID NO: 1006170 - RNA, 16 nt, Mycobacterium avium subsp. paratuberculosis
gcgucggcgucgggcg

SEQ ID NO: 1006171 - RNA, 15 nt, Mycobacterium avium subsp. paratuberculosis
gcgucggcgcgugcc

SEQ ID NO: 1006172 - RNA, 14 nt, Mycobacterium avium subsp. paratuberculosis
gcgucggcgcuggc

SEQ ID NO: 1006173 - RNA, 18 nt, Mycobacterium avium subsp. paratuberculosis
gcgucggcgcuggccagc

SEQ ID NO: 1006174 - RNA, 12 nt, Mycobacterium avium subsp. paratuberculosis
gcgucggcgcgc

SEQ ID NO: 1006175 - RNA, 17 nt, Mycobacterium avium subsp. paratuberculosis
gcgucggcgcgcaccgc

SEQ ID NO: 1006176 - RNA, 17 nt, Mycobacterium avium subsp. paratuberculosis
gcgucuuuucccacacg

SEQ ID NO: 1006177 - RNA, 23 nt, Mycobacterium avium subsp. paratuberculosis
gcgucuuuucccacacgcucggc

SEQ ID NO: 1006178 - RNA, 16 nt, Mycobacterium avium subsp. paratuberculosis
gcgucuuggaaagcgc

SEQ ID NO: 1006179 - RNA, 20 nt, Mycobacterium avium subsp. paratuberculosis
gcgugaauccucagcacggc

SEQ ID NO: 1006180 - RNA, 16 nt, Mycobacterium avium subsp. paratuberculosis
gcgugacaggggcagc

SEQ ID NO: 1006181 - RNA, 16 nt, Mycobacterium avium subsp. paratuberculosis
gcgugacuugucgggc

SEQ ID NO: 1006182 - RNA, 16 nt, Mycobacterium avium subsp. paratuberculosis
gcgugacgcucgccgg

SEQ ID NO: 1006183 - RNA, 17 nt, Mycobacterium avium subsp. paratuberculosis
gcgugacgcucgccggc

SEQ ID NO: 1006184 - RNA, 23 nt, Mycobacterium avium subsp. paratuberculosis
gcgugaccgggaaguagggcagc

SEQ ID NO: 1006185 - RNA, 19 nt, Mycobacterium avium subsp. paratuberculosis
gcgugaccucgacggugcu

SEQ ID NO: 1006186 - RNA, 22 nt, Mycobacterium avium subsp. paratuberculosis
gcgugaccccggcgaccagcag

SEQ ID NO: 1006187 - RNA, 15 nt, Mycobacterium avium subsp. paratuberculosis
gcgugacggccgcgg

SEQ ID NO: 1006188 - RNA, 18 nt, Mycobacterium avium subsp. paratuberculosis
gcgugaugacggcggcgg

SEQ ID NO: 1006189 - RNA, 16 nt, Mycobacterium avium subsp. paratuberculosis
gcgugaugcagcaggu

SEQ ID NO: 1006190 - RNA, 19 nt, Mycobacterium avium subsp. paratuberculosis
gcgugcacaggccgccgca

SEQ ID NO: 1006191 - RNA, 21 nt, Mycobacterium avium subsp. paratuberculosis
gcgugcaccugugaggcaccg

SEQ ID NO: 1006192 - RNA, 20 nt, Mycobacterium avium subsp. paratuberculosis
gcgugcacgaacgcggccag

SEQ ID NO: 1006193 - RNA, 21 nt, Mycobacterium avium subsp. paratuberculosis
gcgugcacgaacgcggccagc

SEQ ID NO: 1006194 - RNA, 15 nt, Mycobacterium avium subsp. paratuberculosis
gcgugaugggugggc

SEQ ID NO: 1006195 - RNA, 15 nt, Mycobacterium avium subsp. paratuberculosis
gcgugcccggccagc

SEQ ID NO: 1006196 - RNA, 12 nt, Mycobacterium avium subsp. paratuberculosis
gcgugcccggcg

SEQ ID NO: 1006197 - RNA, 13 nt, Mycobacterium avium subsp. paratuberculosis
gcgugcccgccga

SEQ ID NO: 1006198 - RNA, 13 nt, Mycobacterium avium subsp. paratuberculosis
gcgugcagcccgc

SEQ ID NO: 1006199 - RNA, 15 nt, Mycobacterium avium subsp. paratuberculosis
gcgugcagccgcaag

SEQ ID NO: 1006200 - RNA, 17 nt, Mycobacterium avium subsp. paratuberculosis
gcgugcagccgggcggc

SEQ ID NO: 1006201 - RNA, 19 nt, Mycobacterium avium subsp. paratuberculosis
gcgugcaggccgcgggugg

SEQ ID NO: 1006202 - RNA, 15 nt, Mycobacterium avium subsp. paratuberculosis
gcgugcggccgcagc

SEQ ID NO: 1006203 - RNA, 20 nt, Mycobacterium avium subsp. paratuberculosis
gcgugcggccucggcaccgu

SEQ ID NO: 1006204 - RNA, 14 nt, Mycobacterium avium subsp. paratuberculosis
gcgugcggcgcggu

SEQ ID NO: 1006205 - RNA, 15 nt, Mycobacterium avium subsp. paratuberculosis
gcgugcgcgugggug

SEQ ID NO: 1006206 - RNA, 13 nt, Mycobacterium avium subsp. paratuberculosis
gcgugcgcggccg

SEQ ID NO: 1006207 - RNA, 15 nt, Mycobacterium avium subsp. paratuberculosis
gcgugcggggugugc

SEQ ID NO: 1006208 - RNA, 20 nt, Mycobacterium avium subsp. paratuberculosis
gcgugcggguggccgggucg

SEQ ID NO: 1006209 - RNA, 17 nt, Mycobacterium avium subsp. paratuberculosis
gcgugcggucgcgggac

SEQ ID NO: 1006210 - RNA, 16 nt, Mycobacterium avium subsp. paratuberculosis
gcgugcgguggucggc

SEQ ID NO: 1006211 - RNA, 20 nt, Mycobacterium avium subsp. paratuberculosis
gcgugcgguuggcccgcggc

SEQ ID NO: 1006212 - RNA, 23 nt, Mycobacterium avium subsp. paratuberculosis
gcgugcgguuggcccgcggcgcc

SEQ ID NO: 1006213 - RNA, 17 nt, Mycobacterium avium subsp. paratuberculosis
gcgugcgaaugacgcgc

SEQ ID NO: 1006214 - RNA, 17 nt, Mycobacterium avium subsp. paratuberculosis
gcgugcgagccgagcac

SEQ ID NO: 1006215 - RNA, 16 nt, Mycobacterium avium subsp. paratuberculosis
gcgugccuugcaccca

SEQ ID NO: 1006216 - RNA, 12 nt, Mycobacterium avium subsp. paratuberculosis
gcgugccgccgg

SEQ ID NO: 1006217 - RNA, 17 nt, Mycobacterium avium subsp. paratuberculosis
gcgugccgcgcaccacc

SEQ ID NO: 1006218 - RNA, 12 nt, Mycobacterium avium subsp. paratuberculosis
gcgugccggccc

SEQ ID NO: 1006219 - RNA, 16 nt, Mycobacterium avium subsp. paratuberculosis
gcgugccggcccggcg

SEQ ID NO: 1006220 - RNA, 17 nt, Mycobacterium avium subsp. paratuberculosis
gcgugccggcccggcgg

SEQ ID NO: 1006221 - RNA, 22 nt, Mycobacterium avium subsp. paratuberculosis
gcgugccggcccggcgggucag

SEQ ID NO: 1006222 - RNA, 16 nt, Mycobacterium avium subsp. paratuberculosis
gcgugccggcggcgga

SEQ ID NO: 1006223 - RNA, 17 nt, Mycobacterium avium subsp. paratuberculosis
gcguggauggccggccg

SEQ ID NO: 1006224 - RNA, 20 nt, Mycobacterium avium subsp. paratuberculosis
gcguggacaccgcacccaga

SEQ ID NO: 1006225 - RNA, 18 nt, Mycobacterium avium subsp. paratuberculosis
gcguggcagcggucggcg

SEQ ID NO: 1006226 - RNA, 15 nt, Mycobacterium avium subsp. paratuberculosis
gcguggcccagccgg

SEQ ID NO: 1006227 - RNA, 20 nt, Mycobacterium avium subsp. paratuberculosis
gcgugcuugaacgccgcccc

SEQ ID NO: 1006228 - RNA, 16 nt, Mycobacterium avium subsp. paratuberculosis
gcgugcuccagcaggc

SEQ ID NO: 1006229 - RNA, 18 nt, Mycobacterium avium subsp. paratuberculosis
gcgugcugaugcuguucg

SEQ ID NO: 1006230 - RNA, 15 nt, Mycobacterium avium subsp. paratuberculosis
gcgugcugcgcagca

SEQ ID NO: 1006231 - RNA, 19 nt, Mycobacterium avium subsp. paratuberculosis
gcguaucaacugagcgccc

SEQ ID NO: 1006232 - RNA, 19 nt, Mycobacterium avium subsp. paratuberculosis
gcguagugggucggcggcu

SEQ ID NO: 1006233 - RNA, 17 nt, Mycobacterium avium subsp. paratuberculosis
gcguagucggugcagug

SEQ ID NO: 1006234 - RNA, 15 nt, Mycobacterium avium subsp. paratuberculosis
gcguaugccuccucg

SEQ ID NO: 1006235 - RNA, 19 nt, Mycobacterium avium subsp. paratuberculosis
gcguauugcacggcggcga

SEQ ID NO: 1006236 - RNA, 14 nt, Mycobacterium avium subsp. paratuberculosis
gcguaggacagcag

SEQ ID NO: 1006237 - RNA, 15 nt, Mycobacterium avium subsp. paratuberculosis
gcguaggacagcagc

SEQ ID NO: 1006238 - RNA, 20 nt, Mycobacterium avium subsp. paratuberculosis
gcguaggacagcagccgcuc

SEQ ID NO: 1006239 - RNA, 18 nt, Mycobacterium avium subsp. paratuberculosis
gcguaggccuugcugagc

SEQ ID NO: 1006240 - RNA, 14 nt, Mycobacterium avium subsp. paratuberculosis
gcguaguccagcac

SEQ ID NO: 1006241 - RNA, 21 nt, Mycobacterium avium subsp. paratuberculosis
gcguaggugggcagcgcggcc

SEQ ID NO: 1006242 - RNA, 23 nt, Mycobacterium avium subsp. paratuberculosis
gcguacgcgauggcggcgcgcuc

SEQ ID NO: 1006243 - RNA, 15 nt, Mycobacterium avium subsp. paratuberculosis
gcguacuucgcgccc

SEQ ID NO: 1006244 - RNA, 18 nt, Mycobacterium avium subsp. paratuberculosis
gcgucaucacgugcuggc

SEQ ID NO: 1006245 - RNA, 15 nt, Mycobacterium avium subsp. paratuberculosis
gcgucaggcgcuggg

SEQ ID NO: 1006246 - RNA, 18 nt, Mycobacterium avium subsp. paratuberculosis
gcgucaggcgcugggugc

SEQ ID NO: 1006247 - RNA, 19 nt, Mycobacterium avium subsp. paratuberculosis
gcgucagggguuggcgcgc

SEQ ID NO: 1006248 - RNA, 19 nt, Mycobacterium avium subsp. paratuberculosis
gcgucaggucaccgagcgg

SEQ ID NO: 1006249 - RNA, 15 nt, Mycobacterium avium subsp. paratuberculosis
gcgucagcaucgccg

SEQ ID NO: 1006250 - RNA, 16 nt, Mycobacterium avium subsp. paratuberculosis
gcgucaggauggugaa

SEQ ID NO: 1006251 - RNA, 14 nt, Mycobacterium avium subsp. paratuberculosis
gcgucagcggcggg

SEQ ID NO: 1006252 - RNA, 15 nt, Mycobacterium avium subsp. paratuberculosis
gcgucacgucggccu

SEQ ID NO: 1006253 - RNA, 13 nt, Mycobacterium avium subsp. paratuberculosis
gcgucacgcuggc

SEQ ID NO: 1006254 - RNA, 14 nt, Mycobacterium avium subsp. paratuberculosis
gcgucacgcuggcg

SEQ ID NO: 1006255 - RNA, 18 nt, Mycobacterium avium subsp. paratuberculosis
gcgucacgcuggcguggc

SEQ ID NO: 1006256 - RNA, 14 nt, Mycobacterium avium subsp. paratuberculosis
gcgucacgcuggug

SEQ ID NO: 1006257 - RNA, 15 nt, Mycobacterium avium subsp. paratuberculosis
gcgucacgcugguga

SEQ ID NO: 1006258 - RNA, 15 nt, Mycobacterium avium subsp. paratuberculosis
gcgucagcagcgcga

SEQ ID NO: 1006259 - RNA, 17 nt, Mycobacterium avium subsp. paratuberculosis
gcgucacucuggcguga

SEQ ID NO: 1006260 - RNA, 22 nt, Mycobacterium avium subsp. paratuberculosis
gcgucagaaccggggccagcac

SEQ ID NO: 1006261 - RNA, 20 nt, Mycobacterium avium subsp. paratuberculosis
gcgucaccccaccgagcagc

SEQ ID NO: 1006262 - RNA, 17 nt, Mycobacterium avium subsp. paratuberculosis
gcgucacgcaucagggc

SEQ ID NO: 1006263 - RNA, 20 nt, Mycobacterium avium subsp. paratuberculosis
gcgucacccuggaacuuguu

SEQ ID NO: 1006264 - RNA, 15 nt, Mycobacterium avium subsp. paratuberculosis
gcgucaccgcgggug

SEQ ID NO: 1006265 - RNA, 15 nt, Mycobacterium avium subsp. paratuberculosis
gcgucaacggcuugc

SEQ ID NO: 1006266 - RNA, 19 nt, Mycobacterium avium subsp. paratuberculosis
gcgucaccaaugcgccggc

SEQ ID NO: 1006267 - RNA, 18 nt, Mycobacterium avium subsp. paratuberculosis
gcgucacauacgccucac

SEQ ID NO: 1006268 - RNA, 14 nt, Mycobacterium avium subsp. paratuberculosis
gcguccggcccggc

SEQ ID NO: 1006269 - RNA, 17 nt, Mycobacterium avium subsp. paratuberculosis
gcguccggucugcuccg

SEQ ID NO: 1006270 - RNA, 18 nt, Mycobacterium avium subsp. paratuberculosis
gcguccugcagcagccgg

SEQ ID NO: 1006271 - RNA, 15 nt, Mycobacterium avium subsp. paratuberculosis
gcguccugcaggcag

SEQ ID NO: 1006272 - RNA, 15 nt, Mycobacterium avium subsp. paratuberculosis
gcguccugcggggag

SEQ ID NO: 1006273 - RNA, 12 nt, Mycobacterium avium subsp. paratuberculosis
gcguccuccucg

SEQ ID NO: 1006274 - RNA, 19 nt, Mycobacterium avium subsp. paratuberculosis
gcguccucgacgccgcgca

SEQ ID NO: 1006275 - RNA, 18 nt, Mycobacterium avium subsp. paratuberculosis
gcgucgaaauagcggcgc

SEQ ID NO: 1006276 - RNA, 23 nt, Mycobacterium avium subsp. paratuberculosis
gcguccuugaacuucagcugcuc

SEQ ID NO: 1006277 - RNA, 22 nt, Mycobacterium avium subsp. paratuberculosis
gcgucgaacgggccgggcaccg

SEQ ID NO: 1006278 - RNA, 23 nt, Mycobacterium avium subsp. paratuberculosis
gcguccucgccguacgcgccggc

SEQ ID NO: 1006279 - RNA, 18 nt, Mycobacterium avium subsp. paratuberculosis
gcgucgaacagccgggcc

SEQ ID NO: 1006280 - RNA, 15 nt, Mycobacterium avium subsp. paratuberculosis
gcgucgaagcgcaug

SEQ ID NO: 1006281 - RNA, 21 nt, Mycobacterium avium subsp. paratuberculosis
gcgucgaccaccgccggcccg

SEQ ID NO: 1006282 - RNA, 23 nt, Mycobacterium avium subsp. paratuberculosis
gcgucgaccaccgccggcccggc

SEQ ID NO: 1006283 - RNA, 16 nt, Mycobacterium avium subsp. paratuberculosis
gcgucgaccagccggu

SEQ ID NO: 1006284 - RNA, 14 nt, Mycobacterium avium subsp. paratuberculosis
gcgucgaccgcccc

SEQ ID NO: 1006285 - RNA, 19 nt, Mycobacterium avium subsp. paratuberculosis
gcgucgaccgccccgccgg

SEQ ID NO: 1006286 - RNA, 20 nt, Mycobacterium avium subsp. paratuberculosis
gcgucgaccgccgcgaacgg

SEQ ID NO: 1006287 - RNA, 20 nt, Mycobacterium avium subsp. paratuberculosis
gcgucgacaccccgcucggc

SEQ ID NO: 1006288 - RNA, 17 nt, Mycobacterium avium subsp. paratuberculosis
gcgucgacagccggucg

SEQ ID NO: 1006289 - RNA, 20 nt, Mycobacterium avium subsp. paratuberculosis
gcgucgccagccgccggcuc

SEQ ID NO: 1006290 - RNA, 18 nt, Mycobacterium avium subsp. paratuberculosis
gcgucgcccaucaccagc

SEQ ID NO: 1006291 - RNA, 15 nt, Mycobacterium avium subsp. paratuberculosis
gcgucgccgacgggc

SEQ ID NO: 1006292 - RNA, 16 nt, Mycobacterium avium subsp. paratuberculosis
gcgucgccgacgggcc

SEQ ID NO: 1006293 - RNA, 20 nt, Mycobacterium avium subsp. paratuberculosis
gcgucgccgacgggcccagc

SEQ ID NO: 1006294 - RNA, 12 nt, Mycobacterium avium subsp. paratuberculosis
gcgucgccgccg

SEQ ID NO: 1006295 - RNA, 20 nt, Mycobacterium avium subsp. paratuberculosis
gcgucgccaauccggcgggc

SEQ ID NO: 1006296 - RNA, 21 nt, Mycobacterium avium subsp. paratuberculosis
gcgucgccaauccggcgggcc

SEQ ID NO: 1006297 - RNA, 15 nt, Mycobacterium avium subsp. paratuberculosis
gcgucgccaccaccu

SEQ ID NO: 1006298 - RNA, 17 nt, Mycobacterium avium subsp. paratuberculosis
gcgucgccaccaccuuc

SEQ ID NO: 1006299 - RNA, 18 nt, Mycobacterium avium subsp. paratuberculosis
gcgucgaugucgcccggc

SEQ ID NO: 1006300 - RNA, 21 nt, Mycobacterium avium subsp. paratuberculosis
gcgucgcagaucccgccggcg

SEQ ID NO: 1006301 - RNA, 23 nt, Mycobacterium avium subsp. paratuberculosis
gcgucgaugaugccggcggacag

SEQ ID NO: 1006302 - RNA, 15 nt, Mycobacterium avium subsp. paratuberculosis
gcgucgaugccggcg

SEQ ID NO: 1006303 - RNA, 14 nt, Mycobacterium avium subsp. paratuberculosis
gcgucgaugcgcgc

SEQ ID NO: 1006304 - RNA, 20 nt, Mycobacterium avium subsp. paratuberculosis
gcgucgauggaaggugcuga

SEQ ID NO: 1006305 - RNA, 21 nt, Mycobacterium avium subsp. paratuberculosis
gcgucgagcguggggccuggg

SEQ ID NO: 1006306 - RNA, 22 nt, Mycobacterium avium subsp. paratuberculosis
gcgucgacgauggucuggauga

SEQ ID NO: 1006307 - RNA, 18 nt, Mycobacterium avium subsp. paratuberculosis
gcgucgacgucgggcacg

SEQ ID NO: 1006308 - RNA, 23 nt, Mycobacterium avium subsp. paratuberculosis
gcguccaugcucuugcgggcggc

SEQ ID NO: 1006309 - RNA, 16 nt, Mycobacterium avium subsp. paratuberculosis
gcguccauggucgagc

SEQ ID NO: 1006310 - RNA, 19 nt, Mycobacterium avium subsp. paratuberculosis
gcguccauggucgagccgc

SEQ ID NO: 1006311 - RNA, 21 nt, Mycobacterium avium subsp. paratuberculosis
gcguccauguaguucagcagc

SEQ ID NO: 1006312 - RNA, 15 nt, Mycobacterium avium subsp. paratuberculosis
gcgucccguccuugg

SEQ ID NO: 1006313 - RNA, 17 nt, Mycobacterium avium subsp. paratuberculosis
gcgucccgucggccagu

SEQ ID NO: 1006314 - RNA, 17 nt, Mycobacterium avium subsp. paratuberculosis
gcgucccguuggcgccg

SEQ ID NO: 1006315 - RNA, 20 nt, Mycobacterium avium subsp. paratuberculosis
gcguccgagaagggccgccg

SEQ ID NO: 1006316 - RNA, 21 nt, Mycobacterium avium subsp. paratuberculosis
gcguccgagaagggccgccgc

SEQ ID NO: 1006317 - RNA, 19 nt, Mycobacterium avium subsp. paratuberculosis
gcguccgagcagcagccgc

SEQ ID NO: 1006318 - RNA, 20 nt, Mycobacterium avium subsp. paratuberculosis
gcguccgauaccagccgcgg

SEQ ID NO: 1006319 - RNA, 13 nt, Mycobacterium avium subsp. paratuberculosis
gcguccgcgggcg

SEQ ID NO: 1006320 - RNA, 17 nt, Mycobacterium avium subsp. paratuberculosis
gcguccgcgggcggggc

SEQ ID NO: 1006321 - RNA, 18 nt, Mycobacterium avium subsp. paratuberculosis
gcguccagcugcgcgccg

SEQ ID NO: 1006322 - RNA, 20 nt, Mycobacterium avium subsp. paratuberculosis
gcguccagcugcgcgccggc

SEQ ID NO: 1006323 - RNA, 20 nt, Mycobacterium avium subsp. paratuberculosis
gcguccagcgcggugagcag

SEQ ID NO: 1006324 - RNA, 23 nt, Mycobacterium avium subsp. paratuberculosis
gcguccagcggguugccgcuggc

SEQ ID NO: 1006325 - RNA, 16 nt, Mycobacterium avium subsp. paratuberculosis
gcguccaggugcgccg

SEQ ID NO: 1006326 - RNA, 16 nt, Mycobacterium avium subsp. paratuberculosis
gcguccagggccaccg

SEQ ID NO: 1006327 - RNA, 17 nt, Mycobacterium avium subsp. paratuberculosis
gcguccagcaccugcuc

SEQ ID NO: 1006328 - RNA, 19 nt, Mycobacterium avium subsp. paratuberculosis
gcgucaucgacuugccgcc

SEQ ID NO: 1006329 - RNA, 17 nt, Mycobacterium avium subsp. paratuberculosis
gcgcuugucagcggccu

SEQ ID NO: 1006330 - RNA, 17 nt, Mycobacterium avium subsp. paratuberculosis
gcgcuugucgcagaccc

SEQ ID NO: 1006331 - RNA, 15 nt, Mycobacterium avium subsp. paratuberculosis
gcgcuugucggcgug

SEQ ID NO: 1006332 - RNA, 17 nt, Mycobacterium avium subsp. paratuberculosis
gcgcuuucccugcucga

SEQ ID NO: 1006333 - RNA, 16 nt, Mycobacterium avium subsp. paratuberculosis
gcggaauucgcgggug

SEQ ID NO: 1006334 - RNA, 21 nt, Mycobacterium avium subsp. paratuberculosis
gcggaauucgcgggugcgcuc

SEQ ID NO: 1006335 - RNA, 22 nt, Mycobacterium avium subsp. paratuberculosis
gcggaaugaacgcggccagggu

SEQ ID NO: 1006336 - RNA, 15 nt, Mycobacterium avium subsp. paratuberculosis
gcggacacgcggacc

SEQ ID NO: 1006337 - RNA, 23 nt, Mycobacterium avium subsp. paratuberculosis
gcggacucguuggggccaccaga

SEQ ID NO: 1006338 - RNA, 19 nt, Mycobacterium avium subsp. paratuberculosis
gcggacagccccgagccgc

SEQ ID NO: 1006339 - RNA, 15 nt, Mycobacterium avium subsp. paratuberculosis
gcggacagcgcggug

SEQ ID NO: 1006340 - RNA, 17 nt, Mycobacterium avium subsp. paratuberculosis
gcggacagcugcgcggg

SEQ ID NO: 1006341 - RNA, 15 nt, Mycobacterium avium subsp. paratuberculosis
gcggacagggcggcg

SEQ ID NO: 1006342 - RNA, 15 nt, Mycobacterium avium subsp. paratuberculosis
gcgcuugaccucgcc

SEQ ID NO: 1006343 - RNA, 16 nt, Mycobacterium avium subsp. paratuberculosis
gcgcuugcggcgcagc

SEQ ID NO: 1006344 - RNA, 17 nt, Mycobacterium avium subsp. paratuberculosis
gcgcuugcggcgcagcc

SEQ ID NO: 1006345 - RNA, 23 nt, Mycobacterium avium subsp. paratuberculosis
gcgcuugcguucccagcccggcc

SEQ ID NO: 1006346 - RNA, 15 nt, Mycobacterium avium subsp. paratuberculosis
gcgcugaccaggccg

SEQ ID NO: 1006347 - RNA, 23 nt, Mycobacterium avium subsp. paratuberculosis
gcgcugaacgcggugggcaccag

SEQ ID NO: 1006348 - RNA, 15 nt, Mycobacterium avium subsp. paratuberculosis
gcgcucuugggcggc

SEQ ID NO: 1006349 - RNA, 16 nt, Mycobacterium avium subsp. paratuberculosis
gcgcucuugggcggcc

SEQ ID NO: 1006350 - RNA, 17 nt, Mycobacterium avium subsp. paratuberculosis
gcgcucuugggcggccg

SEQ ID NO: 1006351 - RNA, 16 nt, Mycobacterium avium subsp. paratuberculosis
gcgcuccugccagcgg

SEQ ID NO: 1006352 - RNA, 17 nt, Mycobacterium avium subsp. paratuberculosis
gcgcuccugccagcggc

SEQ ID NO: 1006353 - RNA, 19 nt, Mycobacterium avium subsp. paratuberculosis
gcgcuccugccagcggcgc

SEQ ID NO: 1006354 - RNA, 18 nt, Mycobacterium avium subsp. paratuberculosis
gcggaugccggaggcgcc

SEQ ID NO: 1006355 - RNA, 13 nt, Mycobacterium avium subsp. paratuberculosis
gcggaugucggug

SEQ ID NO: 1006356 - RNA, 13 nt, Mycobacterium avium subsp. paratuberculosis
gcggaugugccug

SEQ ID NO: 1006357 - RNA, 16 nt, Mycobacterium avium subsp. paratuberculosis
gcggauguggaggcga

SEQ ID NO: 1006358 - RNA, 13 nt, Mycobacterium avium subsp. paratuberculosis
gcggauggccucg

SEQ ID NO: 1006359 - RNA, 14 nt, Mycobacterium avium subsp. paratuberculosis
gcggauggcgcccu

SEQ ID NO: 1006360 - RNA, 15 nt, Mycobacterium avium subsp. paratuberculosis
gcggcaaggcgcaga

SEQ ID NO: 1006361 - RNA, 14 nt, Mycobacterium avium subsp. paratuberculosis
gcggcagcacaccu

SEQ ID NO: 1006362 - RNA, 17 nt, Mycobacterium avium subsp. paratuberculosis
gcggcagcacaccuucc

SEQ ID NO: 1006363 - RNA, 20 nt, Mycobacterium avium subsp. paratuberculosis
gcggcagcagcugcgucggc

SEQ ID NO: 1006364 - RNA, 16 nt, Mycobacterium avium subsp. paratuberculosis
gcggcaccagcccgcc

SEQ ID NO: 1006365 - RNA, 18 nt, Mycobacterium avium subsp. paratuberculosis
gcggcacaccagcguucg

SEQ ID NO: 1006366 - RNA, 19 nt, Mycobacterium avium subsp. paratuberculosis
gcggauacgcccggccacc

SEQ ID NO: 1006367 - RNA, 20 nt, Mycobacterium avium subsp. paratuberculosis
gcggaugaagugcgccagcg

SEQ ID NO: 1006368 - RNA, 20 nt, Mycobacterium avium subsp. paratuberculosis
gcggaucuucuccgccacau

SEQ ID NO: 1006369 - RNA, 21 nt, Mycobacterium avium subsp. paratuberculosis
gcggaucuucucgcugcucug

SEQ ID NO: 1006370 - RNA, 16 nt, Mycobacterium avium subsp. paratuberculosis
gcggaucaggucgguc

SEQ ID NO: 1006371 - RNA, 16 nt, Mycobacterium avium subsp. paratuberculosis
gcggaucaugcgcguc

SEQ ID NO: 1006372 - RNA, 14 nt, Mycobacterium avium subsp. paratuberculosis
gcggaucagcaccg

SEQ ID NO: 1006373 - RNA, 15 nt, Mycobacterium avium subsp. paratuberculosis
gcggaggucagcggc

SEQ ID NO: 1006374 - RNA, 14 nt, Mycobacterium avium subsp. paratuberculosis
gcggaguaggcgcc

SEQ ID NO: 1006375 - RNA, 16 nt, Mycobacterium avium subsp. paratuberculosis
gcggaguaggcgccgc

SEQ ID NO: 1006376 - RNA, 20 nt, Mycobacterium avium subsp. paratuberculosis
gcggaggaauucgccgacgc

SEQ ID NO: 1006377 - RNA, 18 nt, Mycobacterium avium subsp. paratuberculosis
gcggaggccugcgcggcc

SEQ ID NO: 1006378 - RNA, 15 nt, Mycobacterium avium subsp. paratuberculosis
gcggaggcgagcagc

SEQ ID NO: 1006379 - RNA, 16 nt, Mycobacterium avium subsp. paratuberculosis
gcggagaugacgugga

SEQ ID NO: 1006380 - RNA, 13 nt, Mycobacterium avium subsp. paratuberculosis
gcggagaugcugg

SEQ ID NO: 1006381 - RNA, 23 nt, Mycobacterium avium subsp. paratuberculosis
gcggcgacggcgucggcggccug

SEQ ID NO: 1006382 - RNA, 16 nt, Mycobacterium avium subsp. paratuberculosis
gcggcgagcagcgcga

SEQ ID NO: 1006383 - RNA, 15 nt, Mycobacterium avium subsp. paratuberculosis
gcggcgagccggccg

SEQ ID NO: 1006384 - RNA, 23 nt, Mycobacterium avium subsp. paratuberculosis
gcggcgacgguguccgcggcguc

SEQ ID NO: 1006385 - RNA, 22 nt, Mycobacterium avium subsp. paratuberculosis
gcggcgacgugaucggcggccu

SEQ ID NO: 1006386 - RNA, 23 nt, Mycobacterium avium subsp. paratuberculosis
gcggcgacgugaucggcggccug

SEQ ID NO: 1006387 - RNA, 20 nt, Mycobacterium avium subsp. paratuberculosis
gcggcgacgugccggcggca

SEQ ID NO: 1006388 - RNA, 17 nt, Mycobacterium avium subsp. paratuberculosis
gcggcgacuccagcagc

SEQ ID NO: 1006389 - RNA, 23 nt, Mycobacterium avium subsp. paratuberculosis
gcggcgacuccagcagcgccagc

SEQ ID NO: 1006390 - RNA, 22 nt, Mycobacterium avium subsp. paratuberculosis
gcggcgaagacgucggcgcggu

SEQ ID NO: 1006391 - RNA, 15 nt, Mycobacterium avium subsp. paratuberculosis
gcggcgaaccagcau

SEQ ID NO: 1006392 - RNA, 15 nt, Mycobacterium avium subsp. paratuberculosis
gcggcgacacccagc

SEQ ID NO: 1006393 - RNA, 15 nt, Mycobacterium avium subsp. paratuberculosis
gcggcgacacgccga

SEQ ID NO: 1006394 - RNA, 13 nt, Mycobacterium avium subsp. paratuberculosis
gcggcgacccgcu

SEQ ID NO: 1006395 - RNA, 15 nt, Mycobacterium avium subsp. paratuberculosis
gcggcgaccggggcg

SEQ ID NO: 1006396 - RNA, 17 nt, Mycobacterium avium subsp. paratuberculosis
gcggcgaccggggcggu

SEQ ID NO: 1006397 - RNA, 21 nt, Mycobacterium avium subsp. paratuberculosis
gcggcgaucaccgccgcggcg

SEQ ID NO: 1006398 - RNA, 23 nt, Mycobacterium avium subsp. paratuberculosis
gcggcgagucccggcgcaccagg

SEQ ID NO: 1006399 - RNA, 19 nt, Mycobacterium avium subsp. paratuberculosis
gcggcgaguucggcggccc

SEQ ID NO: 1006400 - RNA, 20 nt, Mycobacterium avium subsp. paratuberculosis
gcggcgaguucggcggcccg

SEQ ID NO: 1006401 - RNA, 15 nt, Mycobacterium avium subsp. paratuberculosis
gcggcgauccggccg

SEQ ID NO: 1006402 - RNA, 18 nt, Mycobacterium avium subsp. paratuberculosis
gcggcgauccggccggcg

SEQ ID NO: 1006403 - RNA, 22 nt, Mycobacterium avium subsp. paratuberculosis
gcggcgauccggccggcggcgg

SEQ ID NO: 1006404 - RNA, 23 nt, Mycobacterium avium subsp. paratuberculosis
gcggcgauccggccggcggcggu

SEQ ID NO: 1006405 - RNA, 16 nt, Mycobacterium avium subsp. paratuberculosis
gcggcgaucagcagca

SEQ ID NO: 1006406 - RNA, 21 nt, Mycobacterium avium subsp. paratuberculosis
gcggcgaucagcagcacccgg

SEQ ID NO: 1006407 - RNA, 21 nt, Mycobacterium avium subsp. paratuberculosis
gcggcgaucagcccggcccgc

SEQ ID NO: 1006408 - RNA, 16 nt, Mycobacterium avium subsp. paratuberculosis
gcggcgaugcgcggcc

SEQ ID NO: 1006409 - RNA, 17 nt, Mycobacterium avium subsp. paratuberculosis
gcggcgaugcgcggccc

SEQ ID NO: 1006410 - RNA, 22 nt, Mycobacterium avium subsp. paratuberculosis
gcggcgauggacguccagcggc

SEQ ID NO: 1006411 - RNA, 20 nt, Mycobacterium avium subsp. paratuberculosis
gcggcgauggugggcagccg

SEQ ID NO: 1006412 - RNA, 21 nt, Mycobacterium avium subsp. paratuberculosis
gcggcgauggugggcagccgg

SEQ ID NO: 1006413 - RNA, 17 nt, Mycobacterium avium subsp. paratuberculosis
gcggcgaucagcugcuc

SEQ ID NO: 1006414 - RNA, 20 nt, Mycobacterium avium subsp. paratuberculosis
gcggcgcaaccaacucgcga

SEQ ID NO: 1006415 - RNA, 24 nt, Mycobacterium avium subsp. paratuberculosis
gcggcgaucuuugcggccguggcg

SEQ ID NO: 1006416 - RNA, 22 nt, Mycobacterium avium subsp. paratuberculosis
gcggcgaugaagccccggaccg

SEQ ID NO: 1006417 - RNA, 15 nt, Mycobacterium avium subsp. paratuberculosis
gcggcgaugaccgga

SEQ ID NO: 1006418 - RNA, 20 nt, Mycobacterium avium subsp. paratuberculosis
gcggcgaugauccgcggcgc

SEQ ID NO: 1006419 - RNA, 21 nt, Mycobacterium avium subsp. paratuberculosis
gcggcgaugauccgcggcgcc

SEQ ID NO: 1006420 - RNA, 19 nt, Mycobacterium avium subsp. paratuberculosis
gcggcgaucucggcggccg

SEQ ID NO: 1006421 - RNA, 18 nt, Mycobacterium avium subsp. paratuberculosis
gcggcgaucgcgagcagg

SEQ ID NO: 1006422 - RNA, 19 nt, Mycobacterium avium subsp. paratuberculosis
gcggccuucuuggccggag

SEQ ID NO: 1006423 - RNA, 23 nt, Mycobacterium avium subsp. paratuberculosis
gcggccuucuuggccggagccuu

SEQ ID NO: 1006424 - RNA, 23 nt, Mycobacterium avium subsp. paratuberculosis
gcggccuugacgaguuccaccuc

SEQ ID NO: 1006425 - RNA, 17 nt, Mycobacterium avium subsp. paratuberculosis
gcggccuugcgagccgg

SEQ ID NO: 1006426 - RNA, 15 nt, Mycobacterium avium subsp. paratuberculosis
gcggccucggcaccg

SEQ ID NO: 1006427 - RNA, 21 nt, Mycobacterium avium subsp. paratuberculosis
gcggccuuuuucugcgcccga

SEQ ID NO: 1006428 - RNA, 20 nt, Mycobacterium avium subsp. paratuberculosis
gcggcgaaaacgccugcgcc

SEQ ID NO: 1006429 - RNA, 19 nt, Mycobacterium avium subsp. paratuberculosis
gcggcgaaaucgcuccucg

SEQ ID NO: 1006430 - RNA, 15 nt, Mycobacterium avium subsp. paratuberculosis
gcggcgaacaccagc

SEQ ID NO: 1006431 - RNA, 18 nt, Mycobacterium avium subsp. paratuberculosis
gcggcgaacaccagcacc

SEQ ID NO: 1006432 - RNA, 16 nt, Mycobacterium avium subsp. paratuberculosis
gcggcgaacccgagca

SEQ ID NO: 1006433 - RNA, 15 nt, Mycobacterium avium subsp. paratuberculosis
gcggcgaaccgggcc

SEQ ID NO: 1006434 - RNA, 17 nt, Mycobacterium avium subsp. paratuberculosis
gcggcgaacgccgccgu

SEQ ID NO: 1006435 - RNA, 18 nt, Mycobacterium avium subsp. paratuberculosis
gcggcgaacgccgccgug

SEQ ID NO: 1006436 - RNA, 16 nt, Mycobacterium avium subsp. paratuberculosis
gcggcgaacgcgcggu

SEQ ID NO: 1006437 - RNA, 15 nt, Mycobacterium avium subsp. paratuberculosis
gcggccugccggccg

SEQ ID NO: 1006438 - RNA, 15 nt, Mycobacterium avium subsp. paratuberculosis
gcggccugcggcggc

SEQ ID NO: 1006439 - RNA, 17 nt, Mycobacterium avium subsp. paratuberculosis
gcggccugcgggcgccg

SEQ ID NO: 1006440 - RNA, 12 nt, Mycobacterium avium subsp. paratuberculosis
gcggccugagcc

SEQ ID NO: 1006441 - RNA, 18 nt, Mycobacterium avium subsp. paratuberculosis
gcggccugcacaggggcg

SEQ ID NO: 1006442 - RNA, 13 nt, Mycobacterium avium subsp. paratuberculosis
gcggccugcagca

SEQ ID NO: 1006443 - RNA, 23 nt, Mycobacterium avium subsp. paratuberculosis
gcggccuccagccgcuccgcggc

SEQ ID NO: 1006444 - RNA, 21 nt, Mycobacterium avium subsp. paratuberculosis
gcggccuccgagcggcgcagg

SEQ ID NO: 1006445 - RNA, 23 nt, Mycobacterium avium subsp. paratuberculosis
gcggccuccgagcggcgcaggcc

SEQ ID NO: 1006446 - RNA, 21 nt, Mycobacterium avium subsp. paratuberculosis
gcggccuccgccaccuccucc

SEQ ID NO: 1006447 - RNA, 15 nt, Mycobacterium avium subsp. paratuberculosis
gcggccucaccgcgg

SEQ ID NO: 1006448 - RNA, 18 nt, Mycobacterium avium subsp. paratuberculosis
gcggccucaccgcgggcc

SEQ ID NO: 1006449 - RNA, 16 nt, Mycobacterium avium subsp. paratuberculosis
gcggccuaggacgccg

SEQ ID NO: 1006450 - RNA, 21 nt, Mycobacterium avium subsp. paratuberculosis
gcggccuaggacgccgcccuc

SEQ ID NO: 1006451 - RNA, 20 nt, Mycobacterium avium subsp. paratuberculosis
gcggccguguacagcagggu

SEQ ID NO: 1006452 - RNA, 13 nt, Mycobacterium avium subsp. paratuberculosis
gcggccguccagc

SEQ ID NO: 1006453 - RNA, 15 nt, Mycobacterium avium subsp. paratuberculosis
gcggccgucgcgcac

SEQ ID NO: 1006454 - RNA, 21 nt, Mycobacterium avium subsp. paratuberculosis
gcggccgucgcgcaccaccuc

SEQ ID NO: 1006455 - RNA, 17 nt, Mycobacterium avium subsp. paratuberculosis
gcggccagugccgggcc

SEQ ID NO: 1006456 - RNA, 18 nt, Mycobacterium avium subsp. paratuberculosis
gcggccagcguggcgcgc

SEQ ID NO: 1006457 - RNA, 20 nt, Mycobacterium avium subsp. paratuberculosis
gcggccagcucccgggcggc

SEQ ID NO: 1006458 - RNA, 18 nt, Mycobacterium avium subsp. paratuberculosis
gcggccagcgcgcgggcg

SEQ ID NO: 1006459 - RNA, 20 nt, Mycobacterium avium subsp. paratuberculosis
gcggccaggccggcgacgau

SEQ ID NO: 1006460 - RNA, 14 nt, Mycobacterium avium subsp. paratuberculosis
gcggccaggccggc

SEQ ID NO: 1006461 - RNA, 15 nt, Mycobacterium avium subsp. paratuberculosis
gcggccaggccggcg

SEQ ID NO: 1006462 - RNA, 17 nt, Mycobacterium avium subsp. paratuberculosis
gcggccagcugcccgcc

SEQ ID NO: 1006463 - RNA, 14 nt, Mycobacterium avium subsp. paratuberculosis
gcggccagcggcag

SEQ ID NO: 1006464 - RNA, 14 nt, Mycobacterium avium subsp. paratuberculosis
gcggccagcgggcc

SEQ ID NO: 1006465 - RNA, 13 nt, Mycobacterium avium subsp. paratuberculosis
gcggccagcgcga

SEQ ID NO: 1006466 - RNA, 13 nt, Mycobacterium avium subsp. paratuberculosis
gcggccagcgagg

SEQ ID NO: 1006467 - RNA, 13 nt, Mycobacterium avium subsp. paratuberculosis
gcggccagccggu

SEQ ID NO: 1006468 - RNA, 15 nt, Mycobacterium avium subsp. paratuberculosis
gcggccagccggucg

SEQ ID NO: 1006469 - RNA, 14 nt, Mycobacterium avium subsp. paratuberculosis
gcggccagccccgg

SEQ ID NO: 1006470 - RNA, 20 nt, Mycobacterium avium subsp. paratuberculosis
gcggccagccccgggaacca

SEQ ID NO: 1006471 - RNA, 17 nt, Mycobacterium avium subsp. paratuberculosis
gcggccagcccgcggca

SEQ ID NO: 1006472 - RNA, 19 nt, Mycobacterium avium subsp. paratuberculosis
gcggccagcccgcggcagc

SEQ ID NO: 1006473 - RNA, 22 nt, Mycobacterium avium subsp. paratuberculosis
gcggccagcccgcggcagccag

SEQ ID NO: 1006474 - RNA, 13 nt, Mycobacterium avium subsp. paratuberculosis
gcggccagccgcg

SEQ ID NO: 1006475 - RNA, 15 nt, Mycobacterium avium subsp. paratuberculosis
gcggccagccgcgcg

SEQ ID NO: 1006476 - RNA, 17 nt, Mycobacterium avium subsp. paratuberculosis
gcggccagccgcgcggc

SEQ ID NO: 1006477 - RNA, 16 nt, Mycobacterium avium subsp. paratuberculosis
gcggcaggucggccag

SEQ ID NO: 1006478 - RNA, 19 nt, Mycobacterium avium subsp. paratuberculosis
gcggcaggucggccagcgc

SEQ ID NO: 1006479 - RNA, 19 nt, Mycobacterium avium subsp. paratuberculosis
gcggcagguaggcgccgcu

SEQ ID NO: 1006480 - RNA, 21 nt, Mycobacterium avium subsp. paratuberculosis
gcggcagguaggcgccgcucg

SEQ ID NO: 1006481 - RNA, 20 nt, Mycobacterium avium subsp. paratuberculosis
gcggcaggucccaggccagg

SEQ ID NO: 1006482 - RNA, 14 nt, Mycobacterium avium subsp. paratuberculosis
gcggcagccgggcg

SEQ ID NO: 1006483 - RNA, 12 nt, Mycobacterium avium subsp. paratuberculosis
gcggcagcagca

SEQ ID NO: 1006484 - RNA, 14 nt, Mycobacterium avium subsp. paratuberculosis
gcggcagccaggcg

SEQ ID NO: 1006485 - RNA, 19 nt, Mycobacterium avium subsp. paratuberculosis
gcggcagcgacagcgcguc

SEQ ID NO: 1006486 - RNA, 21 nt, Mycobacterium avium subsp. paratuberculosis
gcggcagguuggggacggcga

SEQ ID NO: 1006487 - RNA, 17 nt, Mycobacterium avium subsp. paratuberculosis
gcggcagucgcagcagc

SEQ ID NO: 1006488 - RNA, 16 nt, Mycobacterium avium subsp. paratuberculosis
gcggcauaguccagcu

SEQ ID NO: 1006489 - RNA, 15 nt, Mycobacterium avium subsp. paratuberculosis
gcggccggggggagg

SEQ ID NO: 1006490 - RNA, 12 nt, Mycobacterium avium subsp. paratuberculosis
gcggccggcggg

SEQ ID NO: 1006491 - RNA, 13 nt, Mycobacterium avium subsp. paratuberculosis
gcggccggcgggc

SEQ ID NO: 1006492 - RNA, 19 nt, Mycobacterium avium subsp. paratuberculosis
gcggccggcuucggccaag

SEQ ID NO: 1006493 - RNA, 19 nt, Mycobacterium avium subsp. paratuberculosis
gcggccgggaugccgccgg

SEQ ID NO: 1006494 - RNA, 14 nt, Mycobacterium avium subsp. paratuberculosis
gcggccgggcgccc

SEQ ID NO: 1006495 - RNA, 15 nt, Mycobacterium avium subsp. paratuberculosis
gcggccggcggcagu

SEQ ID NO: 1006496 - RNA, 19 nt, Mycobacterium avium subsp. paratuberculosis
gcggccggcggcaguccgg

SEQ ID NO: 1006497 - RNA, 13 nt, Mycobacterium avium subsp. paratuberculosis
gcggccggcggcg

SEQ ID NO: 1006498 - RNA, 16 nt, Mycobacterium avium subsp. paratuberculosis
gcggccggccgcgccc

SEQ ID NO: 1006499 - RNA, 20 nt, Mycobacterium avium subsp. paratuberculosis
gcggccggccgcgcgcggcg

SEQ ID NO: 1006500 - RNA, 15 nt, Mycobacterium avium subsp. paratuberculosis
gcggccggccggccu

SEQ ID NO: 1006501 - RNA, 16 nt, Mycobacterium avium subsp. paratuberculosis
gcggccggccggccug

SEQ ID NO: 1006502 - RNA, 17 nt, Mycobacterium avium subsp. paratuberculosis
gcggccggccggccugg

SEQ ID NO: 1006503 - RNA, 15 nt, Mycobacterium avium subsp. paratuberculosis
gcggccggcgcagcc

SEQ ID NO: 1006504 - RNA, 15 nt, Mycobacterium avium subsp. paratuberculosis
gcggccggcgccggc

SEQ ID NO: 1006505 - RNA, 21 nt, Mycobacterium avium subsp. paratuberculosis
gcggccggccagcgcgcggcc

SEQ ID NO: 1006506 - RNA, 21 nt, Mycobacterium avium subsp. paratuberculosis
gcggccggccccggccgggcg

SEQ ID NO: 1006507 - RNA, 15 nt, Mycobacterium avium subsp. paratuberculosis
gcggccggcccggcc

SEQ ID NO: 1006508 - RNA, 13 nt, Mycobacterium avium subsp. paratuberculosis
gcggccggccagc

SEQ ID NO: 1006509 - RNA, 18 nt, Mycobacterium avium subsp. paratuberculosis
gcggccggccagcagccg

SEQ ID NO: 1006510 - RNA, 23 nt, Mycobacterium avium subsp. paratuberculosis
gcggccggaucgaauccggcggc

SEQ ID NO: 1006511 - RNA, 14 nt, Mycobacterium avium subsp. paratuberculosis
gcggccgcgucggc

SEQ ID NO: 1006512 - RNA, 19 nt, Mycobacterium avium subsp. paratuberculosis
gcggccgcgucgccgaucg

SEQ ID NO: 1006513 - RNA, 13 nt, Mycobacterium avium subsp. paratuberculosis
gcggccgcggcgg

SEQ ID NO: 1006514 - RNA, 14 nt, Mycobacterium avium subsp. paratuberculosis
gcggccgcggcggg

SEQ ID NO: 1006515 - RNA, 15 nt, Mycobacterium avium subsp. paratuberculosis
gcggccgcggcgggc

SEQ ID NO: 1006516 - RNA, 16 nt, Mycobacterium avium subsp. paratuberculosis
gcggccgcggcgggcg

SEQ ID NO: 1006517 - RNA, 20 nt, Mycobacterium avium subsp. paratuberculosis
gcggccgcgaaggcggcguc

SEQ ID NO: 1006518 - RNA, 18 nt, Mycobacterium avium subsp. paratuberculosis
gcggccgcgaucgccaac

SEQ ID NO: 1006519 - RNA, 16 nt, Mycobacterium avium subsp. paratuberculosis
gcggccgcgccggccg

SEQ ID NO: 1006520 - RNA, 13 nt, Mycobacterium avium subsp. paratuberculosis
gcggccgcgcgcc

SEQ ID NO: 1006521 - RNA, 22 nt, Mycobacterium avium subsp. paratuberculosis
gcggccaucucgugcccgggcc

SEQ ID NO: 1006522 - RNA, 17 nt, Mycobacterium avium subsp. paratuberculosis
gcggccaucgccgccau

SEQ ID NO: 1006523 - RNA, 16 nt, Mycobacterium avium subsp. paratuberculosis
gcggccaucgccgcgg

SEQ ID NO: 1006524 - RNA, 20 nt, Mycobacterium avium subsp. paratuberculosis
gcggccaucgccgcgguggc

SEQ ID NO: 1006525 - RNA, 14 nt, Mycobacterium avium subsp. paratuberculosis
gcggccaucgccug

SEQ ID NO: 1006526 - RNA, 13 nt, Mycobacterium avium subsp. paratuberculosis
gcggccaucgccg

SEQ ID NO: 1006527 - RNA, 20 nt, Mycobacterium avium subsp. paratuberculosis
gcggccaggguagaggcggc

SEQ ID NO: 1006528 - RNA, 18 nt, Mycobacterium avium subsp. paratuberculosis
gcgcguuccagcacgccc

SEQ ID NO: 1006529 - RNA, 15 nt, Mycobacterium avium subsp. paratuberculosis
gcgcguuccaucagc

SEQ ID NO: 1006530 - RNA, 14 nt, Mycobacterium avium subsp. paratuberculosis
gcgcguugcggccg

SEQ ID NO: 1006531 - RNA, 13 nt, Mycobacterium avium subsp. paratuberculosis
gcgcuaccaggcg

SEQ ID NO: 1006532 - RNA, 16 nt, Mycobacterium avium subsp. paratuberculosis
gcgcuaacaaaagccc

SEQ ID NO: 1006533 - RNA, 21 nt, Mycobacterium avium subsp. paratuberculosis
gcgcguuuugaaauccgggcg

SEQ ID NO: 1006534 - RNA, 23 nt, Mycobacterium avium subsp. paratuberculosis
gcgcguuuugaaauccgggcgcg

SEQ ID NO: 1006535 - RNA, 16 nt, Mycobacterium avium subsp. paratuberculosis
gcgcguuguccagcag

SEQ ID NO: 1006536 - RNA, 17 nt, Mycobacterium avium subsp. paratuberculosis
gcgcuaaagccaccagc

SEQ ID NO: 1006537 - RNA, 20 nt, Mycobacterium avium subsp. paratuberculosis
gcgcgugcgccgcggcggcu

SEQ ID NO: 1006538 - RNA, 20 nt, Mycobacterium avium subsp. paratuberculosis
gcgcgugcagccgggcggcg

SEQ ID NO: 1006539 - RNA, 15 nt, Mycobacterium avium subsp. paratuberculosis
gcgcgugaccccggc

SEQ ID NO: 1006540 - RNA, 13 nt, Mycobacterium avium subsp. paratuberculosis
gcgcgugacgcgc

SEQ ID NO: 1006541 - RNA, 15 nt, Mycobacterium avium subsp. paratuberculosis
gcgcgugacgcgcgu

SEQ ID NO: 1006542 - RNA, 17 nt, Mycobacterium avium subsp. paratuberculosis
gcgcguggucccacacc

SEQ ID NO: 1006543 - RNA, 14 nt, Mycobacterium avium subsp. paratuberculosis
gcgcgugcuugccg

SEQ ID NO: 1006544 - RNA, 19 nt, Mycobacterium avium subsp. paratuberculosis
gcgcgucguccgacaccac

SEQ ID NO: 1006545 - RNA, 16 nt, Mycobacterium avium subsp. paratuberculosis
gcgcgucgggcucgcg

SEQ ID NO: 1006546 - RNA, 14 nt, Mycobacterium avium subsp. paratuberculosis
gcgcgucgcugccg

SEQ ID NO: 1006547 - RNA, 22 nt, Mycobacterium avium subsp. paratuberculosis
gcgcgucggccagcgcgcgggc

SEQ ID NO: 1006548 - RNA, 15 nt, Mycobacterium avium subsp. paratuberculosis
gcgcgucggccgcac

SEQ ID NO: 1006549 - RNA, 16 nt, Mycobacterium avium subsp. paratuberculosis
gcgcgucggccgcaca

SEQ ID NO: 1006550 - RNA, 13 nt, Mycobacterium avium subsp. paratuberculosis
gcgcgucgcgccc

SEQ ID NO: 1006551 - RNA, 14 nt, Mycobacterium avium subsp. paratuberculosis
gcgcuccagcgggc

SEQ ID NO: 1006552 - RNA, 16 nt, Mycobacterium avium subsp. paratuberculosis
gcgcuccagcgggcgg

SEQ ID NO: 1006553 - RNA, 18 nt, Mycobacterium avium subsp. paratuberculosis
gcgcuccagcgggcggcg

SEQ ID NO: 1006554 - RNA, 14 nt, Mycobacterium avium subsp. paratuberculosis
gcgcuccagcaggc

SEQ ID NO: 1006555 - RNA, 23 nt, Mycobacterium avium subsp. paratuberculosis
gcgcuccaccagguucgcgcagc

SEQ ID NO: 1006556 - RNA, 18 nt, Mycobacterium avium subsp. paratuberculosis
gcgcucaucaggcggccg

SEQ ID NO: 1006557 - RNA, 19 nt, Mycobacterium avium subsp. paratuberculosis
gcgcucaucaggcggccgg

SEQ ID NO: 1006558 - RNA, 20 nt, Mycobacterium avium subsp. paratuberculosis
gcgcucaucaggcggccggc

SEQ ID NO: 1006559 - RNA, 20 nt, Mycobacterium avium subsp. paratuberculosis
gcgcucagcgcggccacacc

SEQ ID NO: 1006560 - RNA, 19 nt, Mycobacterium avium subsp. paratuberculosis
gcgcucagcgcggcgggcc

SEQ ID NO: 1006561 - RNA, 13 nt, Mycobacterium avium subsp. paratuberculosis
gcgcucagcggca

SEQ ID NO: 1006562 - RNA, 15 nt, Mycobacterium avium subsp. paratuberculosis
gcgcucagcggcagc

SEQ ID NO: 1006563 - RNA, 16 nt, Mycobacterium avium subsp. paratuberculosis
gcgcucagcggcagcg

SEQ ID NO: 1006564 - RNA, 14 nt, Mycobacterium avium subsp. paratuberculosis
gcgcucagcgcggc

SEQ ID NO: 1006565 - RNA, 16 nt, Mycobacterium avium subsp. paratuberculosis
gcgcucaacccgggcc

SEQ ID NO: 1006566 - RNA, 18 nt, Mycobacterium avium subsp. paratuberculosis
gcgcucaacccgggccgg

SEQ ID NO: 1006567 - RNA, 20 nt, Mycobacterium avium subsp. paratuberculosis
gcgcucaacccgggccggac

SEQ ID NO: 1006568 - RNA, 15 nt, Mycobacterium avium subsp. paratuberculosis
gcgcucaaccgccca

SEQ ID NO: 1006569 - RNA, 20 nt, Mycobacterium avium subsp. paratuberculosis
gcgcucaaccgcccagcggc

SEQ ID NO: 1006570 - RNA, 23 nt, Mycobacterium avium subsp. paratuberculosis
gcgcucaagaugauugcgugccc

SEQ ID NO: 1006571 - RNA, 19 nt, Mycobacterium avium subsp. paratuberculosis
gcgcuaggacgcgggccug

SEQ ID NO: 1006572 - RNA, 18 nt, Mycobacterium avium subsp. paratuberculosis
gcgcuacgccggcucggu

SEQ ID NO: 1006573 - RNA, 18 nt, Mycobacterium avium subsp. paratuberculosis
gcgcgggcugcagggccg

SEQ ID NO: 1006574 - RNA, 16 nt, Mycobacterium avium subsp. paratuberculosis
gcgcgggcggcgcggu

SEQ ID NO: 1006575 - RNA, 14 nt, Mycobacterium avium subsp. paratuberculosis
gcgcgggcgcgcgc

SEQ ID NO: 1006576 - RNA, 22 nt, Mycobacterium avium subsp. paratuberculosis
gcgcgggcgaccugcgggccca

SEQ ID NO: 1006577 - RNA, 19 nt, Mycobacterium avium subsp. paratuberculosis
gcgcggguucacccuggcg

SEQ ID NO: 1006578 - RNA, 16 nt, Mycobacterium avium subsp. paratuberculosis
gcgcgggucggcgccg

SEQ ID NO: 1006579 - RNA, 16 nt, Mycobacterium avium subsp. paratuberculosis
gcgcgggggcggccug

SEQ ID NO: 1006580 - RNA, 17 nt, Mycobacterium avium subsp. paratuberculosis
gcgcggguacggcggcc

SEQ ID NO: 1006581 - RNA, 23 nt, Mycobacterium avium subsp. paratuberculosis
gcgcggggucccaauccucgccg

SEQ ID NO: 1006582 - RNA, 16 nt, Mycobacterium avium subsp. paratuberculosis
gcgcggggucgggccg

SEQ ID NO: 1006583 - RNA, 18 nt, Mycobacterium avium subsp. paratuberculosis
gcgcgggguggcgccggc

SEQ ID NO: 1006584 - RNA, 19 nt, Mycobacterium avium subsp. paratuberculosis
gcgcgggguggcgccggcc

SEQ ID NO: 1006585 - RNA, 18 nt, Mycobacterium avium subsp. paratuberculosis
gcgcggggcgcgaggcgc

SEQ ID NO: 1006586 - RNA, 13 nt, Mycobacterium avium subsp. paratuberculosis
gcgcggggcggcc

SEQ ID NO: 1006587 - RNA, 14 nt, Mycobacterium avium subsp. paratuberculosis
gcgcggggcggccg

SEQ ID NO: 1006588 - RNA, 18 nt, Mycobacterium avium subsp. paratuberculosis
gcgcggggcggccgccgg

SEQ ID NO: 1006589 - RNA, 19 nt, Mycobacterium avium subsp. paratuberculosis
gcgcggcggcggcgcgggc

SEQ ID NO: 1006590 - RNA, 23 nt, Mycobacterium avium subsp. paratuberculosis
gcgcggcggcggcgcgggcgccc

SEQ ID NO: 1006591 - RNA, 20 nt, Mycobacterium avium subsp. paratuberculosis
gcgcggcggcguccgcggcc

SEQ ID NO: 1006592 - RNA, 12 nt, Mycobacterium avium subsp. paratuberculosis
gcgcggcggagg

SEQ ID NO: 1006593 - RNA, 13 nt, Mycobacterium avium subsp. paratuberculosis
gcgcggcggaggu

SEQ ID NO: 1006594 - RNA, 15 nt, Mycobacterium avium subsp. paratuberculosis
gcgcggcgguccagc

SEQ ID NO: 1006595 - RNA, 21 nt, Mycobacterium avium subsp. paratuberculosis
gcgcggcgguccagcgagccc

SEQ ID NO: 1006596 - RNA, 20 nt, Mycobacterium avium subsp. paratuberculosis
gcgcggcggucgcgcgccgg

SEQ ID NO: 1006597 - RNA, 12 nt, Mycobacterium avium subsp. paratuberculosis
gcgcggcucgcg

SEQ ID NO: 1006598 - RNA, 15 nt, Mycobacterium avium subsp. paratuberculosis
gcgcggcucgcgggc

SEQ ID NO: 1006599 - RNA, 15 nt, Mycobacterium avium subsp. paratuberculosis
gcgcggcgggcccgc

SEQ ID NO: 1006600 - RNA, 21 nt, Mycobacterium avium subsp. paratuberculosis
gcgcggcuaguuggccggcuu

SEQ ID NO: 1006601 - RNA, 20 nt, Mycobacterium avium subsp. paratuberculosis
gcgcggcucacagcgcggcg

SEQ ID NO: 1006602 - RNA, 16 nt, Mycobacterium avium subsp. paratuberculosis
gcgcggcucacgacuc

SEQ ID NO: 1006603 - RNA, 23 nt, Mycobacterium avium subsp. paratuberculosis
gcgcggcucacgacuccuggccg

SEQ ID NO: 1006604 - RNA, 12 nt, Mycobacterium avium subsp. paratuberculosis
gcgcgggcagcc

SEQ ID NO: 1006605 - RNA, 15 nt, Mycobacterium avium subsp. paratuberculosis
gcgcgggccgcagcg

SEQ ID NO: 1006606 - RNA, 15 nt, Mycobacterium avium subsp. paratuberculosis
gcgcgggccagcagc

SEQ ID NO: 1006607 - RNA, 15 nt, Mycobacterium avium subsp. paratuberculosis
gcgcgggccagcagu

SEQ ID NO: 1006608 - RNA, 15 nt, Mycobacterium avium subsp. paratuberculosis
gcgcgggccagcgcc

SEQ ID NO: 1006609 - RNA, 19 nt, Mycobacterium avium subsp. paratuberculosis
gcgcgggaacgaucggcuc

SEQ ID NO: 1006610 - RNA, 16 nt, Mycobacterium avium subsp. paratuberculosis
gcgcgggaagccgccg

SEQ ID NO: 1006611 - RNA, 17 nt, Mycobacterium avium subsp. paratuberculosis
gcgcgggaagccgccgc

SEQ ID NO: 1006612 - RNA, 20 nt, Mycobacterium avium subsp. paratuberculosis
gcgcggcgucaggggugcca

SEQ ID NO: 1006613 - RNA, 13 nt, Mycobacterium avium subsp. paratuberculosis
gcgcggcuggccg

SEQ ID NO: 1006614 - RNA, 16 nt, Mycobacterium avium subsp. paratuberculosis
gcgcguauuccagcgc

SEQ ID NO: 1006615 - RNA, 14 nt, Mycobacterium avium subsp. paratuberculosis
gcgcguccgcgggc

SEQ ID NO: 1006616 - RNA, 16 nt, Mycobacterium avium subsp. paratuberculosis
gcgcguccgcgggcgg

SEQ ID NO: 1006617 - RNA, 21 nt, Mycobacterium avium subsp. paratuberculosis
gcgcgguguacagcgcgccgc

SEQ ID NO: 1006618 - RNA, 16 nt, Mycobacterium avium subsp. paratuberculosis
gcgcguagagcaucag

SEQ ID NO: 1006619 - RNA, 20 nt, Mycobacterium avium subsp. paratuberculosis
gcgcguagcgcagcuccagg

SEQ ID NO: 1006620 - RNA, 22 nt, Mycobacterium avium subsp. paratuberculosis
gcgcgguuccggcgugcagcac

SEQ ID NO: 1006621 - RNA, 23 nt, Mycobacterium avium subsp. paratuberculosis
gcgcggugugggcgauggcggcg

SEQ ID NO: 1006622 - RNA, 17 nt, Mycobacterium avium subsp. paratuberculosis
gcgcggugggcggcggg

SEQ ID NO: 1006623 - RNA, 18 nt, Mycobacterium avium subsp. paratuberculosis
gcgcggugcucggcgcgc

SEQ ID NO: 1006624 - RNA, 16 nt, Mycobacterium avium subsp. paratuberculosis
gcgcgguggcgcgggu

SEQ ID NO: 1006625 - RNA, 23 nt, Mycobacterium avium subsp. paratuberculosis
gcgcgguggcgugcagcgcggcg

SEQ ID NO: 1006626 - RNA, 12 nt, Mycobacterium avium subsp. paratuberculosis
gcgcggucggug

SEQ ID NO: 1006627 - RNA, 15 nt, Mycobacterium avium subsp. paratuberculosis
gcgcggugagcagca

SEQ ID NO: 1006628 - RNA, 19 nt, Mycobacterium avium subsp. paratuberculosis
gcgcggugcaccaggacgc

SEQ ID NO: 1006629 - RNA, 19 nt, Mycobacterium avium subsp. paratuberculosis
gcgcgguccacggucagcg

SEQ ID NO: 1006630 - RNA, 12 nt, Mycobacterium avium subsp. paratuberculosis
gcgcggucagcg

SEQ ID NO: 1006631 - RNA, 14 nt, Mycobacterium avium subsp. paratuberculosis
gcgcggucgcaggc

SEQ ID NO: 1006632 - RNA, 18 nt, Mycobacterium avium subsp. paratuberculosis
gcgcggucgcaggcgagc

SEQ ID NO: 1006633 - RNA, 17 nt, Mycobacterium avium subsp. paratuberculosis
gcgcgcagguagccgcc

SEQ ID NO: 1006634 - RNA, 17 nt, Mycobacterium avium subsp. paratuberculosis
gcgcgcagucgcaggcc

SEQ ID NO: 1006635 - RNA, 17 nt, Mycobacterium avium subsp. paratuberculosis
gcgcgcaggcgcgcggc

SEQ ID NO: 1006636 - RNA, 18 nt, Mycobacterium avium subsp. paratuberculosis
gcgcgcaggcgcgcggcc

SEQ ID NO: 1006637 - RNA, 19 nt, Mycobacterium avium subsp. paratuberculosis
gcgcgcaggcgcgcggcca

SEQ ID NO: 1006638 - RNA, 20 nt, Mycobacterium avium subsp. paratuberculosis
gcgcgcagcucgcgcagccg

SEQ ID NO: 1006639 - RNA, 22 nt, Mycobacterium avium subsp. paratuberculosis
gcgcgcagcucgcgcagccggc

SEQ ID NO: 1006640 - RNA, 17 nt, Mycobacterium avium subsp. paratuberculosis
gcgcgcagccagucgcc

SEQ ID NO: 1006641 - RNA, 13 nt, Mycobacterium avium subsp. paratuberculosis
gcgcgcagccggc

SEQ ID NO: 1006642 - RNA, 20 nt, Mycobacterium avium subsp. paratuberculosis
gcgcgcagaacaccaccgcc

SEQ ID NO: 1006643 - RNA, 22 nt, Mycobacterium avium subsp. paratuberculosis
gcgcgcagaacaccaccgccag

SEQ ID NO: 1006644 - RNA, 13 nt, Mycobacterium avium subsp. paratuberculosis
gcgcgcaccgcga

SEQ ID NO: 1006645 - RNA, 14 nt, Mycobacterium avium subsp. paratuberculosis
gcgcgcaccccggc

SEQ ID NO: 1006646 - RNA, 17 nt, Mycobacterium avium subsp. paratuberculosis
gcgcgagucgagcaccg

SEQ ID NO: 1006647 - RNA, 16 nt, Mycobacterium avium subsp. paratuberculosis
gcgcgauccgcgcguc

SEQ ID NO: 1006648 - RNA, 16 nt, Mycobacterium avium subsp. paratuberculosis
gcgcgaggcgcggggc

SEQ ID NO: 1006649 - RNA, 13 nt, Mycobacterium avium subsp. paratuberculosis
gcgcgagcgcgcu

SEQ ID NO: 1006650 - RNA, 17 nt, Mycobacterium avium subsp. paratuberculosis
gcgcgaggcggguaggc

SEQ ID NO: 1006651 - RNA, 18 nt, Mycobacterium avium subsp. paratuberculosis
gcgcgacaccggacugcu

SEQ ID NO: 1006652 - RNA, 16 nt, Mycobacterium avium subsp. paratuberculosis
gcgcgaauuccucagc

SEQ ID NO: 1006653 - RNA, 21 nt, Mycobacterium avium subsp. paratuberculosis
gcgcgaauuccucagcgcccc

SEQ ID NO: 1006654 - RNA, 14 nt, Mycobacterium avium subsp. paratuberculosis
gcgcgaaccgggcc

SEQ ID NO: 1006655 - RNA, 18 nt, Mycobacterium avium subsp. paratuberculosis
gcgcgaaccgggccagga

SEQ ID NO: 1006656 - RNA, 14 nt, Mycobacterium avium subsp. paratuberculosis
gcgcgaagcugggg

SEQ ID NO: 1006657 - RNA, 16 nt, Mycobacterium avium subsp. paratuberculosis
gcgcgaagucgagcag

SEQ ID NO: 1006658 - RNA, 13 nt, Mycobacterium avium subsp. paratuberculosis
gcgauccggccgg

SEQ ID NO: 1006659 - RNA, 17 nt, Mycobacterium avium subsp. paratuberculosis
gcgaucgacagcuccaa

SEQ ID NO: 1006660 - RNA, 16 nt, Mycobacterium avium subsp. paratuberculosis
gcgaucgccggggauc

SEQ ID NO: 1006661 - RNA, 18 nt, Mycobacterium avium subsp. paratuberculosis
gcgaucgccgacgccagc

SEQ ID NO: 1006662 - RNA, 18 nt, Mycobacterium avium subsp. paratuberculosis
gcgaucgccagcgcggug

SEQ ID NO: 1006663 - RNA, 14 nt, Mycobacterium avium subsp. paratuberculosis
gcgaucgaggaucu

SEQ ID NO: 1006664 - RNA, 23 nt, Mycobacterium avium subsp. paratuberculosis
gcgaucgaucccuuggcggcggc

SEQ ID NO: 1006665 - RNA, 21 nt, Mycobacterium avium subsp. paratuberculosis
gcgauccgggcacgcagcggc

SEQ ID NO: 1006666 - RNA, 18 nt, Mycobacterium avium subsp. paratuberculosis
gcgauccgggcgccggcc

SEQ ID NO: 1006667 - RNA, 17 nt, Mycobacterium avium subsp. paratuberculosis
gcgaucagggccgcggc

SEQ ID NO: 1006668 - RNA, 14 nt, Mycobacterium avium subsp. paratuberculosis
gcgaucagggcggc

SEQ ID NO: 1006669 - RNA, 18 nt, Mycobacterium avium subsp. paratuberculosis
gcgaucaggccggccacc

SEQ ID NO: 1006670 - RNA, 15 nt, Mycobacterium avium subsp. paratuberculosis
gcgaucagcgcgcac

SEQ ID NO: 1006671 - RNA, 13 nt, Mycobacterium avium subsp. paratuberculosis
gcgaucagcuccu

SEQ ID NO: 1006672 - RNA, 14 nt, Mycobacterium avium subsp. paratuberculosis
gcgaucagcugcuc

SEQ ID NO: 1006673 - RNA, 16 nt, Mycobacterium avium subsp. paratuberculosis
gcgcgccugcgcggcg

SEQ ID NO: 1006674 - RNA, 16 nt, Mycobacterium avium subsp. paratuberculosis
gcgcgccgucccagcc

SEQ ID NO: 1006675 - RNA, 14 nt, Mycobacterium avium subsp. paratuberculosis
gcgcgcggcgcaga

SEQ ID NO: 1006676 - RNA, 21 nt, Mycobacterium avium subsp. paratuberculosis
gcgcgcggggugucgcggcug

SEQ ID NO: 1006677 - RNA, 22 nt, Mycobacterium avium subsp. paratuberculosis
gcgcgcggggugucgcggcugc

SEQ ID NO: 1006678 - RNA, 15 nt, Mycobacterium avium subsp. paratuberculosis
gcgcgcggggccggc

SEQ ID NO: 1006679 - RNA, 16 nt, Mycobacterium avium subsp. paratuberculosis
gcgcgcggggccggcg

SEQ ID NO: 1006680 - RNA, 18 nt, Mycobacterium avium subsp. paratuberculosis
gcgcgcggcggccaccgc

SEQ ID NO: 1006681 - RNA, 22 nt, Mycobacterium avium subsp. paratuberculosis
gcgcgcggcggccaccgcgccg

SEQ ID NO: 1006682 - RNA, 14 nt, Mycobacterium avium subsp. paratuberculosis
gcgcgcggccgcga

SEQ ID NO: 1006683 - RNA, 23 nt, Mycobacterium avium subsp. paratuberculosis
gcgcgcgaaaaaacggcggcgga

SEQ ID NO: 1006684 - RNA, 12 nt, Mycobacterium avium subsp. paratuberculosis
gcgcgcccgcgg

SEQ ID NO: 1006685 - RNA, 12 nt, Mycobacterium avium subsp. paratuberculosis
gcgcgccccggc

SEQ ID NO: 1006686 - RNA, 19 nt, Mycobacterium avium subsp. paratuberculosis
gcgcgcagcacaaaagggc

SEQ ID NO: 1006687 - RNA, 14 nt, Mycobacterium avium subsp. paratuberculosis
gcgcgcccacccgc

SEQ ID NO: 1006688 - RNA, 23 nt, Mycobacterium avium subsp. paratuberculosis
gcgcgcccacccgcgccggcaga

SEQ ID NO: 1006689 - RNA, 14 nt, Mycobacterium avium subsp. paratuberculosis
gcgcgccgagcagc

SEQ ID NO: 1006690 - RNA, 17 nt, Mycobacterium avium subsp. paratuberculosis
gcgcgccgagcagcugg

SEQ ID NO: 1006691 - RNA, 14 nt, Mycobacterium avium subsp. paratuberculosis
gcgcgcccaggccc

SEQ ID NO: 1006692 - RNA, 22 nt, Mycobacterium avium subsp. paratuberculosis
gcgcgcccgucgucggucagcu

SEQ ID NO: 1006693 - RNA, 17 nt, Mycobacterium avium subsp. paratuberculosis
gcgcgcccugaggcccg

SEQ ID NO: 1006694 - RNA, 13 nt, Mycobacterium avium subsp. paratuberculosis
gcgcggccagcac

SEQ ID NO: 1006695 - RNA, 16 nt, Mycobacterium avium subsp. paratuberculosis
gcgcggaugcccaggc

SEQ ID NO: 1006696 - RNA, 16 nt, Mycobacterium avium subsp. paratuberculosis
gcgcggauuccagcgc

SEQ ID NO: 1006697 - RNA, 20 nt, Mycobacterium avium subsp. paratuberculosis
gcgcggauuccagcgcgacc

SEQ ID NO: 1006698 - RNA, 22 nt, Mycobacterium avium subsp. paratuberculosis
gcgcggauuccagcgcgaccgc

SEQ ID NO: 1006699 - RNA, 15 nt, Mycobacterium avium subsp. paratuberculosis
gcgcggccagcggcg

SEQ ID NO: 1006700 - RNA, 16 nt, Mycobacterium avium subsp. paratuberculosis
gcgcggccagcggcgc

SEQ ID NO: 1006701 - RNA, 13 nt, Mycobacterium avium subsp. paratuberculosis
gcgcggccagccc

SEQ ID NO: 1006702 - RNA, 19 nt, Mycobacterium avium subsp. paratuberculosis
gcgcggccagccccgggaa

SEQ ID NO: 1006703 - RNA, 11 nt, Mycobacterium avium subsp. paratuberculosis
gcgcggcggcc

SEQ ID NO: 1006704 - RNA, 12 nt, Mycobacterium avium subsp. paratuberculosis
gcgcggcggcca

SEQ ID NO: 1006705 - RNA, 23 nt, Mycobacterium avium subsp. paratuberculosis
gcgcggcggccaccucggcggca

SEQ ID NO: 1006706 - RNA, 13 nt, Mycobacterium avium subsp. paratuberculosis
gcgcggcggccag

SEQ ID NO: 1006707 - RNA, 12 nt, Mycobacterium avium subsp. paratuberculosis
gcgcggcggccg

SEQ ID NO: 1006708 - RNA, 14 nt, Mycobacterium avium subsp. paratuberculosis
gcgcggcggccggc

SEQ ID NO: 1006709 - RNA, 13 nt, Mycobacterium avium subsp. paratuberculosis
gcgcggcggccuc

SEQ ID NO: 1006710 - RNA, 20 nt, Mycobacterium avium subsp. paratuberculosis
gcgcggcggccucggugguc

SEQ ID NO: 1006711 - RNA, 22 nt, Mycobacterium avium subsp. paratuberculosis
gcgcggccggugcgcgucagcc

SEQ ID NO: 1006712 - RNA, 12 nt, Mycobacterium avium subsp. paratuberculosis
gcgcggccggcc

SEQ ID NO: 1006713 - RNA, 15 nt, Mycobacterium avium subsp. paratuberculosis
gcgcggccggccacg

SEQ ID NO: 1006714 - RNA, 13 nt, Mycobacterium avium subsp. paratuberculosis
gcgcggccggccg

SEQ ID NO: 1006715 - RNA, 12 nt, Mycobacterium avium subsp. paratuberculosis
gcgcggccggaa

SEQ ID NO: 1006716 - RNA, 21 nt, Mycobacterium avium subsp. paratuberculosis
gcgcggccgauucggcgccgc

SEQ ID NO: 1006717 - RNA, 13 nt, Mycobacterium avium subsp. paratuberculosis
gcgcggcccgccg

SEQ ID NO: 1006718 - RNA, 13 nt, Mycobacterium avium subsp. paratuberculosis
gcgcggcccggcc

SEQ ID NO: 1006719 - RNA, 19 nt, Mycobacterium avium subsp. paratuberculosis
gcgcggcccggcccgcugg

SEQ ID NO: 1006720 - RNA, 20 nt, Mycobacterium avium subsp. paratuberculosis
gcgcggaugacgugcaccac

SEQ ID NO: 1006721 - RNA, 21 nt, Mycobacterium avium subsp. paratuberculosis
gcgcggacagcugcgcgggcg

SEQ ID NO: 1006722 - RNA, 19 nt, Mycobacterium avium subsp. paratuberculosis
gcgcggacauucggacggc

SEQ ID NO: 1006723 - RNA, 20 nt, Mycobacterium avium subsp. paratuberculosis
gcgcggaccccagugcaggc

SEQ ID NO: 1006724 - RNA, 12 nt, Mycobacterium avium subsp. paratuberculosis
gcgcggagauca

SEQ ID NO: 1006725 - RNA, 19 nt, Mycobacterium avium subsp. paratuberculosis
gcgcgcucaaccgcccagc

SEQ ID NO: 1006726 - RNA, 21 nt, Mycobacterium avium subsp. paratuberculosis
gcgcgcucgggggugcccggc

SEQ ID NO: 1006727 - RNA, 22 nt, Mycobacterium avium subsp. paratuberculosis
gcgcggaaacuccuggccccga

SEQ ID NO: 1006728 - RNA, 23 nt, Mycobacterium avium subsp. paratuberculosis
gcgcggaacagcgucgccgacgg

SEQ ID NO: 1006729 - RNA, 18 nt, Mycobacterium avium subsp. paratuberculosis
gcgcggaacgcgccgggc

SEQ ID NO: 1006730 - RNA, 13 nt, Mycobacterium avium subsp. paratuberculosis
gccuugucguccu

SEQ ID NO: 1006731 - RNA, 14 nt, Mycobacterium avium subsp. paratuberculosis
gccuugucguccuc

SEQ ID NO: 1006732 - RNA, 18 nt, Mycobacterium avium subsp. paratuberculosis
gccuuggugaugggcagc

SEQ ID NO: 1006733 - RNA, 22 nt, Mycobacterium avium subsp. paratuberculosis
gccuuggugaugggcagcgccc

SEQ ID NO: 1006734 - RNA, 18 nt, Mycobacterium avium subsp. paratuberculosis
gccuugcugagccggccc

SEQ ID NO: 1006735 - RNA, 19 nt, Mycobacterium avium subsp. paratuberculosis
gccuugcugauccccagcg

SEQ ID NO: 1006736 - RNA, 17 nt, Mycobacterium avium subsp. paratuberculosis
gccuugcuccacacugg

SEQ ID NO: 1006737 - RNA, 17 nt, Mycobacterium avium subsp. paratuberculosis
gccuucgacggccggcc

SEQ ID NO: 1006738 - RNA, 19 nt, Mycobacterium avium subsp. paratuberculosis
gccuucgacggccggcccu

SEQ ID NO: 1006739 - RNA, 15 nt, Mycobacterium avium subsp. paratuberculosis
gccuucuccagcucc

SEQ ID NO: 1006740 - RNA, 17 nt, Mycobacterium avium subsp. paratuberculosis
gccuucuccagcuccuc

SEQ ID NO: 1006741 - RNA, 20 nt, Mycobacterium avium subsp. paratuberculosis
gccuucuccagcuccucggu

SEQ ID NO: 1006742 - RNA, 18 nt, Mycobacterium avium subsp. paratuberculosis
gccuucuggaagccuggc

SEQ ID NO: 1006743 - RNA, 20 nt, Mycobacterium avium subsp. paratuberculosis
gccuucuuggcgggcgccuu

SEQ ID NO: 1006744 - RNA, 15 nt, Mycobacterium avium subsp. paratuberculosis
gccuucuucgccgca

SEQ ID NO: 1006745 - RNA, 17 nt, Mycobacterium avium subsp. paratuberculosis
gccuucuucgccgcagc

SEQ ID NO: 1006746 - RNA, 13 nt, Mycobacterium avium subsp. paratuberculosis
gccuucuuggccg

SEQ ID NO: 1006747 - RNA, 18 nt, Mycobacterium avium subsp. paratuberculosis
gccuucuuggccggagcc

SEQ ID NO: 1006748 - RNA, 18 nt, Mycobacterium avium subsp. paratuberculosis
gccuucgaguuuggccug

SEQ ID NO: 1006749 - RNA, 22 nt, Mycobacterium avium subsp. paratuberculosis
gccuucgaugcccuccagcacc

SEQ ID NO: 1006750 - RNA, 14 nt, Mycobacterium avium subsp. paratuberculosis
gccuuacaaagccg

SEQ ID NO: 1006751 - RNA, 14 nt, Mycobacterium avium subsp. paratuberculosis
gccuuagcccggcc

SEQ ID NO: 1006752 - RNA, 20 nt, Mycobacterium avium subsp. paratuberculosis
gccuuagcccggccgcggcc

SEQ ID NO: 1006753 - RNA, 13 nt, Mycobacterium avium subsp. paratuberculosis
gccugugcgacgg

SEQ ID NO: 1006754 - RNA, 19 nt, Mycobacterium avium subsp. paratuberculosis
gccugguggcccaggcaga

SEQ ID NO: 1006755 - RNA, 20 nt, Mycobacterium avium subsp. paratuberculosis
gccuggaaaccccucagccg

SEQ ID NO: 1006756 - RNA, 17 nt, Mycobacterium avium subsp. paratuberculosis
gccugcuuuucggccga

SEQ ID NO: 1006757 - RNA, 13 nt, Mycobacterium avium subsp. paratuberculosis
gccugcuugggca

SEQ ID NO: 1006758 - RNA, 20 nt, Mycobacterium avium subsp. paratuberculosis
gccugcuuggucgccugcac

SEQ ID NO: 1006759 - RNA, 22 nt, Mycobacterium avium subsp. paratuberculosis
gccugcucgcuugccagccggg

SEQ ID NO: 1006760 - RNA, 22 nt, Mycobacterium avium subsp. paratuberculosis
gccugcagggauucggccaugc

SEQ ID NO: 1006761 - RNA, 18 nt, Mycobacterium avium subsp. paratuberculosis
gccugcacguccuugggc

SEQ ID NO: 1006762 - RNA, 17 nt, Mycobacterium avium subsp. paratuberculosis
gccugcacggugcgccg

SEQ ID NO: 1006763 - RNA, 22 nt, Mycobacterium avium subsp. paratuberculosis
gccugcacggugcgccggcagc

SEQ ID NO: 1006764 - RNA, 20 nt, Mycobacterium avium subsp. paratuberculosis
gccugcaccaccacacccag

SEQ ID NO: 1006765 - RNA, 21 nt, Mycobacterium avium subsp. paratuberculosis
gccugcaccaccacacccagc

SEQ ID NO: 1006766 - RNA, 15 nt, Mycobacterium avium subsp. paratuberculosis
gccugcagcaccagg

SEQ ID NO: 1006767 - RNA, 20 nt, Mycobacterium avium subsp. paratuberculosis
gccugcagcaccaggcccuc

SEQ ID NO: 1006768 - RNA, 22 nt, Mycobacterium avium subsp. paratuberculosis
gccugcagcaccgaaccggcgg

SEQ ID NO: 1006769 - RNA, 14 nt, Mycobacterium avium subsp. paratuberculosis
gccugcgagcguga

SEQ ID NO: 1006770 - RNA, 13 nt, Mycobacterium avium subsp. paratuberculosis
gccugcgagcaca

SEQ ID NO: 1006771 - RNA, 23 nt, Mycobacterium avium subsp. paratuberculosis
gccugcccagcggcacgggcacc

SEQ ID NO: 1006772 - RNA, 14 nt, Mycobacterium avium subsp. paratuberculosis
gccugccccccuug

SEQ ID NO: 1006773 - RNA, 12 nt, Mycobacterium avium subsp. paratuberculosis
gccugcccgccg

SEQ ID NO: 1006774 - RNA, 17 nt, Mycobacterium avium subsp. paratuberculosis
gccugcccgcgcaggcc

SEQ ID NO: 1006775 - RNA, 16 nt, Mycobacterium avium subsp. paratuberculosis
gccugcuccagcgagu

SEQ ID NO: 1006776 - RNA, 20 nt, Mycobacterium avium subsp. paratuberculosis
gccugcgcgaacagcgaagc

SEQ ID NO: 1006777 - RNA, 14 nt, Mycobacterium avium subsp. paratuberculosis
gccugcgccgccgu

SEQ ID NO: 1006778 - RNA, 19 nt, Mycobacterium avium subsp. paratuberculosis
gccuaccggguggccagca

SEQ ID NO: 1006779 - RNA, 22 nt, Mycobacterium avium subsp. paratuberculosis
gccuaccggguggccagcacca

SEQ ID NO: 1006780 - RNA, 23 nt, Mycobacterium avium subsp. paratuberculosis
gccuaccggguggccagcaccag

SEQ ID NO: 1006781 - RNA, 19 nt, Mycobacterium avium subsp. paratuberculosis
gccugagcaaccgguucgg

SEQ ID NO: 1006782 - RNA, 13 nt, Mycobacterium avium subsp. paratuberculosis
gccugagcccgcc

SEQ ID NO: 1006783 - RNA, 22 nt, Mycobacterium avium subsp. paratuberculosis
gccugacuaagucaccagggug

SEQ ID NO: 1006784 - RNA, 21 nt, Mycobacterium avium subsp. paratuberculosis
gccugacuucugaaccgaagg

SEQ ID NO: 1006785 - RNA, 18 nt, Mycobacterium avium subsp. paratuberculosis
gcgagugaggccgaggcg

SEQ ID NO: 1006786 - RNA, 16 nt, Mycobacterium avium subsp. paratuberculosis
gcgagucuuugguagu

SEQ ID NO: 1006787 - RNA, 14 nt, Mycobacterium avium subsp. paratuberculosis
gcgaucagcagcac

SEQ ID NO: 1006788 - RNA, 15 nt, Mycobacterium avium subsp. paratuberculosis
gcgaucagccccagg

SEQ ID NO: 1006789 - RNA, 15 nt, Mycobacterium avium subsp. paratuberculosis
gcgaucagcccgccc

SEQ ID NO: 1006790 - RNA, 16 nt, Mycobacterium avium subsp. paratuberculosis
gcgauacccgggagca

SEQ ID NO: 1006791 - RNA, 23 nt, Mycobacterium avium subsp. paratuberculosis
gcgaguacaccucgagcuugccg

SEQ ID NO: 1006792 - RNA, 22 nt, Mycobacterium avium subsp. paratuberculosis
gcgaggugcgccaguugcucgg

SEQ ID NO: 1006793 - RNA, 16 nt, Mycobacterium avium subsp. paratuberculosis
gcgaggugugaggagu

SEQ ID NO: 1006794 - RNA, 21 nt, Mycobacterium avium subsp. paratuberculosis
gcgaggucgggauacucgucc

SEQ ID NO: 1006795 - RNA, 15 nt, Mycobacterium avium subsp. paratuberculosis
gcgaguccagccagc

SEQ ID NO: 1006796 - RNA, 18 nt, Mycobacterium avium subsp. paratuberculosis
gcgaguccgcggaggcga

SEQ ID NO: 1006797 - RNA, 15 nt, Mycobacterium avium subsp. paratuberculosis
gcgaguccggccagg

SEQ ID NO: 1006798 - RNA, 23 nt, Mycobacterium avium subsp. paratuberculosis
gcgagucgaagccguggcaggca

SEQ ID NO: 1006799 - RNA, 20 nt, Mycobacterium avium subsp. paratuberculosis
gcgagucgaaggcgcgggcg

SEQ ID NO: 1006800 - RNA, 16 nt, Mycobacterium avium subsp. paratuberculosis
gcgagcgucacgcugg

SEQ ID NO: 1006801 - RNA, 22 nt, Mycobacterium avium subsp. paratuberculosis
gcgagcgcguucuccaccgcgc

SEQ ID NO: 1006802 - RNA, 22 nt, Mycobacterium avium subsp. paratuberculosis
gcgagcgcuaccgcgcucaccg

SEQ ID NO: 1006803 - RNA, 13 nt, Mycobacterium avium subsp. paratuberculosis
gcgagcgggcacg

SEQ ID NO: 1006804 - RNA, 20 nt, Mycobacterium avium subsp. paratuberculosis
gcgagcgggcacgccgccgc

SEQ ID NO: 1006805 - RNA, 20 nt, Mycobacterium avium subsp. paratuberculosis
gcgagcggcccugcgcggcc

SEQ ID NO: 1006806 - RNA, 12 nt, Mycobacterium avium subsp. paratuberculosis
gcgagcgcgcug

SEQ ID NO: 1006807 - RNA, 16 nt, Mycobacterium avium subsp. paratuberculosis
gcgagcgcagcgccag

SEQ ID NO: 1006808 - RNA, 21 nt, Mycobacterium avium subsp. paratuberculosis
gcgagcgcagcgccaggcaga

SEQ ID NO: 1006809 - RNA, 22 nt, Mycobacterium avium subsp. paratuberculosis
gcgaggcggguaggcgucgcgc

SEQ ID NO: 1006810 - RNA, 19 nt, Mycobacterium avium subsp. paratuberculosis
gcgaggcguccagcgcguc

SEQ ID NO: 1006811 - RNA, 14 nt, Mycobacterium avium subsp. paratuberculosis
gcgagcggacgggc

SEQ ID NO: 1006812 - RNA, 13 nt, Mycobacterium avium subsp. paratuberculosis
gcgaggccaggcg

SEQ ID NO: 1006813 - RNA, 21 nt, Mycobacterium avium subsp. paratuberculosis
gcgaggcgaucgcggugcggg

SEQ ID NO: 1006814 - RNA, 13 nt, Mycobacterium avium subsp. paratuberculosis
gcgaggccucgcc

SEQ ID NO: 1006815 - RNA, 22 nt, Mycobacterium avium subsp. paratuberculosis
gcgacggugcaugcgcuggcga

SEQ ID NO: 1006816 - RNA, 15 nt, Mycobacterium avium subsp. paratuberculosis
gcgacgguggcgccc

SEQ ID NO: 1006817 - RNA, 15 nt, Mycobacterium avium subsp. paratuberculosis
gcgacgguggcggcg

SEQ ID NO: 1006818 - RNA, 22 nt, Mycobacterium avium subsp. paratuberculosis
gcgacgguguaggacgccgugc

SEQ ID NO: 1006819 - RNA, 23 nt, Mycobacterium avium subsp. paratuberculosis
gcgacgguguaggacgccgugca

SEQ ID NO: 1006820 - RNA, 17 nt, Mycobacterium avium subsp. paratuberculosis
gcgacgguguccgcggc

SEQ ID NO: 1006821 - RNA, 19 nt, Mycobacterium avium subsp. paratuberculosis
gcgacggguugcggaucgg

SEQ ID NO: 1006822 - RNA, 15 nt, Mycobacterium avium subsp. paratuberculosis
gcgacgcugccgggg

SEQ ID NO: 1006823 - RNA, 17 nt, Mycobacterium avium subsp. paratuberculosis
gcgacgcugccggggcg

SEQ ID NO: 1006824 - RNA, 20 nt, Mycobacterium avium subsp. paratuberculosis
gcgacgggcugucccggccg

SEQ ID NO: 1006825 - RNA, 13 nt, Mycobacterium avium subsp. paratuberculosis
gcgacgcggcggg

SEQ ID NO: 1006826 - RNA, 14 nt, Mycobacterium avium subsp. paratuberculosis
gcgacgcgacgcgc

SEQ ID NO: 1006827 - RNA, 16 nt, Mycobacterium avium subsp. paratuberculosis
gcgacgcugagcgcca

SEQ ID NO: 1006828 - RNA, 19 nt, Mycobacterium avium subsp. paratuberculosis
gcgacgcugagcgccaggc

SEQ ID NO: 1006829 - RNA, 20 nt, Mycobacterium avium subsp. paratuberculosis
gcgacgcugagcgccaggcc

SEQ ID NO: 1006830 - RNA, 19 nt, Mycobacterium avium subsp. paratuberculosis
gcgacgcggugagcgcgcc

SEQ ID NO: 1006831 - RNA, 23 nt, Mycobacterium avium subsp. paratuberculosis
gcgacgcggugagcgcgccggcc

SEQ ID NO: 1006832 - RNA, 14 nt, Mycobacterium avium subsp. paratuberculosis
gcgacgauggccag

SEQ ID NO: 1006833 - RNA, 17 nt, Mycobacterium avium subsp. paratuberculosis
gcgacgauggccaggcc

SEQ ID NO: 1006834 - RNA, 19 nt, Mycobacterium avium subsp. paratuberculosis
gcgacgaugucgacccgcg

SEQ ID NO: 1006835 - RNA, 21 nt, Mycobacterium avium subsp. paratuberculosis
gcgacgaugucgacccgcggc

SEQ ID NO: 1006836 - RNA, 15 nt, Mycobacterium avium subsp. paratuberculosis
gcgacgcacgccggc

SEQ ID NO: 1006837 - RNA, 16 nt, Mycobacterium avium subsp. paratuberculosis
gcgacgcacgccggcg

SEQ ID NO: 1006838 - RNA, 21 nt, Mycobacterium avium subsp. paratuberculosis
gcgacgccgcgcagcggggcg

SEQ ID NO: 1006839 - RNA, 22 nt, Mycobacterium avium subsp. paratuberculosis
gcgacgccguagaucacgccgg

SEQ ID NO: 1006840 - RNA, 20 nt, Mycobacterium avium subsp. paratuberculosis
gcgacgccgucauccccauc

SEQ ID NO: 1006841 - RNA, 15 nt, Mycobacterium avium subsp. paratuberculosis
gcgacgccgucgggg

SEQ ID NO: 1006842 - RNA, 23 nt, Mycobacterium avium subsp. paratuberculosis
gcgacgccacggggcugcgggcc

SEQ ID NO: 1006843 - RNA, 14 nt, Mycobacterium avium subsp. paratuberculosis
gcgacgccagcacc

SEQ ID NO: 1006844 - RNA, 14 nt, Mycobacterium avium subsp. paratuberculosis
gcgacgccagcggc

SEQ ID NO: 1006845 - RNA, 18 nt, Mycobacterium avium subsp. paratuberculosis
gcgacgccagcggcagcg

SEQ ID NO: 1006846 - RNA, 20 nt, Mycobacterium avium subsp. paratuberculosis
gcgacgccagcggcagcgcc

SEQ ID NO: 1006847 - RNA, 21 nt, Mycobacterium avium subsp. paratuberculosis
gcgacgccagcggcagcgcca

SEQ ID NO: 1006848 - RNA, 22 nt, Mycobacterium avium subsp. paratuberculosis
gcgacgccagcggcagcgccag

SEQ ID NO: 1006849 - RNA, 23 nt, Mycobacterium avium subsp. paratuberculosis
gcgacgccagcggcagcgccagc

SEQ ID NO: 1006850 - RNA, 15 nt, Mycobacterium avium subsp. paratuberculosis
gcgacgagcgggccg

SEQ ID NO: 1006851 - RNA, 17 nt, Mycobacterium avium subsp. paratuberculosis
gcgacgaucgcgacggc

SEQ ID NO: 1006852 - RNA, 15 nt, Mycobacterium avium subsp. paratuberculosis
gcgacgaucagcagc

SEQ ID NO: 1006853 - RNA, 21 nt, Mycobacterium avium subsp. paratuberculosis
gcgacgaucagcagccgggcc

SEQ ID NO: 1006854 - RNA, 22 nt, Mycobacterium avium subsp. paratuberculosis
gcgacgaucagcagccgggccu

SEQ ID NO: 1006855 - RNA, 19 nt, Mycobacterium avium subsp. paratuberculosis
gcgacguccaucgggaccg

SEQ ID NO: 1006856 - RNA, 23 nt, Mycobacterium avium subsp. paratuberculosis
gcgacgucgugcacgccguggcg

SEQ ID NO: 1006857 - RNA, 18 nt, Mycobacterium avium subsp. paratuberculosis
gcgacguccuugaucagc

SEQ ID NO: 1006858 - RNA, 14 nt, Mycobacterium avium subsp. paratuberculosis
gcgacgucgccggc

SEQ ID NO: 1006859 - RNA, 16 nt, Mycobacterium avium subsp. paratuberculosis
gcgacuugccgccggc

SEQ ID NO: 1006860 - RNA, 17 nt, Mycobacterium avium subsp. paratuberculosis
gcgacuugccgccggcg

SEQ ID NO: 1006861 - RNA, 22 nt, Mycobacterium avium subsp. paratuberculosis
gcgacuucuacggcgggccggc

SEQ ID NO: 1006862 - RNA, 21 nt, Mycobacterium avium subsp. paratuberculosis
gcgacuugaccagcagcugga

SEQ ID NO: 1006863 - RNA, 18 nt, Mycobacterium avium subsp. paratuberculosis
gcgacugggugcucccgc

SEQ ID NO: 1006864 - RNA, 18 nt, Mycobacterium avium subsp. paratuberculosis
gcgagaucaacaccgcgc

SEQ ID NO: 1006865 - RNA, 19 nt, Mycobacterium avium subsp. paratuberculosis
gcgacuugguggccagcac

SEQ ID NO: 1006866 - RNA, 14 nt, Mycobacterium avium subsp. paratuberculosis
gcgagaugaucagc

SEQ ID NO: 1006867 - RNA, 22 nt, Mycobacterium avium subsp. paratuberculosis
gcgagauuggccucggcgcggg

SEQ ID NO: 1006868 - RNA, 18 nt, Mycobacterium avium subsp. paratuberculosis
gcgagcaccgugccgucg

SEQ ID NO: 1006869 - RNA, 14 nt, Mycobacterium avium subsp. paratuberculosis
gcgagcagcugcag

SEQ ID NO: 1006870 - RNA, 14 nt, Mycobacterium avium subsp. paratuberculosis
gcgagcagccgcgc

SEQ ID NO: 1006871 - RNA, 20 nt, Mycobacterium avium subsp. paratuberculosis
gcgagcagccgcgccgggcg

SEQ ID NO: 1006872 - RNA, 15 nt, Mycobacterium avium subsp. paratuberculosis
gcgagcagccgggug

SEQ ID NO: 1006873 - RNA, 20 nt, Mycobacterium avium subsp. paratuberculosis
gcgagcagcagcgcggugcc

SEQ ID NO: 1006874 - RNA, 16 nt, Mycobacterium avium subsp. paratuberculosis
gcgaccuugcgcagcc

SEQ ID NO: 1006875 - RNA, 23 nt, Mycobacterium avium subsp. paratuberculosis
gcgacgaacagcaccgccacggc

SEQ ID NO: 1006876 - RNA, 14 nt, Mycobacterium avium subsp. paratuberculosis
gcgacgaagcagcu

SEQ ID NO: 1006877 - RNA, 20 nt, Mycobacterium avium subsp. paratuberculosis
gcgaccuggacgccgcacgc

SEQ ID NO: 1006878 - RNA, 16 nt, Mycobacterium avium subsp. paratuberculosis
gcgaccugcggcucgu

SEQ ID NO: 1006879 - RNA, 18 nt, Mycobacterium avium subsp. paratuberculosis
gcgaccucgguggugcug

SEQ ID NO: 1006880 - RNA, 18 nt, Mycobacterium avium subsp. paratuberculosis
gcgaccucuucgcuggac

SEQ ID NO: 1006881 - RNA, 19 nt, Mycobacterium avium subsp. paratuberculosis
gcgacgaccaccaggagca

SEQ ID NO: 1006882 - RNA, 22 nt, Mycobacterium avium subsp. paratuberculosis
gcgacgagagcggaucggcggc

SEQ ID NO: 1006883 - RNA, 17 nt, Mycobacterium avium subsp. paratuberculosis
gcgacgaagucgacggc

SEQ ID NO: 1006884 - RNA, 17 nt, Mycobacterium avium subsp. paratuberculosis
gcgacgaagccggugcc

SEQ ID NO: 1006885 - RNA, 15 nt, Mycobacterium avium subsp. paratuberculosis
gcgaccgcgcgcggc

SEQ ID NO: 1006886 - RNA, 18 nt, Mycobacterium avium subsp. paratuberculosis
gcgaccgcgcgcggcgcc

SEQ ID NO: 1006887 - RNA, 13 nt, Mycobacterium avium subsp. paratuberculosis
gcgaccgcgcggc

SEQ ID NO: 1006888 - RNA, 19 nt, Mycobacterium avium subsp. paratuberculosis
gcgaccgcgaucagggccg

SEQ ID NO: 1006889 - RNA, 17 nt, Mycobacterium avium subsp. paratuberculosis
gcgaccgcgcaggcggc

SEQ ID NO: 1006890 - RNA, 16 nt, Mycobacterium avium subsp. paratuberculosis
gcgaccgcccggggcg

SEQ ID NO: 1006891 - RNA, 21 nt, Mycobacterium avium subsp. paratuberculosis
gcgaccgugcccaccagccgg

SEQ ID NO: 1006892 - RNA, 19 nt, Mycobacterium avium subsp. paratuberculosis
gcgaccgucagcagggccu

SEQ ID NO: 1006893 - RNA, 20 nt, Mycobacterium avium subsp. paratuberculosis
gcgaccgucagcagggccuc

SEQ ID NO: 1006894 - RNA, 22 nt, Mycobacterium avium subsp. paratuberculosis
gcgaccgucagcagggccucgc

SEQ ID NO: 1006895 - RNA, 22 nt, Mycobacterium avium subsp. paratuberculosis
gcgaccgucgggacggccagca

SEQ ID NO: 1006896 - RNA, 19 nt, Mycobacterium avium subsp. paratuberculosis
gcgacccgcuucgcccggc

SEQ ID NO: 1006897 - RNA, 16 nt, Mycobacterium avium subsp. paratuberculosis
gcgacccaggccgccg

SEQ ID NO: 1006898 - RNA, 22 nt, Mycobacterium avium subsp. paratuberculosis
gcgacccagacuugggcagcag

SEQ ID NO: 1006899 - RNA, 18 nt, Mycobacterium avium subsp. paratuberculosis
gcgaccaugcccagcagu

SEQ ID NO: 1006900 - RNA, 16 nt, Mycobacterium avium subsp. paratuberculosis
gcgaccaucagccugc

SEQ ID NO: 1006901 - RNA, 21 nt, Mycobacterium avium subsp. paratuberculosis
gcgaccaucagccugcgguga

SEQ ID NO: 1006902 - RNA, 16 nt, Mycobacterium avium subsp. paratuberculosis
gcgaccaguagaagug

SEQ ID NO: 1006903 - RNA, 17 nt, Mycobacterium avium subsp. paratuberculosis
gcgaccaguaggccagc

SEQ ID NO: 1006904 - RNA, 17 nt, Mycobacterium avium subsp. paratuberculosis
gcgaccagcgcgccggc

SEQ ID NO: 1006905 - RNA, 19 nt, Mycobacterium avium subsp. paratuberculosis
gcgaccagcggcagcagca

SEQ ID NO: 1006906 - RNA, 15 nt, Mycobacterium avium subsp. paratuberculosis
gcgaccagcgagccc

SEQ ID NO: 1006907 - RNA, 13 nt, Mycobacterium avium subsp. paratuberculosis
gcgacaucucggu

SEQ ID NO: 1006908 - RNA, 16 nt, Mycobacterium avium subsp. paratuberculosis
gcgacaucgccgcggc

SEQ ID NO: 1006909 - RNA, 12 nt, Mycobacterium avium subsp. paratuberculosis
gcgacaucggcg

SEQ ID NO: 1006910 - RNA, 14 nt, Mycobacterium avium subsp. paratuberculosis
gcgaccacagcgcc

SEQ ID NO: 1006911 - RNA, 16 nt, Mycobacterium avium subsp. paratuberculosis
gcgaccacagcgccuc

SEQ ID NO: 1006912 - RNA, 21 nt, Mycobacterium avium subsp. paratuberculosis
gcgaccaccagccgcaggugc

SEQ ID NO: 1006913 - RNA, 23 nt, Mycobacterium avium subsp. paratuberculosis
gcgaccaccacggccgcagcggc

SEQ ID NO: 1006914 - RNA, 18 nt, Mycobacterium avium subsp. paratuberculosis
gcgaccacccucaccacg

SEQ ID NO: 1006915 - RNA, 10 nt, Mycobacterium avium subsp. paratuberculosis
gcgaccaccg

SEQ ID NO: 1006916 - RNA, 18 nt, Mycobacterium avium subsp. paratuberculosis
gcgaccagauaggccagc

SEQ ID NO: 1006917 - RNA, 20 nt, Mycobacterium avium subsp. paratuberculosis
gcgaccagauaggccagcgc

SEQ ID NO: 1006918 - RNA, 15 nt, Mycobacterium avium subsp. paratuberculosis
gcgaccacgccgcgg

SEQ ID NO: 1006919 - RNA, 17 nt, Mycobacterium avium subsp. paratuberculosis
gcgaccacgaacaccgg

SEQ ID NO: 1006920 - RNA, 17 nt, Mycobacterium avium subsp. paratuberculosis
gcgaauccgggccuccu

SEQ ID NO: 1006921 - RNA, 12 nt, Mycobacterium avium subsp. paratuberculosis
gcgaauccaagg

SEQ ID NO: 1006922 - RNA, 19 nt, Mycobacterium avium subsp. paratuberculosis
gcgaaaccuccggagaucg

SEQ ID NO: 1006923 - RNA, 17 nt, Mycobacterium avium subsp. paratuberculosis
gcgaaacacagcagcac

SEQ ID NO: 1006924 - RNA, 20 nt, Mycobacterium avium subsp. paratuberculosis
gcgaaacccccgggaugccu

SEQ ID NO: 1006925 - RNA, 17 nt, Mycobacterium avium subsp. paratuberculosis
gcgacaaaggaggggcg

SEQ ID NO: 1006926 - RNA, 22 nt, Mycobacterium avium subsp. paratuberculosis
gcgacaaaggaggggcgcggca

SEQ ID NO: 1006927 - RNA, 15 nt, Mycobacterium avium subsp. paratuberculosis
gcgacagcacgggcg

SEQ ID NO: 1006928 - RNA, 15 nt, Mycobacterium avium subsp. paratuberculosis
gcgacagaaaucgcg

SEQ ID NO: 1006929 - RNA, 21 nt, Mycobacterium avium subsp. paratuberculosis
gcgacaccugcucaccgagcu

SEQ ID NO: 1006930 - RNA, 14 nt, Mycobacterium avium subsp. paratuberculosis
gcgacacgccgcgc

SEQ ID NO: 1006931 - RNA, 16 nt, Mycobacterium avium subsp. paratuberculosis
gcgacaccgcggcgac

SEQ ID NO: 1006932 - RNA, 15 nt, Mycobacterium avium subsp. paratuberculosis
gcgacacccagcggc

SEQ ID NO: 1006933 - RNA, 19 nt, Mycobacterium avium subsp. paratuberculosis
gcgacacccagcggcgcgg

SEQ ID NO: 1006934 - RNA, 13 nt, Mycobacterium avium subsp. paratuberculosis
gcgacagccgccc

SEQ ID NO: 1006935 - RNA, 16 nt, Mycobacterium avium subsp. paratuberculosis
gcgacagccgcccggc

SEQ ID NO: 1006936 - RNA, 17 nt, Mycobacterium avium subsp. paratuberculosis
gcgacagccgcccggcg

SEQ ID NO: 1006937 - RNA, 21 nt, Mycobacterium avium subsp. paratuberculosis
gcgacagccgggaaucgaggg

SEQ ID NO: 1006938 - RNA, 16 nt, Mycobacterium avium subsp. paratuberculosis
gcgacagcgcgucggc

SEQ ID NO: 1006939 - RNA, 21 nt, Mycobacterium avium subsp. paratuberculosis
gcgacaggucggcggucgcgg

SEQ ID NO: 1006940 - RNA, 16 nt, Mycobacterium avium subsp. paratuberculosis
gcgacaucaccgcggg

SEQ ID NO: 1006941 - RNA, 17 nt, Mycobacterium avium subsp. paratuberculosis
gccggacgcuaagcgcu

SEQ ID NO: 1006942 - RNA, 14 nt, Mycobacterium avium subsp. paratuberculosis
gccggacggcccgc

SEQ ID NO: 1006943 - RNA, 21 nt, Mycobacterium avium subsp. paratuberculosis
gccggacgggaucggcgcguc

SEQ ID NO: 1006944 - RNA, 19 nt, Mycobacterium avium subsp. paratuberculosis
gccggaccucgaccagccg

SEQ ID NO: 1006945 - RNA, 21 nt, Mycobacterium avium subsp. paratuberculosis
gccggaccgcuugacgccgcc

SEQ ID NO: 1006946 - RNA, 23 nt, Mycobacterium avium subsp. paratuberculosis
gccggaccgcuugacgccgccga

SEQ ID NO: 1006947 - RNA, 22 nt, Mycobacterium avium subsp. paratuberculosis
gccggaccgauccggcgcccga

SEQ ID NO: 1006948 - RNA, 20 nt, Mycobacterium avium subsp. paratuberculosis
gccggacccauucgucggcg

SEQ ID NO: 1006949 - RNA, 19 nt, Mycobacterium avium subsp. paratuberculosis
gccggaccccacagcgcgc

SEQ ID NO: 1006950 - RNA, 20 nt, Mycobacterium avium subsp. paratuberculosis
gccggaccccacagcgcgcc

SEQ ID NO: 1006951 - RNA, 18 nt, Mycobacterium avium subsp. paratuberculosis
gccggacccccucggggc

SEQ ID NO: 1006952 - RNA, 19 nt, Mycobacterium avium subsp. paratuberculosis
gccggacaccaccgcggug

SEQ ID NO: 1006953 - RNA, 21 nt, Mycobacterium avium subsp. paratuberculosis
gccggacaccaccgcgguggg

SEQ ID NO: 1006954 - RNA, 13 nt, Mycobacterium avium subsp. paratuberculosis
gccggacaccccg

SEQ ID NO: 1006955 - RNA, 22 nt, Mycobacterium avium subsp. paratuberculosis
gccggacaccgaaccgccccgc

SEQ ID NO: 1006956 - RNA, 15 nt, Mycobacterium avium subsp. paratuberculosis
gccggacaccuggag

SEQ ID NO: 1006957 - RNA, 14 nt, Mycobacterium avium subsp. paratuberculosis
gccggacagcuggc

SEQ ID NO: 1006958 - RNA, 20 nt, Mycobacterium avium subsp. paratuberculosis
gccggacagccggggcagcu

SEQ ID NO: 1006959 - RNA, 16 nt, Mycobacterium avium subsp. paratuberculosis
gccgcggccagcgagg

SEQ ID NO: 1006960 - RNA, 20 nt, Mycobacterium avium subsp. paratuberculosis
gccggaaggccaaggccagc

SEQ ID NO: 1006961 - RNA, 19 nt, Mycobacterium avium subsp. paratuberculosis
gccgcggaagccccaggcc

SEQ ID NO: 1006962 - RNA, 20 nt, Mycobacterium avium subsp. paratuberculosis
gccgcggaagccccaggccc

SEQ ID NO: 1006963 - RNA, 16 nt, Mycobacterium avium subsp. paratuberculosis
gccgcggaaggccagc

SEQ ID NO: 1006964 - RNA, 18 nt, Mycobacterium avium subsp. paratuberculosis
gccgcgccgugcgccagc

SEQ ID NO: 1006965 - RNA, 20 nt, Mycobacterium avium subsp. paratuberculosis
gccgcggaucuucuccgcca

SEQ ID NO: 1006966 - RNA, 22 nt, Mycobacterium avium subsp. paratuberculosis
gccgcggaugaccaggucgccg

SEQ ID NO: 1006967 - RNA, 17 nt, Mycobacterium avium subsp. paratuberculosis
gccgcggacggccagcc

SEQ ID NO: 1006968 - RNA, 16 nt, Mycobacterium avium subsp. paratuberculosis
gccgcggagcggcggu

SEQ ID NO: 1006969 - RNA, 17 nt, Mycobacterium avium subsp. paratuberculosis
gccgcggccagcugccc

SEQ ID NO: 1006970 - RNA, 19 nt, Mycobacterium avium subsp. paratuberculosis
gccgcggccagcugcccgc

SEQ ID NO: 1006971 - RNA, 16 nt, Mycobacterium avium subsp. paratuberculosis
gccggaacucggccgg

SEQ ID NO: 1006972 - RNA, 14 nt, Mycobacterium avium subsp. paratuberculosis
gccgcggcccugca

SEQ ID NO: 1006973 - RNA, 16 nt, Mycobacterium avium subsp. paratuberculosis
gccgcggcccugcagc

SEQ ID NO: 1006974 - RNA, 17 nt, Mycobacterium avium subsp. paratuberculosis
gccgcggcccugcagcg

SEQ ID NO: 1006975 - RNA, 12 nt, Mycobacterium avium subsp. paratuberculosis
gccgcggccgcc

SEQ ID NO: 1006976 - RNA, 13 nt, Mycobacterium avium subsp. paratuberculosis
gccgcggccaggu

SEQ ID NO: 1006977 - RNA, 13 nt, Mycobacterium avium subsp. paratuberculosis
gccgcggccagcc

SEQ ID NO: 1006978 - RNA, 21 nt, Mycobacterium avium subsp. paratuberculosis
gccgcggauguggaggcgagc

SEQ ID NO: 1006979 - RNA, 23 nt, Mycobacterium avium subsp. paratuberculosis
gccgcggauuccggcaucggcuc

SEQ ID NO: 1006980 - RNA, 12 nt, Mycobacterium avium subsp. paratuberculosis
gccgcggccaca

SEQ ID NO: 1006981 - RNA, 21 nt, Mycobacterium avium subsp. paratuberculosis
gccggacuauacacgccugga

SEQ ID NO: 1006982 - RNA, 15 nt, Mycobacterium avium subsp. paratuberculosis
gccggagaccagcag

SEQ ID NO: 1006983 - RNA, 16 nt, Mycobacterium avium subsp. paratuberculosis
gccggagaccagcagc

SEQ ID NO: 1006984 - RNA, 22 nt, Mycobacterium avium subsp. paratuberculosis
gccggacucgaucgccaccgag

SEQ ID NO: 1006985 - RNA, 23 nt, Mycobacterium avium subsp. paratuberculosis
gccggagaucaauucugcugccc

SEQ ID NO: 1006986 - RNA, 14 nt, Mycobacterium avium subsp. paratuberculosis
gccggagccggccu

SEQ ID NO: 1006987 - RNA, 22 nt, Mycobacterium avium subsp. paratuberculosis
gccggagccuucuucgccgcaa

SEQ ID NO: 1006988 - RNA, 23 nt, Mycobacterium avium subsp. paratuberculosis
gccggagccuucuucgccgcagc

SEQ ID NO: 1006989 - RNA, 13 nt, Mycobacterium avium subsp. paratuberculosis
gccggagccuugg

SEQ ID NO: 1006990 - RNA, 22 nt, Mycobacterium avium subsp. paratuberculosis
gccggagccuuggucgcggccu

SEQ ID NO: 1006991 - RNA, 13 nt, Mycobacterium avium subsp. paratuberculosis
gccggaggcggcg

SEQ ID NO: 1006992 - RNA, 22 nt, Mycobacterium avium subsp. paratuberculosis
gccggaucagcguuccggcggc

SEQ ID NO: 1006993 - RNA, 23 nt, Mycobacterium avium subsp. paratuberculosis
gccggaucagcguuccggcggcc

SEQ ID NO: 1006994 - RNA, 17 nt, Mycobacterium avium subsp. paratuberculosis
gccggaucgagcacccg

SEQ ID NO: 1006995 - RNA, 22 nt, Mycobacterium avium subsp. paratuberculosis
gccggaucgagcacccggcggg

SEQ ID NO: 1006996 - RNA, 15 nt, Mycobacterium avium subsp. paratuberculosis
gccggaucgccgagg

SEQ ID NO: 1006997 - RNA, 18 nt, Mycobacterium avium subsp. paratuberculosis
gccggaucgggaccggga

SEQ ID NO: 1006998 - RNA, 14 nt, Mycobacterium avium subsp. paratuberculosis
gccggaugcggcuc

SEQ ID NO: 1006999 - RNA, 13 nt, Mycobacterium avium subsp. paratuberculosis
gccggaugcggcc

SEQ ID NO: 1007000 - RNA, 23 nt, Mycobacterium avium subsp. paratuberculosis
gccggaucgugucccggcgcccu

SEQ ID NO: 1007001 - RNA, 14 nt, Mycobacterium avium subsp. paratuberculosis
gccggaugccgcgc

SEQ ID NO: 1007002 - RNA, 20 nt, Mycobacterium avium subsp. paratuberculosis
gccggauguccuacggcggg

SEQ ID NO: 1007003 - RNA, 18 nt, Mycobacterium avium subsp. paratuberculosis
gccggauuacucgccggc

SEQ ID NO: 1007004 - RNA, 19 nt, Mycobacterium avium subsp. paratuberculosis
gccggauuacucgccggcg

SEQ ID NO: 1007005 - RNA, 21 nt, Mycobacterium avium subsp. paratuberculosis
gccggauuacucgccggcggc

SEQ ID NO: 1007006 - RNA, 15 nt, Mycobacterium avium subsp. paratuberculosis
gccggcaccagcagc

SEQ ID NO: 1007007 - RNA, 21 nt, Mycobacterium avium subsp. paratuberculosis
gccggcaccagcagccgcagc

SEQ ID NO: 1007008 - RNA, 15 nt, Mycobacterium avium subsp. paratuberculosis
gccggcacaccgagc

SEQ ID NO: 1007009 - RNA, 18 nt, Mycobacterium avium subsp. paratuberculosis
gccggcaacaacgccagc

SEQ ID NO: 1007010 - RNA, 18 nt, Mycobacterium avium subsp. paratuberculosis
gccggcaggucgaggccg

SEQ ID NO: 1007011 - RNA, 16 nt, Mycobacterium avium subsp. paratuberculosis
gccggcagcggcugcu

SEQ ID NO: 1007012 - RNA, 17 nt, Mycobacterium avium subsp. paratuberculosis
gccggcagcggcugcug

SEQ ID NO: 1007013 - RNA, 14 nt, Mycobacterium avium subsp. paratuberculosis
gccggcagcggccg

SEQ ID NO: 1007014 - RNA, 15 nt, Mycobacterium avium subsp. paratuberculosis
gccggcagcggccgc

SEQ ID NO: 1007015 - RNA, 18 nt, Mycobacterium avium subsp. paratuberculosis
gccggcagccggccaccu

SEQ ID NO: 1007016 - RNA, 14 nt, Mycobacterium avium subsp. paratuberculosis
gccggcagcaaccg

SEQ ID NO: 1007017 - RNA, 15 nt, Mycobacterium avium subsp. paratuberculosis
gccggcagcaaccgg

SEQ ID NO: 1007018 - RNA, 14 nt, Mycobacterium avium subsp. paratuberculosis
gccggcacgcgcgc

SEQ ID NO: 1007019 - RNA, 22 nt, Mycobacterium avium subsp. paratuberculosis
gccggcacuaccgccucgccag

SEQ ID NO: 1007020 - RNA, 19 nt, Mycobacterium avium subsp. paratuberculosis
gccggcacucgccucggag

SEQ ID NO: 1007021 - RNA, 23 nt, Mycobacterium avium subsp. paratuberculosis
gccggcacucgucguggcggugc

SEQ ID NO: 1007022 - RNA, 22 nt, Mycobacterium avium subsp. paratuberculosis
gccggcaccucgaagggcgcca

SEQ ID NO: 1007023 - RNA, 19 nt, Mycobacterium avium subsp. paratuberculosis
gccggcaucgaccgcccgc

SEQ ID NO: 1007024 - RNA, 17 nt, Mycobacterium avium subsp. paratuberculosis
gccggcaucagcgagac

SEQ ID NO: 1007025 - RNA, 16 nt, Mycobacterium avium subsp. paratuberculosis
gccggcauaggccagc

SEQ ID NO: 1007026 - RNA, 23 nt, Mycobacterium avium subsp. paratuberculosis
gccggccaccgccccagccgacc

SEQ ID NO: 1007027 - RNA, 13 nt, Mycobacterium avium subsp. paratuberculosis
gccggccaccucg

SEQ ID NO: 1007028 - RNA, 17 nt, Mycobacterium avium subsp. paratuberculosis
gccggccaccaacaggu

SEQ ID NO: 1007029 - RNA, 13 nt, Mycobacterium avium subsp. paratuberculosis
gccggccaacagc

SEQ ID NO: 1007030 - RNA, 16 nt, Mycobacterium avium subsp. paratuberculosis
gccggccaacagcagc

SEQ ID NO: 1007031 - RNA, 21 nt, Mycobacterium avium subsp. paratuberculosis
gccggccaacagcagcgccgc

SEQ ID NO: 1007032 - RNA, 24 nt, Mycobacterium avium subsp. paratuberculosis
gccggccaugcccucgaucgagga

SEQ ID NO: 1007033 - RNA, 20 nt, Mycobacterium avium subsp. paratuberculosis
gccggccccgcccggcgcgc

SEQ ID NO: 1007034 - RNA, 22 nt, Mycobacterium avium subsp. paratuberculosis
gccggccccgcccggcgcgcag

SEQ ID NO: 1007035 - RNA, 18 nt, Mycobacterium avium subsp. paratuberculosis
gccggccccgcccggggc

SEQ ID NO: 1007036 - RNA, 19 nt, Mycobacterium avium subsp. paratuberculosis
gccggccccgcccggggcg

SEQ ID NO: 1007037 - RNA, 23 nt, Mycobacterium avium subsp. paratuberculosis
gccggccccgcccggggcggcga

SEQ ID NO: 1007038 - RNA, 15 nt, Mycobacterium avium subsp. paratuberculosis
gccggccccggccgg

SEQ ID NO: 1007039 - RNA, 17 nt, Mycobacterium avium subsp. paratuberculosis
gccggccccggccgggc

SEQ ID NO: 1007040 - RNA, 17 nt, Mycobacterium avium subsp. paratuberculosis
gccggccccggcgacgg

SEQ ID NO: 1007041 - RNA, 15 nt, Mycobacterium avium subsp. paratuberculosis
gccggcccagcgcgc

SEQ ID NO: 1007042 - RNA, 15 nt, Mycobacterium avium subsp. paratuberculosis
gccggcccagcucca

SEQ ID NO: 1007043 - RNA, 13 nt, Mycobacterium avium subsp. paratuberculosis
gccggcccaggca

SEQ ID NO: 1007044 - RNA, 23 nt, Mycobacterium avium subsp. paratuberculosis
gccggccaugaugaugacguccu

SEQ ID NO: 1007045 - RNA, 13 nt, Mycobacterium avium subsp. paratuberculosis
gccggccaguucc

SEQ ID NO: 1007046 - RNA, 17 nt, Mycobacterium avium subsp. paratuberculosis
gccggccagcggccagc

SEQ ID NO: 1007047 - RNA, 21 nt, Mycobacterium avium subsp. paratuberculosis
gccggccagcggccagcccgc

SEQ ID NO: 1007048 - RNA, 19 nt, Mycobacterium avium subsp. paratuberculosis
gccggccagcuccgccacc

SEQ ID NO: 1007049 - RNA, 11 nt, Mycobacterium avium subsp. paratuberculosis
gccggccagcc

SEQ ID NO: 1007050 - RNA, 16 nt, Mycobacterium avium subsp. paratuberculosis
gccggccaccagcggc

SEQ ID NO: 1007051 - RNA, 13 nt, Mycobacterium avium subsp. paratuberculosis
gccggccagcaca

SEQ ID NO: 1007052 - RNA, 16 nt, Mycobacterium avium subsp. paratuberculosis
gccggccagcaccacg

SEQ ID NO: 1007053 - RNA, 19 nt, Mycobacterium avium subsp. paratuberculosis
gccggccagcacggccagc

SEQ ID NO: 1007054 - RNA, 19 nt, Mycobacterium avium subsp. paratuberculosis
gccggccagcacggcggcg

SEQ ID NO: 1007055 - RNA, 14 nt, Mycobacterium avium subsp. paratuberculosis
gccggccagcagca

SEQ ID NO: 1007056 - RNA, 17 nt, Mycobacterium avium subsp. paratuberculosis
gccggccagcagcaggu

SEQ ID NO: 1007057 - RNA, 15 nt, Mycobacterium avium subsp. paratuberculosis
gccggccagcagccg

SEQ ID NO: 1007058 - RNA, 17 nt, Mycobacterium avium subsp. paratuberculosis
gccggccagcagccggu

SEQ ID NO: 1007059 - RNA, 14 nt, Mycobacterium avium subsp. paratuberculosis
gccggccagcagcg

SEQ ID NO: 1007060 - RNA, 16 nt, Mycobacterium avium subsp. paratuberculosis
gccggcgcgcgguggu

SEQ ID NO: 1007061 - RNA, 15 nt, Mycobacterium avium subsp. paratuberculosis
gccggcgcggccagc

SEQ ID NO: 1007062 - RNA, 13 nt, Mycobacterium avium subsp. paratuberculosis
gccggcgccgcgg

SEQ ID NO: 1007063 - RNA, 16 nt, Mycobacterium avium subsp. paratuberculosis
gccggcgcgaccagcg

SEQ ID NO: 1007064 - RNA, 18 nt, Mycobacterium avium subsp. paratuberculosis
gccggcgcgaccagcggc

SEQ ID NO: 1007065 - RNA, 17 nt, Mycobacterium avium subsp. paratuberculosis
gccggcgccgggcgggc

SEQ ID NO: 1007066 - RNA, 22 nt, Mycobacterium avium subsp. paratuberculosis
gccggcgccggugccgcagccg

SEQ ID NO: 1007067 - RNA, 16 nt, Mycobacterium avium subsp. paratuberculosis
gccggcgcgcaccccg

SEQ ID NO: 1007068 - RNA, 13 nt, Mycobacterium avium subsp. paratuberculosis
gccggcgcgcagc

SEQ ID NO: 1007069 - RNA, 12 nt, Mycobacterium avium subsp. paratuberculosis
gccggcgcccgu

SEQ ID NO: 1007070 - RNA, 19 nt, Mycobacterium avium subsp. paratuberculosis
gccggcgcccgucacgcug

SEQ ID NO: 1007071 - RNA, 13 nt, Mycobacterium avium subsp. paratuberculosis
gccggcgcccugc

SEQ ID NO: 1007072 - RNA, 18 nt, Mycobacterium avium subsp. paratuberculosis
gccggcgcccugcgcgcc

SEQ ID NO: 1007073 - RNA, 19 nt, Mycobacterium avium subsp. paratuberculosis
gccggcgaugaacacgccg

SEQ ID NO: 1007074 - RNA, 17 nt, Mycobacterium avium subsp. paratuberculosis
gccggcgauggcgcggc

SEQ ID NO: 1007075 - RNA, 18 nt, Mycobacterium avium subsp. paratuberculosis
gccggcgauggcgcggcc

SEQ ID NO: 1007076 - RNA, 23 nt, Mycobacterium avium subsp. paratuberculosis
gccggcgauaggcggccagcucc

SEQ ID NO: 1007077 - RNA, 16 nt, Mycobacterium avium subsp. paratuberculosis
gccggcgacgccgcgc

SEQ ID NO: 1007078 - RNA, 19 nt, Mycobacterium avium subsp. paratuberculosis
gccggcgauccgcgcggcg

SEQ ID NO: 1007079 - RNA, 13 nt, Mycobacterium avium subsp. paratuberculosis
gccggcgcaggug

SEQ ID NO: 1007080 - RNA, 15 nt, Mycobacterium avium subsp. paratuberculosis
gccggcgcagguguc

SEQ ID NO: 1007081 - RNA, 21 nt, Mycobacterium avium subsp. paratuberculosis
gccggcgcagguguccagccc

SEQ ID NO: 1007082 - RNA, 20 nt, Mycobacterium avium subsp. paratuberculosis
gccggcgcaacucguccagc

SEQ ID NO: 1007083 - RNA, 14 nt, Mycobacterium avium subsp. paratuberculosis
gccggcgcaccgcg

SEQ ID NO: 1007084 - RNA, 16 nt, Mycobacterium avium subsp. paratuberculosis
gccggcgcacucccgc

SEQ ID NO: 1007085 - RNA, 18 nt, Mycobacterium avium subsp. paratuberculosis
gccggcgcacucccgcgu

SEQ ID NO: 1007086 - RNA, 15 nt, Mycobacterium avium subsp. paratuberculosis
gccggcgcagccggc

SEQ ID NO: 1007087 - RNA, 16 nt, Mycobacterium avium subsp. paratuberculosis
gccggcgaucaccggg

SEQ ID NO: 1007088 - RNA, 16 nt, Mycobacterium avium subsp. paratuberculosis
gccggcgacggccagc

SEQ ID NO: 1007089 - RNA, 22 nt, Mycobacterium avium subsp. paratuberculosis
gccggcgacgguggcgcccagc

SEQ ID NO: 1007090 - RNA, 16 nt, Mycobacterium avium subsp. paratuberculosis
gccggcgagcgcgcug

SEQ ID NO: 1007091 - RNA, 19 nt, Mycobacterium avium subsp. paratuberculosis
gccggcgagcucgcggccg

SEQ ID NO: 1007092 - RNA, 20 nt, Mycobacterium avium subsp. paratuberculosis
gccggcgagcucgcggccgu

SEQ ID NO: 1007093 - RNA, 14 nt, Mycobacterium avium subsp. paratuberculosis
gccggcgaccagcc

SEQ ID NO: 1007094 - RNA, 18 nt, Mycobacterium avium subsp. paratuberculosis
gccggcgaccagccccuc

SEQ ID NO: 1007095 - RNA, 15 nt, Mycobacterium avium subsp. paratuberculosis
gccggcgaccgccuu

SEQ ID NO: 1007096 - RNA, 16 nt, Mycobacterium avium subsp. paratuberculosis
gccggcgaccgccuug

SEQ ID NO: 1007097 - RNA, 16 nt, Mycobacterium avium subsp. paratuberculosis
gccggcgaaccgccgc

SEQ ID NO: 1007098 - RNA, 17 nt, Mycobacterium avium subsp. paratuberculosis
gccggcgaaccgccgca

SEQ ID NO: 1007099 - RNA, 18 nt, Mycobacterium avium subsp. paratuberculosis
gccggcgaaccgccgcac

SEQ ID NO: 1007100 - RNA, 19 nt, Mycobacterium avium subsp. paratuberculosis
gccggcgaaccucacccau

SEQ ID NO: 1007101 - RNA, 23 nt, Mycobacterium avium subsp. paratuberculosis
gccggcgaacuccacccugccga

SEQ ID NO: 1007102 - RNA, 17 nt, Mycobacterium avium subsp. paratuberculosis
gccggcgaacucgcggc

SEQ ID NO: 1007103 - RNA, 20 nt, Mycobacterium avium subsp. paratuberculosis
gccggcgaacucgcggcggg

SEQ ID NO: 1007104 - RNA, 16 nt, Mycobacterium avium subsp. paratuberculosis
gccggcgaaggacagc

SEQ ID NO: 1007105 - RNA, 22 nt, Mycobacterium avium subsp. paratuberculosis
gccggccuucucgcgcaccgcg

SEQ ID NO: 1007106 - RNA, 20 nt, Mycobacterium avium subsp. paratuberculosis
gccggccuugcucgccgcgu

SEQ ID NO: 1007107 - RNA, 18 nt, Mycobacterium avium subsp. paratuberculosis
gccggccuuggcccgcgc

SEQ ID NO: 1007108 - RNA, 17 nt, Mycobacterium avium subsp. paratuberculosis
gccggccuggcccagcc

SEQ ID NO: 1007109 - RNA, 23 nt, Mycobacterium avium subsp. paratuberculosis
gccggccugcccgccgcggccgc

SEQ ID NO: 1007110 - RNA, 19 nt, Mycobacterium avium subsp. paratuberculosis
gccggccucgggguugcug

SEQ ID NO: 1007111 - RNA, 13 nt, Mycobacterium avium subsp. paratuberculosis
gccggccgucagg

SEQ ID NO: 1007112 - RNA, 11 nt, Mycobacterium avium subsp. paratuberculosis
gccggccgggg

SEQ ID NO: 1007113 - RNA, 11 nt, Mycobacterium avium subsp. paratuberculosis
gccggccggca

SEQ ID NO: 1007114 - RNA, 12 nt, Mycobacterium avium subsp. paratuberculosis
gccggccggcag

SEQ ID NO: 1007115 - RNA, 14 nt, Mycobacterium avium subsp. paratuberculosis
gccggccggcagcu

SEQ ID NO: 1007116 - RNA, 15 nt, Mycobacterium avium subsp. paratuberculosis
gccggccgcgggcga

SEQ ID NO: 1007117 - RNA, 16 nt, Mycobacterium avium subsp. paratuberculosis
gccggccgcgcgcggc

SEQ ID NO: 1007118 - RNA, 14 nt, Mycobacterium avium subsp. paratuberculosis
gccggccgcgcaga

SEQ ID NO: 1007119 - RNA, 13 nt, Mycobacterium avium subsp. paratuberculosis
gccggccgccggc

SEQ ID NO: 1007120 - RNA, 12 nt, Mycobacterium avium subsp. paratuberculosis
gccggccgccgg

SEQ ID NO: 1007121 - RNA, 12 nt, Mycobacterium avium subsp. paratuberculosis
gccggccgccgu

SEQ ID NO: 1007122 - RNA, 23 nt, Mycobacterium avium subsp. paratuberculosis
gccggccgccguaucccugccag

SEQ ID NO: 1007123 - RNA, 14 nt, Mycobacterium avium subsp. paratuberculosis
gccggccgccgcgc

SEQ ID NO: 1007124 - RNA, 20 nt, Mycobacterium avium subsp. paratuberculosis
gccggccgccgcgcauccgc

SEQ ID NO: 1007125 - RNA, 17 nt, Mycobacterium avium subsp. paratuberculosis
gccggccgaugaccucg

SEQ ID NO: 1007126 - RNA, 13 nt, Mycobacterium avium subsp. paratuberculosis
gccggccgcagcu

SEQ ID NO: 1007127 - RNA, 16 nt, Mycobacterium avium subsp. paratuberculosis
gccggcccugcggcca

SEQ ID NO: 1007128 - RNA, 18 nt, Mycobacterium avium subsp. paratuberculosis
gccggccgaacacggccg

SEQ ID NO: 1007129 - RNA, 22 nt, Mycobacterium avium subsp. paratuberculosis
gccggccgaacacggccgccuc

SEQ ID NO: 1007130 - RNA, 14 nt, Mycobacterium avium subsp. paratuberculosis
gccggcccgcggcg

SEQ ID NO: 1007131 - RNA, 19 nt, Mycobacterium avium subsp. paratuberculosis
gccggcccgagcccugcgc

SEQ ID NO: 1007132 - RNA, 24 nt, Mycobacterium avium subsp. paratuberculosis
gccggcccgauaggccgacuggug

SEQ ID NO: 1007133 - RNA, 20 nt, Mycobacterium avium subsp. paratuberculosis
gccggccccuaccgccgagc

SEQ ID NO: 1007134 - RNA, 22 nt, Mycobacterium avium subsp. paratuberculosis
gccgggauauucgcccagcggc

SEQ ID NO: 1007135 - RNA, 22 nt, Mycobacterium avium subsp. paratuberculosis
gccgggaaaguuguagcgcagc

SEQ ID NO: 1007136 - RNA, 19 nt, Mycobacterium avium subsp. paratuberculosis
gccgggacagguagcgcag

SEQ ID NO: 1007137 - RNA, 20 nt, Mycobacterium avium subsp. paratuberculosis
gccgggacagguagcgcagc

SEQ ID NO: 1007138 - RNA, 21 nt, Mycobacterium avium subsp. paratuberculosis
gccgggaaucgagggcgcgca

SEQ ID NO: 1007139 - RNA, 19 nt, Mycobacterium avium subsp. paratuberculosis
gccgggaaugucgcgcagc

SEQ ID NO: 1007140 - RNA, 20 nt, Mycobacterium avium subsp. paratuberculosis
gccgggaucggcggggcgcg

SEQ ID NO: 1007141 - RNA, 20 nt, Mycobacterium avium subsp. paratuberculosis
gccgggauugugcuccagga

SEQ ID NO: 1007142 - RNA, 17 nt, Mycobacterium avium subsp. paratuberculosis
gccgggcaacagcgcgc

SEQ ID NO: 1007143 - RNA, 23 nt, Mycobacterium avium subsp. paratuberculosis
gccgggcaacagcgcgccggccg

SEQ ID NO: 1007144 - RNA, 13 nt, Mycobacterium avium subsp. paratuberculosis
gccgggaacagcg

SEQ ID NO: 1007145 - RNA, 14 nt, Mycobacterium avium subsp. paratuberculosis
gccggcuugggcga

SEQ ID NO: 1007146 - RNA, 23 nt, Mycobacterium avium subsp. paratuberculosis
gccggcuuaccgaccucgaggcc

SEQ ID NO: 1007147 - RNA, 21 nt, Mycobacterium avium subsp. paratuberculosis
gccggcguuauuugugcgcug

SEQ ID NO: 1007148 - RNA, 23 nt, Mycobacterium avium subsp. paratuberculosis
gccggcgucgucgagcaccggca

SEQ ID NO: 1007149 - RNA, 21 nt, Mycobacterium avium subsp. paratuberculosis
gccggcgucgucgucgcagug

SEQ ID NO: 1007150 - RNA, 23 nt, Mycobacterium avium subsp. paratuberculosis
gccggcgugcacaggccgccgca

SEQ ID NO: 1007151 - RNA, 21 nt, Mycobacterium avium subsp. paratuberculosis
gccggcgucggugucccgcgc

SEQ ID NO: 1007152 - RNA, 21 nt, Mycobacterium avium subsp. paratuberculosis
gccggcgugcugggccacgau

SEQ ID NO: 1007153 - RNA, 18 nt, Mycobacterium avium subsp. paratuberculosis
gccggcuggaacaucccg

SEQ ID NO: 1007154 - RNA, 14 nt, Mycobacterium avium subsp. paratuberculosis
gccggcuggcgggc

SEQ ID NO: 1007155 - RNA, 16 nt, Mycobacterium avium subsp. paratuberculosis
gccggcuggcgggcga

SEQ ID NO: 1007156 - RNA, 14 nt, Mycobacterium avium subsp. paratuberculosis
gccggcugcagccg

SEQ ID NO: 1007157 - RNA, 17 nt, Mycobacterium avium subsp. paratuberculosis
gccggcugcagccgggc

SEQ ID NO: 1007158 - RNA, 17 nt, Mycobacterium avium subsp. paratuberculosis
gccggcugaaccugcug

SEQ ID NO: 1007159 - RNA, 21 nt, Mycobacterium avium subsp. paratuberculosis
gccggcuccgcaugcccgggc

SEQ ID NO: 1007160 - RNA, 13 nt, Mycobacterium avium subsp. paratuberculosis
gccggcuccaccg

SEQ ID NO: 1007161 - RNA, 16 nt, Mycobacterium avium subsp. paratuberculosis
gccggcuccaccgcgc

SEQ ID NO: 1007162 - RNA, 18 nt, Mycobacterium avium subsp. paratuberculosis
gccggcuccaccgcgccg

SEQ ID NO: 1007163 - RNA, 20 nt, Mycobacterium avium subsp. paratuberculosis
gccggcuccaccgcgccggc

SEQ ID NO: 1007164 - RNA, 21 nt, Mycobacterium avium subsp. paratuberculosis
gccggcuccaccgcgccggcg

SEQ ID NO: 1007165 - RNA, 23 nt, Mycobacterium avium subsp. paratuberculosis
gccggcuccaccgcgccggcggc

SEQ ID NO: 1007166 - RNA, 14 nt, Mycobacterium avium subsp. paratuberculosis
gccggcggugcagg

SEQ ID NO: 1007167 - RNA, 14 nt, Mycobacterium avium subsp. paratuberculosis
gccggcggugcggg

SEQ ID NO: 1007168 - RNA, 19 nt, Mycobacterium avium subsp. paratuberculosis
gccggcgguucggcgggcc

SEQ ID NO: 1007169 - RNA, 18 nt, Mycobacterium avium subsp. paratuberculosis
gccggcguacucgcacag

SEQ ID NO: 1007170 - RNA, 16 nt, Mycobacterium avium subsp. paratuberculosis
gccggcguagaccagc

SEQ ID NO: 1007171 - RNA, 13 nt, Mycobacterium avium subsp. paratuberculosis
gccggcggucagg

SEQ ID NO: 1007172 - RNA, 16 nt, Mycobacterium avium subsp. paratuberculosis
gccggcgucgccgcug

SEQ ID NO: 1007173 - RNA, 15 nt, Mycobacterium avium subsp. paratuberculosis
gccggcgucgcggug

SEQ ID NO: 1007174 - RNA, 22 nt, Mycobacterium avium subsp. paratuberculosis
gccggcguccaguucggccagc

SEQ ID NO: 1007175 - RNA, 15 nt, Mycobacterium avium subsp. paratuberculosis
gccggcgucacucug

SEQ ID NO: 1007176 - RNA, 18 nt, Mycobacterium avium subsp. paratuberculosis
gccggcguccagcgccgc

SEQ ID NO: 1007177 - RNA, 15 nt, Mycobacterium avium subsp. paratuberculosis
gccggcggggcgucg

SEQ ID NO: 1007178 - RNA, 18 nt, Mycobacterium avium subsp. paratuberculosis
gccggcggggcgucgccc

SEQ ID NO: 1007179 - RNA, 23 nt, Mycobacterium avium subsp. paratuberculosis
gccggcggggcgucgcccgccga

SEQ ID NO: 1007180 - RNA, 15 nt, Mycobacterium avium subsp. paratuberculosis
gccggcgggggcgcg

SEQ ID NO: 1007181 - RNA, 18 nt, Mycobacterium avium subsp. paratuberculosis
gccggcgggggcgcgucc

SEQ ID NO: 1007182 - RNA, 22 nt, Mycobacterium avium subsp. paratuberculosis
gccggcgggggcgcguccgcgg

SEQ ID NO: 1007183 - RNA, 15 nt, Mycobacterium avium subsp. paratuberculosis
gccggcgggcgcucg

SEQ ID NO: 1007184 - RNA, 16 nt, Mycobacterium avium subsp. paratuberculosis
gccggcggcggccagc

SEQ ID NO: 1007185 - RNA, 12 nt, Mycobacterium avium subsp. paratuberculosis
gccggcggcggg

SEQ ID NO: 1007186 - RNA, 13 nt, Mycobacterium avium subsp. paratuberculosis
gccggcggcgggc

SEQ ID NO: 1007187 - RNA, 14 nt, Mycobacterium avium subsp. paratuberculosis
gccggcggcggugc

SEQ ID NO: 1007188 - RNA, 22 nt, Mycobacterium avium subsp. paratuberculosis
gccggcggcggugcgucgggcg

SEQ ID NO: 1007189 - RNA, 12 nt, Mycobacterium avium subsp. paratuberculosis
gccggcggcgga

SEQ ID NO: 1007190 - RNA, 21 nt, Mycobacterium avium subsp. paratuberculosis
gccggcggcgaagccggcccc

SEQ ID NO: 1007191 - RNA, 15 nt, Mycobacterium avium subsp. paratuberculosis
gccggcggcgcccgc

SEQ ID NO: 1007192 - RNA, 15 nt, Mycobacterium avium subsp. paratuberculosis
gccggcggccgccgc

SEQ ID NO: 1007193 - RNA, 16 nt, Mycobacterium avium subsp. paratuberculosis
gccggcggccgccggc

SEQ ID NO: 1007194 - RNA, 14 nt, Mycobacterium avium subsp. paratuberculosis
gccggcggccgcga

SEQ ID NO: 1007195 - RNA, 13 nt, Mycobacterium avium subsp. paratuberculosis
gccggcggccgcc

SEQ ID NO: 1007196 - RNA, 13 nt, Mycobacterium avium subsp. paratuberculosis
gccggcggccacg

SEQ ID NO: 1007197 - RNA, 15 nt, Mycobacterium avium subsp. paratuberculosis
gccggcggccacgau

SEQ ID NO: 1007198 - RNA, 14 nt, Mycobacterium avium subsp. paratuberculosis
gccggcggccacgc

SEQ ID NO: 1007199 - RNA, 13 nt, Mycobacterium avium subsp. paratuberculosis
gccggcggccagc

SEQ ID NO: 1007200 - RNA, 14 nt, Mycobacterium avium subsp. paratuberculosis
gccggcggccagca

SEQ ID NO: 1007201 - RNA, 18 nt, Mycobacterium avium subsp. paratuberculosis
gccggcgcuggcgcgccg

SEQ ID NO: 1007202 - RNA, 20 nt, Mycobacterium avium subsp. paratuberculosis
gccggcgcuucugcgccggu

SEQ ID NO: 1007203 - RNA, 23 nt, Mycobacterium avium subsp. paratuberculosis
gccggcgcuucugcgccgguucg

SEQ ID NO: 1007204 - RNA, 17 nt, Mycobacterium avium subsp. paratuberculosis
gccggcggacagccccg

SEQ ID NO: 1007205 - RNA, 19 nt, Mycobacterium avium subsp. paratuberculosis
gccggcggacgcggccagc

SEQ ID NO: 1007206 - RNA, 19 nt, Mycobacterium avium subsp. paratuberculosis
gccggcgcggugggcggcg

SEQ ID NO: 1007207 - RNA, 20 nt, Mycobacterium avium subsp. paratuberculosis
gccggcgcguccggaggugc

SEQ ID NO: 1007208 - RNA, 14 nt, Mycobacterium avium subsp. paratuberculosis
gccgguuggcggcc

SEQ ID NO: 1007209 - RNA, 17 nt, Mycobacterium avium subsp. paratuberculosis
gccgguucgucccgcgc

SEQ ID NO: 1007210 - RNA, 15 nt, Mycobacterium avium subsp. paratuberculosis
gccgguucgcuggcg

SEQ ID NO: 1007211 - RNA, 22 nt, Mycobacterium avium subsp. paratuberculosis
gccggugugaucgagcaccagc

SEQ ID NO: 1007212 - RNA, 21 nt, Mycobacterium avium subsp. paratuberculosis
gccggugugcagccacccguc

SEQ ID NO: 1007213 - RNA, 14 nt, Mycobacterium avium subsp. paratuberculosis
gccguacaugguga

SEQ ID NO: 1007214 - RNA, 13 nt, Mycobacterium avium subsp. paratuberculosis
gccguaggccagg

SEQ ID NO: 1007215 - RNA, 17 nt, Mycobacterium avium subsp. paratuberculosis
gccguagcgcuggguga

SEQ ID NO: 1007216 - RNA, 17 nt, Mycobacterium avium subsp. paratuberculosis
gccguagcggcucgcca

SEQ ID NO: 1007217 - RNA, 23 nt, Mycobacterium avium subsp. paratuberculosis
gccguaccgcaacaccgaaagcc

SEQ ID NO: 1007218 - RNA, 14 nt, Mycobacterium avium subsp. paratuberculosis
gccgucauccccau

SEQ ID NO: 1007219 - RNA, 23 nt, Mycobacterium avium subsp. paratuberculosis
gccgucauccccaucucgagcag

SEQ ID NO: 1007220 - RNA, 20 nt, Mycobacterium avium subsp. paratuberculosis
gccgucaggagugcucggcg

SEQ ID NO: 1007221 - RNA, 23 nt, Mycobacterium avium subsp. paratuberculosis
gccgucaggccugguaggccgcc

SEQ ID NO: 1007222 - RNA, 14 nt, Mycobacterium avium subsp. paratuberculosis
gccguaggccgcgc

SEQ ID NO: 1007223 - RNA, 18 nt, Mycobacterium avium subsp. paratuberculosis
gccguccuugucgcgcac

SEQ ID NO: 1007224 - RNA, 18 nt, Mycobacterium avium subsp. paratuberculosis
gccgucgaaacggcugcu

SEQ ID NO: 1007225 - RNA, 14 nt, Mycobacterium avium subsp. paratuberculosis
gccguccacccggc

SEQ ID NO: 1007226 - RNA, 14 nt, Mycobacterium avium subsp. paratuberculosis
gccguccagcagca

SEQ ID NO: 1007227 - RNA, 19 nt, Mycobacterium avium subsp. paratuberculosis
gccgucgccgcacgcccac

SEQ ID NO: 1007228 - RNA, 19 nt, Mycobacterium avium subsp. paratuberculosis
gccgucgcaucagcucggc

SEQ ID NO: 1007229 - RNA, 19 nt, Mycobacterium avium subsp. paratuberculosis
gccgucgguaucgaggucc

SEQ ID NO: 1007230 - RNA, 18 nt, Mycobacterium avium subsp. paratuberculosis
gccgucgucagccgggcc

SEQ ID NO: 1007231 - RNA, 21 nt, Mycobacterium avium subsp. paratuberculosis
gccgucgagggggagcaggac

SEQ ID NO: 1007232 - RNA, 18 nt, Mycobacterium avium subsp. paratuberculosis
gccgucgaaggccgggcu

SEQ ID NO: 1007233 - RNA, 19 nt, Mycobacterium avium subsp. paratuberculosis
gccgucgaccccgccggcc

SEQ ID NO: 1007234 - RNA, 20 nt, Mycobacterium avium subsp. paratuberculosis
gccguucuucucacagguga

SEQ ID NO: 1007235 - RNA, 17 nt, Mycobacterium avium subsp. paratuberculosis
gccguucuugcggguga

SEQ ID NO: 1007236 - RNA, 21 nt, Mycobacterium avium subsp. paratuberculosis
gccguugaccggugcgcccgc

SEQ ID NO: 1007237 - RNA, 16 nt, Mycobacterium avium subsp. paratuberculosis
gccguucugacccuuc

SEQ ID NO: 1007238 - RNA, 18 nt, Mycobacterium avium subsp. paratuberculosis
gccguugauugcgcccgc

SEQ ID NO: 1007239 - RNA, 16 nt, Mycobacterium avium subsp. paratuberculosis
gccguugaucgagcac

SEQ ID NO: 1007240 - RNA, 16 nt, Mycobacterium avium subsp. paratuberculosis
gccguuuugccgccga

SEQ ID NO: 1007241 - RNA, 20 nt, Mycobacterium avium subsp. paratuberculosis
gccguugccggcccgcagcg

SEQ ID NO: 1007242 - RNA, 14 nt, Mycobacterium avium subsp. paratuberculosis
gccguugccgccgc

SEQ ID NO: 1007243 - RNA, 16 nt, Mycobacterium avium subsp. paratuberculosis
gccguugccgccgcgc

SEQ ID NO: 1007244 - RNA, 19 nt, Mycobacterium avium subsp. paratuberculosis
gccuacaggugccggcggc

SEQ ID NO: 1007245 - RNA, 16 nt, Mycobacterium avium subsp. paratuberculosis
gccguguacagcaggg

SEQ ID NO: 1007246 - RNA, 20 nt, Mycobacterium avium subsp. paratuberculosis
gccgugggugccgacgagcu

SEQ ID NO: 1007247 - RNA, 13 nt, Mycobacterium avium subsp. paratuberculosis
gccguggucggug

SEQ ID NO: 1007248 - RNA, 20 nt, Mycobacterium avium subsp. paratuberculosis
gccguggccgucacgcuggc

SEQ ID NO: 1007249 - RNA, 16 nt, Mycobacterium avium subsp. paratuberculosis
gccgugcgccagcgac

SEQ ID NO: 1007250 - RNA, 21 nt, Mycobacterium avium subsp. paratuberculosis
gccguggcguuacacccgcgg

SEQ ID NO: 1007251 - RNA, 13 nt, Mycobacterium avium subsp. paratuberculosis
gccguggcggcgg

SEQ ID NO: 1007252 - RNA, 14 nt, Mycobacterium avium subsp. paratuberculosis
gccguggcggcggg

SEQ ID NO: 1007253 - RNA, 19 nt, Mycobacterium avium subsp. paratuberculosis
gccguggcggcgggccagc

SEQ ID NO: 1007254 - RNA, 16 nt, Mycobacterium avium subsp. paratuberculosis
gccgucucgagccggc

SEQ ID NO: 1007255 - RNA, 20 nt, Mycobacterium avium subsp. paratuberculosis
gccgucguugcgggcggcgc

SEQ ID NO: 1007256 - RNA, 22 nt, Mycobacterium avium subsp. paratuberculosis
gccgucgucggacaccagcaug

SEQ ID NO: 1007257 - RNA, 21 nt, Mycobacterium avium subsp. paratuberculosis
gccgucgucgucggccgggcc

SEQ ID NO: 1007258 - RNA, 21 nt, Mycobacterium avium subsp. paratuberculosis
gccgucguggguauccgccgc

SEQ ID NO: 1007259 - RNA, 19 nt, Mycobacterium avium subsp. paratuberculosis
gccgucgugguggccgcga

SEQ ID NO: 1007260 - RNA, 21 nt, Mycobacterium avium subsp. paratuberculosis
gccgucguugacgcccuccug

SEQ ID NO: 1007261 - RNA, 16 nt, Mycobacterium avium subsp. paratuberculosis
gccgugaugcgccggc

SEQ ID NO: 1007262 - RNA, 18 nt, Mycobacterium avium subsp. paratuberculosis
gccgugcccggcgcccug

SEQ ID NO: 1007263 - RNA, 13 nt, Mycobacterium avium subsp. paratuberculosis
gccgugcccgagg

SEQ ID NO: 1007264 - RNA, 13 nt, Mycobacterium avium subsp. paratuberculosis
gccgugcccgcgg

SEQ ID NO: 1007265 - RNA, 16 nt, Mycobacterium avium subsp. paratuberculosis
gccgugcagaacagca

SEQ ID NO: 1007266 - RNA, 19 nt, Mycobacterium avium subsp. paratuberculosis
gccgugcagcacgccgcgg

SEQ ID NO: 1007267 - RNA, 20 nt, Mycobacterium avium subsp. paratuberculosis
gccgugcagcacgccgcgga

SEQ ID NO: 1007268 - RNA, 17 nt, Mycobacterium avium subsp. paratuberculosis
gccgugcagcgcccagc

SEQ ID NO: 1007269 - RNA, 21 nt, Mycobacterium avium subsp. paratuberculosis
gccgugcagggggcgcagccg

SEQ ID NO: 1007270 - RNA, 21 nt, Mycobacterium avium subsp. paratuberculosis
gccgugcaucgggcgcucggc

SEQ ID NO: 1007271 - RNA, 14 nt, Mycobacterium avium subsp. paratuberculosis
gccgugccagccgg

SEQ ID NO: 1007272 - RNA, 21 nt, Mycobacterium avium subsp. paratuberculosis
gccgugccagccggccgcuga

SEQ ID NO: 1007273 - RNA, 15 nt, Mycobacterium avium subsp. paratuberculosis
gccgggucgccgucg

SEQ ID NO: 1007274 - RNA, 13 nt, Mycobacterium avium subsp. paratuberculosis
gccgggucgcagc

SEQ ID NO: 1007275 - RNA, 14 nt, Mycobacterium avium subsp. paratuberculosis
gccgggucgcagcg

SEQ ID NO: 1007276 - RNA, 22 nt, Mycobacterium avium subsp. paratuberculosis
gccgggucgcaggcagcagcac

SEQ ID NO: 1007277 - RNA, 17 nt, Mycobacterium avium subsp. paratuberculosis
gccggguccuugcgccc

SEQ ID NO: 1007278 - RNA, 19 nt, Mycobacterium avium subsp. paratuberculosis
gccgggucaguucgcggcg

SEQ ID NO: 1007279 - RNA, 20 nt, Mycobacterium avium subsp. paratuberculosis
gccgggucaguucgcggcgc

SEQ ID NO: 1007280 - RNA, 22 nt, Mycobacterium avium subsp. paratuberculosis
gccgggguccgcaacgccggcg

SEQ ID NO: 1007281 - RNA, 21 nt, Mycobacterium avium subsp. paratuberculosis
gccgggguccucucggcgccg

SEQ ID NO: 1007282 - RNA, 20 nt, Mycobacterium avium subsp. paratuberculosis
gccggggugcccgggccgca

SEQ ID NO: 1007283 - RNA, 13 nt, Mycobacterium avium subsp. paratuberculosis
gccggggugugca

SEQ ID NO: 1007284 - RNA, 16 nt, Mycobacterium avium subsp. paratuberculosis
gccggguagcgccgcc

SEQ ID NO: 1007285 - RNA, 19 nt, Mycobacterium avium subsp. paratuberculosis
gccgggggcgcgggcggca

SEQ ID NO: 1007286 - RNA, 15 nt, Mycobacterium avium subsp. paratuberculosis
gccgggggcggcggc

SEQ ID NO: 1007287 - RNA, 15 nt, Mycobacterium avium subsp. paratuberculosis
gccgggggcggugca

SEQ ID NO: 1007288 - RNA, 17 nt, Mycobacterium avium subsp. paratuberculosis
gccgggggcggugcagc

SEQ ID NO: 1007289 - RNA, 19 nt, Mycobacterium avium subsp. paratuberculosis
gccgggggcggugcagccg

SEQ ID NO: 1007290 - RNA, 15 nt, Mycobacterium avium subsp. paratuberculosis
gccgggggccgagca

SEQ ID NO: 1007291 - RNA, 20 nt, Mycobacterium avium subsp. paratuberculosis
gccgggguagaggccgcgga

SEQ ID NO: 1007292 - RNA, 17 nt, Mycobacterium avium subsp. paratuberculosis
gccgggguagggcggcg

SEQ ID NO: 1007293 - RNA, 15 nt, Mycobacterium avium subsp. paratuberculosis
gccggggccagcacc

SEQ ID NO: 1007294 - RNA, 16 nt, Mycobacterium avium subsp. paratuberculosis
gccggggccagcaccc

SEQ ID NO: 1007295 - RNA, 12 nt, Mycobacterium avium subsp. paratuberculosis
gccggggcacca

SEQ ID NO: 1007296 - RNA, 13 nt, Mycobacterium avium subsp. paratuberculosis
gccggggcaccau

SEQ ID NO: 1007297 - RNA, 21 nt, Mycobacterium avium subsp. paratuberculosis
gccggggcaccauugcgggaa

SEQ ID NO: 1007298 - RNA, 17 nt, Mycobacterium avium subsp. paratuberculosis
gccggggcagcacccgc

SEQ ID NO: 1007299 - RNA, 17 nt, Mycobacterium avium subsp. paratuberculosis
gccggggacggugcagc

SEQ ID NO: 1007300 - RNA, 21 nt, Mycobacterium avium subsp. paratuberculosis
gccggggacggugcagccggg

SEQ ID NO: 1007301 - RNA, 14 nt, Mycobacterium avium subsp. paratuberculosis
gccgggcuggcgcu

SEQ ID NO: 1007302 - RNA, 15 nt, Mycobacterium avium subsp. paratuberculosis
gccgggcuggcgcug

SEQ ID NO: 1007303 - RNA, 17 nt, Mycobacterium avium subsp. paratuberculosis
gccgggcuggcgcugga

SEQ ID NO: 1007304 - RNA, 19 nt, Mycobacterium avium subsp. paratuberculosis
gccgggcugguccggaacc

SEQ ID NO: 1007305 - RNA, 21 nt, Mycobacterium avium subsp. paratuberculosis
gccggggcgggcacgucgcgc

SEQ ID NO: 1007306 - RNA, 21 nt, Mycobacterium avium subsp. paratuberculosis
gccggggcucauacggcggcu

SEQ ID NO: 1007307 - RNA, 24 nt, Mycobacterium avium subsp. paratuberculosis
gccgggggaggcguugcgucccgc

SEQ ID NO: 1007308 - RNA, 13 nt, Mycobacterium avium subsp. paratuberculosis
gccggggcgcaga

SEQ ID NO: 1007309 - RNA, 14 nt, Mycobacterium avium subsp. paratuberculosis
gccggggcgccgcc

SEQ ID NO: 1007310 - RNA, 16 nt, Mycobacterium avium subsp. paratuberculosis
gccggggccgcggcuc

SEQ ID NO: 1007311 - RNA, 22 nt, Mycobacterium avium subsp. paratuberculosis
gccgggcacgaauucgguggcg

SEQ ID NO: 1007312 - RNA, 14 nt, Mycobacterium avium subsp. paratuberculosis
gccgggcaccgcgc

SEQ ID NO: 1007313 - RNA, 18 nt, Mycobacterium avium subsp. paratuberculosis
gccgggcaccgcgcccgc

SEQ ID NO: 1007314 - RNA, 13 nt, Mycobacterium avium subsp. paratuberculosis
gccgggcaccagc

SEQ ID NO: 1007315 - RNA, 16 nt, Mycobacterium avium subsp. paratuberculosis
gccgggcaccagcgac

SEQ ID NO: 1007316 - RNA, 17 nt, Mycobacterium avium subsp. paratuberculosis
gccgggcagcccgccgc

SEQ ID NO: 1007317 - RNA, 20 nt, Mycobacterium avium subsp. paratuberculosis
gccgggcagcccgccgcgga

SEQ ID NO: 1007318 - RNA, 15 nt, Mycobacterium avium subsp. paratuberculosis
gccgggcacucccuu

SEQ ID NO: 1007319 - RNA, 13 nt, Mycobacterium avium subsp. paratuberculosis
gccgggcaggugg

SEQ ID NO: 1007320 - RNA, 23 nt, Mycobacterium avium subsp. paratuberculosis
gccgggcauccgggccgccgcgg

SEQ ID NO: 1007321 - RNA, 17 nt, Mycobacterium avium subsp. paratuberculosis
gccgggcaugccguuca

SEQ ID NO: 1007322 - RNA, 14 nt, Mycobacterium avium subsp. paratuberculosis
gccgggcagcgcgc

SEQ ID NO: 1007323 - RNA, 15 nt, Mycobacterium avium subsp. paratuberculosis
gccgggccugcggcg

SEQ ID NO: 1007324 - RNA, 21 nt, Mycobacterium avium subsp. paratuberculosis
gccgggccggcggccaguucg

SEQ ID NO: 1007325 - RNA, 17 nt, Mycobacterium avium subsp. paratuberculosis
gccgggccgcauccagc

SEQ ID NO: 1007326 - RNA, 22 nt, Mycobacterium avium subsp. paratuberculosis
gccgggccgccgcggccacacu

SEQ ID NO: 1007327 - RNA, 16 nt, Mycobacterium avium subsp. paratuberculosis
gccgggccaggugugc

SEQ ID NO: 1007328 - RNA, 14 nt, Mycobacterium avium subsp. paratuberculosis
gccgggccagcagc

SEQ ID NO: 1007329 - RNA, 13 nt, Mycobacterium avium subsp. paratuberculosis
gccgggccagccc

SEQ ID NO: 1007330 - RNA, 15 nt, Mycobacterium avium subsp. paratuberculosis
gccgggccagccggc

SEQ ID NO: 1007331 - RNA, 21 nt, Mycobacterium avium subsp. paratuberculosis
gccgggcgggggcuguccacc

SEQ ID NO: 1007332 - RNA, 17 nt, Mycobacterium avium subsp. paratuberculosis
gccgggcggcagcagcu

SEQ ID NO: 1007333 - RNA, 18 nt, Mycobacterium avium subsp. paratuberculosis
gccgggcgucacgccagc

SEQ ID NO: 1007334 - RNA, 19 nt, Mycobacterium avium subsp. paratuberculosis
gccgggcgucacgccagcg

SEQ ID NO: 1007335 - RNA, 14 nt, Mycobacterium avium subsp. paratuberculosis
gccgggcgucgcgc

SEQ ID NO: 1007336 - RNA, 19 nt, Mycobacterium avium subsp. paratuberculosis
gccgggcguugcccgccgc

SEQ ID NO: 1007337 - RNA, 21 nt, Mycobacterium avium subsp. paratuberculosis
gccgggcguugcccgccgcgg

SEQ ID NO: 1007338 - RNA, 18 nt, Mycobacterium avium subsp. paratuberculosis
gccgggcugagcugugcc

SEQ ID NO: 1007339 - RNA, 18 nt, Mycobacterium avium subsp. paratuberculosis
gccgggcugcgcagcacc

SEQ ID NO: 1007340 - RNA, 16 nt, Mycobacterium avium subsp. paratuberculosis
gccgggcucgagggcg

SEQ ID NO: 1007341 - RNA, 20 nt, Mycobacterium avium subsp. paratuberculosis
gccgggcucgaguuuggcca

SEQ ID NO: 1007342 - RNA, 22 nt, Mycobacterium avium subsp. paratuberculosis
gccgggcucgaguuuggccagc

SEQ ID NO: 1007343 - RNA, 13 nt, Mycobacterium avium subsp. paratuberculosis
gccgggcucccgc

SEQ ID NO: 1007344 - RNA, 14 nt, Mycobacterium avium subsp. paratuberculosis
gccgggcucccgcu

SEQ ID NO: 1007345 - RNA, 14 nt, Mycobacterium avium subsp. paratuberculosis
gccgggcggccagc

SEQ ID NO: 1007346 - RNA, 14 nt, Mycobacterium avium subsp. paratuberculosis
gccgggcggcccgc

SEQ ID NO: 1007347 - RNA, 14 nt, Mycobacterium avium subsp. paratuberculosis
gccgggcgcuggcc

SEQ ID NO: 1007348 - RNA, 13 nt, Mycobacterium avium subsp. paratuberculosis
gccgggcgcccgc

SEQ ID NO: 1007349 - RNA, 19 nt, Mycobacterium avium subsp. paratuberculosis
gccgggcgccacccgcaug

SEQ ID NO: 1007350 - RNA, 17 nt, Mycobacterium avium subsp. paratuberculosis
gccgggcgccacgcugg

SEQ ID NO: 1007351 - RNA, 19 nt, Mycobacterium avium subsp. paratuberculosis
gccgggcgccacgcuggcg

SEQ ID NO: 1007352 - RNA, 15 nt, Mycobacterium avium subsp. paratuberculosis
gccgguaccgccggc

SEQ ID NO: 1007353 - RNA, 17 nt, Mycobacterium avium subsp. paratuberculosis
gccgguagagcgccagg

SEQ ID NO: 1007354 - RNA, 17 nt, Mycobacterium avium subsp. paratuberculosis
gccgggugcccaucugc

SEQ ID NO: 1007355 - RNA, 14 nt, Mycobacterium avium subsp. paratuberculosis
gccggguugggcgg

SEQ ID NO: 1007356 - RNA, 16 nt, Mycobacterium avium subsp. paratuberculosis
gccggguugggcggcg

SEQ ID NO: 1007357 - RNA, 17 nt, Mycobacterium avium subsp. paratuberculosis
gccggguuguagcaggc

SEQ ID NO: 1007358 - RNA, 19 nt, Mycobacterium avium subsp. paratuberculosis
gccggguuguagcaggcgg

SEQ ID NO: 1007359 - RNA, 17 nt, Mycobacterium avium subsp. paratuberculosis
gccgggugcgggccagc

SEQ ID NO: 1007360 - RNA, 15 nt, Mycobacterium avium subsp. paratuberculosis
gccgggugcggugca

SEQ ID NO: 1007361 - RNA, 14 nt, Mycobacterium avium subsp. paratuberculosis
gccggguggcccgc

SEQ ID NO: 1007362 - RNA, 14 nt, Mycobacterium avium subsp. paratuberculosis
gccgguccagccgc

SEQ ID NO: 1007363 - RNA, 15 nt, Mycobacterium avium subsp. paratuberculosis
gccggucccgcggcg

SEQ ID NO: 1007364 - RNA, 18 nt, Mycobacterium avium subsp. paratuberculosis
gccggucccgcggcggcg

SEQ ID NO: 1007365 - RNA, 18 nt, Mycobacterium avium subsp. paratuberculosis
gccggucgaggucgccga

SEQ ID NO: 1007366 - RNA, 20 nt, Mycobacterium avium subsp. paratuberculosis
gccgguccugggccuccggc

SEQ ID NO: 1007367 - RNA, 17 nt, Mycobacterium avium subsp. paratuberculosis
gccgguccuuggccugc

SEQ ID NO: 1007368 - RNA, 20 nt, Mycobacterium avium subsp. paratuberculosis
gccggucgaacgccagcgcc

SEQ ID NO: 1007369 - RNA, 19 nt, Mycobacterium avium subsp. paratuberculosis
gccggucgacgcggggcgg

SEQ ID NO: 1007370 - RNA, 15 nt, Mycobacterium avium subsp. paratuberculosis
gccgguaggccgcgc

SEQ ID NO: 1007371 - RNA, 17 nt, Mycobacterium avium subsp. paratuberculosis
gccgguaggcgcgggug

SEQ ID NO: 1007372 - RNA, 23 nt, Mycobacterium avium subsp. paratuberculosis
gccgguaggcggccagcgcccgc

SEQ ID NO: 1007373 - RNA, 23 nt, Mycobacterium avium subsp. paratuberculosis
gccgguggacaggugcauccagu

SEQ ID NO: 1007374 - RNA, 22 nt, Mycobacterium avium subsp. paratuberculosis
gccgguggauauuucgcggccg

SEQ ID NO: 1007375 - RNA, 17 nt, Mycobacterium avium subsp. paratuberculosis
gccgguggcagcccggc

SEQ ID NO: 1007376 - RNA, 14 nt, Mycobacterium avium subsp. paratuberculosis
gccgguggccgcga

SEQ ID NO: 1007377 - RNA, 22 nt, Mycobacterium avium subsp. paratuberculosis
gccggugcuggucaugccgucg

SEQ ID NO: 1007378 - RNA, 21 nt, Mycobacterium avium subsp. paratuberculosis
gccggugguuuugcggcccug

SEQ ID NO: 1007379 - RNA, 22 nt, Mycobacterium avium subsp. paratuberculosis
gccggugguuuugcggcccugc

SEQ ID NO: 1007380 - RNA, 13 nt, Mycobacterium avium subsp. paratuberculosis
gccgguggcggcg

SEQ ID NO: 1007381 - RNA, 17 nt, Mycobacterium avium subsp. paratuberculosis
gccgguggcggcgagga

SEQ ID NO: 1007382 - RNA, 16 nt, Mycobacterium avium subsp. paratuberculosis
gccgguggcgucggug

SEQ ID NO: 1007383 - RNA, 21 nt, Mycobacterium avium subsp. paratuberculosis
gccggugcgcgucagccgucg

SEQ ID NO: 1007384 - RNA, 12 nt, Mycobacterium avium subsp. paratuberculosis
gccggugcggcc

SEQ ID NO: 1007385 - RNA, 15 nt, Mycobacterium avium subsp. paratuberculosis
gccggugcggccgcg

SEQ ID NO: 1007386 - RNA, 16 nt, Mycobacterium avium subsp. paratuberculosis
gccggugcggucggcg

SEQ ID NO: 1007387 - RNA, 19 nt, Mycobacterium avium subsp. paratuberculosis
gccggugcguccgccggcg

SEQ ID NO: 1007388 - RNA, 13 nt, Mycobacterium avium subsp. paratuberculosis
gccggugcgcagc

SEQ ID NO: 1007389 - RNA, 14 nt, Mycobacterium avium subsp. paratuberculosis
gccggugccgccgg

SEQ ID NO: 1007390 - RNA, 15 nt, Mycobacterium avium subsp. paratuberculosis
gccggugccgccggc

SEQ ID NO: 1007391 - RNA, 20 nt, Mycobacterium avium subsp. paratuberculosis
gccggugccgccggcgcauc

SEQ ID NO: 1007392 - RNA, 18 nt, Mycobacterium avium subsp. paratuberculosis
gccggugccacggucagg

SEQ ID NO: 1007393 - RNA, 13 nt, Mycobacterium avium subsp. paratuberculosis
gccggugcagcac

SEQ ID NO: 1007394 - RNA, 16 nt, Mycobacterium avium subsp. paratuberculosis
gccggugaucgcggcg

SEQ ID NO: 1007395 - RNA, 19 nt, Mycobacterium avium subsp. paratuberculosis
gccggugauccacuccagc

SEQ ID NO: 1007396 - RNA, 22 nt, Mycobacterium avium subsp. paratuberculosis
gccggucugguacccgauggug

SEQ ID NO: 1007397 - RNA, 19 nt, Mycobacterium avium subsp. paratuberculosis
gccggucgugcgacuccug

SEQ ID NO: 1007398 - RNA, 17 nt, Mycobacterium avium subsp. paratuberculosis
gccggucuuggacagca

SEQ ID NO: 1007399 - RNA, 20 nt, Mycobacterium avium subsp. paratuberculosis
gccggucuuggacagcagca

SEQ ID NO: 1007400 - RNA, 19 nt, Mycobacterium avium subsp. paratuberculosis
gccggugaagaucgcccgc

SEQ ID NO: 1007401 - RNA, 20 nt, Mycobacterium avium subsp. paratuberculosis
gccggugaagaucgcccgcc

SEQ ID NO: 1007402 - RNA, 15 nt, Mycobacterium avium subsp. paratuberculosis
gccggucggcccgcu

SEQ ID NO: 1007403 - RNA, 15 nt, Mycobacterium avium subsp. paratuberculosis
gccggucgcccccuc

SEQ ID NO: 1007404 - RNA, 18 nt, Mycobacterium avium subsp. paratuberculosis
gccggucgcccccucggc

SEQ ID NO: 1007405 - RNA, 21 nt, Mycobacterium avium subsp. paratuberculosis
gccggucgcccccucggccgg

SEQ ID NO: 1007406 - RNA, 22 nt, Mycobacterium avium subsp. paratuberculosis
gccggucggucagucgcgccgc

SEQ ID NO: 1007407 - RNA, 22 nt, Mycobacterium avium subsp. paratuberculosis
gccggucguagcgucgggggcg

SEQ ID NO: 1007408 - RNA, 18 nt, Mycobacterium avium subsp. paratuberculosis
gccgccucacgcagggcc

SEQ ID NO: 1007409 - RNA, 15 nt, Mycobacterium avium subsp. paratuberculosis
gccgccuccagcacg

SEQ ID NO: 1007410 - RNA, 18 nt, Mycobacterium avium subsp. paratuberculosis
gccgccggugaccacgcu

SEQ ID NO: 1007411 - RNA, 19 nt, Mycobacterium avium subsp. paratuberculosis
gccgccguagccggcggug

SEQ ID NO: 1007412 - RNA, 12 nt, Mycobacterium avium subsp. paratuberculosis
gccgccgucccc

SEQ ID NO: 1007413 - RNA, 18 nt, Mycobacterium avium subsp. paratuberculosis
gccgccuccgggcugccg

SEQ ID NO: 1007414 - RNA, 14 nt, Mycobacterium avium subsp. paratuberculosis
gccgcgaccccgga

SEQ ID NO: 1007415 - RNA, 14 nt, Mycobacterium avium subsp. paratuberculosis
gccgccugcgcgcc

SEQ ID NO: 1007416 - RNA, 15 nt, Mycobacterium avium subsp. paratuberculosis
gccgccugcgcgccg

SEQ ID NO: 1007417 - RNA, 16 nt, Mycobacterium avium subsp. paratuberculosis
gccgccugcgcgccgu

SEQ ID NO: 1007418 - RNA, 23 nt, Mycobacterium avium subsp. paratuberculosis
gccgccugcggguucuggccgug

SEQ ID NO: 1007419 - RNA, 13 nt, Mycobacterium avium subsp. paratuberculosis
gccgcgaccgcga

SEQ ID NO: 1007420 - RNA, 13 nt, Mycobacterium avium subsp. paratuberculosis
gccgccugcccgg

SEQ ID NO: 1007421 - RNA, 23 nt, Mycobacterium avium subsp. paratuberculosis
gccgccugcccgggcgccgagaa

SEQ ID NO: 1007422 - RNA, 17 nt, Mycobacterium avium subsp. paratuberculosis
gccgccguaucccugcc

SEQ ID NO: 1007423 - RNA, 23 nt, Mycobacterium avium subsp. paratuberculosis
gccgccgguggcgucggugaugc

SEQ ID NO: 1007424 - RNA, 22 nt, Mycobacterium avium subsp. paratuberculosis
gccgccggucgcccccucggcc

SEQ ID NO: 1007425 - RNA, 16 nt, Mycobacterium avium subsp. paratuberculosis
gccgccggugaacacg

SEQ ID NO: 1007426 - RNA, 17 nt, Mycobacterium avium subsp. paratuberculosis
gccgccggggugcaccg

SEQ ID NO: 1007427 - RNA, 21 nt, Mycobacterium avium subsp. paratuberculosis
gccgccggguccuugcgcccc

SEQ ID NO: 1007428 - RNA, 12 nt, Mycobacterium avium subsp. paratuberculosis
gccgccggggcc

SEQ ID NO: 1007429 - RNA, 19 nt, Mycobacterium avium subsp. paratuberculosis
gccgccggggcgccgccga

SEQ ID NO: 1007430 - RNA, 18 nt, Mycobacterium avium subsp. paratuberculosis
gccgccggggcgggcagc

SEQ ID NO: 1007431 - RNA, 13 nt, Mycobacterium avium subsp. paratuberculosis
gccgccggccgcg

SEQ ID NO: 1007432 - RNA, 14 nt, Mycobacterium avium subsp. paratuberculosis
gccgccggccgcgc

SEQ ID NO: 1007433 - RNA, 15 nt, Mycobacterium avium subsp. paratuberculosis
gccgccggccgcggc

SEQ ID NO: 1007434 - RNA, 13 nt, Mycobacterium avium subsp. paratuberculosis
gccgccggccgcu

SEQ ID NO: 1007435 - RNA, 14 nt, Mycobacterium avium subsp. paratuberculosis
gccgccggccgcuc

SEQ ID NO: 1007436 - RNA, 17 nt, Mycobacterium avium subsp. paratuberculosis
gccgccggccagcuccg

SEQ ID NO: 1007437 - RNA, 21 nt, Mycobacterium avium subsp. paratuberculosis
gccgccggccagcuccgccac

SEQ ID NO: 1007438 - RNA, 14 nt, Mycobacterium avium subsp. paratuberculosis
gccgccggccacca

SEQ ID NO: 1007439 - RNA, 21 nt, Mycobacterium avium subsp. paratuberculosis
gccgcgacgaugccggcgucg

SEQ ID NO: 1007440 - RNA, 16 nt, Mycobacterium avium subsp. paratuberculosis
gccgcgaccgucagca

SEQ ID NO: 1007441 - RNA, 17 nt, Mycobacterium avium subsp. paratuberculosis
gccgcgacgaccgccug

SEQ ID NO: 1007442 - RNA, 20 nt, Mycobacterium avium subsp. paratuberculosis
gccgcgacgaccgccugcuu

SEQ ID NO: 1007443 - RNA, 15 nt, Mycobacterium avium subsp. paratuberculosis
gccgcgacgccgccg

SEQ ID NO: 1007444 - RNA, 20 nt, Mycobacterium avium subsp. paratuberculosis
gccgcgacgccgugcuucca

SEQ ID NO: 1007445 - RNA, 23 nt, Mycobacterium avium subsp. paratuberculosis
gccgcgacgggcugucccggccg

SEQ ID NO: 1007446 - RNA, 20 nt, Mycobacterium avium subsp. paratuberculosis
gccgcgacgguuguucagcc

SEQ ID NO: 1007447 - RNA, 15 nt, Mycobacterium avium subsp. paratuberculosis
gccgcgacucugcac

SEQ ID NO: 1007448 - RNA, 15 nt, Mycobacterium avium subsp. paratuberculosis
gccgcgacugcaccc

SEQ ID NO: 1007449 - RNA, 16 nt, Mycobacterium avium subsp. paratuberculosis
gccgcgacugcacccg

SEQ ID NO: 1007450 - RNA, 13 nt, Mycobacterium avium subsp. paratuberculosis
gccgcgagcccgc

SEQ ID NO: 1007451 - RNA, 14 nt, Mycobacterium avium subsp. paratuberculosis
gccgcgagcccggc

SEQ ID NO: 1007452 - RNA, 18 nt, Mycobacterium avium subsp. paratuberculosis
gccgcgagcccggcgacg

SEQ ID NO: 1007453 - RNA, 18 nt, Mycobacterium avium subsp. paratuberculosis
gccgcgagccgcccaggc

SEQ ID NO: 1007454 - RNA, 23 nt, Mycobacterium avium subsp. paratuberculosis
gccgcgccaccgaggccagcaga

SEQ ID NO: 1007455 - RNA, 22 nt, Mycobacterium avium subsp. paratuberculosis
gccgcgccaccgcggggcuggg

SEQ ID NO: 1007456 - RNA, 14 nt, Mycobacterium avium subsp. paratuberculosis
gccgcgcauccgca

SEQ ID NO: 1007457 - RNA, 15 nt, Mycobacterium avium subsp. paratuberculosis
gccgcgcauccgcac

SEQ ID NO: 1007458 - RNA, 14 nt, Mycobacterium avium subsp. paratuberculosis
gccgcgccagcacc

SEQ ID NO: 1007459 - RNA, 14 nt, Mycobacterium avium subsp. paratuberculosis
gccgcgccagccgc

SEQ ID NO: 1007460 - RNA, 16 nt, Mycobacterium avium subsp. paratuberculosis
gccgcgccagccgccg

SEQ ID NO: 1007461 - RNA, 20 nt, Mycobacterium avium subsp. paratuberculosis
gccgcgccagccgccgccga

SEQ ID NO: 1007462 - RNA, 23 nt, Mycobacterium avium subsp. paratuberculosis
gccgcgaggauuucgcucagccg

SEQ ID NO: 1007463 - RNA, 21 nt, Mycobacterium avium subsp. paratuberculosis
gccgcgcccacccgcgcacgc

SEQ ID NO: 1007464 - RNA, 13 nt, Mycobacterium avium subsp. paratuberculosis
gccgcgcccagca

SEQ ID NO: 1007465 - RNA, 12 nt, Mycobacterium avium subsp. paratuberculosis
gccgcgcccagc

SEQ ID NO: 1007466 - RNA, 17 nt, Mycobacterium avium subsp. paratuberculosis
gccgcgcccaguguggg

SEQ ID NO: 1007467 - RNA, 15 nt, Mycobacterium avium subsp. paratuberculosis
gccgcgcccagcacg

SEQ ID NO: 1007468 - RNA, 13 nt, Mycobacterium avium subsp. paratuberculosis
gccgcgccgggcg

SEQ ID NO: 1007469 - RNA, 14 nt, Mycobacterium avium subsp. paratuberculosis
gccgcgccgggcga

SEQ ID NO: 1007470 - RNA, 18 nt, Mycobacterium avium subsp. paratuberculosis
gccgcgccccgagcagcg

SEQ ID NO: 1007471 - RNA, 19 nt, Mycobacterium avium subsp. paratuberculosis
gccgcgccccggcgcgccu

SEQ ID NO: 1007472 - RNA, 20 nt, Mycobacterium avium subsp. paratuberculosis
gccgcgcgcgcggccuccag

SEQ ID NO: 1007473 - RNA, 21 nt, Mycobacterium avium subsp. paratuberculosis
gccgcgcgcgcggccuccagc

SEQ ID NO: 1007474 - RNA, 23 nt, Mycobacterium avium subsp. paratuberculosis
gccgcgcgcgcggccuccagccg

SEQ ID NO: 1007475 - RNA, 13 nt, Mycobacterium avium subsp. paratuberculosis
gccgcgcgcggcc

SEQ ID NO: 1007476 - RNA, 16 nt, Mycobacterium avium subsp. paratuberculosis
gccgcgcgcccgcggc

SEQ ID NO: 1007477 - RNA, 24 nt, Mycobacterium avium subsp. paratuberculosis
gccgcccguccuggaugaacagca

SEQ ID NO: 1007478 - RNA, 18 nt, Mycobacterium avium subsp. paratuberculosis
gccgcccgucggggcccg

SEQ ID NO: 1007479 - RNA, 22 nt, Mycobacterium avium subsp. paratuberculosis
gccgcccgucggggcccggccc

SEQ ID NO: 1007480 - RNA, 22 nt, Mycobacterium avium subsp. paratuberculosis
gccgcccugcccgucgggcgcg

SEQ ID NO: 1007481 - RNA, 19 nt, Mycobacterium avium subsp. paratuberculosis
gccgcccucgcugccgccc

SEQ ID NO: 1007482 - RNA, 16 nt, Mycobacterium avium subsp. paratuberculosis
gccgcccccgccgcga

SEQ ID NO: 1007483 - RNA, 14 nt, Mycobacterium avium subsp. paratuberculosis
gccgcccccgcggc

SEQ ID NO: 1007484 - RNA, 15 nt, Mycobacterium avium subsp. paratuberculosis
gccgcccccgcuggc

SEQ ID NO: 1007485 - RNA, 22 nt, Mycobacterium avium subsp. paratuberculosis
gccgccccgaacagcgccaggg

SEQ ID NO: 1007486 - RNA, 14 nt, Mycobacterium avium subsp. paratuberculosis
gccgcccgggcccg

SEQ ID NO: 1007487 - RNA, 16 nt, Mycobacterium avium subsp. paratuberculosis
gccgcccgggccgcgc

SEQ ID NO: 1007488 - RNA, 15 nt, Mycobacterium avium subsp. paratuberculosis
gccgcccgggcggcc

SEQ ID NO: 1007489 - RNA, 18 nt, Mycobacterium avium subsp. paratuberculosis
gccgcccgucagccccuu

SEQ ID NO: 1007490 - RNA, 15 nt, Mycobacterium avium subsp. paratuberculosis
gccgcccguccagcg

SEQ ID NO: 1007491 - RNA, 14 nt, Mycobacterium avium subsp. paratuberculosis
gccgcccaccaccg

SEQ ID NO: 1007492 - RNA, 13 nt, Mycobacterium avium subsp. paratuberculosis
gccgcccaccagc

SEQ ID NO: 1007493 - RNA, 21 nt, Mycobacterium avium subsp. paratuberculosis
gccgcccaccuucccaacccc

SEQ ID NO: 1007494 - RNA, 21 nt, Mycobacterium avium subsp. paratuberculosis
gccgcccacgccgcccaggcc

SEQ ID NO: 1007495 - RNA, 19 nt, Mycobacterium avium subsp. paratuberculosis
gccgcccacguaggggccc

SEQ ID NO: 1007496 - RNA, 18 nt, Mycobacterium avium subsp. paratuberculosis
gccgcccagcagcgggcc

SEQ ID NO: 1007497 - RNA, 19 nt, Mycobacterium avium subsp. paratuberculosis
gccgcccagcagcgggccc

SEQ ID NO: 1007498 - RNA, 20 nt, Mycobacterium avium subsp. paratuberculosis
gccgcccagcagcgggcccg

SEQ ID NO: 1007499 - RNA, 23 nt, Mycobacterium avium subsp. paratuberculosis
gccgcccagcagcgggcccgggc

SEQ ID NO: 1007500 - RNA, 13 nt, Mycobacterium avium subsp. paratuberculosis
gccgcccagcagc

SEQ ID NO: 1007501 - RNA, 13 nt, Mycobacterium avium subsp. paratuberculosis
gccgcccagcggc

SEQ ID NO: 1007502 - RNA, 16 nt, Mycobacterium avium subsp. paratuberculosis
gccgcccaggccgagc

SEQ ID NO: 1007503 - RNA, 16 nt, Mycobacterium avium subsp. paratuberculosis
gccgcccagcccgcgc

SEQ ID NO: 1007504 - RNA, 20 nt, Mycobacterium avium subsp. paratuberculosis
gccgcccaggcgggccagcu

SEQ ID NO: 1007505 - RNA, 17 nt, Mycobacterium avium subsp. paratuberculosis
gccgcccaucaccccga

SEQ ID NO: 1007506 - RNA, 23 nt, Mycobacterium avium subsp. paratuberculosis
gccgcccaucagcaggaccaggc

SEQ ID NO: 1007507 - RNA, 20 nt, Mycobacterium avium subsp. paratuberculosis
gccgccgacgguggccccca

SEQ ID NO: 1007508 - RNA, 23 nt, Mycobacterium avium subsp. paratuberculosis
gccgccgacgguggcccccacca

SEQ ID NO: 1007509 - RNA, 19 nt, Mycobacterium avium subsp. paratuberculosis
gccgccgaucuugagccgg

SEQ ID NO: 1007510 - RNA, 22 nt, Mycobacterium avium subsp. paratuberculosis
gccgccgaucaacaggcccagc

SEQ ID NO: 1007511 - RNA, 19 nt, Mycobacterium avium subsp. paratuberculosis
gccgccgagggccagcagc

SEQ ID NO: 1007512 - RNA, 18 nt, Mycobacterium avium subsp. paratuberculosis
gccgccgaugacggcgcg

SEQ ID NO: 1007513 - RNA, 21 nt, Mycobacterium avium subsp. paratuberculosis
gccgccgcuagucgcccagca

SEQ ID NO: 1007514 - RNA, 20 nt, Mycobacterium avium subsp. paratuberculosis
gccgccggauuacucgccgg

SEQ ID NO: 1007515 - RNA, 21 nt, Mycobacterium avium subsp. paratuberculosis
gccgccggauuacucgccggc

SEQ ID NO: 1007516 - RNA, 19 nt, Mycobacterium avium subsp. paratuberculosis
gccgccgaacagccgggug

SEQ ID NO: 1007517 - RNA, 16 nt, Mycobacterium avium subsp. paratuberculosis
gccgccgacgacggcg

SEQ ID NO: 1007518 - RNA, 15 nt, Mycobacterium avium subsp. paratuberculosis
gccgccgaagccggc

SEQ ID NO: 1007519 - RNA, 16 nt, Mycobacterium avium subsp. paratuberculosis
gccgccgaagccggcu

SEQ ID NO: 1007520 - RNA, 23 nt, Mycobacterium avium subsp. paratuberculosis
gccgcccuuguugaugguguugc

SEQ ID NO: 1007521 - RNA, 19 nt, Mycobacterium avium subsp. paratuberculosis
gccgccgaaagccuccgcg

SEQ ID NO: 1007522 - RNA, 13 nt, Mycobacterium avium subsp. paratuberculosis
gccgcccuggccc

SEQ ID NO: 1007523 - RNA, 15 nt, Mycobacterium avium subsp. paratuberculosis
gccgauucaaccccg

SEQ ID NO: 1007524 - RNA, 18 nt, Mycobacterium avium subsp. paratuberculosis
gccgauucaaccccgcgc

SEQ ID NO: 1007525 - RNA, 14 nt, Mycobacterium avium subsp. paratuberculosis
gccgaugugcucgg

SEQ ID NO: 1007526 - RNA, 16 nt, Mycobacterium avium subsp. paratuberculosis
gccgauguucaccccg

SEQ ID NO: 1007527 - RNA, 20 nt, Mycobacterium avium subsp. paratuberculosis
gccgauguccccgcggguga

SEQ ID NO: 1007528 - RNA, 13 nt, Mycobacterium avium subsp. paratuberculosis
gccgauggucagc

SEQ ID NO: 1007529 - RNA, 16 nt, Mycobacterium avium subsp. paratuberculosis
gccgauggucagcugc

SEQ ID NO: 1007530 - RNA, 23 nt, Mycobacterium avium subsp. paratuberculosis
gccgauggugacggugccgccgu

SEQ ID NO: 1007531 - RNA, 19 nt, Mycobacterium avium subsp. paratuberculosis
gccgaugcgccgcaccagu

SEQ ID NO: 1007532 - RNA, 14 nt, Mycobacterium avium subsp. paratuberculosis
gccgauggagaccu

SEQ ID NO: 1007533 - RNA, 21 nt, Mycobacterium avium subsp. paratuberculosis
gccgauggcgaagcccaugcc

SEQ ID NO: 1007534 - RNA, 20 nt, Mycobacterium avium subsp. paratuberculosis
gccgauggcgcccagcgucu

SEQ ID NO: 1007535 - RNA, 22 nt, Mycobacterium avium subsp. paratuberculosis
gccgaugaugaugccgcccauc

SEQ ID NO: 1007536 - RNA, 15 nt, Mycobacterium avium subsp. paratuberculosis
gccgaugcagcacau

SEQ ID NO: 1007537 - RNA, 19 nt, Mycobacterium avium subsp. paratuberculosis
gccgaugcagcacauccag

SEQ ID NO: 1007538 - RNA, 20 nt, Mycobacterium avium subsp. paratuberculosis
gccgaugaugguggcggcca

SEQ ID NO: 1007539 - RNA, 16 nt, Mycobacterium avium subsp. paratuberculosis
gccgaugcccagcagc

SEQ ID NO: 1007540 - RNA, 13 nt, Mycobacterium avium subsp. paratuberculosis
gccgaugccgcgc

SEQ ID NO: 1007541 - RNA, 14 nt, Mycobacterium avium subsp. paratuberculosis
gccgaugcgcccgc

SEQ ID NO: 1007542 - RNA, 17 nt, Mycobacterium avium subsp. paratuberculosis
gccgaugcgcccgcugc

SEQ ID NO: 1007543 - RNA, 15 nt, Mycobacterium avium subsp. paratuberculosis
gccgaugccggccug

SEQ ID NO: 1007544 - RNA, 17 nt, Mycobacterium avium subsp. paratuberculosis
gccgaguaacucggccu

SEQ ID NO: 1007545 - RNA, 16 nt, Mycobacterium avium subsp. paratuberculosis
gccgagguagccgcgc

SEQ ID NO: 1007546 - RNA, 17 nt, Mycobacterium avium subsp. paratuberculosis
gccgaggucgccgacgc

SEQ ID NO: 1007547 - RNA, 16 nt, Mycobacterium avium subsp. paratuberculosis
gccgagggccagcagc

SEQ ID NO: 1007548 - RNA, 15 nt, Mycobacterium avium subsp. paratuberculosis
gccgagggcccgggc

SEQ ID NO: 1007549 - RNA, 20 nt, Mycobacterium avium subsp. paratuberculosis
gccgacggagacgaccaggu

SEQ ID NO: 1007550 - RNA, 14 nt, Mycobacterium avium subsp. paratuberculosis
gccgaucagcacca

SEQ ID NO: 1007551 - RNA, 20 nt, Mycobacterium avium subsp. paratuberculosis
gccgaguccgggccgccggc

SEQ ID NO: 1007552 - RNA, 19 nt, Mycobacterium avium subsp. paratuberculosis
gccgagucgacgugcucgg

SEQ ID NO: 1007553 - RNA, 22 nt, Mycobacterium avium subsp. paratuberculosis
gccgagucgaucgccagcgcgc

SEQ ID NO: 1007554 - RNA, 20 nt, Mycobacterium avium subsp. paratuberculosis
gccgaucaacaggcccagca

SEQ ID NO: 1007555 - RNA, 21 nt, Mycobacterium avium subsp. paratuberculosis
gccgacgggcguguagccugc

SEQ ID NO: 1007556 - RNA, 18 nt, Mycobacterium avium subsp. paratuberculosis
gccgacggcugcccggcc

SEQ ID NO: 1007557 - RNA, 14 nt, Mycobacterium avium subsp. paratuberculosis
gccgaggcugucgg

SEQ ID NO: 1007558 - RNA, 17 nt, Mycobacterium avium subsp. paratuberculosis
gccgacggccagcagga

SEQ ID NO: 1007559 - RNA, 18 nt, Mycobacterium avium subsp. paratuberculosis
gccgacggccagcaggau

SEQ ID NO: 1007560 - RNA, 17 nt, Mycobacterium avium subsp. paratuberculosis
gccgacgcuggccgaga

SEQ ID NO: 1007561 - RNA, 16 nt, Mycobacterium avium subsp. paratuberculosis
gccgacggccagcagg

SEQ ID NO: 1007562 - RNA, 14 nt, Mycobacterium avium subsp. paratuberculosis
gccgacgccugcgc

SEQ ID NO: 1007563 - RNA, 14 nt, Mycobacterium avium subsp. paratuberculosis
gccgacgcggccuc

SEQ ID NO: 1007564 - RNA, 20 nt, Mycobacterium avium subsp. paratuberculosis
gccgacgcccacagcgccag

SEQ ID NO: 1007565 - RNA, 17 nt, Mycobacterium avium subsp. paratuberculosis
gccgacgcccagcaccg

SEQ ID NO: 1007566 - RNA, 17 nt, Mycobacterium avium subsp. paratuberculosis
gccgacgcccaggcuca

SEQ ID NO: 1007567 - RNA, 17 nt, Mycobacterium avium subsp. paratuberculosis
gccgacgcauguccgcc

SEQ ID NO: 1007568 - RNA, 19 nt, Mycobacterium avium subsp. paratuberculosis
gccgccauccugucauccg

SEQ ID NO: 1007569 - RNA, 16 nt, Mycobacterium avium subsp. paratuberculosis
gccgccagggcgcggc

SEQ ID NO: 1007570 - RNA, 21 nt, Mycobacterium avium subsp. paratuberculosis
gccgccaguuguuggccgggc

SEQ ID NO: 1007571 - RNA, 16 nt, Mycobacterium avium subsp. paratuberculosis
gccgccauccguucgg

SEQ ID NO: 1007572 - RNA, 20 nt, Mycobacterium avium subsp. paratuberculosis
gccgccauccguucggcucu

SEQ ID NO: 1007573 - RNA, 21 nt, Mycobacterium avium subsp. paratuberculosis
gccgccauccguucggcucug

SEQ ID NO: 1007574 - RNA, 19 nt, Mycobacterium avium subsp. paratuberculosis
gccgccaucgccgccgcca

SEQ ID NO: 1007575 - RNA, 18 nt, Mycobacterium avium subsp. paratuberculosis
gccgccagcgcggggucg

SEQ ID NO: 1007576 - RNA, 20 nt, Mycobacterium avium subsp. paratuberculosis
gccgccagcgcggggucggc

SEQ ID NO: 1007577 - RNA, 19 nt, Mycobacterium avium subsp. paratuberculosis
gccgccagccgcagcaggc

SEQ ID NO: 1007578 - RNA, 17 nt, Mycobacterium avium subsp. paratuberculosis
gccgccagccgcgucuu

SEQ ID NO: 1007579 - RNA, 16 nt, Mycobacterium avium subsp. paratuberculosis
gccgccagcgccaccc

SEQ ID NO: 1007580 - RNA, 23 nt, Mycobacterium avium subsp. paratuberculosis
gccgccagcaguguccagucggc

SEQ ID NO: 1007581 - RNA, 23 nt, Mycobacterium avium subsp. paratuberculosis
gccgccacagcgccucgcggucg

SEQ ID NO: 1007582 - RNA, 13 nt, Mycobacterium avium subsp. paratuberculosis
gccgccaccaaca

SEQ ID NO: 1007583 - RNA, 18 nt, Mycobacterium avium subsp. paratuberculosis
gccgcagugccggcgcac

SEQ ID NO: 1007584 - RNA, 17 nt, Mycobacterium avium subsp. paratuberculosis
gccgccaaaucgaucac

SEQ ID NO: 1007585 - RNA, 20 nt, Mycobacterium avium subsp. paratuberculosis
gccgccaaccaggucgcggc

SEQ ID NO: 1007586 - RNA, 14 nt, Mycobacterium avium subsp. paratuberculosis
gccgcaggcggcca

SEQ ID NO: 1007587 - RNA, 16 nt, Mycobacterium avium subsp. paratuberculosis
gccgcaggcggccagc

SEQ ID NO: 1007588 - RNA, 18 nt, Mycobacterium avium subsp. paratuberculosis
gccgcaggcggccagcac

SEQ ID NO: 1007589 - RNA, 19 nt, Mycobacterium avium subsp. paratuberculosis
gccgcaggagaucggcgcg

SEQ ID NO: 1007590 - RNA, 21 nt, Mycobacterium avium subsp. paratuberculosis
gccgcaggguggccagcaccg

SEQ ID NO: 1007591 - RNA, 15 nt, Mycobacterium avium subsp. paratuberculosis
gccgcaggugcucgc

SEQ ID NO: 1007592 - RNA, 19 nt, Mycobacterium avium subsp. paratuberculosis
gccgcaggugcucgccggc

SEQ ID NO: 1007593 - RNA, 21 nt, Mycobacterium avium subsp. paratuberculosis
gccgcaggugcucgccggcgc

SEQ ID NO: 1007594 - RNA, 15 nt, Mycobacterium avium subsp. paratuberculosis
gccgcaggugguggg

SEQ ID NO: 1007595 - RNA, 16 nt, Mycobacterium avium subsp. paratuberculosis
gccgcacccagcgggc

SEQ ID NO: 1007596 - RNA, 18 nt, Mycobacterium avium subsp. paratuberculosis
gccgcacccagcgggcga

SEQ ID NO: 1007597 - RNA, 13 nt, Mycobacterium avium subsp. paratuberculosis
gccgcacccccuc

SEQ ID NO: 1007598 - RNA, 16 nt, Mycobacterium avium subsp. paratuberculosis
gccgcaccgcaaagca

SEQ ID NO: 1007599 - RNA, 20 nt, Mycobacterium avium subsp. paratuberculosis
gccgcagcucgaucacccag

SEQ ID NO: 1007600 - RNA, 14 nt, Mycobacterium avium subsp. paratuberculosis
gccgcagcucgccc

SEQ ID NO: 1007601 - RNA, 17 nt, Mycobacterium avium subsp. paratuberculosis
gccgcagcugcugcggc

SEQ ID NO: 1007602 - RNA, 21 nt, Mycobacterium avium subsp. paratuberculosis
gccgcagcuguucgggcagau

SEQ ID NO: 1007603 - RNA, 16 nt, Mycobacterium avium subsp. paratuberculosis
gccgcacagccggcgg

SEQ ID NO: 1007604 - RNA, 16 nt, Mycobacterium avium subsp. paratuberculosis
gccgcacaccgcgcag

SEQ ID NO: 1007605 - RNA, 14 nt, Mycobacterium avium subsp. paratuberculosis
gccgcacaccgcgg

SEQ ID NO: 1007606 - RNA, 15 nt, Mycobacterium avium subsp. paratuberculosis
gccgcacaccgcggc

SEQ ID NO: 1007607 - RNA, 23 nt, Mycobacterium avium subsp. paratuberculosis
gccgacagucgcgggcagccggc

SEQ ID NO: 1007608 - RNA, 13 nt, Mycobacterium avium subsp. paratuberculosis
gccgacagguagc

SEQ ID NO: 1007609 - RNA, 12 nt, Mycobacterium avium subsp. paratuberculosis
gccgacagcgac

SEQ ID NO: 1007610 - RNA, 18 nt, Mycobacterium avium subsp. paratuberculosis
gccgacagcugagcagcc

SEQ ID NO: 1007611 - RNA, 20 nt, Mycobacterium avium subsp. paratuberculosis
gccgacagacccgacagucc

SEQ ID NO: 1007612 - RNA, 18 nt, Mycobacterium avium subsp. paratuberculosis
gccgacagcacgccgggc

SEQ ID NO: 1007613 - RNA, 13 nt, Mycobacterium avium subsp. paratuberculosis
gccgacagcagcu

SEQ ID NO: 1007614 - RNA, 21 nt, Mycobacterium avium subsp. paratuberculosis
gccgacagcagcucauacagc

SEQ ID NO: 1007615 - RNA, 20 nt, Mycobacterium avium subsp. paratuberculosis
gccgaccaacacccccgcgc

SEQ ID NO: 1007616 - RNA, 18 nt, Mycobacterium avium subsp. paratuberculosis
gccgaccaacgggcggcg

SEQ ID NO: 1007617 - RNA, 15 nt, Mycobacterium avium subsp. paratuberculosis
gccgacaucucccgg

SEQ ID NO: 1007618 - RNA, 23 nt, Mycobacterium avium subsp. paratuberculosis
gccgacaugcugggcuaccagcc

SEQ ID NO: 1007619 - RNA, 17 nt, Mycobacterium avium subsp. paratuberculosis
gccgaccacaugccguu

SEQ ID NO: 1007620 - RNA, 13 nt, Mycobacterium avium subsp. paratuberculosis
gccgaccucggcc

SEQ ID NO: 1007621 - RNA, 16 nt, Mycobacterium avium subsp. paratuberculosis
gccgaccucggccagc

SEQ ID NO: 1007622 - RNA, 21 nt, Mycobacterium avium subsp. paratuberculosis
gccgacgaugucgaaacccag

SEQ ID NO: 1007623 - RNA, 23 nt, Mycobacterium avium subsp. paratuberculosis
gccgacgaugucgaaacccagga

SEQ ID NO: 1007624 - RNA, 19 nt, Mycobacterium avium subsp. paratuberculosis
gccgacgaucccggcgagc

SEQ ID NO: 1007625 - RNA, 18 nt, Mycobacterium avium subsp. paratuberculosis
gccgacgauccgcgccgc

SEQ ID NO: 1007626 - RNA, 19 nt, Mycobacterium avium subsp. paratuberculosis
gccgacgauccgggcgccc

SEQ ID NO: 1007627 - RNA, 17 nt, Mycobacterium avium subsp. paratuberculosis
gccgaccugggcggcca

SEQ ID NO: 1007628 - RNA, 16 nt, Mycobacterium avium subsp. paratuberculosis
gccgaccuggucgccg

SEQ ID NO: 1007629 - RNA, 20 nt, Mycobacterium avium subsp. paratuberculosis
gccgaccuguagggcgagcu

SEQ ID NO: 1007630 - RNA, 19 nt, Mycobacterium avium subsp. paratuberculosis
gccgaccuugacccaggcc

SEQ ID NO: 1007631 - RNA, 16 nt, Mycobacterium avium subsp. paratuberculosis
gccgacgaacaagggc

SEQ ID NO: 1007632 - RNA, 21 nt, Mycobacterium avium subsp. paratuberculosis
gccgacgaagaucccgcuggc

SEQ ID NO: 1007633 - RNA, 22 nt, Mycobacterium avium subsp. paratuberculosis
gccgacgaagaucccgcuggcc

SEQ ID NO: 1007634 - RNA, 14 nt, Mycobacterium avium subsp. paratuberculosis
aaagcguugcgaaa

SEQ ID NO: 1007635 - RNA, 22 nt, Mycobacterium avium subsp. paratuberculosis
gccgaaaaacgcgacggcccgg

SEQ ID NO: 1007636 - RNA, 23 nt, Mycobacterium avium subsp. paratuberculosis
gccgaagaagauguugcggcggc

SEQ ID NO: 1007637 - RNA, 20 nt, Mycobacterium avium subsp. paratuberculosis
gccgaagaccgggccgauga

SEQ ID NO: 1007638 - RNA, 16 nt, Mycobacterium avium subsp. paratuberculosis
gccgaagcccgcagcg

SEQ ID NO: 1007639 - RNA, 19 nt, Mycobacterium avium subsp. paratuberculosis
gccgaagcccgcagcgaac

SEQ ID NO: 1007640 - RNA, 14 nt, Mycobacterium avium subsp. paratuberculosis
gccgaagccgccgu

SEQ ID NO: 1007641 - RNA, 22 nt, Mycobacterium avium subsp. paratuberculosis
gccgaagccgccguccccgcgc

SEQ ID NO: 1007642 - RNA, 19 nt, Mycobacterium avium subsp. paratuberculosis
gcccucuuccucgcugucc

SEQ ID NO: 1007643 - RNA, 23 nt, Mycobacterium avium subsp. paratuberculosis
gcccucuuccucgcuguccugcc

SEQ ID NO: 1007644 - RNA, 22 nt, Mycobacterium avium subsp. paratuberculosis
gcccucuucgaucaggcgcagc

SEQ ID NO: 1007645 - RNA, 13 nt, Mycobacterium avium subsp. paratuberculosis
gcccucucacggc

SEQ ID NO: 1007646 - RNA, 19 nt, Mycobacterium avium subsp. paratuberculosis
gcccugacacagcaccggc

SEQ ID NO: 1007647 - RNA, 22 nt, Mycobacterium avium subsp. paratuberculosis
gcccucggaggugccgcgcggc

SEQ ID NO: 1007648 - RNA, 19 nt, Mycobacterium avium subsp. paratuberculosis
gcccucggcuuccgagccg

SEQ ID NO: 1007649 - RNA, 16 nt, Mycobacterium avium subsp. paratuberculosis
gcccucgucggcgagc

SEQ ID NO: 1007650 - RNA, 18 nt, Mycobacterium avium subsp. paratuberculosis
gcccucguagcggccgca

SEQ ID NO: 1007651 - RNA, 17 nt, Mycobacterium avium subsp. paratuberculosis
gcccucgucgaagccga

SEQ ID NO: 1007652 - RNA, 22 nt, Mycobacterium avium subsp. paratuberculosis
gcccucgucgaugacguccacc

SEQ ID NO: 1007653 - RNA, 19 nt, Mycobacterium avium subsp. paratuberculosis
gcccucgucuuccgcggcg

SEQ ID NO: 1007654 - RNA, 15 nt, Mycobacterium avium subsp. paratuberculosis
gcccugcagcgcgaa

SEQ ID NO: 1007655 - RNA, 14 nt, Mycobacterium avium subsp. paratuberculosis
gcccuggccgccgg

SEQ ID NO: 1007656 - RNA, 16 nt, Mycobacterium avium subsp. paratuberculosis
gcccugcacccagccg

SEQ ID NO: 1007657 - RNA, 20 nt, Mycobacterium avium subsp. paratuberculosis
gcccugcacccagccgugcc

SEQ ID NO: 1007658 - RNA, 16 nt, Mycobacterium avium subsp. paratuberculosis
gcccuggcgggcggcc

SEQ ID NO: 1007659 - RNA, 15 nt, Mycobacterium avium subsp. paratuberculosis
gcccuggccgccggc

SEQ ID NO: 1007660 - RNA, 15 nt, Mycobacterium avium subsp. paratuberculosis
gcccuuccagcaccc

SEQ ID NO: 1007661 - RNA, 20 nt, Mycobacterium avium subsp. paratuberculosis
gcccuuccccggcggccggc

SEQ ID NO: 1007662 - RNA, 22 nt, Mycobacterium avium subsp. paratuberculosis
gcccuugugguugcgugacuug

SEQ ID NO: 1007663 - RNA, 15 nt, Mycobacterium avium subsp. paratuberculosis
gcccuuguccucgag

SEQ ID NO: 1007664 - RNA, 20 nt, Mycobacterium avium subsp. paratuberculosis
gcccgugcgggugguccacc

SEQ ID NO: 1007665 - RNA, 15 nt, Mycobacterium avium subsp. paratuberculosis
gcccguggccagcgc

SEQ ID NO: 1007666 - RNA, 18 nt, Mycobacterium avium subsp. paratuberculosis
gcccgugaucgccacggc

SEQ ID NO: 1007667 - RNA, 14 nt, Mycobacterium avium subsp. paratuberculosis
gcccguccgggccg

SEQ ID NO: 1007668 - RNA, 21 nt, Mycobacterium avium subsp. paratuberculosis
gcccgucgacgggccaccagc

SEQ ID NO: 1007669 - RNA, 19 nt, Mycobacterium avium subsp. paratuberculosis
gcccgucgccaccacggcg

SEQ ID NO: 1007670 - RNA, 15 nt, Mycobacterium avium subsp. paratuberculosis
gcccgucgccggcgc

SEQ ID NO: 1007671 - RNA, 17 nt, Mycobacterium avium subsp. paratuberculosis
gcccgucgccggcgcgc

SEQ ID NO: 1007672 - RNA, 20 nt, Mycobacterium avium subsp. paratuberculosis
gcccgucucggcgugcucgg

SEQ ID NO: 1007673 - RNA, 23 nt, Mycobacterium avium subsp. paratuberculosis
gcccgucguccuugagcccccac

SEQ ID NO: 1007674 - RNA, 22 nt, Mycobacterium avium subsp. paratuberculosis
gcccguccuggaugaacagcac

SEQ ID NO: 1007675 - RNA, 18 nt, Mycobacterium avium subsp. paratuberculosis
gcccgucggggcccggcc

SEQ ID NO: 1007676 - RNA, 20 nt, Mycobacterium avium subsp. paratuberculosis
gcccgucggggcccggcccg

SEQ ID NO: 1007677 - RNA, 14 nt, Mycobacterium avium subsp. paratuberculosis
gcccuccuggguga

SEQ ID NO: 1007678 - RNA, 15 nt, Mycobacterium avium subsp. paratuberculosis
gcccucgcgcagggc

SEQ ID NO: 1007679 - RNA, 18 nt, Mycobacterium avium subsp. paratuberculosis
gcccucggccagccaggc

SEQ ID NO: 1007680 - RNA, 21 nt, Mycobacterium avium subsp. paratuberculosis
gcccucgauaauggcggccgc

SEQ ID NO: 1007681 - RNA, 23 nt, Mycobacterium avium subsp. paratuberculosis
gcccucgauaauggcggccgccg

SEQ ID NO: 1007682 - RNA, 21 nt, Mycobacterium avium subsp. paratuberculosis
gcccucgccgaaccggggccg

SEQ ID NO: 1007683 - RNA, 17 nt, Mycobacterium avium subsp. paratuberculosis
gcccucgccggcggcgc

SEQ ID NO: 1007684 - RNA, 17 nt, Mycobacterium avium subsp. paratuberculosis
gcccuccccggccagca

SEQ ID NO: 1007685 - RNA, 18 nt, Mycobacterium avium subsp. paratuberculosis
gcccuccccggccagcac

SEQ ID NO: 1007686 - RNA, 19 nt, Mycobacterium avium subsp. paratuberculosis
gcccuccccggccagcacg

SEQ ID NO: 1007687 - RNA, 22 nt, Mycobacterium avium subsp. paratuberculosis
gcccucaggcguccagcaccug

SEQ ID NO: 1007688 - RNA, 17 nt, Mycobacterium avium subsp. paratuberculosis
gcccuaacgugcccggc

SEQ ID NO: 1007689 - RNA, 14 nt, Mycobacterium avium subsp. paratuberculosis
gcccuagcgguggc

SEQ ID NO: 1007690 - RNA, 23 nt, Mycobacterium avium subsp. paratuberculosis
gcccuagcgguggcguucacagu

SEQ ID NO: 1007691 - RNA, 18 nt, Mycobacterium avium subsp. paratuberculosis
gcccuauggcaucgccaa

SEQ ID NO: 1007692 - RNA, 15 nt, Mycobacterium avium subsp. paratuberculosis
gcccguacucgggug

SEQ ID NO: 1007693 - RNA, 20 nt, Mycobacterium avium subsp. paratuberculosis
gcccguagaugcggcccagc

SEQ ID NO: 1007694 - RNA, 23 nt, Mycobacterium avium subsp. paratuberculosis
gcccguagaugcggcccagcccg

SEQ ID NO: 1007695 - RNA, 17 nt, Mycobacterium avium subsp. paratuberculosis
gcccguagcucgcgccg

SEQ ID NO: 1007696 - RNA, 21 nt, Mycobacterium avium subsp. paratuberculosis
gcccguagcucgcgccgaccc

SEQ ID NO: 1007697 - RNA, 16 nt, Mycobacterium avium subsp. paratuberculosis
gcccguagcggugggc

SEQ ID NO: 1007698 - RNA, 14 nt, Mycobacterium avium subsp. paratuberculosis
gcccgucacgcugg

SEQ ID NO: 1007699 - RNA, 16 nt, Mycobacterium avium subsp. paratuberculosis
gcccgucacgcuggcg

SEQ ID NO: 1007700 - RNA, 15 nt, Mycobacterium avium subsp. paratuberculosis
gcccgucacggccgu

SEQ ID NO: 1007701 - RNA, 21 nt, Mycobacterium avium subsp. paratuberculosis
gcccgucacggccguccaggc

SEQ ID NO: 1007702 - RNA, 13 nt, Mycobacterium avium subsp. paratuberculosis
gcccgucagcccc

SEQ ID NO: 1007703 - RNA, 20 nt, Mycobacterium avium subsp. paratuberculosis
gcccguccagaucggccagc

SEQ ID NO: 1007704 - RNA, 13 nt, Mycobacterium avium subsp. paratuberculosis
gcccguccccacc

SEQ ID NO: 1007705 - RNA, 15 nt, Mycobacterium avium subsp. paratuberculosis
gcccguccgccccgc

SEQ ID NO: 1007706 - RNA, 17 nt, Mycobacterium avium subsp. paratuberculosis
gcccggucugcggccgc

SEQ ID NO: 1007707 - RNA, 17 nt, Mycobacterium avium subsp. paratuberculosis
gcccggugagccucagg

SEQ ID NO: 1007708 - RNA, 22 nt, Mycobacterium avium subsp. paratuberculosis
gcccggugcgacgccgcgcagc

SEQ ID NO: 1007709 - RNA, 15 nt, Mycobacterium avium subsp. paratuberculosis
gcccggugcgccagc

SEQ ID NO: 1007710 - RNA, 19 nt, Mycobacterium avium subsp. paratuberculosis
gcccgguaggccgccgcga

SEQ ID NO: 1007711 - RNA, 23 nt, Mycobacterium avium subsp. paratuberculosis
gcccgguagauauggcccuccac

SEQ ID NO: 1007712 - RNA, 23 nt, Mycobacterium avium subsp. paratuberculosis
gcccggggucugacccaugcccc

SEQ ID NO: 1007713 - RNA, 21 nt, Mycobacterium avium subsp. paratuberculosis
gcccggucgaggucggccagc

SEQ ID NO: 1007714 - RNA, 16 nt, Mycobacterium avium subsp. paratuberculosis
gcccgccggcccagcu

SEQ ID NO: 1007715 - RNA, 21 nt, Mycobacterium avium subsp. paratuberculosis
gcccgccggaacucggccggc

SEQ ID NO: 1007716 - RNA, 20 nt, Mycobacterium avium subsp. paratuberculosis
gcccgcccacgggucgccga

SEQ ID NO: 1007717 - RNA, 20 nt, Mycobacterium avium subsp. paratuberculosis
gcccgccgcguacagcagcu

SEQ ID NO: 1007718 - RNA, 14 nt, Mycobacterium avium subsp. paratuberculosis
gcccgccgcguccg

SEQ ID NO: 1007719 - RNA, 15 nt, Mycobacterium avium subsp. paratuberculosis
gcccgccgcugcagc

SEQ ID NO: 1007720 - RNA, 23 nt, Mycobacterium avium subsp. paratuberculosis
gcccgccaucgcccggugcgcca

SEQ ID NO: 1007721 - RNA, 20 nt, Mycobacterium avium subsp. paratuberculosis
gcccgcccacauacaccggg

SEQ ID NO: 1007722 - RNA, 23 nt, Mycobacterium avium subsp. paratuberculosis
gcccgccaggaauaacgccggcc

SEQ ID NO: 1007723 - RNA, 16 nt, Mycobacterium avium subsp. paratuberculosis
gcccgccacggccagc

SEQ ID NO: 1007724 - RNA, 18 nt, Mycobacterium avium subsp. paratuberculosis
gcccggguggacgcccgc

SEQ ID NO: 1007725 - RNA, 21 nt, Mycobacterium avium subsp. paratuberculosis
gcccgggugauggucucccgg

SEQ ID NO: 1007726 - RNA, 19 nt, Mycobacterium avium subsp. paratuberculosis
gcccgggugcaggcccagc

SEQ ID NO: 1007727 - RNA, 21 nt, Mycobacterium avium subsp. paratuberculosis
gcccgggugcaggcccagcug

SEQ ID NO: 1007728 - RNA, 15 nt, Mycobacterium avium subsp. paratuberculosis
gcccgguacagcgcc

SEQ ID NO: 1007729 - RNA, 16 nt, Mycobacterium avium subsp. paratuberculosis
gcccgguacagcgccg

SEQ ID NO: 1007730 - RNA, 22 nt, Mycobacterium avium subsp. paratuberculosis
gcccgguacagcgccgcggcca

SEQ ID NO: 1007731 - RNA, 22 nt, Mycobacterium avium subsp. paratuberculosis
gcccgguacaucgacgcgaccg

SEQ ID NO: 1007732 - RNA, 20 nt, Mycobacterium avium subsp. paratuberculosis
gcccgggguccaccggccga

SEQ ID NO: 1007733 - RNA, 21 nt, Mycobacterium avium subsp. paratuberculosis
gcccgggguccaccggccgau

SEQ ID NO: 1007734 - RNA, 20 nt, Mycobacterium avium subsp. paratuberculosis
gcccggguccuggcccccgc

SEQ ID NO: 1007735 - RNA, 17 nt, Mycobacterium avium subsp. paratuberculosis
gcccgggucgugcggcg

SEQ ID NO: 1007736 - RNA, 18 nt, Mycobacterium avium subsp. paratuberculosis
gcccgccucacagcgaca

SEQ ID NO: 1007737 - RNA, 17 nt, Mycobacterium avium subsp. paratuberculosis
gcccgccucggcggccg

SEQ ID NO: 1007738 - RNA, 20 nt, Mycobacterium avium subsp. paratuberculosis
gcccgccucggcggccgccu

SEQ ID NO: 1007739 - RNA, 18 nt, Mycobacterium avium subsp. paratuberculosis
gcccgccgugcgccccgc

SEQ ID NO: 1007740 - RNA, 16 nt, Mycobacterium avium subsp. paratuberculosis
gcccgccgucgaccac

SEQ ID NO: 1007741 - RNA, 20 nt, Mycobacterium avium subsp. paratuberculosis
gcccgccgucgaccacgaag

SEQ ID NO: 1007742 - RNA, 14 nt, Mycobacterium avium subsp. paratuberculosis
gcccgccggcggcg

SEQ ID NO: 1007743 - RNA, 12 nt, Mycobacterium avium subsp. paratuberculosis
gcccgccgggcg

SEQ ID NO: 1007744 - RNA, 13 nt, Mycobacterium avium subsp. paratuberculosis
gcccgccgggcug

SEQ ID NO: 1007745 - RNA, 18 nt, Mycobacterium avium subsp. paratuberculosis
gcccgccgguggccgcgc

SEQ ID NO: 1007746 - RNA, 16 nt, Mycobacterium avium subsp. paratuberculosis
gccauguccccgccgg

SEQ ID NO: 1007747 - RNA, 13 nt, Mycobacterium avium subsp. paratuberculosis
gccauguccggca

SEQ ID NO: 1007748 - RNA, 20 nt, Mycobacterium avium subsp. paratuberculosis
gccaugaacuccgacuccag

SEQ ID NO: 1007749 - RNA, 23 nt, Mycobacterium avium subsp. paratuberculosis
gccaucgugggcgccgucgccgc

SEQ ID NO: 1007750 - RNA, 20 nt, Mycobacterium avium subsp. paratuberculosis
gccaucggcagacccagcag

SEQ ID NO: 1007751 - RNA, 21 nt, Mycobacterium avium subsp. paratuberculosis
gccaucggcagacccagcagc

SEQ ID NO: 1007752 - RNA, 16 nt, Mycobacterium avium subsp. paratuberculosis
gccauggugccgccgu

SEQ ID NO: 1007753 - RNA, 22 nt, Mycobacterium avium subsp. paratuberculosis
gccauggcggcauccccagcug

SEQ ID NO: 1007754 - RNA, 17 nt, Mycobacterium avium subsp. paratuberculosis
gccauggcggcccgcgc

SEQ ID NO: 1007755 - RNA, 15 nt, Mycobacterium avium subsp. paratuberculosis
gccaugcagaccagc

SEQ ID NO: 1007756 - RNA, 16 nt, Mycobacterium avium subsp. paratuberculosis
gccaugcagaccagcc

SEQ ID NO: 1007757 - RNA, 20 nt, Mycobacterium avium subsp. paratuberculosis
gccaguugggggccagcgcc

SEQ ID NO: 1007758 - RNA, 19 nt, Mycobacterium avium subsp. paratuberculosis
gccaucacggugccgaguu

SEQ ID NO: 1007759 - RNA, 16 nt, Mycobacterium avium subsp. paratuberculosis
gccaucaccagcgcgu

SEQ ID NO: 1007760 - RNA, 21 nt, Mycobacterium avium subsp. paratuberculosis
gccaucccggugccgcuggau

SEQ ID NO: 1007761 - RNA, 18 nt, Mycobacterium avium subsp. paratuberculosis
gccaucgccucggccacc

SEQ ID NO: 1007762 - RNA, 20 nt, Mycobacterium avium subsp. paratuberculosis
gccacuucgacggcagcggc

SEQ ID NO: 1007763 - RNA, 14 nt, Mycobacterium avium subsp. paratuberculosis
gccagggccgggcg

SEQ ID NO: 1007764 - RNA, 19 nt, Mycobacterium avium subsp. paratuberculosis
gccagggccgccgcauacc

SEQ ID NO: 1007765 - RNA, 13 nt, Mycobacterium avium subsp. paratuberculosis
gccagggcgagga

SEQ ID NO: 1007766 - RNA, 24 nt, Mycobacterium avium subsp. paratuberculosis
gccagggccgccuugaucuuggcc

SEQ ID NO: 1007767 - RNA, 15 nt, Mycobacterium avium subsp. paratuberculosis
gccagggcccgcagc

SEQ ID NO: 1007768 - RNA, 17 nt, Mycobacterium avium subsp. paratuberculosis
gccagggcagcgcgacc

SEQ ID NO: 1007769 - RNA, 19 nt, Mycobacterium avium subsp. paratuberculosis
gccagggccccguuggugc

SEQ ID NO: 1007770 - RNA, 22 nt, Mycobacterium avium subsp. paratuberculosis
gccagguacugaucaccgcgcu

SEQ ID NO: 1007771 - RNA, 22 nt, Mycobacterium avium subsp. paratuberculosis
gccagguauucgcgggaggaca

SEQ ID NO: 1007772 - RNA, 20 nt, Mycobacterium avium subsp. paratuberculosis
gccagggugccgcugcccgc

SEQ ID NO: 1007773 - RNA, 14 nt, Mycobacterium avium subsp. paratuberculosis
gccagggucucggg

SEQ ID NO: 1007774 - RNA, 21 nt, Mycobacterium avium subsp. paratuberculosis
gccagggucucgggcagcagc

SEQ ID NO: 1007775 - RNA, 15 nt, Mycobacterium avium subsp. paratuberculosis
gccaggucgccgcgc

SEQ ID NO: 1007776 - RNA, 18 nt, Mycobacterium avium subsp. paratuberculosis
gccaggucgccgcgcagc

SEQ ID NO: 1007777 - RNA, 14 nt, Mycobacterium avium subsp. paratuberculosis
gccaggucgggguc

SEQ ID NO: 1007778 - RNA, 19 nt, Mycobacterium avium subsp. paratuberculosis
gccaggucgggguccaggc

SEQ ID NO: 1007779 - RNA, 18 nt, Mycobacterium avium subsp. paratuberculosis
gccaggucgaagcgcagc

SEQ ID NO: 1007780 - RNA, 14 nt, Mycobacterium avium subsp. paratuberculosis
gccagguuggucag

SEQ ID NO: 1007781 - RNA, 18 nt, Mycobacterium avium subsp. paratuberculosis
gccagguuggucagcagc

SEQ ID NO: 1007782 - RNA, 17 nt, Mycobacterium avium subsp. paratuberculosis
gccagguucaggcccgc

SEQ ID NO: 1007783 - RNA, 19 nt, Mycobacterium avium subsp. paratuberculosis
gccagguucaggcccgcgc

SEQ ID NO: 1007784 - RNA, 20 nt, Mycobacterium avium subsp. paratuberculosis
gccagguuccaccgggcguc

SEQ ID NO: 1007785 - RNA, 19 nt, Mycobacterium avium subsp. paratuberculosis
gccagguugaccaccagcg

SEQ ID NO: 1007786 - RNA, 21 nt, Mycobacterium avium subsp. paratuberculosis
gccagguugcgccguccggcc

SEQ ID NO: 1007787 - RNA, 15 nt, Mycobacterium avium subsp. paratuberculosis
gccagguuggcggcg

SEQ ID NO: 1007788 - RNA, 19 nt, Mycobacterium avium subsp. paratuberculosis
gccagguuggcggcggccc

SEQ ID NO: 1007789 - RNA, 18 nt, Mycobacterium avium subsp. paratuberculosis
gccaggugcacgccgagc

SEQ ID NO: 1007790 - RNA, 19 nt, Mycobacterium avium subsp. paratuberculosis
gccaggugcacgccgagca

SEQ ID NO: 1007791 - RNA, 15 nt, Mycobacterium avium subsp. paratuberculosis
gccaggugugcggca

SEQ ID NO: 1007792 - RNA, 14 nt, Mycobacterium avium subsp. paratuberculosis
gccaggugcagcug

SEQ ID NO: 1007793 - RNA, 15 nt, Mycobacterium avium subsp. paratuberculosis
gccaguaccagcggc

SEQ ID NO: 1007794 - RNA, 17 nt, Mycobacterium avium subsp. paratuberculosis
gccaguccggcagcagc

SEQ ID NO: 1007795 - RNA, 18 nt, Mycobacterium avium subsp. paratuberculosis
gccaguccggcagcagcg

SEQ ID NO: 1007796 - RNA, 17 nt, Mycobacterium avium subsp. paratuberculosis
gccaguccaggccgccg

SEQ ID NO: 1007797 - RNA, 20 nt, Mycobacterium avium subsp. paratuberculosis
gccagucgcggcgaaccagc

SEQ ID NO: 1007798 - RNA, 21 nt, Mycobacterium avium subsp. paratuberculosis
gccagucgcggcgaaccagca

SEQ ID NO: 1007799 - RNA, 21 nt, Mycobacterium avium subsp. paratuberculosis
gccagucggucaacgugucga

SEQ ID NO: 1007800 - RNA, 15 nt, Mycobacterium avium subsp. paratuberculosis
gccaguucgucgcgc

SEQ ID NO: 1007801 - RNA, 15 nt, Mycobacterium avium subsp. paratuberculosis
gccaguucgucggcc

SEQ ID NO: 1007802 - RNA, 14 nt, Mycobacterium avium subsp. paratuberculosis
gccaguucccgggc

SEQ ID NO: 1007803 - RNA, 19 nt, Mycobacterium avium subsp. paratuberculosis
gccaguucgagcgccgcgg

SEQ ID NO: 1007804 - RNA, 21 nt, Mycobacterium avium subsp. paratuberculosis
gccccacgccagucauggcag

SEQ ID NO: 1007805 - RNA, 21 nt, Mycobacterium avium subsp. paratuberculosis
gccccacgcgcucagcgcggc

SEQ ID NO: 1007806 - RNA, 23 nt, Mycobacterium avium subsp. paratuberculosis
gccccacgcgcucagcgcggcca

SEQ ID NO: 1007807 - RNA, 21 nt, Mycobacterium avium subsp. paratuberculosis
gccccagaaccgcucggcggc

SEQ ID NO: 1007808 - RNA, 14 nt, Mycobacterium avium subsp. paratuberculosis
gccccaccgccgcu

SEQ ID NO: 1007809 - RNA, 15 nt, Mycobacterium avium subsp. paratuberculosis
gccccaccggccacu

SEQ ID NO: 1007810 - RNA, 20 nt, Mycobacterium avium subsp. paratuberculosis
gccccaccaccgccaccagc

SEQ ID NO: 1007811 - RNA, 18 nt, Mycobacterium avium subsp. paratuberculosis
gccccaccaccgccggcc

SEQ ID NO: 1007812 - RNA, 19 nt, Mycobacterium avium subsp. paratuberculosis
gccccaccaccgccggccc

SEQ ID NO: 1007813 - RNA, 23 nt, Mycobacterium avium subsp. paratuberculosis
gccccaccaccgccggcccaggc

SEQ ID NO: 1007814 - RNA, 14 nt, Mycobacterium avium subsp. paratuberculosis
gccccaaccccccu

SEQ ID NO: 1007815 - RNA, 20 nt, Mycobacterium avium subsp. paratuberculosis
gccccacacgcucggcgcgc

SEQ ID NO: 1007816 - RNA, 16 nt, Mycobacterium avium subsp. paratuberculosis
gcccaucggcagcccg

SEQ ID NO: 1007817 - RNA, 21 nt, Mycobacterium avium subsp. paratuberculosis
gcccagugucgcaaagacauu

SEQ ID NO: 1007818 - RNA, 17 nt, Mycobacterium avium subsp. paratuberculosis
gcccaucugcacagcuu

SEQ ID NO: 1007819 - RNA, 15 nt, Mycobacterium avium subsp. paratuberculosis
gcccagugcgcgccg

SEQ ID NO: 1007820 - RNA, 14 nt, Mycobacterium avium subsp. paratuberculosis
gcccagucgccgcc

SEQ ID NO: 1007821 - RNA, 15 nt, Mycobacterium avium subsp. paratuberculosis
gcccaguccugcagc

SEQ ID NO: 1007822 - RNA, 13 nt, Mycobacterium avium subsp. paratuberculosis
gcccagucgccgc

SEQ ID NO: 1007823 - RNA, 21 nt, Mycobacterium avium subsp. paratuberculosis
gcccaggccuuguacgccccg

SEQ ID NO: 1007824 - RNA, 23 nt, Mycobacterium avium subsp. paratuberculosis
gcccaagccggccaggcccagcc

SEQ ID NO: 1007825 - RNA, 18 nt, Mycobacterium avium subsp. paratuberculosis
gcccagacgcgggcgccc

SEQ ID NO: 1007826 - RNA, 17 nt, Mycobacterium avium subsp. paratuberculosis
gcccagauacgccgcga

SEQ ID NO: 1007827 - RNA, 14 nt, Mycobacterium avium subsp. paratuberculosis
gcccagcaccaccu

SEQ ID NO: 1007828 - RNA, 20 nt, Mycobacterium avium subsp. paratuberculosis
gcccagcagauagcccagcc

SEQ ID NO: 1007829 - RNA, 10 nt, Mycobacterium avium subsp. paratuberculosis
gcccagcagc

SEQ ID NO: 1007830 - RNA, 23 nt, Mycobacterium avium subsp. paratuberculosis
gcccagcacccgguuccaccggg

SEQ ID NO: 1007831 - RNA, 14 nt, Mycobacterium avium subsp. paratuberculosis
gcccagcaccacca

SEQ ID NO: 1007832 - RNA, 17 nt, Mycobacterium avium subsp. paratuberculosis
gcccagcaccaccacgu

SEQ ID NO: 1007833 - RNA, 11 nt, Mycobacterium avium subsp. paratuberculosis
gcccagcacca

SEQ ID NO: 1007834 - RNA, 17 nt, Mycobacterium avium subsp. paratuberculosis
gcccagaucgccgaccc

SEQ ID NO: 1007835 - RNA, 17 nt, Mycobacterium avium subsp. paratuberculosis
gcccagaucggccagcc

SEQ ID NO: 1007836 - RNA, 16 nt, Mycobacterium avium subsp. paratuberculosis
gcccagaugccgccgc

SEQ ID NO: 1007837 - RNA, 17 nt, Mycobacterium avium subsp. paratuberculosis
gcccagaugccgccgcc

SEQ ID NO: 1007838 - RNA, 18 nt, Mycobacterium avium subsp. paratuberculosis
gcccagaugccgccgcca

SEQ ID NO: 1007839 - RNA, 22 nt, Mycobacterium avium subsp. paratuberculosis
gcccagaugccgccgccagcgc

SEQ ID NO: 1007840 - RNA, 16 nt, Mycobacterium avium subsp. paratuberculosis
gcccagauugcggccc

SEQ ID NO: 1007841 - RNA, 14 nt, Mycobacterium avium subsp. paratuberculosis
gcccagcgcgcggc

SEQ ID NO: 1007842 - RNA, 15 nt, Mycobacterium avium subsp. paratuberculosis
gcccagcgcgcggcg

SEQ ID NO: 1007843 - RNA, 14 nt, Mycobacterium avium subsp. paratuberculosis
gcccagcgcgcggu

SEQ ID NO: 1007844 - RNA, 16 nt, Mycobacterium avium subsp. paratuberculosis
gcccagcgcggcggcc

SEQ ID NO: 1007845 - RNA, 20 nt, Mycobacterium avium subsp. paratuberculosis
gcccagcgcggcggccaccu

SEQ ID NO: 1007846 - RNA, 17 nt, Mycobacterium avium subsp. paratuberculosis
gcccagcggcacgaagu

SEQ ID NO: 1007847 - RNA, 19 nt, Mycobacterium avium subsp. paratuberculosis
gcccagcgcguugcggccg

SEQ ID NO: 1007848 - RNA, 20 nt, Mycobacterium avium subsp. paratuberculosis
gcccagcgcgcgaucgccgg

SEQ ID NO: 1007849 - RNA, 14 nt, Mycobacterium avium subsp. paratuberculosis
gcccagcgccgcgu

SEQ ID NO: 1007850 - RNA, 16 nt, Mycobacterium avium subsp. paratuberculosis
gcccaggccgauggug

SEQ ID NO: 1007851 - RNA, 14 nt, Mycobacterium avium subsp. paratuberculosis
gcccaggccgacgc

SEQ ID NO: 1007852 - RNA, 19 nt, Mycobacterium avium subsp. paratuberculosis
gcccaggccgacgccggcc

SEQ ID NO: 1007853 - RNA, 16 nt, Mycobacterium avium subsp. paratuberculosis
gcccaggccgagcgca

SEQ ID NO: 1007854 - RNA, 14 nt, Mycobacterium avium subsp. paratuberculosis
gcccaggccccggc

SEQ ID NO: 1007855 - RNA, 15 nt, Mycobacterium avium subsp. paratuberculosis
gcccaggccaacagc

SEQ ID NO: 1007856 - RNA, 19 nt, Mycobacterium avium subsp. paratuberculosis
gcccaggccaacagcagca

SEQ ID NO: 1007857 - RNA, 22 nt, Mycobacterium avium subsp. paratuberculosis
gcccagcggcgaugcccacagc

SEQ ID NO: 1007858 - RNA, 15 nt, Mycobacterium avium subsp. paratuberculosis
gcccagcggcauggc

SEQ ID NO: 1007859 - RNA, 17 nt, Mycobacterium avium subsp. paratuberculosis
gcccagccgccagccgg

SEQ ID NO: 1007860 - RNA, 11 nt, Mycobacterium avium subsp. paratuberculosis
gcccagccggu

SEQ ID NO: 1007861 - RNA, 21 nt, Mycobacterium avium subsp. paratuberculosis
gcccagccggucgccgggccg

SEQ ID NO: 1007862 - RNA, 11 nt, Mycobacterium avium subsp. paratuberculosis
gcccagccggc

SEQ ID NO: 1007863 - RNA, 19 nt, Mycobacterium avium subsp. paratuberculosis
gcccagccggcggugcagg

SEQ ID NO: 1007864 - RNA, 20 nt, Mycobacterium avium subsp. paratuberculosis
gcccagccggcggugcaggg

SEQ ID NO: 1007865 - RNA, 19 nt, Mycobacterium avium subsp. paratuberculosis
gcccagcagcccggccagc

SEQ ID NO: 1007866 - RNA, 21 nt, Mycobacterium avium subsp. paratuberculosis
gcccagcagcggggcgagcug

SEQ ID NO: 1007867 - RNA, 23 nt, Mycobacterium avium subsp. paratuberculosis
gcccagcagcggggcgagcuggc

SEQ ID NO: 1007868 - RNA, 13 nt, Mycobacterium avium subsp. paratuberculosis
gcccagccgcagg

SEQ ID NO: 1007869 - RNA, 19 nt, Mycobacterium avium subsp. paratuberculosis
gcccagccgcaggugcagc

SEQ ID NO: 1007870 - RNA, 23 nt, Mycobacterium avium subsp. paratuberculosis
gcccagccgcaggugcagcuccu

SEQ ID NO: 1007871 - RNA, 15 nt, Mycobacterium avium subsp. paratuberculosis
gcccagcgcauccac

SEQ ID NO: 1007872 - RNA, 13 nt, Mycobacterium avium subsp. paratuberculosis
gcccagcgcccgu

SEQ ID NO: 1007873 - RNA, 16 nt, Mycobacterium avium subsp. paratuberculosis
gcccagcgagcugccg

SEQ ID NO: 1007874 - RNA, 22 nt, Mycobacterium avium subsp. paratuberculosis
gcccagcgaggcggccagcggc

SEQ ID NO: 1007875 - RNA, 16 nt, Mycobacterium avium subsp. paratuberculosis
gcccagcgcagcaucg

SEQ ID NO: 1007876 - RNA, 21 nt, Mycobacterium avium subsp. paratuberculosis
gcccagcgacucggccaggau

SEQ ID NO: 1007877 - RNA, 13 nt, Mycobacterium avium subsp. paratuberculosis
gcccagcgcagcg

SEQ ID NO: 1007878 - RNA, 22 nt, Mycobacterium avium subsp. paratuberculosis
gccccucgacccgaagccaggu

SEQ ID NO: 1007879 - RNA, 19 nt, Mycobacterium avium subsp. paratuberculosis
gccccucgacguccaggcc

SEQ ID NO: 1007880 - RNA, 15 nt, Mycobacterium avium subsp. paratuberculosis
gccccucgccgggcg

SEQ ID NO: 1007881 - RNA, 18 nt, Mycobacterium avium subsp. paratuberculosis
gccccucccaccacggcc

SEQ ID NO: 1007882 - RNA, 20 nt, Mycobacterium avium subsp. paratuberculosis
gccccuccagccgccggucc

SEQ ID NO: 1007883 - RNA, 16 nt, Mycobacterium avium subsp. paratuberculosis
gccccuccaggcaugg

SEQ ID NO: 1007884 - RNA, 22 nt, Mycobacterium avium subsp. paratuberculosis
gccccggagaugguggcguagc

SEQ ID NO: 1007885 - RNA, 21 nt, Mycobacterium avium subsp. paratuberculosis
gccccggauccgucgccccgc

SEQ ID NO: 1007886 - RNA, 23 nt, Mycobacterium avium subsp. paratuberculosis
gccccggauccgucgccccgcac

SEQ ID NO: 1007887 - RNA, 21 nt, Mycobacterium avium subsp. paratuberculosis
gcccgaauugcgcugcaccgc

SEQ ID NO: 1007888 - RNA, 17 nt, Mycobacterium avium subsp. paratuberculosis
gcccgacaccgccccgc

SEQ ID NO: 1007889 - RNA, 21 nt, Mycobacterium avium subsp. paratuberculosis
gcccgcaacuguucgcggcug

SEQ ID NO: 1007890 - RNA, 23 nt, Mycobacterium avium subsp. paratuberculosis
gcccgcaacuguucgcggcuggc

SEQ ID NO: 1007891 - RNA, 18 nt, Mycobacterium avium subsp. paratuberculosis
gcccgcaaaucagccgag

SEQ ID NO: 1007892 - RNA, 21 nt, Mycobacterium avium subsp. paratuberculosis
gcccgcaaaucagccgagccg

SEQ ID NO: 1007893 - RNA, 16 nt, Mycobacterium avium subsp. paratuberculosis
gcccgauucgcggcca

SEQ ID NO: 1007894 - RNA, 21 nt, Mycobacterium avium subsp. paratuberculosis
gcccgauggaggugccgcgca

SEQ ID NO: 1007895 - RNA, 16 nt, Mycobacterium avium subsp. paratuberculosis
gcccgacccguccagc

SEQ ID NO: 1007896 - RNA, 20 nt, Mycobacterium avium subsp. paratuberculosis
gcccgacccguccagcagca

SEQ ID NO: 1007897 - RNA, 21 nt, Mycobacterium avium subsp. paratuberculosis
gcccgacccguccagcagcau

SEQ ID NO: 1007898 - RNA, 12 nt, Mycobacterium avium subsp. paratuberculosis
gcccgaccgcgc

SEQ ID NO: 1007899 - RNA, 18 nt, Mycobacterium avium subsp. paratuberculosis
gcccgaccuucugcugca

SEQ ID NO: 1007900 - RNA, 19 nt, Mycobacterium avium subsp. paratuberculosis
gcccgacaucugccgggcg

SEQ ID NO: 1007901 - RNA, 21 nt, Mycobacterium avium subsp. paratuberculosis
gcccgacaucugccgggcggc

SEQ ID NO: 1007902 - RNA, 17 nt, Mycobacterium avium subsp. paratuberculosis
gcccgaccagcgggccg

SEQ ID NO: 1007903 - RNA, 18 nt, Mycobacterium avium subsp. paratuberculosis
gcccgaccagcgggccga

SEQ ID NO: 1007904 - RNA, 20 nt, Mycobacterium avium subsp. paratuberculosis
gcccgacaccgccccgccgc

SEQ ID NO: 1007905 - RNA, 16 nt, Mycobacterium avium subsp. paratuberculosis
gcccgcaccacccagc

SEQ ID NO: 1007906 - RNA, 19 nt, Mycobacterium avium subsp. paratuberculosis
gcccgcaccacccagcccu

SEQ ID NO: 1007907 - RNA, 15 nt, Mycobacterium avium subsp. paratuberculosis
gcccgcaccagcagg

SEQ ID NO: 1007908 - RNA, 19 nt, Mycobacterium avium subsp. paratuberculosis
gcccgcacccgccgcccga

SEQ ID NO: 1007909 - RNA, 13 nt, Mycobacterium avium subsp. paratuberculosis
gcccgcacggccg

SEQ ID NO: 1007910 - RNA, 14 nt, Mycobacterium avium subsp. paratuberculosis
gcccgcagccagcg

SEQ ID NO: 1007911 - RNA, 18 nt, Mycobacterium avium subsp. paratuberculosis
gcccgcagccagcgcagc

SEQ ID NO: 1007912 - RNA, 13 nt, Mycobacterium avium subsp. paratuberculosis
gcccgcagccgcu

SEQ ID NO: 1007913 - RNA, 18 nt, Mycobacterium avium subsp. paratuberculosis
gcccgcagccgcuggccg

SEQ ID NO: 1007914 - RNA, 17 nt, Mycobacterium avium subsp. paratuberculosis
gcccgcaggaucgagcc

SEQ ID NO: 1007915 - RNA, 21 nt, Mycobacterium avium subsp. paratuberculosis
gcccgcaggaucgagccggcc

SEQ ID NO: 1007916 - RNA, 18 nt, Mycobacterium avium subsp. paratuberculosis
gcccgccacccgaggccg

SEQ ID NO: 1007917 - RNA, 14 nt, Mycobacterium avium subsp. paratuberculosis
gccccagcuccucg

SEQ ID NO: 1007918 - RNA, 19 nt, Mycobacterium avium subsp. paratuberculosis
gccccagcugucggguggc

SEQ ID NO: 1007919 - RNA, 20 nt, Mycobacterium avium subsp. paratuberculosis
gccccagcgagcaggucacc

SEQ ID NO: 1007920 - RNA, 21 nt, Mycobacterium avium subsp. paratuberculosis
gccccagcacgaucccgccgc

SEQ ID NO: 1007921 - RNA, 17 nt, Mycobacterium avium subsp. paratuberculosis
gccccagccccucgccg

SEQ ID NO: 1007922 - RNA, 14 nt, Mycobacterium avium subsp. paratuberculosis
gccccagccacagc

SEQ ID NO: 1007923 - RNA, 17 nt, Mycobacterium avium subsp. paratuberculosis
gccccagccacagccgc

SEQ ID NO: 1007924 - RNA, 12 nt, Mycobacterium avium subsp. paratuberculosis
gccccagccacc

SEQ ID NO: 1007925 - RNA, 19 nt, Mycobacterium avium subsp. paratuberculosis
gccccagcccggcuggcag

SEQ ID NO: 1007926 - RNA, 14 nt, Mycobacterium avium subsp. paratuberculosis
gccccagccgacca

SEQ ID NO: 1007927 - RNA, 13 nt, Mycobacterium avium subsp. paratuberculosis
gccccagccgccg

SEQ ID NO: 1007928 - RNA, 14 nt, Mycobacterium avium subsp. paratuberculosis
gccccagccgccgc

SEQ ID NO: 1007929 - RNA, 17 nt, Mycobacterium avium subsp. paratuberculosis
gccccaggcggaaugca

SEQ ID NO: 1007930 - RNA, 12 nt, Mycobacterium avium subsp. paratuberculosis
gccccaggcgaa

SEQ ID NO: 1007931 - RNA, 19 nt, Mycobacterium avium subsp. paratuberculosis
gccccaggucggggugggc

SEQ ID NO: 1007932 - RNA, 15 nt, Mycobacterium avium subsp. paratuberculosis
gccccagggaccagu

SEQ ID NO: 1007933 - RNA, 16 nt, Mycobacterium avium subsp. paratuberculosis
gccccagggugcgccg

SEQ ID NO: 1007934 - RNA, 18 nt, Mycobacterium avium subsp. paratuberculosis
gccccagugcaggcaggc

SEQ ID NO: 1007935 - RNA, 12 nt, Mycobacterium avium subsp. paratuberculosis
gcccccagcucu

SEQ ID NO: 1007936 - RNA, 21 nt, Mycobacterium avium subsp. paratuberculosis
gccccgcgcgaucaggccggc

SEQ ID NO: 1007937 - RNA, 22 nt, Mycobacterium avium subsp. paratuberculosis
gccccgcgcgaucaggccggcc

SEQ ID NO: 1007938 - RNA, 22 nt, Mycobacterium avium subsp. paratuberculosis
gccccgcugccguccggcggca

SEQ ID NO: 1007939 - RNA, 22 nt, Mycobacterium avium subsp. paratuberculosis
gccccgcuccuccucgcgccgc

SEQ ID NO: 1007940 - RNA, 18 nt, Mycobacterium avium subsp. paratuberculosis
gccccgcaccgagccugg

SEQ ID NO: 1007941 - RNA, 14 nt, Mycobacterium avium subsp. paratuberculosis
gccccgcaccgcca

SEQ ID NO: 1007942 - RNA, 21 nt, Mycobacterium avium subsp. paratuberculosis
gccccgccagauagggcagcg

SEQ ID NO: 1007943 - RNA, 14 nt, Mycobacterium avium subsp. paratuberculosis
gccccgccagcaga

SEQ ID NO: 1007944 - RNA, 22 nt, Mycobacterium avium subsp. paratuberculosis
gccccgcgaccgcagcaggcgg

SEQ ID NO: 1007945 - RNA, 19 nt, Mycobacterium avium subsp. paratuberculosis
gcccccgccccagcccggc

SEQ ID NO: 1007946 - RNA, 13 nt, Mycobacterium avium subsp. paratuberculosis
gccccgacagcaa

SEQ ID NO: 1007947 - RNA, 14 nt, Mycobacterium avium subsp. paratuberculosis
gccccgacaggagg

SEQ ID NO: 1007948 - RNA, 22 nt, Mycobacterium avium subsp. paratuberculosis
gcccccgaggagacgucggccg

SEQ ID NO: 1007949 - RNA, 14 nt, Mycobacterium avium subsp. paratuberculosis
gcccccgcagcccg

SEQ ID NO: 1007950 - RNA, 20 nt, Mycobacterium avium subsp. paratuberculosis
gccccgacaucgccaucagc

SEQ ID NO: 1007951 - RNA, 18 nt, Mycobacterium avium subsp. paratuberculosis
gccccgagaucccagcgg

SEQ ID NO: 1007952 - RNA, 15 nt, Mycobacterium avium subsp. paratuberculosis
gccacguccggaugc

SEQ ID NO: 1007953 - RNA, 23 nt, Mycobacterium avium subsp. paratuberculosis
gccacgucguucaugaucggcag

SEQ ID NO: 1007954 - RNA, 17 nt, Mycobacterium avium subsp. paratuberculosis
gccacuccaccaccggc

SEQ ID NO: 1007955 - RNA, 14 nt, Mycobacterium avium subsp. paratuberculosis
gccacucgccgcga

SEQ ID NO: 1007956 - RNA, 15 nt, Mycobacterium avium subsp. paratuberculosis
gccacucgcgucccc

SEQ ID NO: 1007957 - RNA, 17 nt, Mycobacterium avium subsp. paratuberculosis
gccacucgggcggccgc

SEQ ID NO: 1007958 - RNA, 14 nt, Mycobacterium avium subsp. paratuberculosis
gccacugccccggc

SEQ ID NO: 1007959 - RNA, 16 nt, Mycobacterium avium subsp. paratuberculosis
gccacuggcgccaccu

SEQ ID NO: 1007960 - RNA, 13 nt, Mycobacterium avium subsp. paratuberculosis
gccacgaccagcg

SEQ ID NO: 1007961 - RNA, 17 nt, Mycobacterium avium subsp. paratuberculosis
gccacgacgcgccacgc

SEQ ID NO: 1007962 - RNA, 17 nt, Mycobacterium avium subsp. paratuberculosis
gccacgacgcggcgcgc

SEQ ID NO: 1007963 - RNA, 18 nt, Mycobacterium avium subsp. paratuberculosis
gccacgacugcgcggccg

SEQ ID NO: 1007964 - RNA, 14 nt, Mycobacterium avium subsp. paratuberculosis
gccacgagcccagc

SEQ ID NO: 1007965 - RNA, 16 nt, Mycobacterium avium subsp. paratuberculosis
gccacgaucaccacca

SEQ ID NO: 1007966 - RNA, 18 nt, Mycobacterium avium subsp. paratuberculosis
gccacgauccgcgcggcc

SEQ ID NO: 1007967 - RNA, 12 nt, Mycobacterium avium subsp. paratuberculosis
gccacggcagcu

SEQ ID NO: 1007968 - RNA, 12 nt, Mycobacterium avium subsp. paratuberculosis
gccacggccagc

SEQ ID NO: 1007969 - RNA, 15 nt, Mycobacterium avium subsp. paratuberculosis
gccacggccagcacc

SEQ ID NO: 1007970 - RNA, 16 nt, Mycobacterium avium subsp. paratuberculosis
gccacggccgcggccc

SEQ ID NO: 1007971 - RNA, 23 nt, Mycobacterium avium subsp. paratuberculosis
gccacggccgcggcccggccacc

SEQ ID NO: 1007972 - RNA, 15 nt, Mycobacterium avium subsp. paratuberculosis
gccacggggcgccgc

SEQ ID NO: 1007973 - RNA, 18 nt, Mycobacterium avium subsp. paratuberculosis
gccacggggcgccgcugc

SEQ ID NO: 1007974 - RNA, 24 nt, Mycobacterium avium subsp. paratuberculosis
gccacggggucgagaagcccgugc

SEQ ID NO: 1007975 - RNA, 23 nt, Mycobacterium avium subsp. paratuberculosis
gccacggcggggucaagcggcag

SEQ ID NO: 1007976 - RNA, 19 nt, Mycobacterium avium subsp. paratuberculosis
gccacggcguugaccaacg

SEQ ID NO: 1007977 - RNA, 18 nt, Mycobacterium avium subsp. paratuberculosis
gccacggucaggcgcagc

SEQ ID NO: 1007978 - RNA, 15 nt, Mycobacterium avium subsp. paratuberculosis
gccacgguggcgguc

SEQ ID NO: 1007979 - RNA, 18 nt, Mycobacterium avium subsp. paratuberculosis
gccacgguggcggucagg

SEQ ID NO: 1007980 - RNA, 19 nt, Mycobacterium avium subsp. paratuberculosis
gccaccaugggcgggacga

SEQ ID NO: 1007981 - RNA, 17 nt, Mycobacterium avium subsp. paratuberculosis
gccacagcagcaccagc

SEQ ID NO: 1007982 - RNA, 22 nt, Mycobacterium avium subsp. paratuberculosis
gccacagcaugaagaucagcac

SEQ ID NO: 1007983 - RNA, 15 nt, Mycobacterium avium subsp. paratuberculosis
gccacaccgccgcgg

SEQ ID NO: 1007984 - RNA, 19 nt, Mycobacterium avium subsp. paratuberculosis
gccacaccgccgcggcggu

SEQ ID NO: 1007985 - RNA, 13 nt, Mycobacterium avium subsp. paratuberculosis
gccacacuggcca

SEQ ID NO: 1007986 - RNA, 15 nt, Mycobacterium avium subsp. paratuberculosis
gccaccccaggcgau

SEQ ID NO: 1007987 - RNA, 21 nt, Mycobacterium avium subsp. paratuberculosis
gccaccccgaacccggccagc

SEQ ID NO: 1007988 - RNA, 22 nt, Mycobacterium avium subsp. paratuberculosis
gccaccccgaacccggccagcg

SEQ ID NO: 1007989 - RNA, 12 nt, Mycobacterium avium subsp. paratuberculosis
gccaccccgcgc

SEQ ID NO: 1007990 - RNA, 19 nt, Mycobacterium avium subsp. paratuberculosis
gccacccgcugcucgaccu

SEQ ID NO: 1007991 - RNA, 12 nt, Mycobacterium avium subsp. paratuberculosis
gccacccgcgau

SEQ ID NO: 1007992 - RNA, 13 nt, Mycobacterium avium subsp. paratuberculosis
gccacccgcgccu

SEQ ID NO: 1007993 - RNA, 14 nt, Mycobacterium avium subsp. paratuberculosis
gccacccgcgccuc

SEQ ID NO: 1007994 - RNA, 13 nt, Mycobacterium avium subsp. paratuberculosis
gccaccuucaccg

SEQ ID NO: 1007995 - RNA, 20 nt, Mycobacterium avium subsp. paratuberculosis
gccaccgcccgaaccgcguc

SEQ ID NO: 1007996 - RNA, 22 nt, Mycobacterium avium subsp. paratuberculosis
gccaccgcccgcugaccgccgc

SEQ ID NO: 1007997 - RNA, 13 nt, Mycobacterium avium subsp. paratuberculosis
gccaccgccgcca

SEQ ID NO: 1007998 - RNA, 18 nt, Mycobacterium avium subsp. paratuberculosis
gccaccggccgguccgcc

SEQ ID NO: 1007999 - RNA, 21 nt, Mycobacterium avium subsp. paratuberculosis
gccaccggcuccuugcgccgc

SEQ ID NO: 1008000 - RNA, 20 nt, Mycobacterium avium subsp. paratuberculosis
gccaccgagaucaugccggc

SEQ ID NO: 1008001 - RNA, 21 nt, Mycobacterium avium subsp. paratuberculosis
gccaccgagaucaugccggcg

SEQ ID NO: 1008002 - RNA, 18 nt, Mycobacterium avium subsp. paratuberculosis
gccaccgacaccaccggc

SEQ ID NO: 1008003 - RNA, 14 nt, Mycobacterium avium subsp. paratuberculosis
gccacccgggcgcc

SEQ ID NO: 1008004 - RNA, 15 nt, Mycobacterium avium subsp. paratuberculosis
gccacccgggcgccg

SEQ ID NO: 1008005 - RNA, 17 nt, Mycobacterium avium subsp. paratuberculosis
gccacccgggcgccggc

SEQ ID NO: 1008006 - RNA, 16 nt, Mycobacterium avium subsp. paratuberculosis
gccaacccgggcgcca

SEQ ID NO: 1008007 - RNA, 23 nt, Mycobacterium avium subsp. paratuberculosis
gccaacgcgacgaagccggugcc

SEQ ID NO: 1008008 - RNA, 23 nt, Mycobacterium avium subsp. paratuberculosis
gccaacgccucgucgaccgcggc

SEQ ID NO: 1008009 - RNA, 19 nt, Mycobacterium avium subsp. paratuberculosis
gccaacgguucggccgcuc

SEQ ID NO: 1008010 - RNA, 15 nt, Mycobacterium avium subsp. paratuberculosis
gccaagauugggcca

SEQ ID NO: 1008011 - RNA, 19 nt, Mycobacterium avium subsp. paratuberculosis
gccaagauugggccacaga

SEQ ID NO: 1008012 - RNA, 20 nt, Mycobacterium avium subsp. paratuberculosis
gccaacaacucagaacaggu

SEQ ID NO: 1008013 - RNA, 14 nt, Mycobacterium avium subsp. paratuberculosis
gccaacagcagcag

SEQ ID NO: 1008014 - RNA, 15 nt, Mycobacterium avium subsp. paratuberculosis
gccaacacggcggcg

SEQ ID NO: 1008015 - RNA, 20 nt, Mycobacterium avium subsp. paratuberculosis
gccaacacggcggcgcgcac

SEQ ID NO: 1008016 - RNA, 14 nt, Mycobacterium avium subsp. paratuberculosis
gccaaccacuugaa

SEQ ID NO: 1008017 - RNA, 15 nt, Mycobacterium avium subsp. paratuberculosis
gccacaaacagcgcg

SEQ ID NO: 1008018 - RNA, 17 nt, Mycobacterium avium subsp. paratuberculosis
gccacaaacagcgcggc

SEQ ID NO: 1008019 - RNA, 18 nt, Mycobacterium avium subsp. paratuberculosis
gccacaaacagcgcggcc

SEQ ID NO: 1008020 - RNA, 15 nt, Mycobacterium avium subsp. paratuberculosis
gccacaacauguccc

SEQ ID NO: 1008021 - RNA, 14 nt, Mycobacterium avium subsp. paratuberculosis
gccaauuacgcugc

SEQ ID NO: 1008022 - RNA, 17 nt, Mycobacterium avium subsp. paratuberculosis
gccaauuacgcugcggc

SEQ ID NO: 1008023 - RNA, 18 nt, Mycobacterium avium subsp. paratuberculosis
gccaaugggguauggugu

SEQ ID NO: 1008024 - RNA, 23 nt, Mycobacterium avium subsp. paratuberculosis
gccaauaagaucgugcuugagca

SEQ ID NO: 1008025 - RNA, 21 nt, Mycobacterium avium subsp. paratuberculosis
gccaagcguauccggccagcc

SEQ ID NO: 1008026 - RNA, 19 nt, Mycobacterium avium subsp. paratuberculosis
gccaagccauuucagcagc

SEQ ID NO: 1008027 - RNA, 23 nt, Mycobacterium avium subsp. paratuberculosis
gccaaggucgccggugugcagcc

SEQ ID NO: 1008028 - RNA, 12 nt, Mycobacterium avium subsp. paratuberculosis
gccaaggccagc

SEQ ID NO: 1008029 - RNA, 15 nt, Mycobacterium avium subsp. paratuberculosis
gccaaggccagcaac

SEQ ID NO: 1008030 - RNA, 14 nt, Mycobacterium avium subsp. paratuberculosis
gcaucacccggcgc

SEQ ID NO: 1008031 - RNA, 16 nt, Mycobacterium avium subsp. paratuberculosis
gcaucacgucggcgag

SEQ ID NO: 1008032 - RNA, 17 nt, Mycobacterium avium subsp. paratuberculosis
gcaucacgucggcgagc

SEQ ID NO: 1008033 - RNA, 15 nt, Mycobacterium avium subsp. paratuberculosis
gcauaccgcccgcgc

SEQ ID NO: 1008034 - RNA, 17 nt, Mycobacterium avium subsp. paratuberculosis
gcaguagacgccgccgu

SEQ ID NO: 1008035 - RNA, 22 nt, Mycobacterium avium subsp. paratuberculosis
gcaguagccgaucuccaccgag

SEQ ID NO: 1008036 - RNA, 15 nt, Mycobacterium avium subsp. paratuberculosis
gcaucagcgccacca

SEQ ID NO: 1008037 - RNA, 24 nt, Mycobacterium avium subsp. paratuberculosis
gcaucagcgagacgaccaggaugc

SEQ ID NO: 1008038 - RNA, 14 nt, Mycobacterium avium subsp. paratuberculosis
gcaucagcgccacc

SEQ ID NO: 1008039 - RNA, 23 nt, Mycobacterium avium subsp. paratuberculosis
gcauccccagcugggccgccagc

SEQ ID NO: 1008040 - RNA, 23 nt, Mycobacterium avium subsp. paratuberculosis
gcaucagcggagugaccgccagc

SEQ ID NO: 1008041 - RNA, 21 nt, Mycobacterium avium subsp. paratuberculosis
gcaucagcggggcguccagcg

SEQ ID NO: 1008042 - RNA, 19 nt, Mycobacterium avium subsp. paratuberculosis
gcauccggaaccgggcacc

SEQ ID NO: 1008043 - RNA, 14 nt, Mycobacterium avium subsp. paratuberculosis
gcauccgccgggcg

SEQ ID NO: 1008044 - RNA, 18 nt, Mycobacterium avium subsp. paratuberculosis
gcauccgccgggcggcgu

SEQ ID NO: 1008045 - RNA, 13 nt, Mycobacterium avium subsp. paratuberculosis
gcauccgcuggug

SEQ ID NO: 1008046 - RNA, 22 nt, Mycobacterium avium subsp. paratuberculosis
gcauccgcaacgugcgccggcc

SEQ ID NO: 1008047 - RNA, 16 nt, Mycobacterium avium subsp. paratuberculosis
gcauccggcgcacggc

SEQ ID NO: 1008048 - RNA, 18 nt, Mycobacterium avium subsp. paratuberculosis
gcauccggcucagaaggc

SEQ ID NO: 1008049 - RNA, 17 nt, Mycobacterium avium subsp. paratuberculosis
gcauccgucggccuugc

SEQ ID NO: 1008050 - RNA, 20 nt, Mycobacterium avium subsp. paratuberculosis
gcaucgccggcgaugcgcgc

SEQ ID NO: 1008051 - RNA, 15 nt, Mycobacterium avium subsp. paratuberculosis
gcaucgccggcgcgc

SEQ ID NO: 1008052 - RNA, 17 nt, Mycobacterium avium subsp. paratuberculosis
gcaucgcgcgcggcggc

SEQ ID NO: 1008053 - RNA, 17 nt, Mycobacterium avium subsp. paratuberculosis
gcaucgccucggcggcc

SEQ ID NO: 1008054 - RNA, 18 nt, Mycobacterium avium subsp. paratuberculosis
gcaucgccgucauggugu

SEQ ID NO: 1008055 - RNA, 19 nt, Mycobacterium avium subsp. paratuberculosis
gcaucggcgacgccgccgu

SEQ ID NO: 1008056 - RNA, 20 nt, Mycobacterium avium subsp. paratuberculosis
gcaucggcuggucggcggcc

SEQ ID NO: 1008057 - RNA, 18 nt, Mycobacterium avium subsp. paratuberculosis
gcaucgggacgccugccg

SEQ ID NO: 1008058 - RNA, 14 nt, Mycobacterium avium subsp. paratuberculosis
gcaucgggcgcagg

SEQ ID NO: 1008059 - RNA, 17 nt, Mycobacterium avium subsp. paratuberculosis
gcaucgucgcggcgguc

SEQ ID NO: 1008060 - RNA, 18 nt, Mycobacterium avium subsp. paratuberculosis
gcaucggucaccagcucc

SEQ ID NO: 1008061 - RNA, 19 nt, Mycobacterium avium subsp. paratuberculosis
gcaucggucaccagcuccc

SEQ ID NO: 1008062 - RNA, 15 nt, Mycobacterium avium subsp. paratuberculosis
gcaugcgccagagcg

SEQ ID NO: 1008063 - RNA, 20 nt, Mycobacterium avium subsp. paratuberculosis
gcaugccguucagcgcggcc

SEQ ID NO: 1008064 - RNA, 18 nt, Mycobacterium avium subsp. paratuberculosis
gcaugccggugucggugc

SEQ ID NO: 1008065 - RNA, 12 nt, Mycobacterium avium subsp. paratuberculosis
gcaugccgggca

SEQ ID NO: 1008066 - RNA, 15 nt, Mycobacterium avium subsp. paratuberculosis
gcaugccgggcagga

SEQ ID NO: 1008067 - RNA, 21 nt, Mycobacterium avium subsp. paratuberculosis
gcaugccgggccagccggccc

SEQ ID NO: 1008068 - RNA, 12 nt, Mycobacterium avium subsp. paratuberculosis
gcaugcccugga

SEQ ID NO: 1008069 - RNA, 23 nt, Mycobacterium avium subsp. paratuberculosis
gcauggucaccggagagcaacac

SEQ ID NO: 1008070 - RNA, 17 nt, Mycobacterium avium subsp. paratuberculosis
gcaugggcgugccggcc

SEQ ID NO: 1008071 - RNA, 19 nt, Mycobacterium avium subsp. paratuberculosis
gcagguucauccccgcggc

SEQ ID NO: 1008072 - RNA, 19 nt, Mycobacterium avium subsp. paratuberculosis
gcagguucugcacguggug

SEQ ID NO: 1008073 - RNA, 15 nt, Mycobacterium avium subsp. paratuberculosis
gcagguugcgcugga

SEQ ID NO: 1008074 - RNA, 17 nt, Mycobacterium avium subsp. paratuberculosis
gcagguggggcagcacc

SEQ ID NO: 1008075 - RNA, 21 nt, Mycobacterium avium subsp. paratuberculosis
gcaggugcccgucggccucgg

SEQ ID NO: 1008076 - RNA, 19 nt, Mycobacterium avium subsp. paratuberculosis
gcaggugcaucgccaccgu

SEQ ID NO: 1008077 - RNA, 16 nt, Mycobacterium avium subsp. paratuberculosis
gcaggugcgcggucag

SEQ ID NO: 1008078 - RNA, 21 nt, Mycobacterium avium subsp. paratuberculosis
gcaggugcggcaccuccagcc

SEQ ID NO: 1008079 - RNA, 16 nt, Mycobacterium avium subsp. paratuberculosis
gcaggugcaccaccca

SEQ ID NO: 1008080 - RNA, 15 nt, Mycobacterium avium subsp. paratuberculosis
gcaggugcagcuccu

SEQ ID NO: 1008081 - RNA, 20 nt, Mycobacterium avium subsp. paratuberculosis
gcaggucgucgucgccgcgc

SEQ ID NO: 1008082 - RNA, 23 nt, Mycobacterium avium subsp. paratuberculosis
gcaggucggugcgcgggguggcg

SEQ ID NO: 1008083 - RNA, 19 nt, Mycobacterium avium subsp. paratuberculosis
gcaggucguccgacaggau

SEQ ID NO: 1008084 - RNA, 17 nt, Mycobacterium avium subsp. paratuberculosis
gcaggucggccagcgcc

SEQ ID NO: 1008085 - RNA, 13 nt, Mycobacterium avium subsp. paratuberculosis
gcagguccucgga

SEQ ID NO: 1008086 - RNA, 21 nt, Mycobacterium avium subsp. paratuberculosis
gcaggucgaaggcggccgcga

SEQ ID NO: 1008087 - RNA, 18 nt, Mycobacterium avium subsp. paratuberculosis
gcagguccauggccuuga

SEQ ID NO: 1008088 - RNA, 15 nt, Mycobacterium avium subsp. paratuberculosis
gcagguccgccggug

SEQ ID NO: 1008089 - RNA, 23 nt, Mycobacterium avium subsp. paratuberculosis
gcaggucgaggccggccagcggg

SEQ ID NO: 1008090 - RNA, 15 nt, Mycobacterium avium subsp. paratuberculosis
gcaggcuucgcagca

SEQ ID NO: 1008091 - RNA, 20 nt, Mycobacterium avium subsp. paratuberculosis
gcagggucgagaucagcacc

SEQ ID NO: 1008092 - RNA, 14 nt, Mycobacterium avium subsp. paratuberculosis
gcagggugccgccg

SEQ ID NO: 1008093 - RNA, 14 nt, Mycobacterium avium subsp. paratuberculosis
gcaggguggccagc

SEQ ID NO: 1008094 - RNA, 18 nt, Mycobacterium avium subsp. paratuberculosis
gcagguaaaccagcagcg

SEQ ID NO: 1008095 - RNA, 16 nt, Mycobacterium avium subsp. paratuberculosis
gcagguagaagccgcg

SEQ ID NO: 1008096 - RNA, 23 nt, Mycobacterium avium subsp. paratuberculosis
gcagguagccgccguagccggcg

SEQ ID NO: 1008097 - RNA, 19 nt, Mycobacterium avium subsp. paratuberculosis
gcagguagaucgccagcgc

SEQ ID NO: 1008098 - RNA, 20 nt, Mycobacterium avium subsp. paratuberculosis
gcagguagaucgccagcgcc

SEQ ID NO: 1008099 - RNA, 17 nt, Mycobacterium avium subsp. paratuberculosis
gcagguaggcgccgcuc

SEQ ID NO: 1008100 - RNA, 16 nt, Mycobacterium avium subsp. paratuberculosis
gcaggucacccuccuc

SEQ ID NO: 1008101 - RNA, 15 nt, Mycobacterium avium subsp. paratuberculosis
gcaggcacuccuggu

SEQ ID NO: 1008102 - RNA, 20 nt, Mycobacterium avium subsp. paratuberculosis
gcaggcacugaucccuccgu

SEQ ID NO: 1008103 - RNA, 12 nt, Mycobacterium avium subsp. paratuberculosis
gcaggcagcagc

SEQ ID NO: 1008104 - RNA, 15 nt, Mycobacterium avium subsp. paratuberculosis
gcaggcagcagcacc

SEQ ID NO: 1008105 - RNA, 16 nt, Mycobacterium avium subsp. paratuberculosis
gcaggcagcagcaccc

SEQ ID NO: 1008106 - RNA, 15 nt, Mycobacterium avium subsp. paratuberculosis
gcaggcaggccggca

SEQ ID NO: 1008107 - RNA, 18 nt, Mycobacterium avium subsp. paratuberculosis
gcaggauggucagcgagu

SEQ ID NO: 1008108 - RNA, 21 nt, Mycobacterium avium subsp. paratuberculosis
gcagcucgucggcgcgccacc

SEQ ID NO: 1008109 - RNA, 23 nt, Mycobacterium avium subsp. paratuberculosis
gcagcugauagcccgccgcggcg

SEQ ID NO: 1008110 - RNA, 22 nt, Mycobacterium avium subsp. paratuberculosis
gcaggaucuuugcauacagcag

SEQ ID NO: 1008111 - RNA, 17 nt, Mycobacterium avium subsp. paratuberculosis
gcaggaugcccagcacc

SEQ ID NO: 1008112 - RNA, 14 nt, Mycobacterium avium subsp. paratuberculosis
gcaggaucuggugc

SEQ ID NO: 1008113 - RNA, 20 nt, Mycobacterium avium subsp. paratuberculosis
gcaggaucuggugcgcgcgc

SEQ ID NO: 1008114 - RNA, 19 nt, Mycobacterium avium subsp. paratuberculosis
gcagcuccucggcggccuc

SEQ ID NO: 1008115 - RNA, 14 nt, Mycobacterium avium subsp. paratuberculosis
gcagcuccuugagc

SEQ ID NO: 1008116 - RNA, 23 nt, Mycobacterium avium subsp. paratuberculosis
gcagcuccuugagccgccgcggc

SEQ ID NO: 1008117 - RNA, 22 nt, Mycobacterium avium subsp. paratuberculosis
gcagcucgacaucggccgccuu

SEQ ID NO: 1008118 - RNA, 18 nt, Mycobacterium avium subsp. paratuberculosis
gcagcucgaucacccagg

SEQ ID NO: 1008119 - RNA, 15 nt, Mycobacterium avium subsp. paratuberculosis
gcagcucgcccagca

SEQ ID NO: 1008120 - RNA, 15 nt, Mycobacterium avium subsp. paratuberculosis
gcagcucgggcagcc

SEQ ID NO: 1008121 - RNA, 16 nt, Mycobacterium avium subsp. paratuberculosis
gcagcucgggcagccc

SEQ ID NO: 1008122 - RNA, 14 nt, Mycobacterium avium subsp. paratuberculosis
gcagcucggcggcc

SEQ ID NO: 1008123 - RNA, 20 nt, Mycobacterium avium subsp. paratuberculosis
gcagcucggucaccagcggc

SEQ ID NO: 1008124 - RNA, 16 nt, Mycobacterium avium subsp. paratuberculosis
gcaggcgguagcggca

SEQ ID NO: 1008125 - RNA, 13 nt, Mycobacterium avium subsp. paratuberculosis
gcaggcggcgcgc

SEQ ID NO: 1008126 - RNA, 20 nt, Mycobacterium avium subsp. paratuberculosis
gcaggcggcgcgcagccggc

SEQ ID NO: 1008127 - RNA, 16 nt, Mycobacterium avium subsp. paratuberculosis
gcaggcccgggcggcg

SEQ ID NO: 1008128 - RNA, 20 nt, Mycobacterium avium subsp. paratuberculosis
gcaggcccggguagcgcagc

SEQ ID NO: 1008129 - RNA, 16 nt, Mycobacterium avium subsp. paratuberculosis
gcaggcgcugagcggg

SEQ ID NO: 1008130 - RNA, 16 nt, Mycobacterium avium subsp. paratuberculosis
gcaggcggccagcacc

SEQ ID NO: 1008131 - RNA, 19 nt, Mycobacterium avium subsp. paratuberculosis
gcaggcggccagcaccagu

SEQ ID NO: 1008132 - RNA, 22 nt, Mycobacterium avium subsp. paratuberculosis
gcaggccccguucgguggccac

SEQ ID NO: 1008133 - RNA, 16 nt, Mycobacterium avium subsp. paratuberculosis
gcaggccccggcgcgc

SEQ ID NO: 1008134 - RNA, 14 nt, Mycobacterium avium subsp. paratuberculosis
gcaggcccucggcc

SEQ ID NO: 1008135 - RNA, 13 nt, Mycobacterium avium subsp. paratuberculosis
gcaggcccagcug

SEQ ID NO: 1008136 - RNA, 20 nt, Mycobacterium avium subsp. paratuberculosis
gcaggccaggugcagcugca

SEQ ID NO: 1008137 - RNA, 19 nt, Mycobacterium avium subsp. paratuberculosis
gcaggccaucagcccggcg

SEQ ID NO: 1008138 - RNA, 23 nt, Mycobacterium avium subsp. paratuberculosis
gcaggccaucagcccggcguccu

SEQ ID NO: 1008139 - RNA, 18 nt, Mycobacterium avium subsp. paratuberculosis
gcaggccacgcccacgcc

SEQ ID NO: 1008140 - RNA, 21 nt, Mycobacterium avium subsp. paratuberculosis
gcaggcauuuccagguccggg

SEQ ID NO: 1008141 - RNA, 21 nt, Mycobacterium avium subsp. paratuberculosis
gcagccuucuucgccggggcc

SEQ ID NO: 1008142 - RNA, 18 nt, Mycobacterium avium subsp. paratuberculosis
gcagccuucuuggcgggc

SEQ ID NO: 1008143 - RNA, 16 nt, Mycobacterium avium subsp. paratuberculosis
gcagccuuuccacauc

SEQ ID NO: 1008144 - RNA, 19 nt, Mycobacterium avium subsp. paratuberculosis
gcagccgucgaugccggcg

SEQ ID NO: 1008145 - RNA, 21 nt, Mycobacterium avium subsp. paratuberculosis
gcagccgucgcaucagcucgg

SEQ ID NO: 1008146 - RNA, 21 nt, Mycobacterium avium subsp. paratuberculosis
gcagccgguccggcggcacca

SEQ ID NO: 1008147 - RNA, 17 nt, Mycobacterium avium subsp. paratuberculosis
gcagccgggccagcaac

SEQ ID NO: 1008148 - RNA, 14 nt, Mycobacterium avium subsp. paratuberculosis
gcagccgggcggcg

SEQ ID NO: 1008149 - RNA, 14 nt, Mycobacterium avium subsp. paratuberculosis
gcagccgggggcgg

SEQ ID NO: 1008150 - RNA, 19 nt, Mycobacterium avium subsp. paratuberculosis
gcagccgggggcggugcag

SEQ ID NO: 1008151 - RNA, 13 nt, Mycobacterium avium subsp. paratuberculosis
gcagccggggguc

SEQ ID NO: 1008152 - RNA, 19 nt, Mycobacterium avium subsp. paratuberculosis
gcagccggggugcccgggc

SEQ ID NO: 1008153 - RNA, 21 nt, Mycobacterium avium subsp. paratuberculosis
gcagccggggugcccgggccg

SEQ ID NO: 1008154 - RNA, 17 nt, Mycobacterium avium subsp. paratuberculosis
gcagccgggugcgggcc

SEQ ID NO: 1008155 - RNA, 19 nt, Mycobacterium avium subsp. paratuberculosis
gcagccggguggcccgccc

SEQ ID NO: 1008156 - RNA, 14 nt, Mycobacterium avium subsp. paratuberculosis
gcagccgggugggc

SEQ ID NO: 1008157 - RNA, 18 nt, Mycobacterium avium subsp. paratuberculosis
gcagccgggugggcggca

SEQ ID NO: 1008158 - RNA, 19 nt, Mycobacterium avium subsp. paratuberculosis
gcagccgggugggcggcac

SEQ ID NO: 1008159 - RNA, 15 nt, Mycobacterium avium subsp. paratuberculosis
gcagcgaucggcggc

SEQ ID NO: 1008160 - RNA, 17 nt, Mycobacterium avium subsp. paratuberculosis
gcagcgcauccgacacc

SEQ ID NO: 1008161 - RNA, 22 nt, Mycobacterium avium subsp. paratuberculosis
gcagcgcacgucgccgccgcaa

SEQ ID NO: 1008162 - RNA, 23 nt, Mycobacterium avium subsp. paratuberculosis
gcagcgcagcaccauccgcgcga

SEQ ID NO: 1008163 - RNA, 17 nt, Mycobacterium avium subsp. paratuberculosis
gcagcgaggcguccagc

SEQ ID NO: 1008164 - RNA, 21 nt, Mycobacterium avium subsp. paratuberculosis
gcagcgacaaucggcucgccu

SEQ ID NO: 1008165 - RNA, 21 nt, Mycobacterium avium subsp. paratuberculosis
gcagcgaaacucguugccagc

SEQ ID NO: 1008166 - RNA, 15 nt, Mycobacterium avium subsp. paratuberculosis
gcagcgaacgucagg

SEQ ID NO: 1008167 - RNA, 18 nt, Mycobacterium avium subsp. paratuberculosis
gcagcgaacgucaggauc

SEQ ID NO: 1008168 - RNA, 16 nt, Mycobacterium avium subsp. paratuberculosis
gcagcgacuggcccuc

SEQ ID NO: 1008169 - RNA, 20 nt, Mycobacterium avium subsp. paratuberculosis
gcagcgagaaccggcgcaga

SEQ ID NO: 1008170 - RNA, 13 nt, Mycobacterium avium subsp. paratuberculosis
gcagcgagaccuc

SEQ ID NO: 1008171 - RNA, 21 nt, Mycobacterium avium subsp. paratuberculosis
gcagcgacucguuggccggcu

SEQ ID NO: 1008172 - RNA, 23 nt, Mycobacterium avium subsp. paratuberculosis
gcagcgacugcacccgggucagg

SEQ ID NO: 1008173 - RNA, 17 nt, Mycobacterium avium subsp. paratuberculosis
gcagcgaccgcggauga

SEQ ID NO: 1008174 - RNA, 12 nt, Mycobacterium avium subsp. paratuberculosis
gcagccgcaagg

SEQ ID NO: 1008175 - RNA, 13 nt, Mycobacterium avium subsp. paratuberculosis
gcagccgcaacac

SEQ ID NO: 1008176 - RNA, 14 nt, Mycobacterium avium subsp. paratuberculosis
gcagccgcacaccg

SEQ ID NO: 1008177 - RNA, 21 nt, Mycobacterium avium subsp. paratuberculosis
gcagccgcacaccgcggcggc

SEQ ID NO: 1008178 - RNA, 16 nt, Mycobacterium avium subsp. paratuberculosis
gcagccgcgcggccgg

SEQ ID NO: 1008179 - RNA, 18 nt, Mycobacterium avium subsp. paratuberculosis
gcagccgcgcccacccgc

SEQ ID NO: 1008180 - RNA, 16 nt, Mycobacterium avium subsp. paratuberculosis
gcagccgcgccgacgc

SEQ ID NO: 1008181 - RNA, 13 nt, Mycobacterium avium subsp. paratuberculosis
gcagccgcgcggc

SEQ ID NO: 1008182 - RNA, 13 nt, Mycobacterium avium subsp. paratuberculosis
gcagccgccgcgg

SEQ ID NO: 1008183 - RNA, 22 nt, Mycobacterium avium subsp. paratuberculosis
gcagccgccgcggagcggcggu

SEQ ID NO: 1008184 - RNA, 14 nt, Mycobacterium avium subsp. paratuberculosis
gcagccgccgggcc

SEQ ID NO: 1008185 - RNA, 14 nt, Mycobacterium avium subsp. paratuberculosis
gcagccgccgggcu

SEQ ID NO: 1008186 - RNA, 13 nt, Mycobacterium avium subsp. paratuberculosis
gcagccgcgacac

SEQ ID NO: 1008187 - RNA, 17 nt, Mycobacterium avium subsp. paratuberculosis
gcagccggcggcgccuu

SEQ ID NO: 1008188 - RNA, 20 nt, Mycobacterium avium subsp. paratuberculosis
gcagccggcggcgccuugcc

SEQ ID NO: 1008189 - RNA, 23 nt, Mycobacterium avium subsp. paratuberculosis
gcagccggaaggccaaggccagc

SEQ ID NO: 1008190 - RNA, 15 nt, Mycobacterium avium subsp. paratuberculosis
gcagccggcgcggca

SEQ ID NO: 1008191 - RNA, 18 nt, Mycobacterium avium subsp. paratuberculosis
gcagccgcugcugggugc

SEQ ID NO: 1008192 - RNA, 22 nt, Mycobacterium avium subsp. paratuberculosis
gcagccgcugcugggugccgcg

SEQ ID NO: 1008193 - RNA, 14 nt, Mycobacterium avium subsp. paratuberculosis
gcagccggccggca

SEQ ID NO: 1008194 - RNA, 14 nt, Mycobacterium avium subsp. paratuberculosis
gcagccggccggcg

SEQ ID NO: 1008195 - RNA, 14 nt, Mycobacterium avium subsp. paratuberculosis
gcagccggccgucc

SEQ ID NO: 1008196 - RNA, 19 nt, Mycobacterium avium subsp. paratuberculosis
gcagccggccguccacggc

SEQ ID NO: 1008197 - RNA, 16 nt, Mycobacterium avium subsp. paratuberculosis
gcagccgcgcgugcag

SEQ ID NO: 1008198 - RNA, 19 nt, Mycobacterium avium subsp. paratuberculosis
gcagccgcgcgugcagccg

SEQ ID NO: 1008199 - RNA, 15 nt, Mycobacterium avium subsp. paratuberculosis
gcagccgcgguggcg

SEQ ID NO: 1008200 - RNA, 14 nt, Mycobacterium avium subsp. paratuberculosis
gcagccgcucacac

SEQ ID NO: 1008201 - RNA, 22 nt, Mycobacterium avium subsp. paratuberculosis
gcagccgcucacacagccgcuu

SEQ ID NO: 1008202 - RNA, 14 nt, Mycobacterium avium subsp. paratuberculosis
gcagcccagccagc

SEQ ID NO: 1008203 - RNA, 20 nt, Mycobacterium avium subsp. paratuberculosis
gcagcccccggaccacgucc

SEQ ID NO: 1008204 - RNA, 14 nt, Mycobacterium avium subsp. paratuberculosis
gcagcccggccagc

SEQ ID NO: 1008205 - RNA, 20 nt, Mycobacterium avium subsp. paratuberculosis
gcagcccggccagccgggcg

SEQ ID NO: 1008206 - RNA, 23 nt, Mycobacterium avium subsp. paratuberculosis
gcagcccggccagccgggcggcc

SEQ ID NO: 1008207 - RNA, 11 nt, Mycobacterium avium subsp. paratuberculosis
gcagcccggcg

SEQ ID NO: 1008208 - RNA, 12 nt, Mycobacterium avium subsp. paratuberculosis
gcagcccggcgg

SEQ ID NO: 1008209 - RNA, 23 nt, Mycobacterium avium subsp. paratuberculosis
gcagcccgaacagccgggcggcc

SEQ ID NO: 1008210 - RNA, 17 nt, Mycobacterium avium subsp. paratuberculosis
gcagcccgaccaccucc

SEQ ID NO: 1008211 - RNA, 16 nt, Mycobacterium avium subsp. paratuberculosis
gcagcccgaucgccag

SEQ ID NO: 1008212 - RNA, 19 nt, Mycobacterium avium subsp. paratuberculosis
gcagcccgaucgccagcgc

SEQ ID NO: 1008213 - RNA, 15 nt, Mycobacterium avium subsp. paratuberculosis
gcagcccgccgaugg

SEQ ID NO: 1008214 - RNA, 19 nt, Mycobacterium avium subsp. paratuberculosis
gcagccgaucuggcgggcg

SEQ ID NO: 1008215 - RNA, 20 nt, Mycobacterium avium subsp. paratuberculosis
gcagccgaucuggcgggcgg

SEQ ID NO: 1008216 - RNA, 18 nt, Mycobacterium avium subsp. paratuberculosis
gcagcccgcugaccaggc

SEQ ID NO: 1008217 - RNA, 19 nt, Mycobacterium avium subsp. paratuberculosis
gcagcccgcugaccaggcc

SEQ ID NO: 1008218 - RNA, 11 nt, Mycobacterium avium subsp. paratuberculosis
gcagcccggcu

SEQ ID NO: 1008219 - RNA, 17 nt, Mycobacterium avium subsp. paratuberculosis
gcagcccggguccuggc

SEQ ID NO: 1008220 - RNA, 23 nt, Mycobacterium avium subsp. paratuberculosis
gcagcccgggucuagaucuccag

SEQ ID NO: 1008221 - RNA, 22 nt, Mycobacterium avium subsp. paratuberculosis
gcagcgcuaaccgcgggcaucg

SEQ ID NO: 1008222 - RNA, 19 nt, Mycobacterium avium subsp. paratuberculosis
gcagcgcgucgcgggcccg

SEQ ID NO: 1008223 - RNA, 23 nt, Mycobacterium avium subsp. paratuberculosis
gcagcgcgucgggcucggccgcc

SEQ ID NO: 1008224 - RNA, 17 nt, Mycobacterium avium subsp. paratuberculosis
gcagcgcggcuuggcca

SEQ ID NO: 1008225 - RNA, 20 nt, Mycobacterium avium subsp. paratuberculosis
gcagcgcgacgaacagcacc

SEQ ID NO: 1008226 - RNA, 18 nt, Mycobacterium avium subsp. paratuberculosis
gcagcgccucgccgggcc

SEQ ID NO: 1008227 - RNA, 12 nt, Mycobacterium avium subsp. paratuberculosis
gcagcgccucgg

SEQ ID NO: 1008228 - RNA, 23 nt, Mycobacterium avium subsp. paratuberculosis
gcagcgccgucucgacccgggcc

SEQ ID NO: 1008229 - RNA, 18 nt, Mycobacterium avium subsp. paratuberculosis
gcagcgccugcugccagg

SEQ ID NO: 1008230 - RNA, 19 nt, Mycobacterium avium subsp. paratuberculosis
gcagcgccugcugccagga

SEQ ID NO: 1008231 - RNA, 12 nt, Mycobacterium avium subsp. paratuberculosis
gcagcgccuugg

SEQ ID NO: 1008232 - RNA, 16 nt, Mycobacterium avium subsp. paratuberculosis
gcagcgcgaccagccc

SEQ ID NO: 1008233 - RNA, 14 nt, Mycobacterium avium subsp. paratuberculosis
gcagcgcauggaga

SEQ ID NO: 1008234 - RNA, 19 nt, Mycobacterium avium subsp. paratuberculosis
gcagcgccagcaccgccug

SEQ ID NO: 1008235 - RNA, 19 nt, Mycobacterium avium subsp. paratuberculosis
gcagcgccagcaccgggcc

SEQ ID NO: 1008236 - RNA, 18 nt, Mycobacterium avium subsp. paratuberculosis
gcagcgccagcagcggca

SEQ ID NO: 1008237 - RNA, 15 nt, Mycobacterium avium subsp. paratuberculosis
gcagcgccacaaugg

SEQ ID NO: 1008238 - RNA, 17 nt, Mycobacterium avium subsp. paratuberculosis
gcagcgcaucgccggcg

SEQ ID NO: 1008239 - RNA, 18 nt, Mycobacterium avium subsp. paratuberculosis
gcagcgcccagccgagcc

SEQ ID NO: 1008240 - RNA, 22 nt, Mycobacterium avium subsp. paratuberculosis
gcagcgcccagccgagccgggc

SEQ ID NO: 1008241 - RNA, 15 nt, Mycobacterium avium subsp. paratuberculosis
gcagcgccagcggga

SEQ ID NO: 1008242 - RNA, 15 nt, Mycobacterium avium subsp. paratuberculosis
gcagcgccaggcaga

SEQ ID NO: 1008243 - RNA, 23 nt, Mycobacterium avium subsp. paratuberculosis
gcagcgccgcuucgucgccggcc

SEQ ID NO: 1008244 - RNA, 18 nt, Mycobacterium avium subsp. paratuberculosis
gcagcgccgcgccgaccu

SEQ ID NO: 1008245 - RNA, 14 nt, Mycobacterium avium subsp. paratuberculosis
gcagcgccgcccgc

SEQ ID NO: 1008246 - RNA, 15 nt, Mycobacterium avium subsp. paratuberculosis
gcagcgccgaggcca

SEQ ID NO: 1008247 - RNA, 12 nt, Mycobacterium avium subsp. paratuberculosis
gcagcgccgcga

SEQ ID NO: 1008248 - RNA, 13 nt, Mycobacterium avium subsp. paratuberculosis
gcagcgcccgggc

SEQ ID NO: 1008249 - RNA, 22 nt, Mycobacterium avium subsp. paratuberculosis
gcagcggcuugagcgccagcgc

SEQ ID NO: 1008250 - RNA, 15 nt, Mycobacterium avium subsp. paratuberculosis
gcagcggcgguugcu

SEQ ID NO: 1008251 - RNA, 21 nt, Mycobacterium avium subsp. paratuberculosis
gcagcggcgucacgcccucuu

SEQ ID NO: 1008252 - RNA, 16 nt, Mycobacterium avium subsp. paratuberculosis
gcagcggcgccgcagc

SEQ ID NO: 1008253 - RNA, 13 nt, Mycobacterium avium subsp. paratuberculosis
gcagcggcccgaa

SEQ ID NO: 1008254 - RNA, 23 nt, Mycobacterium avium subsp. paratuberculosis
gcagcggaaugaacgcggccagg

SEQ ID NO: 1008255 - RNA, 23 nt, Mycobacterium avium subsp. paratuberculosis
gcagcggacccggucggccgcgu

SEQ ID NO: 1008256 - RNA, 21 nt, Mycobacterium avium subsp. paratuberculosis
gcagcggcacccgguccggcc

SEQ ID NO: 1008257 - RNA, 18 nt, Mycobacterium avium subsp. paratuberculosis
gcagcggcagccacggca

SEQ ID NO: 1008258 - RNA, 16 nt, Mycobacterium avium subsp. paratuberculosis
gcagcggcaugccccc

SEQ ID NO: 1008259 - RNA, 20 nt, Mycobacterium avium subsp. paratuberculosis
gcagcggggaggcccagccc

SEQ ID NO: 1008260 - RNA, 14 nt, Mycobacterium avium subsp. paratuberculosis
gcagcggggcgagc

SEQ ID NO: 1008261 - RNA, 18 nt, Mycobacterium avium subsp. paratuberculosis
gcagcgucgccagccgcc

SEQ ID NO: 1008262 - RNA, 18 nt, Mycobacterium avium subsp. paratuberculosis
gcagcgucucccgggugc

SEQ ID NO: 1008263 - RNA, 17 nt, Mycobacterium avium subsp. paratuberculosis
gcagcgucugcgccagc

SEQ ID NO: 1008264 - RNA, 22 nt, Mycobacterium avium subsp. paratuberculosis
gcagcgucugcgccagcugggu

SEQ ID NO: 1008265 - RNA, 16 nt, Mycobacterium avium subsp. paratuberculosis
gcagcgucugcgcccc

SEQ ID NO: 1008266 - RNA, 19 nt, Mycobacterium avium subsp. paratuberculosis
gcagcgucugcgccccggc

SEQ ID NO: 1008267 - RNA, 17 nt, Mycobacterium avium subsp. paratuberculosis
gcagcguucggucagca

SEQ ID NO: 1008268 - RNA, 22 nt, Mycobacterium avium subsp. paratuberculosis
gcagcgugguccagcacgugcc

SEQ ID NO: 1008269 - RNA, 18 nt, Mycobacterium avium subsp. paratuberculosis
gcagcgugucggggucgg

SEQ ID NO: 1008270 - RNA, 23 nt, Mycobacterium avium subsp. paratuberculosis
gcagcgucuugcccagcggggcg

SEQ ID NO: 1008271 - RNA, 15 nt, Mycobacterium avium subsp. paratuberculosis
gcagcaacggcggcg

SEQ ID NO: 1008272 - RNA, 15 nt, Mycobacterium avium subsp. paratuberculosis
gcagcaaccggcggc

SEQ ID NO: 1008273 - RNA, 20 nt, Mycobacterium avium subsp. paratuberculosis
gcagcaccaggcccuccugg

SEQ ID NO: 1008274 - RNA, 23 nt, Mycobacterium avium subsp. paratuberculosis
gcagcaccaggcccucgccgcgg

SEQ ID NO: 1008275 - RNA, 20 nt, Mycobacterium avium subsp. paratuberculosis
gcagcaccagcgccgcgaug

SEQ ID NO: 1008276 - RNA, 23 nt, Mycobacterium avium subsp. paratuberculosis
gcagcaccacgaacgcugccagg

SEQ ID NO: 1008277 - RNA, 14 nt, Mycobacterium avium subsp. paratuberculosis
gcagcaccagcggc

SEQ ID NO: 1008278 - RNA, 20 nt, Mycobacterium avium subsp. paratuberculosis
gcagcaccagcguggccggc

SEQ ID NO: 1008279 - RNA, 12 nt, Mycobacterium avium subsp. paratuberculosis
gcagcaccaccc

SEQ ID NO: 1008280 - RNA, 14 nt, Mycobacterium avium subsp. paratuberculosis
gcagcacauccagc

SEQ ID NO: 1008281 - RNA, 19 nt, Mycobacterium avium subsp. paratuberculosis
gcagcacauccagcccugc

SEQ ID NO: 1008282 - RNA, 22 nt, Mycobacterium avium subsp. paratuberculosis
gcagcacauccagcccugcuug

SEQ ID NO: 1008283 - RNA, 20 nt, Mycobacterium avium subsp. paratuberculosis
gcagcacgcugaagcccacc

SEQ ID NO: 1008284 - RNA, 23 nt, Mycobacterium avium subsp. paratuberculosis
gcagcacgccgcggaaggccagc

SEQ ID NO: 1008285 - RNA, 16 nt, Mycobacterium avium subsp. paratuberculosis
gcagcacgcccagccc

SEQ ID NO: 1008286 - RNA, 17 nt, Mycobacterium avium subsp. paratuberculosis
gcagcacgcccagcccg

SEQ ID NO: 1008287 - RNA, 16 nt, Mycobacterium avium subsp. paratuberculosis
gcagcacgcccucggc

SEQ ID NO: 1008288 - RNA, 20 nt, Mycobacterium avium subsp. paratuberculosis
gcagcacgcccucggcuucc

SEQ ID NO: 1008289 - RNA, 18 nt, Mycobacterium avium subsp. paratuberculosis
gcagcaccucgcgcgcga

SEQ ID NO: 1008290 - RNA, 16 nt, Mycobacterium avium subsp. paratuberculosis
gcagcacccgacuucg

SEQ ID NO: 1008291 - RNA, 22 nt, Mycobacterium avium subsp. paratuberculosis
gcagcaccgccgacaucgcccg

SEQ ID NO: 1008292 - RNA, 23 nt, Mycobacterium avium subsp. paratuberculosis
gcagcaccgaaccggcggggucg

SEQ ID NO: 1008293 - RNA, 18 nt, Mycobacterium avium subsp. paratuberculosis
gcagcaccgacuccuccg

SEQ ID NO: 1008294 - RNA, 15 nt, Mycobacterium avium subsp. paratuberculosis
gcagcaccggcaccg

SEQ ID NO: 1008295 - RNA, 18 nt, Mycobacterium avium subsp. paratuberculosis
gcagcaccggcaccgcgg

SEQ ID NO: 1008296 - RNA, 19 nt, Mycobacterium avium subsp. paratuberculosis
gcagcaccggcaccgcggc

SEQ ID NO: 1008297 - RNA, 14 nt, Mycobacterium avium subsp. paratuberculosis
gcagcaccggcaug

SEQ ID NO: 1008298 - RNA, 12 nt, Mycobacterium avium subsp. paratuberculosis
gcagcagcacca

SEQ ID NO: 1008299 - RNA, 22 nt, Mycobacterium avium subsp. paratuberculosis
gcagcagcaccagcguggccgg

SEQ ID NO: 1008300 - RNA, 14 nt, Mycobacterium avium subsp. paratuberculosis
gcagcagcaccagg

SEQ ID NO: 1008301 - RNA, 16 nt, Mycobacterium avium subsp. paratuberculosis
gcagcagcaccaggcu

SEQ ID NO: 1008302 - RNA, 12 nt, Mycobacterium avium subsp. paratuberculosis
gcagcagcagau

SEQ ID NO: 1008303 - RNA, 16 nt, Mycobacterium avium subsp. paratuberculosis
gcagcagcagccacgc

SEQ ID NO: 1008304 - RNA, 19 nt, Mycobacterium avium subsp. paratuberculosis
gcagcagauccucagcagc

SEQ ID NO: 1008305 - RNA, 12 nt, Mycobacterium avium subsp. paratuberculosis
gcagcagcaggu

SEQ ID NO: 1008306 - RNA, 21 nt, Mycobacterium avium subsp. paratuberculosis
gcagcagccgcagcggcggcu

SEQ ID NO: 1008307 - RNA, 18 nt, Mycobacterium avium subsp. paratuberculosis
gcagcagccgcgccgccg

SEQ ID NO: 1008308 - RNA, 14 nt, Mycobacterium avium subsp. paratuberculosis
gcagcagaaccagc

SEQ ID NO: 1008309 - RNA, 15 nt, Mycobacterium avium subsp. paratuberculosis
gcagcagaccgccgg

SEQ ID NO: 1008310 - RNA, 22 nt, Mycobacterium avium subsp. paratuberculosis
gcagcagaccgcgaucagcccc

SEQ ID NO: 1008311 - RNA, 16 nt, Mycobacterium avium subsp. paratuberculosis
gcagcacugagcggca

SEQ ID NO: 1008312 - RNA, 22 nt, Mycobacterium avium subsp. paratuberculosis
gcagcacggccacugccccggc

SEQ ID NO: 1008313 - RNA, 19 nt, Mycobacterium avium subsp. paratuberculosis
gcagcauggcccacaggac

SEQ ID NO: 1008314 - RNA, 17 nt, Mycobacterium avium subsp. paratuberculosis
gcagccaaccgccgggg

SEQ ID NO: 1008315 - RNA, 15 nt, Mycobacterium avium subsp. paratuberculosis
gcagccaccgcccga

SEQ ID NO: 1008316 - RNA, 16 nt, Mycobacterium avium subsp. paratuberculosis
gcagccacgagcccag

SEQ ID NO: 1008317 - RNA, 18 nt, Mycobacterium avium subsp. paratuberculosis
gcagccacgagcccagcc

SEQ ID NO: 1008318 - RNA, 19 nt, Mycobacterium avium subsp. paratuberculosis
gcagccacgccagccaggc

SEQ ID NO: 1008319 - RNA, 22 nt, Mycobacterium avium subsp. paratuberculosis
gcagcccagguaaucgaaggcc

SEQ ID NO: 1008320 - RNA, 16 nt, Mycobacterium avium subsp. paratuberculosis
gcagccagguccgggc

SEQ ID NO: 1008321 - RNA, 21 nt, Mycobacterium avium subsp. paratuberculosis
gcagccagguccgggcacucg

SEQ ID NO: 1008322 - RNA, 12 nt, Mycobacterium avium subsp. paratuberculosis
gcagccagguga

SEQ ID NO: 1008323 - RNA, 15 nt, Mycobacterium avium subsp. paratuberculosis
gcagccaggugguga

SEQ ID NO: 1008324 - RNA, 22 nt, Mycobacterium avium subsp. paratuberculosis
gcagccagguggugaacucuuc

SEQ ID NO: 1008325 - RNA, 20 nt, Mycobacterium avium subsp. paratuberculosis
gcagccagucgccggccagg

SEQ ID NO: 1008326 - RNA, 14 nt, Mycobacterium avium subsp. paratuberculosis
gcagccagcucggc

SEQ ID NO: 1008327 - RNA, 15 nt, Mycobacterium avium subsp. paratuberculosis
gcagccagccuggcg

SEQ ID NO: 1008328 - RNA, 14 nt, Mycobacterium avium subsp. paratuberculosis
gcagccagcgcagc

SEQ ID NO: 1008329 - RNA, 18 nt, Mycobacterium avium subsp. paratuberculosis
gcagccagcgcagcacug

SEQ ID NO: 1008330 - RNA, 13 nt, Mycobacterium avium subsp. paratuberculosis
gcagcagcuuggc

SEQ ID NO: 1008331 - RNA, 14 nt, Mycobacterium avium subsp. paratuberculosis
gcagcaggcggacg

SEQ ID NO: 1008332 - RNA, 21 nt, Mycobacterium avium subsp. paratuberculosis
gcagcaggcggacggcgaccu

SEQ ID NO: 1008333 - RNA, 23 nt, Mycobacterium avium subsp. paratuberculosis
gcagcagcgcccaccgcucgucg

SEQ ID NO: 1008334 - RNA, 15 nt, Mycobacterium avium subsp. paratuberculosis
gcagcagcgccagca

SEQ ID NO: 1008335 - RNA, 17 nt, Mycobacterium avium subsp. paratuberculosis
gcagcagcgccagcagc

SEQ ID NO: 1008336 - RNA, 18 nt, Mycobacterium avium subsp. paratuberculosis
gcagcagcgccagcagcg

SEQ ID NO: 1008337 - RNA, 15 nt, Mycobacterium avium subsp. paratuberculosis
gcagcagcgcgcggu

SEQ ID NO: 1008338 - RNA, 13 nt, Mycobacterium avium subsp. paratuberculosis
gcagcagcgcggc

SEQ ID NO: 1008339 - RNA, 16 nt, Mycobacterium avium subsp. paratuberculosis
gcagcagcgcggcaug

SEQ ID NO: 1008340 - RNA, 13 nt, Mycobacterium avium subsp. paratuberculosis
gcagcagcgcggu

SEQ ID NO: 1008341 - RNA, 19 nt, Mycobacterium avium subsp. paratuberculosis
gcagcaggugcaucgccac

SEQ ID NO: 1008342 - RNA, 21 nt, Mycobacterium avium subsp. paratuberculosis
gcagcagguaaaccagcagcg

SEQ ID NO: 1008343 - RNA, 18 nt, Mycobacterium avium subsp. paratuberculosis
gcagcaggucggccagcu

SEQ ID NO: 1008344 - RNA, 23 nt, Mycobacterium avium subsp. paratuberculosis
gcagcaggucggcgugcucgucg

SEQ ID NO: 1008345 - RNA, 16 nt, Mycobacterium avium subsp. paratuberculosis
gcagcaguuccggagc

SEQ ID NO: 1008346 - RNA, 21 nt, Mycobacterium avium subsp. paratuberculosis
gcagcaguuccggagcgcggu

SEQ ID NO: 1008347 - RNA, 22 nt, Mycobacterium avium subsp. paratuberculosis
gcagcaguuccggagcgcgguc

SEQ ID NO: 1008348 - RNA, 14 nt, Mycobacterium avium subsp. paratuberculosis
gcagcaucuccgag

SEQ ID NO: 1008349 - RNA, 13 nt, Mycobacterium avium subsp. paratuberculosis
gcagcauccgcac

SEQ ID NO: 1008350 - RNA, 19 nt, Mycobacterium avium subsp. paratuberculosis
gcagaagcuccacgccgcc

SEQ ID NO: 1008351 - RNA, 16 nt, Mycobacterium avium subsp. paratuberculosis
gcagaacgccaucacc

SEQ ID NO: 1008352 - RNA, 22 nt, Mycobacterium avium subsp. paratuberculosis
gcagaacaauguuuuucugcuc

SEQ ID NO: 1008353 - RNA, 18 nt, Mycobacterium avium subsp. paratuberculosis
gcagaacaccaccgccag

SEQ ID NO: 1008354 - RNA, 12 nt, Mycobacterium avium subsp. paratuberculosis
gcagaacaccag

SEQ ID NO: 1008355 - RNA, 17 nt, Mycobacterium avium subsp. paratuberculosis
gcagacguagcaccagu

SEQ ID NO: 1008356 - RNA, 18 nt, Mycobacterium avium subsp. paratuberculosis
gcagacguagcaccaguc

SEQ ID NO: 1008357 - RNA, 22 nt, Mycobacterium avium subsp. paratuberculosis
gcagacgguaugcccgccgcgu

SEQ ID NO: 1008358 - RNA, 14 nt, Mycobacterium avium subsp. paratuberculosis
gcagacccagcagc

SEQ ID NO: 1008359 - RNA, 18 nt, Mycobacterium avium subsp. paratuberculosis
gcagaccgaacccgggcg

SEQ ID NO: 1008360 - RNA, 20 nt, Mycobacterium avium subsp. paratuberculosis
gcagaccggacagcugggcg

SEQ ID NO: 1008361 - RNA, 14 nt, Mycobacterium avium subsp. paratuberculosis
gcagaccgguggcg

SEQ ID NO: 1008362 - RNA, 18 nt, Mycobacterium avium subsp. paratuberculosis
gcagacggacacccgcgc

SEQ ID NO: 1008363 - RNA, 21 nt, Mycobacterium avium subsp. paratuberculosis
gcagacggacacccgcgcggu

SEQ ID NO: 1008364 - RNA, 20 nt, Mycobacterium avium subsp. paratuberculosis
gcagaugucgguggccuugg

SEQ ID NO: 1008365 - RNA, 20 nt, Mycobacterium avium subsp. paratuberculosis
gcagaugcgcgucgcggcgc

SEQ ID NO: 1008366 - RNA, 16 nt, Mycobacterium avium subsp. paratuberculosis
gcagauccugcagcug

SEQ ID NO: 1008367 - RNA, 17 nt, Mycobacterium avium subsp. paratuberculosis
gcagaucaccacggugg

SEQ ID NO: 1008368 - RNA, 23 nt, Mycobacterium avium subsp. paratuberculosis
gcagaucaccacgguggccgcga

SEQ ID NO: 1008369 - RNA, 22 nt, Mycobacterium avium subsp. paratuberculosis
gcagagcggugacaucgccacc

SEQ ID NO: 1008370 - RNA, 21 nt, Mycobacterium avium subsp. paratuberculosis
gcagauagccguacacggcgg

SEQ ID NO: 1008371 - RNA, 16 nt, Mycobacterium avium subsp. paratuberculosis
gcacuggucgugcugg

SEQ ID NO: 1008372 - RNA, 13 nt, Mycobacterium avium subsp. paratuberculosis
gcacuuaacaccu

SEQ ID NO: 1008373 - RNA, 18 nt, Mycobacterium avium subsp. paratuberculosis
gcacuuaacaccucgccu

SEQ ID NO: 1008374 - RNA, 21 nt, Mycobacterium avium subsp. paratuberculosis
gcacugcgguucacaaaggcc

SEQ ID NO: 1008375 - RNA, 18 nt, Mycobacterium avium subsp. paratuberculosis
gcacugcaucucgaccug

SEQ ID NO: 1008376 - RNA, 15 nt, Mycobacterium avium subsp. paratuberculosis
gcacugcacggccuc

SEQ ID NO: 1008377 - RNA, 19 nt, Mycobacterium avium subsp. paratuberculosis
gcacugcacggccucgguc

SEQ ID NO: 1008378 - RNA, 22 nt, Mycobacterium avium subsp. paratuberculosis
gcacugcccgcaucgcacagau

SEQ ID NO: 1008379 - RNA, 21 nt, Mycobacterium avium subsp. paratuberculosis
gcacuucgaucaucuccaccc

SEQ ID NO: 1008380 - RNA, 17 nt, Mycobacterium avium subsp. paratuberculosis
gcacuucgcgggcggcg

SEQ ID NO: 1008381 - RNA, 21 nt, Mycobacterium avium subsp. paratuberculosis
gcacguaccgguacagcgacu

SEQ ID NO: 1008382 - RNA, 15 nt, Mycobacterium avium subsp. paratuberculosis
gcacgucacgggcca

SEQ ID NO: 1008383 - RNA, 19 nt, Mycobacterium avium subsp. paratuberculosis
gcacgucacgggccaggcg

SEQ ID NO: 1008384 - RNA, 23 nt, Mycobacterium avium subsp. paratuberculosis
gcacguccccgugcagccgggcc

SEQ ID NO: 1008385 - RNA, 23 nt, Mycobacterium avium subsp. paratuberculosis
gcacgucccgcccggcgccggcc

SEQ ID NO: 1008386 - RNA, 17 nt, Mycobacterium avium subsp. paratuberculosis
gcacgucgacgcccugc

SEQ ID NO: 1008387 - RNA, 14 nt, Mycobacterium avium subsp. paratuberculosis
gcacgucgcggccc

SEQ ID NO: 1008388 - RNA, 21 nt, Mycobacterium avium subsp. paratuberculosis
gcacgucggcagguugucgcu

SEQ ID NO: 1008389 - RNA, 21 nt, Mycobacterium avium subsp. paratuberculosis
gcacgucggccacgccgggca

SEQ ID NO: 1008390 - RNA, 15 nt, Mycobacterium avium subsp. paratuberculosis
gcacgucggccgcca

SEQ ID NO: 1008391 - RNA, 21 nt, Mycobacterium avium subsp. paratuberculosis
gcacgucggcgcgcaggcugg

SEQ ID NO: 1008392 - RNA, 14 nt, Mycobacterium avium subsp. paratuberculosis
gcacgucggcggcc

SEQ ID NO: 1008393 - RNA, 14 nt, Mycobacterium avium subsp. paratuberculosis
gcacgucgccggcg

SEQ ID NO: 1008394 - RNA, 20 nt, Mycobacterium avium subsp. paratuberculosis
gcacgucgggguggccggcc

SEQ ID NO: 1008395 - RNA, 16 nt, Mycobacterium avium subsp. paratuberculosis
gcacguggugaccgua

SEQ ID NO: 1008396 - RNA, 14 nt, Mycobacterium avium subsp. paratuberculosis
gcacgugcccagcc

SEQ ID NO: 1008397 - RNA, 18 nt, Mycobacterium avium subsp. paratuberculosis
gcacgugcccagcccgcg

SEQ ID NO: 1008398 - RNA, 14 nt, Mycobacterium avium subsp. paratuberculosis
gcacgugcccgccg

SEQ ID NO: 1008399 - RNA, 17 nt, Mycobacterium avium subsp. paratuberculosis
gcacguguucucacggc

SEQ ID NO: 1008400 - RNA, 14 nt, Mycobacterium avium subsp. paratuberculosis
gcacguggccgggc

SEQ ID NO: 1008401 - RNA, 15 nt, Mycobacterium avium subsp. paratuberculosis
gcacguggccgggcu

SEQ ID NO: 1008402 - RNA, 18 nt, Mycobacterium avium subsp. paratuberculosis
gcacguggccgggcucga

SEQ ID NO: 1008403 - RNA, 18 nt, Mycobacterium avium subsp. paratuberculosis
gcacuaccgccucgccag

SEQ ID NO: 1008404 - RNA, 15 nt, Mycobacterium avium subsp. paratuberculosis
gcacguugcccagga

SEQ ID NO: 1008405 - RNA, 18 nt, Mycobacterium avium subsp. paratuberculosis
gcacguuggcggccagcg

SEQ ID NO: 1008406 - RNA, 15 nt, Mycobacterium avium subsp. paratuberculosis
gcacguugugcucgu

SEQ ID NO: 1008407 - RNA, 17 nt, Mycobacterium avium subsp. paratuberculosis
gcacguugugcuucugg

SEQ ID NO: 1008408 - RNA, 17 nt, Mycobacterium avium subsp. paratuberculosis
gcacucgcgcaggguca

SEQ ID NO: 1008409 - RNA, 14 nt, Mycobacterium avium subsp. paratuberculosis
gcacucgcgggacg

SEQ ID NO: 1008410 - RNA, 17 nt, Mycobacterium avium subsp. paratuberculosis
gcacucgccucggaggc

SEQ ID NO: 1008411 - RNA, 21 nt, Mycobacterium avium subsp. paratuberculosis
gcacucgccucggaggccacc

SEQ ID NO: 1008412 - RNA, 17 nt, Mycobacterium avium subsp. paratuberculosis
gcacucgaucagcaccg

SEQ ID NO: 1008413 - RNA, 18 nt, Mycobacterium avium subsp. paratuberculosis
gcacucgaacggcccgga

SEQ ID NO: 1008414 - RNA, 16 nt, Mycobacterium avium subsp. paratuberculosis
gcacgguuggccggcc

SEQ ID NO: 1008415 - RNA, 19 nt, Mycobacterium avium subsp. paratuberculosis
gcacggucggccccgcgca

SEQ ID NO: 1008416 - RNA, 13 nt, Mycobacterium avium subsp. paratuberculosis
gcacggugggacg

SEQ ID NO: 1008417 - RNA, 21 nt, Mycobacterium avium subsp. paratuberculosis
gcacggugcgccggcagcggc

SEQ ID NO: 1008418 - RNA, 15 nt, Mycobacterium avium subsp. paratuberculosis
gcacggucagcggcc

SEQ ID NO: 1008419 - RNA, 20 nt, Mycobacterium avium subsp. paratuberculosis
gcacgggcggcgggggcgag

SEQ ID NO: 1008420 - RNA, 14 nt, Mycobacterium avium subsp. paratuberculosis
gcacgggcgggcag

SEQ ID NO: 1008421 - RNA, 18 nt, Mycobacterium avium subsp. paratuberculosis
gcacggugaucagcagca

SEQ ID NO: 1008422 - RNA, 22 nt, Mycobacterium avium subsp. paratuberculosis
gcacggugcacacgccgaggcg

SEQ ID NO: 1008423 - RNA, 20 nt, Mycobacterium avium subsp. paratuberculosis
gcacggugcccgucggcaac

SEQ ID NO: 1008424 - RNA, 20 nt, Mycobacterium avium subsp. paratuberculosis
gcacggugccgccguccaug

SEQ ID NO: 1008425 - RNA, 16 nt, Mycobacterium avium subsp. paratuberculosis
gcacggcacgcccguu

SEQ ID NO: 1008426 - RNA, 22 nt, Mycobacterium avium subsp. paratuberculosis
gcacggcaaugguugcggcggg

SEQ ID NO: 1008427 - RNA, 12 nt, Mycobacterium avium subsp. paratuberculosis
gcacggcccauc

SEQ ID NO: 1008428 - RNA, 21 nt, Mycobacterium avium subsp. paratuberculosis
gcacggcccaucaccagcggc

SEQ ID NO: 1008429 - RNA, 16 nt, Mycobacterium avium subsp. paratuberculosis
gcacggccagccagcc

SEQ ID NO: 1008430 - RNA, 14 nt, Mycobacterium avium subsp. paratuberculosis
gcacggccaccagc

SEQ ID NO: 1008431 - RNA, 19 nt, Mycobacterium avium subsp. paratuberculosis
gcacggcgccaccagccac

SEQ ID NO: 1008432 - RNA, 13 nt, Mycobacterium avium subsp. paratuberculosis
gcacggccgccag

SEQ ID NO: 1008433 - RNA, 14 nt, Mycobacterium avium subsp. paratuberculosis
gcacggccgcggcc

SEQ ID NO: 1008434 - RNA, 17 nt, Mycobacterium avium subsp. paratuberculosis
gcacggccgcggccagc

SEQ ID NO: 1008435 - RNA, 14 nt, Mycobacterium avium subsp. paratuberculosis
gcacggcgcuggcg

SEQ ID NO: 1008436 - RNA, 17 nt, Mycobacterium avium subsp. paratuberculosis
gcacggcgcuggcgacc

SEQ ID NO: 1008437 - RNA, 15 nt, Mycobacterium avium subsp. paratuberculosis
gcacgggcccgcggg

SEQ ID NO: 1008438 - RNA, 19 nt, Mycobacterium avium subsp. paratuberculosis
gcacgcguugcagcgccgc

SEQ ID NO: 1008439 - RNA, 18 nt, Mycobacterium avium subsp. paratuberculosis
gcacgccguggcggcggg

SEQ ID NO: 1008440 - RNA, 19 nt, Mycobacterium avium subsp. paratuberculosis
gcacgccguggcggcgggc

SEQ ID NO: 1008441 - RNA, 20 nt, Mycobacterium avium subsp. paratuberculosis
gcacgccguggcggcgggcc

SEQ ID NO: 1008442 - RNA, 22 nt, Mycobacterium avium subsp. paratuberculosis
gcacgccguggcggcgggccag

SEQ ID NO: 1008443 - RNA, 23 nt, Mycobacterium avium subsp. paratuberculosis
gcacgccguccuuggccgccagc

SEQ ID NO: 1008444 - RNA, 12 nt, Mycobacterium avium subsp. paratuberculosis
gcacgccggggc

SEQ ID NO: 1008445 - RNA, 13 nt, Mycobacterium avium subsp. paratuberculosis
gcacgccggggcc

SEQ ID NO: 1008446 - RNA, 18 nt, Mycobacterium avium subsp. paratuberculosis
gcacgccggucagcacca

SEQ ID NO: 1008447 - RNA, 13 nt, Mycobacterium avium subsp. paratuberculosis
gcacgcggccgcg

SEQ ID NO: 1008448 - RNA, 16 nt, Mycobacterium avium subsp. paratuberculosis
gcacgcugucgggguc

SEQ ID NO: 1008449 - RNA, 21 nt, Mycobacterium avium subsp. paratuberculosis
gcacgcuguuggaaccggcca

SEQ ID NO: 1008450 - RNA, 16 nt, Mycobacterium avium subsp. paratuberculosis
gcacgcugcgccagcc

SEQ ID NO: 1008451 - RNA, 19 nt, Mycobacterium avium subsp. paratuberculosis
gcaccuucaccgaccagcu

SEQ ID NO: 1008452 - RNA, 18 nt, Mycobacterium avium subsp. paratuberculosis
gcaccuggucggucagcu

SEQ ID NO: 1008453 - RNA, 21 nt, Mycobacterium avium subsp. paratuberculosis
gcaccuggucggucagcucga

SEQ ID NO: 1008454 - RNA, 17 nt, Mycobacterium avium subsp. paratuberculosis
gcacgacggucagcacg

SEQ ID NO: 1008455 - RNA, 21 nt, Mycobacterium avium subsp. paratuberculosis
gcacgaccacacccgcacgcu

SEQ ID NO: 1008456 - RNA, 16 nt, Mycobacterium avium subsp. paratuberculosis
gcacgaccccgcccac

SEQ ID NO: 1008457 - RNA, 14 nt, Mycobacterium avium subsp. paratuberculosis
gcacgaccgccagc

SEQ ID NO: 1008458 - RNA, 15 nt, Mycobacterium avium subsp. paratuberculosis
gcacgaccgccagca

SEQ ID NO: 1008459 - RNA, 16 nt, Mycobacterium avium subsp. paratuberculosis
gcacgaaggccgccgg

SEQ ID NO: 1008460 - RNA, 13 nt, Mycobacterium avium subsp. paratuberculosis
gcacgaagucgac

SEQ ID NO: 1008461 - RNA, 15 nt, Mycobacterium avium subsp. paratuberculosis
gcacgaacagcagcg

SEQ ID NO: 1008462 - RNA, 18 nt, Mycobacterium avium subsp. paratuberculosis
gcacgaacgcggccagcg

SEQ ID NO: 1008463 - RNA, 21 nt, Mycobacterium avium subsp. paratuberculosis
gcacgaacgcggccagcgggc

SEQ ID NO: 1008464 - RNA, 19 nt, Mycobacterium avium subsp. paratuberculosis
gcacgaacgcggccgccau

SEQ ID NO: 1008465 - RNA, 20 nt, Mycobacterium avium subsp. paratuberculosis
gcacgaacgcggccgccauc

SEQ ID NO: 1008466 - RNA, 23 nt, Mycobacterium avium subsp. paratuberculosis
gcacgaagaaggcuccgccgaug

SEQ ID NO: 1008467 - RNA, 15 nt, Mycobacterium avium subsp. paratuberculosis
gcacgaucagggugu

SEQ ID NO: 1008468 - RNA, 17 nt, Mycobacterium avium subsp. paratuberculosis
gcacgaucccgccgccc

SEQ ID NO: 1008469 - RNA, 20 nt, Mycobacterium avium subsp. paratuberculosis
gcacgaucgucgccgccaac

SEQ ID NO: 1008470 - RNA, 18 nt, Mycobacterium avium subsp. paratuberculosis
gcacgaugaucccgagga

SEQ ID NO: 1008471 - RNA, 18 nt, Mycobacterium avium subsp. paratuberculosis
gcacgauggcgcggcgca

SEQ ID NO: 1008472 - RNA, 21 nt, Mycobacterium avium subsp. paratuberculosis
gcacgauggcgcggcgcaccg

SEQ ID NO: 1008473 - RNA, 15 nt, Mycobacterium avium subsp. paratuberculosis
gcacgcagcggcguc

SEQ ID NO: 1008474 - RNA, 21 nt, Mycobacterium avium subsp. paratuberculosis
gcacgcccagaucgacgccga

SEQ ID NO: 1008475 - RNA, 17 nt, Mycobacterium avium subsp. paratuberculosis
gcacgcccagaucgccg

SEQ ID NO: 1008476 - RNA, 14 nt, Mycobacterium avium subsp. paratuberculosis
gcacgcccagcccg

SEQ ID NO: 1008477 - RNA, 15 nt, Mycobacterium avium subsp. paratuberculosis
gcacgcccagcccgc

SEQ ID NO: 1008478 - RNA, 19 nt, Mycobacterium avium subsp. paratuberculosis
gcacgcccagcccgcgggc

SEQ ID NO: 1008479 - RNA, 17 nt, Mycobacterium avium subsp. paratuberculosis
gcacgcccccgcuggcc

SEQ ID NO: 1008480 - RNA, 20 nt, Mycobacterium avium subsp. paratuberculosis
gcacgccgagcagcaccggc

SEQ ID NO: 1008481 - RNA, 14 nt, Mycobacterium avium subsp. paratuberculosis
gcaccaccaacagc

SEQ ID NO: 1008482 - RNA, 18 nt, Mycobacterium avium subsp. paratuberculosis
gcaccaccaacagcagcg

SEQ ID NO: 1008483 - RNA, 16 nt, Mycobacterium avium subsp. paratuberculosis
gcaccaccacacccag

SEQ ID NO: 1008484 - RNA, 17 nt, Mycobacterium avium subsp. paratuberculosis
gcaccaccacacccagc

SEQ ID NO: 1008485 - RNA, 21 nt, Mycobacterium avium subsp. paratuberculosis
gcaccaccacacccagcgcca

SEQ ID NO: 1008486 - RNA, 22 nt, Mycobacterium avium subsp. paratuberculosis
gcaccacgacgucgagccagcg

SEQ ID NO: 1008487 - RNA, 21 nt, Mycobacterium avium subsp. paratuberculosis
gcaccaccgucaccgccgcac

SEQ ID NO: 1008488 - RNA, 23 nt, Mycobacterium avium subsp. paratuberculosis
gcaccaccucgcgcggggcggcc

SEQ ID NO: 1008489 - RNA, 14 nt, Mycobacterium avium subsp. paratuberculosis
gcaccaccuuguca

SEQ ID NO: 1008490 - RNA, 19 nt, Mycobacterium avium subsp. paratuberculosis
gcaccacgaagcgggcggc

SEQ ID NO: 1008491 - RNA, 17 nt, Mycobacterium avium subsp. paratuberculosis
gcaccaccacgcuggcc

SEQ ID NO: 1008492 - RNA, 20 nt, Mycobacterium avium subsp. paratuberculosis
gcaccaccaccgacaccccg

SEQ ID NO: 1008493 - RNA, 15 nt, Mycobacterium avium subsp. paratuberculosis
gcaccaccacccccg

SEQ ID NO: 1008494 - RNA, 13 nt, Mycobacterium avium subsp. paratuberculosis
gcaccaccagcgu

SEQ ID NO: 1008495 - RNA, 21 nt, Mycobacterium avium subsp. paratuberculosis
gcaccaccagcucgucgccga

SEQ ID NO: 1008496 - RNA, 13 nt, Mycobacterium avium subsp. paratuberculosis
gcaccaccaggcc

SEQ ID NO: 1008497 - RNA, 19 nt, Mycobacterium avium subsp. paratuberculosis
gcaccaccaggcccaccac

SEQ ID NO: 1008498 - RNA, 15 nt, Mycobacterium avium subsp. paratuberculosis
gcaccacccagcccu

SEQ ID NO: 1008499 - RNA, 17 nt, Mycobacterium avium subsp. paratuberculosis
gcaccacccaggccacc

SEQ ID NO: 1008500 - RNA, 21 nt, Mycobacterium avium subsp. paratuberculosis
gcaccacccgcaccucgcccg

SEQ ID NO: 1008501 - RNA, 19 nt, Mycobacterium avium subsp. paratuberculosis
gcaccacccgcggccggcc

SEQ ID NO: 1008502 - RNA, 17 nt, Mycobacterium avium subsp. paratuberculosis
gcaccacguccaccagc

SEQ ID NO: 1008503 - RNA, 23 nt, Mycobacterium avium subsp. paratuberculosis
gcaccacggugaucucgccgagc

SEQ ID NO: 1008504 - RNA, 15 nt, Mycobacterium avium subsp. paratuberculosis
gcaccacgguggcgc

SEQ ID NO: 1008505 - RNA, 13 nt, Mycobacterium avium subsp. paratuberculosis
gcaccacggcggc

SEQ ID NO: 1008506 - RNA, 12 nt, Mycobacterium avium subsp. paratuberculosis
gcaccagcagcc

SEQ ID NO: 1008507 - RNA, 16 nt, Mycobacterium avium subsp. paratuberculosis
gcaccagcagccagcc

SEQ ID NO: 1008508 - RNA, 17 nt, Mycobacterium avium subsp. paratuberculosis
gcaccagcagccgcagc

SEQ ID NO: 1008509 - RNA, 15 nt, Mycobacterium avium subsp. paratuberculosis
gcaccagcagccggu

SEQ ID NO: 1008510 - RNA, 12 nt, Mycobacterium avium subsp. paratuberculosis
gcaccagcaccg

SEQ ID NO: 1008511 - RNA, 16 nt, Mycobacterium avium subsp. paratuberculosis
gcaccagcucgaggcc

SEQ ID NO: 1008512 - RNA, 22 nt, Mycobacterium avium subsp. paratuberculosis
gcaccagcugauucgcgguggc

SEQ ID NO: 1008513 - RNA, 19 nt, Mycobacterium avium subsp. paratuberculosis
gcaccagcguggccggcag

SEQ ID NO: 1008514 - RNA, 18 nt, Mycobacterium avium subsp. paratuberculosis
gcaccaggcgcaccagcu

SEQ ID NO: 1008515 - RNA, 14 nt, Mycobacterium avium subsp. paratuberculosis
gcaccaggcgccac

SEQ ID NO: 1008516 - RNA, 16 nt, Mycobacterium avium subsp. paratuberculosis
gcaccaggcgccacag

SEQ ID NO: 1008517 - RNA, 19 nt, Mycobacterium avium subsp. paratuberculosis
gcaccaggcgccacagcag

SEQ ID NO: 1008518 - RNA, 16 nt, Mycobacterium avium subsp. paratuberculosis
gcaccaggcccucgcc

SEQ ID NO: 1008519 - RNA, 19 nt, Mycobacterium avium subsp. paratuberculosis
gcaccaggccgacgcuggc

SEQ ID NO: 1008520 - RNA, 16 nt, Mycobacterium avium subsp. paratuberculosis
gcaccagcgcgcgggu

SEQ ID NO: 1008521 - RNA, 19 nt, Mycobacterium avium subsp. paratuberculosis
gcaccagcggcaccaggua

SEQ ID NO: 1008522 - RNA, 15 nt, Mycobacterium avium subsp. paratuberculosis
gcaccagcggcgccc

SEQ ID NO: 1008523 - RNA, 12 nt, Mycobacterium avium subsp. paratuberculosis
gcaccagcggca

SEQ ID NO: 1008524 - RNA, 16 nt, Mycobacterium avium subsp. paratuberculosis
gcaccagcccggccag

SEQ ID NO: 1008525 - RNA, 17 nt, Mycobacterium avium subsp. paratuberculosis
gcaccagcccggccagc

SEQ ID NO: 1008526 - RNA, 20 nt, Mycobacterium avium subsp. paratuberculosis
gcaccagcccggccagcggc

SEQ ID NO: 1008527 - RNA, 18 nt, Mycobacterium avium subsp. paratuberculosis
gcaccagguugucgccgc

SEQ ID NO: 1008528 - RNA, 20 nt, Mycobacterium avium subsp. paratuberculosis
gcaccagguaccggcgggcg

SEQ ID NO: 1008529 - RNA, 19 nt, Mycobacterium avium subsp. paratuberculosis
gcaccaggcugaccagcgc

SEQ ID NO: 1008530 - RNA, 21 nt, Mycobacterium avium subsp. paratuberculosis
gcaccagggccugcagcacca

SEQ ID NO: 1008531 - RNA, 23 nt, Mycobacterium avium subsp. paratuberculosis
gcaccagggccugcagcaccagg

SEQ ID NO: 1008532 - RNA, 21 nt, Mycobacterium avium subsp. paratuberculosis
gcaccaguugcaccggcaccg

SEQ ID NO: 1008533 - RNA, 23 nt, Mycobacterium avium subsp. paratuberculosis
gcaccaguuugguguucgggcag

SEQ ID NO: 1008534 - RNA, 20 nt, Mycobacterium avium subsp. paratuberculosis
gcaccauccgcgacgccagc

SEQ ID NO: 1008535 - RNA, 20 nt, Mycobacterium avium subsp. paratuberculosis
gcaccaugaucaggccccac

SEQ ID NO: 1008536 - RNA, 21 nt, Mycobacterium avium subsp. paratuberculosis
gcacccaggaaaaccagcgac

SEQ ID NO: 1008537 - RNA, 22 nt, Mycobacterium avium subsp. paratuberculosis
gcacccagcggaaccgggggcc

SEQ ID NO: 1008538 - RNA, 20 nt, Mycobacterium avium subsp. paratuberculosis
gcacccgcugauccagcagc

SEQ ID NO: 1008539 - RNA, 21 nt, Mycobacterium avium subsp. paratuberculosis
gcacccgcugauccagcagcg

SEQ ID NO: 1008540 - RNA, 18 nt, Mycobacterium avium subsp. paratuberculosis
gcacccgcugcaccagcc

SEQ ID NO: 1008541 - RNA, 18 nt, Mycobacterium avium subsp. paratuberculosis
gcacccgcugcagccggu

SEQ ID NO: 1008542 - RNA, 19 nt, Mycobacterium avium subsp. paratuberculosis
gcacccggccacgccgggu

SEQ ID NO: 1008543 - RNA, 16 nt, Mycobacterium avium subsp. paratuberculosis
gcacccggcccacgcc

SEQ ID NO: 1008544 - RNA, 15 nt, Mycobacterium avium subsp. paratuberculosis
gcacccggcgcggcc

SEQ ID NO: 1008545 - RNA, 13 nt, Mycobacterium avium subsp. paratuberculosis
gcacccgggcccg

SEQ ID NO: 1008546 - RNA, 20 nt, Mycobacterium avium subsp. paratuberculosis
gcacccgggccugcggcggc

SEQ ID NO: 1008547 - RNA, 23 nt, Mycobacterium avium subsp. paratuberculosis
gcacccgggccugcggcggccgc

SEQ ID NO: 1008548 - RNA, 23 nt, Mycobacterium avium subsp. paratuberculosis
gcacccgggcgacaugcccgcgg

SEQ ID NO: 1008549 - RNA, 14 nt, Mycobacterium avium subsp. paratuberculosis
gcacccgccagccc

SEQ ID NO: 1008550 - RNA, 13 nt, Mycobacterium avium subsp. paratuberculosis
gcacccgcccgga

SEQ ID NO: 1008551 - RNA, 21 nt, Mycobacterium avium subsp. paratuberculosis
gcacccgcaucaacugcacca

SEQ ID NO: 1008552 - RNA, 13 nt, Mycobacterium avium subsp. paratuberculosis
gcacccgcaacac

SEQ ID NO: 1008553 - RNA, 17 nt, Mycobacterium avium subsp. paratuberculosis
gcacccgcagcuccagc

SEQ ID NO: 1008554 - RNA, 13 nt, Mycobacterium avium subsp. paratuberculosis
gcacccgcucgcc

SEQ ID NO: 1008555 - RNA, 17 nt, Mycobacterium avium subsp. paratuberculosis
gcacccgcucgcgggcc

SEQ ID NO: 1008556 - RNA, 12 nt, Mycobacterium avium subsp. paratuberculosis
gcacccgccaug

SEQ ID NO: 1008557 - RNA, 20 nt, Mycobacterium avium subsp. paratuberculosis
gcacccgcgcgucgcgcagc

SEQ ID NO: 1008558 - RNA, 16 nt, Mycobacterium avium subsp. paratuberculosis
gcaccccugccgccac

SEQ ID NO: 1008559 - RNA, 17 nt, Mycobacterium avium subsp. paratuberculosis
gcaccccugccgccacc

SEQ ID NO: 1008560 - RNA, 18 nt, Mycobacterium avium subsp. paratuberculosis
gcacccgaugcucccggu

SEQ ID NO: 1008561 - RNA, 20 nt, Mycobacterium avium subsp. paratuberculosis
gcacccgaccgacgcccggc

SEQ ID NO: 1008562 - RNA, 21 nt, Mycobacterium avium subsp. paratuberculosis
gcacccgaccgacgcccggcu

SEQ ID NO: 1008563 - RNA, 21 nt, Mycobacterium avium subsp. paratuberculosis
gcacccgacgucgacgcgggc

SEQ ID NO: 1008564 - RNA, 22 nt, Mycobacterium avium subsp. paratuberculosis
gcacccgacgucgacgcgggcg

SEQ ID NO: 1008565 - RNA, 17 nt, Mycobacterium avium subsp. paratuberculosis
gcacccgacacgccgau

SEQ ID NO: 1008566 - RNA, 14 nt, Mycobacterium avium subsp. paratuberculosis
gcacccaggucacc

SEQ ID NO: 1008567 - RNA, 13 nt, Mycobacterium avium subsp. paratuberculosis
gcacccaggugcu

SEQ ID NO: 1008568 - RNA, 17 nt, Mycobacterium avium subsp. paratuberculosis
gcacccaggugcugccc

SEQ ID NO: 1008569 - RNA, 13 nt, Mycobacterium avium subsp. paratuberculosis
gcaccccaucggc

SEQ ID NO: 1008570 - RNA, 20 nt, Mycobacterium avium subsp. paratuberculosis
gcacccccaauugccgggcc

SEQ ID NO: 1008571 - RNA, 21 nt, Mycobacterium avium subsp. paratuberculosis
gcacccccaauugccgggcca

SEQ ID NO: 1008572 - RNA, 14 nt, Mycobacterium avium subsp. paratuberculosis
gcacccccuccaca

SEQ ID NO: 1008573 - RNA, 15 nt, Mycobacterium avium subsp. paratuberculosis
gcacccccuccacac

SEQ ID NO: 1008574 - RNA, 18 nt, Mycobacterium avium subsp. paratuberculosis
gcaccguugugacccgcu

SEQ ID NO: 1008575 - RNA, 16 nt, Mycobacterium avium subsp. paratuberculosis
gcaccgugccgcccgu

SEQ ID NO: 1008576 - RNA, 14 nt, Mycobacterium avium subsp. paratuberculosis
gcaccgugccgcgc

SEQ ID NO: 1008577 - RNA, 17 nt, Mycobacterium avium subsp. paratuberculosis
gcaccgucgugccagcg

SEQ ID NO: 1008578 - RNA, 19 nt, Mycobacterium avium subsp. paratuberculosis
gcaccgucgugccagcgca

SEQ ID NO: 1008579 - RNA, 16 nt, Mycobacterium avium subsp. paratuberculosis
gcaccuccagcccggc

SEQ ID NO: 1008580 - RNA, 15 nt, Mycobacterium avium subsp. paratuberculosis
gcaccuccugcaccc

SEQ ID NO: 1008581 - RNA, 16 nt, Mycobacterium avium subsp. paratuberculosis
gcaccucgaaacccag

SEQ ID NO: 1008582 - RNA, 14 nt, Mycobacterium avium subsp. paratuberculosis
gcaccucgaugccg

SEQ ID NO: 1008583 - RNA, 15 nt, Mycobacterium avium subsp. paratuberculosis
gcaccucgcccggcu

SEQ ID NO: 1008584 - RNA, 13 nt, Mycobacterium avium subsp. paratuberculosis
gcaccucgccggc

SEQ ID NO: 1008585 - RNA, 19 nt, Mycobacterium avium subsp. paratuberculosis
gcaccucgcgcagcaccga

SEQ ID NO: 1008586 - RNA, 14 nt, Mycobacterium avium subsp. paratuberculosis
gcaccucgcggcag

SEQ ID NO: 1008587 - RNA, 16 nt, Mycobacterium avium subsp. paratuberculosis
gcaccucgcccugcag

SEQ ID NO: 1008588 - RNA, 15 nt, Mycobacterium avium subsp. paratuberculosis
gcaccucggccgggu

SEQ ID NO: 1008589 - RNA, 13 nt, Mycobacterium avium subsp. paratuberculosis
gcaccugcggcag

SEQ ID NO: 1008590 - RNA, 20 nt, Mycobacterium avium subsp. paratuberculosis
gcaccugcuuggucuccggc

SEQ ID NO: 1008591 - RNA, 14 nt, Mycobacterium avium subsp. paratuberculosis
gcaccuggauccag

SEQ ID NO: 1008592 - RNA, 17 nt, Mycobacterium avium subsp. paratuberculosis
gcaccuggcagcauccg

SEQ ID NO: 1008593 - RNA, 20 nt, Mycobacterium avium subsp. paratuberculosis
gcaccugaccgucggccaga

SEQ ID NO: 1008594 - RNA, 21 nt, Mycobacterium avium subsp. paratuberculosis
gcaccugaccgucggccagau

SEQ ID NO: 1008595 - RNA, 17 nt, Mycobacterium avium subsp. paratuberculosis
gcaccucgucgcccggc

SEQ ID NO: 1008596 - RNA, 15 nt, Mycobacterium avium subsp. paratuberculosis
gcaccucgucgccgu

SEQ ID NO: 1008597 - RNA, 23 nt, Mycobacterium avium subsp. paratuberculosis
gcaccucuucgaaagccacccgc

SEQ ID NO: 1008598 - RNA, 14 nt, Mycobacterium avium subsp. paratuberculosis
gcaccggcagccgc

SEQ ID NO: 1008599 - RNA, 17 nt, Mycobacterium avium subsp. paratuberculosis
gcaccggcagccgcagc

SEQ ID NO: 1008600 - RNA, 17 nt, Mycobacterium avium subsp. paratuberculosis
gcaccggcaccgccccc

SEQ ID NO: 1008601 - RNA, 19 nt, Mycobacterium avium subsp. paratuberculosis
gcaccggcaccgcccccgc

SEQ ID NO: 1008602 - RNA, 23 nt, Mycobacterium avium subsp. paratuberculosis
gcaccggcgaugcagaucaccac

SEQ ID NO: 1008603 - RNA, 20 nt, Mycobacterium avium subsp. paratuberculosis
gcaccggcgccccgggcagc

SEQ ID NO: 1008604 - RNA, 16 nt, Mycobacterium avium subsp. paratuberculosis
gcaccggcgccgccac

SEQ ID NO: 1008605 - RNA, 15 nt, Mycobacterium avium subsp. paratuberculosis
gcaccggcgcgccgc

SEQ ID NO: 1008606 - RNA, 22 nt, Mycobacterium avium subsp. paratuberculosis
gcaccggccggauguuguccgg

SEQ ID NO: 1008607 - RNA, 13 nt, Mycobacterium avium subsp. paratuberculosis
gcaccggcuggcc

SEQ ID NO: 1008608 - RNA, 18 nt, Mycobacterium avium subsp. paratuberculosis
gcaccggcuggccgagcg

SEQ ID NO: 1008609 - RNA, 14 nt, Mycobacterium avium subsp. paratuberculosis
gcaccggcuggugc

SEQ ID NO: 1008610 - RNA, 17 nt, Mycobacterium avium subsp. paratuberculosis
gcaccggcuggugcagc

SEQ ID NO: 1008611 - RNA, 20 nt, Mycobacterium avium subsp. paratuberculosis
gcaccgguuccaacggaagc

SEQ ID NO: 1008612 - RNA, 16 nt, Mycobacterium avium subsp. paratuberculosis
gcaccgucagccaggu

SEQ ID NO: 1008613 - RNA, 14 nt, Mycobacterium avium subsp. paratuberculosis
gcaccguccacagc

SEQ ID NO: 1008614 - RNA, 16 nt, Mycobacterium avium subsp. paratuberculosis
gcaccguccacagccg

SEQ ID NO: 1008615 - RNA, 14 nt, Mycobacterium avium subsp. paratuberculosis
gcaccgucgccggc

SEQ ID NO: 1008616 - RNA, 18 nt, Mycobacterium avium subsp. paratuberculosis
gcaccggugcggcgguga

SEQ ID NO: 1008617 - RNA, 20 nt, Mycobacterium avium subsp. paratuberculosis
gcaccgucaccuucaccccc

SEQ ID NO: 1008618 - RNA, 20 nt, Mycobacterium avium subsp. paratuberculosis
gcaccgggugauaccggccc

SEQ ID NO: 1008619 - RNA, 23 nt, Mycobacterium avium subsp. paratuberculosis
gcaccgggugauaccggcccagc

SEQ ID NO: 1008620 - RNA, 19 nt, Mycobacterium avium subsp. paratuberculosis
gcaccgggcgucggggccc

SEQ ID NO: 1008621 - RNA, 16 nt, Mycobacterium avium subsp. paratuberculosis
gcaccgggccgaaggc

SEQ ID NO: 1008622 - RNA, 12 nt, Mycobacterium avium subsp. paratuberculosis
gcaccggggcca

SEQ ID NO: 1008623 - RNA, 23 nt, Mycobacterium avium subsp. paratuberculosis
gcaccggggccaacuccggcggc

SEQ ID NO: 1008624 - RNA, 15 nt, Mycobacterium avium subsp. paratuberculosis
gcaccggggccggcg

SEQ ID NO: 1008625 - RNA, 16 nt, Mycobacterium avium subsp. paratuberculosis
gcaccgggaccagcgc

SEQ ID NO: 1008626 - RNA, 17 nt, Mycobacterium avium subsp. paratuberculosis
gcaccgggaccagcgcg

SEQ ID NO: 1008627 - RNA, 23 nt, Mycobacterium avium subsp. paratuberculosis
gcaccgggacgggucggugguuc

SEQ ID NO: 1008628 - RNA, 12 nt, Mycobacterium avium subsp. paratuberculosis
gcaccgggauga

SEQ ID NO: 1008629 - RNA, 18 nt, Mycobacterium avium subsp. paratuberculosis
gcaccgaaucgccgagcu

SEQ ID NO: 1008630 - RNA, 18 nt, Mycobacterium avium subsp. paratuberculosis
gcacccgggugcccggcu

SEQ ID NO: 1008631 - RNA, 14 nt, Mycobacterium avium subsp. paratuberculosis
gcacccggucgccg

SEQ ID NO: 1008632 - RNA, 19 nt, Mycobacterium avium subsp. paratuberculosis
gcaccgcaaagcaccgcga

SEQ ID NO: 1008633 - RNA, 20 nt, Mycobacterium avium subsp. paratuberculosis
gcaccgcaacguuguuccac

SEQ ID NO: 1008634 - RNA, 15 nt, Mycobacterium avium subsp. paratuberculosis
gcaccgacgaggaga

SEQ ID NO: 1008635 - RNA, 22 nt, Mycobacterium avium subsp. paratuberculosis
gcaccgacggagccgagcacca

SEQ ID NO: 1008636 - RNA, 16 nt, Mycobacterium avium subsp. paratuberculosis
gcaccgaccagcggga

SEQ ID NO: 1008637 - RNA, 17 nt, Mycobacterium avium subsp. paratuberculosis
gcaccgacagggccagc

SEQ ID NO: 1008638 - RNA, 20 nt, Mycobacterium avium subsp. paratuberculosis
gcaccgacagggccagcgcc

SEQ ID NO: 1008639 - RNA, 21 nt, Mycobacterium avium subsp. paratuberculosis
gcaccgagaccaugccgccga

SEQ ID NO: 1008640 - RNA, 13 nt, Mycobacterium avium subsp. paratuberculosis
gcaccgacuccuc

SEQ ID NO: 1008641 - RNA, 20 nt, Mycobacterium avium subsp. paratuberculosis
gcaccgacuccuccggcccg

SEQ ID NO: 1008642 - RNA, 16 nt, Mycobacterium avium subsp. paratuberculosis
gcaccgacugcggcgc

SEQ ID NO: 1008643 - RNA, 23 nt, Mycobacterium avium subsp. paratuberculosis
gcaccgcgaccacgccgcggucg

SEQ ID NO: 1008644 - RNA, 16 nt, Mycobacterium avium subsp. paratuberculosis
gcaccgcgacccaggc

SEQ ID NO: 1008645 - RNA, 18 nt, Mycobacterium avium subsp. paratuberculosis
gcaccgcgacccaggccg

SEQ ID NO: 1008646 - RNA, 14 nt, Mycobacterium avium subsp. paratuberculosis
gcaccgcgauggcc

SEQ ID NO: 1008647 - RNA, 22 nt, Mycobacterium avium subsp. paratuberculosis
gcaccgcgaacaucgccagcaa

SEQ ID NO: 1008648 - RNA, 19 nt, Mycobacterium avium subsp. paratuberculosis
gcaccgccgagccgucguc

SEQ ID NO: 1008649 - RNA, 17 nt, Mycobacterium avium subsp. paratuberculosis
gcaccgcgcggcggugc

SEQ ID NO: 1008650 - RNA, 19 nt, Mycobacterium avium subsp. paratuberculosis
gcaccgcggauuccagcgc

SEQ ID NO: 1008651 - RNA, 19 nt, Mycobacterium avium subsp. paratuberculosis
gcaccgcgucggcgcuggc

SEQ ID NO: 1008652 - RNA, 19 nt, Mycobacterium avium subsp. paratuberculosis
gcaccgcggcguagcgcca

SEQ ID NO: 1008653 - RNA, 20 nt, Mycobacterium avium subsp. paratuberculosis
gcaccgcggcguagcgccag

SEQ ID NO: 1008654 - RNA, 21 nt, Mycobacterium avium subsp. paratuberculosis
gcaccgcggcguagcgccagu

SEQ ID NO: 1008655 - RNA, 17 nt, Mycobacterium avium subsp. paratuberculosis
gcaccgcgggggcggcc

SEQ ID NO: 1008656 - RNA, 18 nt, Mycobacterium avium subsp. paratuberculosis
gcaccgcggucugcgcca

SEQ ID NO: 1008657 - RNA, 15 nt, Mycobacterium avium subsp. paratuberculosis
gcaccgcggcgauga

SEQ ID NO: 1008658 - RNA, 14 nt, Mycobacterium avium subsp. paratuberculosis
gcaccgcggcgcgc

SEQ ID NO: 1008659 - RNA, 16 nt, Mycobacterium avium subsp. paratuberculosis
gcaccgcggccgucgc

SEQ ID NO: 1008660 - RNA, 13 nt, Mycobacterium avium subsp. paratuberculosis
gcaccgcggcggg

SEQ ID NO: 1008661 - RNA, 17 nt, Mycobacterium avium subsp. paratuberculosis
gcaccgccagcgccggc

SEQ ID NO: 1008662 - RNA, 18 nt, Mycobacterium avium subsp. paratuberculosis
gcaccgccagcgccggca

SEQ ID NO: 1008663 - RNA, 19 nt, Mycobacterium avium subsp. paratuberculosis
gcaccgccagcgccggcag

SEQ ID NO: 1008664 - RNA, 14 nt, Mycobacterium avium subsp. paratuberculosis
gcaccgccagcgcg

SEQ ID NO: 1008665 - RNA, 12 nt, Mycobacterium avium subsp. paratuberculosis
gcaccgccaggc

SEQ ID NO: 1008666 - RNA, 17 nt, Mycobacterium avium subsp. paratuberculosis
gcaccgccaggcuggcc

SEQ ID NO: 1008667 - RNA, 19 nt, Mycobacterium avium subsp. paratuberculosis
gcaccgccaggcuggccag

SEQ ID NO: 1008668 - RNA, 22 nt, Mycobacterium avium subsp. paratuberculosis
gcaccgccaggcuggccaggcu

SEQ ID NO: 1008669 - RNA, 17 nt, Mycobacterium avium subsp. paratuberculosis
gcaccgccaccggcccg

SEQ ID NO: 1008670 - RNA, 15 nt, Mycobacterium avium subsp. paratuberculosis
gcaccgccacggcga

SEQ ID NO: 1008671 - RNA, 14 nt, Mycobacterium avium subsp. paratuberculosis
gcaccgccagcacc

SEQ ID NO: 1008672 - RNA, 16 nt, Mycobacterium avium subsp. paratuberculosis
gcaccgcauggggcag

SEQ ID NO: 1008673 - RNA, 17 nt, Mycobacterium avium subsp. paratuberculosis
gcaccgcauagcgggag

SEQ ID NO: 1008674 - RNA, 16 nt, Mycobacterium avium subsp. paratuberculosis
gcaccgcaucccccuc

SEQ ID NO: 1008675 - RNA, 14 nt, Mycobacterium avium subsp. paratuberculosis
gcaccgccccgguc

SEQ ID NO: 1008676 - RNA, 20 nt, Mycobacterium avium subsp. paratuberculosis
gcaccgcccccgcggcggcc

SEQ ID NO: 1008677 - RNA, 15 nt, Mycobacterium avium subsp. paratuberculosis
gcaccgccgcgcggc

SEQ ID NO: 1008678 - RNA, 15 nt, Mycobacterium avium subsp. paratuberculosis
gcaccgccgcggccg

SEQ ID NO: 1008679 - RNA, 14 nt, Mycobacterium avium subsp. paratuberculosis
gcaccgccggcggc

SEQ ID NO: 1008680 - RNA, 15 nt, Mycobacterium avium subsp. paratuberculosis
gcaccgccggcggcc

SEQ ID NO: 1008681 - RNA, 13 nt, Mycobacterium avium subsp. paratuberculosis
gcacaacgccucc

SEQ ID NO: 1008682 - RNA, 18 nt, Mycobacterium avium subsp. paratuberculosis
gcacacagcagcagcacc

SEQ ID NO: 1008683 - RNA, 19 nt, Mycobacterium avium subsp. paratuberculosis
gcacacagcagcagcacca

SEQ ID NO: 1008684 - RNA, 22 nt, Mycobacterium avium subsp. paratuberculosis
gcacacgggcccguccgcgaau

SEQ ID NO: 1008685 - RNA, 14 nt, Mycobacterium avium subsp. paratuberculosis
gcacaccaccacgu

SEQ ID NO: 1008686 - RNA, 21 nt, Mycobacterium avium subsp. paratuberculosis
gcacaccagguaggcgguggc

SEQ ID NO: 1008687 - RNA, 15 nt, Mycobacterium avium subsp. paratuberculosis
gcacacccagcgagc

SEQ ID NO: 1008688 - RNA, 23 nt, Mycobacterium avium subsp. paratuberculosis
gcacacccucaccccgcccagcg

SEQ ID NO: 1008689 - RNA, 16 nt, Mycobacterium avium subsp. paratuberculosis
gcacaccgucucccac

SEQ ID NO: 1008690 - RNA, 19 nt, Mycobacterium avium subsp. paratuberculosis
gcacaccguucccaccggc

SEQ ID NO: 1008691 - RNA, 18 nt, Mycobacterium avium subsp. paratuberculosis
gcacaccgcgcagaaccg

SEQ ID NO: 1008692 - RNA, 12 nt, Mycobacterium avium subsp. paratuberculosis
gcacaccgcgcg

SEQ ID NO: 1008693 - RNA, 19 nt, Mycobacterium avium subsp. paratuberculosis
gcacaccgcgcgcaggccc

SEQ ID NO: 1008694 - RNA, 14 nt, Mycobacterium avium subsp. paratuberculosis
gcacaccggccuuc

SEQ ID NO: 1008695 - RNA, 17 nt, Mycobacterium avium subsp. paratuberculosis
gcacaccggccuucacc

SEQ ID NO: 1008696 - RNA, 18 nt, Mycobacterium avium subsp. paratuberculosis
gcacaccggccuucacca

SEQ ID NO: 1008697 - RNA, 15 nt, Mycobacterium avium subsp. paratuberculosis
gcacaugcccgucgg

SEQ ID NO: 1008698 - RNA, 21 nt, Mycobacterium avium subsp. paratuberculosis
gcacaucacgguggccgccac

SEQ ID NO: 1008699 - RNA, 15 nt, Mycobacterium avium subsp. paratuberculosis
gcacauagcgcagcu

SEQ ID NO: 1008700 - RNA, 22 nt, Mycobacterium avium subsp. paratuberculosis
gcacagcguuauccaccagguu

SEQ ID NO: 1008701 - RNA, 19 nt, Mycobacterium avium subsp. paratuberculosis
gcacagcuuucgggcggcc

SEQ ID NO: 1008702 - RNA, 19 nt, Mycobacterium avium subsp. paratuberculosis
gcacaggaugcccaacagc

SEQ ID NO: 1008703 - RNA, 20 nt, Mycobacterium avium subsp. paratuberculosis
gcacaggaugcccaacagcu

SEQ ID NO: 1008704 - RNA, 16 nt, Mycobacterium avium subsp. paratuberculosis
gcacagcgccacaccg

SEQ ID NO: 1008705 - RNA, 15 nt, Mycobacterium avium subsp. paratuberculosis
gcacagcgccgcguu

SEQ ID NO: 1008706 - RNA, 18 nt, Mycobacterium avium subsp. paratuberculosis
gcacagccggcgcgcggu

SEQ ID NO: 1008707 - RNA, 20 nt, Mycobacterium avium subsp. paratuberculosis
gcacagcacggcaucgaugg

SEQ ID NO: 1008708 - RNA, 22 nt, Mycobacterium avium subsp. paratuberculosis
gcacagcauguccucggggugg

SEQ ID NO: 1008709 - RNA, 13 nt, Mycobacterium avium subsp. paratuberculosis
gcacagccagcgc

SEQ ID NO: 1008710 - RNA, 20 nt, Mycobacterium avium subsp. paratuberculosis
gcacaggcgaaucggcgcac

SEQ ID NO: 1008711 - RNA, 13 nt, Mycobacterium avium subsp. paratuberculosis
gcacaggccgccg

SEQ ID NO: 1008712 - RNA, 17 nt, Mycobacterium avium subsp. paratuberculosis
gcaauugcgccagcagc

SEQ ID NO: 1008713 - RNA, 18 nt, Mycobacterium avium subsp. paratuberculosis
gcaauugcgccagcagca

SEQ ID NO: 1008714 - RNA, 15 nt, Mycobacterium avium subsp. paratuberculosis
gcaaugccgccgcga

SEQ ID NO: 1008715 - RNA, 13 nt, Mycobacterium avium subsp. paratuberculosis
gcaauggccgcga

SEQ ID NO: 1008716 - RNA, 20 nt, Mycobacterium avium subsp. paratuberculosis
gcaauccgcugaacgggcag

SEQ ID NO: 1008717 - RNA, 16 nt, Mycobacterium avium subsp. paratuberculosis
gcaaucggacccagcc

SEQ ID NO: 1008718 - RNA, 23 nt, Mycobacterium avium subsp. paratuberculosis
gcaaucgcugcgcccgccgccac

SEQ ID NO: 1008719 - RNA, 19 nt, Mycobacterium avium subsp. paratuberculosis
gcaauccggccccgcugcc

SEQ ID NO: 1008720 - RNA, 20 nt, Mycobacterium avium subsp. paratuberculosis
gcaagccgaguuugcgguga

SEQ ID NO: 1008721 - RNA, 20 nt, Mycobacterium avium subsp. paratuberculosis
gcaagcccuuuggcggccag

SEQ ID NO: 1008722 - RNA, 22 nt, Mycobacterium avium subsp. paratuberculosis
gcaagcagcggcagccacggca

SEQ ID NO: 1008723 - RNA, 18 nt, Mycobacterium avium subsp. paratuberculosis
gcaagcagagcagcgaga

SEQ ID NO: 1008724 - RNA, 15 nt, Mycobacterium avium subsp. paratuberculosis
gcaagcucgccagga

SEQ ID NO: 1008725 - RNA, 13 nt, Mycobacterium avium subsp. paratuberculosis
gcaagcugauucg

SEQ ID NO: 1008726 - RNA, 18 nt, Mycobacterium avium subsp. paratuberculosis
gcaaggccugcgccuugg

SEQ ID NO: 1008727 - RNA, 23 nt, Mycobacterium avium subsp. paratuberculosis
gcaaguccggguccuaucaggac

SEQ ID NO: 1008728 - RNA, 14 nt, Mycobacterium avium subsp. paratuberculosis
gcaagucgaacgga

SEQ ID NO: 1008729 - RNA, 19 nt, Mycobacterium avium subsp. paratuberculosis
gcaauacggugcccgccgc

SEQ ID NO: 1008730 - RNA, 15 nt, Mycobacterium avium subsp. paratuberculosis
gcaaccugggcggcg

SEQ ID NO: 1008731 - RNA, 22 nt, Mycobacterium avium subsp. paratuberculosis
gcaacgacccggccaccgccgc

SEQ ID NO: 1008732 - RNA, 19 nt, Mycobacterium avium subsp. paratuberculosis
gcaacgcacgggcggcggg

SEQ ID NO: 1008733 - RNA, 15 nt, Mycobacterium avium subsp. paratuberculosis
gcaaccgggccgcac

SEQ ID NO: 1008734 - RNA, 19 nt, Mycobacterium avium subsp. paratuberculosis
gcaaccgggccgcaccccc

SEQ ID NO: 1008735 - RNA, 21 nt, Mycobacterium avium subsp. paratuberculosis
gcaaccgggccgcacccccuc

SEQ ID NO: 1008736 - RNA, 19 nt, Mycobacterium avium subsp. paratuberculosis
gcaaccgucuuggcuggca

SEQ ID NO: 1008737 - RNA, 16 nt, Mycobacterium avium subsp. paratuberculosis
gcaaccggcggcuggg

SEQ ID NO: 1008738 - RNA, 20 nt, Mycobacterium avium subsp. paratuberculosis
gcaaccggcggcugggcagc

SEQ ID NO: 1008739 - RNA, 23 nt, Mycobacterium avium subsp. paratuberculosis
gcaaccggcggcugggcagccgc

SEQ ID NO: 1008740 - RNA, 13 nt, Mycobacterium avium subsp. paratuberculosis
gcaacgcggcggu

SEQ ID NO: 1008741 - RNA, 13 nt, Mycobacterium avium subsp. paratuberculosis
gcaacgcgccggc

SEQ ID NO: 1008742 - RNA, 14 nt, Mycobacterium avium subsp. paratuberculosis
gcaacgccagcgcg

SEQ ID NO: 1008743 - RNA, 18 nt, Mycobacterium avium subsp. paratuberculosis
gcaacggcuggcgcaggu

SEQ ID NO: 1008744 - RNA, 15 nt, Mycobacterium avium subsp. paratuberculosis
gcaacgggccgcagc

SEQ ID NO: 1008745 - RNA, 21 nt, Mycobacterium avium subsp. paratuberculosis
gcaacgguacgugcgccggcg

SEQ ID NO: 1008746 - RNA, 22 nt, Mycobacterium avium subsp. paratuberculosis
gcaacggcggucgugcggcugc

SEQ ID NO: 1008747 - RNA, 14 nt, Mycobacterium avium subsp. paratuberculosis
gcaacugcguggcc

SEQ ID NO: 1008748 - RNA, 20 nt, Mycobacterium avium subsp. paratuberculosis
gcaacugggugagcaacagc

SEQ ID NO: 1008749 - RNA, 23 nt, Mycobacterium avium subsp. paratuberculosis
gcaacugggugagcaacagcgcu

SEQ ID NO: 1008750 - RNA, 21 nt, Mycobacterium avium subsp. paratuberculosis
gcaacugcucgaccagccccc

SEQ ID NO: 1008751 - RNA, 16 nt, Mycobacterium avium subsp. paratuberculosis
gcaacuguucgcggcu

SEQ ID NO: 1008752 - RNA, 13 nt, Mycobacterium avium subsp. paratuberculosis
guaaccacccgug

SEQ ID NO: 1008753 - RNA, 13 nt, Mycobacterium avium subsp. paratuberculosis
guaaaccagcagc

SEQ ID NO: 1008754 - RNA, 17 nt, Mycobacterium avium subsp. paratuberculosis
guaaaccgccagcagcg

SEQ ID NO: 1008755 - RNA, 13 nt, Mycobacterium avium subsp. paratuberculosis
guaacccgggacc

SEQ ID NO: 1008756 - RNA, 15 nt, Mycobacterium avium subsp. paratuberculosis
guaaccggcggcggu

SEQ ID NO: 1008757 - RNA, 16 nt, Mycobacterium avium subsp. paratuberculosis
guaaggccgaggcgag

SEQ ID NO: 1008758 - RNA, 21 nt, Mycobacterium avium subsp. paratuberculosis
guaaggccgaggcgagugagg

SEQ ID NO: 1008759 - RNA, 19 nt, Mycobacterium avium subsp. paratuberculosis
guacaagugaugaccugga

SEQ ID NO: 1008760 - RNA, 23 nt, Mycobacterium avium subsp. paratuberculosis
guacaagacaauucgcugccccg

SEQ ID NO: 1008761 - RNA, 16 nt, Mycobacterium avium subsp. paratuberculosis
guacacggcccgcggc

SEQ ID NO: 1008762 - RNA, 14 nt, Mycobacterium avium subsp. paratuberculosis
guacacgaugcccu

SEQ ID NO: 1008763 - RNA, 21 nt, Mycobacterium avium subsp. paratuberculosis
guacacgaugcccuuggccag

SEQ ID NO: 1008764 - RNA, 15 nt, Mycobacterium avium subsp. paratuberculosis
guacaccucgagcuu

SEQ ID NO: 1008765 - RNA, 22 nt, Mycobacterium avium subsp. paratuberculosis
guacaggucgaccaucugccgg

SEQ ID NO: 1008766 - RNA, 16 nt, Mycobacterium avium subsp. paratuberculosis
guacaggucgcacagg

SEQ ID NO: 1008767 - RNA, 18 nt, Mycobacterium avium subsp. paratuberculosis
guacaggucgcacaggau

SEQ ID NO: 1008768 - RNA, 18 nt, Mycobacterium avium subsp. paratuberculosis
guacaggucgcugcccgg

SEQ ID NO: 1008769 - RNA, 17 nt, Mycobacterium avium subsp. paratuberculosis
guacauggugaccagcg

SEQ ID NO: 1008770 - RNA, 14 nt, Mycobacterium avium subsp. paratuberculosis
guacaucccgccgg

SEQ ID NO: 1008771 - RNA, 18 nt, Mycobacterium avium subsp. paratuberculosis
guacaucccgccgggcau

SEQ ID NO: 1008772 - RNA, 15 nt, Mycobacterium avium subsp. paratuberculosis
guacagcaccgccgc

SEQ ID NO: 1008773 - RNA, 14 nt, Mycobacterium avium subsp. paratuberculosis
guacagcagccccu

SEQ ID NO: 1008774 - RNA, 20 nt, Mycobacterium avium subsp. paratuberculosis
guacaggaucaacucgucgg

SEQ ID NO: 1008775 - RNA, 17 nt, Mycobacterium avium subsp. paratuberculosis
guacagcuaggccagca

SEQ ID NO: 1008776 - RNA, 19 nt, Mycobacterium avium subsp. paratuberculosis
guacagcuaggccagcagc

SEQ ID NO: 1008777 - RNA, 20 nt, Mycobacterium avium subsp. paratuberculosis
guacagcuaggccagcagcg

SEQ ID NO: 1008778 - RNA, 19 nt, Mycobacterium avium subsp. paratuberculosis
guacagcgccagcggcuug

SEQ ID NO: 1008779 - RNA, 17 nt, Mycobacterium avium subsp. paratuberculosis
guacagcgccauguccu

SEQ ID NO: 1008780 - RNA, 18 nt, Mycobacterium avium subsp. paratuberculosis
guacagcgccgcggccag

SEQ ID NO: 1008781 - RNA, 21 nt, Mycobacterium avium subsp. paratuberculosis
guaccagugcaagcucgccag

SEQ ID NO: 1008782 - RNA, 16 nt, Mycobacterium avium subsp. paratuberculosis
guaccagcgccacggg

SEQ ID NO: 1008783 - RNA, 19 nt, Mycobacterium avium subsp. paratuberculosis
guaccagcugcccaccagc

SEQ ID NO: 1008784 - RNA, 18 nt, Mycobacterium avium subsp. paratuberculosis
guaccacuugaaggaggc

SEQ ID NO: 1008785 - RNA, 17 nt, Mycobacterium avium subsp. paratuberculosis
guaccgccggccaggcg

SEQ ID NO: 1008786 - RNA, 15 nt, Mycobacterium avium subsp. paratuberculosis
guaccggcgccaggc

SEQ ID NO: 1008787 - RNA, 16 nt, Mycobacterium avium subsp. paratuberculosis
guaccggcgccaggcc

SEQ ID NO: 1008788 - RNA, 17 nt, Mycobacterium avium subsp. paratuberculosis
guaccgauccgcgggcc

SEQ ID NO: 1008789 - RNA, 23 nt, Mycobacterium avium subsp. paratuberculosis
guaccgauccgcgggccggcacu

SEQ ID NO: 1008790 - RNA, 23 nt, Mycobacterium avium subsp. paratuberculosis
guaccgaugaccaccgcugugga

SEQ ID NO: 1008791 - RNA, 23 nt, Mycobacterium avium subsp. paratuberculosis
guacccgcaggccaugaucgaaa

SEQ ID NO: 1008792 - RNA, 12 nt, Mycobacterium avium subsp. paratuberculosis
guaccccagcaa

SEQ ID NO: 1008793 - RNA, 23 nt, Mycobacterium avium subsp. paratuberculosis
guaccccagcaaaaccccgccgu

SEQ ID NO: 1008794 - RNA, 15 nt, Mycobacterium avium subsp. paratuberculosis
guacgcgccggccag

SEQ ID NO: 1008795 - RNA, 19 nt, Mycobacterium avium subsp. paratuberculosis
guacggcucaacggccggc

SEQ ID NO: 1008796 - RNA, 20 nt, Mycobacterium avium subsp. paratuberculosis
guacggcucaacggccggcg

SEQ ID NO: 1008797 - RNA, 19 nt, Mycobacterium avium subsp. paratuberculosis
guacgggcugaagaucaac

SEQ ID NO: 1008798 - RNA, 20 nt, Mycobacterium avium subsp. paratuberculosis
guacggauugcggacgccuc

SEQ ID NO: 1008799 - RNA, 13 nt, Mycobacterium avium subsp. paratuberculosis
ggugcugcggcuc

SEQ ID NO: 1008800 - RNA, 16 nt, Mycobacterium avium subsp. paratuberculosis
ggugcugcccggcgcg

SEQ ID NO: 1008801 - RNA, 12 nt, Mycobacterium avium subsp. paratuberculosis
ggugcugcagcg

SEQ ID NO: 1008802 - RNA, 16 nt, Mycobacterium avium subsp. paratuberculosis
ggugcugccgugccga

SEQ ID NO: 1008803 - RNA, 17 nt, Mycobacterium avium subsp. paratuberculosis
ggugcugaacgccugcc

SEQ ID NO: 1008804 - RNA, 20 nt, Mycobacterium avium subsp. paratuberculosis
ggugcucacgcuuccgugcu

SEQ ID NO: 1008805 - RNA, 15 nt, Mycobacterium avium subsp. paratuberculosis
ggugcucgccccgcc

SEQ ID NO: 1008806 - RNA, 17 nt, Mycobacterium avium subsp. paratuberculosis
ggugcucgcgccgggcg

SEQ ID NO: 1008807 - RNA, 18 nt, Mycobacterium avium subsp. paratuberculosis
ggugcucaccccggccag

SEQ ID NO: 1008808 - RNA, 20 nt, Mycobacterium avium subsp. paratuberculosis
ggugcgucgaaucacaaggg

SEQ ID NO: 1008809 - RNA, 17 nt, Mycobacterium avium subsp. paratuberculosis
ggugcgucgggcgccgg

SEQ ID NO: 1008810 - RNA, 22 nt, Mycobacterium avium subsp. paratuberculosis
ggugcguucgcguucgggcagc

SEQ ID NO: 1008811 - RNA, 20 nt, Mycobacterium avium subsp. paratuberculosis
ggugcgguaggugccggccg

SEQ ID NO: 1008812 - RNA, 21 nt, Mycobacterium avium subsp. paratuberculosis
ggugcguccagaccggccggg

SEQ ID NO: 1008813 - RNA, 16 nt, Mycobacterium avium subsp. paratuberculosis
ggugcguccgccggcg

SEQ ID NO: 1008814 - RNA, 14 nt, Mycobacterium avium subsp. paratuberculosis
ggugcgggccagca

SEQ ID NO: 1008815 - RNA, 14 nt, Mycobacterium avium subsp. paratuberculosis
ggugcgcgccggcg

SEQ ID NO: 1008816 - RNA, 21 nt, Mycobacterium avium subsp. paratuberculosis
ggugcgccgccgcgucgccgc

SEQ ID NO: 1008817 - RNA, 16 nt, Mycobacterium avium subsp. paratuberculosis
ggugcgccgcucgucg

SEQ ID NO: 1008818 - RNA, 22 nt, Mycobacterium avium subsp. paratuberculosis
ggugcgccgcucgucggccagc

SEQ ID NO: 1008819 - RNA, 14 nt, Mycobacterium avium subsp. paratuberculosis
ggugcgcagccgcu

SEQ ID NO: 1008820 - RNA, 15 nt, Mycobacterium avium subsp. paratuberculosis
ggugcgcagccgcug

SEQ ID NO: 1008821 - RNA, 19 nt, Mycobacterium avium subsp. paratuberculosis
ggugcgcagccgcugcagc

SEQ ID NO: 1008822 - RNA, 22 nt, Mycobacterium avium subsp. paratuberculosis
ggugcgccaggcaggcggccag

SEQ ID NO: 1008823 - RNA, 19 nt, Mycobacterium avium subsp. paratuberculosis
ggugcgcccgucgucgccg

SEQ ID NO: 1008824 - RNA, 15 nt, Mycobacterium avium subsp. paratuberculosis
ggugcggcgcugccg

SEQ ID NO: 1008825 - RNA, 16 nt, Mycobacterium avium subsp. paratuberculosis
ggugcggcgcugccgg

SEQ ID NO: 1008826 - RNA, 17 nt, Mycobacterium avium subsp. paratuberculosis
ggugcggcucgggcggu

SEQ ID NO: 1008827 - RNA, 11 nt, Mycobacterium avium subsp. paratuberculosis
ggugcggccuc

SEQ ID NO: 1008828 - RNA, 13 nt, Mycobacterium avium subsp. paratuberculosis
ggugcggcaccuc

SEQ ID NO: 1008829 - RNA, 15 nt, Mycobacterium avium subsp. paratuberculosis
ggugcggccagcgca

SEQ ID NO: 1008830 - RNA, 16 nt, Mycobacterium avium subsp. paratuberculosis
ggugcggcccgcggca

SEQ ID NO: 1008831 - RNA, 21 nt, Mycobacterium avium subsp. paratuberculosis
ggugcgcucgugaccggcggu

SEQ ID NO: 1008832 - RNA, 13 nt, Mycobacterium avium subsp. paratuberculosis
ggugcggaacacc

SEQ ID NO: 1008833 - RNA, 18 nt, Mycobacterium avium subsp. paratuberculosis
ggugccguugaccacgcc

SEQ ID NO: 1008834 - RNA, 22 nt, Mycobacterium avium subsp. paratuberculosis
ggugccguugaucagggcggcg

SEQ ID NO: 1008835 - RNA, 21 nt, Mycobacterium avium subsp. paratuberculosis
ggugccgucgaucgcccgcuc

SEQ ID NO: 1008836 - RNA, 19 nt, Mycobacterium avium subsp. paratuberculosis
ggugccggugacggucagg

SEQ ID NO: 1008837 - RNA, 21 nt, Mycobacterium avium subsp. paratuberculosis
ggugccggugacggucagggu

SEQ ID NO: 1008838 - RNA, 23 nt, Mycobacterium avium subsp. paratuberculosis
ggugcgcaccccguugccgccgg

SEQ ID NO: 1008839 - RNA, 15 nt, Mycobacterium avium subsp. paratuberculosis
ggugcgagccaccuc

SEQ ID NO: 1008840 - RNA, 18 nt, Mycobacterium avium subsp. paratuberculosis
ggugcgaacagccacggu

SEQ ID NO: 1008841 - RNA, 18 nt, Mycobacterium avium subsp. paratuberculosis
ggugcgacgccgcgcagc

SEQ ID NO: 1008842 - RNA, 16 nt, Mycobacterium avium subsp. paratuberculosis
ggugccgagcccgccg

SEQ ID NO: 1008843 - RNA, 14 nt, Mycobacterium avium subsp. paratuberculosis
ggugccgagcgcgc

SEQ ID NO: 1008844 - RNA, 11 nt, Mycobacterium avium subsp. paratuberculosis
ggugccgcagc

SEQ ID NO: 1008845 - RNA, 23 nt, Mycobacterium avium subsp. paratuberculosis
ggugccgaacacguacagcggcg

SEQ ID NO: 1008846 - RNA, 15 nt, Mycobacterium avium subsp. paratuberculosis
ggugccgaaccggau

SEQ ID NO: 1008847 - RNA, 13 nt, Mycobacterium avium subsp. paratuberculosis
ggugccgaagcgc

SEQ ID NO: 1008848 - RNA, 22 nt, Mycobacterium avium subsp. paratuberculosis
ggugccgaagcgccacggggcg

SEQ ID NO: 1008849 - RNA, 19 nt, Mycobacterium avium subsp. paratuberculosis
ggugccgaccugggcggcc

SEQ ID NO: 1008850 - RNA, 18 nt, Mycobacterium avium subsp. paratuberculosis
ggugccgacgagcucgcc

SEQ ID NO: 1008851 - RNA, 21 nt, Mycobacterium avium subsp. paratuberculosis
ggugccgagcacgcggccgcg

SEQ ID NO: 1008852 - RNA, 13 nt, Mycobacterium avium subsp. paratuberculosis
ggugccgcagcgg

SEQ ID NO: 1008853 - RNA, 16 nt, Mycobacterium avium subsp. paratuberculosis
ggugccgcagcggcgg

SEQ ID NO: 1008854 - RNA, 11 nt, Mycobacterium avium subsp. paratuberculosis
ggugccgcagu

SEQ ID NO: 1008855 - RNA, 17 nt, Mycobacterium avium subsp. paratuberculosis
ggugccgcugcccgccg

SEQ ID NO: 1008856 - RNA, 15 nt, Mycobacterium avium subsp. paratuberculosis
ggugccgccgugcgc

SEQ ID NO: 1008857 - RNA, 20 nt, Mycobacterium avium subsp. paratuberculosis
ggugccggaaguucucgccg

SEQ ID NO: 1008858 - RNA, 13 nt, Mycobacterium avium subsp. paratuberculosis
ggugccggccaga

SEQ ID NO: 1008859 - RNA, 23 nt, Mycobacterium avium subsp. paratuberculosis
ggugccggccucgucggcgagca

SEQ ID NO: 1008860 - RNA, 13 nt, Mycobacterium avium subsp. paratuberculosis
ggugccggcggcg

SEQ ID NO: 1008861 - RNA, 16 nt, Mycobacterium avium subsp. paratuberculosis
ggugccgcgcggcagg

SEQ ID NO: 1008862 - RNA, 17 nt, Mycobacterium avium subsp. paratuberculosis
ggugccgcgcggcaggu

SEQ ID NO: 1008863 - RNA, 13 nt, Mycobacterium avium subsp. paratuberculosis
ggugccgcgcagc

SEQ ID NO: 1008864 - RNA, 14 nt, Mycobacterium avium subsp. paratuberculosis
ggugggcgggcacc

SEQ ID NO: 1008865 - RNA, 15 nt, Mycobacterium avium subsp. paratuberculosis
ggugggcucccaguc

SEQ ID NO: 1008866 - RNA, 16 nt, Mycobacterium avium subsp. paratuberculosis
ggugggguccgcaggc

SEQ ID NO: 1008867 - RNA, 14 nt, Mycobacterium avium subsp. paratuberculosis
gguggggcaccaga

SEQ ID NO: 1008868 - RNA, 13 nt, Mycobacterium avium subsp. paratuberculosis
ggugggguggugg

SEQ ID NO: 1008869 - RNA, 14 nt, Mycobacterium avium subsp. paratuberculosis
ggugggguggugga

SEQ ID NO: 1008870 - RNA, 21 nt, Mycobacterium avium subsp. paratuberculosis
ggugggaauccacagcgguuc

SEQ ID NO: 1008871 - RNA, 12 nt, Mycobacterium avium subsp. paratuberculosis
ggugggcggcgc

SEQ ID NO: 1008872 - RNA, 17 nt, Mycobacterium avium subsp. paratuberculosis
ggugggcgaacagcagc

SEQ ID NO: 1008873 - RNA, 18 nt, Mycobacterium avium subsp. paratuberculosis
ggugggcgaacagcagca

SEQ ID NO: 1008874 - RNA, 14 nt, Mycobacterium avium subsp. paratuberculosis
ggugggcgccggcg

SEQ ID NO: 1008875 - RNA, 14 nt, Mycobacterium avium subsp. paratuberculosis
ggugggcagaugcc

SEQ ID NO: 1008876 - RNA, 18 nt, Mycobacterium avium subsp. paratuberculosis
ggugggcagaugcccgcu

SEQ ID NO: 1008877 - RNA, 14 nt, Mycobacterium avium subsp. paratuberculosis
gguggcgcccgcgg

SEQ ID NO: 1008878 - RNA, 13 nt, Mycobacterium avium subsp. paratuberculosis
gguggcgccgcgc

SEQ ID NO: 1008879 - RNA, 14 nt, Mycobacterium avium subsp. paratuberculosis
gguggcgccgcgca

SEQ ID NO: 1008880 - RNA, 17 nt, Mycobacterium avium subsp. paratuberculosis
gguggcgccgguaggcg

SEQ ID NO: 1008881 - RNA, 16 nt, Mycobacterium avium subsp. paratuberculosis
gguggccgcggccgcc

SEQ ID NO: 1008882 - RNA, 15 nt, Mycobacterium avium subsp. paratuberculosis
gguggccggugggcg

SEQ ID NO: 1008883 - RNA, 19 nt, Mycobacterium avium subsp. paratuberculosis
gguggccgucgccucgccc

SEQ ID NO: 1008884 - RNA, 15 nt, Mycobacterium avium subsp. paratuberculosis
gguggccucggcgcu

SEQ ID NO: 1008885 - RNA, 16 nt, Mycobacterium avium subsp. paratuberculosis
gguggccuggucggcg

SEQ ID NO: 1008886 - RNA, 21 nt, Mycobacterium avium subsp. paratuberculosis
gguggccuucaucaccgcccc

SEQ ID NO: 1008887 - RNA, 19 nt, Mycobacterium avium subsp. paratuberculosis
gguggcgaacagcggguuc

SEQ ID NO: 1008888 - RNA, 14 nt, Mycobacterium avium subsp. paratuberculosis
gguggcgaagcacg

SEQ ID NO: 1008889 - RNA, 21 nt, Mycobacterium avium subsp. paratuberculosis
gguggcgggccgccggguggc

SEQ ID NO: 1008890 - RNA, 13 nt, Mycobacterium avium subsp. paratuberculosis
gguggcggccacg

SEQ ID NO: 1008891 - RNA, 10 nt, Mycobacterium avium subsp. paratuberculosis
gguggcggcg

SEQ ID NO: 1008892 - RNA, 11 nt, Mycobacterium avium subsp. paratuberculosis
gguggcggcga

SEQ ID NO: 1008893 - RNA, 15 nt, Mycobacterium avium subsp. paratuberculosis
ggugcuuggucagcg

SEQ ID NO: 1008894 - RNA, 15 nt, Mycobacterium avium subsp. paratuberculosis
gguggagaaguggcu

SEQ ID NO: 1008895 - RNA, 22 nt, Mycobacterium avium subsp. paratuberculosis
gguggacuccagcaccagcacg

SEQ ID NO: 1008896 - RNA, 23 nt, Mycobacterium avium subsp. paratuberculosis
gguggacuccagcaccagcacgg

SEQ ID NO: 1008897 - RNA, 15 nt, Mycobacterium avium subsp. paratuberculosis
gguggacgcccgcga

SEQ ID NO: 1008898 - RNA, 14 nt, Mycobacterium avium subsp. paratuberculosis
gguggacgccgcgc

SEQ ID NO: 1008899 - RNA, 23 nt, Mycobacterium avium subsp. paratuberculosis
gguggacgcgaccaggcccagcg

SEQ ID NO: 1008900 - RNA, 13 nt, Mycobacterium avium subsp. paratuberculosis
gguggagcacagc

SEQ ID NO: 1008901 - RNA, 22 nt, Mycobacterium avium subsp. paratuberculosis
gguggagcgcggcaugccgccc

SEQ ID NO: 1008902 - RNA, 19 nt, Mycobacterium avium subsp. paratuberculosis
gguggaugaugccggcggu

SEQ ID NO: 1008903 - RNA, 14 nt, Mycobacterium avium subsp. paratuberculosis
gguggaugggcucg

SEQ ID NO: 1008904 - RNA, 14 nt, Mycobacterium avium subsp. paratuberculosis
gguggccaccaccg

SEQ ID NO: 1008905 - RNA, 14 nt, Mycobacterium avium subsp. paratuberculosis
gguggccccagccc

SEQ ID NO: 1008906 - RNA, 17 nt, Mycobacterium avium subsp. paratuberculosis
gguggccccgggccgca

SEQ ID NO: 1008907 - RNA, 13 nt, Mycobacterium avium subsp. paratuberculosis
gguggcccgaccc

SEQ ID NO: 1008908 - RNA, 18 nt, Mycobacterium avium subsp. paratuberculosis
gguggcccgguacagcgc

SEQ ID NO: 1008909 - RNA, 21 nt, Mycobacterium avium subsp. paratuberculosis
gguggcccgguacagcgccgc

SEQ ID NO: 1008910 - RNA, 15 nt, Mycobacterium avium subsp. paratuberculosis
gguggccgaaccgcu

SEQ ID NO: 1008911 - RNA, 18 nt, Mycobacterium avium subsp. paratuberculosis
gguggccgccaccaacau

SEQ ID NO: 1008912 - RNA, 15 nt, Mycobacterium avium subsp. paratuberculosis
ggugaggccaggcgu

SEQ ID NO: 1008913 - RNA, 16 nt, Mycobacterium avium subsp. paratuberculosis
ggugagcgcgccggcc

SEQ ID NO: 1008914 - RNA, 17 nt, Mycobacterium avium subsp. paratuberculosis
ggugagcggccgcagcg

SEQ ID NO: 1008915 - RNA, 16 nt, Mycobacterium avium subsp. paratuberculosis
ggugagcggcgcgucc

SEQ ID NO: 1008916 - RNA, 21 nt, Mycobacterium avium subsp. paratuberculosis
ggugagccgccacagcgccuc

SEQ ID NO: 1008917 - RNA, 20 nt, Mycobacterium avium subsp. paratuberculosis
ggugacuccuccucggccag

SEQ ID NO: 1008918 - RNA, 18 nt, Mycobacterium avium subsp. paratuberculosis
ggugagacggccagcagc

SEQ ID NO: 1008919 - RNA, 19 nt, Mycobacterium avium subsp. paratuberculosis
ggugacgcucacccggccc

SEQ ID NO: 1008920 - RNA, 18 nt, Mycobacterium avium subsp. paratuberculosis
ggugacgaacucaagggc

SEQ ID NO: 1008921 - RNA, 23 nt, Mycobacterium avium subsp. paratuberculosis
ggugacggauguggucggccacg

SEQ ID NO: 1008922 - RNA, 21 nt, Mycobacterium avium subsp. paratuberculosis
ggugacggccgugaugccggg

SEQ ID NO: 1008923 - RNA, 13 nt, Mycobacterium avium subsp. paratuberculosis
ggugacggccucc

SEQ ID NO: 1008924 - RNA, 20 nt, Mycobacterium avium subsp. paratuberculosis
ggugacggucaugccgagcc

SEQ ID NO: 1008925 - RNA, 14 nt, Mycobacterium avium subsp. paratuberculosis
ggugacgucgccga

SEQ ID NO: 1008926 - RNA, 22 nt, Mycobacterium avium subsp. paratuberculosis
ggugacgugcaccugcagccgg

SEQ ID NO: 1008927 - RNA, 17 nt, Mycobacterium avium subsp. paratuberculosis
ggugacguggcggccgu

SEQ ID NO: 1008928 - RNA, 13 nt, Mycobacterium avium subsp. paratuberculosis
ggugaccgcccgc

SEQ ID NO: 1008929 - RNA, 22 nt, Mycobacterium avium subsp. paratuberculosis
ggugaccgccucgucgaagguc

SEQ ID NO: 1008930 - RNA, 19 nt, Mycobacterium avium subsp. paratuberculosis
ggugaccgccuuggcgcgc

SEQ ID NO: 1008931 - RNA, 15 nt, Mycobacterium avium subsp. paratuberculosis
ggugaccgucgccga

SEQ ID NO: 1008932 - RNA, 16 nt, Mycobacterium avium subsp. paratuberculosis
ggugaccgcgccgcgg

SEQ ID NO: 1008933 - RNA, 18 nt, Mycobacterium avium subsp. paratuberculosis
ggugaccggcgcgcagca

SEQ ID NO: 1008934 - RNA, 14 nt, Mycobacterium avium subsp. paratuberculosis
ggugaccggcggcc

SEQ ID NO: 1008935 - RNA, 16 nt, Mycobacterium avium subsp. paratuberculosis
ggugaccggcggccag

SEQ ID NO: 1008936 - RNA, 18 nt, Mycobacterium avium subsp. paratuberculosis
ggugaccucgagcagcgc

SEQ ID NO: 1008937 - RNA, 20 nt, Mycobacterium avium subsp. paratuberculosis
ggugaccucgagcagcgcgc

SEQ ID NO: 1008938 - RNA, 18 nt, Mycobacterium avium subsp. paratuberculosis
ggugacgaggaggguguc

SEQ ID NO: 1008939 - RNA, 17 nt, Mycobacterium avium subsp. paratuberculosis
ggcuccggccgcgccgg

SEQ ID NO: 1008940 - RNA, 19 nt, Mycobacterium avium subsp. paratuberculosis
ggcuccggccgcgccggcc

SEQ ID NO: 1008941 - RNA, 21 nt, Mycobacterium avium subsp. paratuberculosis
ggcuccuaugucggugcggcg

SEQ ID NO: 1008942 - RNA, 16 nt, Mycobacterium avium subsp. paratuberculosis
ggugaccaggcuugcc

SEQ ID NO: 1008943 - RNA, 18 nt, Mycobacterium avium subsp. paratuberculosis
ggugacaacggugguggc

SEQ ID NO: 1008944 - RNA, 17 nt, Mycobacterium avium subsp. paratuberculosis
ggugaccacggucggcg

SEQ ID NO: 1008945 - RNA, 20 nt, Mycobacterium avium subsp. paratuberculosis
ggugaccagcgcccccgaca

SEQ ID NO: 1008946 - RNA, 18 nt, Mycobacterium avium subsp. paratuberculosis
ggcucaggggaucucggg

SEQ ID NO: 1008947 - RNA, 20 nt, Mycobacterium avium subsp. paratuberculosis
ggcucagggugcgcuggccg

SEQ ID NO: 1008948 - RNA, 17 nt, Mycobacterium avium subsp. paratuberculosis
ggcucaggccgguggcg

SEQ ID NO: 1008949 - RNA, 16 nt, Mycobacterium avium subsp. paratuberculosis
ggcuccgaucuccugg

SEQ ID NO: 1008950 - RNA, 18 nt, Mycobacterium avium subsp. paratuberculosis
ggcucaggaucagcagcc

SEQ ID NO: 1008951 - RNA, 22 nt, Mycobacterium avium subsp. paratuberculosis
ggcuccgcguucgaccuccacg

SEQ ID NO: 1008952 - RNA, 13 nt, Mycobacterium avium subsp. paratuberculosis
ggugcaacaccga

SEQ ID NO: 1008953 - RNA, 20 nt, Mycobacterium avium subsp. paratuberculosis
ggugauuccggcacccgcca

SEQ ID NO: 1008954 - RNA, 14 nt, Mycobacterium avium subsp. paratuberculosis
ggugaugucgccga

SEQ ID NO: 1008955 - RNA, 22 nt, Mycobacterium avium subsp. paratuberculosis
ggugauggucccccugagcugg

SEQ ID NO: 1008956 - RNA, 14 nt, Mycobacterium avium subsp. paratuberculosis
ggugaugccggcgg

SEQ ID NO: 1008957 - RNA, 13 nt, Mycobacterium avium subsp. paratuberculosis
ggugaugcggccc

SEQ ID NO: 1008958 - RNA, 20 nt, Mycobacterium avium subsp. paratuberculosis
ggugauggacaucuccggca

SEQ ID NO: 1008959 - RNA, 15 nt, Mycobacterium avium subsp. paratuberculosis
ggugaucccaggaac

SEQ ID NO: 1008960 - RNA, 20 nt, Mycobacterium avium subsp. paratuberculosis
ggugauccggugccacgcgg

SEQ ID NO: 1008961 - RNA, 20 nt, Mycobacterium avium subsp. paratuberculosis
ggugaucuuggccuccaccg

SEQ ID NO: 1008962 - RNA, 21 nt, Mycobacterium avium subsp. paratuberculosis
ggugaucucgccgcgguggug

SEQ ID NO: 1008963 - RNA, 19 nt, Mycobacterium avium subsp. paratuberculosis
ggugaucugcaccagcgug

SEQ ID NO: 1008964 - RNA, 18 nt, Mycobacterium avium subsp. paratuberculosis
ggugaggggcgcgcgccg

SEQ ID NO: 1008965 - RNA, 12 nt, Mycobacterium avium subsp. paratuberculosis
ggugcagccccg

SEQ ID NO: 1008966 - RNA, 23 nt, Mycobacterium avium subsp. paratuberculosis
ggugcagccccgcacugaacggg

SEQ ID NO: 1008967 - RNA, 24 nt, Mycobacterium avium subsp. paratuberculosis
ggugcagaccggacagcugggcgu

SEQ ID NO: 1008968 - RNA, 13 nt, Mycobacterium avium subsp. paratuberculosis
ggugcacccgcgg

SEQ ID NO: 1008969 - RNA, 15 nt, Mycobacterium avium subsp. paratuberculosis
ggugcacagcccgug

SEQ ID NO: 1008970 - RNA, 15 nt, Mycobacterium avium subsp. paratuberculosis
ggugcacgccgagca

SEQ ID NO: 1008971 - RNA, 18 nt, Mycobacterium avium subsp. paratuberculosis
ggugcacgccgagcagca

SEQ ID NO: 1008972 - RNA, 22 nt, Mycobacterium avium subsp. paratuberculosis
ggugcacgccgagcagcaccgg

SEQ ID NO: 1008973 - RNA, 22 nt, Mycobacterium avium subsp. paratuberculosis
ggugcaccgccagcgcggcggc

SEQ ID NO: 1008974 - RNA, 19 nt, Mycobacterium avium subsp. paratuberculosis
ggugcacggucagcucgcg

SEQ ID NO: 1008975 - RNA, 22 nt, Mycobacterium avium subsp. paratuberculosis
ggugcagcuccuugagccgccg

SEQ ID NO: 1008976 - RNA, 17 nt, Mycobacterium avium subsp. paratuberculosis
ggugcagcgggcuggcg

SEQ ID NO: 1008977 - RNA, 13 nt, Mycobacterium avium subsp. paratuberculosis
ggugcagccgcgg

SEQ ID NO: 1008978 - RNA, 21 nt, Mycobacterium avium subsp. paratuberculosis
ggugcagccgggggcggugca

SEQ ID NO: 1008979 - RNA, 18 nt, Mycobacterium avium subsp. paratuberculosis
ggugcagccgggugcggu

SEQ ID NO: 1008980 - RNA, 13 nt, Mycobacterium avium subsp. paratuberculosis
ggugcagcgacuc

SEQ ID NO: 1008981 - RNA, 20 nt, Mycobacterium avium subsp. paratuberculosis
ggugcaggugcccgucggcc

SEQ ID NO: 1008982 - RNA, 22 nt, Mycobacterium avium subsp. paratuberculosis
ggugcaggugcccgucggccuc

SEQ ID NO: 1008983 - RNA, 15 nt, Mycobacterium avium subsp. paratuberculosis
ggugccacggucagg

SEQ ID NO: 1008984 - RNA, 16 nt, Mycobacterium avium subsp. paratuberculosis
ggugccacggucaggc

SEQ ID NO: 1008985 - RNA, 12 nt, Mycobacterium avium subsp. paratuberculosis
ggugccagcaac

SEQ ID NO: 1008986 - RNA, 21 nt, Mycobacterium avium subsp. paratuberculosis
ggugcauccagucggcgccga

SEQ ID NO: 1008987 - RNA, 17 nt, Mycobacterium avium subsp. paratuberculosis
ggugccaaggucgccgg

SEQ ID NO: 1008988 - RNA, 14 nt, Mycobacterium avium subsp. paratuberculosis
ggugcccagccgca

SEQ ID NO: 1008989 - RNA, 14 nt, Mycobacterium avium subsp. paratuberculosis
ggugcccggcgagg

SEQ ID NO: 1008990 - RNA, 22 nt, Mycobacterium avium subsp. paratuberculosis
ggugcccggcugggcgcgcaac

SEQ ID NO: 1008991 - RNA, 23 nt, Mycobacterium avium subsp. paratuberculosis
ggugcccgggucgugcggcggcg

SEQ ID NO: 1008992 - RNA, 12 nt, Mycobacterium avium subsp. paratuberculosis
ggugcccuccuc

SEQ ID NO: 1008993 - RNA, 18 nt, Mycobacterium avium subsp. paratuberculosis
ggugcccaucugcacagc

SEQ ID NO: 1008994 - RNA, 17 nt, Mycobacterium avium subsp. paratuberculosis
ggugcccccgcccggcc

SEQ ID NO: 1008995 - RNA, 19 nt, Mycobacterium avium subsp. paratuberculosis
ggugcccccgcccggccgg

SEQ ID NO: 1008996 - RNA, 19 nt, Mycobacterium avium subsp. paratuberculosis
ggugccccgcgaccgcagc

SEQ ID NO: 1008997 - RNA, 14 nt, Mycobacterium avium subsp. paratuberculosis
ggugcccgagcuga

SEQ ID NO: 1008998 - RNA, 13 nt, Mycobacterium avium subsp. paratuberculosis
ggugcccgcagca

SEQ ID NO: 1008999 - RNA, 16 nt, Mycobacterium avium subsp. paratuberculosis
ggugcccgcagcauca

SEQ ID NO: 1009000 - RNA, 12 nt, Mycobacterium avium subsp. paratuberculosis
ggugcccgccga

SEQ ID NO: 1009001 - RNA, 19 nt, Mycobacterium avium subsp. paratuberculosis
ggugcccgcguacagcggg

SEQ ID NO: 1009002 - RNA, 22 nt, Mycobacterium avium subsp. paratuberculosis
ggugcccggaacggcgggcccg

SEQ ID NO: 1009003 - RNA, 13 nt, Mycobacterium avium subsp. paratuberculosis
ggugcccagcgcg

SEQ ID NO: 1009004 - RNA, 17 nt, Mycobacterium avium subsp. paratuberculosis
ggugcccaccgggcagc

SEQ ID NO: 1009005 - RNA, 18 nt, Mycobacterium avium subsp. paratuberculosis
ggugcccaccgggcagcc

SEQ ID NO: 1009006 - RNA, 19 nt, Mycobacterium avium subsp. paratuberculosis
ggugcccaccgggcagccg

SEQ ID NO: 1009007 - RNA, 17 nt, Mycobacterium avium subsp. paratuberculosis
gguucuugcgccauccc

SEQ ID NO: 1009008 - RNA, 21 nt, Mycobacterium avium subsp. paratuberculosis
gguugacgccgaugcgguuga

SEQ ID NO: 1009009 - RNA, 14 nt, Mycobacterium avium subsp. paratuberculosis
gguucuccucccag

SEQ ID NO: 1009010 - RNA, 19 nt, Mycobacterium avium subsp. paratuberculosis
gguugccucggccagcacc

SEQ ID NO: 1009011 - RNA, 23 nt, Mycobacterium avium subsp. paratuberculosis
gguugccacgcggauagcccagc

SEQ ID NO: 1009012 - RNA, 20 nt, Mycobacterium avium subsp. paratuberculosis
gguuguugaagucgaucaug

SEQ ID NO: 1009013 - RNA, 11 nt, Mycobacterium avium subsp. paratuberculosis
gguuggcggcc

SEQ ID NO: 1009014 - RNA, 12 nt, Mycobacterium avium subsp. paratuberculosis
gguugucgccgc

SEQ ID NO: 1009015 - RNA, 16 nt, Mycobacterium avium subsp. paratuberculosis
gguugggcgccagcag

SEQ ID NO: 1009016 - RNA, 17 nt, Mycobacterium avium subsp. paratuberculosis
gguugggcgccagcagc

SEQ ID NO: 1009017 - RNA, 17 nt, Mycobacterium avium subsp. paratuberculosis
gguugcgguacaucccg

SEQ ID NO: 1009018 - RNA, 19 nt, Mycobacterium avium subsp. paratuberculosis
gguugcgguguugcgcagc

SEQ ID NO: 1009019 - RNA, 21 nt, Mycobacterium avium subsp. paratuberculosis
gguugcgguugucggucaggc

SEQ ID NO: 1009020 - RNA, 21 nt, Mycobacterium avium subsp. paratuberculosis
gguuggacaguucgguggggc

SEQ ID NO: 1009021 - RNA, 15 nt, Mycobacterium avium subsp. paratuberculosis
gguugcugagccgcc

SEQ ID NO: 1009022 - RNA, 21 nt, Mycobacterium avium subsp. paratuberculosis
gguuucgggucgagagccgca

SEQ ID NO: 1009023 - RNA, 15 nt, Mycobacterium avium subsp. paratuberculosis
gguuugaccacggcg

SEQ ID NO: 1009024 - RNA, 15 nt, Mycobacterium avium subsp. paratuberculosis
gguguuccccgggcg

SEQ ID NO: 1009025 - RNA, 19 nt, Mycobacterium avium subsp. paratuberculosis
gguguuccaccagcggccg

SEQ ID NO: 1009026 - RNA, 16 nt, Mycobacterium avium subsp. paratuberculosis
gguguucgagggcgcg

SEQ ID NO: 1009027 - RNA, 18 nt, Mycobacterium avium subsp. paratuberculosis
gguguugaucagguucac

SEQ ID NO: 1009028 - RNA, 15 nt, Mycobacterium avium subsp. paratuberculosis
ggugugcccgcccuu

SEQ ID NO: 1009029 - RNA, 15 nt, Mycobacterium avium subsp. paratuberculosis
ggugugccgaagggc

SEQ ID NO: 1009030 - RNA, 14 nt, Mycobacterium avium subsp. paratuberculosis
ggugugccgcugca

SEQ ID NO: 1009031 - RNA, 22 nt, Mycobacterium avium subsp. paratuberculosis
ggugugccgcugguaggcggcg

SEQ ID NO: 1009032 - RNA, 20 nt, Mycobacterium avium subsp. paratuberculosis
ggugucgucgggccgcagca

SEQ ID NO: 1009033 - RNA, 21 nt, Mycobacterium avium subsp. paratuberculosis
ggugucggcgccccggcgcug

SEQ ID NO: 1009034 - RNA, 16 nt, Mycobacterium avium subsp. paratuberculosis
ggugucguagcggcug

SEQ ID NO: 1009035 - RNA, 17 nt, Mycobacterium avium subsp. paratuberculosis
ggugugcggcagcucgg

SEQ ID NO: 1009036 - RNA, 16 nt, Mycobacterium avium subsp. paratuberculosis
ggugugcucggcggcg

SEQ ID NO: 1009037 - RNA, 18 nt, Mycobacterium avium subsp. paratuberculosis
ggugugcucggugaucca

SEQ ID NO: 1009038 - RNA, 16 nt, Mycobacterium avium subsp. paratuberculosis
gguguggaucuccagc

SEQ ID NO: 1009039 - RNA, 15 nt, Mycobacterium avium subsp. paratuberculosis
gguguggcagguggc

SEQ ID NO: 1009040 - RNA, 15 nt, Mycobacterium avium subsp. paratuberculosis
gguguagucgcugac

SEQ ID NO: 1009041 - RNA, 22 nt, Mycobacterium avium subsp. paratuberculosis
gguguagcgagugccggccagc

SEQ ID NO: 1009042 - RNA, 22 nt, Mycobacterium avium subsp. paratuberculosis
gguguagcggcggcugaagcgc

SEQ ID NO: 1009043 - RNA, 20 nt, Mycobacterium avium subsp. paratuberculosis
ggugucggugcccaggucgc

SEQ ID NO: 1009044 - RNA, 17 nt, Mycobacterium avium subsp. paratuberculosis
ggugucggugccgagca

SEQ ID NO: 1009045 - RNA, 21 nt, Mycobacterium avium subsp. paratuberculosis
ggugucgcccucgcgcagggc

SEQ ID NO: 1009046 - RNA, 14 nt, Mycobacterium avium subsp. paratuberculosis
ggugucccagcgcc

SEQ ID NO: 1009047 - RNA, 14 nt, Mycobacterium avium subsp. paratuberculosis
ggugguggaaggug

SEQ ID NO: 1009048 - RNA, 19 nt, Mycobacterium avium subsp. paratuberculosis
gguggucgagcuccuccgg

SEQ ID NO: 1009049 - RNA, 16 nt, Mycobacterium avium subsp. paratuberculosis
ggugguccacccagaa

SEQ ID NO: 1009050 - RNA, 23 nt, Mycobacterium avium subsp. paratuberculosis
ggugguccagucgauaguggcgu

SEQ ID NO: 1009051 - RNA, 18 nt, Mycobacterium avium subsp. paratuberculosis
gguggucaccaccaccag

SEQ ID NO: 1009052 - RNA, 15 nt, Mycobacterium avium subsp. paratuberculosis
gguuauccacgaauu

SEQ ID NO: 1009053 - RNA, 13 nt, Mycobacterium avium subsp. paratuberculosis
gguucaccagcac

SEQ ID NO: 1009054 - RNA, 18 nt, Mycobacterium avium subsp. paratuberculosis
gguuaguaaccggaggcc

SEQ ID NO: 1009055 - RNA, 16 nt, Mycobacterium avium subsp. paratuberculosis
gguuccuaaccgggca

SEQ ID NO: 1009056 - RNA, 20 nt, Mycobacterium avium subsp. paratuberculosis
gguuccgggcgaccccggcc

SEQ ID NO: 1009057 - RNA, 21 nt, Mycobacterium avium subsp. paratuberculosis
gguuccgguggacuccagcac

SEQ ID NO: 1009058 - RNA, 15 nt, Mycobacterium avium subsp. paratuberculosis
gguuccggaucaacc

SEQ ID NO: 1009059 - RNA, 18 nt, Mycobacterium avium subsp. paratuberculosis
gguuccggaucaaccaca

SEQ ID NO: 1009060 - RNA, 16 nt, Mycobacterium avium subsp. paratuberculosis
gguuccggcgugcagc

SEQ ID NO: 1009061 - RNA, 17 nt, Mycobacterium avium subsp. paratuberculosis
gguuccggcgugcagca

SEQ ID NO: 1009062 - RNA, 18 nt, Mycobacterium avium subsp. paratuberculosis
gguucccggcaccaccac

SEQ ID NO: 1009063 - RNA, 19 nt, Mycobacterium avium subsp. paratuberculosis
gguuccacagcugcaggcu

SEQ ID NO: 1009064 - RNA, 20 nt, Mycobacterium avium subsp. paratuberculosis
gguucaugugaccggggucg

SEQ ID NO: 1009065 - RNA, 18 nt, Mycobacterium avium subsp. paratuberculosis
gguucaucaccacgaacu

SEQ ID NO: 1009066 - RNA, 14 nt, Mycobacterium avium subsp. paratuberculosis
gguucagccguucu

SEQ ID NO: 1009067 - RNA, 23 nt, Mycobacterium avium subsp. paratuberculosis
gguucaggcccgcgccgacggcc

SEQ ID NO: 1009068 - RNA, 17 nt, Mycobacterium avium subsp. paratuberculosis
gguucgaucuccucggc

SEQ ID NO: 1009069 - RNA, 13 nt, Mycobacterium avium subsp. paratuberculosis
gguucgcccuccc

SEQ ID NO: 1009070 - RNA, 14 nt, Mycobacterium avium subsp. paratuberculosis
gguucgcccucccc

SEQ ID NO: 1009071 - RNA, 21 nt, Mycobacterium avium subsp. paratuberculosis
gguucgcccuccccggccagc

SEQ ID NO: 1009072 - RNA, 20 nt, Mycobacterium avium subsp. paratuberculosis
gguucgccggugaccgcgcc

SEQ ID NO: 1009073 - RNA, 17 nt, Mycobacterium avium subsp. paratuberculosis
gguucggacacggcgcc

SEQ ID NO: 1009074 - RNA, 16 nt, Mycobacterium avium subsp. paratuberculosis
gguucgcgccgaugca

SEQ ID NO: 1009075 - RNA, 21 nt, Mycobacterium avium subsp. paratuberculosis
gguucgucccgcgcgggggcc

SEQ ID NO: 1009076 - RNA, 16 nt, Mycobacterium avium subsp. paratuberculosis
gguucgucgcggcggc

SEQ ID NO: 1009077 - RNA, 18 nt, Mycobacterium avium subsp. paratuberculosis
gguucggucucggcggcg

SEQ ID NO: 1009078 - RNA, 19 nt, Mycobacterium avium subsp. paratuberculosis
gucguccagugacgccugc

SEQ ID NO: 1009079 - RNA, 13 nt, Mycobacterium avium subsp. paratuberculosis
gucgucagguccg

SEQ ID NO: 1009080 - RNA, 21 nt, Mycobacterium avium subsp. paratuberculosis
gucguccgacaccaccugcac

SEQ ID NO: 1009081 - RNA, 19 nt, Mycobacterium avium subsp. paratuberculosis
gucguccgcaaccgccggc

SEQ ID NO: 1009082 - RNA, 22 nt, Mycobacterium avium subsp. paratuberculosis
gucguccgcaaccgccggcagc

SEQ ID NO: 1009083 - RNA, 16 nt, Mycobacterium avium subsp. paratuberculosis
gucgucgaggcggauc

SEQ ID NO: 1009084 - RNA, 19 nt, Mycobacterium avium subsp. paratuberculosis
gucgucgauggccaccagg

SEQ ID NO: 1009085 - RNA, 14 nt, Mycobacterium avium subsp. paratuberculosis
gucgucggacagca

SEQ ID NO: 1009086 - RNA, 16 nt, Mycobacterium avium subsp. paratuberculosis
gucgucggcgaacggc

SEQ ID NO: 1009087 - RNA, 21 nt, Mycobacterium avium subsp. paratuberculosis
gucggcgagcagcagcgcggu

SEQ ID NO: 1009088 - RNA, 14 nt, Mycobacterium avium subsp. paratuberculosis
gucggcgacgccgu

SEQ ID NO: 1009089 - RNA, 16 nt, Mycobacterium avium subsp. paratuberculosis
gucggcgacgccgucg

SEQ ID NO: 1009090 - RNA, 14 nt, Mycobacterium avium subsp. paratuberculosis
gucggcgacggcgc

SEQ ID NO: 1009091 - RNA, 15 nt, Mycobacterium avium subsp. paratuberculosis
gucggcgacggcgcu

SEQ ID NO: 1009092 - RNA, 17 nt, Mycobacterium avium subsp. paratuberculosis
gucggcgaucagcuccu

SEQ ID NO: 1009093 - RNA, 15 nt, Mycobacterium avium subsp. paratuberculosis
gucggcgaucgcgcg

SEQ ID NO: 1009094 - RNA, 20 nt, Mycobacterium avium subsp. paratuberculosis
gucggcgaucggcgugccgg

SEQ ID NO: 1009095 - RNA, 17 nt, Mycobacterium avium subsp. paratuberculosis
gucggcgcccaggauuc

SEQ ID NO: 1009096 - RNA, 17 nt, Mycobacterium avium subsp. paratuberculosis
gucggcgccccgcccgc

SEQ ID NO: 1009097 - RNA, 13 nt, Mycobacterium avium subsp. paratuberculosis
gucggcgccgcgc

SEQ ID NO: 1009098 - RNA, 17 nt, Mycobacterium avium subsp. paratuberculosis
gucggcgccgcgccggc

SEQ ID NO: 1009099 - RNA, 16 nt, Mycobacterium avium subsp. paratuberculosis
gucggcgcggacguga

SEQ ID NO: 1009100 - RNA, 13 nt, Mycobacterium avium subsp. paratuberculosis
gucggcgcggcga

SEQ ID NO: 1009101 - RNA, 18 nt, Mycobacterium avium subsp. paratuberculosis
gucggcgggauggguggu

SEQ ID NO: 1009102 - RNA, 23 nt, Mycobacterium avium subsp. paratuberculosis
gucggcgggcaccucggccaggu

SEQ ID NO: 1009103 - RNA, 20 nt, Mycobacterium avium subsp. paratuberculosis
gucggcggggaaggugcggg

SEQ ID NO: 1009104 - RNA, 17 nt, Mycobacterium avium subsp. paratuberculosis
gucggggucggcgccgc

SEQ ID NO: 1009105 - RNA, 19 nt, Mycobacterium avium subsp. paratuberculosis
gucggggucggcgccgcgc

SEQ ID NO: 1009106 - RNA, 23 nt, Mycobacterium avium subsp. paratuberculosis
gucggggucgucgacggccgcgc

SEQ ID NO: 1009107 - RNA, 23 nt, Mycobacterium avium subsp. paratuberculosis
gucggggugcucgaucggcgcgc

SEQ ID NO: 1009108 - RNA, 16 nt, Mycobacterium avium subsp. paratuberculosis
gucggcggacuggcug

SEQ ID NO: 1009109 - RNA, 15 nt, Mycobacterium avium subsp. paratuberculosis
gucggcgcgguuguc

SEQ ID NO: 1009110 - RNA, 16 nt, Mycobacterium avium subsp. paratuberculosis
gucguacucccaggcc

SEQ ID NO: 1009111 - RNA, 15 nt, Mycobacterium avium subsp. paratuberculosis
gucggucaggcacuc

SEQ ID NO: 1009112 - RNA, 14 nt, Mycobacterium avium subsp. paratuberculosis
gucggucggcagga

SEQ ID NO: 1009113 - RNA, 17 nt, Mycobacterium avium subsp. paratuberculosis
gucguaguugcgcgccg

SEQ ID NO: 1009114 - RNA, 17 nt, Mycobacterium avium subsp. paratuberculosis
gucguagccgaagccgc

SEQ ID NO: 1009115 - RNA, 16 nt, Mycobacterium avium subsp. paratuberculosis
gucguagaacucgccg

SEQ ID NO: 1009116 - RNA, 15 nt, Mycobacterium avium subsp. paratuberculosis
gucguagagcaggac

SEQ ID NO: 1009117 - RNA, 15 nt, Mycobacterium avium subsp. paratuberculosis
gucguagagcgcgaa

SEQ ID NO: 1009118 - RNA, 13 nt, Mycobacterium avium subsp. paratuberculosis
gucggccaucagc

SEQ ID NO: 1009119 - RNA, 23 nt, Mycobacterium avium subsp. paratuberculosis
gucggcccaguccagucgcgccg

SEQ ID NO: 1009120 - RNA, 16 nt, Mycobacterium avium subsp. paratuberculosis
gucggcccgccaaaac

SEQ ID NO: 1009121 - RNA, 18 nt, Mycobacterium avium subsp. paratuberculosis
gucggcgaaggcgcgcag

SEQ ID NO: 1009122 - RNA, 19 nt, Mycobacterium avium subsp. paratuberculosis
gucggcgaaggugccccgc

SEQ ID NO: 1009123 - RNA, 14 nt, Mycobacterium avium subsp. paratuberculosis
gucggccuccuccu

SEQ ID NO: 1009124 - RNA, 17 nt, Mycobacterium avium subsp. paratuberculosis
gucggccuugaccagga

SEQ ID NO: 1009125 - RNA, 17 nt, Mycobacterium avium subsp. paratuberculosis
gucggcgaacaccugcu

SEQ ID NO: 1009126 - RNA, 15 nt, Mycobacterium avium subsp. paratuberculosis
gucggccggcugcag

SEQ ID NO: 1009127 - RNA, 16 nt, Mycobacterium avium subsp. paratuberculosis
gucggccgggggcgcg

SEQ ID NO: 1009128 - RNA, 12 nt, Mycobacterium avium subsp. paratuberculosis
gucggcccaggc

SEQ ID NO: 1009129 - RNA, 16 nt, Mycobacterium avium subsp. paratuberculosis
gucgcuaccucaccac

SEQ ID NO: 1009130 - RNA, 13 nt, Mycobacterium avium subsp. paratuberculosis
gucgcguccagca

SEQ ID NO: 1009131 - RNA, 20 nt, Mycobacterium avium subsp. paratuberculosis
gucgcgucgugcggccggcg

SEQ ID NO: 1009132 - RNA, 19 nt, Mycobacterium avium subsp. paratuberculosis
gucgcguucgacccacacc

SEQ ID NO: 1009133 - RNA, 23 nt, Mycobacterium avium subsp. paratuberculosis
gucggacgccaguggcugcacgu

SEQ ID NO: 1009134 - RNA, 18 nt, Mycobacterium avium subsp. paratuberculosis
gucggacgcggccgagcc

SEQ ID NO: 1009135 - RNA, 16 nt, Mycobacterium avium subsp. paratuberculosis
gucggacaugccggcg

SEQ ID NO: 1009136 - RNA, 15 nt, Mycobacterium avium subsp. paratuberculosis
gucggaauacagcag

SEQ ID NO: 1009137 - RNA, 14 nt, Mycobacterium avium subsp. paratuberculosis
gucggagcccagcg

SEQ ID NO: 1009138 - RNA, 17 nt, Mycobacterium avium subsp. paratuberculosis
gucggagaucaccggca

SEQ ID NO: 1009139 - RNA, 24 nt, Mycobacterium avium subsp. paratuberculosis
gucggagaucagggugcucagccg

SEQ ID NO: 1009140 - RNA, 16 nt, Mycobacterium avium subsp. paratuberculosis
gucggacuucugguug

SEQ ID NO: 1009141 - RNA, 19 nt, Mycobacterium avium subsp. paratuberculosis
gucgcgguccacgccggcg

SEQ ID NO: 1009142 - RNA, 21 nt, Mycobacterium avium subsp. paratuberculosis
gucgcggugggcucggcgccg

SEQ ID NO: 1009143 - RNA, 20 nt, Mycobacterium avium subsp. paratuberculosis
gucgcgggugaccggcgccg

SEQ ID NO: 1009144 - RNA, 19 nt, Mycobacterium avium subsp. paratuberculosis
gucgcgcgacugggcgccc

SEQ ID NO: 1009145 - RNA, 13 nt, Mycobacterium avium subsp. paratuberculosis
gucgcgcccagga

SEQ ID NO: 1009146 - RNA, 12 nt, Mycobacterium avium subsp. paratuberculosis
gucgcgcagcau

SEQ ID NO: 1009147 - RNA, 16 nt, Mycobacterium avium subsp. paratuberculosis
gucgcgcagcauggcc

SEQ ID NO: 1009148 - RNA, 16 nt, Mycobacterium avium subsp. paratuberculosis
gucgcgcagccgggcg

SEQ ID NO: 1009149 - RNA, 14 nt, Mycobacterium avium subsp. paratuberculosis
gucgcgcagcuggg

SEQ ID NO: 1009150 - RNA, 22 nt, Mycobacterium avium subsp. paratuberculosis
gucgcgcaggaugcccagcacc

SEQ ID NO: 1009151 - RNA, 15 nt, Mycobacterium avium subsp. paratuberculosis
gucgccagccgccgg

SEQ ID NO: 1009152 - RNA, 17 nt, Mycobacterium avium subsp. paratuberculosis
gucgcccacaccggaug

SEQ ID NO: 1009153 - RNA, 18 nt, Mycobacterium avium subsp. paratuberculosis
gucgcccacccggggccg

SEQ ID NO: 1009154 - RNA, 16 nt, Mycobacterium avium subsp. paratuberculosis
gucgcgcaccgcggcg

SEQ ID NO: 1009155 - RNA, 17 nt, Mycobacterium avium subsp. paratuberculosis
gucgccaccaccacggg

SEQ ID NO: 1009156 - RNA, 16 nt, Mycobacterium avium subsp. paratuberculosis
gucgccaccaccagcg

SEQ ID NO: 1009157 - RNA, 18 nt, Mycobacterium avium subsp. paratuberculosis
gucgccaccaccagcggg

SEQ ID NO: 1009158 - RNA, 15 nt, Mycobacterium avium subsp. paratuberculosis
gucgccaccaccgcg

SEQ ID NO: 1009159 - RNA, 15 nt, Mycobacterium avium subsp. paratuberculosis
gucgccaccaccuuc

SEQ ID NO: 1009160 - RNA, 11 nt, Mycobacterium avium subsp. paratuberculosis
gucgccaggcc

SEQ ID NO: 1009161 - RNA, 19 nt, Mycobacterium avium subsp. paratuberculosis
guccucgagagucgcuggc

SEQ ID NO: 1009162 - RNA, 21 nt, Mycobacterium avium subsp. paratuberculosis
guccucgagccguuugaugcc

SEQ ID NO: 1009163 - RNA, 21 nt, Mycobacterium avium subsp. paratuberculosis
guccucgaccacccgcugguc

SEQ ID NO: 1009164 - RNA, 16 nt, Mycobacterium avium subsp. paratuberculosis
guccucgacgccgcgc

SEQ ID NO: 1009165 - RNA, 20 nt, Mycobacterium avium subsp. paratuberculosis
guccucgauccgguccagcc

SEQ ID NO: 1009166 - RNA, 17 nt, Mycobacterium avium subsp. paratuberculosis
guccucgcgccguggcc

SEQ ID NO: 1009167 - RNA, 19 nt, Mycobacterium avium subsp. paratuberculosis
guccgguaggccggccgca

SEQ ID NO: 1009168 - RNA, 20 nt, Mycobacterium avium subsp. paratuberculosis
guccgguucgaccggcguca

SEQ ID NO: 1009169 - RNA, 22 nt, Mycobacterium avium subsp. paratuberculosis
guccggucagcaccgcgcggcg

SEQ ID NO: 1009170 - RNA, 17 nt, Mycobacterium avium subsp. paratuberculosis
guccggucucuggccug

SEQ ID NO: 1009171 - RNA, 17 nt, Mycobacterium avium subsp. paratuberculosis
guccgcgccggucccgc

SEQ ID NO: 1009172 - RNA, 15 nt, Mycobacterium avium subsp. paratuberculosis
guccgcgaacgggug

SEQ ID NO: 1009173 - RNA, 22 nt, Mycobacterium avium subsp. paratuberculosis
guccgcgaacgggugcggcgcu

SEQ ID NO: 1009174 - RNA, 21 nt, Mycobacterium avium subsp. paratuberculosis
guccgccggagaccagcagcu

SEQ ID NO: 1009175 - RNA, 15 nt, Mycobacterium avium subsp. paratuberculosis
guccgccgcagcggc

SEQ ID NO: 1009176 - RNA, 21 nt, Mycobacterium avium subsp. paratuberculosis
guccgauuucccgacuccuca

SEQ ID NO: 1009177 - RNA, 18 nt, Mycobacterium avium subsp. paratuberculosis
guccgaugacgagcagcg

SEQ ID NO: 1009178 - RNA, 18 nt, Mycobacterium avium subsp. paratuberculosis
guccgcaugucgaagaag

SEQ ID NO: 1009179 - RNA, 19 nt, Mycobacterium avium subsp. paratuberculosis
guccuggaucgcgcaggug

SEQ ID NO: 1009180 - RNA, 14 nt, Mycobacterium avium subsp. paratuberculosis
guccucgggguggu

SEQ ID NO: 1009181 - RNA, 14 nt, Mycobacterium avium subsp. paratuberculosis
guccugggccggga

SEQ ID NO: 1009182 - RNA, 15 nt, Mycobacterium avium subsp. paratuberculosis
gucgaacgggccggg

SEQ ID NO: 1009183 - RNA, 18 nt, Mycobacterium avium subsp. paratuberculosis
gucgaacgccagcgccgc

SEQ ID NO: 1009184 - RNA, 15 nt, Mycobacterium avium subsp. paratuberculosis
gucgaacaggaugca

SEQ ID NO: 1009185 - RNA, 13 nt, Mycobacterium avium subsp. paratuberculosis
gucgaacagcagg

SEQ ID NO: 1009186 - RNA, 16 nt, Mycobacterium avium subsp. paratuberculosis
gucgaacagcgcgccc

SEQ ID NO: 1009187 - RNA, 18 nt, Mycobacterium avium subsp. paratuberculosis
gucgaacagcgcgcccga

SEQ ID NO: 1009188 - RNA, 21 nt, Mycobacterium avium subsp. paratuberculosis
gucgaacaucacccggcggca

SEQ ID NO: 1009189 - RNA, 19 nt, Mycobacterium avium subsp. paratuberculosis
gucgaaccacgcggcggcg

SEQ ID NO: 1009190 - RNA, 13 nt, Mycobacterium avium subsp. paratuberculosis
gucgauggucugc

SEQ ID NO: 1009191 - RNA, 17 nt, Mycobacterium avium subsp. paratuberculosis
gucgaugucgacgccgu

SEQ ID NO: 1009192 - RNA, 16 nt, Mycobacterium avium subsp. paratuberculosis
gucgaguucgcggcgc

SEQ ID NO: 1009193 - RNA, 21 nt, Mycobacterium avium subsp. paratuberculosis
gucgaguucgcggcgcagcac

SEQ ID NO: 1009194 - RNA, 16 nt, Mycobacterium avium subsp. paratuberculosis
gucgaucucggccagc

SEQ ID NO: 1009195 - RNA, 22 nt, Mycobacterium avium subsp. paratuberculosis
gucgagguguugucgugccggg

SEQ ID NO: 1009196 - RNA, 16 nt, Mycobacterium avium subsp. paratuberculosis
gucgaguuccuccacg

SEQ ID NO: 1009197 - RNA, 19 nt, Mycobacterium avium subsp. paratuberculosis
gucgaguuccuccacgacu

SEQ ID NO: 1009198 - RNA, 14 nt, Mycobacterium avium subsp. paratuberculosis
gucgaugcccgcgc

SEQ ID NO: 1009199 - RNA, 16 nt, Mycobacterium avium subsp. paratuberculosis
gucgaugacggcggcg

SEQ ID NO: 1009200 - RNA, 16 nt, Mycobacterium avium subsp. paratuberculosis
gucgaugacgccgcgc

SEQ ID NO: 1009201 - RNA, 20 nt, Mycobacterium avium subsp. paratuberculosis
gucgaugaccucgcgcccgg

SEQ ID NO: 1009202 - RNA, 23 nt, Mycobacterium avium subsp. paratuberculosis
gucgaugaacucgcgggcgagca

SEQ ID NO: 1009203 - RNA, 15 nt, Mycobacterium avium subsp. paratuberculosis
gucgauggccaccag

SEQ ID NO: 1009204 - RNA, 20 nt, Mycobacterium avium subsp. paratuberculosis
gucgaugccgaucggggcgc

SEQ ID NO: 1009205 - RNA, 18 nt, Mycobacterium avium subsp. paratuberculosis
gucgaugcgcgccaccag

SEQ ID NO: 1009206 - RNA, 16 nt, Mycobacterium avium subsp. paratuberculosis
gucgagaaaagcggcg

SEQ ID NO: 1009207 - RNA, 16 nt, Mycobacterium avium subsp. paratuberculosis
gucgagaaacgcgcgc

SEQ ID NO: 1009208 - RNA, 23 nt, Mycobacterium avium subsp. paratuberculosis
gucgagaaaggccagcacgcagg

SEQ ID NO: 1009209 - RNA, 18 nt, Mycobacterium avium subsp. paratuberculosis
gucgagacaccgucgcgc

SEQ ID NO: 1009210 - RNA, 20 nt, Mycobacterium avium subsp. paratuberculosis
gucgagaucagcaccgggug

SEQ ID NO: 1009211 - RNA, 22 nt, Mycobacterium avium subsp. paratuberculosis
gucgagggugaugucgcugccg

SEQ ID NO: 1009212 - RNA, 18 nt, Mycobacterium avium subsp. paratuberculosis
gucgagggggagcaggac

SEQ ID NO: 1009213 - RNA, 13 nt, Mycobacterium avium subsp. paratuberculosis
gucgagcaccgcg

SEQ ID NO: 1009214 - RNA, 13 nt, Mycobacterium avium subsp. paratuberculosis
gucgacugcaccg

SEQ ID NO: 1009215 - RNA, 16 nt, Mycobacterium avium subsp. paratuberculosis
gucgacugcaccgacu

SEQ ID NO: 1009216 - RNA, 14 nt, Mycobacterium avium subsp. paratuberculosis
gucgaaggcgcggg

SEQ ID NO: 1009217 - RNA, 18 nt, Mycobacterium avium subsp. paratuberculosis
gucgaaguccugcgccgc

SEQ ID NO: 1009218 - RNA, 17 nt, Mycobacterium avium subsp. paratuberculosis
gucgaaguagggccgca

SEQ ID NO: 1009219 - RNA, 22 nt, Mycobacterium avium subsp. paratuberculosis
gucgaagccguggcaggcacga

SEQ ID NO: 1009220 - RNA, 13 nt, Mycobacterium avium subsp. paratuberculosis
gucgaaggccggg

SEQ ID NO: 1009221 - RNA, 19 nt, Mycobacterium avium subsp. paratuberculosis
gucgaagaggugcucgacg

SEQ ID NO: 1009222 - RNA, 18 nt, Mycobacterium avium subsp. paratuberculosis
gucgaagaugaccugauc

SEQ ID NO: 1009223 - RNA, 16 nt, Mycobacterium avium subsp. paratuberculosis
gucgaagauggccagg

SEQ ID NO: 1009224 - RNA, 15 nt, Mycobacterium avium subsp. paratuberculosis
gucgaagaagcggcc

SEQ ID NO: 1009225 - RNA, 16 nt, Mycobacterium avium subsp. paratuberculosis
gucgaagaagcggccg

SEQ ID NO: 1009226 - RNA, 20 nt, Mycobacterium avium subsp. paratuberculosis
gucgaagaagcggccgacga

SEQ ID NO: 1009227 - RNA, 19 nt, Mycobacterium avium subsp. paratuberculosis
gucgaagaaguaguucugc

SEQ ID NO: 1009228 - RNA, 15 nt, Mycobacterium avium subsp. paratuberculosis
gucccacucgggaaa

SEQ ID NO: 1009229 - RNA, 14 nt, Mycobacterium avium subsp. paratuberculosis
gucccacaccacca

SEQ ID NO: 1009230 - RNA, 19 nt, Mycobacterium avium subsp. paratuberculosis
gucccacaccaccaccgag

SEQ ID NO: 1009231 - RNA, 21 nt, Mycobacterium avium subsp. paratuberculosis
gucccacaccaccaccgagcc

SEQ ID NO: 1009232 - RNA, 23 nt, Mycobacterium avium subsp. paratuberculosis
gucccacacgggugugacauccc

SEQ ID NO: 1009233 - RNA, 17 nt, Mycobacterium avium subsp. paratuberculosis
gucccacaucuccuugg

SEQ ID NO: 1009234 - RNA, 16 nt, Mycobacterium avium subsp. paratuberculosis
guccauguaguucagc

SEQ ID NO: 1009235 - RNA, 15 nt, Mycobacterium avium subsp. paratuberculosis
guccagggugguggu

SEQ ID NO: 1009236 - RNA, 22 nt, Mycobacterium avium subsp. paratuberculosis
guccaugugccgcaucugguau

SEQ ID NO: 1009237 - RNA, 22 nt, Mycobacterium avium subsp. paratuberculosis
guccaguugugccgcaaggcau

SEQ ID NO: 1009238 - RNA, 22 nt, Mycobacterium avium subsp. paratuberculosis
guccagguagcccaugucgccg

SEQ ID NO: 1009239 - RNA, 15 nt, Mycobacterium avium subsp. paratuberculosis
guccagucgcgccga

SEQ ID NO: 1009240 - RNA, 20 nt, Mycobacterium avium subsp. paratuberculosis
guccagugacgccugcggcc

SEQ ID NO: 1009241 - RNA, 17 nt, Mycobacterium avium subsp. paratuberculosis
guccagggugccgaugu

SEQ ID NO: 1009242 - RNA, 16 nt, Mycobacterium avium subsp. paratuberculosis
guccaggguggccagc

SEQ ID NO: 1009243 - RNA, 20 nt, Mycobacterium avium subsp. paratuberculosis
guccagguccuugaggaugc

SEQ ID NO: 1009244 - RNA, 22 nt, Mycobacterium avium subsp. paratuberculosis
guccaggucgaucucggccagc

SEQ ID NO: 1009245 - RNA, 17 nt, Mycobacterium avium subsp. paratuberculosis
guccaggugcgccgccg

SEQ ID NO: 1009246 - RNA, 18 nt, Mycobacterium avium subsp. paratuberculosis
guccaggugcgccgccgc

SEQ ID NO: 1009247 - RNA, 15 nt, Mycobacterium avium subsp. paratuberculosis
guccaguacaccgcg

SEQ ID NO: 1009248 - RNA, 15 nt, Mycobacterium avium subsp. paratuberculosis
guccaguagccgccg

SEQ ID NO: 1009249 - RNA, 14 nt, Mycobacterium avium subsp. paratuberculosis
guccagaugccguu

SEQ ID NO: 1009250 - RNA, 14 nt, Mycobacterium avium subsp. paratuberculosis
guccagcaccugcu

SEQ ID NO: 1009251 - RNA, 17 nt, Mycobacterium avium subsp. paratuberculosis
guccagcaccugcucga

SEQ ID NO: 1009252 - RNA, 19 nt, Mycobacterium avium subsp. paratuberculosis
gucccggugucgccgucgc

SEQ ID NO: 1009253 - RNA, 18 nt, Mycobacterium avium subsp. paratuberculosis
gucccggguaccucugcg

SEQ ID NO: 1009254 - RNA, 19 nt, Mycobacterium avium subsp. paratuberculosis
gucccguccaucgccgcgc

SEQ ID NO: 1009255 - RNA, 20 nt, Mycobacterium avium subsp. paratuberculosis
gucccggcgggggcggcggg

SEQ ID NO: 1009256 - RNA, 22 nt, Mycobacterium avium subsp. paratuberculosis
guccccgggcccagcaccacca

SEQ ID NO: 1009257 - RNA, 20 nt, Mycobacterium avium subsp. paratuberculosis
gucccccgagcgggccuuca

SEQ ID NO: 1009258 - RNA, 14 nt, Mycobacterium avium subsp. paratuberculosis
gucccccugagcug

SEQ ID NO: 1009259 - RNA, 23 nt, Mycobacterium avium subsp. paratuberculosis
guccccgaccaucauggccuccc

SEQ ID NO: 1009260 - RNA, 16 nt, Mycobacterium avium subsp. paratuberculosis
gucccgugcgccgccc

SEQ ID NO: 1009261 - RNA, 22 nt, Mycobacterium avium subsp. paratuberculosis
gucccugcggcugcaucaugcc

SEQ ID NO: 1009262 - RNA, 16 nt, Mycobacterium avium subsp. paratuberculosis
guccgacaccaccugc

SEQ ID NO: 1009263 - RNA, 17 nt, Mycobacterium avium subsp. paratuberculosis
guccgacaccaccugca

SEQ ID NO: 1009264 - RNA, 14 nt, Mycobacterium avium subsp. paratuberculosis
guccgacagcgccu

SEQ ID NO: 1009265 - RNA, 15 nt, Mycobacterium avium subsp. paratuberculosis
guccgaccagcggcc

SEQ ID NO: 1009266 - RNA, 13 nt, Mycobacterium avium subsp. paratuberculosis
guccgaccaggaa

SEQ ID NO: 1009267 - RNA, 15 nt, Mycobacterium avium subsp. paratuberculosis
guccgaccaggaaca

SEQ ID NO: 1009268 - RNA, 18 nt, Mycobacterium avium subsp. paratuberculosis
guccgaccgccaccaccc

SEQ ID NO: 1009269 - RNA, 19 nt, Mycobacterium avium subsp. paratuberculosis
guccgaccgcguacagggc

SEQ ID NO: 1009270 - RNA, 14 nt, Mycobacterium avium subsp. paratuberculosis
guccgacggcugcg

SEQ ID NO: 1009271 - RNA, 11 nt, Mycobacterium avium subsp. paratuberculosis
guccaccugca

SEQ ID NO: 1009272 - RNA, 18 nt, Mycobacterium avium subsp. paratuberculosis
guccagaucggccagcgc

SEQ ID NO: 1009273 - RNA, 22 nt, Mycobacterium avium subsp. paratuberculosis
guccagcaccugaccgucggcc

SEQ ID NO: 1009274 - RNA, 17 nt, Mycobacterium avium subsp. paratuberculosis
guccacgucgcccagcg

SEQ ID NO: 1009275 - RNA, 15 nt, Mycobacterium avium subsp. paratuberculosis
guccacguugaugcc

SEQ ID NO: 1009276 - RNA, 19 nt, Mycobacterium avium subsp. paratuberculosis
guccacguugaugccgccc

SEQ ID NO: 1009277 - RNA, 12 nt, Mycobacterium avium subsp. paratuberculosis
guccacgcuggc

SEQ ID NO: 1009278 - RNA, 13 nt, Mycobacterium avium subsp. paratuberculosis
guccacgcuggcg

SEQ ID NO: 1009279 - RNA, 19 nt, Mycobacterium avium subsp. paratuberculosis
guccacgaccccggcggca

SEQ ID NO: 1009280 - RNA, 19 nt, Mycobacterium avium subsp. paratuberculosis
guccacgaugcggugccgg

SEQ ID NO: 1009281 - RNA, 16 nt, Mycobacterium avium subsp. paratuberculosis
gucaugccgagccgcu

SEQ ID NO: 1009282 - RNA, 15 nt, Mycobacterium avium subsp. paratuberculosis
gucaggaacgccggc

SEQ ID NO: 1009283 - RNA, 14 nt, Mycobacterium avium subsp. paratuberculosis
gucaggaacccggc

SEQ ID NO: 1009284 - RNA, 19 nt, Mycobacterium avium subsp. paratuberculosis
gucaggauccaguuccagu

SEQ ID NO: 1009285 - RNA, 19 nt, Mycobacterium avium subsp. paratuberculosis
gucagcuuggagccgagca

SEQ ID NO: 1009286 - RNA, 22 nt, Mycobacterium avium subsp. paratuberculosis
gucagaucguugaugucggugg

SEQ ID NO: 1009287 - RNA, 15 nt, Mycobacterium avium subsp. paratuberculosis
gucagaaccggggcc

SEQ ID NO: 1009288 - RNA, 23 nt, Mycobacterium avium subsp. paratuberculosis
gucagaaccggggccagcacgcc

SEQ ID NO: 1009289 - RNA, 18 nt, Mycobacterium avium subsp. paratuberculosis
gucagaccacaacacggg

SEQ ID NO: 1009290 - RNA, 21 nt, Mycobacterium avium subsp. paratuberculosis
gucagacgaugggccgcccgc

SEQ ID NO: 1009291 - RNA, 16 nt, Mycobacterium avium subsp. paratuberculosis
gucagcgucgccgccc

SEQ ID NO: 1009292 - RNA, 21 nt, Mycobacterium avium subsp. paratuberculosis
gucagcucccccgacaccgcc

SEQ ID NO: 1009293 - RNA, 15 nt, Mycobacterium avium subsp. paratuberculosis
gucagcucccccguc

SEQ ID NO: 1009294 - RNA, 13 nt, Mycobacterium avium subsp. paratuberculosis
gucagcggcgggc

SEQ ID NO: 1009295 - RNA, 18 nt, Mycobacterium avium subsp. paratuberculosis
gucagcggcaacacgccg

SEQ ID NO: 1009296 - RNA, 17 nt, Mycobacterium avium subsp. paratuberculosis
gucagcggcagguccca

SEQ ID NO: 1009297 - RNA, 21 nt, Mycobacterium avium subsp. paratuberculosis
gucagcggcaggucccaggcc

SEQ ID NO: 1009298 - RNA, 15 nt, Mycobacterium avium subsp. paratuberculosis
gucagcggccagccc

SEQ ID NO: 1009299 - RNA, 23 nt, Mycobacterium avium subsp. paratuberculosis
gucagcggcccgaucaccaggcc

SEQ ID NO: 1009300 - RNA, 13 nt, Mycobacterium avium subsp. paratuberculosis
gucagcggccucg

SEQ ID NO: 1009301 - RNA, 20 nt, Mycobacterium avium subsp. paratuberculosis
gucagcaccaccaacagcag

SEQ ID NO: 1009302 - RNA, 17 nt, Mycobacterium avium subsp. paratuberculosis
gucagcgcgggccagca

SEQ ID NO: 1009303 - RNA, 17 nt, Mycobacterium avium subsp. paratuberculosis
gucacaccgcggccagc

SEQ ID NO: 1009304 - RNA, 20 nt, Mycobacterium avium subsp. paratuberculosis
gucacaccgcggccagcgcg

SEQ ID NO: 1009305 - RNA, 22 nt, Mycobacterium avium subsp. paratuberculosis
gucacaccgcggccagcgcgcg

SEQ ID NO: 1009306 - RNA, 14 nt, Mycobacterium avium subsp. paratuberculosis
gucacaggccgccu

SEQ ID NO: 1009307 - RNA, 16 nt, Mycobacterium avium subsp. paratuberculosis
gucaacgagacacccu

SEQ ID NO: 1009308 - RNA, 15 nt, Mycobacterium avium subsp. paratuberculosis
gucaaggugcugaac

SEQ ID NO: 1009309 - RNA, 16 nt, Mycobacterium avium subsp. paratuberculosis
gucaccucgaccagau

SEQ ID NO: 1009310 - RNA, 21 nt, Mycobacterium avium subsp. paratuberculosis
gucacaucgcguuagcaaggg

SEQ ID NO: 1009311 - RNA, 13 nt, Mycobacterium avium subsp. paratuberculosis
guauuggccacgc

SEQ ID NO: 1009312 - RNA, 18 nt, Mycobacterium avium subsp. paratuberculosis
guauuggccacgcuggcg

SEQ ID NO: 1009313 - RNA, 17 nt, Mycobacterium avium subsp. paratuberculosis
gucaacaccguggugga

SEQ ID NO: 1009314 - RNA, 14 nt, Mycobacterium avium subsp. paratuberculosis
guaugccuccucgg

SEQ ID NO: 1009315 - RNA, 16 nt, Mycobacterium avium subsp. paratuberculosis
guauccgaucgcggcc

SEQ ID NO: 1009316 - RNA, 19 nt, Mycobacterium avium subsp. paratuberculosis
guauccgccgccagcgcca

SEQ ID NO: 1009317 - RNA, 16 nt, Mycobacterium avium subsp. paratuberculosis
guauccggucagcgcc

SEQ ID NO: 1009318 - RNA, 14 nt, Mycobacterium avium subsp. paratuberculosis
guaguucagcagcc

SEQ ID NO: 1009319 - RNA, 23 nt, Mycobacterium avium subsp. paratuberculosis
guagcucagccacgccggcacac

SEQ ID NO: 1009320 - RNA, 23 nt, Mycobacterium avium subsp. paratuberculosis
guagcucagugguagagcucugg

SEQ ID NO: 1009321 - RNA, 16 nt, Mycobacterium avium subsp. paratuberculosis
guagcugagcagcagg

SEQ ID NO: 1009322 - RNA, 19 nt, Mycobacterium avium subsp. paratuberculosis
guaggacaccacgguggcg

SEQ ID NO: 1009323 - RNA, 14 nt, Mycobacterium avium subsp. paratuberculosis
guaggacagcagcc

SEQ ID NO: 1009324 - RNA, 14 nt, Mycobacterium avium subsp. paratuberculosis
guagccggggacgg

SEQ ID NO: 1009325 - RNA, 21 nt, Mycobacterium avium subsp. paratuberculosis
guagccggggacggugcagcc

SEQ ID NO: 1009326 - RNA, 16 nt, Mycobacterium avium subsp. paratuberculosis
guagcgagcgcuggcc

SEQ ID NO: 1009327 - RNA, 14 nt, Mycobacterium avium subsp. paratuberculosis
guagccugcagugu

SEQ ID NO: 1009328 - RNA, 20 nt, Mycobacterium avium subsp. paratuberculosis
guagccgcucgcccagcgcg

SEQ ID NO: 1009329 - RNA, 23 nt, Mycobacterium avium subsp. paratuberculosis
guagccgcucgcccagcgcggcg

SEQ ID NO: 1009330 - RNA, 21 nt, Mycobacterium avium subsp. paratuberculosis
guagccggcccgcagccagcg

SEQ ID NO: 1009331 - RNA, 14 nt, Mycobacterium avium subsp. paratuberculosis
guagcccugcaggu

SEQ ID NO: 1009332 - RNA, 22 nt, Mycobacterium avium subsp. paratuberculosis
guagcgggucagcuccaccugc

SEQ ID NO: 1009333 - RNA, 16 nt, Mycobacterium avium subsp. paratuberculosis
guagcggucgugcggg

SEQ ID NO: 1009334 - RNA, 17 nt, Mycobacterium avium subsp. paratuberculosis
guagcggucgugcggga

SEQ ID NO: 1009335 - RNA, 19 nt, Mycobacterium avium subsp. paratuberculosis
guagcggauggcgacggcg

SEQ ID NO: 1009336 - RNA, 15 nt, Mycobacterium avium subsp. paratuberculosis
guagcgcugggugaa

SEQ ID NO: 1009337 - RNA, 21 nt, Mycobacterium avium subsp. paratuberculosis
guagcggcugaccgagcggcg

SEQ ID NO: 1009338 - RNA, 12 nt, Mycobacterium avium subsp. paratuberculosis
guagcgcagcau

SEQ ID NO: 1009339 - RNA, 15 nt, Mycobacterium avium subsp. paratuberculosis
guagcgccgccgggg

SEQ ID NO: 1009340 - RNA, 13 nt, Mycobacterium avium subsp. paratuberculosis
guagcgcgccggg

SEQ ID NO: 1009341 - RNA, 22 nt, Mycobacterium avium subsp. paratuberculosis
guaggccagcccggcgugcagg

SEQ ID NO: 1009342 - RNA, 23 nt, Mycobacterium avium subsp. paratuberculosis
guaggccagcccggcgugcagga

SEQ ID NO: 1009343 - RNA, 18 nt, Mycobacterium avium subsp. paratuberculosis
guaggcccgaucaggguc

SEQ ID NO: 1009344 - RNA, 19 nt, Mycobacterium avium subsp. paratuberculosis
guaggccgcguagcucgcc

SEQ ID NO: 1009345 - RNA, 16 nt, Mycobacterium avium subsp. paratuberculosis
guaggcggccagcagc

SEQ ID NO: 1009346 - RNA, 14 nt, Mycobacterium avium subsp. paratuberculosis
guaggcgccgcucg

SEQ ID NO: 1009347 - RNA, 23 nt, Mycobacterium avium subsp. paratuberculosis
guaggcgccgcucgaccccucgg

SEQ ID NO: 1009348 - RNA, 20 nt, Mycobacterium avium subsp. paratuberculosis
guaggcgaccaugcccagca

SEQ ID NO: 1009349 - RNA, 14 nt, Mycobacterium avium subsp. paratuberculosis
guaggcgcccugcg

SEQ ID NO: 1009350 - RNA, 17 nt, Mycobacterium avium subsp. paratuberculosis
guaggcgccgccgcgca

SEQ ID NO: 1009351 - RNA, 13 nt, Mycobacterium avium subsp. paratuberculosis
guaggugugcagc

SEQ ID NO: 1009352 - RNA, 18 nt, Mycobacterium avium subsp. paratuberculosis
guaggugcccgagcugau

SEQ ID NO: 1009353 - RNA, 13 nt, Mycobacterium avium subsp. paratuberculosis
guagguggccagc

SEQ ID NO: 1009354 - RNA, 17 nt, Mycobacterium avium subsp. paratuberculosis
guagggcagcccgagca

SEQ ID NO: 1009355 - RNA, 17 nt, Mycobacterium avium subsp. paratuberculosis
guagugcagcugcagcg

SEQ ID NO: 1009356 - RNA, 20 nt, Mycobacterium avium subsp. paratuberculosis
guagucgucgaucucgguga

SEQ ID NO: 1009357 - RNA, 14 nt, Mycobacterium avium subsp. paratuberculosis
guagucggcccagg

SEQ ID NO: 1009358 - RNA, 16 nt, Mycobacterium avium subsp. paratuberculosis
guagucggcccgccgg

SEQ ID NO: 1009359 - RNA, 17 nt, Mycobacterium avium subsp. paratuberculosis
guagucggcgcagcgca

SEQ ID NO: 1009360 - RNA, 17 nt, Mycobacterium avium subsp. paratuberculosis
guagucgcucggcggcg

SEQ ID NO: 1009361 - RNA, 22 nt, Mycobacterium avium subsp. paratuberculosis
guaguagccggggacggugcag

SEQ ID NO: 1009362 - RNA, 13 nt, Mycobacterium avium subsp. paratuberculosis
guaguccagcaca

SEQ ID NO: 1009363 - RNA, 14 nt, Mycobacterium avium subsp. paratuberculosis
guaguccagggugu

SEQ ID NO: 1009364 - RNA, 12 nt, Mycobacterium avium subsp. paratuberculosis
guaguccagguc

SEQ ID NO: 1009365 - RNA, 16 nt, Mycobacterium avium subsp. paratuberculosis
guagucgaccacccgc

SEQ ID NO: 1009366 - RNA, 18 nt, Mycobacterium avium subsp. paratuberculosis
guacuagccuggcacggc

SEQ ID NO: 1009367 - RNA, 11 nt, Mycobacterium avium subsp. paratuberculosis
guacuccugcg

SEQ ID NO: 1009368 - RNA, 19 nt, Mycobacterium avium subsp. paratuberculosis
guacucccaggccgcggcc

SEQ ID NO: 1009369 - RNA, 22 nt, Mycobacterium avium subsp. paratuberculosis
guacugaccagcccgcucagag

SEQ ID NO: 1009370 - RNA, 17 nt, Mycobacterium avium subsp. paratuberculosis
guacugcuugccgccgg

SEQ ID NO: 1009371 - RNA, 20 nt, Mycobacterium avium subsp. paratuberculosis
guagaaccagugcgccuugu

SEQ ID NO: 1009372 - RNA, 23 nt, Mycobacterium avium subsp. paratuberculosis
guagaacauccacggcaugguga

SEQ ID NO: 1009373 - RNA, 19 nt, Mycobacterium avium subsp. paratuberculosis
guagagcgggauccccacc

SEQ ID NO: 1009374 - RNA, 20 nt, Mycobacterium avium subsp. paratuberculosis
guagagcgggauccccaccg

SEQ ID NO: 1009375 - RNA, 20 nt, Mycobacterium avium subsp. paratuberculosis
guagauaagcggauugacca

SEQ ID NO: 1009376 - RNA, 20 nt, Mycobacterium avium subsp. paratuberculosis
guagaggcuguccagcagcg

SEQ ID NO: 1009377 - RNA, 18 nt, Mycobacterium avium subsp. paratuberculosis
guagaggugcagcgggcu

SEQ ID NO: 1009378 - RNA, 23 nt, Mycobacterium avium subsp. paratuberculosis
guagacccggggguccagggugc

SEQ ID NO: 1009379 - RNA, 16 nt, Mycobacterium avium subsp. paratuberculosis
guagacccacagcugc

SEQ ID NO: 1009380 - RNA, 18 nt, Mycobacterium avium subsp. paratuberculosis
guagacgaugcccagccc

SEQ ID NO: 1009381 - RNA, 16 nt, Mycobacterium avium subsp. paratuberculosis
guagacggcaugccgg

SEQ ID NO: 1009382 - RNA, 20 nt, Mycobacterium avium subsp. paratuberculosis
guagacguucuccccgccgg

SEQ ID NO: 1009383 - RNA, 17 nt, Mycobacterium avium subsp. paratuberculosis
guagaugcggcccagcc

SEQ ID NO: 1009384 - RNA, 14 nt, Mycobacterium avium subsp. paratuberculosis
guagcagcagaccg

SEQ ID NO: 1009385 - RNA, 13 nt, Mycobacterium avium subsp. paratuberculosis
guagccagcaccg

SEQ ID NO: 1009386 - RNA, 19 nt, Mycobacterium avium subsp. paratuberculosis
guagcagucggccugcagc

SEQ ID NO: 1009387 - RNA, 11 nt, Mycobacterium avium subsp. paratuberculosis
guuuggccagc

SEQ ID NO: 1009388 - RNA, 19 nt, Mycobacterium avium subsp. paratuberculosis
guuuggccugaaccagcuc

SEQ ID NO: 1009389 - RNA, 20 nt, Mycobacterium avium subsp. paratuberculosis
guuucuuugaucucaucguc

SEQ ID NO: 1009390 - RNA, 14 nt, Mycobacterium avium subsp. paratuberculosis
uaacccagcaccac

SEQ ID NO: 1009391 - RNA, 14 nt, Mycobacterium avium subsp. paratuberculosis
uaaaggaugucgcc

SEQ ID NO: 1009392 - RNA, 11 nt, Mycobacterium avium subsp. paratuberculosis
guugggcagcu

SEQ ID NO: 1009393 - RNA, 16 nt, Mycobacterium avium subsp. paratuberculosis
guugggcgccugcggu

SEQ ID NO: 1009394 - RNA, 18 nt, Mycobacterium avium subsp. paratuberculosis
guugggcgccugcgguga

SEQ ID NO: 1009395 - RNA, 19 nt, Mycobacterium avium subsp. paratuberculosis
guuguagcaggcgguggug

SEQ ID NO: 1009396 - RNA, 21 nt, Mycobacterium avium subsp. paratuberculosis
guugugccgcaaggcauucca

SEQ ID NO: 1009397 - RNA, 17 nt, Mycobacterium avium subsp. paratuberculosis
guugugaauccagccgu

SEQ ID NO: 1009398 - RNA, 11 nt, Mycobacterium avium subsp. paratuberculosis
guuggcaggcc

SEQ ID NO: 1009399 - RNA, 22 nt, Mycobacterium avium subsp. paratuberculosis
guuggagccgaccagcgcgauc

SEQ ID NO: 1009400 - RNA, 15 nt, Mycobacterium avium subsp. paratuberculosis
guuggacgcccgcuc

SEQ ID NO: 1009401 - RNA, 17 nt, Mycobacterium avium subsp. paratuberculosis
guugccgacggcgccgg

SEQ ID NO: 1009402 - RNA, 13 nt, Mycobacterium avium subsp. paratuberculosis
guugccagccggu

SEQ ID NO: 1009403 - RNA, 16 nt, Mycobacterium avium subsp. paratuberculosis
guugcccgaucagccg

SEQ ID NO: 1009404 - RNA, 15 nt, Mycobacterium avium subsp. paratuberculosis
guugcccgccagcau

SEQ ID NO: 1009405 - RNA, 14 nt, Mycobacterium avium subsp. paratuberculosis
guugccccaaaacg

SEQ ID NO: 1009406 - RNA, 23 nt, Mycobacterium avium subsp. paratuberculosis
guuguucuccagcggccgcagcg

SEQ ID NO: 1009407 - RNA, 19 nt, Mycobacterium avium subsp. paratuberculosis
guuguggugcacgaacggc

SEQ ID NO: 1009408 - RNA, 13 nt, Mycobacterium avium subsp. paratuberculosis
guuguuggcggug

SEQ ID NO: 1009409 - RNA, 16 nt, Mycobacterium avium subsp. paratuberculosis
guugaugucggccagg

SEQ ID NO: 1009410 - RNA, 24 nt, Mycobacterium avium subsp. paratuberculosis
guugaugcgcaccgcggcgugcgc

SEQ ID NO: 1009411 - RNA, 17 nt, Mycobacterium avium subsp. paratuberculosis
guugagcacgcccgcga

SEQ ID NO: 1009412 - RNA, 19 nt, Mycobacterium avium subsp. paratuberculosis
guugagcagauccugcagc

SEQ ID NO: 1009413 - RNA, 20 nt, Mycobacterium avium subsp. paratuberculosis
guugagcagauccugcagcu

SEQ ID NO: 1009414 - RNA, 17 nt, Mycobacterium avium subsp. paratuberculosis
guugaucucgucgauga

SEQ ID NO: 1009415 - RNA, 14 nt, Mycobacterium avium subsp. paratuberculosis
guugaugaaaacca

SEQ ID NO: 1009416 - RNA, 19 nt, Mycobacterium avium subsp. paratuberculosis
guugacguagacgacgggc

SEQ ID NO: 1009417 - RNA, 14 nt, Mycobacterium avium subsp. paratuberculosis
guugaccaccagcg

SEQ ID NO: 1009418 - RNA, 18 nt, Mycobacterium avium subsp. paratuberculosis
guugaccaccagguaggc

SEQ ID NO: 1009419 - RNA, 17 nt, Mycobacterium avium subsp. paratuberculosis
guugaccacccgcagcg

SEQ ID NO: 1009420 - RNA, 16 nt, Mycobacterium avium subsp. paratuberculosis
guugacccucagcagg

SEQ ID NO: 1009421 - RNA, 14 nt, Mycobacterium avium subsp. paratuberculosis
guugaccggugcgc

SEQ ID NO: 1009422 - RNA, 16 nt, Mycobacterium avium subsp. paratuberculosis
guucuuggcggccugc

SEQ ID NO: 1009423 - RNA, 17 nt, Mycobacterium avium subsp. paratuberculosis
guucugguaggcggccg

SEQ ID NO: 1009424 - RNA, 17 nt, Mycobacterium avium subsp. paratuberculosis
guucugcucgaaggcaa

SEQ ID NO: 1009425 - RNA, 15 nt, Mycobacterium avium subsp. paratuberculosis
guucguugcgccgcc

SEQ ID NO: 1009426 - RNA, 18 nt, Mycobacterium avium subsp. paratuberculosis
guucguugcgccgccagg

SEQ ID NO: 1009427 - RNA, 13 nt, Mycobacterium avium subsp. paratuberculosis
guucgugagcggu

SEQ ID NO: 1009428 - RNA, 15 nt, Mycobacterium avium subsp. paratuberculosis
guucugcaccagcuc

SEQ ID NO: 1009429 - RNA, 14 nt, Mycobacterium avium subsp. paratuberculosis
guucugcaccgacu

SEQ ID NO: 1009430 - RNA, 12 nt, Mycobacterium avium subsp. paratuberculosis
guucauuauccc

SEQ ID NO: 1009431 - RNA, 15 nt, Mycobacterium avium subsp. paratuberculosis
guucauguagcagcg

SEQ ID NO: 1009432 - RNA, 18 nt, Mycobacterium avium subsp. paratuberculosis
guucagcagccggcagac

SEQ ID NO: 1009433 - RNA, 21 nt, Mycobacterium avium subsp. paratuberculosis
guucaguucgggaaaccggau

SEQ ID NO: 1009434 - RNA, 15 nt, Mycobacterium avium subsp. paratuberculosis
guuccggcggccggc

SEQ ID NO: 1009435 - RNA, 17 nt, Mycobacterium avium subsp. paratuberculosis
guuccggugucgagccg

SEQ ID NO: 1009436 - RNA, 16 nt, Mycobacterium avium subsp. paratuberculosis
guuccgguuggccagg

SEQ ID NO: 1009437 - RNA, 14 nt, Mycobacterium avium subsp. paratuberculosis
guuccggcgugcag

SEQ ID NO: 1009438 - RNA, 18 nt, Mycobacterium avium subsp. paratuberculosis
guucccagcccggccagu

SEQ ID NO: 1009439 - RNA, 17 nt, Mycobacterium avium subsp. paratuberculosis
guuccaguacccgcgca

SEQ ID NO: 1009440 - RNA, 14 nt, Mycobacterium avium subsp. paratuberculosis
guucguccaccucc

SEQ ID NO: 1009441 - RNA, 20 nt, Mycobacterium avium subsp. paratuberculosis
guucgcgguugaugaucuug

SEQ ID NO: 1009442 - RNA, 13 nt, Mycobacterium avium subsp. paratuberculosis
guucgcggcuggc

SEQ ID NO: 1009443 - RNA, 23 nt, Mycobacterium avium subsp. paratuberculosis
guucgaugucggccagcgcggcg

SEQ ID NO: 1009444 - RNA, 22 nt, Mycobacterium avium subsp. paratuberculosis
guucgaucagcagcucgguggc

SEQ ID NO: 1009445 - RNA, 16 nt, Mycobacterium avium subsp. paratuberculosis
guucgagucggccacg

SEQ ID NO: 1009446 - RNA, 21 nt, Mycobacterium avium subsp. paratuberculosis
guucgaguucgucgaccagcg

SEQ ID NO: 1009447 - RNA, 19 nt, Mycobacterium avium subsp. paratuberculosis
guucgagcgccgcggccac

SEQ ID NO: 1009448 - RNA, 19 nt, Mycobacterium avium subsp. paratuberculosis
guucgacgccucggugcgg

SEQ ID NO: 1009449 - RNA, 19 nt, Mycobacterium avium subsp. paratuberculosis
guucgacguagcccgccga

SEQ ID NO: 1009450 - RNA, 14 nt, Mycobacterium avium subsp. paratuberculosis
guuacgguagcacu

SEQ ID NO: 1009451 - RNA, 22 nt, Mycobacterium avium subsp. paratuberculosis
guguuguucauccccagcacgg

SEQ ID NO: 1009452 - RNA, 20 nt, Mycobacterium avium subsp. paratuberculosis
guguuguaggagcugccggc

SEQ ID NO: 1009453 - RNA, 17 nt, Mycobacterium avium subsp. paratuberculosis
gugucgccgagccgcac

SEQ ID NO: 1009454 - RNA, 23 nt, Mycobacterium avium subsp. paratuberculosis
gugucgcccagcugggccagcgc

SEQ ID NO: 1009455 - RNA, 14 nt, Mycobacterium avium subsp. paratuberculosis
gugucgaacagcag

SEQ ID NO: 1009456 - RNA, 23 nt, Mycobacterium avium subsp. paratuberculosis
gugucgaacagguuugagcgugc

SEQ ID NO: 1009457 - RNA, 19 nt, Mycobacterium avium subsp. paratuberculosis
gugucgcacagcauguccu

SEQ ID NO: 1009458 - RNA, 18 nt, Mycobacterium avium subsp. paratuberculosis
gugucgaagaccggugcg

SEQ ID NO: 1009459 - RNA, 19 nt, Mycobacterium avium subsp. paratuberculosis
gugucgaagaccggugcgc

SEQ ID NO: 1009460 - RNA, 21 nt, Mycobacterium avium subsp. paratuberculosis
gugucgaagaccggugcgcgc

SEQ ID NO: 1009461 - RNA, 20 nt, Mycobacterium avium subsp. paratuberculosis
gugucgaagcugcgcagccg

SEQ ID NO: 1009462 - RNA, 18 nt, Mycobacterium avium subsp. paratuberculosis
guguccggcccgaugcgg

SEQ ID NO: 1009463 - RNA, 12 nt, Mycobacterium avium subsp. paratuberculosis
guggugggcaga

SEQ ID NO: 1009464 - RNA, 18 nt, Mycobacterium avium subsp. paratuberculosis
guggugggcgaacagcag

SEQ ID NO: 1009465 - RNA, 16 nt, Mycobacterium avium subsp. paratuberculosis
gugguggcguggugga

SEQ ID NO: 1009466 - RNA, 13 nt, Mycobacterium avium subsp. paratuberculosis
gugguggggccgg

SEQ ID NO: 1009467 - RNA, 15 nt, Mycobacterium avium subsp. paratuberculosis
gugguaccggguggc

SEQ ID NO: 1009468 - RNA, 22 nt, Mycobacterium avium subsp. paratuberculosis
guggucaccaccaccaguucca

SEQ ID NO: 1009469 - RNA, 15 nt, Mycobacterium avium subsp. paratuberculosis
guggucaggcccagg

SEQ ID NO: 1009470 - RNA, 22 nt, Mycobacterium avium subsp. paratuberculosis
gugguccagccggucgcaggug

SEQ ID NO: 1009471 - RNA, 17 nt, Mycobacterium avium subsp. paratuberculosis
gugguccuggcgguggc

SEQ ID NO: 1009472 - RNA, 18 nt, Mycobacterium avium subsp. paratuberculosis
guggucgacgcgccgcac

SEQ ID NO: 1009473 - RNA, 20 nt, Mycobacterium avium subsp. paratuberculosis
guggucgagcaugcggguga

SEQ ID NO: 1009474 - RNA, 13 nt, Mycobacterium avium subsp. paratuberculosis
guggugcaggugc

SEQ ID NO: 1009475 - RNA, 19 nt, Mycobacterium avium subsp. paratuberculosis
guggugcugauguccuugu

SEQ ID NO: 1009476 - RNA, 22 nt, Mycobacterium avium subsp. paratuberculosis
guggugacgggcgucggcgggc

SEQ ID NO: 1009477 - RNA, 16 nt, Mycobacterium avium subsp. paratuberculosis
guggugagacccugga

SEQ ID NO: 1009478 - RNA, 23 nt, Mycobacterium avium subsp. paratuberculosis
guggucgucgacgagcccgccgg

SEQ ID NO: 1009479 - RNA, 20 nt, Mycobacterium avium subsp. paratuberculosis
guggucgccguuggcgugga

SEQ ID NO: 1009480 - RNA, 14 nt, Mycobacterium avium subsp. paratuberculosis
guggucgcgcagca

SEQ ID NO: 1009481 - RNA, 14 nt, Mycobacterium avium subsp. paratuberculosis
guggucggcagcac

SEQ ID NO: 1009482 - RNA, 22 nt, Mycobacterium avium subsp. paratuberculosis
guggucgaugaacucgcgggcg

SEQ ID NO: 1009483 - RNA, 17 nt, Mycobacterium avium subsp. paratuberculosis
guggucgggcaugccgg

SEQ ID NO: 1009484 - RNA, 19 nt, Mycobacterium avium subsp. paratuberculosis
guggucuccuggccgccgu

SEQ ID NO: 1009485 - RNA, 19 nt, Mycobacterium avium subsp. paratuberculosis
guggucucgcaccugccgu

SEQ ID NO: 1009486 - RNA, 16 nt, Mycobacterium avium subsp. paratuberculosis
gugggcuuagcggggu

SEQ ID NO: 1009487 - RNA, 19 nt, Mycobacterium avium subsp. paratuberculosis
gugguaaacgcuucuccgc

SEQ ID NO: 1009488 - RNA, 13 nt, Mycobacterium avium subsp. paratuberculosis
guggguggucagc

SEQ ID NO: 1009489 - RNA, 12 nt, Mycobacterium avium subsp. paratuberculosis
gugggcugcauc

SEQ ID NO: 1009490 - RNA, 21 nt, Mycobacterium avium subsp. paratuberculosis
gugggcugcaucuccagccgc

SEQ ID NO: 1009491 - RNA, 13 nt, Mycobacterium avium subsp. paratuberculosis
gugggcgugccgg

SEQ ID NO: 1009492 - RNA, 19 nt, Mycobacterium avium subsp. paratuberculosis
gugggccgccgcggcggca

SEQ ID NO: 1009493 - RNA, 14 nt, Mycobacterium avium subsp. paratuberculosis
gugggcgcgguggu

SEQ ID NO: 1009494 - RNA, 23 nt, Mycobacterium avium subsp. paratuberculosis
gugggcggccaccaacggcagca

SEQ ID NO: 1009495 - RNA, 13 nt, Mycobacterium avium subsp. paratuberculosis
gugggcggcggga

SEQ ID NO: 1009496 - RNA, 14 nt, Mycobacterium avium subsp. paratuberculosis
gugggcggugcgca

SEQ ID NO: 1009497 - RNA, 18 nt, Mycobacterium avium subsp. paratuberculosis
gugggcguacgggcgggc

SEQ ID NO: 1009498 - RNA, 17 nt, Mycobacterium avium subsp. paratuberculosis
gugggcgauggcggcgu

SEQ ID NO: 1009499 - RNA, 18 nt, Mycobacterium avium subsp. paratuberculosis
gugggcgccgucgccgcc

SEQ ID NO: 1009500 - RNA, 17 nt, Mycobacterium avium subsp. paratuberculosis
gugggcgcgcagcacca

SEQ ID NO: 1009501 - RNA, 20 nt, Mycobacterium avium subsp. paratuberculosis
guggcuuuggucgccagcac

SEQ ID NO: 1009502 - RNA, 14 nt, Mycobacterium avium subsp. paratuberculosis
guggcggcgaggaa

SEQ ID NO: 1009503 - RNA, 13 nt, Mycobacterium avium subsp. paratuberculosis
guggcggcggcga

SEQ ID NO: 1009504 - RNA, 19 nt, Mycobacterium avium subsp. paratuberculosis
guggcggcgacaucgaugc

SEQ ID NO: 1009505 - RNA, 22 nt, Mycobacterium avium subsp. paratuberculosis
guggcugcacgucacgggccag

SEQ ID NO: 1009506 - RNA, 19 nt, Mycobacterium avium subsp. paratuberculosis
guggacgaugcggggccgg

SEQ ID NO: 1009507 - RNA, 16 nt, Mycobacterium avium subsp. paratuberculosis
guggacggucagcgcg

SEQ ID NO: 1009508 - RNA, 17 nt, Mycobacterium avium subsp. paratuberculosis
guggacgcggucgccgc

SEQ ID NO: 1009509 - RNA, 21 nt, Mycobacterium avium subsp. paratuberculosis
guggaccgcgugugcccgccu

SEQ ID NO: 1009510 - RNA, 18 nt, Mycobacterium avium subsp. paratuberculosis
guggacaccuuggcggcc

SEQ ID NO: 1009511 - RNA, 17 nt, Mycobacterium avium subsp. paratuberculosis
guggacagaugccagac

SEQ ID NO: 1009512 - RNA, 15 nt, Mycobacterium avium subsp. paratuberculosis
guggacaggaggaca

SEQ ID NO: 1009513 - RNA, 16 nt, Mycobacterium avium subsp. paratuberculosis
guggacaggucgauga

SEQ ID NO: 1009514 - RNA, 22 nt, Mycobacterium avium subsp. paratuberculosis
guggacaggucgaugauguugc

SEQ ID NO: 1009515 - RNA, 14 nt, Mycobacterium avium subsp. paratuberculosis
guggccgcggcggc

SEQ ID NO: 1009516 - RNA, 15 nt, Mycobacterium avium subsp. paratuberculosis
guggccgcggcggcc

SEQ ID NO: 1009517 - RNA, 18 nt, Mycobacterium avium subsp. paratuberculosis
guggccgaucagcggcgg

SEQ ID NO: 1009518 - RNA, 20 nt, Mycobacterium avium subsp. paratuberculosis
guggccgaucagcggcgggc

SEQ ID NO: 1009519 - RNA, 22 nt, Mycobacterium avium subsp. paratuberculosis
guggccgaucagcugcucggcc

SEQ ID NO: 1009520 - RNA, 16 nt, Mycobacterium avium subsp. paratuberculosis
guggacuccagcacca

SEQ ID NO: 1009521 - RNA, 13 nt, Mycobacterium avium subsp. paratuberculosis
guggcgcgccccg

SEQ ID NO: 1009522 - RNA, 17 nt, Mycobacterium avium subsp. paratuberculosis
guggcgcgaaucccggc

SEQ ID NO: 1009523 - RNA, 16 nt, Mycobacterium avium subsp. paratuberculosis
guggcgcgacgcggga

SEQ ID NO: 1009524 - RNA, 19 nt, Mycobacterium avium subsp. paratuberculosis
guggcgccuccgcccgggu

SEQ ID NO: 1009525 - RNA, 20 nt, Mycobacterium avium subsp. paratuberculosis
guggcgccuccgcccgggug

SEQ ID NO: 1009526 - RNA, 17 nt, Mycobacterium avium subsp. paratuberculosis
guggcgccgcgcagcca

SEQ ID NO: 1009527 - RNA, 15 nt, Mycobacterium avium subsp. paratuberculosis
guggcgcccgcggug

SEQ ID NO: 1009528 - RNA, 21 nt, Mycobacterium avium subsp. paratuberculosis
guggccguugaucgagcaccg

SEQ ID NO: 1009529 - RNA, 19 nt, Mycobacterium avium subsp. paratuberculosis
guggccgucacgcuggcgu

SEQ ID NO: 1009530 - RNA, 20 nt, Mycobacterium avium subsp. paratuberculosis
guggccgucacgcuggcgug

SEQ ID NO: 1009531 - RNA, 21 nt, Mycobacterium avium subsp. paratuberculosis
guggccgcgucgaccagccgg

SEQ ID NO: 1009532 - RNA, 16 nt, Mycobacterium avium subsp. paratuberculosis
guggccggcguccagg

SEQ ID NO: 1009533 - RNA, 18 nt, Mycobacterium avium subsp. paratuberculosis
gugcugcucgagggccuc

SEQ ID NO: 1009534 - RNA, 16 nt, Mycobacterium avium subsp. paratuberculosis
gugcugcccggcgcgg

SEQ ID NO: 1009535 - RNA, 20 nt, Mycobacterium avium subsp. paratuberculosis
gugcugcccggcgcggacag

SEQ ID NO: 1009536 - RNA, 19 nt, Mycobacterium avium subsp. paratuberculosis
gugcugccgaacaucagcc

SEQ ID NO: 1009537 - RNA, 14 nt, Mycobacterium avium subsp. paratuberculosis
gugcugccggccgg

SEQ ID NO: 1009538 - RNA, 16 nt, Mycobacterium avium subsp. paratuberculosis
gugcugccggccggca

SEQ ID NO: 1009539 - RNA, 18 nt, Mycobacterium avium subsp. paratuberculosis
gugcugacccggucgcgg

SEQ ID NO: 1009540 - RNA, 24 nt, Mycobacterium avium subsp. paratuberculosis
gugcugcagaccgaacgucacggc

SEQ ID NO: 1009541 - RNA, 22 nt, Mycobacterium avium subsp. paratuberculosis
gugcugcagcgcgaggcgcagu

SEQ ID NO: 1009542 - RNA, 23 nt, Mycobacterium avium subsp. paratuberculosis
guggaauucuggccgaccgccgc

SEQ ID NO: 1009543 - RNA, 23 nt, Mycobacterium avium subsp. paratuberculosis
gugcuugcccgacgagucgccgu

SEQ ID NO: 1009544 - RNA, 18 nt, Mycobacterium avium subsp. paratuberculosis
gugcugaacgccugccgg

SEQ ID NO: 1009545 - RNA, 17 nt, Mycobacterium avium subsp. paratuberculosis
gugcucuuggugguggu

SEQ ID NO: 1009546 - RNA, 13 nt, Mycobacterium avium subsp. paratuberculosis
gugcucuccugcu

SEQ ID NO: 1009547 - RNA, 15 nt, Mycobacterium avium subsp. paratuberculosis
gugcucggugaucca

SEQ ID NO: 1009548 - RNA, 15 nt, Mycobacterium avium subsp. paratuberculosis
gugcucggcgagcac

SEQ ID NO: 1009549 - RNA, 15 nt, Mycobacterium avium subsp. paratuberculosis
gugcucggcggcggg

SEQ ID NO: 1009550 - RNA, 19 nt, Mycobacterium avium subsp. paratuberculosis
gugcucgggagugacguug

SEQ ID NO: 1009551 - RNA, 22 nt, Mycobacterium avium subsp. paratuberculosis
gugcucgccggcgcggaacagc

SEQ ID NO: 1009552 - RNA, 20 nt, Mycobacterium avium subsp. paratuberculosis
gugcucgagcaucucggugc

SEQ ID NO: 1009553 - RNA, 15 nt, Mycobacterium avium subsp. paratuberculosis
gugcucgauggccag

SEQ ID NO: 1009554 - RNA, 18 nt, Mycobacterium avium subsp. paratuberculosis
gugcucgauggccagcgc

SEQ ID NO: 1009555 - RNA, 19 nt, Mycobacterium avium subsp. paratuberculosis
gugcucgauguaccaggcc

SEQ ID NO: 1009556 - RNA, 13 nt, Mycobacterium avium subsp. paratuberculosis
gugcucccgccga

SEQ ID NO: 1009557 - RNA, 22 nt, Mycobacterium avium subsp. paratuberculosis
gugcucagguugcgcagcagcc

SEQ ID NO: 1009558 - RNA, 13 nt, Mycobacterium avium subsp. paratuberculosis
gugcguagcggcc

SEQ ID NO: 1009559 - RNA, 16 nt, Mycobacterium avium subsp. paratuberculosis
gugcgugccagcagcu

SEQ ID NO: 1009560 - RNA, 20 nt, Mycobacterium avium subsp. paratuberculosis
gugcgugaugaccagggccu

SEQ ID NO: 1009561 - RNA, 22 nt, Mycobacterium avium subsp. paratuberculosis
gugcgugaugaccagggccucg

SEQ ID NO: 1009562 - RNA, 14 nt, Mycobacterium avium subsp. paratuberculosis
gugcucagccgcac

SEQ ID NO: 1009563 - RNA, 15 nt, Mycobacterium avium subsp. paratuberculosis
gugcggaacaccgcc

SEQ ID NO: 1009564 - RNA, 21 nt, Mycobacterium avium subsp. paratuberculosis
gugcggacccguugggccaga

SEQ ID NO: 1009565 - RNA, 13 nt, Mycobacterium avium subsp. paratuberculosis
gugcggcacggca

SEQ ID NO: 1009566 - RNA, 19 nt, Mycobacterium avium subsp. paratuberculosis
gugcggcagcucggcggcc

SEQ ID NO: 1009567 - RNA, 20 nt, Mycobacterium avium subsp. paratuberculosis
gugcggcguucggugcccgg

SEQ ID NO: 1009568 - RNA, 16 nt, Mycobacterium avium subsp. paratuberculosis
gugcggcgcugccggc

SEQ ID NO: 1009569 - RNA, 21 nt, Mycobacterium avium subsp. paratuberculosis
gugcggccucggcaccgugcc

SEQ ID NO: 1009570 - RNA, 19 nt, Mycobacterium avium subsp. paratuberculosis
gugcggcgccgcccggcga

SEQ ID NO: 1009571 - RNA, 15 nt, Mycobacterium avium subsp. paratuberculosis
gugcggucagcuccc

SEQ ID NO: 1009572 - RNA, 14 nt, Mycobacterium avium subsp. paratuberculosis
gugcggucgcgcag

SEQ ID NO: 1009573 - RNA, 22 nt, Mycobacterium avium subsp. paratuberculosis
gugcggucggcgucguacagca

SEQ ID NO: 1009574 - RNA, 18 nt, Mycobacterium avium subsp. paratuberculosis
gugcgggugaggccaggc

SEQ ID NO: 1009575 - RNA, 23 nt, Mycobacterium avium subsp. paratuberculosis
gugcgggcguccuugaccagcug

SEQ ID NO: 1009576 - RNA, 14 nt, Mycobacterium avium subsp. paratuberculosis
gugcgggccagcac

SEQ ID NO: 1009577 - RNA, 15 nt, Mycobacterium avium subsp. paratuberculosis
gugcgggccagcacg

SEQ ID NO: 1009578 - RNA, 19 nt, Mycobacterium avium subsp. paratuberculosis
gugcgguuggcccgcggcg

SEQ ID NO: 1009579 - RNA, 14 nt, Mycobacterium avium subsp. paratuberculosis
gugcggugcggccg

SEQ ID NO: 1009580 - RNA, 18 nt, Mycobacterium avium subsp. paratuberculosis
gugcgguucacgcggcug

SEQ ID NO: 1009581 - RNA, 12 nt, Mycobacterium avium subsp. paratuberculosis
gugcguccagac

SEQ ID NO: 1009582 - RNA, 21 nt, Mycobacterium avium subsp. paratuberculosis
gugcguccagaccggccgggg

SEQ ID NO: 1009583 - RNA, 22 nt, Mycobacterium avium subsp. paratuberculosis
gugcguccagaccggccggggc

SEQ ID NO: 1009584 - RNA, 22 nt, Mycobacterium avium subsp. paratuberculosis
gugcgucagaaccggggccagc

SEQ ID NO: 1009585 - RNA, 23 nt, Mycobacterium avium subsp. paratuberculosis
gugcgucagaaccggggccagca

SEQ ID NO: 1009586 - RNA, 15 nt, Mycobacterium avium subsp. paratuberculosis
gugcgaucgccguga

SEQ ID NO: 1009587 - RNA, 14 nt, Mycobacterium avium subsp. paratuberculosis
gugcgagccgagca

SEQ ID NO: 1009588 - RNA, 21 nt, Mycobacterium avium subsp. paratuberculosis
gugcgagccgagcacgcagcc

SEQ ID NO: 1009589 - RNA, 21 nt, Mycobacterium avium subsp. paratuberculosis
gugcgacggcaauccggcccc

SEQ ID NO: 1009590 - RNA, 23 nt, Mycobacterium avium subsp. paratuberculosis
gugcgacuugguggccagcacca

SEQ ID NO: 1009591 - RNA, 13 nt, Mycobacterium avium subsp. paratuberculosis
gugcgccagcgcc

SEQ ID NO: 1009592 - RNA, 21 nt, Mycobacterium avium subsp. paratuberculosis
gugcgccaggcaggcggccag

SEQ ID NO: 1009593 - RNA, 15 nt, Mycobacterium avium subsp. paratuberculosis
gugcgccccacggcg

SEQ ID NO: 1009594 - RNA, 21 nt, Mycobacterium avium subsp. paratuberculosis
gugcgccacgcccgcagcgca

SEQ ID NO: 1009595 - RNA, 16 nt, Mycobacterium avium subsp. paratuberculosis
gugcgcaccagcaggu

SEQ ID NO: 1009596 - RNA, 12 nt, Mycobacterium avium subsp. paratuberculosis
gugcgcagcacg

SEQ ID NO: 1009597 - RNA, 19 nt, Mycobacterium avium subsp. paratuberculosis
gugcgcaggcggcgcgcag

SEQ ID NO: 1009598 - RNA, 13 nt, Mycobacterium avium subsp. paratuberculosis
gugcgccccgccc

SEQ ID NO: 1009599 - RNA, 18 nt, Mycobacterium avium subsp. paratuberculosis
gugcgccggcagcggccg

SEQ ID NO: 1009600 - RNA, 17 nt, Mycobacterium avium subsp. paratuberculosis
gugcgcgaagcuggggu

SEQ ID NO: 1009601 - RNA, 16 nt, Mycobacterium avium subsp. paratuberculosis
gugcgcucgacggccu

SEQ ID NO: 1009602 - RNA, 23 nt, Mycobacterium avium subsp. paratuberculosis
gugcgcgggaacgaucggcucca

SEQ ID NO: 1009603 - RNA, 19 nt, Mycobacterium avium subsp. paratuberculosis
gugcgcgucgacaccccgc

SEQ ID NO: 1009604 - RNA, 13 nt, Mycobacterium avium subsp. paratuberculosis
gugcgcgcuggcc

SEQ ID NO: 1009605 - RNA, 13 nt, Mycobacterium avium subsp. paratuberculosis
gugcgcgcaccag

SEQ ID NO: 1009606 - RNA, 15 nt, Mycobacterium avium subsp. paratuberculosis
gugcgcgcaccaggc

SEQ ID NO: 1009607 - RNA, 13 nt, Mycobacterium avium subsp. paratuberculosis
gugaucagcagca

SEQ ID NO: 1009608 - RNA, 19 nt, Mycobacterium avium subsp. paratuberculosis
gugaucagcagcagguccu

SEQ ID NO: 1009609 - RNA, 14 nt, Mycobacterium avium subsp. paratuberculosis
gugaugcagcugaa

SEQ ID NO: 1009610 - RNA, 23 nt, Mycobacterium avium subsp. paratuberculosis
gugaugcagugguugagcagcag

SEQ ID NO: 1009611 - RNA, 13 nt, Mycobacterium avium subsp. paratuberculosis
gugaugaccugga

SEQ ID NO: 1009612 - RNA, 22 nt, Mycobacterium avium subsp. paratuberculosis
gugaugcggaugcccgccggcg

SEQ ID NO: 1009613 - RNA, 14 nt, Mycobacterium avium subsp. paratuberculosis
gugaugugcaggac

SEQ ID NO: 1009614 - RNA, 16 nt, Mycobacterium avium subsp. paratuberculosis
gugauggccgccgcag

SEQ ID NO: 1009615 - RNA, 15 nt, Mycobacterium avium subsp. paratuberculosis
gugaucacccgccgg

SEQ ID NO: 1009616 - RNA, 17 nt, Mycobacterium avium subsp. paratuberculosis
gugauaccggcccagcg

SEQ ID NO: 1009617 - RNA, 13 nt, Mycobacterium avium subsp. paratuberculosis
gugauagcggccg

SEQ ID NO: 1009618 - RNA, 16 nt, Mycobacterium avium subsp. paratuberculosis
gucuacuuggccagcu

SEQ ID NO: 1009619 - RNA, 18 nt, Mycobacterium avium subsp. paratuberculosis
gucuagaucuccaggcuc

SEQ ID NO: 1009620 - RNA, 16 nt, Mycobacterium avium subsp. paratuberculosis
gucuagccgccgagcg

SEQ ID NO: 1009621 - RNA, 14 nt, Mycobacterium avium subsp. paratuberculosis
gugcagcagcagcc

SEQ ID NO: 1009622 - RNA, 19 nt, Mycobacterium avium subsp. paratuberculosis
gugcagcacgccgcggaag

SEQ ID NO: 1009623 - RNA, 17 nt, Mycobacterium avium subsp. paratuberculosis
gugcagcacgugcgcgg

SEQ ID NO: 1009624 - RNA, 18 nt, Mycobacterium avium subsp. paratuberculosis
gugcagcacgugcgcggg

SEQ ID NO: 1009625 - RNA, 16 nt, Mycobacterium avium subsp. paratuberculosis
gugcagccggcggcgc

SEQ ID NO: 1009626 - RNA, 15 nt, Mycobacterium avium subsp. paratuberculosis
gugcagccgggccug

SEQ ID NO: 1009627 - RNA, 21 nt, Mycobacterium avium subsp. paratuberculosis
gugcagccgggggcggugcag

SEQ ID NO: 1009628 - RNA, 18 nt, Mycobacterium avium subsp. paratuberculosis
gugcacgaacgcggccag

SEQ ID NO: 1009629 - RNA, 13 nt, Mycobacterium avium subsp. paratuberculosis
gugcagcaccgcc

SEQ ID NO: 1009630 - RNA, 14 nt, Mycobacterium avium subsp. paratuberculosis
gugcagcaccgcca

SEQ ID NO: 1009631 - RNA, 18 nt, Mycobacterium avium subsp. paratuberculosis
gugcagcaccgccagcau

SEQ ID NO: 1009632 - RNA, 14 nt, Mycobacterium avium subsp. paratuberculosis
gugcaccgugguga

SEQ ID NO: 1009633 - RNA, 14 nt, Mycobacterium avium subsp. paratuberculosis
gugcacaggccgcc

SEQ ID NO: 1009634 - RNA, 15 nt, Mycobacterium avium subsp. paratuberculosis
gugcaccagguagau

SEQ ID NO: 1009635 - RNA, 13 nt, Mycobacterium avium subsp. paratuberculosis
gugcaccgccagc

SEQ ID NO: 1009636 - RNA, 19 nt, Mycobacterium avium subsp. paratuberculosis
gugcaccgccagcgcggcg

SEQ ID NO: 1009637 - RNA, 20 nt, Mycobacterium avium subsp. paratuberculosis
gugcaacugcguggccgugu

SEQ ID NO: 1009638 - RNA, 14 nt, Mycobacterium avium subsp. paratuberculosis
gugcaccacccagg

SEQ ID NO: 1009639 - RNA, 15 nt, Mycobacterium avium subsp. paratuberculosis
gugcaccaccgugcc

SEQ ID NO: 1009640 - RNA, 14 nt, Mycobacterium avium subsp. paratuberculosis
gugcaccagcgauc

SEQ ID NO: 1009641 - RNA, 14 nt, Mycobacterium avium subsp. paratuberculosis
gugcaacacauggu

SEQ ID NO: 1009642 - RNA, 17 nt, Mycobacterium avium subsp. paratuberculosis
gugcaacaccgaaagcc

SEQ ID NO: 1009643 - RNA, 19 nt, Mycobacterium avium subsp. paratuberculosis
gugcaacacucgagcgcgc

SEQ ID NO: 1009644 - RNA, 21 nt, Mycobacterium avium subsp. paratuberculosis
gugcaacacucgagcgcgcuc

SEQ ID NO: 1009645 - RNA, 20 nt, Mycobacterium avium subsp. paratuberculosis
gugcauguggccgucgccga

SEQ ID NO: 1009646 - RNA, 19 nt, Mycobacterium avium subsp. paratuberculosis
gugcagcgcccagccgagc

SEQ ID NO: 1009647 - RNA, 17 nt, Mycobacterium avium subsp. paratuberculosis
gugcagugcgaucgccg

SEQ ID NO: 1009648 - RNA, 20 nt, Mycobacterium avium subsp. paratuberculosis
gugcaguucgaugccgauga

SEQ ID NO: 1009649 - RNA, 17 nt, Mycobacterium avium subsp. paratuberculosis
gugcaggugcccgucgg

SEQ ID NO: 1009650 - RNA, 23 nt, Mycobacterium avium subsp. paratuberculosis
gugcccgagcugaucgcggccgg

SEQ ID NO: 1009651 - RNA, 22 nt, Mycobacterium avium subsp. paratuberculosis
gugcccgauuggaagagggcca

SEQ ID NO: 1009652 - RNA, 13 nt, Mycobacterium avium subsp. paratuberculosis
gugcccggccagc

SEQ ID NO: 1009653 - RNA, 14 nt, Mycobacterium avium subsp. paratuberculosis
gugcccggcccagg

SEQ ID NO: 1009654 - RNA, 16 nt, Mycobacterium avium subsp. paratuberculosis
gugcccaccgggcagc

SEQ ID NO: 1009655 - RNA, 14 nt, Mycobacterium avium subsp. paratuberculosis
gugcccagccaggc

SEQ ID NO: 1009656 - RNA, 19 nt, Mycobacterium avium subsp. paratuberculosis
gugcccagccaggccgccg

SEQ ID NO: 1009657 - RNA, 12 nt, Mycobacterium avium subsp. paratuberculosis
gugcccagcccg

SEQ ID NO: 1009658 - RNA, 18 nt, Mycobacterium avium subsp. paratuberculosis
gugccccacgccaugugc

SEQ ID NO: 1009659 - RNA, 22 nt, Mycobacterium avium subsp. paratuberculosis
gugccccacgccaugugccggc

SEQ ID NO: 1009660 - RNA, 15 nt, Mycobacterium avium subsp. paratuberculosis
gugcccccgcccggc

SEQ ID NO: 1009661 - RNA, 23 nt, Mycobacterium avium subsp. paratuberculosis
gugccccgcaccgccaggcuggc

SEQ ID NO: 1009662 - RNA, 20 nt, Mycobacterium avium subsp. paratuberculosis
gugccgaucaccucgccggc

SEQ ID NO: 1009663 - RNA, 14 nt, Mycobacterium avium subsp. paratuberculosis
gugccgauggccac

SEQ ID NO: 1009664 - RNA, 21 nt, Mycobacterium avium subsp. paratuberculosis
gugccgauguaggacaggucg

SEQ ID NO: 1009665 - RNA, 16 nt, Mycobacterium avium subsp. paratuberculosis
gugccgacgagcucgc

SEQ ID NO: 1009666 - RNA, 13 nt, Mycobacterium avium subsp. paratuberculosis
gugccgagcacgc

SEQ ID NO: 1009667 - RNA, 21 nt, Mycobacterium avium subsp. paratuberculosis
gugccgacggugcgugccagc

SEQ ID NO: 1009668 - RNA, 22 nt, Mycobacterium avium subsp. paratuberculosis
gugccgaagcgccgcaugcccu

SEQ ID NO: 1009669 - RNA, 18 nt, Mycobacterium avium subsp. paratuberculosis
gugcccuuccccggcggc

SEQ ID NO: 1009670 - RNA, 15 nt, Mycobacterium avium subsp. paratuberculosis
gugcccuucgaguug

SEQ ID NO: 1009671 - RNA, 21 nt, Mycobacterium avium subsp. paratuberculosis
gugcccuucgaguugccguug

SEQ ID NO: 1009672 - RNA, 18 nt, Mycobacterium avium subsp. paratuberculosis
gugcccgucggccucggc

SEQ ID NO: 1009673 - RNA, 13 nt, Mycobacterium avium subsp. paratuberculosis
gugccagggcagc

SEQ ID NO: 1009674 - RNA, 17 nt, Mycobacterium avium subsp. paratuberculosis
gugccaacacggcggcg

SEQ ID NO: 1009675 - RNA, 20 nt, Mycobacterium avium subsp. paratuberculosis
gugccaacacggcggcgcgc

SEQ ID NO: 1009676 - RNA, 20 nt, Mycobacterium avium subsp. paratuberculosis
gugccaccaccacggccagg

SEQ ID NO: 1009677 - RNA, 15 nt, Mycobacterium avium subsp. paratuberculosis
gugccaccgcugggc

SEQ ID NO: 1009678 - RNA, 21 nt, Mycobacterium avium subsp. paratuberculosis
gugccacggucaggcgcagcc

SEQ ID NO: 1009679 - RNA, 18 nt, Mycobacterium avium subsp. paratuberculosis
gugccacuucgacggcag

SEQ ID NO: 1009680 - RNA, 14 nt, Mycobacterium avium subsp. paratuberculosis
gugcgaaucgccuu

SEQ ID NO: 1009681 - RNA, 22 nt, Mycobacterium avium subsp. paratuberculosis
gugcgaaaauggcugcccggca

SEQ ID NO: 1009682 - RNA, 20 nt, Mycobacterium avium subsp. paratuberculosis
gugcgaacagccacgguccu

SEQ ID NO: 1009683 - RNA, 17 nt, Mycobacterium avium subsp. paratuberculosis
gugccuggcuccccggc

SEQ ID NO: 1009684 - RNA, 12 nt, Mycobacterium avium subsp. paratuberculosis
gugccucgccac

SEQ ID NO: 1009685 - RNA, 14 nt, Mycobacterium avium subsp. paratuberculosis
gugccucgcgcauc

SEQ ID NO: 1009686 - RNA, 18 nt, Mycobacterium avium subsp. paratuberculosis
gugccugcgggcccagcu

SEQ ID NO: 1009687 - RNA, 16 nt, Mycobacterium avium subsp. paratuberculosis
gugccguugagcgugg

SEQ ID NO: 1009688 - RNA, 15 nt, Mycobacterium avium subsp. paratuberculosis
gugccgcgcggcggu

SEQ ID NO: 1009689 - RNA, 22 nt, Mycobacterium avium subsp. paratuberculosis
gugccgccuugguagaugcguu

SEQ ID NO: 1009690 - RNA, 13 nt, Mycobacterium avium subsp. paratuberculosis
gugccgcggcggc

SEQ ID NO: 1009691 - RNA, 15 nt, Mycobacterium avium subsp. paratuberculosis
gugccgcgguugaac

SEQ ID NO: 1009692 - RNA, 23 nt, Mycobacterium avium subsp. paratuberculosis
gugccgcgguugaacaggcugcc

SEQ ID NO: 1009693 - RNA, 18 nt, Mycobacterium avium subsp. paratuberculosis
gugccgcugcauccgcag

SEQ ID NO: 1009694 - RNA, 12 nt, Mycobacterium avium subsp. paratuberculosis
gugccgcaggcg

SEQ ID NO: 1009695 - RNA, 15 nt, Mycobacterium avium subsp. paratuberculosis
gugccgcagugccgg

SEQ ID NO: 1009696 - RNA, 20 nt, Mycobacterium avium subsp. paratuberculosis
gugccggaaguucucgccgu

SEQ ID NO: 1009697 - RNA, 13 nt, Mycobacterium avium subsp. paratuberculosis
gugccggaggcgg

SEQ ID NO: 1009698 - RNA, 23 nt, Mycobacterium avium subsp. paratuberculosis
gugccggccaccggcgcgacggc

SEQ ID NO: 1009699 - RNA, 18 nt, Mycobacterium avium subsp. paratuberculosis
gugccgggccagcugcuc

SEQ ID NO: 1009700 - RNA, 14 nt, Mycobacterium avium subsp. paratuberculosis
gugccgggccaggu

SEQ ID NO: 1009701 - RNA, 20 nt, Mycobacterium avium subsp. paratuberculosis
gugccggcgggucagcagcg

SEQ ID NO: 1009702 - RNA, 20 nt, Mycobacterium avium subsp. paratuberculosis
gugccgguguugccgacggc

SEQ ID NO: 1009703 - RNA, 13 nt, Mycobacterium avium subsp. paratuberculosis
gugccggccgggu

SEQ ID NO: 1009704 - RNA, 14 nt, Mycobacterium avium subsp. paratuberculosis
uacaccccaccgga

SEQ ID NO: 1009705 - RNA, 18 nt, Mycobacterium avium subsp. paratuberculosis
uacaccugccgcacaccg

SEQ ID NO: 1009706 - RNA, 14 nt, Mycobacterium avium subsp. paratuberculosis
uacacauagcccau

SEQ ID NO: 1009707 - RNA, 19 nt, Mycobacterium avium subsp. paratuberculosis
uacagccagcccguggcca

SEQ ID NO: 1009708 - RNA, 19 nt, Mycobacterium avium subsp. paratuberculosis
uacagcgacuccagcgcga

SEQ ID NO: 1009709 - RNA, 20 nt, Mycobacterium avium subsp. paratuberculosis
uacaggccgucggggaugcc

SEQ ID NO: 1009710 - RNA, 15 nt, Mycobacterium avium subsp. paratuberculosis
uacaggagggccagg

SEQ ID NO: 1009711 - RNA, 16 nt, Mycobacterium avium subsp. paratuberculosis
uacaggagggccaggg

SEQ ID NO: 1009712 - RNA, 19 nt, Mycobacterium avium subsp. paratuberculosis
uacagcuaggccagcagcg

SEQ ID NO: 1009713 - RNA, 15 nt, Mycobacterium avium subsp. paratuberculosis
uacagcggcgccagg

SEQ ID NO: 1009714 - RNA, 13 nt, Mycobacterium avium subsp. paratuberculosis
uacagcgucagca

SEQ ID NO: 1009715 - RNA, 20 nt, Mycobacterium avium subsp. paratuberculosis
uacagcgucagcaucgccgu

SEQ ID NO: 1009716 - RNA, 16 nt, Mycobacterium avium subsp. paratuberculosis
uaaucgaaggccaggu

SEQ ID NO: 1009717 - RNA, 16 nt, Mycobacterium avium subsp. paratuberculosis
uacuucgucagcagcg

SEQ ID NO: 1009718 - RNA, 22 nt, Mycobacterium avium subsp. paratuberculosis
uagacccggggguccagggugc

SEQ ID NO: 1009719 - RNA, 21 nt, Mycobacterium avium subsp. paratuberculosis
uagaccucuugggacuggaug

SEQ ID NO: 1009720 - RNA, 15 nt, Mycobacterium avium subsp. paratuberculosis
uagacgcgggccggc

SEQ ID NO: 1009721 - RNA, 13 nt, Mycobacterium avium subsp. paratuberculosis
uagaagaugcgcc

SEQ ID NO: 1009722 - RNA, 16 nt, Mycobacterium avium subsp. paratuberculosis
uagaagcucagcugcu

SEQ ID NO: 1009723 - RNA, 19 nt, Mycobacterium avium subsp. paratuberculosis
uagaaccggcccagcagcg

SEQ ID NO: 1009724 - RNA, 20 nt, Mycobacterium avium subsp. paratuberculosis
uacggaucgccggacagcgg

SEQ ID NO: 1009725 - RNA, 14 nt, Mycobacterium avium subsp. paratuberculosis
uacggacgcaucca

SEQ ID NO: 1009726 - RNA, 18 nt, Mycobacterium avium subsp. paratuberculosis
uacgcuguggggcccacu

SEQ ID NO: 1009727 - RNA, 20 nt, Mycobacterium avium subsp. paratuberculosis
uacgcugcggcgccgggcau

SEQ ID NO: 1009728 - RNA, 22 nt, Mycobacterium avium subsp. paratuberculosis
uaccucgcuguaggccagccgg

SEQ ID NO: 1009729 - RNA, 21 nt, Mycobacterium avium subsp. paratuberculosis
uaccugcguccgauaccagcc

SEQ ID NO: 1009730 - RNA, 17 nt, Mycobacterium avium subsp. paratuberculosis
uaccggccggccgccug

SEQ ID NO: 1009731 - RNA, 14 nt, Mycobacterium avium subsp. paratuberculosis
uaccggcgccaggc

SEQ ID NO: 1009732 - RNA, 16 nt, Mycobacterium avium subsp. paratuberculosis
uaccggcgcuggaaca

SEQ ID NO: 1009733 - RNA, 15 nt, Mycobacterium avium subsp. paratuberculosis
uaccggguggccagc

SEQ ID NO: 1009734 - RNA, 19 nt, Mycobacterium avium subsp. paratuberculosis
uaccggguggccagcacca

SEQ ID NO: 1009735 - RNA, 20 nt, Mycobacterium avium subsp. paratuberculosis
uaccggguggccagcaccag

SEQ ID NO: 1009736 - RNA, 21 nt, Mycobacterium avium subsp. paratuberculosis
uaccggguggccagcaccagc

SEQ ID NO: 1009737 - RNA, 18 nt, Mycobacterium avium subsp. paratuberculosis
uaccgccgagcgugaagu

SEQ ID NO: 1009738 - RNA, 14 nt, Mycobacterium avium subsp. paratuberculosis
uaccgccucgccag

SEQ ID NO: 1009739 - RNA, 16 nt, Mycobacterium avium subsp. paratuberculosis
uaccgccggccaggcg

SEQ ID NO: 1009740 - RNA, 17 nt, Mycobacterium avium subsp. paratuberculosis
uaccgccgggcgggccg

SEQ ID NO: 1009741 - RNA, 19 nt, Mycobacterium avium subsp. paratuberculosis
uaccgccgggcgggccgca

SEQ ID NO: 1009742 - RNA, 17 nt, Mycobacterium avium subsp. paratuberculosis
uagaugcggcccagccc

SEQ ID NO: 1009743 - RNA, 21 nt, Mycobacterium avium subsp. paratuberculosis
uagaugcggcccagcccggcc

SEQ ID NO: 1009744 - RNA, 20 nt, Mycobacterium avium subsp. paratuberculosis
uagaucaucccggccacccc

SEQ ID NO: 1009745 - RNA, 13 nt, Mycobacterium avium subsp. paratuberculosis
uagaucagcgccu

SEQ ID NO: 1009746 - RNA, 21 nt, Mycobacterium avium subsp. paratuberculosis
uagagcgggaucugcgccgcc

SEQ ID NO: 1009747 - RNA, 16 nt, Mycobacterium avium subsp. paratuberculosis
uagagcuggugggcca

SEQ ID NO: 1009748 - RNA, 13 nt, Mycobacterium avium subsp. paratuberculosis
uagaggugcagcg

SEQ ID NO: 1009749 - RNA, 20 nt, Mycobacterium avium subsp. paratuberculosis
uagaggggugauuaggcagu

SEQ ID NO: 1009750 - RNA, 19 nt, Mycobacterium avium subsp. paratuberculosis
uagcagcgcggcuuggcca

SEQ ID NO: 1009751 - RNA, 23 nt, Mycobacterium avium subsp. paratuberculosis
uagcuugggugagcuaucagcuc

SEQ ID NO: 1009752 - RNA, 22 nt, Mycobacterium avium subsp. paratuberculosis
uaggacgccgcaccgcaaagca

SEQ ID NO: 1009753 - RNA, 21 nt, Mycobacterium avium subsp. paratuberculosis
uaggaccggaugaaggacugg

SEQ ID NO: 1009754 - RNA, 15 nt, Mycobacterium avium subsp. paratuberculosis
uaggacagcaccaca

SEQ ID NO: 1009755 - RNA, 12 nt, Mycobacterium avium subsp. paratuberculosis
uaggacagcagc

SEQ ID NO: 1009756 - RNA, 16 nt, Mycobacterium avium subsp. paratuberculosis
uaggaguagcaggcau

SEQ ID NO: 1009757 - RNA, 21 nt, Mycobacterium avium subsp. paratuberculosis
uagcugggccccuccagccgc

SEQ ID NO: 1009758 - RNA, 13 nt, Mycobacterium avium subsp. paratuberculosis
uagcccagcgcgu

SEQ ID NO: 1009759 - RNA, 20 nt, Mycobacterium avium subsp. paratuberculosis
uagccucgccagccguccug

SEQ ID NO: 1009760 - RNA, 17 nt, Mycobacterium avium subsp. paratuberculosis
uagccgucggcggccuu

SEQ ID NO: 1009761 - RNA, 20 nt, Mycobacterium avium subsp. paratuberculosis
uagccggggacggugcagcc

SEQ ID NO: 1009762 - RNA, 14 nt, Mycobacterium avium subsp. paratuberculosis
uagccgaccuugac

SEQ ID NO: 1009763 - RNA, 17 nt, Mycobacterium avium subsp. paratuberculosis
uagccgaccuugaccca

SEQ ID NO: 1009764 - RNA, 20 nt, Mycobacterium avium subsp. paratuberculosis
uagccgaccaacgggcggcg

SEQ ID NO: 1009765 - RNA, 21 nt, Mycobacterium avium subsp. paratuberculosis
uagccgaccgacccggccagc

SEQ ID NO: 1009766 - RNA, 21 nt, Mycobacterium avium subsp. paratuberculosis
uagccgccgagcgucacgcua

SEQ ID NO: 1009767 - RNA, 18 nt, Mycobacterium avium subsp. paratuberculosis
uagccgcucgcccagcgc

SEQ ID NO: 1009768 - RNA, 15 nt, Mycobacterium avium subsp. paratuberculosis
uagcggccgcggaau

SEQ ID NO: 1009769 - RNA, 19 nt, Mycobacterium avium subsp. paratuberculosis
uagcgggagccggccaggu

SEQ ID NO: 1009770 - RNA, 17 nt, Mycobacterium avium subsp. paratuberculosis
uagcgcaugaugcccag

SEQ ID NO: 1009771 - RNA, 16 nt, Mycobacterium avium subsp. paratuberculosis
uagcgccgcucggccg

SEQ ID NO: 1009772 - RNA, 16 nt, Mycobacterium avium subsp. paratuberculosis
uagcgccgcccgucca

SEQ ID NO: 1009773 - RNA, 14 nt, Mycobacterium avium subsp. paratuberculosis
uagcgcagcaccag

SEQ ID NO: 1009774 - RNA, 19 nt, Mycobacterium avium subsp. paratuberculosis
uagcgcauguaggacaccc

SEQ ID NO: 1009775 - RNA, 16 nt, Mycobacterium avium subsp. paratuberculosis
uagcgccacaucagcu

SEQ ID NO: 1009776 - RNA, 14 nt, Mycobacterium avium subsp. paratuberculosis
uagccuuggccgca

SEQ ID NO: 1009777 - RNA, 22 nt, Mycobacterium avium subsp. paratuberculosis
uagugcauguagcggucguaga

SEQ ID NO: 1009778 - RNA, 15 nt, Mycobacterium avium subsp. paratuberculosis
uagugcagcugcagc

SEQ ID NO: 1009779 - RNA, 21 nt, Mycobacterium avium subsp. paratuberculosis
uaguccgacuucgcgugccgc

SEQ ID NO: 1009780 - RNA, 13 nt, Mycobacterium avium subsp. paratuberculosis
uaguucagcagcc

SEQ ID NO: 1009781 - RNA, 13 nt, Mycobacterium avium subsp. paratuberculosis
uaguguguuuggu

SEQ ID NO: 1009782 - RNA, 22 nt, Mycobacterium avium subsp. paratuberculosis
uaguagccggggacggugcagc

SEQ ID NO: 1009783 - RNA, 14 nt, Mycobacterium avium subsp. paratuberculosis
uaggcguggcaggc

SEQ ID NO: 1009784 - RNA, 16 nt, Mycobacterium avium subsp. paratuberculosis
uaggcggccagcagca

SEQ ID NO: 1009785 - RNA, 24 nt, Mycobacterium avium subsp. paratuberculosis
uagggcagauaggcggcgacggcg

SEQ ID NO: 1009786 - RNA, 22 nt, Mycobacterium avium subsp. paratuberculosis
uagggcagccacaucugguugc

SEQ ID NO: 1009787 - RNA, 11 nt, Mycobacterium avium subsp. paratuberculosis
uaggccagccc

SEQ ID NO: 1009788 - RNA, 19 nt, Mycobacterium avium subsp. paratuberculosis
uaggccagguucaggcuga

SEQ ID NO: 1009789 - RNA, 13 nt, Mycobacterium avium subsp. paratuberculosis
uaggcccaguccu

SEQ ID NO: 1009790 - RNA, 18 nt, Mycobacterium avium subsp. paratuberculosis
uaggcccaguccugcagc

SEQ ID NO: 1009791 - RNA, 21 nt, Mycobacterium avium subsp. paratuberculosis
uaggccgccgcgaccgucagc

SEQ ID NO: 1009792 - RNA, 15 nt, Mycobacterium avium subsp. paratuberculosis
uaggccgcgcugaac

SEQ ID NO: 1009793 - RNA, 18 nt, Mycobacterium avium subsp. paratuberculosis
uaggccgcgcuggccagc

SEQ ID NO: 1009794 - RNA, 20 nt, Mycobacterium avium subsp. paratuberculosis
uaggcgaaauaacccacccc

SEQ ID NO: 1009795 - RNA, 17 nt, Mycobacterium avium subsp. paratuberculosis
uaggcgaucgggaacag

SEQ ID NO: 1009796 - RNA, 20 nt, Mycobacterium avium subsp. paratuberculosis
uaggcgaucgggaacagccc

SEQ ID NO: 1009797 - RNA, 19 nt, Mycobacterium avium subsp. paratuberculosis
ucacucgucuugcagccgg

SEQ ID NO: 1009798 - RNA, 11 nt, Mycobacterium avium subsp. paratuberculosis
ucagccaggug

SEQ ID NO: 1009799 - RNA, 22 nt, Mycobacterium avium subsp. paratuberculosis
ucagccgcgacagccgcccggc

SEQ ID NO: 1009800 - RNA, 16 nt, Mycobacterium avium subsp. paratuberculosis
ucagccggagccggcc

SEQ ID NO: 1009801 - RNA, 15 nt, Mycobacterium avium subsp. paratuberculosis
ucagcgacggcccgc

SEQ ID NO: 1009802 - RNA, 16 nt, Mycobacterium avium subsp. paratuberculosis
ucagcgacggcccgcc

SEQ ID NO: 1009803 - RNA, 14 nt, Mycobacterium avium subsp. paratuberculosis
ucagcugcucggcc

SEQ ID NO: 1009804 - RNA, 14 nt, Mycobacterium avium subsp. paratuberculosis
ucagcugcagccgg

SEQ ID NO: 1009805 - RNA, 15 nt, Mycobacterium avium subsp. paratuberculosis
ucagcugcccggagu

SEQ ID NO: 1009806 - RNA, 15 nt, Mycobacterium avium subsp. paratuberculosis
ucagcguggucagcg

SEQ ID NO: 1009807 - RNA, 10 nt, Mycobacterium avium subsp. paratuberculosis
ucagcgcggu

SEQ ID NO: 1009808 - RNA, 19 nt, Mycobacterium avium subsp. paratuberculosis
ucagcgcggucagcccgcc

SEQ ID NO: 1009809 - RNA, 22 nt, Mycobacterium avium subsp. paratuberculosis
ucagcgcggccaccuccagccc

SEQ ID NO: 1009810 - RNA, 14 nt, Mycobacterium avium subsp. paratuberculosis
ucagcgcggcccgc

SEQ ID NO: 1009811 - RNA, 19 nt, Mycobacterium avium subsp. paratuberculosis
ucagcgcgacgugccggcg

SEQ ID NO: 1009812 - RNA, 15 nt, Mycobacterium avium subsp. paratuberculosis
ucagcgcgcacagcg

SEQ ID NO: 1009813 - RNA, 17 nt, Mycobacterium avium subsp. paratuberculosis
ucagcgcgcacagcgcc

SEQ ID NO: 1009814 - RNA, 17 nt, Mycobacterium avium subsp. paratuberculosis
ucagcuuggagccgagc

SEQ ID NO: 1009815 - RNA, 21 nt, Mycobacterium avium subsp. paratuberculosis
ucaggaacaccgagccggcgg

SEQ ID NO: 1009816 - RNA, 12 nt, Mycobacterium avium subsp. paratuberculosis
ucaggaacccga

SEQ ID NO: 1009817 - RNA, 17 nt, Mycobacterium avium subsp. paratuberculosis
ucaggaugacgccgcgg

SEQ ID NO: 1009818 - RNA, 18 nt, Mycobacterium avium subsp. paratuberculosis
ucaggaugcccgggccgu

SEQ ID NO: 1009819 - RNA, 23 nt, Mycobacterium avium subsp. paratuberculosis
ucagggcucgcaaccgucuuggc

SEQ ID NO: 1009820 - RNA, 16 nt, Mycobacterium avium subsp. paratuberculosis
ucagggcggugcggug

SEQ ID NO: 1009821 - RNA, 19 nt, Mycobacterium avium subsp. paratuberculosis
ucagggcgcgcugucgacg

SEQ ID NO: 1009822 - RNA, 21 nt, Mycobacterium avium subsp. paratuberculosis
ucagggcgcucaucaggcggc

SEQ ID NO: 1009823 - RNA, 15 nt, Mycobacterium avium subsp. paratuberculosis
ucagggcccacagca

SEQ ID NO: 1009824 - RNA, 14 nt, Mycobacterium avium subsp. paratuberculosis
ucagggcagcggug

SEQ ID NO: 1009825 - RNA, 11 nt, Mycobacterium avium subsp. paratuberculosis
ucagggccgcg

SEQ ID NO: 1009826 - RNA, 20 nt, Mycobacterium avium subsp. paratuberculosis
ucaguaccggcgaugccagc

SEQ ID NO: 1009827 - RNA, 24 nt, Mycobacterium avium subsp. paratuberculosis
ucaguaccggcgaugccagcgcac

SEQ ID NO: 1009828 - RNA, 14 nt, Mycobacterium avium subsp. paratuberculosis
ucagguucgccacg

SEQ ID NO: 1009829 - RNA, 16 nt, Mycobacterium avium subsp. paratuberculosis
ucagguucgccacgau

SEQ ID NO: 1009830 - RNA, 15 nt, Mycobacterium avium subsp. paratuberculosis
ucagguucaccagca

SEQ ID NO: 1009831 - RNA, 20 nt, Mycobacterium avium subsp. paratuberculosis
ucaguuccuugauccggccg

SEQ ID NO: 1009832 - RNA, 15 nt, Mycobacterium avium subsp. paratuberculosis
ucaguccucgccgag

SEQ ID NO: 1009833 - RNA, 18 nt, Mycobacterium avium subsp. paratuberculosis
ucauccaggugaacagca

SEQ ID NO: 1009834 - RNA, 19 nt, Mycobacterium avium subsp. paratuberculosis
ucauccaggugaacagcag

SEQ ID NO: 1009835 - RNA, 19 nt, Mycobacterium avium subsp. paratuberculosis
ucauccccgcggccacccc

SEQ ID NO: 1009836 - RNA, 20 nt, Mycobacterium avium subsp. paratuberculosis
ucauccccaucucgagcagg

SEQ ID NO: 1009837 - RNA, 21 nt, Mycobacterium avium subsp. paratuberculosis
ucaucccccgcagcuucugca

SEQ ID NO: 1009838 - RNA, 23 nt, Mycobacterium avium subsp. paratuberculosis
ucaucgagcaguagacgccgccg

SEQ ID NO: 1009839 - RNA, 16 nt, Mycobacterium avium subsp. paratuberculosis
ucaucgacuugccgcc

SEQ ID NO: 1009840 - RNA, 23 nt, Mycobacterium avium subsp. paratuberculosis
ucaucgacaccgaacccaccagc

SEQ ID NO: 1009841 - RNA, 13 nt, Mycobacterium avium subsp. paratuberculosis
ucauaggccgcgc

SEQ ID NO: 1009842 - RNA, 18 nt, Mycobacterium avium subsp. paratuberculosis
ucauagcugaucacaugg

SEQ ID NO: 1009843 - RNA, 21 nt, Mycobacterium avium subsp. paratuberculosis
ucauauugguucgcucgucuu

SEQ ID NO: 1009844 - RNA, 12 nt, Mycobacterium avium subsp. paratuberculosis
ucaucaccgccg

SEQ ID NO: 1009845 - RNA, 16 nt, Mycobacterium avium subsp. paratuberculosis
ucaucaccggcgcgcc

SEQ ID NO: 1009846 - RNA, 19 nt, Mycobacterium avium subsp. paratuberculosis
ucaucuggaacauggccuu

SEQ ID NO: 1009847 - RNA, 16 nt, Mycobacterium avium subsp. paratuberculosis
ucaucguggacaggag

SEQ ID NO: 1009848 - RNA, 17 nt, Mycobacterium avium subsp. paratuberculosis
ucaucgguuugaccacg

SEQ ID NO: 1009849 - RNA, 14 nt, Mycobacterium avium subsp. paratuberculosis
ucaucuccguguug

SEQ ID NO: 1009850 - RNA, 21 nt, Mycobacterium avium subsp. paratuberculosis
ucaucucggugguggccaucg

SEQ ID NO: 1009851 - RNA, 17 nt, Mycobacterium avium subsp. paratuberculosis
ucaugcacggcgcuggc

SEQ ID NO: 1009852 - RNA, 14 nt, Mycobacterium avium subsp. paratuberculosis
ucaugaucggcagg

SEQ ID NO: 1009853 - RNA, 19 nt, Mycobacterium avium subsp. paratuberculosis
ucaugccguaaguggcgcc

SEQ ID NO: 1009854 - RNA, 22 nt, Mycobacterium avium subsp. paratuberculosis
ucauggcaguuguuccaguccc

SEQ ID NO: 1009855 - RNA, 15 nt, Mycobacterium avium subsp. paratuberculosis
ucauggacagccacc

SEQ ID NO: 1009856 - RNA, 14 nt, Mycobacterium avium subsp. paratuberculosis
ucauggugucccau

SEQ ID NO: 1009857 - RNA, 19 nt, Mycobacterium avium subsp. paratuberculosis
ucaugguguuccaccagcg

SEQ ID NO: 1009858 - RNA, 22 nt, Mycobacterium avium subsp. paratuberculosis
ucaugguguuccaccagcggcc

SEQ ID NO: 1009859 - RNA, 17 nt, Mycobacterium avium subsp. paratuberculosis
uccaccaccggccgcgc

SEQ ID NO: 1009860 - RNA, 22 nt, Mycobacterium avium subsp. paratuberculosis
uccacccgccccgccgcggcca

SEQ ID NO: 1009861 - RNA, 22 nt, Mycobacterium avium subsp. paratuberculosis
uccaccgaaaagcccgccgccu

SEQ ID NO: 1009862 - RNA, 19 nt, Mycobacterium avium subsp. paratuberculosis
uccacccggcccaccaccg

SEQ ID NO: 1009863 - RNA, 13 nt, Mycobacterium avium subsp. paratuberculosis
uccaccgacaggu

SEQ ID NO: 1009864 - RNA, 15 nt, Mycobacterium avium subsp. paratuberculosis
uccaccgcgcggcca

SEQ ID NO: 1009865 - RNA, 21 nt, Mycobacterium avium subsp. paratuberculosis
uccaccgcgcggccagcggcg

SEQ ID NO: 1009866 - RNA, 15 nt, Mycobacterium avium subsp. paratuberculosis
uccacaucagguuga

SEQ ID NO: 1009867 - RNA, 21 nt, Mycobacterium avium subsp. paratuberculosis
uccacaucugccggcagaucu

SEQ ID NO: 1009868 - RNA, 15 nt, Mycobacterium avium subsp. paratuberculosis
uccaccaaggucucc

SEQ ID NO: 1009869 - RNA, 20 nt, Mycobacterium avium subsp. paratuberculosis
uccaccaauucgcgcugcca

SEQ ID NO: 1009870 - RNA, 12 nt, Mycobacterium avium subsp. paratuberculosis
uccaccaccaca

SEQ ID NO: 1009871 - RNA, 22 nt, Mycobacterium avium subsp. paratuberculosis
uccaccaccacacccgcggccg

SEQ ID NO: 1009872 - RNA, 22 nt, Mycobacterium avium subsp. paratuberculosis
uccacaaccagcgauucccgcc

SEQ ID NO: 1009873 - RNA, 19 nt, Mycobacterium avium subsp. paratuberculosis
uccacagcccguugcugcg

SEQ ID NO: 1009874 - RNA, 23 nt, Mycobacterium avium subsp. paratuberculosis
uccaaagcggcuaagccggcguc

SEQ ID NO: 1009875 - RNA, 22 nt, Mycobacterium avium subsp. paratuberculosis
uccaccguggucggcagcaccg

SEQ ID NO: 1009876 - RNA, 17 nt, Mycobacterium avium subsp. paratuberculosis
uccaccucgggccgggc

SEQ ID NO: 1009877 - RNA, 21 nt, Mycobacterium avium subsp. paratuberculosis
uccaccgcguccugcaggcag

SEQ ID NO: 1009878 - RNA, 22 nt, Mycobacterium avium subsp. paratuberculosis
uccaccgcguccugcaggcagg

SEQ ID NO: 1009879 - RNA, 17 nt, Mycobacterium avium subsp. paratuberculosis
uccaccggauggcgccc

SEQ ID NO: 1009880 - RNA, 15 nt, Mycobacterium avium subsp. paratuberculosis
uccaccgggccgcca

SEQ ID NO: 1009881 - RNA, 15 nt, Mycobacterium avium subsp. paratuberculosis
uccagacggucuugg

SEQ ID NO: 1009882 - RNA, 21 nt, Mycobacterium avium subsp. paratuberculosis
uccagaugccgggugggcagc

SEQ ID NO: 1009883 - RNA, 19 nt, Mycobacterium avium subsp. paratuberculosis
uccagaucggccagcgcgg

SEQ ID NO: 1009884 - RNA, 13 nt, Mycobacterium avium subsp. paratuberculosis
uccagaucggcgc

SEQ ID NO: 1009885 - RNA, 16 nt, Mycobacterium avium subsp. paratuberculosis
uccagcuggagaggcc

SEQ ID NO: 1009886 - RNA, 14 nt, Mycobacterium avium subsp. paratuberculosis
uccagcugcgcgcc

SEQ ID NO: 1009887 - RNA, 15 nt, Mycobacterium avium subsp. paratuberculosis
uccagcugcgcgccg

SEQ ID NO: 1009888 - RNA, 22 nt, Mycobacterium avium subsp. paratuberculosis
uccagcuugucguagcggcgcc

SEQ ID NO: 1009889 - RNA, 22 nt, Mycobacterium avium subsp. paratuberculosis
uccaggaacggcacccgcagcu

SEQ ID NO: 1009890 - RNA, 15 nt, Mycobacterium avium subsp. paratuberculosis
uccaggguggccagc

SEQ ID NO: 1009891 - RNA, 15 nt, Mycobacterium avium subsp. paratuberculosis
uccagggugguggug

SEQ ID NO: 1009892 - RNA, 15 nt, Mycobacterium avium subsp. paratuberculosis
uccagggugucgucg

SEQ ID NO: 1009893 - RNA, 22 nt, Mycobacterium avium subsp. paratuberculosis
uccaggguucucgcggcggccg

SEQ ID NO: 1009894 - RNA, 23 nt, Mycobacterium avium subsp. paratuberculosis
uccaggcucgacaacugcccaau

SEQ ID NO: 1009895 - RNA, 17 nt, Mycobacterium avium subsp. paratuberculosis
uccaggcugaaucccuc

SEQ ID NO: 1009896 - RNA, 20 nt, Mycobacterium avium subsp. paratuberculosis
uccagcuaggagccugcuga

SEQ ID NO: 1009897 - RNA, 22 nt, Mycobacterium avium subsp. paratuberculosis
uccagcguuuccuggugcacca

SEQ ID NO: 1009898 - RNA, 15 nt, Mycobacterium avium subsp. paratuberculosis
uccagcucagcgcgc

SEQ ID NO: 1009899 - RNA, 15 nt, Mycobacterium avium subsp. paratuberculosis
uccagccuugcagcc

SEQ ID NO: 1009900 - RNA, 16 nt, Mycobacterium avium subsp. paratuberculosis
uccagcgcacacaccg

SEQ ID NO: 1009901 - RNA, 21 nt, Mycobacterium avium subsp. paratuberculosis
uccagcccgauguuggccuca

SEQ ID NO: 1009902 - RNA, 14 nt, Mycobacterium avium subsp. paratuberculosis
uccagccagcgcgc

SEQ ID NO: 1009903 - RNA, 20 nt, Mycobacterium avium subsp. paratuberculosis
uccagcccugcucggccagc

SEQ ID NO: 1009904 - RNA, 18 nt, Mycobacterium avium subsp. paratuberculosis
uccagccgccgcguggcc

SEQ ID NO: 1009905 - RNA, 14 nt, Mycobacterium avium subsp. paratuberculosis
uccagccggcccgc

SEQ ID NO: 1009906 - RNA, 13 nt, Mycobacterium avium subsp. paratuberculosis
uccagcacgccca

SEQ ID NO: 1009907 - RNA, 15 nt, Mycobacterium avium subsp. paratuberculosis
uccagcacccggccc

SEQ ID NO: 1009908 - RNA, 16 nt, Mycobacterium avium subsp. paratuberculosis
uccagcagcagcgcgc

SEQ ID NO: 1009909 - RNA, 21 nt, Mycobacterium avium subsp. paratuberculosis
uccagcagcccgggcugcagc

SEQ ID NO: 1009910 - RNA, 19 nt, Mycobacterium avium subsp. paratuberculosis
uccagcagcgccagcaccg

SEQ ID NO: 1009911 - RNA, 22 nt, Mycobacterium avium subsp. paratuberculosis
uccagcagcgccggcagcgccu

SEQ ID NO: 1009912 - RNA, 14 nt, Mycobacterium avium subsp. paratuberculosis
uccagccacuccac

SEQ ID NO: 1009913 - RNA, 18 nt, Mycobacterium avium subsp. paratuberculosis
uccagccacuccaccacc

SEQ ID NO: 1009914 - RNA, 20 nt, Mycobacterium avium subsp. paratuberculosis
uccagccacuccaccaccgg

SEQ ID NO: 1009915 - RNA, 13 nt, Mycobacterium avium subsp. paratuberculosis
ucacguagcucag

SEQ ID NO: 1009916 - RNA, 16 nt, Mycobacterium avium subsp. paratuberculosis
ucacgcggcuggcccg

SEQ ID NO: 1009917 - RNA, 16 nt, Mycobacterium avium subsp. paratuberculosis
ucacgcggcgggaacg

SEQ ID NO: 1009918 - RNA, 21 nt, Mycobacterium avium subsp. paratuberculosis
ucacgcuagcgugacagucga

SEQ ID NO: 1009919 - RNA, 15 nt, Mycobacterium avium subsp. paratuberculosis
ucacgcuggcgugac

SEQ ID NO: 1009920 - RNA, 21 nt, Mycobacterium avium subsp. paratuberculosis
ucacgcuggcgugacagucga

SEQ ID NO: 1009921 - RNA, 20 nt, Mycobacterium avium subsp. paratuberculosis
ucacgcuggugacgugcacc

SEQ ID NO: 1009922 - RNA, 22 nt, Mycobacterium avium subsp. paratuberculosis
ucacggugacgguuuuggucug

SEQ ID NO: 1009923 - RNA, 23 nt, Mycobacterium avium subsp. paratuberculosis
ucaccuucugcgucggcuugacu

SEQ ID NO: 1009924 - RNA, 13 nt, Mycobacterium avium subsp. paratuberculosis
ucaccugcgugcc

SEQ ID NO: 1009925 - RNA, 18 nt, Mycobacterium avium subsp. paratuberculosis
ucaccuccuuggccaggc

SEQ ID NO: 1009926 - RNA, 14 nt, Mycobacterium avium subsp. paratuberculosis
ucacgaagaaguau

SEQ ID NO: 1009927 - RNA, 16 nt, Mycobacterium avium subsp. paratuberculosis
ucaccuugcggccggc

SEQ ID NO: 1009928 - RNA, 16 nt, Mycobacterium avium subsp. paratuberculosis
ucaccuugcccugcgu

SEQ ID NO: 1009929 - RNA, 20 nt, Mycobacterium avium subsp. paratuberculosis
ucacgagcuccagcuaggag

SEQ ID NO: 1009930 - RNA, 15 nt, Mycobacterium avium subsp. paratuberculosis
ucacgaccggcagca

SEQ ID NO: 1009931 - RNA, 21 nt, Mycobacterium avium subsp. paratuberculosis
ucacgacgcggucugcggugc

SEQ ID NO: 1009932 - RNA, 15 nt, Mycobacterium avium subsp. paratuberculosis
ucaccccgcccagcg

SEQ ID NO: 1009933 - RNA, 18 nt, Mycobacterium avium subsp. paratuberculosis
ucaccccgaucaacaccg

SEQ ID NO: 1009934 - RNA, 14 nt, Mycobacterium avium subsp. paratuberculosis
ucacccgcagcccg

SEQ ID NO: 1009935 - RNA, 19 nt, Mycobacterium avium subsp. paratuberculosis
ucaccgaaguccgccaggg

SEQ ID NO: 1009936 - RNA, 22 nt, Mycobacterium avium subsp. paratuberculosis
ucaccgacaagggccgggcgcu

SEQ ID NO: 1009937 - RNA, 16 nt, Mycobacterium avium subsp. paratuberculosis
ucaccgagcugggccg

SEQ ID NO: 1009938 - RNA, 14 nt, Mycobacterium avium subsp. paratuberculosis
ucaccgccaccagc

SEQ ID NO: 1009939 - RNA, 17 nt, Mycobacterium avium subsp. paratuberculosis
ucaccgccaccagcagg

SEQ ID NO: 1009940 - RNA, 19 nt, Mycobacterium avium subsp. paratuberculosis
ucaccgccaggaccaccca

SEQ ID NO: 1009941 - RNA, 20 nt, Mycobacterium avium subsp. paratuberculosis
ucaccgagauggccaccauc

SEQ ID NO: 1009942 - RNA, 13 nt, Mycobacterium avium subsp. paratuberculosis
ucaccgaccagcu

SEQ ID NO: 1009943 - RNA, 15 nt, Mycobacterium avium subsp. paratuberculosis
ucaccgaccagcugu

SEQ ID NO: 1009944 - RNA, 16 nt, Mycobacterium avium subsp. paratuberculosis
ucaccgacgccagcgg

SEQ ID NO: 1009945 - RNA, 15 nt, Mycobacterium avium subsp. paratuberculosis
ucaccgacagcgcgu

SEQ ID NO: 1009946 - RNA, 14 nt, Mycobacterium avium subsp. paratuberculosis
ucaccgggcggccg

SEQ ID NO: 1009947 - RNA, 19 nt, Mycobacterium avium subsp. paratuberculosis
ucaccgggugaugucgccg

SEQ ID NO: 1009948 - RNA, 19 nt, Mycobacterium avium subsp. paratuberculosis
ucaccggcgcguuggcccg

SEQ ID NO: 1009949 - RNA, 15 nt, Mycobacterium avium subsp. paratuberculosis
ucaccgguggccgcg

SEQ ID NO: 1009950 - RNA, 22 nt, Mycobacterium avium subsp. paratuberculosis
ucaccggugucacgcuggcgug

SEQ ID NO: 1009951 - RNA, 19 nt, Mycobacterium avium subsp. paratuberculosis
ucaccgugaucgccaccac

SEQ ID NO: 1009952 - RNA, 19 nt, Mycobacterium avium subsp. paratuberculosis
ucaccgugcgcgcgcaccu

SEQ ID NO: 1009953 - RNA, 15 nt, Mycobacterium avium subsp. paratuberculosis
ucaccgucaggguga

SEQ ID NO: 1009954 - RNA, 14 nt, Mycobacterium avium subsp. paratuberculosis
ucaccgccgagccg

SEQ ID NO: 1009955 - RNA, 17 nt, Mycobacterium avium subsp. paratuberculosis
ucaccgccgagccgcuc

SEQ ID NO: 1009956 - RNA, 15 nt, Mycobacterium avium subsp. paratuberculosis
ucaccgccgagggcc

SEQ ID NO: 1009957 - RNA, 14 nt, Mycobacterium avium subsp. paratuberculosis
ucaccgccgcggcg

SEQ ID NO: 1009958 - RNA, 21 nt, Mycobacterium avium subsp. paratuberculosis
ucaccggaccggccagcagcc

SEQ ID NO: 1009959 - RNA, 15 nt, Mycobacterium avium subsp. paratuberculosis
ucaccggccagggcc

SEQ ID NO: 1009960 - RNA, 16 nt, Mycobacterium avium subsp. paratuberculosis
ucaccggccagggccg

SEQ ID NO: 1009961 - RNA, 22 nt, Mycobacterium avium subsp. paratuberculosis
ucaccgcgccgggcaccaccac

SEQ ID NO: 1009962 - RNA, 22 nt, Mycobacterium avium subsp. paratuberculosis
ucaccgcgcuuuggaccagggc

SEQ ID NO: 1009963 - RNA, 12 nt, Mycobacterium avium subsp. paratuberculosis
ucaccgcggcca

SEQ ID NO: 1009964 - RNA, 18 nt, Mycobacterium avium subsp. paratuberculosis
ucaccgcggccaccaccg

SEQ ID NO: 1009965 - RNA, 23 nt, Mycobacterium avium subsp. paratuberculosis
ucaccgcgggaauggccgcgccg

SEQ ID NO: 1009966 - RNA, 15 nt, Mycobacterium avium subsp. paratuberculosis
ucaccgcgggccagg

SEQ ID NO: 1009967 - RNA, 14 nt, Mycobacterium avium subsp. paratuberculosis
ucaccgcggggugc

SEQ ID NO: 1009968 - RNA, 20 nt, Mycobacterium avium subsp. paratuberculosis
ucaccacggucagggccagc

SEQ ID NO: 1009969 - RNA, 17 nt, Mycobacterium avium subsp. paratuberculosis
ucaccacgguggccgcg

SEQ ID NO: 1009970 - RNA, 15 nt, Mycobacterium avium subsp. paratuberculosis
ucaccaccaacgcca

SEQ ID NO: 1009971 - RNA, 13 nt, Mycobacterium avium subsp. paratuberculosis
ucacacgcgcgcc

SEQ ID NO: 1009972 - RNA, 21 nt, Mycobacterium avium subsp. paratuberculosis
ucacaccgcugagguaguccc

SEQ ID NO: 1009973 - RNA, 22 nt, Mycobacterium avium subsp. paratuberculosis
ucacaccucgcuacgcgagcug

SEQ ID NO: 1009974 - RNA, 16 nt, Mycobacterium avium subsp. paratuberculosis
ucacacagccgcuugg

SEQ ID NO: 1009975 - RNA, 17 nt, Mycobacterium avium subsp. paratuberculosis
ucacaaauccagcagcg

SEQ ID NO: 1009976 - RNA, 17 nt, Mycobacterium avium subsp. paratuberculosis
ucaaucggucagggugu

SEQ ID NO: 1009977 - RNA, 19 nt, Mycobacterium avium subsp. paratuberculosis
ucaaguccucgguggccac

SEQ ID NO: 1009978 - RNA, 19 nt, Mycobacterium avium subsp. paratuberculosis
ucaagccggcaugguuccc

SEQ ID NO: 1009979 - RNA, 15 nt, Mycobacterium avium subsp. paratuberculosis
ucaagccggccagca

SEQ ID NO: 1009980 - RNA, 21 nt, Mycobacterium avium subsp. paratuberculosis
ucaagccggccagcagcggcu

SEQ ID NO: 1009981 - RNA, 20 nt, Mycobacterium avium subsp. paratuberculosis
ucaagauggugugcaaaagc

SEQ ID NO: 1009982 - RNA, 15 nt, Mycobacterium avium subsp. paratuberculosis
ucaagauaccggccg

SEQ ID NO: 1009983 - RNA, 11 nt, Mycobacterium avium subsp. paratuberculosis
ucaaggugcug

SEQ ID NO: 1009984 - RNA, 12 nt, Mycobacterium avium subsp. paratuberculosis
ucaacugcacca

SEQ ID NO: 1009985 - RNA, 19 nt, Mycobacterium avium subsp. paratuberculosis
ucaagaacgaaucgucgcc

SEQ ID NO: 1009986 - RNA, 20 nt, Mycobacterium avium subsp. paratuberculosis
ucaaaaaccccgcucccauc

SEQ ID NO: 1009987 - RNA, 13 nt, Mycobacterium avium subsp. paratuberculosis
aaaugaccgcgcc

SEQ ID NO: 1009988 - RNA, 20 nt, Mycobacterium avium subsp. paratuberculosis
ucuaacuguugucagccacu

SEQ ID NO: 1009989 - RNA, 13 nt, Mycobacterium avium subsp. paratuberculosis
ucucagucggcca

SEQ ID NO: 1009990 - RNA, 13 nt, Mycobacterium avium subsp. paratuberculosis
ucucagcggcgcu

SEQ ID NO: 1009991 - RNA, 22 nt, Mycobacterium avium subsp. paratuberculosis
aaaugcccgcgccccggccuga

SEQ ID NO: 1009992 - RNA, 17 nt, Mycobacterium avium subsp. paratuberculosis
aaaugccgugccagccg

SEQ ID NO: 1009993 - RNA, 18 nt, Mycobacterium avium subsp. paratuberculosis
ucucacggcgaauauuuc

SEQ ID NO: 1009994 - RNA, 19 nt, Mycobacterium avium subsp. paratuberculosis
ucuaggacgugcucugccu

SEQ ID NO: 1009995 - RNA, 18 nt, Mycobacterium avium subsp. paratuberculosis
ucuggaucaccugggaga

SEQ ID NO: 1009996 - RNA, 15 nt, Mycobacterium avium subsp. paratuberculosis
ucugcuuggcaggcg

SEQ ID NO: 1009997 - RNA, 15 nt, Mycobacterium avium subsp. paratuberculosis
ucugcuugcaaggcg

SEQ ID NO: 1009998 - RNA, 13 nt, Mycobacterium avium subsp. paratuberculosis
ucugccacgccca

SEQ ID NO: 1009999 - RNA, 20 nt, Mycobacterium avium subsp. paratuberculosis
ucugccagaacggcggcagc

SEQ ID NO: 1010000 - RNA, 17 nt, Mycobacterium avium subsp. paratuberculosis
ucuggcagccggccggc

SEQ ID NO: 1010001 - RNA, 16 nt, Mycobacterium avium subsp. paratuberculosis
ucuggucggccagcgc

SEQ ID NO: 1010002 - RNA, 21 nt, Mycobacterium avium subsp. paratuberculosis
ucuggcuggugauggccaucu

SEQ ID NO: 1010003 - RNA, 21 nt, Mycobacterium avium subsp. paratuberculosis
ucugggcgaacggcaacggcg

SEQ ID NO: 1010004 - RNA, 20 nt, Mycobacterium avium subsp. paratuberculosis
ucugggcgaccaugccgcgg

SEQ ID NO: 1010005 - RNA, 19 nt, Mycobacterium avium subsp. paratuberculosis
ucugucgcgcucagugcac

SEQ ID NO: 1010006 - RNA, 13 nt, Mycobacterium avium subsp. paratuberculosis
ucuguauuaagcu

SEQ ID NO: 1010007 - RNA, 21 nt, Mycobacterium avium subsp. paratuberculosis
ucugguucaccgccaccagca

SEQ ID NO: 1010008 - RNA, 23 nt, Mycobacterium avium subsp. paratuberculosis
ucugguugaaccgguacaggccc

SEQ ID NO: 1010009 - RNA, 15 nt, Mycobacterium avium subsp. paratuberculosis
ucugguuggccggcg

SEQ ID NO: 1010010 - RNA, 21 nt, Mycobacterium avium subsp. paratuberculosis
ucugguuuuacacaccagcgg

SEQ ID NO: 1010011 - RNA, 13 nt, Mycobacterium avium subsp. paratuberculosis
ucuucccagugcc

SEQ ID NO: 1010012 - RNA, 17 nt, Mycobacterium avium subsp. paratuberculosis
ucuguugccggacaccu

SEQ ID NO: 1010013 - RNA, 17 nt, Mycobacterium avium subsp. paratuberculosis
ucucggccagccgguag

SEQ ID NO: 1010014 - RNA, 12 nt, Mycobacterium avium subsp. paratuberculosis
ucucggccgcgg

SEQ ID NO: 1010015 - RNA, 14 nt, Mycobacterium avium subsp. paratuberculosis
ucucggcggucuuu

SEQ ID NO: 1010016 - RNA, 16 nt, Mycobacterium avium subsp. paratuberculosis
ucugcagcucgcugag

SEQ ID NO: 1010017 - RNA, 23 nt, Mycobacterium avium subsp. paratuberculosis
ucugcaccagcguggugcgcccg

SEQ ID NO: 1010018 - RNA, 12 nt, Mycobacterium avium subsp. paratuberculosis
ucugaaagugac

SEQ ID NO: 1010019 - RNA, 16 nt, Mycobacterium avium subsp. paratuberculosis
ucugaccgagcagcgg

SEQ ID NO: 1010020 - RNA, 23 nt, Mycobacterium avium subsp. paratuberculosis
ucuccuggugucguauuguccug

SEQ ID NO: 1010021 - RNA, 15 nt, Mycobacterium avium subsp. paratuberculosis
ucuccggccccgagc

SEQ ID NO: 1010022 - RNA, 12 nt, Mycobacterium avium subsp. paratuberculosis
ucuccggcccgc

SEQ ID NO: 1010023 - RNA, 20 nt, Mycobacterium avium subsp. paratuberculosis
ucuccguggacggcgagcgg

SEQ ID NO: 1010024 - RNA, 22 nt, Mycobacterium avium subsp. paratuberculosis
ucucgaucgacgacgccagcug

SEQ ID NO: 1010025 - RNA, 20 nt, Mycobacterium avium subsp. paratuberculosis
ucucgcccaccuuggcgucg

SEQ ID NO: 1010026 - RNA, 16 nt, Mycobacterium avium subsp. paratuberculosis
ucucgccccggccguu

SEQ ID NO: 1010027 - RNA, 18 nt, Mycobacterium avium subsp. paratuberculosis
ucucgccgagcacaccgu

SEQ ID NO: 1010028 - RNA, 20 nt, Mycobacterium avium subsp. paratuberculosis
ucucgccggggaacaccggc

SEQ ID NO: 1010029 - RNA, 16 nt, Mycobacterium avium subsp. paratuberculosis
ucucgccguccccacc

SEQ ID NO: 1010030 - RNA, 17 nt, Mycobacterium avium subsp. paratuberculosis
ucucgcucugccgggcc

SEQ ID NO: 1010031 - RNA, 18 nt, Mycobacterium avium subsp. paratuberculosis
ucucgcucugccgggccg

SEQ ID NO: 1010032 - RNA, 21 nt, Mycobacterium avium subsp. paratuberculosis
ucucgcgcaggucacccuccu

SEQ ID NO: 1010033 - RNA, 15 nt, Mycobacterium avium subsp. paratuberculosis
ucucgaacggcccgg

SEQ ID NO: 1010034 - RNA, 14 nt, Mycobacterium avium subsp. paratuberculosis
ucuccuuguugacg

SEQ ID NO: 1010035 - RNA, 19 nt, Mycobacterium avium subsp. paratuberculosis
ucucgagcaggaacagaca

SEQ ID NO: 1010036 - RNA, 21 nt, Mycobacterium avium subsp. paratuberculosis
ucucgaagcgacaaaggaggg

SEQ ID NO: 1010037 - RNA, 19 nt, Mycobacterium avium subsp. paratuberculosis
ucucgacccgggccagcag

SEQ ID NO: 1010038 - RNA, 14 nt, Mycobacterium avium subsp. paratuberculosis
ucuccccgccggag

SEQ ID NO: 1010039 - RNA, 16 nt, Mycobacterium avium subsp. paratuberculosis
ucuccgaggcguccuc

SEQ ID NO: 1010040 - RNA, 14 nt, Mycobacterium avium subsp. paratuberculosis
ucuccgccgggcug

SEQ ID NO: 1010041 - RNA, 13 nt, Mycobacterium avium subsp. paratuberculosis
ucuccagccgcgg

SEQ ID NO: 1010042 - RNA, 12 nt, Mycobacterium avium subsp. paratuberculosis
ucuccagcagcu

SEQ ID NO: 1010043 - RNA, 12 nt, Mycobacterium avium subsp. paratuberculosis
ucuccagcggcc

SEQ ID NO: 1010044 - RNA, 14 nt, Mycobacterium avium subsp. paratuberculosis
ucuccagcggccgc

SEQ ID NO: 1010045 - RNA, 12 nt, Mycobacterium avium subsp. paratuberculosis
ucuccagcuccg

SEQ ID NO: 1010046 - RNA, 13 nt, Mycobacterium avium subsp. paratuberculosis
ucuccagcuccgc

SEQ ID NO: 1010047 - RNA, 19 nt, Mycobacterium avium subsp. paratuberculosis
ucuccaccguguucaccag

SEQ ID NO: 1010048 - RNA, 18 nt, Mycobacterium avium subsp. paratuberculosis
ucguugaacaguucggug

SEQ ID NO: 1010049 - RNA, 14 nt, Mycobacterium avium subsp. paratuberculosis
ucguugaccggguc

SEQ ID NO: 1010050 - RNA, 14 nt, Mycobacterium avium subsp. paratuberculosis
ucguugcgccgcca

SEQ ID NO: 1010051 - RNA, 13 nt, Mycobacterium avium subsp. paratuberculosis
ucguugcacacca

SEQ ID NO: 1010052 - RNA, 16 nt, Mycobacterium avium subsp. paratuberculosis
ucguugcacacccggu

SEQ ID NO: 1010053 - RNA, 17 nt, Mycobacterium avium subsp. paratuberculosis
ucguugaucaggugcag

SEQ ID NO: 1010054 - RNA, 15 nt, Mycobacterium avium subsp. paratuberculosis
ucguuguccaccauc

SEQ ID NO: 1010055 - RNA, 13 nt, Mycobacterium avium subsp. paratuberculosis
ucguugugcaccg

SEQ ID NO: 1010056 - RNA, 21 nt, Mycobacterium avium subsp. paratuberculosis
ucguuguagcugauggcaccc

SEQ ID NO: 1010057 - RNA, 18 nt, Mycobacterium avium subsp. paratuberculosis
ucguugggcaugucgccg

SEQ ID NO: 1010058 - RNA, 16 nt, Mycobacterium avium subsp. paratuberculosis
ucguguccgggcccga

SEQ ID NO: 1010059 - RNA, 14 nt, Mycobacterium avium subsp. paratuberculosis
ucgugcccgggccc

SEQ ID NO: 1010060 - RNA, 18 nt, Mycobacterium avium subsp. paratuberculosis
ucgugccgagcgugaagc

SEQ ID NO: 1010061 - RNA, 15 nt, Mycobacterium avium subsp. paratuberculosis
ucgugcggcgccgcc

SEQ ID NO: 1010062 - RNA, 20 nt, Mycobacterium avium subsp. paratuberculosis
ucgugcggcgccgcccggcg

SEQ ID NO: 1010063 - RNA, 23 nt, Mycobacterium avium subsp. paratuberculosis
ucgugcgggcuccgcacgaccug

SEQ ID NO: 1010064 - RNA, 14 nt, Mycobacterium avium subsp. paratuberculosis
ucgugccagcgcag

SEQ ID NO: 1010065 - RNA, 13 nt, Mycobacterium avium subsp. paratuberculosis
ucgugcugggccg

SEQ ID NO: 1010066 - RNA, 19 nt, Mycobacterium avium subsp. paratuberculosis
ucguggaaaucgagcgcgc

SEQ ID NO: 1010067 - RNA, 19 nt, Mycobacterium avium subsp. paratuberculosis
ucguggacaggaggacaag

SEQ ID NO: 1010068 - RNA, 18 nt, Mycobacterium avium subsp. paratuberculosis
ucguggcccugcucgucg

SEQ ID NO: 1010069 - RNA, 17 nt, Mycobacterium avium subsp. paratuberculosis
ucguggcgcaucaccuu

SEQ ID NO: 1010070 - RNA, 19 nt, Mycobacterium avium subsp. paratuberculosis
ucguggcugaacagcgcgc

SEQ ID NO: 1010071 - RNA, 16 nt, Mycobacterium avium subsp. paratuberculosis
ucgucggucugcaggu

SEQ ID NO: 1010072 - RNA, 22 nt, Mycobacterium avium subsp. paratuberculosis
ucgucggugauggugaccaacc

SEQ ID NO: 1010073 - RNA, 17 nt, Mycobacterium avium subsp. paratuberculosis
ucgucggucaggccggc

SEQ ID NO: 1010074 - RNA, 21 nt, Mycobacterium avium subsp. paratuberculosis
ucgucgugggugacccggccg

SEQ ID NO: 1010075 - RNA, 22 nt, Mycobacterium avium subsp. paratuberculosis
ucgucguugagcaucaccauga

SEQ ID NO: 1010076 - RNA, 16 nt, Mycobacterium avium subsp. paratuberculosis
ucgucgucgccgccgg

SEQ ID NO: 1010077 - RNA, 13 nt, Mycobacterium avium subsp. paratuberculosis
ucgucgucggccg

SEQ ID NO: 1010078 - RNA, 17 nt, Mycobacterium avium subsp. paratuberculosis
ucgucuggccguugaug

SEQ ID NO: 1010079 - RNA, 22 nt, Mycobacterium avium subsp. paratuberculosis
ucguagaggggccggacgguga

SEQ ID NO: 1010080 - RNA, 12 nt, Mycobacterium avium subsp. paratuberculosis
ucguacagcagc

SEQ ID NO: 1010081 - RNA, 18 nt, Mycobacterium avium subsp. paratuberculosis
ucguaccaccaccagucg

SEQ ID NO: 1010082 - RNA, 17 nt, Mycobacterium avium subsp. paratuberculosis
ucgucauccccuggccg

SEQ ID NO: 1010083 - RNA, 23 nt, Mycobacterium avium subsp. paratuberculosis
ucguccaggguggccagcacgcu

SEQ ID NO: 1010084 - RNA, 13 nt, Mycobacterium avium subsp. paratuberculosis
ucguccacaccgg

SEQ ID NO: 1010085 - RNA, 13 nt, Mycobacterium avium subsp. paratuberculosis
ucguccaccagcu

SEQ ID NO: 1010086 - RNA, 16 nt, Mycobacterium avium subsp. paratuberculosis
ucguccggcgcgcagc

SEQ ID NO: 1010087 - RNA, 14 nt, Mycobacterium avium subsp. paratuberculosis
ucgucccggugaug

SEQ ID NO: 1010088 - RNA, 17 nt, Mycobacterium avium subsp. paratuberculosis
ucgucccggugaugacg

SEQ ID NO: 1010089 - RNA, 23 nt, Mycobacterium avium subsp. paratuberculosis
ucgucgcacaaccgggccaacgg

SEQ ID NO: 1010090 - RNA, 20 nt, Mycobacterium avium subsp. paratuberculosis
ucgucgaugcgcagcagcgg

SEQ ID NO: 1010091 - RNA, 21 nt, Mycobacterium avium subsp. paratuberculosis
ucgucgauggccaccaggucc

SEQ ID NO: 1010092 - RNA, 13 nt, Mycobacterium avium subsp. paratuberculosis
ucgucgaucaggg

SEQ ID NO: 1010093 - RNA, 17 nt, Mycobacterium avium subsp. paratuberculosis
ucgucgagggccaccgg

SEQ ID NO: 1010094 - RNA, 15 nt, Mycobacterium avium subsp. paratuberculosis
ucgucgaugaacagc

SEQ ID NO: 1010095 - RNA, 13 nt, Mycobacterium avium subsp. paratuberculosis
ucgucgaccugcu

SEQ ID NO: 1010096 - RNA, 22 nt, Mycobacterium avium subsp. paratuberculosis
ucgucgacgagcccgccggcgg

SEQ ID NO: 1010097 - RNA, 17 nt, Mycobacterium avium subsp. paratuberculosis
ucgucgacgauggcccg

SEQ ID NO: 1010098 - RNA, 19 nt, Mycobacterium avium subsp. paratuberculosis
ucgucgagcaccacccggg

SEQ ID NO: 1010099 - RNA, 16 nt, Mycobacterium avium subsp. paratuberculosis
ucgucgagcaccaccc

SEQ ID NO: 1010100 - RNA, 13 nt, Mycobacterium avium subsp. paratuberculosis
ucgucgagcaccg

SEQ ID NO: 1010101 - RNA, 21 nt, Mycobacterium avium subsp. paratuberculosis
ucguccgugcugccggccggc

SEQ ID NO: 1010102 - RNA, 20 nt, Mycobacterium avium subsp. paratuberculosis
ucguccucgcgccguggccc

SEQ ID NO: 1010103 - RNA, 16 nt, Mycobacterium avium subsp. paratuberculosis
ucgucgaaggucugca

SEQ ID NO: 1010104 - RNA, 18 nt, Mycobacterium avium subsp. paratuberculosis
ucgucgcgguccacgccg

SEQ ID NO: 1010105 - RNA, 14 nt, Mycobacterium avium subsp. paratuberculosis
ucgucgcuggccag

SEQ ID NO: 1010106 - RNA, 17 nt, Mycobacterium avium subsp. paratuberculosis
ucgucgcuguccucgag

SEQ ID NO: 1010107 - RNA, 14 nt, Mycobacterium avium subsp. paratuberculosis
ucgucgccgggcug

SEQ ID NO: 1010108 - RNA, 18 nt, Mycobacterium avium subsp. paratuberculosis
ucgucggguuggccaggg

SEQ ID NO: 1010109 - RNA, 19 nt, Mycobacterium avium subsp. paratuberculosis
ucgucggguuggccagggc

SEQ ID NO: 1010110 - RNA, 18 nt, Mycobacterium avium subsp. paratuberculosis
ucgucgggaaugucggcg

SEQ ID NO: 1010111 - RNA, 18 nt, Mycobacterium avium subsp. paratuberculosis
ucgucgggcaccacggcg

SEQ ID NO: 1010112 - RNA, 17 nt, Mycobacterium avium subsp. paratuberculosis
ucgucggcgcgccaccc

SEQ ID NO: 1010113 - RNA, 20 nt, Mycobacterium avium subsp. paratuberculosis
ucgucggcgcgggccagcag

SEQ ID NO: 1010114 - RNA, 21 nt, Mycobacterium avium subsp. paratuberculosis
ucgucggcgcgguugucguug

SEQ ID NO: 1010115 - RNA, 14 nt, Mycobacterium avium subsp. paratuberculosis
ucgucggccagcga

SEQ ID NO: 1010116 - RNA, 15 nt, Mycobacterium avium subsp. paratuberculosis
ucgucggccgggccg

SEQ ID NO: 1010117 - RNA, 23 nt, Mycobacterium avium subsp. paratuberculosis
ucgucggccgucggcgccgccga

SEQ ID NO: 1010118 - RNA, 14 nt, Mycobacterium avium subsp. paratuberculosis
ucgucggccugcac

SEQ ID NO: 1010119 - RNA, 19 nt, Mycobacterium avium subsp. paratuberculosis
ucgucggcgaacagugcac

SEQ ID NO: 1010120 - RNA, 20 nt, Mycobacterium avium subsp. paratuberculosis
ucggcuuggggaagccggcc

SEQ ID NO: 1010121 - RNA, 16 nt, Mycobacterium avium subsp. paratuberculosis
ucgggaacggucagcc

SEQ ID NO: 1010122 - RNA, 20 nt, Mycobacterium avium subsp. paratuberculosis
ucgggaacggucagccgcgg

SEQ ID NO: 1010123 - RNA, 16 nt, Mycobacterium avium subsp. paratuberculosis
ucgggagcaaggucgu

SEQ ID NO: 1010124 - RNA, 19 nt, Mycobacterium avium subsp. paratuberculosis
ucgggaccgucgcgcagcc

SEQ ID NO: 1010125 - RNA, 15 nt, Mycobacterium avium subsp. paratuberculosis
ucggcuuccuccucg

SEQ ID NO: 1010126 - RNA, 16 nt, Mycobacterium avium subsp. paratuberculosis
ucggcguguuccuugc

SEQ ID NO: 1010127 - RNA, 23 nt, Mycobacterium avium subsp. paratuberculosis
ucggcucgauccacagcgucaau

SEQ ID NO: 1010128 - RNA, 17 nt, Mycobacterium avium subsp. paratuberculosis
ucggcucgcccgcgacu

SEQ ID NO: 1010129 - RNA, 20 nt, Mycobacterium avium subsp. paratuberculosis
ucggcgggugcgggcgcugc

SEQ ID NO: 1010130 - RNA, 22 nt, Mycobacterium avium subsp. paratuberculosis
ucggcgguccgccgcagcggcg

SEQ ID NO: 1010131 - RNA, 17 nt, Mycobacterium avium subsp. paratuberculosis
ucggcggucgccagcgc

SEQ ID NO: 1010132 - RNA, 13 nt, Mycobacterium avium subsp. paratuberculosis
ucggcggucuugg

SEQ ID NO: 1010133 - RNA, 21 nt, Mycobacterium avium subsp. paratuberculosis
ucggcggucuuggcggccagc

SEQ ID NO: 1010134 - RNA, 15 nt, Mycobacterium avium subsp. paratuberculosis
ucggcguccgugccg

SEQ ID NO: 1010135 - RNA, 18 nt, Mycobacterium avium subsp. paratuberculosis
ucggcgucgacgacggcg

SEQ ID NO: 1010136 - RNA, 23 nt, Mycobacterium avium subsp. paratuberculosis
ucggcgucacugcccagccaucu

SEQ ID NO: 1010137 - RNA, 13 nt, Mycobacterium avium subsp. paratuberculosis
ucggcguccagca

SEQ ID NO: 1010138 - RNA, 22 nt, Mycobacterium avium subsp. paratuberculosis
ucggcgggcaccucggccaggu

SEQ ID NO: 1010139 - RNA, 16 nt, Mycobacterium avium subsp. paratuberculosis
ucggcgggagccggcg

SEQ ID NO: 1010140 - RNA, 14 nt, Mycobacterium avium subsp. paratuberculosis
ucggcggcgggcag

SEQ ID NO: 1010141 - RNA, 18 nt, Mycobacterium avium subsp. paratuberculosis
ucggcggguaugucggcg

SEQ ID NO: 1010142 - RNA, 22 nt, Mycobacterium avium subsp. paratuberculosis
ucggcgggccgcccggcgcgcc

SEQ ID NO: 1010143 - RNA, 14 nt, Mycobacterium avium subsp. paratuberculosis
ucggcgggcgugcc

SEQ ID NO: 1010144 - RNA, 19 nt, Mycobacterium avium subsp. paratuberculosis
ucggcgggcucgcgcuggc

SEQ ID NO: 1010145 - RNA, 13 nt, Mycobacterium avium subsp. paratuberculosis
ucggcgggcugca

SEQ ID NO: 1010146 - RNA, 20 nt, Mycobacterium avium subsp. paratuberculosis
ucggcgggcugcagcgacug

SEQ ID NO: 1010147 - RNA, 15 nt, Mycobacterium avium subsp. paratuberculosis
ucggcggcgcggccc

SEQ ID NO: 1010148 - RNA, 20 nt, Mycobacterium avium subsp. paratuberculosis
ucggcgcucgccgcgcggcc

SEQ ID NO: 1010149 - RNA, 15 nt, Mycobacterium avium subsp. paratuberculosis
ucggcgcuggccagc

SEQ ID NO: 1010150 - RNA, 13 nt, Mycobacterium avium subsp. paratuberculosis
ucggcggaggcga

SEQ ID NO: 1010151 - RNA, 15 nt, Mycobacterium avium subsp. paratuberculosis
ucggcggcaaagcgu

SEQ ID NO: 1010152 - RNA, 15 nt, Mycobacterium avium subsp. paratuberculosis
ucggcggccaccagc

SEQ ID NO: 1010153 - RNA, 16 nt, Mycobacterium avium subsp. paratuberculosis
ucggcggccaccagcc

SEQ ID NO: 1010154 - RNA, 21 nt, Mycobacterium avium subsp. paratuberculosis
ucggcggccaccagccggccg

SEQ ID NO: 1010155 - RNA, 22 nt, Mycobacterium avium subsp. paratuberculosis
ucggcgcggaugacgugcacca

SEQ ID NO: 1010156 - RNA, 14 nt, Mycobacterium avium subsp. paratuberculosis
ucggcgcgccggcg

SEQ ID NO: 1010157 - RNA, 19 nt, Mycobacterium avium subsp. paratuberculosis
ucggcgcgcggggccggcg

SEQ ID NO: 1010158 - RNA, 12 nt, Mycobacterium avium subsp. paratuberculosis
ucggcgccgaau

SEQ ID NO: 1010159 - RNA, 14 nt, Mycobacterium avium subsp. paratuberculosis
ucggcgcgccgaag

SEQ ID NO: 1010160 - RNA, 13 nt, Mycobacterium avium subsp. paratuberculosis
ucggcgcgcaccg

SEQ ID NO: 1010161 - RNA, 15 nt, Mycobacterium avium subsp. paratuberculosis
ucggcgcgcaccgcg

SEQ ID NO: 1010162 - RNA, 12 nt, Mycobacterium avium subsp. paratuberculosis
ucggcgccggcg

SEQ ID NO: 1010163 - RNA, 17 nt, Mycobacterium avium subsp. paratuberculosis
ucggcgccggccagcgg

SEQ ID NO: 1010164 - RNA, 23 nt, Mycobacterium avium subsp. paratuberculosis
ucggccugcccgcggguggccuu

SEQ ID NO: 1010165 - RNA, 21 nt, Mycobacterium avium subsp. paratuberculosis
ucggccgugaucucgugccgc

SEQ ID NO: 1010166 - RNA, 15 nt, Mycobacterium avium subsp. paratuberculosis
ucggccggcugcagc

SEQ ID NO: 1010167 - RNA, 18 nt, Mycobacterium avium subsp. paratuberculosis
ucggccgucggcgccgcc

SEQ ID NO: 1010168 - RNA, 13 nt, Mycobacterium avium subsp. paratuberculosis
ucggccgggccgg

SEQ ID NO: 1010169 - RNA, 21 nt, Mycobacterium avium subsp. paratuberculosis
ucggccgggucgcaggcagca

SEQ ID NO: 1010170 - RNA, 22 nt, Mycobacterium avium subsp. paratuberculosis
ucggccggguuguccuggcccu

SEQ ID NO: 1010171 - RNA, 21 nt, Mycobacterium avium subsp. paratuberculosis
ucggccgguccgugcacggcc

SEQ ID NO: 1010172 - RNA, 22 nt, Mycobacterium avium subsp. paratuberculosis
ucggccggcagcggugccgccc

SEQ ID NO: 1010173 - RNA, 20 nt, Mycobacterium avium subsp. paratuberculosis
ucggccggccccgcccggcg

SEQ ID NO: 1010174 - RNA, 14 nt, Mycobacterium avium subsp. paratuberculosis
ucggcgaacagugc

SEQ ID NO: 1010175 - RNA, 16 nt, Mycobacterium avium subsp. paratuberculosis
ucggcgaaccagggca

SEQ ID NO: 1010176 - RNA, 20 nt, Mycobacterium avium subsp. paratuberculosis
ucggcgaaccagggcagcca

SEQ ID NO: 1010177 - RNA, 16 nt, Mycobacterium avium subsp. paratuberculosis
ucggccuugaccagga

SEQ ID NO: 1010178 - RNA, 14 nt, Mycobacterium avium subsp. paratuberculosis
ucggccugcgcugc

SEQ ID NO: 1010179 - RNA, 21 nt, Mycobacterium avium subsp. paratuberculosis
ucggcgccacgaccagcggca

SEQ ID NO: 1010180 - RNA, 22 nt, Mycobacterium avium subsp. paratuberculosis
ucggcgccacgaccagcggcag

SEQ ID NO: 1010181 - RNA, 15 nt, Mycobacterium avium subsp. paratuberculosis
ucggcgccagcccgc

SEQ ID NO: 1010182 - RNA, 13 nt, Mycobacterium avium subsp. paratuberculosis
ucggcgcccagga

SEQ ID NO: 1010183 - RNA, 16 nt, Mycobacterium avium subsp. paratuberculosis
ucggcgccccccugcu

SEQ ID NO: 1010184 - RNA, 20 nt, Mycobacterium avium subsp. paratuberculosis
ucggcgccccgcccgcgacu

SEQ ID NO: 1010185 - RNA, 17 nt, Mycobacterium avium subsp. paratuberculosis
ucggcgaugcgcaccau

SEQ ID NO: 1010186 - RNA, 22 nt, Mycobacterium avium subsp. paratuberculosis
ucggcgaugucgaagcccuuca

SEQ ID NO: 1010187 - RNA, 22 nt, Mycobacterium avium subsp. paratuberculosis
ucggcgauguugaccacccgca

SEQ ID NO: 1010188 - RNA, 13 nt, Mycobacterium avium subsp. paratuberculosis
ucggcgacgcuca

SEQ ID NO: 1010189 - RNA, 19 nt, Mycobacterium avium subsp. paratuberculosis
ucggcgaccgcgcgcggcg

SEQ ID NO: 1010190 - RNA, 15 nt, Mycobacterium avium subsp. paratuberculosis
ucggcgagugcaccu

SEQ ID NO: 1010191 - RNA, 16 nt, Mycobacterium avium subsp. paratuberculosis
ucggcgaucagcuccu

SEQ ID NO: 1010192 - RNA, 17 nt, Mycobacterium avium subsp. paratuberculosis
ucggcgaucagcuccuc

SEQ ID NO: 1010193 - RNA, 15 nt, Mycobacterium avium subsp. paratuberculosis
ucggcgauccacgcc

SEQ ID NO: 1010194 - RNA, 16 nt, Mycobacterium avium subsp. paratuberculosis
ucggcgaucgccagca

SEQ ID NO: 1010195 - RNA, 19 nt, Mycobacterium avium subsp. paratuberculosis
ucggcgagcagccgcgccg

SEQ ID NO: 1010196 - RNA, 22 nt, Mycobacterium avium subsp. paratuberculosis
ucggccagucguacucccaggc

SEQ ID NO: 1010197 - RNA, 10 nt, Mycobacterium avium subsp. paratuberculosis
ucggccaggg

SEQ ID NO: 1010198 - RNA, 13 nt, Mycobacterium avium subsp. paratuberculosis
ucggccagggcuc

SEQ ID NO: 1010199 - RNA, 21 nt, Mycobacterium avium subsp. paratuberculosis
ucggccaguucaccgcgcucc

SEQ ID NO: 1010200 - RNA, 15 nt, Mycobacterium avium subsp. paratuberculosis
ucggccagcggcagc

SEQ ID NO: 1010201 - RNA, 22 nt, Mycobacterium avium subsp. paratuberculosis
ucggccagcucaccggccaggg

SEQ ID NO: 1010202 - RNA, 19 nt, Mycobacterium avium subsp. paratuberculosis
ucggccagcaccagcagcc

SEQ ID NO: 1010203 - RNA, 11 nt, Mycobacterium avium subsp. paratuberculosis
ucggccagcgg

SEQ ID NO: 1010204 - RNA, 16 nt, Mycobacterium avium subsp. paratuberculosis
ucggccagcgccgccc

SEQ ID NO: 1010205 - RNA, 14 nt, Mycobacterium avium subsp. paratuberculosis
ucggccagcgcgcc

SEQ ID NO: 1010206 - RNA, 21 nt, Mycobacterium avium subsp. paratuberculosis
ucggccagcgcgcgcagcgcu

SEQ ID NO: 1010207 - RNA, 14 nt, Mycobacterium avium subsp. paratuberculosis
ucggccagcgcagc

SEQ ID NO: 1010208 - RNA, 12 nt, Mycobacterium avium subsp. paratuberculosis
ucggccagcccc

SEQ ID NO: 1010209 - RNA, 13 nt, Mycobacterium avium subsp. paratuberculosis
ucggccagcagcg

SEQ ID NO: 1010210 - RNA, 15 nt, Mycobacterium avium subsp. paratuberculosis
ucggccagccaggcc

SEQ ID NO: 1010211 - RNA, 14 nt, Mycobacterium avium subsp. paratuberculosis
ucggcccaggccaa

SEQ ID NO: 1010212 - RNA, 23 nt, Mycobacterium avium subsp. paratuberculosis
ucggcccaggccaacagcagcag

SEQ ID NO: 1010213 - RNA, 14 nt, Mycobacterium avium subsp. paratuberculosis
ucggcccccgggcc

SEQ ID NO: 1010214 - RNA, 19 nt, Mycobacterium avium subsp. paratuberculosis
ucggcccccgggcccgaag

SEQ ID NO: 1010215 - RNA, 23 nt, Mycobacterium avium subsp. paratuberculosis
ucggccccgcgcaucggucagca

SEQ ID NO: 1010216 - RNA, 21 nt, Mycobacterium avium subsp. paratuberculosis
ucggccccggccgagccggcg

SEQ ID NO: 1010217 - RNA, 23 nt, Mycobacterium avium subsp. paratuberculosis
ucggcccgacggguucgcgcagc

SEQ ID NO: 1010218 - RNA, 14 nt, Mycobacterium avium subsp. paratuberculosis
ucggccgcgugcac

SEQ ID NO: 1010219 - RNA, 18 nt, Mycobacterium avium subsp. paratuberculosis
ucggccgcacgucccgcc

SEQ ID NO: 1010220 - RNA, 16 nt, Mycobacterium avium subsp. paratuberculosis
ucggccgccaccgcca

SEQ ID NO: 1010221 - RNA, 14 nt, Mycobacterium avium subsp. paratuberculosis
ucggccgccagggc

SEQ ID NO: 1010222 - RNA, 19 nt, Mycobacterium avium subsp. paratuberculosis
ucggccgccagggccaggu

SEQ ID NO: 1010223 - RNA, 15 nt, Mycobacterium avium subsp. paratuberculosis
ucggcccgccgggcc

SEQ ID NO: 1010224 - RNA, 14 nt, Mycobacterium avium subsp. paratuberculosis
ucggucagcgccac

SEQ ID NO: 1010225 - RNA, 13 nt, Mycobacterium avium subsp. paratuberculosis
ucggucagcgcgu

SEQ ID NO: 1010226 - RNA, 13 nt, Mycobacterium avium subsp. paratuberculosis
ucggucagcggcg

SEQ ID NO: 1010227 - RNA, 18 nt, Mycobacterium avium subsp. paratuberculosis
ucggucagucgcgccgcc

SEQ ID NO: 1010228 - RNA, 13 nt, Mycobacterium avium subsp. paratuberculosis
ucggucaggcacu

SEQ ID NO: 1010229 - RNA, 15 nt, Mycobacterium avium subsp. paratuberculosis
ucggucucggcggcg

SEQ ID NO: 1010230 - RNA, 18 nt, Mycobacterium avium subsp. paratuberculosis
ucggugaacgccggugag

SEQ ID NO: 1010231 - RNA, 18 nt, Mycobacterium avium subsp. paratuberculosis
ucgguccagguggccaug

SEQ ID NO: 1010232 - RNA, 21 nt, Mycobacterium avium subsp. paratuberculosis
ucgguccaaaacaucccggac

SEQ ID NO: 1010233 - RNA, 15 nt, Mycobacterium avium subsp. paratuberculosis
ucggugagccgcugg

SEQ ID NO: 1010234 - RNA, 16 nt, Mycobacterium avium subsp. paratuberculosis
ucggugaugucgacgu

SEQ ID NO: 1010235 - RNA, 21 nt, Mycobacterium avium subsp. paratuberculosis
ucggugaucacccgccgggug

SEQ ID NO: 1010236 - RNA, 13 nt, Mycobacterium avium subsp. paratuberculosis
ucggugcacggcg

SEQ ID NO: 1010237 - RNA, 15 nt, Mycobacterium avium subsp. paratuberculosis
ucggugcgcauggcg

SEQ ID NO: 1010238 - RNA, 18 nt, Mycobacterium avium subsp. paratuberculosis
ucggugcgccagaucagc

SEQ ID NO: 1010239 - RNA, 16 nt, Mycobacterium avium subsp. paratuberculosis
ucggugcggaugcuga

SEQ ID NO: 1010240 - RNA, 13 nt, Mycobacterium avium subsp. paratuberculosis
ucggugcccagca

SEQ ID NO: 1010241 - RNA, 20 nt, Mycobacterium avium subsp. paratuberculosis
ucggugaugccgagcgccgc

SEQ ID NO: 1010242 - RNA, 16 nt, Mycobacterium avium subsp. paratuberculosis
ucggugccgagcacgc

SEQ ID NO: 1010243 - RNA, 22 nt, Mycobacterium avium subsp. paratuberculosis
ucgguggacgcggucgccgccc

SEQ ID NO: 1010244 - RNA, 11 nt, Mycobacterium avium subsp. paratuberculosis
ucgguggccca

SEQ ID NO: 1010245 - RNA, 18 nt, Mycobacterium avium subsp. paratuberculosis
ucgguggccaccaccgag

SEQ ID NO: 1010246 - RNA, 21 nt, Mycobacterium avium subsp. paratuberculosis
ucgguggcgguggccacggcg

SEQ ID NO: 1010247 - RNA, 20 nt, Mycobacterium avium subsp. paratuberculosis
ucgguggcgucggcggccug

SEQ ID NO: 1010248 - RNA, 18 nt, Mycobacterium avium subsp. paratuberculosis
ucggugucccgcgcccgc

SEQ ID NO: 1010249 - RNA, 16 nt, Mycobacterium avium subsp. paratuberculosis
ucggugucgagggcca

SEQ ID NO: 1010250 - RNA, 16 nt, Mycobacterium avium subsp. paratuberculosis
ucggugucgcucaucc

SEQ ID NO: 1010251 - RNA, 15 nt, Mycobacterium avium subsp. paratuberculosis
ucggugggccgccgc

SEQ ID NO: 1010252 - RNA, 13 nt, Mycobacterium avium subsp. paratuberculosis
ucgguggucgacg

SEQ ID NO: 1010253 - RNA, 13 nt, Mycobacterium avium subsp. paratuberculosis
ucgguggucucgu

SEQ ID NO: 1010254 - RNA, 16 nt, Mycobacterium avium subsp. paratuberculosis
ucggugugcagcagcu

SEQ ID NO: 1010255 - RNA, 20 nt, Mycobacterium avium subsp. paratuberculosis
ucgguuucgaacugggucug

SEQ ID NO: 1010256 - RNA, 21 nt, Mycobacterium avium subsp. paratuberculosis
ucgguucugcagcgagauccc

SEQ ID NO: 1010257 - RNA, 14 nt, Mycobacterium avium subsp. paratuberculosis
ucgguuggcucgca

SEQ ID NO: 1010258 - RNA, 14 nt, Mycobacterium avium subsp. paratuberculosis
ucggguugccggcg

SEQ ID NO: 1010259 - RNA, 14 nt, Mycobacterium avium subsp. paratuberculosis
ucggguuggccagg

SEQ ID NO: 1010260 - RNA, 15 nt, Mycobacterium avium subsp. paratuberculosis
ucggguuggccaggg

SEQ ID NO: 1010261 - RNA, 18 nt, Mycobacterium avium subsp. paratuberculosis
ucgggugcgcucaccgca

SEQ ID NO: 1010262 - RNA, 14 nt, Mycobacterium avium subsp. paratuberculosis
ucggguggcaggaa

SEQ ID NO: 1010263 - RNA, 21 nt, Mycobacterium avium subsp. paratuberculosis
ucggguuuguccggcucugcc

SEQ ID NO: 1010264 - RNA, 21 nt, Mycobacterium avium subsp. paratuberculosis
ucgguacgcgcaauccugccc

SEQ ID NO: 1010265 - RNA, 17 nt, Mycobacterium avium subsp. paratuberculosis
ucgggggugaaggcggc

SEQ ID NO: 1010266 - RNA, 15 nt, Mycobacterium avium subsp. paratuberculosis
ucggggguggccagc

SEQ ID NO: 1010267 - RNA, 11 nt, Mycobacterium avium subsp. paratuberculosis
ucggggcuggc

SEQ ID NO: 1010268 - RNA, 22 nt, Mycobacterium avium subsp. paratuberculosis
ucgggguagccggcccgcagcc

SEQ ID NO: 1010269 - RNA, 16 nt, Mycobacterium avium subsp. paratuberculosis
ucggguccgaccagca

SEQ ID NO: 1010270 - RNA, 12 nt, Mycobacterium avium subsp. paratuberculosis
ucggggccagga

SEQ ID NO: 1010271 - RNA, 15 nt, Mycobacterium avium subsp. paratuberculosis
ucggggcagccgucg

SEQ ID NO: 1010272 - RNA, 14 nt, Mycobacterium avium subsp. paratuberculosis
ucgggcucggccgc

SEQ ID NO: 1010273 - RNA, 21 nt, Mycobacterium avium subsp. paratuberculosis
ucgggcugcgcuugcggcgca

SEQ ID NO: 1010274 - RNA, 14 nt, Mycobacterium avium subsp. paratuberculosis
ucgggcggccgcgg

SEQ ID NO: 1010275 - RNA, 21 nt, Mycobacterium avium subsp. paratuberculosis
ucgggcggccugccggccgcc

SEQ ID NO: 1010276 - RNA, 22 nt, Mycobacterium avium subsp. paratuberculosis
ucgggcgcucggccagcagugc

SEQ ID NO: 1010277 - RNA, 23 nt, Mycobacterium avium subsp. paratuberculosis
ucgggcguugcgcucuguuggcc

SEQ ID NO: 1010278 - RNA, 12 nt, Mycobacterium avium subsp. paratuberculosis
ucgggcgcacca

SEQ ID NO: 1010279 - RNA, 22 nt, Mycobacterium avium subsp. paratuberculosis
ucgggcgcagguccacccgccc

SEQ ID NO: 1010280 - RNA, 13 nt, Mycobacterium avium subsp. paratuberculosis
ucgggcgccggcg

SEQ ID NO: 1010281 - RNA, 17 nt, Mycobacterium avium subsp. paratuberculosis
ucgggccggcgccgacg

SEQ ID NO: 1010282 - RNA, 17 nt, Mycobacterium avium subsp. paratuberculosis
ucgggauuggacagcgg

SEQ ID NO: 1010283 - RNA, 19 nt, Mycobacterium avium subsp. paratuberculosis
ucgggaugugcgugguugc

SEQ ID NO: 1010284 - RNA, 22 nt, Mycobacterium avium subsp. paratuberculosis
ucgggauccaggaacggcaccc

SEQ ID NO: 1010285 - RNA, 21 nt, Mycobacterium avium subsp. paratuberculosis
ucgggcaaucggacccagccc

SEQ ID NO: 1010286 - RNA, 13 nt, Mycobacterium avium subsp. paratuberculosis
ucgggccagccca

SEQ ID NO: 1010287 - RNA, 13 nt, Mycobacterium avium subsp. paratuberculosis
ucgggcagcagca

SEQ ID NO: 1010288 - RNA, 15 nt, Mycobacterium avium subsp. paratuberculosis
ucggauccgccugcc

SEQ ID NO: 1010289 - RNA, 22 nt, Mycobacterium avium subsp. paratuberculosis
ucggcaggauccggacgaccug

SEQ ID NO: 1010290 - RNA, 16 nt, Mycobacterium avium subsp. paratuberculosis
ucggcagccggcugag

SEQ ID NO: 1010291 - RNA, 20 nt, Mycobacterium avium subsp. paratuberculosis
ucggcagcaccggcagcaac

SEQ ID NO: 1010292 - RNA, 22 nt, Mycobacterium avium subsp. paratuberculosis
ucggcagaucguugggcauguc

SEQ ID NO: 1010293 - RNA, 17 nt, Mycobacterium avium subsp. paratuberculosis
ucggccaccgcgcggcg

SEQ ID NO: 1010294 - RNA, 22 nt, Mycobacterium avium subsp. paratuberculosis
ucggccaccgcgcggugcacca

SEQ ID NO: 1010295 - RNA, 15 nt, Mycobacterium avium subsp. paratuberculosis
ucggccaccgucagc

SEQ ID NO: 1010296 - RNA, 14 nt, Mycobacterium avium subsp. paratuberculosis
ucggccaaggggag

SEQ ID NO: 1010297 - RNA, 21 nt, Mycobacterium avium subsp. paratuberculosis
ucggccaacagugcgcaggcg

SEQ ID NO: 1010298 - RNA, 18 nt, Mycobacterium avium subsp. paratuberculosis
ucggcaucgcgcgcggcg

SEQ ID NO: 1010299 - RNA, 14 nt, Mycobacterium avium subsp. paratuberculosis
ucggacgccagugg

SEQ ID NO: 1010300 - RNA, 20 nt, Mycobacterium avium subsp. paratuberculosis
ucggaccgguaggcgcaccg

SEQ ID NO: 1010301 - RNA, 16 nt, Mycobacterium avium subsp. paratuberculosis
ucggagaucaccggca

SEQ ID NO: 1010302 - RNA, 12 nt, Mycobacterium avium subsp. paratuberculosis
ucggagccgucg

SEQ ID NO: 1010303 - RNA, 17 nt, Mycobacterium avium subsp. paratuberculosis
ucggagacguugccgca

SEQ ID NO: 1010304 - RNA, 21 nt, Mycobacterium avium subsp. paratuberculosis
ucggagacguugccgcacacc

SEQ ID NO: 1010305 - RNA, 15 nt, Mycobacterium avium subsp. paratuberculosis
ucggaauacagcagc

SEQ ID NO: 1010306 - RNA, 16 nt, Mycobacterium avium subsp. paratuberculosis
ucggaauacagcagcu

SEQ ID NO: 1010307 - RNA, 21 nt, Mycobacterium avium subsp. paratuberculosis
ucgcggaggaugccggccagc

SEQ ID NO: 1010308 - RNA, 18 nt, Mycobacterium avium subsp. paratuberculosis
ucgcggacccuggccagc

SEQ ID NO: 1010309 - RNA, 14 nt, Mycobacterium avium subsp. paratuberculosis
ucgcggauccgggc

SEQ ID NO: 1010310 - RNA, 15 nt, Mycobacterium avium subsp. paratuberculosis
ucgcggaucucgucg

SEQ ID NO: 1010311 - RNA, 13 nt, Mycobacterium avium subsp. paratuberculosis
ucgcggcccugga

SEQ ID NO: 1010312 - RNA, 18 nt, Mycobacterium avium subsp. paratuberculosis
ucgcggcccccacgcagc

SEQ ID NO: 1010313 - RNA, 17 nt, Mycobacterium avium subsp. paratuberculosis
ucgcggccagcgugaac

SEQ ID NO: 1010314 - RNA, 15 nt, Mycobacterium avium subsp. paratuberculosis
ucgcgcugaccaggc

SEQ ID NO: 1010315 - RNA, 16 nt, Mycobacterium avium subsp. paratuberculosis
ucgcgcugaccaggcc

SEQ ID NO: 1010316 - RNA, 15 nt, Mycobacterium avium subsp. paratuberculosis
ucgcgcugccagggc

SEQ ID NO: 1010317 - RNA, 13 nt, Mycobacterium avium subsp. paratuberculosis
ucgcggaaccggc

SEQ ID NO: 1010318 - RNA, 15 nt, Mycobacterium avium subsp. paratuberculosis
ucgcggaaccggccg

SEQ ID NO: 1010319 - RNA, 16 nt, Mycobacterium avium subsp. paratuberculosis
ucgcgcggcugcucga

SEQ ID NO: 1010320 - RNA, 18 nt, Mycobacterium avium subsp. paratuberculosis
ucgcgcggggucgggccg

SEQ ID NO: 1010321 - RNA, 20 nt, Mycobacterium avium subsp. paratuberculosis
ucgcgcgguguuuggccgcg

SEQ ID NO: 1010322 - RNA, 18 nt, Mycobacterium avium subsp. paratuberculosis
ucgcgcgguuccggcgug

SEQ ID NO: 1010323 - RNA, 15 nt, Mycobacterium avium subsp. paratuberculosis
ucgcgcgucacgcug

SEQ ID NO: 1010324 - RNA, 16 nt, Mycobacterium avium subsp. paratuberculosis
ucgcgcucauaucccg

SEQ ID NO: 1010325 - RNA, 19 nt, Mycobacterium avium subsp. paratuberculosis
ucgcgcucauaucccguca

SEQ ID NO: 1010326 - RNA, 21 nt, Mycobacterium avium subsp. paratuberculosis
ucgcgccgguaggcggccagc

SEQ ID NO: 1010327 - RNA, 12 nt, Mycobacterium avium subsp. paratuberculosis
ucgcgccgggcg

SEQ ID NO: 1010328 - RNA, 13 nt, Mycobacterium avium subsp. paratuberculosis
ucgcgccgcggcg

SEQ ID NO: 1010329 - RNA, 14 nt, Mycobacterium avium subsp. paratuberculosis
ucgcgccggagccg

SEQ ID NO: 1010330 - RNA, 16 nt, Mycobacterium avium subsp. paratuberculosis
ucgcgccuugggccau

SEQ ID NO: 1010331 - RNA, 18 nt, Mycobacterium avium subsp. paratuberculosis
ucgcgcgaacagccgacc

SEQ ID NO: 1010332 - RNA, 16 nt, Mycobacterium avium subsp. paratuberculosis
ucgcguccccgcgccg

SEQ ID NO: 1010333 - RNA, 22 nt, Mycobacterium avium subsp. paratuberculosis
ucgcguucgcuuucgccgggcg

SEQ ID NO: 1010334 - RNA, 19 nt, Mycobacterium avium subsp. paratuberculosis
ucgcguucgggcccggccg

SEQ ID NO: 1010335 - RNA, 18 nt, Mycobacterium avium subsp. paratuberculosis
ucgcguucugcaccagcu

SEQ ID NO: 1010336 - RNA, 19 nt, Mycobacterium avium subsp. paratuberculosis
ucgcggugggcgcgggccg

SEQ ID NO: 1010337 - RNA, 14 nt, Mycobacterium avium subsp. paratuberculosis
ucgcggugucggcg

SEQ ID NO: 1010338 - RNA, 16 nt, Mycobacterium avium subsp. paratuberculosis
ucgcggugcccagccg

SEQ ID NO: 1010339 - RNA, 19 nt, Mycobacterium avium subsp. paratuberculosis
ucgcggugcggggccgcgg

SEQ ID NO: 1010340 - RNA, 19 nt, Mycobacterium avium subsp. paratuberculosis
ucgcggugaccgccgccau

SEQ ID NO: 1010341 - RNA, 14 nt, Mycobacterium avium subsp. paratuberculosis
ucgcgguccaggau

SEQ ID NO: 1010342 - RNA, 20 nt, Mycobacterium avium subsp. paratuberculosis
ucgcguaguccagcacggcg

SEQ ID NO: 1010343 - RNA, 23 nt, Mycobacterium avium subsp. paratuberculosis
ucgcggcgauggacguccagcgg

SEQ ID NO: 1010344 - RNA, 16 nt, Mycobacterium avium subsp. paratuberculosis
ucgcggcgaugguguc

SEQ ID NO: 1010345 - RNA, 19 nt, Mycobacterium avium subsp. paratuberculosis
ucgcggcgcacccgggcag

SEQ ID NO: 1010346 - RNA, 15 nt, Mycobacterium avium subsp. paratuberculosis
ucgcggcgcacggug

SEQ ID NO: 1010347 - RNA, 18 nt, Mycobacterium avium subsp. paratuberculosis
ucgcggccuugcgggccg

SEQ ID NO: 1010348 - RNA, 14 nt, Mycobacterium avium subsp. paratuberculosis
ucgcggcgagcagc

SEQ ID NO: 1010349 - RNA, 15 nt, Mycobacterium avium subsp. paratuberculosis
ucgcggcgagcagcg

SEQ ID NO: 1010350 - RNA, 23 nt, Mycobacterium avium subsp. paratuberculosis
ucgcggccggcgagucgcggauc

SEQ ID NO: 1010351 - RNA, 19 nt, Mycobacterium avium subsp. paratuberculosis
ucgcggccuccgagcggcg

SEQ ID NO: 1010352 - RNA, 24 nt, Mycobacterium avium subsp. paratuberculosis
ucgcggccuccgagcggcgcaggc

SEQ ID NO: 1010353 - RNA, 13 nt, Mycobacterium avium subsp. paratuberculosis
ucgcggcgcugcg

SEQ ID NO: 1010354 - RNA, 15 nt, Mycobacterium avium subsp. paratuberculosis
ucgcggcggacagca

SEQ ID NO: 1010355 - RNA, 14 nt, Mycobacterium avium subsp. paratuberculosis
ucgcggcggccggc

SEQ ID NO: 1010356 - RNA, 23 nt, Mycobacterium avium subsp. paratuberculosis
ucgcggcuggugccgccggcgau

SEQ ID NO: 1010357 - RNA, 17 nt, Mycobacterium avium subsp. paratuberculosis
ucgcgggaguggccggc

SEQ ID NO: 1010358 - RNA, 17 nt, Mycobacterium avium subsp. paratuberculosis
ucgcgggaucggccggc

SEQ ID NO: 1010359 - RNA, 15 nt, Mycobacterium avium subsp. paratuberculosis
ucgcggggugucgug

SEQ ID NO: 1010360 - RNA, 16 nt, Mycobacterium avium subsp. paratuberculosis
ucgcgggugcggcgcu

SEQ ID NO: 1010361 - RNA, 21 nt, Mycobacterium avium subsp. paratuberculosis
ucgcgggugucgagccaccac

SEQ ID NO: 1010362 - RNA, 17 nt, Mycobacterium avium subsp. paratuberculosis
ucgcgggcgucgggcag

SEQ ID NO: 1010363 - RNA, 17 nt, Mycobacterium avium subsp. paratuberculosis
ucgcgggcgaccuggug

SEQ ID NO: 1010364 - RNA, 16 nt, Mycobacterium avium subsp. paratuberculosis
ucgcgggcccgggcca

SEQ ID NO: 1010365 - RNA, 18 nt, Mycobacterium avium subsp. paratuberculosis
ucgcgggccacagcggcg

SEQ ID NO: 1010366 - RNA, 17 nt, Mycobacterium avium subsp. paratuberculosis
ucgcuacgcgagcugcu

SEQ ID NO: 1010367 - RNA, 21 nt, Mycobacterium avium subsp. paratuberculosis
ucgcucauguugugcaggcag

SEQ ID NO: 1010368 - RNA, 17 nt, Mycobacterium avium subsp. paratuberculosis
ucgcugacgccgagcag

SEQ ID NO: 1010369 - RNA, 12 nt, Mycobacterium avium subsp. paratuberculosis
ucgcugaucuuc

SEQ ID NO: 1010370 - RNA, 14 nt, Mycobacterium avium subsp. paratuberculosis
ucgcucuucucguu

SEQ ID NO: 1010371 - RNA, 20 nt, Mycobacterium avium subsp. paratuberculosis
ucgcuguaggccagcccggc

SEQ ID NO: 1010372 - RNA, 16 nt, Mycobacterium avium subsp. paratuberculosis
ucgcuggcgaucaccu

SEQ ID NO: 1010373 - RNA, 17 nt, Mycobacterium avium subsp. paratuberculosis
ucgcugcgagcccggcc

SEQ ID NO: 1010374 - RNA, 14 nt, Mycobacterium avium subsp. paratuberculosis
ucgcugcgccggcg

SEQ ID NO: 1010375 - RNA, 20 nt, Mycobacterium avium subsp. paratuberculosis
ucgcugccguccacccggcc

SEQ ID NO: 1010376 - RNA, 13 nt, Mycobacterium avium subsp. paratuberculosis
ucgcugccggccg

SEQ ID NO: 1010377 - RNA, 23 nt, Mycobacterium avium subsp. paratuberculosis
ucgcugccccggcgaggccaggc

SEQ ID NO: 1010378 - RNA, 22 nt, Mycobacterium avium subsp. paratuberculosis
ucgccaccgaugcgggccagga

SEQ ID NO: 1010379 - RNA, 22 nt, Mycobacterium avium subsp. paratuberculosis
ucgccaccaccacggggcgggu

SEQ ID NO: 1010380 - RNA, 17 nt, Mycobacterium avium subsp. paratuberculosis
ucgccaccaccagcggu

SEQ ID NO: 1010381 - RNA, 17 nt, Mycobacterium avium subsp. paratuberculosis
ucgccaccaccgcgccg

SEQ ID NO: 1010382 - RNA, 21 nt, Mycobacterium avium subsp. paratuberculosis
ucgccacgaucaccaccaccg

SEQ ID NO: 1010383 - RNA, 14 nt, Mycobacterium avium subsp. paratuberculosis
ucgccaaggcgcug

SEQ ID NO: 1010384 - RNA, 17 nt, Mycobacterium avium subsp. paratuberculosis
ucgccaucagggucuuc

SEQ ID NO: 1010385 - RNA, 18 nt, Mycobacterium avium subsp. paratuberculosis
ucgccaucagcagcgccu

SEQ ID NO: 1010386 - RNA, 18 nt, Mycobacterium avium subsp. paratuberculosis
ucgccaucgcaccgcgag

SEQ ID NO: 1010387 - RNA, 12 nt, Mycobacterium avium subsp. paratuberculosis
ucgccagcacca

SEQ ID NO: 1010388 - RNA, 11 nt, Mycobacterium avium subsp. paratuberculosis
ucgccagcaac

SEQ ID NO: 1010389 - RNA, 14 nt, Mycobacterium avium subsp. paratuberculosis
ucgccagcccggcg

SEQ ID NO: 1010390 - RNA, 16 nt, Mycobacterium avium subsp. paratuberculosis
ucgccagcccggcgua

SEQ ID NO: 1010391 - RNA, 14 nt, Mycobacterium avium subsp. paratuberculosis
ucgccagcgggccg

SEQ ID NO: 1010392 - RNA, 17 nt, Mycobacterium avium subsp. paratuberculosis
ucgccagcgggccgacc

SEQ ID NO: 1010393 - RNA, 22 nt, Mycobacterium avium subsp. paratuberculosis
ucgccagcgcccccagcggggc

SEQ ID NO: 1010394 - RNA, 16 nt, Mycobacterium avium subsp. paratuberculosis
ucgccgaucucggcca

SEQ ID NO: 1010395 - RNA, 17 nt, Mycobacterium avium subsp. paratuberculosis
ucgccgccaacgcgaac

SEQ ID NO: 1010396 - RNA, 13 nt, Mycobacterium avium subsp. paratuberculosis
ucgccgcaggcgu

SEQ ID NO: 1010397 - RNA, 21 nt, Mycobacterium avium subsp. paratuberculosis
ucgccgccgccaucuccuccg

SEQ ID NO: 1010398 - RNA, 23 nt, Mycobacterium avium subsp. paratuberculosis
ucgccgccgccgaucuugagccg

SEQ ID NO: 1010399 - RNA, 15 nt, Mycobacterium avium subsp. paratuberculosis
ucgccgcccgggccg

SEQ ID NO: 1010400 - RNA, 21 nt, Mycobacterium avium subsp. paratuberculosis
ucgccgccgcgcaccgcgcgu

SEQ ID NO: 1010401 - RNA, 15 nt, Mycobacterium avium subsp. paratuberculosis
ucgccgacagcagcu

SEQ ID NO: 1010402 - RNA, 17 nt, Mycobacterium avium subsp. paratuberculosis
ucgccgacagcgucguc

SEQ ID NO: 1010403 - RNA, 15 nt, Mycobacterium avium subsp. paratuberculosis
ucgccgaaccgggcg

SEQ ID NO: 1010404 - RNA, 16 nt, Mycobacterium avium subsp. paratuberculosis
ucgccgaaccggggcc

SEQ ID NO: 1010405 - RNA, 13 nt, Mycobacterium avium subsp. paratuberculosis
ucgccgacgccag

SEQ ID NO: 1010406 - RNA, 18 nt, Mycobacterium avium subsp. paratuberculosis
ucgccgaccagcaggacg

SEQ ID NO: 1010407 - RNA, 22 nt, Mycobacterium avium subsp. paratuberculosis
ucgccgaccagguagcgcugca

SEQ ID NO: 1010408 - RNA, 19 nt, Mycobacterium avium subsp. paratuberculosis
ucgccgacgucccagcaca

SEQ ID NO: 1010409 - RNA, 14 nt, Mycobacterium avium subsp. paratuberculosis
ucgcccuggccgcg

SEQ ID NO: 1010410 - RNA, 13 nt, Mycobacterium avium subsp. paratuberculosis
ucgcccacccggg

SEQ ID NO: 1010411 - RNA, 13 nt, Mycobacterium avium subsp. paratuberculosis
ucgcccagcaccg

SEQ ID NO: 1010412 - RNA, 14 nt, Mycobacterium avium subsp. paratuberculosis
ucgcccagcgcggc

SEQ ID NO: 1010413 - RNA, 16 nt, Mycobacterium avium subsp. paratuberculosis
ucgcccagcugggcca

SEQ ID NO: 1010414 - RNA, 15 nt, Mycobacterium avium subsp. paratuberculosis
ucgcccaccuuggcg

SEQ ID NO: 1010415 - RNA, 12 nt, Mycobacterium avium subsp. paratuberculosis
ucgcccacgccg

SEQ ID NO: 1010416 - RNA, 13 nt, Mycobacterium avium subsp. paratuberculosis
ucgcccagcagcc

SEQ ID NO: 1010417 - RNA, 15 nt, Mycobacterium avium subsp. paratuberculosis
ucgcccgggccaggu

SEQ ID NO: 1010418 - RNA, 13 nt, Mycobacterium avium subsp. paratuberculosis
ucgcccgccgacg

SEQ ID NO: 1010419 - RNA, 14 nt, Mycobacterium avium subsp. paratuberculosis
ucgccccgcaccga

SEQ ID NO: 1010420 - RNA, 15 nt, Mycobacterium avium subsp. paratuberculosis
ucgcccccucggccg

SEQ ID NO: 1010421 - RNA, 20 nt, Mycobacterium avium subsp. paratuberculosis
ucgcccccucggccgguccg

SEQ ID NO: 1010422 - RNA, 23 nt, Mycobacterium avium subsp. paratuberculosis
ucgccccagaacugguccuccaa

SEQ ID NO: 1010423 - RNA, 21 nt, Mycobacterium avium subsp. paratuberculosis
ucgccuccgucagcgccgccc

SEQ ID NO: 1010424 - RNA, 19 nt, Mycobacterium avium subsp. paratuberculosis
ucgccuccugcuggcgcug

SEQ ID NO: 1010425 - RNA, 22 nt, Mycobacterium avium subsp. paratuberculosis
ucgccucgaccaggcuuggccc

SEQ ID NO: 1010426 - RNA, 20 nt, Mycobacterium avium subsp. paratuberculosis
ucgccugacuaagucaccag

SEQ ID NO: 1010427 - RNA, 23 nt, Mycobacterium avium subsp. paratuberculosis
ucgccucggaggccaccgcgccg

SEQ ID NO: 1010428 - RNA, 17 nt, Mycobacterium avium subsp. paratuberculosis
ucgccucgucccucguc

SEQ ID NO: 1010429 - RNA, 15 nt, Mycobacterium avium subsp. paratuberculosis
ucgccguuggucugc

SEQ ID NO: 1010430 - RNA, 16 nt, Mycobacterium avium subsp. paratuberculosis
ucgccgugcagcaccu

SEQ ID NO: 1010431 - RNA, 19 nt, Mycobacterium avium subsp. paratuberculosis
ucgccgucggccagcagcg

SEQ ID NO: 1010432 - RNA, 15 nt, Mycobacterium avium subsp. paratuberculosis
ucgccgucgaaggcc

SEQ ID NO: 1010433 - RNA, 15 nt, Mycobacterium avium subsp. paratuberculosis
ucgccguccggggcc

SEQ ID NO: 1010434 - RNA, 16 nt, Mycobacterium avium subsp. paratuberculosis
ucgccguccggggccg

SEQ ID NO: 1010435 - RNA, 15 nt, Mycobacterium avium subsp. paratuberculosis
ucgccgucacugcac

SEQ ID NO: 1010436 - RNA, 14 nt, Mycobacterium avium subsp. paratuberculosis
ucgccgucagugcg

SEQ ID NO: 1010437 - RNA, 18 nt, Mycobacterium avium subsp. paratuberculosis
ucgccggugucauaccag

SEQ ID NO: 1010438 - RNA, 20 nt, Mycobacterium avium subsp. paratuberculosis
ucgccgggcgucacucuggc

SEQ ID NO: 1010439 - RNA, 14 nt, Mycobacterium avium subsp. paratuberculosis
ucgccgggcuggcc

SEQ ID NO: 1010440 - RNA, 21 nt, Mycobacterium avium subsp. paratuberculosis
ucgccgggcuuggucaugaac

SEQ ID NO: 1010441 - RNA, 17 nt, Mycobacterium avium subsp. paratuberculosis
ucgccggcgcgcugaag

SEQ ID NO: 1010442 - RNA, 18 nt, Mycobacterium avium subsp. paratuberculosis
ucgccggcuaccggcgcu

SEQ ID NO: 1010443 - RNA, 18 nt, Mycobacterium avium subsp. paratuberculosis
ucgccggcuuaccgaccu

SEQ ID NO: 1010444 - RNA, 16 nt, Mycobacterium avium subsp. paratuberculosis
ucgccggcgcuuugcc

SEQ ID NO: 1010445 - RNA, 18 nt, Mycobacterium avium subsp. paratuberculosis
ucgccggccgccagcgcc

SEQ ID NO: 1010446 - RNA, 15 nt, Mycobacterium avium subsp. paratuberculosis
ucgccggccugcccg

SEQ ID NO: 1010447 - RNA, 15 nt, Mycobacterium avium subsp. paratuberculosis
ucgccggccagcacg

SEQ ID NO: 1010448 - RNA, 22 nt, Mycobacterium avium subsp. paratuberculosis
ucgccggcgacggccagcgcgg

SEQ ID NO: 1010449 - RNA, 23 nt, Mycobacterium avium subsp. paratuberculosis
ucgccggcgacggccagcgcggc

SEQ ID NO: 1010450 - RNA, 13 nt, Mycobacterium avium subsp. paratuberculosis
ucgccggccaggc

SEQ ID NO: 1010451 - RNA, 18 nt, Mycobacterium avium subsp. paratuberculosis
ucgccggacagcgggccg

SEQ ID NO: 1010452 - RNA, 20 nt, Mycobacterium avium subsp. paratuberculosis
ucgccggagagcccgucguc

SEQ ID NO: 1010453 - RNA, 20 nt, Mycobacterium avium subsp. paratuberculosis
ucgccggagcgccccagggc

SEQ ID NO: 1010454 - RNA, 23 nt, Mycobacterium avium subsp. paratuberculosis
ucgccgcggccacgcucgggccg

SEQ ID NO: 1010455 - RNA, 12 nt, Mycobacterium avium subsp. paratuberculosis
ucgccgcggccg

SEQ ID NO: 1010456 - RNA, 15 nt, Mycobacterium avium subsp. paratuberculosis
ucgccgcgggccagc

SEQ ID NO: 1010457 - RNA, 19 nt, Mycobacterium avium subsp. paratuberculosis
ucgccgcguacgccgccuu

SEQ ID NO: 1010458 - RNA, 20 nt, Mycobacterium avium subsp. paratuberculosis
ucgccgcucuucgacgaccc

SEQ ID NO: 1010459 - RNA, 18 nt, Mycobacterium avium subsp. paratuberculosis
ucgccgcugggacugaag

SEQ ID NO: 1010460 - RNA, 13 nt, Mycobacterium avium subsp. paratuberculosis
ucgccgcgcaccc

SEQ ID NO: 1010461 - RNA, 22 nt, Mycobacterium avium subsp. paratuberculosis
ucgccgcgcacccggccacgcc

SEQ ID NO: 1010462 - RNA, 17 nt, Mycobacterium avium subsp. paratuberculosis
ucgccgcgccagcaccu

SEQ ID NO: 1010463 - RNA, 12 nt, Mycobacterium avium subsp. paratuberculosis
ucgccgcgaccc

SEQ ID NO: 1010464 - RNA, 14 nt, Mycobacterium avium subsp. paratuberculosis
ucgcgcagggccag

SEQ ID NO: 1010465 - RNA, 18 nt, Mycobacterium avium subsp. paratuberculosis
ucgcgccagacguccagc

SEQ ID NO: 1010466 - RNA, 20 nt, Mycobacterium avium subsp. paratuberculosis
ucgcgcccaggaacgcgccg

SEQ ID NO: 1010467 - RNA, 15 nt, Mycobacterium avium subsp. paratuberculosis
ucgcgcccggcgccg

SEQ ID NO: 1010468 - RNA, 23 nt, Mycobacterium avium subsp. paratuberculosis
ucgcgcccuaacgugcccggccc

SEQ ID NO: 1010469 - RNA, 16 nt, Mycobacterium avium subsp. paratuberculosis
ucgcgccgacccgccc

SEQ ID NO: 1010470 - RNA, 12 nt, Mycobacterium avium subsp. paratuberculosis
ucgcgccgccgc

SEQ ID NO: 1010471 - RNA, 18 nt, Mycobacterium avium subsp. paratuberculosis
ucgcgcacuucgcgggcg

SEQ ID NO: 1010472 - RNA, 20 nt, Mycobacterium avium subsp. paratuberculosis
ucgcgcagcauggcccacag

SEQ ID NO: 1010473 - RNA, 22 nt, Mycobacterium avium subsp. paratuberculosis
ucgcgcagcccgaucgccagcg

SEQ ID NO: 1010474 - RNA, 13 nt, Mycobacterium avium subsp. paratuberculosis
ucgcgcagcagcg

SEQ ID NO: 1010475 - RNA, 14 nt, Mycobacterium avium subsp. paratuberculosis
ucgcgcaccggcug

SEQ ID NO: 1010476 - RNA, 21 nt, Mycobacterium avium subsp. paratuberculosis
ucgcgcaccagcucgaggccg

SEQ ID NO: 1010477 - RNA, 12 nt, Mycobacterium avium subsp. paratuberculosis
ucgcgcaccacc

SEQ ID NO: 1010478 - RNA, 24 nt, Mycobacterium avium subsp. paratuberculosis
ucgcgcaccauccgcgacgccagc

SEQ ID NO: 1010479 - RNA, 19 nt, Mycobacterium avium subsp. paratuberculosis
ucgcgcacccgcacgugcg

SEQ ID NO: 1010480 - RNA, 22 nt, Mycobacterium avium subsp. paratuberculosis
ucgcgcaauaacggagcggccu

SEQ ID NO: 1010481 - RNA, 16 nt, Mycobacterium avium subsp. paratuberculosis
ucgcgcaacugggugg

SEQ ID NO: 1010482 - RNA, 18 nt, Mycobacterium avium subsp. paratuberculosis
ucgcgaucaccgcggcca

SEQ ID NO: 1010483 - RNA, 17 nt, Mycobacterium avium subsp. paratuberculosis
ucgcgaucacaccacca

SEQ ID NO: 1010484 - RNA, 18 nt, Mycobacterium avium subsp. paratuberculosis
ucgcgaucacaccaccac

SEQ ID NO: 1010485 - RNA, 14 nt, Mycobacterium avium subsp. paratuberculosis
ucgcgauccgggcg

SEQ ID NO: 1010486 - RNA, 20 nt, Mycobacterium avium subsp. paratuberculosis
ucgcgaucgcgguccaggau

SEQ ID NO: 1010487 - RNA, 14 nt, Mycobacterium avium subsp. paratuberculosis
ucgcgaugucgacg

SEQ ID NO: 1010488 - RNA, 21 nt, Mycobacterium avium subsp. paratuberculosis
ucgcgacggccggggccagca

SEQ ID NO: 1010489 - RNA, 20 nt, Mycobacterium avium subsp. paratuberculosis
ucgcgaccgccggacaccac

SEQ ID NO: 1010490 - RNA, 23 nt, Mycobacterium avium subsp. paratuberculosis
ucgcgaagacgcuggccacgauc

SEQ ID NO: 1010491 - RNA, 12 nt, Mycobacterium avium subsp. paratuberculosis
ugaacgccgcca

SEQ ID NO: 1010492 - RNA, 14 nt, Mycobacterium avium subsp. paratuberculosis
ugaacgccggugag

SEQ ID NO: 1010493 - RNA, 13 nt, Mycobacterium avium subsp. paratuberculosis
ugaacgaggccgc

SEQ ID NO: 1010494 - RNA, 15 nt, Mycobacterium avium subsp. paratuberculosis
ugaacgaggccgcgc

SEQ ID NO: 1010495 - RNA, 21 nt, Mycobacterium avium subsp. paratuberculosis
ugaaccaggccgcgcuggcgc

SEQ ID NO: 1010496 - RNA, 15 nt, Mycobacterium avium subsp. paratuberculosis
ugaaggugcccuccu

SEQ ID NO: 1010497 - RNA, 16 nt, Mycobacterium avium subsp. paratuberculosis
ugaaggucgcggacug

SEQ ID NO: 1010498 - RNA, 19 nt, Mycobacterium avium subsp. paratuberculosis
ugaagcuagcuucacgcuc

SEQ ID NO: 1010499 - RNA, 19 nt, Mycobacterium avium subsp. paratuberculosis
ugaagcuaguuucacguuc

SEQ ID NO: 1010500 - RNA, 20 nt, Mycobacterium avium subsp. paratuberculosis
ugaagcgcugggacagcgug

SEQ ID NO: 1010501 - RNA, 15 nt, Mycobacterium avium subsp. paratuberculosis
ugaagccgugcccgc

SEQ ID NO: 1010502 - RNA, 21 nt, Mycobacterium avium subsp. paratuberculosis
ugaacaccgcguuggccgcca

SEQ ID NO: 1010503 - RNA, 23 nt, Mycobacterium avium subsp. paratuberculosis
ucuucggcgccggcauccagcac

SEQ ID NO: 1010504 - RNA, 16 nt, Mycobacterium avium subsp. paratuberculosis
ucuucggggccgccgu

SEQ ID NO: 1010505 - RNA, 14 nt, Mycobacterium avium subsp. paratuberculosis
ugaccaucacgcag

SEQ ID NO: 1010506 - RNA, 22 nt, Mycobacterium avium subsp. paratuberculosis
ugaccagcgcgaacagcgcggc

SEQ ID NO: 1010507 - RNA, 22 nt, Mycobacterium avium subsp. paratuberculosis
ugaccagcuugaagcccucguc

SEQ ID NO: 1010508 - RNA, 12 nt, Mycobacterium avium subsp. paratuberculosis
ugaccaggaugu

SEQ ID NO: 1010509 - RNA, 16 nt, Mycobacterium avium subsp. paratuberculosis
ugaccagggccucguc

SEQ ID NO: 1010510 - RNA, 12 nt, Mycobacterium avium subsp. paratuberculosis
ugaccagggugg

SEQ ID NO: 1010511 - RNA, 19 nt, Mycobacterium avium subsp. paratuberculosis
ugaccagcacguugugcuc

SEQ ID NO: 1010512 - RNA, 12 nt, Mycobacterium avium subsp. paratuberculosis
ugacagucgacc

SEQ ID NO: 1010513 - RNA, 20 nt, Mycobacterium avium subsp. paratuberculosis
ugaccugcggaucgcgggcg

SEQ ID NO: 1010514 - RNA, 15 nt, Mycobacterium avium subsp. paratuberculosis
ugaccucgcacagcu

SEQ ID NO: 1010515 - RNA, 15 nt, Mycobacterium avium subsp. paratuberculosis
ugaccugcugggcgg

SEQ ID NO: 1010516 - RNA, 20 nt, Mycobacterium avium subsp. paratuberculosis
ugaccggccggucgaaggcc

SEQ ID NO: 1010517 - RNA, 14 nt, Mycobacterium avium subsp. paratuberculosis
ugaccucccggaca

SEQ ID NO: 1010518 - RNA, 14 nt, Mycobacterium avium subsp. paratuberculosis
ugaccucgccgccc

SEQ ID NO: 1010519 - RNA, 15 nt, Mycobacterium avium subsp. paratuberculosis
ugaccggcgcgcccg

SEQ ID NO: 1010520 - RNA, 18 nt, Mycobacterium avium subsp. paratuberculosis
ugaccucgacacgggccg

SEQ ID NO: 1010521 - RNA, 22 nt, Mycobacterium avium subsp. paratuberculosis
ugaccgcgucggcgccguaguc

SEQ ID NO: 1010522 - RNA, 12 nt, Mycobacterium avium subsp. paratuberculosis
ugaccgcggccu

SEQ ID NO: 1010523 - RNA, 17 nt, Mycobacterium avium subsp. paratuberculosis
ugaccgcggcgauggug

SEQ ID NO: 1010524 - RNA, 20 nt, Mycobacterium avium subsp. paratuberculosis
ugaccgccugcuugaugaug

SEQ ID NO: 1010525 - RNA, 17 nt, Mycobacterium avium subsp. paratuberculosis
ugaccgcgaagguggca

SEQ ID NO: 1010526 - RNA, 15 nt, Mycobacterium avium subsp. paratuberculosis
ugaccgccagcaccg

SEQ ID NO: 1010527 - RNA, 16 nt, Mycobacterium avium subsp. paratuberculosis
ugaccgcccaggaccc

SEQ ID NO: 1010528 - RNA, 18 nt, Mycobacterium avium subsp. paratuberculosis
ugaccgccgacaccaccg

SEQ ID NO: 1010529 - RNA, 22 nt, Mycobacterium avium subsp. paratuberculosis
ugacaacacgucuggcagucuu

SEQ ID NO: 1010530 - RNA, 21 nt, Mycobacterium avium subsp. paratuberculosis
ugacaccgggugcguccagac

SEQ ID NO: 1010531 - RNA, 18 nt, Mycobacterium avium subsp. paratuberculosis
ugaauccgcgcagcagcg

SEQ ID NO: 1010532 - RNA, 15 nt, Mycobacterium avium subsp. paratuberculosis
ugaaucccuccggca

SEQ ID NO: 1010533 - RNA, 20 nt, Mycobacterium avium subsp. paratuberculosis
ugaaucccuccggcaggccg

SEQ ID NO: 1010534 - RNA, 15 nt, Mycobacterium avium subsp. paratuberculosis
ugaauccucagcacg

SEQ ID NO: 1010535 - RNA, 13 nt, Mycobacterium avium subsp. paratuberculosis
ugaaugcccagcg

SEQ ID NO: 1010536 - RNA, 11 nt, Mycobacterium avium subsp. paratuberculosis
ugaauugggcg

SEQ ID NO: 1010537 - RNA, 16 nt, Mycobacterium avium subsp. paratuberculosis
ugaauucgaccacggc

SEQ ID NO: 1010538 - RNA, 12 nt, Mycobacterium avium subsp. paratuberculosis
ugauggucagcc

SEQ ID NO: 1010539 - RNA, 14 nt, Mycobacterium avium subsp. paratuberculosis
ugaugguccagcac

SEQ ID NO: 1010540 - RNA, 13 nt, Mycobacterium avium subsp. paratuberculosis
ugauggugaucuc

SEQ ID NO: 1010541 - RNA, 18 nt, Mycobacterium avium subsp. paratuberculosis
ugaugucgccggcggcga

SEQ ID NO: 1010542 - RNA, 16 nt, Mycobacterium avium subsp. paratuberculosis
ugaugucgguggugug

SEQ ID NO: 1010543 - RNA, 21 nt, Mycobacterium avium subsp. paratuberculosis
ugaugucggugguguggcagg

SEQ ID NO: 1010544 - RNA, 13 nt, Mycobacterium avium subsp. paratuberculosis
ugauguucacccc

SEQ ID NO: 1010545 - RNA, 22 nt, Mycobacterium avium subsp. paratuberculosis
ugauuguaggugugcagccagg

SEQ ID NO: 1010546 - RNA, 15 nt, Mycobacterium avium subsp. paratuberculosis
ugaugccggccgcgu

SEQ ID NO: 1010547 - RNA, 14 nt, Mycobacterium avium subsp. paratuberculosis
ugaugccguccagc

SEQ ID NO: 1010548 - RNA, 22 nt, Mycobacterium avium subsp. paratuberculosis
ugaugccgucgaucaccugcgg

SEQ ID NO: 1010549 - RNA, 13 nt, Mycobacterium avium subsp. paratuberculosis
ugaugccgugcgc

SEQ ID NO: 1010550 - RNA, 12 nt, Mycobacterium avium subsp. paratuberculosis
ugaugcccaggc

SEQ ID NO: 1010551 - RNA, 21 nt, Mycobacterium avium subsp. paratuberculosis
ugaucuugcuggucuucggug

SEQ ID NO: 1010552 - RNA, 15 nt, Mycobacterium avium subsp. paratuberculosis
ugaucucggcggcga

SEQ ID NO: 1010553 - RNA, 15 nt, Mycobacterium avium subsp. paratuberculosis
ugaucucgaccuucu

SEQ ID NO: 1010554 - RNA, 22 nt, Mycobacterium avium subsp. paratuberculosis
ugaucucgccgcgguggugggc

SEQ ID NO: 1010555 - RNA, 17 nt, Mycobacterium avium subsp. paratuberculosis
ugaugcggguguugacc

SEQ ID NO: 1010556 - RNA, 18 nt, Mycobacterium avium subsp. paratuberculosis
ugauggcgaaccagcgcc

SEQ ID NO: 1010557 - RNA, 19 nt, Mycobacterium avium subsp. paratuberculosis
ugauggcgaaccagcgccc

SEQ ID NO: 1010558 - RNA, 14 nt, Mycobacterium avium subsp. paratuberculosis
ugaugggcagcgcc

SEQ ID NO: 1010559 - RNA, 23 nt, Mycobacterium avium subsp. paratuberculosis
ugaugggcagcgccccgguccgg

SEQ ID NO: 1010560 - RNA, 21 nt, Mycobacterium avium subsp. paratuberculosis
ugaucaacggcuugaugaugc

SEQ ID NO: 1010561 - RNA, 12 nt, Mycobacterium avium subsp. paratuberculosis
ugaucaccgcca

SEQ ID NO: 1010562 - RNA, 12 nt, Mycobacterium avium subsp. paratuberculosis
ugaucacaccgc

SEQ ID NO: 1010563 - RNA, 20 nt, Mycobacterium avium subsp. paratuberculosis
ugaucaccaaauagccgucg

SEQ ID NO: 1010564 - RNA, 12 nt, Mycobacterium avium subsp. paratuberculosis
ugaucaccaccu

SEQ ID NO: 1010565 - RNA, 21 nt, Mycobacterium avium subsp. paratuberculosis
ugaucaccaccugguccugcc

SEQ ID NO: 1010566 - RNA, 16 nt, Mycobacterium avium subsp. paratuberculosis
ugauccacuccagcac

SEQ ID NO: 1010567 - RNA, 13 nt, Mycobacterium avium subsp. paratuberculosis
ugaucacccagcc

SEQ ID NO: 1010568 - RNA, 14 nt, Mycobacterium avium subsp. paratuberculosis
ugaucgguucgucg

SEQ ID NO: 1010569 - RNA, 21 nt, Mycobacterium avium subsp. paratuberculosis
ugaucgggugagacggccagc

SEQ ID NO: 1010570 - RNA, 15 nt, Mycobacterium avium subsp. paratuberculosis
ugauccccagcggca

SEQ ID NO: 1010571 - RNA, 18 nt, Mycobacterium avium subsp. paratuberculosis
ugaucgucucggccgcgg

SEQ ID NO: 1010572 - RNA, 15 nt, Mycobacterium avium subsp. paratuberculosis
ugaucucccgugcgg

SEQ ID NO: 1010573 - RNA, 17 nt, Mycobacterium avium subsp. paratuberculosis
ugagucuacuuggccag

SEQ ID NO: 1010574 - RNA, 20 nt, Mycobacterium avium subsp. paratuberculosis
ugagcuucugcccggccagc

SEQ ID NO: 1010575 - RNA, 14 nt, Mycobacterium avium subsp. paratuberculosis
ugagcugugccgcg

SEQ ID NO: 1010576 - RNA, 23 nt, Mycobacterium avium subsp. paratuberculosis
ugagcugugccgcggugcggccc

SEQ ID NO: 1010577 - RNA, 15 nt, Mycobacterium avium subsp. paratuberculosis
ugagcuggugcagcg

SEQ ID NO: 1010578 - RNA, 13 nt, Mycobacterium avium subsp. paratuberculosis
ugagcgccggggc

SEQ ID NO: 1010579 - RNA, 15 nt, Mycobacterium avium subsp. paratuberculosis
ugagcgccagcgcgg

SEQ ID NO: 1010580 - RNA, 14 nt, Mycobacterium avium subsp. paratuberculosis
ugagcgacaccagg

SEQ ID NO: 1010581 - RNA, 19 nt, Mycobacterium avium subsp. paratuberculosis
ugaggcacccgcugcacca

SEQ ID NO: 1010582 - RNA, 22 nt, Mycobacterium avium subsp. paratuberculosis
ugaggcacccgcugcaccagcc

SEQ ID NO: 1010583 - RNA, 23 nt, Mycobacterium avium subsp. paratuberculosis
ugaggcaccgaacgccagcagcu

SEQ ID NO: 1010584 - RNA, 22 nt, Mycobacterium avium subsp. paratuberculosis
ugaggcccggcgugggccgcag

SEQ ID NO: 1010585 - RNA, 17 nt, Mycobacterium avium subsp. paratuberculosis
ugaggccgaggcgagug

SEQ ID NO: 1010586 - RNA, 21 nt, Mycobacterium avium subsp. paratuberculosis
ugaggccaggcguuuggugug

SEQ ID NO: 1010587 - RNA, 14 nt, Mycobacterium avium subsp. paratuberculosis
ugaggccagcaccc

SEQ ID NO: 1010588 - RNA, 18 nt, Mycobacterium avium subsp. paratuberculosis
ugagccaguucgccagca

SEQ ID NO: 1010589 - RNA, 15 nt, Mycobacterium avium subsp. paratuberculosis
ugagccgccgagccg

SEQ ID NO: 1010590 - RNA, 14 nt, Mycobacterium avium subsp. paratuberculosis
ugagccgccggggc

SEQ ID NO: 1010591 - RNA, 15 nt, Mycobacterium avium subsp. paratuberculosis
ugagccgccggggcg

SEQ ID NO: 1010592 - RNA, 20 nt, Mycobacterium avium subsp. paratuberculosis
ugagccgccggggcgccgcc

SEQ ID NO: 1010593 - RNA, 23 nt, Mycobacterium avium subsp. paratuberculosis
ugagccgcuggauguccaggccg

SEQ ID NO: 1010594 - RNA, 18 nt, Mycobacterium avium subsp. paratuberculosis
ugagccggcgcaccgcgu

SEQ ID NO: 1010595 - RNA, 14 nt, Mycobacterium avium subsp. paratuberculosis
ugagcauguugaac

SEQ ID NO: 1010596 - RNA, 22 nt, Mycobacterium avium subsp. paratuberculosis
ugagcacggugaacuccgggcc

SEQ ID NO: 1010597 - RNA, 21 nt, Mycobacterium avium subsp. paratuberculosis
ugagcacggugaucagcagca

SEQ ID NO: 1010598 - RNA, 12 nt, Mycobacterium avium subsp. paratuberculosis
ugagcaccagcc

SEQ ID NO: 1010599 - RNA, 17 nt, Mycobacterium avium subsp. paratuberculosis
ugagcaccagcccggcc

SEQ ID NO: 1010600 - RNA, 20 nt, Mycobacterium avium subsp. paratuberculosis
ugagcaccagcccggccagc

SEQ ID NO: 1010601 - RNA, 20 nt, Mycobacterium avium subsp. paratuberculosis
ugagcaccgcgaccagcucg

SEQ ID NO: 1010602 - RNA, 21 nt, Mycobacterium avium subsp. paratuberculosis
ugagcacgaccgccagcagca

SEQ ID NO: 1010603 - RNA, 21 nt, Mycobacterium avium subsp. paratuberculosis
ugagcagaccgaacccgggcg

SEQ ID NO: 1010604 - RNA, 14 nt, Mycobacterium avium subsp. paratuberculosis
ugagcagcaugccg

SEQ ID NO: 1010605 - RNA, 14 nt, Mycobacterium avium subsp. paratuberculosis
ugagcagggccagc

SEQ ID NO: 1010606 - RNA, 18 nt, Mycobacterium avium subsp. paratuberculosis
ugagcagggccagcggca

SEQ ID NO: 1010607 - RNA, 17 nt, Mycobacterium avium subsp. paratuberculosis
ugagcagcucgcggauc

SEQ ID NO: 1010608 - RNA, 21 nt, Mycobacterium avium subsp. paratuberculosis
ugagcagcucggucaccagcg

SEQ ID NO: 1010609 - RNA, 21 nt, Mycobacterium avium subsp. paratuberculosis
ugacugcgaucgccgacgcca

SEQ ID NO: 1010610 - RNA, 23 nt, Mycobacterium avium subsp. paratuberculosis
ugacugcgaucgccgacgccagc

SEQ ID NO: 1010611 - RNA, 14 nt, Mycobacterium avium subsp. paratuberculosis
ugcgcgccagcagc

SEQ ID NO: 1010612 - RNA, 15 nt, Mycobacterium avium subsp. paratuberculosis
ugcgcgccagcagcg

SEQ ID NO: 1010613 - RNA, 21 nt, Mycobacterium avium subsp. paratuberculosis
ugcgcgccgucggcguucagc

SEQ ID NO: 1010614 - RNA, 14 nt, Mycobacterium avium subsp. paratuberculosis
ugcgcgccgcccuc

SEQ ID NO: 1010615 - RNA, 15 nt, Mycobacterium avium subsp. paratuberculosis
ugcgcgcccugcugg

SEQ ID NO: 1010616 - RNA, 16 nt, Mycobacterium avium subsp. paratuberculosis
ugcgcggcacgggccg

SEQ ID NO: 1010617 - RNA, 13 nt, Mycobacterium avium subsp. paratuberculosis
ugcgcggccgccc

SEQ ID NO: 1010618 - RNA, 11 nt, Mycobacterium avium subsp. paratuberculosis
ugcgcggcgcc

SEQ ID NO: 1010619 - RNA, 15 nt, Mycobacterium avium subsp. paratuberculosis
ugcgcggccggcgug

SEQ ID NO: 1010620 - RNA, 16 nt, Mycobacterium avium subsp. paratuberculosis
ugcgcggccugcagca

SEQ ID NO: 1010621 - RNA, 17 nt, Mycobacterium avium subsp. paratuberculosis
ugcgcggcgaccaccuc

SEQ ID NO: 1010622 - RNA, 22 nt, Mycobacterium avium subsp. paratuberculosis
ugcgcguggggcgucgccgccc

SEQ ID NO: 1010623 - RNA, 15 nt, Mycobacterium avium subsp. paratuberculosis
ugcgcgucggccgca

SEQ ID NO: 1010624 - RNA, 16 nt, Mycobacterium avium subsp. paratuberculosis
ugcgcgucagccgucg

SEQ ID NO: 1010625 - RNA, 16 nt, Mycobacterium avium subsp. paratuberculosis
ugcgcgggucgccggg

SEQ ID NO: 1010626 - RNA, 19 nt, Mycobacterium avium subsp. paratuberculosis
ugcgcgggucgccgggcag

SEQ ID NO: 1010627 - RNA, 16 nt, Mycobacterium avium subsp. paratuberculosis
ugcgcgggcgcggcca

SEQ ID NO: 1010628 - RNA, 22 nt, Mycobacterium avium subsp. paratuberculosis
ugcgcggcguucuccagcaccc

SEQ ID NO: 1010629 - RNA, 13 nt, Mycobacterium avium subsp. paratuberculosis
ugcgcucggccgg

SEQ ID NO: 1010630 - RNA, 13 nt, Mycobacterium avium subsp. paratuberculosis
ugcgcuaccaggc

SEQ ID NO: 1010631 - RNA, 22 nt, Mycobacterium avium subsp. paratuberculosis
ugcggacgcguugaaaguccuu

SEQ ID NO: 1010632 - RNA, 18 nt, Mycobacterium avium subsp. paratuberculosis
ugcgcugcaaccgguccg

SEQ ID NO: 1010633 - RNA, 22 nt, Mycobacterium avium subsp. paratuberculosis
ugcggacaccagucgcacaacc

SEQ ID NO: 1010634 - RNA, 14 nt, Mycobacterium avium subsp. paratuberculosis
ugcggaugucggug

SEQ ID NO: 1010635 - RNA, 17 nt, Mycobacterium avium subsp. paratuberculosis
ugcgggugaggccaggc

SEQ ID NO: 1010636 - RNA, 12 nt, Mycobacterium avium subsp. paratuberculosis
ugcgggucucga

SEQ ID NO: 1010637 - RNA, 18 nt, Mycobacterium avium subsp. paratuberculosis
ugcgggugcggccagcgc

SEQ ID NO: 1010638 - RNA, 13 nt, Mycobacterium avium subsp. paratuberculosis
ugcggguguugac

SEQ ID NO: 1010639 - RNA, 22 nt, Mycobacterium avium subsp. paratuberculosis
ugcggguguccgagcgggccgu

SEQ ID NO: 1010640 - RNA, 17 nt, Mycobacterium avium subsp. paratuberculosis
ugcggguggccgggucg

SEQ ID NO: 1010641 - RNA, 21 nt, Mycobacterium avium subsp. paratuberculosis
ugcggguggccgggucgccgu

SEQ ID NO: 1010642 - RNA, 12 nt, Mycobacterium avium subsp. paratuberculosis
ugcgggccaggu

SEQ ID NO: 1010643 - RNA, 13 nt, Mycobacterium avium subsp. paratuberculosis
ugcgggcccagcu

SEQ ID NO: 1010644 - RNA, 20 nt, Mycobacterium avium subsp. paratuberculosis
ugcgggcggggcccgggccg

SEQ ID NO: 1010645 - RNA, 16 nt, Mycobacterium avium subsp. paratuberculosis
ugcgggcggcgcggcg

SEQ ID NO: 1010646 - RNA, 19 nt, Mycobacterium avium subsp. paratuberculosis
ugcgggcgauggcgggccg

SEQ ID NO: 1010647 - RNA, 12 nt, Mycobacterium avium subsp. paratuberculosis
ugcggggccgcg

SEQ ID NO: 1010648 - RNA, 12 nt, Mycobacterium avium subsp. paratuberculosis
ugcggggccggc

SEQ ID NO: 1010649 - RNA, 18 nt, Mycobacterium avium subsp. paratuberculosis
ugcgggucacggucaggc

SEQ ID NO: 1010650 - RNA, 23 nt, Mycobacterium avium subsp. paratuberculosis
ugcgggucacggucaggccggga

SEQ ID NO: 1010651 - RNA, 19 nt, Mycobacterium avium subsp. paratuberculosis
ugcggcaacagcaccagca

SEQ ID NO: 1010652 - RNA, 20 nt, Mycobacterium avium subsp. paratuberculosis
ugcggcccagcccggccagc

SEQ ID NO: 1010653 - RNA, 16 nt, Mycobacterium avium subsp. paratuberculosis
ugcggccagugccggg

SEQ ID NO: 1010654 - RNA, 19 nt, Mycobacterium avium subsp. paratuberculosis
ugcggccagugccgggcca

SEQ ID NO: 1010655 - RNA, 13 nt, Mycobacterium avium subsp. paratuberculosis
ugcggcccggcac

SEQ ID NO: 1010656 - RNA, 16 nt, Mycobacterium avium subsp. paratuberculosis
ugcggcccggcacugg

SEQ ID NO: 1010657 - RNA, 12 nt, Mycobacterium avium subsp. paratuberculosis
ugcggcccggcu

SEQ ID NO: 1010658 - RNA, 12 nt, Mycobacterium avium subsp. paratuberculosis
ugcgggccaccg

SEQ ID NO: 1010659 - RNA, 23 nt, Mycobacterium avium subsp. paratuberculosis
ugcgggccagcacgaccccgccc

SEQ ID NO: 1010660 - RNA, 15 nt, Mycobacterium avium subsp. paratuberculosis
ugcgggccagcagcc

SEQ ID NO: 1010661 - RNA, 14 nt, Mycobacterium avium subsp. paratuberculosis
ugcggccggcgccg

SEQ ID NO: 1010662 - RNA, 15 nt, Mycobacterium avium subsp. paratuberculosis
ugcggccguccagcg

SEQ ID NO: 1010663 - RNA, 22 nt, Mycobacterium avium subsp. paratuberculosis
ugcggccgcagcgcccggcagc

SEQ ID NO: 1010664 - RNA, 21 nt, Mycobacterium avium subsp. paratuberculosis
ugcggccucggcaccgugccg

SEQ ID NO: 1010665 - RNA, 14 nt, Mycobacterium avium subsp. paratuberculosis
ugcggccgcgcagc

SEQ ID NO: 1010666 - RNA, 23 nt, Mycobacterium avium subsp. paratuberculosis
ugcggccgcgacugcacccgaac

SEQ ID NO: 1010667 - RNA, 20 nt, Mycobacterium avium subsp. paratuberculosis
ugcggccgacuuggucagcc

SEQ ID NO: 1010668 - RNA, 16 nt, Mycobacterium avium subsp. paratuberculosis
ugcgccgugcagcacg

SEQ ID NO: 1010669 - RNA, 22 nt, Mycobacterium avium subsp. paratuberculosis
ugcgcgauggcgugccggcgcu

SEQ ID NO: 1010670 - RNA, 12 nt, Mycobacterium avium subsp. paratuberculosis
ugcgcgagcaga

SEQ ID NO: 1010671 - RNA, 19 nt, Mycobacterium avium subsp. paratuberculosis
ugcgcgacgggcguccgag

SEQ ID NO: 1010672 - RNA, 12 nt, Mycobacterium avium subsp. paratuberculosis
ugcgccuuggcc

SEQ ID NO: 1010673 - RNA, 14 nt, Mycobacterium avium subsp. paratuberculosis
ugcgcccagguacu

SEQ ID NO: 1010674 - RNA, 16 nt, Mycobacterium avium subsp. paratuberculosis
ugcgccccgcccugcu

SEQ ID NO: 1010675 - RNA, 16 nt, Mycobacterium avium subsp. paratuberculosis
ugcgcaucgagcugca

SEQ ID NO: 1010676 - RNA, 13 nt, Mycobacterium avium subsp. paratuberculosis
ugcgcaacagcgu

SEQ ID NO: 1010677 - RNA, 21 nt, Mycobacterium avium subsp. paratuberculosis
ugcgcaacagcgugcacaccc

SEQ ID NO: 1010678 - RNA, 14 nt, Mycobacterium avium subsp. paratuberculosis
ugcgagaucggcag

SEQ ID NO: 1010679 - RNA, 21 nt, Mycobacterium avium subsp. paratuberculosis
ugcgacuucuacggcgggccg

SEQ ID NO: 1010680 - RNA, 18 nt, Mycobacterium avium subsp. paratuberculosis
ugcgcagacccgguggcc

SEQ ID NO: 1010681 - RNA, 15 nt, Mycobacterium avium subsp. paratuberculosis
ugcgcacgucggccg

SEQ ID NO: 1010682 - RNA, 22 nt, Mycobacterium avium subsp. paratuberculosis
ugcgcacgucggccgccagggc

SEQ ID NO: 1010683 - RNA, 14 nt, Mycobacterium avium subsp. paratuberculosis
ugcgcagccgcugc

SEQ ID NO: 1010684 - RNA, 14 nt, Mycobacterium avium subsp. paratuberculosis
ugcgcagccgggcg

SEQ ID NO: 1010685 - RNA, 12 nt, Mycobacterium avium subsp. paratuberculosis
ugcgcagcaccg

SEQ ID NO: 1010686 - RNA, 15 nt, Mycobacterium avium subsp. paratuberculosis
ugcgcagcaccgucc

SEQ ID NO: 1010687 - RNA, 22 nt, Mycobacterium avium subsp. paratuberculosis
ugcgcagcagccaggacagcgu

SEQ ID NO: 1010688 - RNA, 17 nt, Mycobacterium avium subsp. paratuberculosis
ugcgcagcagcgccagc

SEQ ID NO: 1010689 - RNA, 12 nt, Mycobacterium avium subsp. paratuberculosis
ugcgcagcgcgu

SEQ ID NO: 1010690 - RNA, 13 nt, Mycobacterium avium subsp. paratuberculosis
ugcgcagcgcagc

SEQ ID NO: 1010691 - RNA, 14 nt, Mycobacterium avium subsp. paratuberculosis
ugcgcagcgcagca

SEQ ID NO: 1010692 - RNA, 20 nt, Mycobacterium avium subsp. paratuberculosis
ugcgcagcgcagcaccaucc

SEQ ID NO: 1010693 - RNA, 22 nt, Mycobacterium avium subsp. paratuberculosis
ugccuggcccagacaggccggc

SEQ ID NO: 1010694 - RNA, 21 nt, Mycobacterium avium subsp. paratuberculosis
ugccugcugcccauccaggcc

SEQ ID NO: 1010695 - RNA, 23 nt, Mycobacterium avium subsp. paratuberculosis
ugccugcgcccacagguccagcg

SEQ ID NO: 1010696 - RNA, 14 nt, Mycobacterium avium subsp. paratuberculosis
ugcgaccgccgcua

SEQ ID NO: 1010697 - RNA, 14 nt, Mycobacterium avium subsp. paratuberculosis
ugcgacggcagcac

SEQ ID NO: 1010698 - RNA, 16 nt, Mycobacterium avium subsp. paratuberculosis
ugcgacggcagcaccu

SEQ ID NO: 1010699 - RNA, 14 nt, Mycobacterium avium subsp. paratuberculosis
ugcgacggcucuuc

SEQ ID NO: 1010700 - RNA, 15 nt, Mycobacterium avium subsp. paratuberculosis
ugcgacgacgucguc

SEQ ID NO: 1010701 - RNA, 13 nt, Mycobacterium avium subsp. paratuberculosis
ugccgagcagcac

SEQ ID NO: 1010702 - RNA, 14 nt, Mycobacterium avium subsp. paratuberculosis
ugccgagcagcacc

SEQ ID NO: 1010703 - RNA, 15 nt, Mycobacterium avium subsp. paratuberculosis
ugccgagcagcaccg

SEQ ID NO: 1010704 - RNA, 12 nt, Mycobacterium avium subsp. paratuberculosis
ugccgagcagcu

SEQ ID NO: 1010705 - RNA, 13 nt, Mycobacterium avium subsp. paratuberculosis
ugccgagccggcc

SEQ ID NO: 1010706 - RNA, 19 nt, Mycobacterium avium subsp. paratuberculosis
ugccgaggcacagcagcac

SEQ ID NO: 1010707 - RNA, 15 nt, Mycobacterium avium subsp. paratuberculosis
ugccgaguuccugcg

SEQ ID NO: 1010708 - RNA, 16 nt, Mycobacterium avium subsp. paratuberculosis
ugccgacgugaugcac

SEQ ID NO: 1010709 - RNA, 17 nt, Mycobacterium avium subsp. paratuberculosis
ugccgacgauccgggcg

SEQ ID NO: 1010710 - RNA, 23 nt, Mycobacterium avium subsp. paratuberculosis
ugccgaagggcaaccgcagcauc

SEQ ID NO: 1010711 - RNA, 18 nt, Mycobacterium avium subsp. paratuberculosis
ugccgacaccccacaccg

SEQ ID NO: 1010712 - RNA, 16 nt, Mycobacterium avium subsp. paratuberculosis
ugccgaacagcgacgu

SEQ ID NO: 1010713 - RNA, 17 nt, Mycobacterium avium subsp. paratuberculosis
ugccgaaccgcugcgga

SEQ ID NO: 1010714 - RNA, 18 nt, Mycobacterium avium subsp. paratuberculosis
ugccgaacgucaccaaca

SEQ ID NO: 1010715 - RNA, 22 nt, Mycobacterium avium subsp. paratuberculosis
ugccgaacgucaccaacaugau

SEQ ID NO: 1010716 - RNA, 17 nt, Mycobacterium avium subsp. paratuberculosis
ugcccuuggccagcagu

SEQ ID NO: 1010717 - RNA, 17 nt, Mycobacterium avium subsp. paratuberculosis
ugcccuuggcccgggcg

SEQ ID NO: 1010718 - RNA, 16 nt, Mycobacterium avium subsp. paratuberculosis
ugcccugccugcugcc

SEQ ID NO: 1010719 - RNA, 15 nt, Mycobacterium avium subsp. paratuberculosis
ugcccuagcgguggc

SEQ ID NO: 1010720 - RNA, 16 nt, Mycobacterium avium subsp. paratuberculosis
ugcccuccagcaccgu

SEQ ID NO: 1010721 - RNA, 11 nt, Mycobacterium avium subsp. paratuberculosis
ugcccuccucg

SEQ ID NO: 1010722 - RNA, 17 nt, Mycobacterium avium subsp. paratuberculosis
ugcccugcgugcagaca

SEQ ID NO: 1010723 - RNA, 13 nt, Mycobacterium avium subsp. paratuberculosis
ugcccugcacgau

SEQ ID NO: 1010724 - RNA, 15 nt, Mycobacterium avium subsp. paratuberculosis
ugccgcaacgggccg

SEQ ID NO: 1010725 - RNA, 21 nt, Mycobacterium avium subsp. paratuberculosis
ugccgcagugccggcgcaccg

SEQ ID NO: 1010726 - RNA, 13 nt, Mycobacterium avium subsp. paratuberculosis
ugccgauuccagc

SEQ ID NO: 1010727 - RNA, 16 nt, Mycobacterium avium subsp. paratuberculosis
ugccgauggccaccgg

SEQ ID NO: 1010728 - RNA, 21 nt, Mycobacterium avium subsp. paratuberculosis
ugccgaucggggcgcagcccg

SEQ ID NO: 1010729 - RNA, 17 nt, Mycobacterium avium subsp. paratuberculosis
ugccgaucgccgcggcg

SEQ ID NO: 1010730 - RNA, 21 nt, Mycobacterium avium subsp. paratuberculosis
ugccgaucaccucgccggccg

SEQ ID NO: 1010731 - RNA, 18 nt, Mycobacterium avium subsp. paratuberculosis
ugccgaucagcgucagca

SEQ ID NO: 1010732 - RNA, 21 nt, Mycobacterium avium subsp. paratuberculosis
ugccgaucagcgucagcaccg

SEQ ID NO: 1010733 - RNA, 14 nt, Mycobacterium avium subsp. paratuberculosis
ugccgaucaggcug

SEQ ID NO: 1010734 - RNA, 20 nt, Mycobacterium avium subsp. paratuberculosis
ugccgccauccugucauccg

SEQ ID NO: 1010735 - RNA, 17 nt, Mycobacterium avium subsp. paratuberculosis
ugccgcccaucaccccg

SEQ ID NO: 1010736 - RNA, 15 nt, Mycobacterium avium subsp. paratuberculosis
ugccgccccugcugg

SEQ ID NO: 1010737 - RNA, 14 nt, Mycobacterium avium subsp. paratuberculosis
ugccgcccggaccg

SEQ ID NO: 1010738 - RNA, 20 nt, Mycobacterium avium subsp. paratuberculosis
ugccgcccggaccgcggucg

SEQ ID NO: 1010739 - RNA, 18 nt, Mycobacterium avium subsp. paratuberculosis
ugccgcccgggaagcugg

SEQ ID NO: 1010740 - RNA, 14 nt, Mycobacterium avium subsp. paratuberculosis
ugccgcccgggccg

SEQ ID NO: 1010741 - RNA, 18 nt, Mycobacterium avium subsp. paratuberculosis
ugccgcccgucgccuccu

SEQ ID NO: 1010742 - RNA, 14 nt, Mycobacterium avium subsp. paratuberculosis
ugccgccgcagcag

SEQ ID NO: 1010743 - RNA, 23 nt, Mycobacterium avium subsp. paratuberculosis
ugccgccgccgcugucgauggac

SEQ ID NO: 1010744 - RNA, 17 nt, Mycobacterium avium subsp. paratuberculosis
ugccgccgcccaggccg

SEQ ID NO: 1010745 - RNA, 21 nt, Mycobacterium avium subsp. paratuberculosis
ugccgccgcccaggccgagcg

SEQ ID NO: 1010746 - RNA, 23 nt, Mycobacterium avium subsp. paratuberculosis
ugccgccgacgaugucgaaaccc

SEQ ID NO: 1010747 - RNA, 17 nt, Mycobacterium avium subsp. paratuberculosis
ugccgccgagggccagc

SEQ ID NO: 1010748 - RNA, 21 nt, Mycobacterium avium subsp. paratuberculosis
ugccgccgagggccagcagcc

SEQ ID NO: 1010749 - RNA, 22 nt, Mycobacterium avium subsp. paratuberculosis
ugccgccgagggccagcagcca

SEQ ID NO: 1010750 - RNA, 22 nt, Mycobacterium avium subsp. paratuberculosis
ugccguucggccagcgccgcca

SEQ ID NO: 1010751 - RNA, 19 nt, Mycobacterium avium subsp. paratuberculosis
ugccguuccagccggcccg

SEQ ID NO: 1010752 - RNA, 15 nt, Mycobacterium avium subsp. paratuberculosis
ugccguucagcgcgg

SEQ ID NO: 1010753 - RNA, 18 nt, Mycobacterium avium subsp. paratuberculosis
ugccguucagcgcggcca

SEQ ID NO: 1010754 - RNA, 13 nt, Mycobacterium avium subsp. paratuberculosis
ugccgugcgcgcu

SEQ ID NO: 1010755 - RNA, 21 nt, Mycobacterium avium subsp. paratuberculosis
ugccguccagcaacgccgaca

SEQ ID NO: 1010756 - RNA, 19 nt, Mycobacterium avium subsp. paratuberculosis
ugccuaggggagcagcacg

SEQ ID NO: 1010757 - RNA, 14 nt, Mycobacterium avium subsp. paratuberculosis
ugccggcggccagc

SEQ ID NO: 1010758 - RNA, 18 nt, Mycobacterium avium subsp. paratuberculosis
ugccggcggccgccggca

SEQ ID NO: 1010759 - RNA, 22 nt, Mycobacterium avium subsp. paratuberculosis
ugccggcucggcggcucagcaa

SEQ ID NO: 1010760 - RNA, 16 nt, Mycobacterium avium subsp. paratuberculosis
ugccggcgggucagca

SEQ ID NO: 1010761 - RNA, 22 nt, Mycobacterium avium subsp. paratuberculosis
ugccgggacagguagcgcagcc

SEQ ID NO: 1010762 - RNA, 15 nt, Mycobacterium avium subsp. paratuberculosis
ugccgggcagcggcc

SEQ ID NO: 1010763 - RNA, 15 nt, Mycobacterium avium subsp. paratuberculosis
ugccgggcauggcug

SEQ ID NO: 1010764 - RNA, 20 nt, Mycobacterium avium subsp. paratuberculosis
ugccgggcauggcuggaagu

SEQ ID NO: 1010765 - RNA, 12 nt, Mycobacterium avium subsp. paratuberculosis
ugccgggccaga

SEQ ID NO: 1010766 - RNA, 21 nt, Mycobacterium avium subsp. paratuberculosis
ugccgggccgcauccagcgcc

SEQ ID NO: 1010767 - RNA, 18 nt, Mycobacterium avium subsp. paratuberculosis
ugccguccagcuccgccg

SEQ ID NO: 1010768 - RNA, 21 nt, Mycobacterium avium subsp. paratuberculosis
ugccguccagcuccgccgaca

SEQ ID NO: 1010769 - RNA, 20 nt, Mycobacterium avium subsp. paratuberculosis
ugccgucaccggccauccgc

SEQ ID NO: 1010770 - RNA, 17 nt, Mycobacterium avium subsp. paratuberculosis
ugccgucccccgagcgg

SEQ ID NO: 1010771 - RNA, 22 nt, Mycobacterium avium subsp. paratuberculosis
ugccgucccccgagcgggccuu

SEQ ID NO: 1010772 - RNA, 22 nt, Mycobacterium avium subsp. paratuberculosis
ugccgugccagccggccgcuga

SEQ ID NO: 1010773 - RNA, 16 nt, Mycobacterium avium subsp. paratuberculosis
ugccguagcgcaugau

SEQ ID NO: 1010774 - RNA, 15 nt, Mycobacterium avium subsp. paratuberculosis
ugccguagcgcuggg

SEQ ID NO: 1010775 - RNA, 23 nt, Mycobacterium avium subsp. paratuberculosis
ugccguaggacaggaacgggccg

SEQ ID NO: 1010776 - RNA, 22 nt, Mycobacterium avium subsp. paratuberculosis
ugccgcugcgccggcgcggcca

SEQ ID NO: 1010777 - RNA, 17 nt, Mycobacterium avium subsp. paratuberculosis
ugccgcuggauuccacc

SEQ ID NO: 1010778 - RNA, 23 nt, Mycobacterium avium subsp. paratuberculosis
ugccgcuggauuccaccgugguc

SEQ ID NO: 1010779 - RNA, 20 nt, Mycobacterium avium subsp. paratuberculosis
ugccgcgguugaacaggcug

SEQ ID NO: 1010780 - RNA, 22 nt, Mycobacterium avium subsp. paratuberculosis
ugccgcgugacaggggcagcag

SEQ ID NO: 1010781 - RNA, 19 nt, Mycobacterium avium subsp. paratuberculosis
ugccgcguucggaggcuuc

SEQ ID NO: 1010782 - RNA, 14 nt, Mycobacterium avium subsp. paratuberculosis
ugccgcgggccagc

SEQ ID NO: 1010783 - RNA, 18 nt, Mycobacterium avium subsp. paratuberculosis
ugccgcgggccagcagcc

SEQ ID NO: 1010784 - RNA, 11 nt, Mycobacterium avium subsp. paratuberculosis
ugccgcggccg

SEQ ID NO: 1010785 - RNA, 17 nt, Mycobacterium avium subsp. paratuberculosis
ugccgcgcugcgccggg

SEQ ID NO: 1010786 - RNA, 21 nt, Mycobacterium avium subsp. paratuberculosis
ugccggaccgcgcgggccagc

SEQ ID NO: 1010787 - RNA, 24 nt, Mycobacterium avium subsp. paratuberculosis
ugccggaccgcgcgggccagcgcc

SEQ ID NO: 1010788 - RNA, 15 nt, Mycobacterium avium subsp. paratuberculosis
ugccggacaccccgg

SEQ ID NO: 1010789 - RNA, 21 nt, Mycobacterium avium subsp. paratuberculosis
ugccggacaccccggccaguc

SEQ ID NO: 1010790 - RNA, 16 nt, Mycobacterium avium subsp. paratuberculosis
ugccggacaccggcac

SEQ ID NO: 1010791 - RNA, 17 nt, Mycobacterium avium subsp. paratuberculosis
ugccgcgacccgggccg

SEQ ID NO: 1010792 - RNA, 20 nt, Mycobacterium avium subsp. paratuberculosis
ugccgcgacccgggccgcca

SEQ ID NO: 1010793 - RNA, 15 nt, Mycobacterium avium subsp. paratuberculosis
ugccgcgcagcaccg

SEQ ID NO: 1010794 - RNA, 19 nt, Mycobacterium avium subsp. paratuberculosis
ugccgcgccccgagcagcg

SEQ ID NO: 1010795 - RNA, 22 nt, Mycobacterium avium subsp. paratuberculosis
ugccgcgccccgagcagcgggu

SEQ ID NO: 1010796 - RNA, 22 nt, Mycobacterium avium subsp. paratuberculosis
ugccgcgcggcgauggccgaca

SEQ ID NO: 1010797 - RNA, 21 nt, Mycobacterium avium subsp. paratuberculosis
ugccgcgcggcgccagcggcc

SEQ ID NO: 1010798 - RNA, 12 nt, Mycobacterium avium subsp. paratuberculosis
ugccgcgcggcg

SEQ ID NO: 1010799 - RNA, 19 nt, Mycobacterium avium subsp. paratuberculosis
ugccgcgccgccacaccuc

SEQ ID NO: 1010800 - RNA, 13 nt, Mycobacterium avium subsp. paratuberculosis
ugccgcgcgcccg

SEQ ID NO: 1010801 - RNA, 19 nt, Mycobacterium avium subsp. paratuberculosis
ugccgcgcgcccgcggcca

SEQ ID NO: 1010802 - RNA, 18 nt, Mycobacterium avium subsp. paratuberculosis
ugccgccgcgcgcggcca

SEQ ID NO: 1010803 - RNA, 16 nt, Mycobacterium avium subsp. paratuberculosis
ugccgccgggccaggu

SEQ ID NO: 1010804 - RNA, 17 nt, Mycobacterium avium subsp. paratuberculosis
ugccgccgugcgcggcg

SEQ ID NO: 1010805 - RNA, 16 nt, Mycobacterium avium subsp. paratuberculosis
ugcccaucacgcccca

SEQ ID NO: 1010806 - RNA, 12 nt, Mycobacterium avium subsp. paratuberculosis
ugccccagggac

SEQ ID NO: 1010807 - RNA, 21 nt, Mycobacterium avium subsp. paratuberculosis
ugccccagggaccaguggugg

SEQ ID NO: 1010808 - RNA, 20 nt, Mycobacterium avium subsp. paratuberculosis
ugccccaucuugaccagggu

SEQ ID NO: 1010809 - RNA, 13 nt, Mycobacterium avium subsp. paratuberculosis
ugccccgcgaccg

SEQ ID NO: 1010810 - RNA, 19 nt, Mycobacterium avium subsp. paratuberculosis
ugccccggcgaggccaggc

SEQ ID NO: 1010811 - RNA, 21 nt, Mycobacterium avium subsp. paratuberculosis
ugccccguccggcgccagccc

SEQ ID NO: 1010812 - RNA, 20 nt, Mycobacterium avium subsp. paratuberculosis
ugccccgccguuucagcagc

SEQ ID NO: 1010813 - RNA, 15 nt, Mycobacterium avium subsp. paratuberculosis
ugccccgcaccgcca

SEQ ID NO: 1010814 - RNA, 15 nt, Mycobacterium avium subsp. paratuberculosis
ugcccagcagggcgg

SEQ ID NO: 1010815 - RNA, 22 nt, Mycobacterium avium subsp. paratuberculosis
ugcccagcaguuuguccugcuc

SEQ ID NO: 1010816 - RNA, 20 nt, Mycobacterium avium subsp. paratuberculosis
ugcccaccaucccgccgccg

SEQ ID NO: 1010817 - RNA, 14 nt, Mycobacterium avium subsp. paratuberculosis
ugcccaccaccagg

SEQ ID NO: 1010818 - RNA, 16 nt, Mycobacterium avium subsp. paratuberculosis
ugcccaccaccagggg

SEQ ID NO: 1010819 - RNA, 23 nt, Mycobacterium avium subsp. paratuberculosis
ugcccaccaccaggggcagcuga

SEQ ID NO: 1010820 - RNA, 15 nt, Mycobacterium avium subsp. paratuberculosis
ugcccaccagcaggu

SEQ ID NO: 1010821 - RNA, 16 nt, Mycobacterium avium subsp. paratuberculosis
ugcccaccagccggcc

SEQ ID NO: 1010822 - RNA, 17 nt, Mycobacterium avium subsp. paratuberculosis
ugcccaccagccggccg

SEQ ID NO: 1010823 - RNA, 17 nt, Mycobacterium avium subsp. paratuberculosis
ugcccaccgggcagccg

SEQ ID NO: 1010824 - RNA, 23 nt, Mycobacterium avium subsp. paratuberculosis
ugcccaccgggcagccgcacacc

SEQ ID NO: 1010825 - RNA, 18 nt, Mycobacterium avium subsp. paratuberculosis
ugcccacgccgucgaccc

SEQ ID NO: 1010826 - RNA, 20 nt, Mycobacterium avium subsp. paratuberculosis
ugcccaggaaguagccggcc

SEQ ID NO: 1010827 - RNA, 22 nt, Mycobacterium avium subsp. paratuberculosis
ugcccagggcgcguccacucca

SEQ ID NO: 1010828 - RNA, 23 nt, Mycobacterium avium subsp. paratuberculosis
ugcccagggcguuugccacugag

SEQ ID NO: 1010829 - RNA, 18 nt, Mycobacterium avium subsp. paratuberculosis
ugcccaggcccaccagcu

SEQ ID NO: 1010830 - RNA, 13 nt, Mycobacterium avium subsp. paratuberculosis
ugcccagcggggc

SEQ ID NO: 1010831 - RNA, 24 nt, Mycobacterium avium subsp. paratuberculosis
ugcccagcggggcgaccuugcgca

SEQ ID NO: 1010832 - RNA, 12 nt, Mycobacterium avium subsp. paratuberculosis
ugcccagcgcga

SEQ ID NO: 1010833 - RNA, 15 nt, Mycobacterium avium subsp. paratuberculosis
ugcccagcgcgcggu

SEQ ID NO: 1010834 - RNA, 13 nt, Mycobacterium avium subsp. paratuberculosis
ugcccagcgcggu

SEQ ID NO: 1010835 - RNA, 15 nt, Mycobacterium avium subsp. paratuberculosis
ugcccagcgcggucg

SEQ ID NO: 1010836 - RNA, 20 nt, Mycobacterium avium subsp. paratuberculosis
ugcccagccgcaggugcagc

SEQ ID NO: 1010837 - RNA, 21 nt, Mycobacterium avium subsp. paratuberculosis
ugcccagauugcggcccuugc

SEQ ID NO: 1010838 - RNA, 17 nt, Mycobacterium avium subsp. paratuberculosis
ugccccucgacccgaag

SEQ ID NO: 1010839 - RNA, 15 nt, Mycobacterium avium subsp. paratuberculosis
ugccccuugacggug

SEQ ID NO: 1010840 - RNA, 21 nt, Mycobacterium avium subsp. paratuberculosis
ugcccgaauugcgcugcaccg

SEQ ID NO: 1010841 - RNA, 18 nt, Mycobacterium avium subsp. paratuberculosis
ugcccgacggcgcgcccg

SEQ ID NO: 1010842 - RNA, 14 nt, Mycobacterium avium subsp. paratuberculosis
ugcccgacuccuca

SEQ ID NO: 1010843 - RNA, 15 nt, Mycobacterium avium subsp. paratuberculosis
ugcccgacuccucac

SEQ ID NO: 1010844 - RNA, 16 nt, Mycobacterium avium subsp. paratuberculosis
ugcccgacuccucaca

SEQ ID NO: 1010845 - RNA, 12 nt, Mycobacterium avium subsp. paratuberculosis
ugcccgagguga

SEQ ID NO: 1010846 - RNA, 16 nt, Mycobacterium avium subsp. paratuberculosis
ugcccgagcaccugaa

SEQ ID NO: 1010847 - RNA, 15 nt, Mycobacterium avium subsp. paratuberculosis
ugcccgaucagccgg

SEQ ID NO: 1010848 - RNA, 22 nt, Mycobacterium avium subsp. paratuberculosis
ugcccgcaucgccgaaccgggc

SEQ ID NO: 1010849 - RNA, 20 nt, Mycobacterium avium subsp. paratuberculosis
ugcccgccgcugacgcggcg

SEQ ID NO: 1010850 - RNA, 18 nt, Mycobacterium avium subsp. paratuberculosis
ugcccgccgcggccgcug

SEQ ID NO: 1010851 - RNA, 14 nt, Mycobacterium avium subsp. paratuberculosis
ugcccgccgcggcg

SEQ ID NO: 1010852 - RNA, 21 nt, Mycobacterium avium subsp. paratuberculosis
ugcccgccgcggcgagccggc

SEQ ID NO: 1010853 - RNA, 22 nt, Mycobacterium avium subsp. paratuberculosis
ugcccgccgcggcgagccggcc

SEQ ID NO: 1010854 - RNA, 20 nt, Mycobacterium avium subsp. paratuberculosis
ugcccgccgcggugcugauc

SEQ ID NO: 1010855 - RNA, 19 nt, Mycobacterium avium subsp. paratuberculosis
ugcccgccgcguacagcag

SEQ ID NO: 1010856 - RNA, 21 nt, Mycobacterium avium subsp. paratuberculosis
ugcccgccgcguacagcagcu

SEQ ID NO: 1010857 - RNA, 14 nt, Mycobacterium avium subsp. paratuberculosis
ugcccgccccgccc

SEQ ID NO: 1010858 - RNA, 22 nt, Mycobacterium avium subsp. paratuberculosis
ugcccgucggaggacaacgcgu

SEQ ID NO: 1010859 - RNA, 19 nt, Mycobacterium avium subsp. paratuberculosis
ugcccguagucggcggcga

SEQ ID NO: 1010860 - RNA, 15 nt, Mycobacterium avium subsp. paratuberculosis
ugcccgucacggccg

SEQ ID NO: 1010861 - RNA, 23 nt, Mycobacterium avium subsp. paratuberculosis
ugcccggguccuggaucagccag

SEQ ID NO: 1010862 - RNA, 17 nt, Mycobacterium avium subsp. paratuberculosis
ugcccggucugcggccg

SEQ ID NO: 1010863 - RNA, 21 nt, Mycobacterium avium subsp. paratuberculosis
ugcccggcgcggacagcgcgg

SEQ ID NO: 1010864 - RNA, 22 nt, Mycobacterium avium subsp. paratuberculosis
ugcccggcgcggacagcgcggu

SEQ ID NO: 1010865 - RNA, 23 nt, Mycobacterium avium subsp. paratuberculosis
ugcccgggcuguugaccacggcc

SEQ ID NO: 1010866 - RNA, 17 nt, Mycobacterium avium subsp. paratuberculosis
ugcccgggguccaccgg

SEQ ID NO: 1010867 - RNA, 20 nt, Mycobacterium avium subsp. paratuberculosis
ugcccgggguccaccggccg

SEQ ID NO: 1010868 - RNA, 16 nt, Mycobacterium avium subsp. paratuberculosis
ugcccggaucgccgaa

SEQ ID NO: 1010869 - RNA, 15 nt, Mycobacterium avium subsp. paratuberculosis
ugcccggccauaaag

SEQ ID NO: 1010870 - RNA, 21 nt, Mycobacterium avium subsp. paratuberculosis
ugcccggcccgccgcugcagc

SEQ ID NO: 1010871 - RNA, 20 nt, Mycobacterium avium subsp. paratuberculosis
ugcccggagaaaccgucggc

SEQ ID NO: 1010872 - RNA, 16 nt, Mycobacterium avium subsp. paratuberculosis
ugcccgcguccugcag

SEQ ID NO: 1010873 - RNA, 23 nt, Mycobacterium avium subsp. paratuberculosis
ugcccgcgcggcucacagcgcgg

SEQ ID NO: 1010874 - RNA, 18 nt, Mycobacterium avium subsp. paratuberculosis
ugcccgcggccgccgccg

SEQ ID NO: 1010875 - RNA, 17 nt, Mycobacterium avium subsp. paratuberculosis
ugcccgcgggccagacu

SEQ ID NO: 1010876 - RNA, 15 nt, Mycobacterium avium subsp. paratuberculosis
ugcccgcgccgacca

SEQ ID NO: 1010877 - RNA, 21 nt, Mycobacterium avium subsp. paratuberculosis
ugccaucgugggcgccgucgc

SEQ ID NO: 1010878 - RNA, 15 nt, Mycobacterium avium subsp. paratuberculosis
ugccauagauguugg

SEQ ID NO: 1010879 - RNA, 17 nt, Mycobacterium avium subsp. paratuberculosis
ugcccaagccggccagg

SEQ ID NO: 1010880 - RNA, 19 nt, Mycobacterium avium subsp. paratuberculosis
ugcccaaugaucugggccg

SEQ ID NO: 1010881 - RNA, 22 nt, Mycobacterium avium subsp. paratuberculosis
ugcccaacagcucgcgggccug

SEQ ID NO: 1010882 - RNA, 15 nt, Mycobacterium avium subsp. paratuberculosis
ugccaguccugggcc

SEQ ID NO: 1010883 - RNA, 16 nt, Mycobacterium avium subsp. paratuberculosis
ugccaguccugggccg

SEQ ID NO: 1010884 - RNA, 11 nt, Mycobacterium avium subsp. paratuberculosis
ugccagcggcg

SEQ ID NO: 1010885 - RNA, 18 nt, Mycobacterium avium subsp. paratuberculosis
ugccagcgcaccgggccc

SEQ ID NO: 1010886 - RNA, 16 nt, Mycobacterium avium subsp. paratuberculosis
ugccagccggugcuga

SEQ ID NO: 1010887 - RNA, 23 nt, Mycobacterium avium subsp. paratuberculosis
ugccacuucgacggcagcggcac

SEQ ID NO: 1010888 - RNA, 19 nt, Mycobacterium avium subsp. paratuberculosis
ugccacugagcgcaggccg

SEQ ID NO: 1010889 - RNA, 17 nt, Mycobacterium avium subsp. paratuberculosis
ugccacaggccgaacag

SEQ ID NO: 1010890 - RNA, 21 nt, Mycobacterium avium subsp. paratuberculosis
ugccacggcggaucaguaccg

SEQ ID NO: 1010891 - RNA, 23 nt, Mycobacterium avium subsp. paratuberculosis
ugccacgguuucgccguacagcu

SEQ ID NO: 1010892 - RNA, 21 nt, Mycobacterium avium subsp. paratuberculosis
ugccaagccauuucagcagcg

SEQ ID NO: 1010893 - RNA, 18 nt, Mycobacterium avium subsp. paratuberculosis
ugccaagacguccgcguc

SEQ ID NO: 1010894 - RNA, 12 nt, Mycobacterium avium subsp. paratuberculosis
ugccaaggucgc

SEQ ID NO: 1010895 - RNA, 13 nt, Mycobacterium avium subsp. paratuberculosis
ugccaaggucgcc

SEQ ID NO: 1010896 - RNA, 18 nt, Mycobacterium avium subsp. paratuberculosis
ugccaagcgguuccagac

SEQ ID NO: 1010897 - RNA, 13 nt, Mycobacterium avium subsp. paratuberculosis
ugcaugcgcugcu

SEQ ID NO: 1010898 - RNA, 19 nt, Mycobacterium avium subsp. paratuberculosis
ugcaucgcgaucgacagcu

SEQ ID NO: 1010899 - RNA, 16 nt, Mycobacterium avium subsp. paratuberculosis
ugcauagucggcccga

SEQ ID NO: 1010900 - RNA, 14 nt, Mycobacterium avium subsp. paratuberculosis
ugcaggcgcccagg

SEQ ID NO: 1010901 - RNA, 15 nt, Mycobacterium avium subsp. paratuberculosis
ugcaggccgagccgc

SEQ ID NO: 1010902 - RNA, 18 nt, Mycobacterium avium subsp. paratuberculosis
ugcagcauuuccgagcga

SEQ ID NO: 1010903 - RNA, 16 nt, Mycobacterium avium subsp. paratuberculosis
ugcagcagccggaccc

SEQ ID NO: 1010904 - RNA, 22 nt, Mycobacterium avium subsp. paratuberculosis
ugcagcaggaacucccgcgccg

SEQ ID NO: 1010905 - RNA, 12 nt, Mycobacterium avium subsp. paratuberculosis
ugcagcagcucg

SEQ ID NO: 1010906 - RNA, 21 nt, Mycobacterium avium subsp. paratuberculosis
ugcagcagcgacuugaccagc

SEQ ID NO: 1010907 - RNA, 15 nt, Mycobacterium avium subsp. paratuberculosis
ugcagaccagcccgu

SEQ ID NO: 1010908 - RNA, 22 nt, Mycobacterium avium subsp. paratuberculosis
ugcagcagcagccacgccagcc

SEQ ID NO: 1010909 - RNA, 14 nt, Mycobacterium avium subsp. paratuberculosis
ugcagcgcccagcc

SEQ ID NO: 1010910 - RNA, 15 nt, Mycobacterium avium subsp. paratuberculosis
ugcagcgcccagccg

SEQ ID NO: 1010911 - RNA, 19 nt, Mycobacterium avium subsp. paratuberculosis
ugcagcgcccgggccagga

SEQ ID NO: 1010912 - RNA, 15 nt, Mycobacterium avium subsp. paratuberculosis
ugcagcgccgaggcc

SEQ ID NO: 1010913 - RNA, 18 nt, Mycobacterium avium subsp. paratuberculosis
ugcagcgccgaggccagc

SEQ ID NO: 1010914 - RNA, 21 nt, Mycobacterium avium subsp. paratuberculosis
ugcagcgcgguggucagcacc

SEQ ID NO: 1010915 - RNA, 14 nt, Mycobacterium avium subsp. paratuberculosis
ugcagcgccucggu

SEQ ID NO: 1010916 - RNA, 15 nt, Mycobacterium avium subsp. paratuberculosis
ugcagcgccgcggcg

SEQ ID NO: 1010917 - RNA, 13 nt, Mycobacterium avium subsp. paratuberculosis
ugcaggcagccgu

SEQ ID NO: 1010918 - RNA, 23 nt, Mycobacterium avium subsp. paratuberculosis
ugcaggcaggccccuccagcugg

SEQ ID NO: 1010919 - RNA, 14 nt, Mycobacterium avium subsp. paratuberculosis
ugcaggccacgccc

SEQ ID NO: 1010920 - RNA, 12 nt, Mycobacterium avium subsp. paratuberculosis
ugcaggcccagc

SEQ ID NO: 1010921 - RNA, 13 nt, Mycobacterium avium subsp. paratuberculosis
ugcaggcccagcu

SEQ ID NO: 1010922 - RNA, 19 nt, Mycobacterium avium subsp. paratuberculosis
ugcaggcccagcugcugga

SEQ ID NO: 1010923 - RNA, 13 nt, Mycobacterium avium subsp. paratuberculosis
ugcaggccgcgac

SEQ ID NO: 1010924 - RNA, 21 nt, Mycobacterium avium subsp. paratuberculosis
ugcaggccgcggguggcgcca

SEQ ID NO: 1010925 - RNA, 21 nt, Mycobacterium avium subsp. paratuberculosis
ugcaggaccuugucgggccgc

SEQ ID NO: 1010926 - RNA, 21 nt, Mycobacterium avium subsp. paratuberculosis
ugcaggaacgccuugaccgcc

SEQ ID NO: 1010927 - RNA, 21 nt, Mycobacterium avium subsp. paratuberculosis
ugcacuuucgcggucagccgg

SEQ ID NO: 1010928 - RNA, 16 nt, Mycobacterium avium subsp. paratuberculosis
ugcacggucugguggc

SEQ ID NO: 1010929 - RNA, 21 nt, Mycobacterium avium subsp. paratuberculosis
ugcacggucugguggcagcgg

SEQ ID NO: 1010930 - RNA, 23 nt, Mycobacterium avium subsp. paratuberculosis
ugcagaacgcgcggaugcccagg

SEQ ID NO: 1010931 - RNA, 15 nt, Mycobacterium avium subsp. paratuberculosis
ugcacgccgagcagc

SEQ ID NO: 1010932 - RNA, 17 nt, Mycobacterium avium subsp. paratuberculosis
ugcacgccgagcagcac

SEQ ID NO: 1010933 - RNA, 18 nt, Mycobacterium avium subsp. paratuberculosis
ugcacgccgagcagcacc

SEQ ID NO: 1010934 - RNA, 19 nt, Mycobacterium avium subsp. paratuberculosis
ugcacgccgagcagcaccg

SEQ ID NO: 1010935 - RNA, 23 nt, Mycobacterium avium subsp. paratuberculosis
ugcacgccgaggcgugccgcugg

SEQ ID NO: 1010936 - RNA, 13 nt, Mycobacterium avium subsp. paratuberculosis
ugcacgaucucgg

SEQ ID NO: 1010937 - RNA, 18 nt, Mycobacterium avium subsp. paratuberculosis
ugcacgcaaaaaccaugc

SEQ ID NO: 1010938 - RNA, 12 nt, Mycobacterium avium subsp. paratuberculosis
ugcacgcaggcc

SEQ ID NO: 1010939 - RNA, 16 nt, Mycobacterium avium subsp. paratuberculosis
ugcacgacgaacacca

SEQ ID NO: 1010940 - RNA, 19 nt, Mycobacterium avium subsp. paratuberculosis
ugcaccuuggucagcuccc

SEQ ID NO: 1010941 - RNA, 13 nt, Mycobacterium avium subsp. paratuberculosis
ugcaccgcgcgca

SEQ ID NO: 1010942 - RNA, 18 nt, Mycobacterium avium subsp. paratuberculosis
ugcaccgccagcgcggcg

SEQ ID NO: 1010943 - RNA, 17 nt, Mycobacterium avium subsp. paratuberculosis
ugcaccuugcccgucgc

SEQ ID NO: 1010944 - RNA, 14 nt, Mycobacterium avium subsp. paratuberculosis
ugcacccagcggaa

SEQ ID NO: 1010945 - RNA, 14 nt, Mycobacterium avium subsp. paratuberculosis
ugcacccacgccag

SEQ ID NO: 1010946 - RNA, 17 nt, Mycobacterium avium subsp. paratuberculosis
ugcacccagccgugccc

SEQ ID NO: 1010947 - RNA, 21 nt, Mycobacterium avium subsp. paratuberculosis
ugcacccgaacggaccgggcg

SEQ ID NO: 1010948 - RNA, 13 nt, Mycobacterium avium subsp. paratuberculosis
ugcacccucugcc

SEQ ID NO: 1010949 - RNA, 14 nt, Mycobacterium avium subsp. paratuberculosis
ugcacccucugcca

SEQ ID NO: 1010950 - RNA, 21 nt, Mycobacterium avium subsp. paratuberculosis
ugcacccgguucugggcgggc

SEQ ID NO: 1010951 - RNA, 18 nt, Mycobacterium avium subsp. paratuberculosis
uguuguccaacaugccuu

SEQ ID NO: 1010952 - RNA, 16 nt, Mycobacterium avium subsp. paratuberculosis
uguuguccgaccagga

SEQ ID NO: 1010953 - RNA, 21 nt, Mycobacterium avium subsp. paratuberculosis
uguugucgugccgggugaugc

SEQ ID NO: 1010954 - RNA, 20 nt, Mycobacterium avium subsp. paratuberculosis
uguugucguggucgcugcuc

SEQ ID NO: 1010955 - RNA, 18 nt, Mycobacterium avium subsp. paratuberculosis
uguuguggucugaccccc

SEQ ID NO: 1010956 - RNA, 14 nt, Mycobacterium avium subsp. paratuberculosis
uguuguugaccccc

SEQ ID NO: 1010957 - RNA, 20 nt, Mycobacterium avium subsp. paratuberculosis
uguugaucagguucaccagc

SEQ ID NO: 1010958 - RNA, 15 nt, Mycobacterium avium subsp. paratuberculosis
uguugcgcagcgucu

SEQ ID NO: 1010959 - RNA, 18 nt, Mycobacterium avium subsp. paratuberculosis
uguugcggccggccauga

SEQ ID NO: 1010960 - RNA, 18 nt, Mycobacterium avium subsp. paratuberculosis
uguugccccgcgagagaa

SEQ ID NO: 1010961 - RNA, 16 nt, Mycobacterium avium subsp. paratuberculosis
uguugcgcacccgcgg

SEQ ID NO: 1010962 - RNA, 14 nt, Mycobacterium avium subsp. paratuberculosis
uguugcgguccagg

SEQ ID NO: 1010963 - RNA, 20 nt, Mycobacterium avium subsp. paratuberculosis
uguucuggaugcccagggcg

SEQ ID NO: 1010964 - RNA, 13 nt, Mycobacterium avium subsp. paratuberculosis
uguucuccggccc

SEQ ID NO: 1010965 - RNA, 23 nt, Mycobacterium avium subsp. paratuberculosis
uguuccaacaacuucgagcagaa

SEQ ID NO: 1010966 - RNA, 15 nt, Mycobacterium avium subsp. paratuberculosis
uguucagcccgguca

SEQ ID NO: 1010967 - RNA, 11 nt, Mycobacterium avium subsp. paratuberculosis
uguuugcugca

SEQ ID NO: 1010968 - RNA, 14 nt, Mycobacterium avium subsp. paratuberculosis
uguuuccccagccc

SEQ ID NO: 1010969 - RNA, 13 nt, Mycobacterium avium subsp. paratuberculosis
uguuuuucugcuc

SEQ ID NO: 1010970 - RNA, 13 nt, Mycobacterium avium subsp. paratuberculosis
uguuuggccgcgc

SEQ ID NO: 1010971 - RNA, 20 nt, Mycobacterium avium subsp. paratuberculosis
uuaccggcguagaacaccga

SEQ ID NO: 1010972 - RNA, 21 nt, Mycobacterium avium subsp. paratuberculosis
uguggaucgcuucggccagcg

SEQ ID NO: 1010973 - RNA, 19 nt, Mycobacterium avium subsp. paratuberculosis
ugugcuggccagcaccagc

SEQ ID NO: 1010974 - RNA, 20 nt, Mycobacterium avium subsp. paratuberculosis
ugugcuggccagcaccagcg

SEQ ID NO: 1010975 - RNA, 18 nt, Mycobacterium avium subsp. paratuberculosis
ugugcucggcgagguaga

SEQ ID NO: 1010976 - RNA, 23 nt, Mycobacterium avium subsp. paratuberculosis
uguggcguucgaugcccugcccc

SEQ ID NO: 1010977 - RNA, 15 nt, Mycobacterium avium subsp. paratuberculosis
uguggaugacgcagc

SEQ ID NO: 1010978 - RNA, 20 nt, Mycobacterium avium subsp. paratuberculosis
uguggccgcccucgcugccg

SEQ ID NO: 1010979 - RNA, 15 nt, Mycobacterium avium subsp. paratuberculosis
ugugguacagcgcca

SEQ ID NO: 1010980 - RNA, 14 nt, Mycobacterium avium subsp. paratuberculosis
ugugguagggccgc

SEQ ID NO: 1010981 - RNA, 15 nt, Mycobacterium avium subsp. paratuberculosis
uguggguggucagcg

SEQ ID NO: 1010982 - RNA, 22 nt, Mycobacterium avium subsp. paratuberculosis
uguggggcccacugccugaccc

SEQ ID NO: 1010983 - RNA, 14 nt, Mycobacterium avium subsp. paratuberculosis
ugugggccagcagc

SEQ ID NO: 1010984 - RNA, 13 nt, Mycobacterium avium subsp. paratuberculosis
ugugggcgggcgc

SEQ ID NO: 1010985 - RNA, 12 nt, Mycobacterium avium subsp. paratuberculosis
ugugccuggccc

SEQ ID NO: 1010986 - RNA, 21 nt, Mycobacterium avium subsp. paratuberculosis
ugugcgcaucggcgacgccgc

SEQ ID NO: 1010987 - RNA, 18 nt, Mycobacterium avium subsp. paratuberculosis
ugugcgggugaggccagg

SEQ ID NO: 1010988 - RNA, 20 nt, Mycobacterium avium subsp. paratuberculosis
ugugcgggugaggccaggcg

SEQ ID NO: 1010989 - RNA, 14 nt, Mycobacterium avium subsp. paratuberculosis
ugugcgccaugucc

SEQ ID NO: 1010990 - RNA, 13 nt, Mycobacterium avium subsp. paratuberculosis
ugugcagccaccc

SEQ ID NO: 1010991 - RNA, 20 nt, Mycobacterium avium subsp. paratuberculosis
ugucgccgaacgccaccacc

SEQ ID NO: 1010992 - RNA, 14 nt, Mycobacterium avium subsp. paratuberculosis
ugucgccgagccgc

SEQ ID NO: 1010993 - RNA, 21 nt, Mycobacterium avium subsp. paratuberculosis
ugucgccggcgaccgccuugu

SEQ ID NO: 1010994 - RNA, 13 nt, Mycobacterium avium subsp. paratuberculosis
ugucgccggugcu

SEQ ID NO: 1010995 - RNA, 15 nt, Mycobacterium avium subsp. paratuberculosis
uguccagcagcgccg

SEQ ID NO: 1010996 - RNA, 20 nt, Mycobacterium avium subsp. paratuberculosis
uguccagcagcgccggcagc

SEQ ID NO: 1010997 - RNA, 17 nt, Mycobacterium avium subsp. paratuberculosis
ugucggugaaugucgug

SEQ ID NO: 1010998 - RNA, 19 nt, Mycobacterium avium subsp. paratuberculosis
ugucggucguacgucuugc

SEQ ID NO: 1010999 - RNA, 17 nt, Mycobacterium avium subsp. paratuberculosis
ugucggugccgagcacg

SEQ ID NO: 1011000 - RNA, 13 nt, Mycobacterium avium subsp. paratuberculosis
ugucgggccgcgg

SEQ ID NO: 1011001 - RNA, 17 nt, Mycobacterium avium subsp. paratuberculosis
ugucgcugccgccgccg

SEQ ID NO: 1011002 - RNA, 20 nt, Mycobacterium avium subsp. paratuberculosis
ugucgcggcccagcaccacc

SEQ ID NO: 1011003 - RNA, 15 nt, Mycobacterium avium subsp. paratuberculosis
ugucgccgcgccagc

SEQ ID NO: 1011004 - RNA, 20 nt, Mycobacterium avium subsp. paratuberculosis
ugucguagcggcgccaccgg

SEQ ID NO: 1011005 - RNA, 16 nt, Mycobacterium avium subsp. paratuberculosis
ugucucacgccucguc

SEQ ID NO: 1011006 - RNA, 18 nt, Mycobacterium avium subsp. paratuberculosis
uguaggcggcgugccagg

SEQ ID NO: 1011007 - RNA, 17 nt, Mycobacterium avium subsp. paratuberculosis
uguaggccagcccggcg

SEQ ID NO: 1011008 - RNA, 15 nt, Mycobacterium avium subsp. paratuberculosis
uguagcgcagcauca

SEQ ID NO: 1011009 - RNA, 15 nt, Mycobacterium avium subsp. paratuberculosis
uguaguccugcuuca

SEQ ID NO: 1011010 - RNA, 19 nt, Mycobacterium avium subsp. paratuberculosis
uguaggugcgcgagauggc

SEQ ID NO: 1011011 - RNA, 15 nt, Mycobacterium avium subsp. paratuberculosis
uguaaccguggcagg

SEQ ID NO: 1011012 - RNA, 21 nt, Mycobacterium avium subsp. paratuberculosis
uggugaaggcgaacaccagcc

SEQ ID NO: 1011013 - RNA, 14 nt, Mycobacterium avium subsp. paratuberculosis
uggugaaguugccg

SEQ ID NO: 1011014 - RNA, 23 nt, Mycobacterium avium subsp. paratuberculosis
uggugacgaacgggccaagcacc

SEQ ID NO: 1011015 - RNA, 20 nt, Mycobacterium avium subsp. paratuberculosis
uggauucgucgcuggccagg

SEQ ID NO: 1011016 - RNA, 17 nt, Mycobacterium avium subsp. paratuberculosis
ugcguugcgccagcacc

SEQ ID NO: 1011017 - RNA, 21 nt, Mycobacterium avium subsp. paratuberculosis
ugcguugcgccagcaccgaca

SEQ ID NO: 1011018 - RNA, 18 nt, Mycobacterium avium subsp. paratuberculosis
ugcguucggccgcagcgg

SEQ ID NO: 1011019 - RNA, 13 nt, Mycobacterium avium subsp. paratuberculosis
uggcaccgucgac

SEQ ID NO: 1011020 - RNA, 18 nt, Mycobacterium avium subsp. paratuberculosis
uggcacgacgccgccgag

SEQ ID NO: 1011021 - RNA, 13 nt, Mycobacterium avium subsp. paratuberculosis
uggcagccggccg

SEQ ID NO: 1011022 - RNA, 12 nt, Mycobacterium avium subsp. paratuberculosis
uggcagcgcucc

SEQ ID NO: 1011023 - RNA, 17 nt, Mycobacterium avium subsp. paratuberculosis
uggcagcgcuccugcag

SEQ ID NO: 1011024 - RNA, 22 nt, Mycobacterium avium subsp. paratuberculosis
uggcagcgcuccugcagcgcgg

SEQ ID NO: 1011025 - RNA, 14 nt, Mycobacterium avium subsp. paratuberculosis
uggccagccgggcg

SEQ ID NO: 1011026 - RNA, 23 nt, Mycobacterium avium subsp. paratuberculosis
uggccagccgggcgaccgucuuc

SEQ ID NO: 1011027 - RNA, 15 nt, Mycobacterium avium subsp. paratuberculosis
uggccagcagcgugg

SEQ ID NO: 1011028 - RNA, 15 nt, Mycobacterium avium subsp. paratuberculosis
uggccagcagguaga

SEQ ID NO: 1011029 - RNA, 23 nt, Mycobacterium avium subsp. paratuberculosis
uggccaccaccacggagcgcccg

SEQ ID NO: 1011030 - RNA, 12 nt, Mycobacterium avium subsp. paratuberculosis
uggccaccaccg

SEQ ID NO: 1011031 - RNA, 18 nt, Mycobacterium avium subsp. paratuberculosis
uggccaccagcagcaggu

SEQ ID NO: 1011032 - RNA, 16 nt, Mycobacterium avium subsp. paratuberculosis
uggccagcaccagccc

SEQ ID NO: 1011033 - RNA, 18 nt, Mycobacterium avium subsp. paratuberculosis
uggccagcaccagcgcgc

SEQ ID NO: 1011034 - RNA, 23 nt, Mycobacterium avium subsp. paratuberculosis
uggccagcaccauccagugcagu

SEQ ID NO: 1011035 - RNA, 12 nt, Mycobacterium avium subsp. paratuberculosis
uggccagcaccg

SEQ ID NO: 1011036 - RNA, 14 nt, Mycobacterium avium subsp. paratuberculosis
uggccagcaccgcg

SEQ ID NO: 1011037 - RNA, 18 nt, Mycobacterium avium subsp. paratuberculosis
uggccagcaccgcggccg

SEQ ID NO: 1011038 - RNA, 17 nt, Mycobacterium avium subsp. paratuberculosis
uggccagcaccgucagc

SEQ ID NO: 1011039 - RNA, 15 nt, Mycobacterium avium subsp. paratuberculosis
uggccgagccgggcg

SEQ ID NO: 1011040 - RNA, 14 nt, Mycobacterium avium subsp. paratuberculosis
uggccgaggauggg

SEQ ID NO: 1011041 - RNA, 19 nt, Mycobacterium avium subsp. paratuberculosis
uggccgagggguccggggc

SEQ ID NO: 1011042 - RNA, 22 nt, Mycobacterium avium subsp. paratuberculosis
uggccgccaggaucugcucggc

SEQ ID NO: 1011043 - RNA, 14 nt, Mycobacterium avium subsp. paratuberculosis
uggccgccaccaac

SEQ ID NO: 1011044 - RNA, 20 nt, Mycobacterium avium subsp. paratuberculosis
uggccgcacaccugcaucac

SEQ ID NO: 1011045 - RNA, 15 nt, Mycobacterium avium subsp. paratuberculosis
uggccgauggucagc

SEQ ID NO: 1011046 - RNA, 22 nt, Mycobacterium avium subsp. paratuberculosis
uggccgauggucagcugccgca

SEQ ID NO: 1011047 - RNA, 18 nt, Mycobacterium avium subsp. paratuberculosis
uggccgcacggugcagca

SEQ ID NO: 1011048 - RNA, 12 nt, Mycobacterium avium subsp. paratuberculosis
uggccagcgcgg

SEQ ID NO: 1011049 - RNA, 18 nt, Mycobacterium avium subsp. paratuberculosis
uggccagcgccagcgcca

SEQ ID NO: 1011050 - RNA, 16 nt, Mycobacterium avium subsp. paratuberculosis
uggccagcgccuccag

SEQ ID NO: 1011051 - RNA, 22 nt, Mycobacterium avium subsp. paratuberculosis
uggccagcgccuccagccgcuc

SEQ ID NO: 1011052 - RNA, 12 nt, Mycobacterium avium subsp. paratuberculosis
uggccagcgcga

SEQ ID NO: 1011053 - RNA, 19 nt, Mycobacterium avium subsp. paratuberculosis
uggccagcucggccauccc

SEQ ID NO: 1011054 - RNA, 21 nt, Mycobacterium avium subsp. paratuberculosis
uggccagcucgucgcggaaca

SEQ ID NO: 1011055 - RNA, 15 nt, Mycobacterium avium subsp. paratuberculosis
uggccaucgcggccc

SEQ ID NO: 1011056 - RNA, 15 nt, Mycobacterium avium subsp. paratuberculosis
uggccagcuugcagc

SEQ ID NO: 1011057 - RNA, 20 nt, Mycobacterium avium subsp. paratuberculosis
uggccagguacaccaccagg

SEQ ID NO: 1011058 - RNA, 18 nt, Mycobacterium avium subsp. paratuberculosis
uggccagguuggucagca

SEQ ID NO: 1011059 - RNA, 20 nt, Mycobacterium avium subsp. paratuberculosis
uggcgaacacgucggccagc

SEQ ID NO: 1011060 - RNA, 18 nt, Mycobacterium avium subsp. paratuberculosis
uggcgaacugcaccagca

SEQ ID NO: 1011061 - RNA, 17 nt, Mycobacterium avium subsp. paratuberculosis
uggccucgggggugaag

SEQ ID NO: 1011062 - RNA, 18 nt, Mycobacterium avium subsp. paratuberculosis
uggccugaaccagcucgu

SEQ ID NO: 1011063 - RNA, 14 nt, Mycobacterium avium subsp. paratuberculosis
uggccuuggccacc

SEQ ID NO: 1011064 - RNA, 15 nt, Mycobacterium avium subsp. paratuberculosis
uggccuuggccacca

SEQ ID NO: 1011065 - RNA, 13 nt, Mycobacterium avium subsp. paratuberculosis
uggccuccagcuu

SEQ ID NO: 1011066 - RNA, 21 nt, Mycobacterium avium subsp. paratuberculosis
uggccuccagguucgccgccc

SEQ ID NO: 1011067 - RNA, 19 nt, Mycobacterium avium subsp. paratuberculosis
uggccucgagugccugcgc

SEQ ID NO: 1011068 - RNA, 12 nt, Mycobacterium avium subsp. paratuberculosis
uggccggugcgc

SEQ ID NO: 1011069 - RNA, 14 nt, Mycobacterium avium subsp. paratuberculosis
uggccgucacgcug

SEQ ID NO: 1011070 - RNA, 16 nt, Mycobacterium avium subsp. paratuberculosis
uggccgucaucuccga

SEQ ID NO: 1011071 - RNA, 18 nt, Mycobacterium avium subsp. paratuberculosis
uggccgucgaacugcagc

SEQ ID NO: 1011072 - RNA, 23 nt, Mycobacterium avium subsp. paratuberculosis
uggccgucgggucggcgagcagc

SEQ ID NO: 1011073 - RNA, 23 nt, Mycobacterium avium subsp. paratuberculosis
uggccgugcagggggcgcagccg

SEQ ID NO: 1011074 - RNA, 16 nt, Mycobacterium avium subsp. paratuberculosis
uggccggagccuucuu

SEQ ID NO: 1011075 - RNA, 14 nt, Mycobacterium avium subsp. paratuberculosis
uggccggccgggcg

SEQ ID NO: 1011076 - RNA, 20 nt, Mycobacterium avium subsp. paratuberculosis
uggccggcagguuguugacg

SEQ ID NO: 1011077 - RNA, 16 nt, Mycobacterium avium subsp. paratuberculosis
uggccggccaccagcg

SEQ ID NO: 1011078 - RNA, 18 nt, Mycobacterium avium subsp. paratuberculosis
uggccggcgauggcgcgg

SEQ ID NO: 1011079 - RNA, 20 nt, Mycobacterium avium subsp. paratuberculosis
uggccgggaaguuggccucc

SEQ ID NO: 1011080 - RNA, 21 nt, Mycobacterium avium subsp. paratuberculosis
uggccgggaaguuggccuccc

SEQ ID NO: 1011081 - RNA, 14 nt, Mycobacterium avium subsp. paratuberculosis
uggccggaaaggcg

SEQ ID NO: 1011082 - RNA, 18 nt, Mycobacterium avium subsp. paratuberculosis
uggccgcuuuccaccccg

SEQ ID NO: 1011083 - RNA, 22 nt, Mycobacterium avium subsp. paratuberculosis
uggccggaucgaacuugaucac

SEQ ID NO: 1011084 - RNA, 18 nt, Mycobacterium avium subsp. paratuberculosis
uggccgcgucgaccagcc

SEQ ID NO: 1011085 - RNA, 17 nt, Mycobacterium avium subsp. paratuberculosis
uggccgcguuccaggac

SEQ ID NO: 1011086 - RNA, 18 nt, Mycobacterium avium subsp. paratuberculosis
uggccgccgcaggcgaag

SEQ ID NO: 1011087 - RNA, 14 nt, Mycobacterium avium subsp. paratuberculosis
uggccgcccaccac

SEQ ID NO: 1011088 - RNA, 12 nt, Mycobacterium avium subsp. paratuberculosis
uggccgccgccu

SEQ ID NO: 1011089 - RNA, 15 nt, Mycobacterium avium subsp. paratuberculosis
uggccgccgccugag

SEQ ID NO: 1011090 - RNA, 20 nt, Mycobacterium avium subsp. paratuberculosis
uggccgccgccugagcccgc

SEQ ID NO: 1011091 - RNA, 18 nt, Mycobacterium avium subsp. paratuberculosis
uggccgccgugcagggug

SEQ ID NO: 1011092 - RNA, 14 nt, Mycobacterium avium subsp. paratuberculosis
uggccgcggccagc

SEQ ID NO: 1011093 - RNA, 17 nt, Mycobacterium avium subsp. paratuberculosis
uggccgcggccagcugc

SEQ ID NO: 1011094 - RNA, 12 nt, Mycobacterium avium subsp. paratuberculosis
uggccgcggccu

SEQ ID NO: 1011095 - RNA, 14 nt, Mycobacterium avium subsp. paratuberculosis
uggccgcgccgccg

SEQ ID NO: 1011096 - RNA, 21 nt, Mycobacterium avium subsp. paratuberculosis
uggccgcgcgcaggcgcugag

SEQ ID NO: 1011097 - RNA, 17 nt, Mycobacterium avium subsp. paratuberculosis
uggccgcgacgccgccg

SEQ ID NO: 1011098 - RNA, 19 nt, Mycobacterium avium subsp. paratuberculosis
uggcgcugaucgaguccuc

SEQ ID NO: 1011099 - RNA, 12 nt, Mycobacterium avium subsp. paratuberculosis
uggcgcuggauc

SEQ ID NO: 1011100 - RNA, 16 nt, Mycobacterium avium subsp. paratuberculosis
uggcgcuggugcagca

SEQ ID NO: 1011101 - RNA, 13 nt, Mycobacterium avium subsp. paratuberculosis
uggcgggccaggc

SEQ ID NO: 1011102 - RNA, 14 nt, Mycobacterium avium subsp. paratuberculosis
uggcggccaccauc

SEQ ID NO: 1011103 - RNA, 22 nt, Mycobacterium avium subsp. paratuberculosis
uggcggccacgacggcgcuggc

SEQ ID NO: 1011104 - RNA, 15 nt, Mycobacterium avium subsp. paratuberculosis
uggcggccagcgccu

SEQ ID NO: 1011105 - RNA, 22 nt, Mycobacterium avium subsp. paratuberculosis
uggcggccagcgccuucuccag

SEQ ID NO: 1011106 - RNA, 17 nt, Mycobacterium avium subsp. paratuberculosis
uggcgggcgaucgccuc

SEQ ID NO: 1011107 - RNA, 23 nt, Mycobacterium avium subsp. paratuberculosis
uggcgggcgcgccggcgcgcagc

SEQ ID NO: 1011108 - RNA, 22 nt, Mycobacterium avium subsp. paratuberculosis
uggcggggcgugcccggcgccg

SEQ ID NO: 1011109 - RNA, 14 nt, Mycobacterium avium subsp. paratuberculosis
uggcgccgcgcagc

SEQ ID NO: 1011110 - RNA, 21 nt, Mycobacterium avium subsp. paratuberculosis
uggcgccggucgacgcggggc

SEQ ID NO: 1011111 - RNA, 14 nt, Mycobacterium avium subsp. paratuberculosis
uggcgccggccagc

SEQ ID NO: 1011112 - RNA, 14 nt, Mycobacterium avium subsp. paratuberculosis
uggcgccgcggucg

SEQ ID NO: 1011113 - RNA, 18 nt, Mycobacterium avium subsp. paratuberculosis
uggcgccgcccaccagca

SEQ ID NO: 1011114 - RNA, 15 nt, Mycobacterium avium subsp. paratuberculosis
uggcgccgaacagau

SEQ ID NO: 1011115 - RNA, 15 nt, Mycobacterium avium subsp. paratuberculosis
uggcgaucaucagga

SEQ ID NO: 1011116 - RNA, 13 nt, Mycobacterium avium subsp. paratuberculosis
uggcgaucaccuu

SEQ ID NO: 1011117 - RNA, 18 nt, Mycobacterium avium subsp. paratuberculosis
uggcgaucgaugcccagc

SEQ ID NO: 1011118 - RNA, 15 nt, Mycobacterium avium subsp. paratuberculosis
uggcgcccuuggccu

SEQ ID NO: 1011119 - RNA, 22 nt, Mycobacterium avium subsp. paratuberculosis
uggcgagcugaccggccaccuc

SEQ ID NO: 1011120 - RNA, 12 nt, Mycobacterium avium subsp. paratuberculosis
ugguagaacucg

SEQ ID NO: 1011121 - RNA, 19 nt, Mycobacterium avium subsp. paratuberculosis
ugguagcugagcagcaggu

SEQ ID NO: 1011122 - RNA, 13 nt, Mycobacterium avium subsp. paratuberculosis
ugguaggccugga

SEQ ID NO: 1011123 - RNA, 16 nt, Mycobacterium avium subsp. paratuberculosis
ugguaggcggcgcagc

SEQ ID NO: 1011124 - RNA, 22 nt, Mycobacterium avium subsp. paratuberculosis
ugggugcucaccccggccaggg

SEQ ID NO: 1011125 - RNA, 23 nt, Mycobacterium avium subsp. paratuberculosis
uggguucggcggcgcggcccagg

SEQ ID NO: 1011126 - RNA, 17 nt, Mycobacterium avium subsp. paratuberculosis
ugguccaccgccgcgcc

SEQ ID NO: 1011127 - RNA, 13 nt, Mycobacterium avium subsp. paratuberculosis
ugguccagcaccg

SEQ ID NO: 1011128 - RNA, 19 nt, Mycobacterium avium subsp. paratuberculosis
uggucccgaucaccuugcc

SEQ ID NO: 1011129 - RNA, 20 nt, Mycobacterium avium subsp. paratuberculosis
uggucccgaucaccuugccc

SEQ ID NO: 1011130 - RNA, 21 nt, Mycobacterium avium subsp. paratuberculosis
uggucccgaucaccuugccca

SEQ ID NO: 1011131 - RNA, 18 nt, Mycobacterium avium subsp. paratuberculosis
ugguccugccccgggaaa

SEQ ID NO: 1011132 - RNA, 16 nt, Mycobacterium avium subsp. paratuberculosis
uggucgaacagcgcgc

SEQ ID NO: 1011133 - RNA, 22 nt, Mycobacterium avium subsp. paratuberculosis
uggucgccgaacgugcgcggcg

SEQ ID NO: 1011134 - RNA, 14 nt, Mycobacterium avium subsp. paratuberculosis
uggucggcagcacc

SEQ ID NO: 1011135 - RNA, 20 nt, Mycobacterium avium subsp. paratuberculosis
uggucggcagcaccggcagc

SEQ ID NO: 1011136 - RNA, 16 nt, Mycobacterium avium subsp. paratuberculosis
uggucggccggcaggc

SEQ ID NO: 1011137 - RNA, 23 nt, Mycobacterium avium subsp. paratuberculosis
uggucgcggccguguacagcagg

SEQ ID NO: 1011138 - RNA, 12 nt, Mycobacterium avium subsp. paratuberculosis
uggucgcggccu

SEQ ID NO: 1011139 - RNA, 13 nt, Mycobacterium avium subsp. paratuberculosis
uggucaauccggg

SEQ ID NO: 1011140 - RNA, 15 nt, Mycobacterium avium subsp. paratuberculosis
uggucaauccgggca

SEQ ID NO: 1011141 - RNA, 21 nt, Mycobacterium avium subsp. paratuberculosis
uggucagagcccgaacacggg

SEQ ID NO: 1011142 - RNA, 13 nt, Mycobacterium avium subsp. paratuberculosis
uggucaccguguc

SEQ ID NO: 1011143 - RNA, 12 nt, Mycobacterium avium subsp. paratuberculosis
uggucaccagcg

SEQ ID NO: 1011144 - RNA, 15 nt, Mycobacterium avium subsp. paratuberculosis
uggucaccagcgcgg

SEQ ID NO: 1011145 - RNA, 16 nt, Mycobacterium avium subsp. paratuberculosis
uggucacaccgcugag

SEQ ID NO: 1011146 - RNA, 14 nt, Mycobacterium avium subsp. paratuberculosis
uggucaccaccaac

SEQ ID NO: 1011147 - RNA, 14 nt, Mycobacterium avium subsp. paratuberculosis
uggucaccaccacc

SEQ ID NO: 1011148 - RNA, 12 nt, Mycobacterium avium subsp. paratuberculosis
uggucaccagcu

SEQ ID NO: 1011149 - RNA, 16 nt, Mycobacterium avium subsp. paratuberculosis
uggucaccaucagcgg

SEQ ID NO: 1011150 - RNA, 18 nt, Mycobacterium avium subsp. paratuberculosis
uggucagcagcagcgccu

SEQ ID NO: 1011151 - RNA, 19 nt, Mycobacterium avium subsp. paratuberculosis
uggucagccgcaccagguu

SEQ ID NO: 1011152 - RNA, 23 nt, Mycobacterium avium subsp. paratuberculosis
uggucagccgcggcggcagcacc

SEQ ID NO: 1011153 - RNA, 23 nt, Mycobacterium avium subsp. paratuberculosis
uggucagcggcaggucccaggcc

SEQ ID NO: 1011154 - RNA, 19 nt, Mycobacterium avium subsp. paratuberculosis
uggucaggguguaggccgc

SEQ ID NO: 1011155 - RNA, 23 nt, Mycobacterium avium subsp. paratuberculosis
uggucaguacagcuaggccagca

SEQ ID NO: 1011156 - RNA, 17 nt, Mycobacterium avium subsp. paratuberculosis
ugggcaauaccggcagc

SEQ ID NO: 1011157 - RNA, 18 nt, Mycobacterium avium subsp. paratuberculosis
ugggcaauaccggcagca

SEQ ID NO: 1011158 - RNA, 18 nt, Mycobacterium avium subsp. paratuberculosis
ugggcaccagcagcgcga

SEQ ID NO: 1011159 - RNA, 16 nt, Mycobacterium avium subsp. paratuberculosis
uggcgguggccacggc

SEQ ID NO: 1011160 - RNA, 18 nt, Mycobacterium avium subsp. paratuberculosis
uggcgugacgcucggccg

SEQ ID NO: 1011161 - RNA, 22 nt, Mycobacterium avium subsp. paratuberculosis
uggcgugugggcucgcccgggc

SEQ ID NO: 1011162 - RNA, 15 nt, Mycobacterium avium subsp. paratuberculosis
uggcguugagcacgc

SEQ ID NO: 1011163 - RNA, 17 nt, Mycobacterium avium subsp. paratuberculosis
uggggcaccagaacacg

SEQ ID NO: 1011164 - RNA, 11 nt, Mycobacterium avium subsp. paratuberculosis
uggggcccagc

SEQ ID NO: 1011165 - RNA, 12 nt, Mycobacterium avium subsp. paratuberculosis
uggggcagcacc

SEQ ID NO: 1011166 - RNA, 19 nt, Mycobacterium avium subsp. paratuberculosis
uggggcgcaccgccugugc

SEQ ID NO: 1011167 - RNA, 20 nt, Mycobacterium avium subsp. paratuberculosis
uggggcccgguccgcugugc

SEQ ID NO: 1011168 - RNA, 20 nt, Mycobacterium avium subsp. paratuberculosis
uggggccgauguucaccccg

SEQ ID NO: 1011169 - RNA, 14 nt, Mycobacterium avium subsp. paratuberculosis
ugggggccagcgcc

SEQ ID NO: 1011170 - RNA, 12 nt, Mycobacterium avium subsp. paratuberculosis
ugggggccaggc

SEQ ID NO: 1011171 - RNA, 18 nt, Mycobacterium avium subsp. paratuberculosis
uggggguggcgucgacgg

SEQ ID NO: 1011172 - RNA, 24 nt, Mycobacterium avium subsp. paratuberculosis
uggggcuggccgcacggugcagca

SEQ ID NO: 1011173 - RNA, 13 nt, Mycobacterium avium subsp. paratuberculosis
ugggggucgacug

SEQ ID NO: 1011174 - RNA, 19 nt, Mycobacterium avium subsp. paratuberculosis
uggguguccuugcgcacca

SEQ ID NO: 1011175 - RNA, 15 nt, Mycobacterium avium subsp. paratuberculosis
uggguggccccucau

SEQ ID NO: 1011176 - RNA, 23 nt, Mycobacterium avium subsp. paratuberculosis
uggguggucaccguguuggugac

SEQ ID NO: 1011177 - RNA, 23 nt, Mycobacterium avium subsp. paratuberculosis
ugggcguggugcggugcaccgcg

SEQ ID NO: 1011178 - RNA, 18 nt, Mycobacterium avium subsp. paratuberculosis
ugggcgggcacccgggcg

SEQ ID NO: 1011179 - RNA, 16 nt, Mycobacterium avium subsp. paratuberculosis
ugggcgguccgcucca

SEQ ID NO: 1011180 - RNA, 14 nt, Mycobacterium avium subsp. paratuberculosis
ugggcggcaccacc

SEQ ID NO: 1011181 - RNA, 15 nt, Mycobacterium avium subsp. paratuberculosis
ugggcgcgggccgcg

SEQ ID NO: 1011182 - RNA, 17 nt, Mycobacterium avium subsp. paratuberculosis
ugggcgcgggccgcguc

SEQ ID NO: 1011183 - RNA, 17 nt, Mycobacterium avium subsp. paratuberculosis
ugggcgcgaucaggcug

SEQ ID NO: 1011184 - RNA, 19 nt, Mycobacterium avium subsp. paratuberculosis
ugggcgcgaucggcagguc

SEQ ID NO: 1011185 - RNA, 14 nt, Mycobacterium avium subsp. paratuberculosis
ugggcgcugguccu

SEQ ID NO: 1011186 - RNA, 15 nt, Mycobacterium avium subsp. paratuberculosis
ugggcggccaccacu

SEQ ID NO: 1011187 - RNA, 16 nt, Mycobacterium avium subsp. paratuberculosis
ugggcggccaccacuu

SEQ ID NO: 1011188 - RNA, 18 nt, Mycobacterium avium subsp. paratuberculosis
ugggcggccaccacuucc

SEQ ID NO: 1011189 - RNA, 22 nt, Mycobacterium avium subsp. paratuberculosis
ugggcggccaccgcgccccggc

SEQ ID NO: 1011190 - RNA, 15 nt, Mycobacterium avium subsp. paratuberculosis
ugggcgcagggccgc

SEQ ID NO: 1011191 - RNA, 21 nt, Mycobacterium avium subsp. paratuberculosis
ugggcgccgaguccgggccgc

SEQ ID NO: 1011192 - RNA, 18 nt, Mycobacterium avium subsp. paratuberculosis
ugggcaccggcaccgccc

SEQ ID NO: 1011193 - RNA, 14 nt, Mycobacterium avium subsp. paratuberculosis
ugggcaccgucgau

SEQ ID NO: 1011194 - RNA, 18 nt, Mycobacterium avium subsp. paratuberculosis
ugggcagccccagcgagc

SEQ ID NO: 1011195 - RNA, 23 nt, Mycobacterium avium subsp. paratuberculosis
uuauucggcuucguaacacccuc

SEQ ID NO: 1011196 - RNA, 14 nt, Mycobacterium avium subsp. paratuberculosis
uucauguagcagcg

SEQ ID NO: 1011197 - RNA, 21 nt, Mycobacterium avium subsp. paratuberculosis
uuccaagccgggcggcagcag

SEQ ID NO: 1011198 - RNA, 16 nt, Mycobacterium avium subsp. paratuberculosis
uucuucucacagguga

SEQ ID NO: 1011199 - RNA, 21 nt, Mycobacterium avium subsp. paratuberculosis
uucuucgccgcaaccuucuug

SEQ ID NO: 1011200 - RNA, 20 nt, Mycobacterium avium subsp. paratuberculosis
uucuucgccgcagccuucuu

SEQ ID NO: 1011201 - RNA, 21 nt, Mycobacterium avium subsp. paratuberculosis
uucuucgccgcagccuucuug

SEQ ID NO: 1011202 - RNA, 20 nt, Mycobacterium avium subsp. paratuberculosis
uucuucgccggggccuucuu

SEQ ID NO: 1011203 - RNA, 21 nt, Mycobacterium avium subsp. paratuberculosis
uucuucgccggggccuucuug

SEQ ID NO: 1011204 - RNA, 20 nt, Mycobacterium avium subsp. paratuberculosis
uucuucgcgggugccuucuu

SEQ ID NO: 1011205 - RNA, 21 nt, Mycobacterium avium subsp. paratuberculosis
uucuucgcgggugccuucuug

SEQ ID NO: 1011206 - RNA, 14 nt, Mycobacterium avium subsp. paratuberculosis
uucuucagccgcag

SEQ ID NO: 1011207 - RNA, 23 nt, Mycobacterium avium subsp. paratuberculosis
uucuccagcacgaaggccgccgg

SEQ ID NO: 1011208 - RNA, 14 nt, Mycobacterium avium subsp. paratuberculosis
uucuccagcccucg

SEQ ID NO: 1011209 - RNA, 15 nt, Mycobacterium avium subsp. paratuberculosis
uucuccagcuccucg

SEQ ID NO: 1011210 - RNA, 19 nt, Mycobacterium avium subsp. paratuberculosis
uucuggcccgccaucgccc

SEQ ID NO: 1011211 - RNA, 16 nt, Mycobacterium avium subsp. paratuberculosis
uucugcgucggcuuga

SEQ ID NO: 1011212 - RNA, 20 nt, Mycobacterium avium subsp. paratuberculosis
uucuccgaggcguccuccuc

SEQ ID NO: 1011213 - RNA, 16 nt, Mycobacterium avium subsp. paratuberculosis
uucggcgaucucgucg

SEQ ID NO: 1011214 - RNA, 16 nt, Mycobacterium avium subsp. paratuberculosis
uucggcaucccggaga

SEQ ID NO: 1011215 - RNA, 20 nt, Mycobacterium avium subsp. paratuberculosis
uucggccagaucggccaggu

SEQ ID NO: 1011216 - RNA, 12 nt, Mycobacterium avium subsp. paratuberculosis
uucggccagcgc

SEQ ID NO: 1011217 - RNA, 23 nt, Mycobacterium avium subsp. paratuberculosis
uucggcgcggaucgucaccgacc

SEQ ID NO: 1011218 - RNA, 13 nt, Mycobacterium avium subsp. paratuberculosis
uucggcggcccgc

SEQ ID NO: 1011219 - RNA, 14 nt, Mycobacterium avium subsp. paratuberculosis
uucggguggcgucg

SEQ ID NO: 1011220 - RNA, 11 nt, Mycobacterium avium subsp. paratuberculosis
uucgggugugg

SEQ ID NO: 1011221 - RNA, 15 nt, Mycobacterium avium subsp. paratuberculosis
uucggguuacgugga

SEQ ID NO: 1011222 - RNA, 15 nt, Mycobacterium avium subsp. paratuberculosis
uucgggcagcgccuc

SEQ ID NO: 1011223 - RNA, 13 nt, Mycobacterium avium subsp. paratuberculosis
uucgggccagcgc

SEQ ID NO: 1011224 - RNA, 22 nt, Mycobacterium avium subsp. paratuberculosis
uucgggccugaccaaggacaag

SEQ ID NO: 1011225 - RNA, 22 nt, Mycobacterium avium subsp. paratuberculosis
uucggggccaccaggccgaaga

SEQ ID NO: 1011226 - RNA, 21 nt, Mycobacterium avium subsp. paratuberculosis
uucgaucaaaucccgcagcuc

SEQ ID NO: 1011227 - RNA, 13 nt, Mycobacterium avium subsp. paratuberculosis
uucgauguagaag

SEQ ID NO: 1011228 - RNA, 17 nt, Mycobacterium avium subsp. paratuberculosis
uucgaugggaaccgcuc

SEQ ID NO: 1011229 - RNA, 16 nt, Mycobacterium avium subsp. paratuberculosis
uucgacugcaggaaca

SEQ ID NO: 1011230 - RNA, 13 nt, Mycobacterium avium subsp. paratuberculosis
uucgccgacagca

SEQ ID NO: 1011231 - RNA, 20 nt, Mycobacterium avium subsp. paratuberculosis
uucgcgaacuucaggcccuc

SEQ ID NO: 1011232 - RNA, 18 nt, Mycobacterium avium subsp. paratuberculosis
uucgcgcagccaccgccc

SEQ ID NO: 1011233 - RNA, 16 nt, Mycobacterium avium subsp. paratuberculosis
uuccgguuggccaggu

SEQ ID NO: 1011234 - RNA, 22 nt, Mycobacterium avium subsp. paratuberculosis
uuccgguggacuccagcaccag

SEQ ID NO: 1011235 - RNA, 18 nt, Mycobacterium avium subsp. paratuberculosis
uuccguugugccaccgcc

SEQ ID NO: 1011236 - RNA, 22 nt, Mycobacterium avium subsp. paratuberculosis
uuccgggcgaccccggccagga

SEQ ID NO: 1011237 - RNA, 15 nt, Mycobacterium avium subsp. paratuberculosis
uucccggcaccacca

SEQ ID NO: 1011238 - RNA, 21 nt, Mycobacterium avium subsp. paratuberculosis
uuguccaccauggcuuccgcc

SEQ ID NO: 1011239 - RNA, 13 nt, Mycobacterium avium subsp. paratuberculosis
uuguccagcgucu

SEQ ID NO: 1011240 - RNA, 18 nt, Mycobacterium avium subsp. paratuberculosis
uuguccucgaagaucucc

SEQ ID NO: 1011241 - RNA, 14 nt, Mycobacterium avium subsp. paratuberculosis
uuguccucgagccg

SEQ ID NO: 1011242 - RNA, 20 nt, Mycobacterium avium subsp. paratuberculosis
uugucgaaggugaucuuguu

SEQ ID NO: 1011243 - RNA, 20 nt, Mycobacterium avium subsp. paratuberculosis
uugucgcggcccagcaccac

SEQ ID NO: 1011244 - RNA, 13 nt, Mycobacterium avium subsp. paratuberculosis
uuguagcgcagca

SEQ ID NO: 1011245 - RNA, 20 nt, Mycobacterium avium subsp. paratuberculosis
uuguggcggcccaauucgua

SEQ ID NO: 1011246 - RNA, 14 nt, Mycobacterium avium subsp. paratuberculosis
uugugccaccgccg

SEQ ID NO: 1011247 - RNA, 22 nt, Mycobacterium avium subsp. paratuberculosis
uugggcgggaucgcggcgguca

SEQ ID NO: 1011248 - RNA, 14 nt, Mycobacterium avium subsp. paratuberculosis
uugggccaggccuc

SEQ ID NO: 1011249 - RNA, 23 nt, Mycobacterium avium subsp. paratuberculosis
uugggccggucggucggccgcac

SEQ ID NO: 1011250 - RNA, 22 nt, Mycobacterium avium subsp. paratuberculosis
uugggccggugcagcacgugcg

SEQ ID NO: 1011251 - RNA, 22 nt, Mycobacterium avium subsp. paratuberculosis
uugggucucaucccgccgaccc

SEQ ID NO: 1011252 - RNA, 17 nt, Mycobacterium avium subsp. paratuberculosis
uuggucccgaucaccuu

SEQ ID NO: 1011253 - RNA, 15 nt, Mycobacterium avium subsp. paratuberculosis
uuggucggcgcggcg

SEQ ID NO: 1011254 - RNA, 19 nt, Mycobacterium avium subsp. paratuberculosis
uuggucaccaucagcggcu

SEQ ID NO: 1011255 - RNA, 21 nt, Mycobacterium avium subsp. paratuberculosis
uuggucagcccgcgcaccgcg

SEQ ID NO: 1011256 - RNA, 18 nt, Mycobacterium avium subsp. paratuberculosis
uuggucagcggcaggucc

SEQ ID NO: 1011257 - RNA, 17 nt, Mycobacterium avium subsp. paratuberculosis
uuggugccgaucaccuc

SEQ ID NO: 1011258 - RNA, 10 nt, Mycobacterium avium subsp. paratuberculosis
uuggucucga

SEQ ID NO: 1011259 - RNA, 12 nt, Mycobacterium avium subsp. paratuberculosis
uuggucucgaug

SEQ ID NO: 1011260 - RNA, 21 nt, Mycobacterium avium subsp. paratuberculosis
uuggugggcgccggcgucauc

SEQ ID NO: 1011261 - RNA, 17 nt, Mycobacterium avium subsp. paratuberculosis
uuggugcgcaccagcag

SEQ ID NO: 1011262 - RNA, 14 nt, Mycobacterium avium subsp. paratuberculosis
uuggcgccggugaa

SEQ ID NO: 1011263 - RNA, 18 nt, Mycobacterium avium subsp. paratuberculosis
uuggccguauacgccaga

SEQ ID NO: 1011264 - RNA, 16 nt, Mycobacterium avium subsp. paratuberculosis
uuggccgucaucuccg

SEQ ID NO: 1011265 - RNA, 22 nt, Mycobacterium avium subsp. paratuberculosis
uuggccugguagcugagcagca

SEQ ID NO: 1011266 - RNA, 15 nt, Mycobacterium avium subsp. paratuberculosis
uuggccagcucggcg

SEQ ID NO: 1011267 - RNA, 11 nt, Mycobacterium avium subsp. paratuberculosis
uuggccaggug

SEQ ID NO: 1011268 - RNA, 16 nt, Mycobacterium avium subsp. paratuberculosis
uuggccggagccuucu

SEQ ID NO: 1011269 - RNA, 12 nt, Mycobacterium avium subsp. paratuberculosis
uugggccagcgg

SEQ ID NO: 1011270 - RNA, 14 nt, Mycobacterium avium subsp. paratuberculosis
uuggcgucgggcac

SEQ ID NO: 1011271 - RNA, 18 nt, Mycobacterium avium subsp. paratuberculosis
uugcuggcggccuucuug

SEQ ID NO: 1011272 - RNA, 22 nt, Mycobacterium avium subsp. paratuberculosis
uugcuggcggccuucuuggccg

SEQ ID NO: 1011273 - RNA, 16 nt, Mycobacterium avium subsp. paratuberculosis
uuggacuccaccgcca

SEQ ID NO: 1011274 - RNA, 15 nt, Mycobacterium avium subsp. paratuberculosis
uugccgggcaccagc

SEQ ID NO: 1011275 - RNA, 19 nt, Mycobacterium avium subsp. paratuberculosis
uugccgguguaucccauca

SEQ ID NO: 1011276 - RNA, 22 nt, Mycobacterium avium subsp. paratuberculosis
uugccgucgagggggagcagga

SEQ ID NO: 1011277 - RNA, 14 nt, Mycobacterium avium subsp. paratuberculosis
uugcgggccagguc

SEQ ID NO: 1011278 - RNA, 17 nt, Mycobacterium avium subsp. paratuberculosis
uugcggccaaacgugga

SEQ ID NO: 1011279 - RNA, 14 nt, Mycobacterium avium subsp. paratuberculosis
uugcggccccgcca

SEQ ID NO: 1011280 - RNA, 12 nt, Mycobacterium avium subsp. paratuberculosis
uugcggccggcc

SEQ ID NO: 1011281 - RNA, 16 nt, Mycobacterium avium subsp. paratuberculosis
uugcggcgggccgcaa

SEQ ID NO: 1011282 - RNA, 17 nt, Mycobacterium avium subsp. paratuberculosis
uugcggaucggugcagg

SEQ ID NO: 1011283 - RNA, 11 nt, Mycobacterium avium subsp. paratuberculosis
uugcgcugccc

SEQ ID NO: 1011284 - RNA, 17 nt, Mycobacterium avium subsp. paratuberculosis
uugcgcggaaugcucga

SEQ ID NO: 1011285 - RNA, 19 nt, Mycobacterium avium subsp. paratuberculosis
uugcgagcaggccgaggcc

SEQ ID NO: 1011286 - RNA, 23 nt, Mycobacterium avium subsp. paratuberculosis
uugcgaaagcccaggcccggcac

SEQ ID NO: 1011287 - RNA, 15 nt, Mycobacterium avium subsp. paratuberculosis
uugcaggccacgccc

SEQ ID NO: 1011288 - RNA, 14 nt, Mycobacterium avium subsp. paratuberculosis
uugaugguguugcu

SEQ ID NO: 1011289 - RNA, 16 nt, Mycobacterium avium subsp. paratuberculosis
uugaugucgcgcggcu

SEQ ID NO: 1011290 - RNA, 20 nt, Mycobacterium avium subsp. paratuberculosis
uugagugcgccgugcagcac

SEQ ID NO: 1011291 - RNA, 16 nt, Mycobacterium avium subsp. paratuberculosis
uugaggcgagcaauua

SEQ ID NO: 1011292 - RNA, 12 nt, Mycobacterium avium subsp. paratuberculosis
uugagcacgccc

SEQ ID NO: 1011293 - RNA, 13 nt, Mycobacterium avium subsp. paratuberculosis
uugagcaggcugg

SEQ ID NO: 1011294 - RNA, 22 nt, Mycobacterium avium subsp. paratuberculosis
uugagcuccggugauucgugca

SEQ ID NO: 1011295 - RNA, 22 nt, Mycobacterium avium subsp. paratuberculosis
uucuuggcgggcgacuucuucg

SEQ ID NO: 1011296 - RNA, 14 nt, Mycobacterium avium subsp. paratuberculosis
uucuuggccgcggc

SEQ ID NO: 1011297 - RNA, 19 nt, Mycobacterium avium subsp. paratuberculosis
uucuuggccggagccuucu

SEQ ID NO: 1011298 - RNA, 23 nt, Mycobacterium avium subsp. paratuberculosis
aagcgcaugccgaacaacagggc

SEQ ID NO: 1011299 - RNA, 15 nt, Mycobacterium avium subsp. paratuberculosis
aagcgccgcaugccc

SEQ ID NO: 1011300 - RNA, 22 nt, Mycobacterium avium subsp. paratuberculosis
aagcgggcggcgaacaccagca

SEQ ID NO: 1011301 - RNA, 19 nt, Mycobacterium avium subsp. paratuberculosis
aagcgggugaccgacagca

SEQ ID NO: 1011302 - RNA, 17 nt, Mycobacterium avium subsp. paratuberculosis
aagcgcgcauagaggcg

SEQ ID NO: 1011303 - RNA, 18 nt, Mycobacterium avium subsp. paratuberculosis
aagcuggucgccaaacug

SEQ ID NO: 1011304 - RNA, 23 nt, Mycobacterium avium subsp. paratuberculosis
aagcuggucgccaaacugcgcaa

SEQ ID NO: 1011305 - RNA, 22 nt, Mycobacterium avium subsp. paratuberculosis
aaggacucaaucggucagggug

SEQ ID NO: 1011306 - RNA, 22 nt, Mycobacterium avium subsp. paratuberculosis
aaggagaaggccgcgcgcaucu

SEQ ID NO: 1011307 - RNA, 21 nt, Mycobacterium avium subsp. paratuberculosis
aagcgaauaccaucaacccga

SEQ ID NO: 1011308 - RNA, 22 nt, Mycobacterium avium subsp. paratuberculosis
aagccgccguccccgcgcggcu

SEQ ID NO: 1011309 - RNA, 13 nt, Mycobacterium avium subsp. paratuberculosis
aagccggcgucga

SEQ ID NO: 1011310 - RNA, 15 nt, Mycobacterium avium subsp. paratuberculosis
aagccggccagcagc

SEQ ID NO: 1011311 - RNA, 19 nt, Mycobacterium avium subsp. paratuberculosis
aagccggccagcagcggcu

SEQ ID NO: 1011312 - RNA, 21 nt, Mycobacterium avium subsp. paratuberculosis
aagccgcuggaagucggucug

SEQ ID NO: 1011313 - RNA, 16 nt, Mycobacterium avium subsp. paratuberculosis
aagccguucgcgccga

SEQ ID NO: 1011314 - RNA, 17 nt, Mycobacterium avium subsp. paratuberculosis
aagccgggcggcagcag

SEQ ID NO: 1011315 - RNA, 18 nt, Mycobacterium avium subsp. paratuberculosis
aagccgggcggcagcagc

SEQ ID NO: 1011316 - RNA, 19 nt, Mycobacterium avium subsp. paratuberculosis
aagaaggcuccgccgaugu

SEQ ID NO: 1011317 - RNA, 17 nt, Mycobacterium avium subsp. paratuberculosis
aagccauuucagcagcg

SEQ ID NO: 1011318 - RNA, 16 nt, Mycobacterium avium subsp. paratuberculosis
aagcccucgucgaagc

SEQ ID NO: 1011319 - RNA, 19 nt, Mycobacterium avium subsp. paratuberculosis
aagccgaggcgcaacaccg

SEQ ID NO: 1011320 - RNA, 17 nt, Mycobacterium avium subsp. paratuberculosis
aaguacagcgucagcau

SEQ ID NO: 1011321 - RNA, 18 nt, Mycobacterium avium subsp. paratuberculosis
aaggcguuguugaggaac

SEQ ID NO: 1011322 - RNA, 22 nt, Mycobacterium avium subsp. paratuberculosis
aaggcgucaucguggacaggag

SEQ ID NO: 1011323 - RNA, 21 nt, Mycobacterium avium subsp. paratuberculosis
aaggcggccgcgagcccggcg

SEQ ID NO: 1011324 - RNA, 19 nt, Mycobacterium avium subsp. paratuberculosis
aaggcggcgucgagcaccu

SEQ ID NO: 1011325 - RNA, 18 nt, Mycobacterium avium subsp. paratuberculosis
aaggaugucgccgcagau

SEQ ID NO: 1011326 - RNA, 18 nt, Mycobacterium avium subsp. paratuberculosis
aagggcuuuagaaggccg

SEQ ID NO: 1011327 - RNA, 15 nt, Mycobacterium avium subsp. paratuberculosis
aagggcgccagcacc

SEQ ID NO: 1011328 - RNA, 16 nt, Mycobacterium avium subsp. paratuberculosis
aaguagccggccagcg

SEQ ID NO: 1011329 - RNA, 16 nt, Mycobacterium avium subsp. paratuberculosis
aagucgacggcgguga

SEQ ID NO: 1011330 - RNA, 20 nt, Mycobacterium avium subsp. paratuberculosis
aagugccggacccccucggg

SEQ ID NO: 1011331 - RNA, 13 nt, Mycobacterium avium subsp. paratuberculosis
aagugcgccagcg

SEQ ID NO: 1011332 - RNA, 17 nt, Mycobacterium avium subsp. paratuberculosis
aaguucaccaccgcgcu

SEQ ID NO: 1011333 - RNA, 16 nt, Mycobacterium avium subsp. paratuberculosis
aauaccacugcgcgcc

SEQ ID NO: 1011334 - RNA, 14 nt, Mycobacterium avium subsp. paratuberculosis
aauucggagaccag

SEQ ID NO: 1011335 - RNA, 16 nt, Mycobacterium avium subsp. paratuberculosis
aauucggcgaucucgu

SEQ ID NO: 1011336 - RNA, 22 nt, Mycobacterium avium subsp. paratuberculosis
aauucgaccgucuccaacugca

SEQ ID NO: 1011337 - RNA, 11 nt, Mycobacterium avium subsp. paratuberculosis
aauucgacugc

SEQ ID NO: 1011338 - RNA, 22 nt, Mycobacterium avium subsp. paratuberculosis
aauuuaugaugccaguuuuugg

SEQ ID NO: 1011339 - RNA, 20 nt, Mycobacterium avium subsp. paratuberculosis
aauugagguagucggcccag

SEQ ID NO: 1011340 - RNA, 17 nt, Mycobacterium avium subsp. paratuberculosis
aauugccuugcuccaca

SEQ ID NO: 1011341 - RNA, 16 nt, Mycobacterium avium subsp. paratuberculosis
aauugcgccagcagca

SEQ ID NO: 1011342 - RNA, 18 nt, Mycobacterium avium subsp. paratuberculosis
aaugcgucgcggcggcgc

SEQ ID NO: 1011343 - RNA, 19 nt, Mycobacterium avium subsp. paratuberculosis
aaugcgggcgauggcgggc

SEQ ID NO: 1011344 - RNA, 21 nt, Mycobacterium avium subsp. paratuberculosis
aaugguuuucgucgaucagca

SEQ ID NO: 1011345 - RNA, 17 nt, Mycobacterium avium subsp. paratuberculosis
aauggauccgaucagca

SEQ ID NO: 1011346 - RNA, 16 nt, Mycobacterium avium subsp. paratuberculosis
aaugccgcagccgauc

SEQ ID NO: 1011347 - RNA, 22 nt, Mycobacterium avium subsp. paratuberculosis
aaugcgaugagcucgcgcugca

SEQ ID NO: 1011348 - RNA, 22 nt, Mycobacterium avium subsp. paratuberculosis
aaugccuuugccguggcggcgg

SEQ ID NO: 1011349 - RNA, 20 nt, Mycobacterium avium subsp. paratuberculosis
aaucgcgggaucggccggcg

SEQ ID NO: 1011350 - RNA, 19 nt, Mycobacterium avium subsp. paratuberculosis
aaucgccgggauauucgcc

SEQ ID NO: 1011351 - RNA, 14 nt, Mycobacterium avium subsp. paratuberculosis
aaucgguucggcca

SEQ ID NO: 1011352 - RNA, 16 nt, Mycobacterium avium subsp. paratuberculosis
aauccggccggagacc

SEQ ID NO: 1011353 - RNA, 17 nt, Mycobacterium avium subsp. paratuberculosis
aauccaaggagaaggcc

SEQ ID NO: 1011354 - RNA, 16 nt, Mycobacterium avium subsp. paratuberculosis
aagaacgaaaagaugu

SEQ ID NO: 1011355 - RNA, 18 nt, Mycobacterium avium subsp. paratuberculosis
aacuucaccgucugcugg

SEQ ID NO: 1011356 - RNA, 12 nt, Mycobacterium avium subsp. paratuberculosis
aacuucagcugc

SEQ ID NO: 1011357 - RNA, 16 nt, Mycobacterium avium subsp. paratuberculosis
aacuucagcugcuccg

SEQ ID NO: 1011358 - RNA, 19 nt, Mycobacterium avium subsp. paratuberculosis
aacuugaucagcucgcgga

SEQ ID NO: 1011359 - RNA, 12 nt, Mycobacterium avium subsp. paratuberculosis
aacugcaccagc

SEQ ID NO: 1011360 - RNA, 19 nt, Mycobacterium avium subsp. paratuberculosis
aacugcaucauguccaggu

SEQ ID NO: 1011361 - RNA, 18 nt, Mycobacterium avium subsp. paratuberculosis
aacugccgacggucccac

SEQ ID NO: 1011362 - RNA, 14 nt, Mycobacterium avium subsp. paratuberculosis
aacugccgaugcug

SEQ ID NO: 1011363 - RNA, 22 nt, Mycobacterium avium subsp. paratuberculosis
aacugccguugauugaccaucc

SEQ ID NO: 1011364 - RNA, 21 nt, Mycobacterium avium subsp. paratuberculosis
aacugccggcauaggccagca

SEQ ID NO: 1011365 - RNA, 22 nt, Mycobacterium avium subsp. paratuberculosis
aacugccggcauaggccagcac

SEQ ID NO: 1011366 - RNA, 18 nt, Mycobacterium avium subsp. paratuberculosis
aacugcucgaccagcccc

SEQ ID NO: 1011367 - RNA, 16 nt, Mycobacterium avium subsp. paratuberculosis
aacugaauuccuggcc

SEQ ID NO: 1011368 - RNA, 13 nt, Mycobacterium avium subsp. paratuberculosis
aacugguccucca

SEQ ID NO: 1011369 - RNA, 16 nt, Mycobacterium avium subsp. paratuberculosis
aacugguccugcggcu

SEQ ID NO: 1011370 - RNA, 20 nt, Mycobacterium avium subsp. paratuberculosis
aacugggaguugacuccucu

SEQ ID NO: 1011371 - RNA, 22 nt, Mycobacterium avium subsp. paratuberculosis
aacugggaguugacuccucugc

SEQ ID NO: 1011372 - RNA, 17 nt, Mycobacterium avium subsp. paratuberculosis
aacuguuuuuccgccgg

SEQ ID NO: 1011373 - RNA, 18 nt, Mycobacterium avium subsp. paratuberculosis
aacuaucuggucugggcg

SEQ ID NO: 1011374 - RNA, 13 nt, Mycobacterium avium subsp. paratuberculosis
aacuccagcagcu

SEQ ID NO: 1011375 - RNA, 13 nt, Mycobacterium avium subsp. paratuberculosis
aacuccggcggca

SEQ ID NO: 1011376 - RNA, 21 nt, Mycobacterium avium subsp. paratuberculosis
aacuccggcggcagccaggcg

SEQ ID NO: 1011377 - RNA, 15 nt, Mycobacterium avium subsp. paratuberculosis
aacucgacggagugc

SEQ ID NO: 1011378 - RNA, 22 nt, Mycobacterium avium subsp. paratuberculosis
aacuccucgaagaguugggucg

SEQ ID NO: 1011379 - RNA, 19 nt, Mycobacterium avium subsp. paratuberculosis
aacucuacugcugcgggug

SEQ ID NO: 1011380 - RNA, 21 nt, Mycobacterium avium subsp. paratuberculosis
aacgucaggcccagcgaggcg

SEQ ID NO: 1011381 - RNA, 13 nt, Mycobacterium avium subsp. paratuberculosis
aacgucaccaaca

SEQ ID NO: 1011382 - RNA, 14 nt, Mycobacterium avium subsp. paratuberculosis
aacgucucgcggga

SEQ ID NO: 1011383 - RNA, 14 nt, Mycobacterium avium subsp. paratuberculosis
aacuaacuucacgc

SEQ ID NO: 1011384 - RNA, 14 nt, Mycobacterium avium subsp. paratuberculosis
aacuagcuucacgg

SEQ ID NO: 1011385 - RNA, 19 nt, Mycobacterium avium subsp. paratuberculosis
aacuacuucgucagcagcg

SEQ ID NO: 1011386 - RNA, 18 nt, Mycobacterium avium subsp. paratuberculosis
aacgguucggccgcucgg

SEQ ID NO: 1011387 - RNA, 20 nt, Mycobacterium avium subsp. paratuberculosis
aacgggugaccggcggccag

SEQ ID NO: 1011388 - RNA, 17 nt, Mycobacterium avium subsp. paratuberculosis
aacggccaaccgcccgg

SEQ ID NO: 1011389 - RNA, 21 nt, Mycobacterium avium subsp. paratuberculosis
aacggcgggcccgucgccggc

SEQ ID NO: 1011390 - RNA, 19 nt, Mycobacterium avium subsp. paratuberculosis
aacggcggucgugcggcug

SEQ ID NO: 1011391 - RNA, 22 nt, Mycobacterium avium subsp. paratuberculosis
aacggcgcgaaccgggccagga

SEQ ID NO: 1011392 - RNA, 20 nt, Mycobacterium avium subsp. paratuberculosis
aacgggccgcagccgcgcgg

SEQ ID NO: 1011393 - RNA, 16 nt, Mycobacterium avium subsp. paratuberculosis
aacgggccgggcaccg

SEQ ID NO: 1011394 - RNA, 12 nt, Mycobacterium avium subsp. paratuberculosis
aacgggcggcgg

SEQ ID NO: 1011395 - RNA, 15 nt, Mycobacterium avium subsp. paratuberculosis
aacggcacccgcagc

SEQ ID NO: 1011396 - RNA, 23 nt, Mycobacterium avium subsp. paratuberculosis
aacgcgucguugucgucgccggc

SEQ ID NO: 1011397 - RNA, 22 nt, Mycobacterium avium subsp. paratuberculosis
aacgcgguuuugaugccgccgg

SEQ ID NO: 1011398 - RNA, 18 nt, Mycobacterium avium subsp. paratuberculosis
aacgcguacagcgcccgg

SEQ ID NO: 1011399 - RNA, 21 nt, Mycobacterium avium subsp. paratuberculosis
aacgcucccgguagagcggca

SEQ ID NO: 1011400 - RNA, 16 nt, Mycobacterium avium subsp. paratuberculosis
aacgccaugggcaucg

SEQ ID NO: 1011401 - RNA, 13 nt, Mycobacterium avium subsp. paratuberculosis
aacgccagcagcu

SEQ ID NO: 1011402 - RNA, 19 nt, Mycobacterium avium subsp. paratuberculosis
aacgccagcagcugcggga

SEQ ID NO: 1011403 - RNA, 18 nt, Mycobacterium avium subsp. paratuberculosis
aacgcgacgaucagcagc

SEQ ID NO: 1011404 - RNA, 16 nt, Mycobacterium avium subsp. paratuberculosis
aacgcgcacaacagcc

SEQ ID NO: 1011405 - RNA, 17 nt, Mycobacterium avium subsp. paratuberculosis
aacgccucguuggccag

SEQ ID NO: 1011406 - RNA, 18 nt, Mycobacterium avium subsp. paratuberculosis
aacgccuccgccgccccg

SEQ ID NO: 1011407 - RNA, 13 nt, Mycobacterium avium subsp. paratuberculosis
aacgccgccuccg

SEQ ID NO: 1011408 - RNA, 18 nt, Mycobacterium avium subsp. paratuberculosis
aacgccgaggugcaacac

SEQ ID NO: 1011409 - RNA, 15 nt, Mycobacterium avium subsp. paratuberculosis
aacgaucggcuccag

SEQ ID NO: 1011410 - RNA, 13 nt, Mycobacterium avium subsp. paratuberculosis
aacgaggccaggg

SEQ ID NO: 1011411 - RNA, 18 nt, Mycobacterium avium subsp. paratuberculosis
aacgcaacagggccaccg

SEQ ID NO: 1011412 - RNA, 14 nt, Mycobacterium avium subsp. paratuberculosis
aaccguugaccacc

SEQ ID NO: 1011413 - RNA, 23 nt, Mycobacterium avium subsp. paratuberculosis
aaccucgagauucugcagccgca

SEQ ID NO: 1011414 - RNA, 14 nt, Mycobacterium avium subsp. paratuberculosis
aaccuucuuggccg

SEQ ID NO: 1011415 - RNA, 21 nt, Mycobacterium avium subsp. paratuberculosis
aaccggcggcggugagcgcgu

SEQ ID NO: 1011416 - RNA, 17 nt, Mycobacterium avium subsp. paratuberculosis
aaccggcggcugggcag

SEQ ID NO: 1011417 - RNA, 12 nt, Mycobacterium avium subsp. paratuberculosis
aaccggccggcg

SEQ ID NO: 1011418 - RNA, 12 nt, Mycobacterium avium subsp. paratuberculosis
aaccggccgggg

SEQ ID NO: 1011419 - RNA, 13 nt, Mycobacterium avium subsp. paratuberculosis
aaccgggccagga

SEQ ID NO: 1011420 - RNA, 16 nt, Mycobacterium avium subsp. paratuberculosis
aaccgggcccguaggu

SEQ ID NO: 1011421 - RNA, 17 nt, Mycobacterium avium subsp. paratuberculosis
aaccgggccgcaccccc

SEQ ID NO: 1011422 - RNA, 13 nt, Mycobacterium avium subsp. paratuberculosis
aaccggggcacca

SEQ ID NO: 1011423 - RNA, 22 nt, Mycobacterium avium subsp. paratuberculosis
aaccgggucacgaacuccuuga

SEQ ID NO: 1011424 - RNA, 17 nt, Mycobacterium avium subsp. paratuberculosis
aaccgggucagcaccac

SEQ ID NO: 1011425 - RNA, 20 nt, Mycobacterium avium subsp. paratuberculosis
aaccgggucucgcgccacca

SEQ ID NO: 1011426 - RNA, 23 nt, Mycobacterium avium subsp. paratuberculosis
aaccgggugacgaccauggucag

SEQ ID NO: 1011427 - RNA, 21 nt, Mycobacterium avium subsp. paratuberculosis
aaccgcggcggcggcccgucc

SEQ ID NO: 1011428 - RNA, 21 nt, Mycobacterium avium subsp. paratuberculosis
aaccgccggggaagaucucgg

SEQ ID NO: 1011429 - RNA, 16 nt, Mycobacterium avium subsp. paratuberculosis
aaccgcccuuccagca

SEQ ID NO: 1011430 - RNA, 20 nt, Mycobacterium avium subsp. paratuberculosis
aaccgccgcgcucgcaccag

SEQ ID NO: 1011431 - RNA, 17 nt, Mycobacterium avium subsp. paratuberculosis
aaccccccuuggcggca

SEQ ID NO: 1011432 - RNA, 16 nt, Mycobacterium avium subsp. paratuberculosis
aaccccgcucccaucc

SEQ ID NO: 1011433 - RNA, 17 nt, Mycobacterium avium subsp. paratuberculosis
aacccgaaaagcaccag

SEQ ID NO: 1011434 - RNA, 14 nt, Mycobacterium avium subsp. paratuberculosis
aacccgaccgcgau

SEQ ID NO: 1011435 - RNA, 21 nt, Mycobacterium avium subsp. paratuberculosis
aacccggcgugcuccagcagg

SEQ ID NO: 1011436 - RNA, 20 nt, Mycobacterium avium subsp. paratuberculosis
aaccgacauaggucagguug

SEQ ID NO: 1011437 - RNA, 18 nt, Mycobacterium avium subsp. paratuberculosis
aaccgaagggaaaggcag

SEQ ID NO: 1011438 - RNA, 23 nt, Mycobacterium avium subsp. paratuberculosis
aaccgaagggaaaggcagcagcc

SEQ ID NO: 1011439 - RNA, 11 nt, Mycobacterium avium subsp. paratuberculosis
aacccugcccc

SEQ ID NO: 1011440 - RNA, 20 nt, Mycobacterium avium subsp. paratuberculosis
aacccugccccacggcccgg

SEQ ID NO: 1011441 - RNA, 17 nt, Mycobacterium avium subsp. paratuberculosis
aaccaugccagucaagc

SEQ ID NO: 1011442 - RNA, 18 nt, Mycobacterium avium subsp. paratuberculosis
aaccauuugcccagcagg

SEQ ID NO: 1011443 - RNA, 23 nt, Mycobacterium avium subsp. paratuberculosis
aaccauucguggcugaacagcgc

SEQ ID NO: 1011444 - RNA, 15 nt, Mycobacterium avium subsp. paratuberculosis
aacccagcaccacca

SEQ ID NO: 1011445 - RNA, 15 nt, Mycobacterium avium subsp. paratuberculosis
aacccagcaccaaca

SEQ ID NO: 1011446 - RNA, 13 nt, Mycobacterium avium subsp. paratuberculosis
aaccacuucuggc

SEQ ID NO: 1011447 - RNA, 18 nt, Mycobacterium avium subsp. paratuberculosis
aaccacaccccggccacc

SEQ ID NO: 1011448 - RNA, 13 nt, Mycobacterium avium subsp. paratuberculosis
aaccacagcugcu

SEQ ID NO: 1011449 - RNA, 15 nt, Mycobacterium avium subsp. paratuberculosis
aaccagggcagccag

SEQ ID NO: 1011450 - RNA, 16 nt, Mycobacterium avium subsp. paratuberculosis
aaccagggcagccagc

SEQ ID NO: 1011451 - RNA, 20 nt, Mycobacterium avium subsp. paratuberculosis
aaccaggcgccggccagcac

SEQ ID NO: 1011452 - RNA, 14 nt, Mycobacterium avium subsp. paratuberculosis
aacaucuccagcgc

SEQ ID NO: 1011453 - RNA, 23 nt, Mycobacterium avium subsp. paratuberculosis
aacaucggccgggucgcaggcag

SEQ ID NO: 1011454 - RNA, 15 nt, Mycobacterium avium subsp. paratuberculosis
aacaucgccagcaac

SEQ ID NO: 1011455 - RNA, 16 nt, Mycobacterium avium subsp. paratuberculosis
aacauccgcgacgaca

SEQ ID NO: 1011456 - RNA, 15 nt, Mycobacterium avium subsp. paratuberculosis
aacaucgagcccacc

SEQ ID NO: 1011457 - RNA, 20 nt, Mycobacterium avium subsp. paratuberculosis
aacaguuccucggcgaugcc

SEQ ID NO: 1011458 - RNA, 19 nt, Mycobacterium avium subsp. paratuberculosis
aacaggugcuuggucagcg

SEQ ID NO: 1011459 - RNA, 12 nt, Mycobacterium avium subsp. paratuberculosis
aacaggcccagc

SEQ ID NO: 1011460 - RNA, 15 nt, Mycobacterium avium subsp. paratuberculosis
aacaggcccagcagc

SEQ ID NO: 1011461 - RNA, 16 nt, Mycobacterium avium subsp. paratuberculosis
aacaggcccagcagcg

SEQ ID NO: 1011462 - RNA, 17 nt, Mycobacterium avium subsp. paratuberculosis
aacagcggguucuucag

SEQ ID NO: 1011463 - RNA, 17 nt, Mycobacterium avium subsp. paratuberculosis
aacagcgucgccgacgg

SEQ ID NO: 1011464 - RNA, 22 nt, Mycobacterium avium subsp. paratuberculosis
aacagcgacgucugcggcucgg

SEQ ID NO: 1011465 - RNA, 19 nt, Mycobacterium avium subsp. paratuberculosis
aacagccgggccagcagcu

SEQ ID NO: 1011466 - RNA, 17 nt, Mycobacterium avium subsp. paratuberculosis
aacagccgggccgcccg

SEQ ID NO: 1011467 - RNA, 19 nt, Mycobacterium avium subsp. paratuberculosis
aacagcgccgagacguggu

SEQ ID NO: 1011468 - RNA, 18 nt, Mycobacterium avium subsp. paratuberculosis
aacagcggcccgaucacc

SEQ ID NO: 1011469 - RNA, 14 nt, Mycobacterium avium subsp. paratuberculosis
aacagcccgcccug

SEQ ID NO: 1011470 - RNA, 14 nt, Mycobacterium avium subsp. paratuberculosis
aacagcagcggcau

SEQ ID NO: 1011471 - RNA, 21 nt, Mycobacterium avium subsp. paratuberculosis
aacagcagcacccgggugauc

SEQ ID NO: 1011472 - RNA, 15 nt, Mycobacterium avium subsp. paratuberculosis
aacagcagcagcagc

SEQ ID NO: 1011473 - RNA, 20 nt, Mycobacterium avium subsp. paratuberculosis
aacagcaccucgucgcccgg

SEQ ID NO: 1011474 - RNA, 18 nt, Mycobacterium avium subsp. paratuberculosis
aacagcacgaacagcagc

SEQ ID NO: 1011475 - RNA, 17 nt, Mycobacterium avium subsp. paratuberculosis
aacagcacgccggccgg

SEQ ID NO: 1011476 - RNA, 16 nt, Mycobacterium avium subsp. paratuberculosis
aacagacucagcccgg

SEQ ID NO: 1011477 - RNA, 17 nt, Mycobacterium avium subsp. paratuberculosis
aacacggucgccggcuu

SEQ ID NO: 1011478 - RNA, 13 nt, Mycobacterium avium subsp. paratuberculosis
aacacggccucga

SEQ ID NO: 1011479 - RNA, 17 nt, Mycobacterium avium subsp. paratuberculosis
aacacgcccugcagguu

SEQ ID NO: 1011480 - RNA, 20 nt, Mycobacterium avium subsp. paratuberculosis
aacacgugggcaaucugccc

SEQ ID NO: 1011481 - RNA, 23 nt, Mycobacterium avium subsp. paratuberculosis
aacacguugagucccucggcgag

SEQ ID NO: 1011482 - RNA, 13 nt, Mycobacterium avium subsp. paratuberculosis
aacacaacgccuu

SEQ ID NO: 1011483 - RNA, 13 nt, Mycobacterium avium subsp. paratuberculosis
aacaauggccccg

SEQ ID NO: 1011484 - RNA, 17 nt, Mycobacterium avium subsp. paratuberculosis
aacaauguuuuucugcu

SEQ ID NO: 1011485 - RNA, 21 nt, Mycobacterium avium subsp. paratuberculosis
aacacaucguggcgcaucacc

SEQ ID NO: 1011486 - RNA, 18 nt, Mycobacterium avium subsp. paratuberculosis
aacacagccaaucgccga

SEQ ID NO: 1011487 - RNA, 12 nt, Mycobacterium avium subsp. paratuberculosis
aacacagcagca

SEQ ID NO: 1011488 - RNA, 18 nt, Mycobacterium avium subsp. paratuberculosis
aacaccaacgacagcgac

SEQ ID NO: 1011489 - RNA, 18 nt, Mycobacterium avium subsp. paratuberculosis
aacaccgugccgucacgc

SEQ ID NO: 1011490 - RNA, 15 nt, Mycobacterium avium subsp. paratuberculosis
aacaccucgccucca

SEQ ID NO: 1011491 - RNA, 18 nt, Mycobacterium avium subsp. paratuberculosis
aacaccucgccuccagca

SEQ ID NO: 1011492 - RNA, 15 nt, Mycobacterium avium subsp. paratuberculosis
aacaccucgggaucc

SEQ ID NO: 1011493 - RNA, 14 nt, Mycobacterium avium subsp. paratuberculosis
aacaccgaaagccg

SEQ ID NO: 1011494 - RNA, 23 nt, Mycobacterium avium subsp. paratuberculosis
aacaccgaaagccgacaccucac

SEQ ID NO: 1011495 - RNA, 19 nt, Mycobacterium avium subsp. paratuberculosis
aacaccggcagcgccacca

SEQ ID NO: 1011496 - RNA, 21 nt, Mycobacterium avium subsp. paratuberculosis
aacaccgccuugcccggcucg

SEQ ID NO: 1011497 - RNA, 14 nt, Mycobacterium avium subsp. paratuberculosis
aacaccgugaacag

SEQ ID NO: 1011498 - RNA, 21 nt, Mycobacterium avium subsp. paratuberculosis
aacacccagaugcccagcggc

SEQ ID NO: 1011499 - RNA, 16 nt, Mycobacterium avium subsp. paratuberculosis
aaauugcugaccauga

SEQ ID NO: 1011500 - RNA, 12 nt, Mycobacterium avium subsp. paratuberculosis
aacaaccgcagc

SEQ ID NO: 1011501 - RNA, 12 nt, Mycobacterium avium subsp. paratuberculosis
aacaacgccaca

SEQ ID NO: 1011502 - RNA, 20 nt, Mycobacterium avium subsp. paratuberculosis
aacaacuacgagcagcaaga

SEQ ID NO: 1011503 - RNA, 14 nt, Mycobacterium avium subsp. paratuberculosis
aacaacucgccgga

SEQ ID NO: 1011504 - RNA, 15 nt, Mycobacterium avium subsp. paratuberculosis
acaggggcagcagca

SEQ ID NO: 1011505 - RNA, 14 nt, Mycobacterium avium subsp. paratuberculosis
acagguagcaggcg

SEQ ID NO: 1011506 - RNA, 18 nt, Mycobacterium avium subsp. paratuberculosis
acaggucgcacaggaugc

SEQ ID NO: 1011507 - RNA, 18 nt, Mycobacterium avium subsp. paratuberculosis
acagguccuugcccagca

SEQ ID NO: 1011508 - RNA, 15 nt, Mycobacterium avium subsp. paratuberculosis
acaggucgaccaucu

SEQ ID NO: 1011509 - RNA, 21 nt, Mycobacterium avium subsp. paratuberculosis
acagguucuuggcggccugcu

SEQ ID NO: 1011510 - RNA, 15 nt, Mycobacterium avium subsp. paratuberculosis
acagguggggcacca

SEQ ID NO: 1011511 - RNA, 14 nt, Mycobacterium avium subsp. paratuberculosis
acaggugugggcgu

SEQ ID NO: 1011512 - RNA, 22 nt, Mycobacterium avium subsp. paratuberculosis
acaggucgaugauguugccccg

SEQ ID NO: 1011513 - RNA, 18 nt, Mycobacterium avium subsp. paratuberculosis
acaggucggcgugcagca

SEQ ID NO: 1011514 - RNA, 15 nt, Mycobacterium avium subsp. paratuberculosis
acaguucggcgcgca

SEQ ID NO: 1011515 - RNA, 20 nt, Mycobacterium avium subsp. paratuberculosis
acagucccgcguugugcacc

SEQ ID NO: 1011516 - RNA, 21 nt, Mycobacterium avium subsp. paratuberculosis
acaguccgaccgcguacaggg

SEQ ID NO: 1011517 - RNA, 13 nt, Mycobacterium avium subsp. paratuberculosis
acagucgcugggu

SEQ ID NO: 1011518 - RNA, 14 nt, Mycobacterium avium subsp. paratuberculosis
acagucggccggcg

SEQ ID NO: 1011519 - RNA, 16 nt, Mycobacterium avium subsp. paratuberculosis
acagugcgcaggcggc

SEQ ID NO: 1011520 - RNA, 20 nt, Mycobacterium avium subsp. paratuberculosis
acaugcugggcuaccagccc

SEQ ID NO: 1011521 - RNA, 14 nt, Mycobacterium avium subsp. paratuberculosis
acaugcugccgccg

SEQ ID NO: 1011522 - RNA, 22 nt, Mycobacterium avium subsp. paratuberculosis
acaucuccuuggggcugaccuc

SEQ ID NO: 1011523 - RNA, 16 nt, Mycobacterium avium subsp. paratuberculosis
acaucgccaccuggaa

SEQ ID NO: 1011524 - RNA, 23 nt, Mycobacterium avium subsp. paratuberculosis
acaucgccggcgaccgugcccac

SEQ ID NO: 1011525 - RNA, 16 nt, Mycobacterium avium subsp. paratuberculosis
acaucacgucccgcuc

SEQ ID NO: 1011526 - RNA, 18 nt, Mycobacterium avium subsp. paratuberculosis
acaucacgucccgcucga

SEQ ID NO: 1011527 - RNA, 23 nt, Mycobacterium avium subsp. paratuberculosis
acaucgacgugccguugacgaac

SEQ ID NO: 1011528 - RNA, 15 nt, Mycobacterium avium subsp. paratuberculosis
acaucgagcccaccg

SEQ ID NO: 1011529 - RNA, 21 nt, Mycobacterium avium subsp. paratuberculosis
acauccacggcauggugauga

SEQ ID NO: 1011530 - RNA, 17 nt, Mycobacterium avium subsp. paratuberculosis
acacuuuuaaggagcaa

SEQ ID NO: 1011531 - RNA, 22 nt, Mycobacterium avium subsp. paratuberculosis
acagccagcccguggccagcgc

SEQ ID NO: 1011532 - RNA, 19 nt, Mycobacterium avium subsp. paratuberculosis
acagcagccacgacaccag

SEQ ID NO: 1011533 - RNA, 13 nt, Mycobacterium avium subsp. paratuberculosis
acagcagccgcuc

SEQ ID NO: 1011534 - RNA, 14 nt, Mycobacterium avium subsp. paratuberculosis
acagcacguagguc

SEQ ID NO: 1011535 - RNA, 14 nt, Mycobacterium avium subsp. paratuberculosis
acagcagcaccagc

SEQ ID NO: 1011536 - RNA, 23 nt, Mycobacterium avium subsp. paratuberculosis
acagcagcagaaccagcaccgcc

SEQ ID NO: 1011537 - RNA, 17 nt, Mycobacterium avium subsp. paratuberculosis
acagcaccgccacggcg

SEQ ID NO: 1011538 - RNA, 19 nt, Mycobacterium avium subsp. paratuberculosis
acagcaccgccgcgggcuc

SEQ ID NO: 1011539 - RNA, 18 nt, Mycobacterium avium subsp. paratuberculosis
acagcaccagcaccaccg

SEQ ID NO: 1011540 - RNA, 13 nt, Mycobacterium avium subsp. paratuberculosis
acagcaccaccag

SEQ ID NO: 1011541 - RNA, 16 nt, Mycobacterium avium subsp. paratuberculosis
acagcacccaggugcu

SEQ ID NO: 1011542 - RNA, 13 nt, Mycobacterium avium subsp. paratuberculosis
acagcacccgcug

SEQ ID NO: 1011543 - RNA, 23 nt, Mycobacterium avium subsp. paratuberculosis
acagauggugaaggugcccuccu

SEQ ID NO: 1011544 - RNA, 21 nt, Mycobacterium avium subsp. paratuberculosis
acagaucgucucggccagccg

SEQ ID NO: 1011545 - RNA, 13 nt, Mycobacterium avium subsp. paratuberculosis
acagcucgacgaa

SEQ ID NO: 1011546 - RNA, 24 nt, Mycobacterium avium subsp. paratuberculosis
acagcucaccugcgugccuugcac

SEQ ID NO: 1011547 - RNA, 22 nt, Mycobacterium avium subsp. paratuberculosis
acagcuuugggaagaggcgcgc

SEQ ID NO: 1011548 - RNA, 17 nt, Mycobacterium avium subsp. paratuberculosis
acaggccgucggggaug

SEQ ID NO: 1011549 - RNA, 12 nt, Mycobacterium avium subsp. paratuberculosis
acaggcccagcg

SEQ ID NO: 1011550 - RNA, 14 nt, Mycobacterium avium subsp. paratuberculosis
acaggcagcccggc

SEQ ID NO: 1011551 - RNA, 14 nt, Mycobacterium avium subsp. paratuberculosis
acagcgucaauacg

SEQ ID NO: 1011552 - RNA, 18 nt, Mycobacterium avium subsp. paratuberculosis
acagcgucugcuggaugg

SEQ ID NO: 1011553 - RNA, 13 nt, Mycobacterium avium subsp. paratuberculosis
acagcggcgcgcg

SEQ ID NO: 1011554 - RNA, 15 nt, Mycobacterium avium subsp. paratuberculosis
acagcggggugccca

SEQ ID NO: 1011555 - RNA, 22 nt, Mycobacterium avium subsp. paratuberculosis
acagcgccucgucgagccgggc

SEQ ID NO: 1011556 - RNA, 14 nt, Mycobacterium avium subsp. paratuberculosis
acagcgcccuugag

SEQ ID NO: 1011557 - RNA, 15 nt, Mycobacterium avium subsp. paratuberculosis
acagcgcccuugagc

SEQ ID NO: 1011558 - RNA, 15 nt, Mycobacterium avium subsp. paratuberculosis
acagcgccagggugc

SEQ ID NO: 1011559 - RNA, 13 nt, Mycobacterium avium subsp. paratuberculosis
acagcgccagcac

SEQ ID NO: 1011560 - RNA, 11 nt, Mycobacterium avium subsp. paratuberculosis
acagcgcgccc

SEQ ID NO: 1011561 - RNA, 15 nt, Mycobacterium avium subsp. paratuberculosis
acagcgcgucggcca

SEQ ID NO: 1011562 - RNA, 14 nt, Mycobacterium avium subsp. paratuberculosis
acagccgcaccaga

SEQ ID NO: 1011563 - RNA, 20 nt, Mycobacterium avium subsp. paratuberculosis
acagccgcaccggcgccgcc

SEQ ID NO: 1011564 - RNA, 15 nt, Mycobacterium avium subsp. paratuberculosis
acagccgcagcagcc

SEQ ID NO: 1011565 - RNA, 17 nt, Mycobacterium avium subsp. paratuberculosis
acagccgggccagcagc

SEQ ID NO: 1011566 - RNA, 15 nt, Mycobacterium avium subsp. paratuberculosis
acagccggggcagcu

SEQ ID NO: 1011567 - RNA, 18 nt, Mycobacterium avium subsp. paratuberculosis
acagccggggcagcugcu

SEQ ID NO: 1011568 - RNA, 23 nt, Mycobacterium avium subsp. paratuberculosis
acagccgguccgaccgccaccac

SEQ ID NO: 1011569 - RNA, 15 nt, Mycobacterium avium subsp. paratuberculosis
acccacuggcggccg

SEQ ID NO: 1011570 - RNA, 18 nt, Mycobacterium avium subsp. paratuberculosis
acccacuggcggccggcc

SEQ ID NO: 1011571 - RNA, 17 nt, Mycobacterium avium subsp. paratuberculosis
accccaucggccaggaa

SEQ ID NO: 1011572 - RNA, 23 nt, Mycobacterium avium subsp. paratuberculosis
accccagugcaggcugacgcgac

SEQ ID NO: 1011573 - RNA, 13 nt, Mycobacterium avium subsp. paratuberculosis
accccagccggcc

SEQ ID NO: 1011574 - RNA, 15 nt, Mycobacterium avium subsp. paratuberculosis
accccagcaaaaccc

SEQ ID NO: 1011575 - RNA, 19 nt, Mycobacterium avium subsp. paratuberculosis
acccccgccgcgucgguca

SEQ ID NO: 1011576 - RNA, 16 nt, Mycobacterium avium subsp. paratuberculosis
acccccgcgcugccca

SEQ ID NO: 1011577 - RNA, 21 nt, Mycobacterium avium subsp. paratuberculosis
acccccgcgcugcccagcgcg

SEQ ID NO: 1011578 - RNA, 12 nt, Mycobacterium avium subsp. paratuberculosis
accccccacgcu

SEQ ID NO: 1011579 - RNA, 20 nt, Mycobacterium avium subsp. paratuberculosis
acccccuacgccguggccug

SEQ ID NO: 1011580 - RNA, 17 nt, Mycobacterium avium subsp. paratuberculosis
acccccucggggcucac

SEQ ID NO: 1011581 - RNA, 16 nt, Mycobacterium avium subsp. paratuberculosis
accccgaguucggcca

SEQ ID NO: 1011582 - RNA, 18 nt, Mycobacterium avium subsp. paratuberculosis
accccgacggcgccgcgg

SEQ ID NO: 1011583 - RNA, 13 nt, Mycobacterium avium subsp. paratuberculosis
accccgaaccagu

SEQ ID NO: 1011584 - RNA, 11 nt, Mycobacterium avium subsp. paratuberculosis
accccgaaccc

SEQ ID NO: 1011585 - RNA, 17 nt, Mycobacterium avium subsp. paratuberculosis
accccgaacccggccag

SEQ ID NO: 1011586 - RNA, 17 nt, Mycobacterium avium subsp. paratuberculosis
accccgaaccgcccgcc

SEQ ID NO: 1011587 - RNA, 17 nt, Mycobacterium avium subsp. paratuberculosis
accccaccgagcagcug

SEQ ID NO: 1011588 - RNA, 23 nt, Mycobacterium avium subsp. paratuberculosis
accccacaccuucgcggucggca

SEQ ID NO: 1011589 - RNA, 16 nt, Mycobacterium avium subsp. paratuberculosis
accccacggccgcaac

SEQ ID NO: 1011590 - RNA, 21 nt, Mycobacterium avium subsp. paratuberculosis
acccagcuccucggccagcac

SEQ ID NO: 1011591 - RNA, 15 nt, Mycobacterium avium subsp. paratuberculosis
acccagcgucaggau

SEQ ID NO: 1011592 - RNA, 13 nt, Mycobacterium avium subsp. paratuberculosis
acccagcaccacc

SEQ ID NO: 1011593 - RNA, 18 nt, Mycobacterium avium subsp. paratuberculosis
acccagcaccaccacgcu

SEQ ID NO: 1011594 - RNA, 16 nt, Mycobacterium avium subsp. paratuberculosis
acccagaugcccagcg

SEQ ID NO: 1011595 - RNA, 13 nt, Mycobacterium avium subsp. paratuberculosis
accaucacgcaga

SEQ ID NO: 1011596 - RNA, 15 nt, Mycobacterium avium subsp. paratuberculosis
accaucagcccggug

SEQ ID NO: 1011597 - RNA, 21 nt, Mycobacterium avium subsp. paratuberculosis
accaucagccugcggugaugc

SEQ ID NO: 1011598 - RNA, 15 nt, Mycobacterium avium subsp. paratuberculosis
accagugucagggca

SEQ ID NO: 1011599 - RNA, 16 nt, Mycobacterium avium subsp. paratuberculosis
accagugucagggcag

SEQ ID NO: 1011600 - RNA, 15 nt, Mycobacterium avium subsp. paratuberculosis
accagugcagagcga

SEQ ID NO: 1011601 - RNA, 18 nt, Mycobacterium avium subsp. paratuberculosis
accaguucgccaccacgg

SEQ ID NO: 1011602 - RNA, 23 nt, Mycobacterium avium subsp. paratuberculosis
accaguucgcguacccgcgcggc

SEQ ID NO: 1011603 - RNA, 12 nt, Mycobacterium avium subsp. paratuberculosis
accagucggcca

SEQ ID NO: 1011604 - RNA, 18 nt, Mycobacterium avium subsp. paratuberculosis
accaggcauuagcgcgug

SEQ ID NO: 1011605 - RNA, 19 nt, Mycobacterium avium subsp. paratuberculosis
accagcgcggccaccacca

SEQ ID NO: 1011606 - RNA, 12 nt, Mycobacterium avium subsp. paratuberculosis
accagcgcgccg

SEQ ID NO: 1011607 - RNA, 13 nt, Mycobacterium avium subsp. paratuberculosis
accagcgccucgc

SEQ ID NO: 1011608 - RNA, 20 nt, Mycobacterium avium subsp. paratuberculosis
accagcgcgaacagcgcggc

SEQ ID NO: 1011609 - RNA, 22 nt, Mycobacterium avium subsp. paratuberculosis
accagcgcggugaugugcagga

SEQ ID NO: 1011610 - RNA, 23 nt, Mycobacterium avium subsp. paratuberculosis
accagcgcguagagcaucagguc

SEQ ID NO: 1011611 - RNA, 13 nt, Mycobacterium avium subsp. paratuberculosis
accaggcccuccu

SEQ ID NO: 1011612 - RNA, 19 nt, Mycobacterium avium subsp. paratuberculosis
accaggcccuccuggguga

SEQ ID NO: 1011613 - RNA, 17 nt, Mycobacterium avium subsp. paratuberculosis
accaggcgccacagcag

SEQ ID NO: 1011614 - RNA, 19 nt, Mycobacterium avium subsp. paratuberculosis
accaggcgccacagcagca

SEQ ID NO: 1011615 - RNA, 20 nt, Mycobacterium avium subsp. paratuberculosis
accagcgauccggcgcguuc

SEQ ID NO: 1011616 - RNA, 14 nt, Mycobacterium avium subsp. paratuberculosis
accagcgacgccag

SEQ ID NO: 1011617 - RNA, 15 nt, Mycobacterium avium subsp. paratuberculosis
accagcgacgccagc

SEQ ID NO: 1011618 - RNA, 18 nt, Mycobacterium avium subsp. paratuberculosis
accagcgacgccagcggc

SEQ ID NO: 1011619 - RNA, 13 nt, Mycobacterium avium subsp. paratuberculosis
accagcgcccgcc

SEQ ID NO: 1011620 - RNA, 21 nt, Mycobacterium avium subsp. paratuberculosis
accagcgccgagaccagccag

SEQ ID NO: 1011621 - RNA, 20 nt, Mycobacterium avium subsp. paratuberculosis
accagguccaccccgccaau

SEQ ID NO: 1011622 - RNA, 15 nt, Mycobacterium avium subsp. paratuberculosis
accaggucgaggguc

SEQ ID NO: 1011623 - RNA, 15 nt, Mycobacterium avium subsp. paratuberculosis
accaggucggccuuc

SEQ ID NO: 1011624 - RNA, 16 nt, Mycobacterium avium subsp. paratuberculosis
accaggucgcacacca

SEQ ID NO: 1011625 - RNA, 14 nt, Mycobacterium avium subsp. paratuberculosis
accaggucgccggc

SEQ ID NO: 1011626 - RNA, 16 nt, Mycobacterium avium subsp. paratuberculosis
accaggugggcggcca

SEQ ID NO: 1011627 - RNA, 16 nt, Mycobacterium avium subsp. paratuberculosis
accaggcgcaccagcu

SEQ ID NO: 1011628 - RNA, 20 nt, Mycobacterium avium subsp. paratuberculosis
accaggcgccggccagcacg

SEQ ID NO: 1011629 - RNA, 17 nt, Mycobacterium avium subsp. paratuberculosis
accagggcagccagccc

SEQ ID NO: 1011630 - RNA, 20 nt, Mycobacterium avium subsp. paratuberculosis
accaggcugcucggcgggcu

SEQ ID NO: 1011631 - RNA, 13 nt, Mycobacterium avium subsp. paratuberculosis
accaggcuugccc

SEQ ID NO: 1011632 - RNA, 20 nt, Mycobacterium avium subsp. paratuberculosis
accagggcgaucaccgcggc

SEQ ID NO: 1011633 - RNA, 14 nt, Mycobacterium avium subsp. paratuberculosis
accaggguggucag

SEQ ID NO: 1011634 - RNA, 15 nt, Mycobacterium avium subsp. paratuberculosis
accaggguggucagc

SEQ ID NO: 1011635 - RNA, 24 nt, Mycobacterium avium subsp. paratuberculosis
accagggugccccgcgaccgcagc

SEQ ID NO: 1011636 - RNA, 21 nt, Mycobacterium avium subsp. paratuberculosis
accagggugucgucgcgcacc

SEQ ID NO: 1011637 - RNA, 15 nt, Mycobacterium avium subsp. paratuberculosis
accaggguggcccca

SEQ ID NO: 1011638 - RNA, 18 nt, Mycobacterium avium subsp. paratuberculosis
accaggguggccccagcc

SEQ ID NO: 1011639 - RNA, 21 nt, Mycobacterium avium subsp. paratuberculosis
accaggguggccccagcccgg

SEQ ID NO: 1011640 - RNA, 19 nt, Mycobacterium avium subsp. paratuberculosis
accaggguggccgccacca

SEQ ID NO: 1011641 - RNA, 23 nt, Mycobacterium avium subsp. paratuberculosis
accacggucagggccagcaacac

SEQ ID NO: 1011642 - RNA, 19 nt, Mycobacterium avium subsp. paratuberculosis
accacggugcgcucgugac

SEQ ID NO: 1011643 - RNA, 16 nt, Mycobacterium avium subsp. paratuberculosis
accacggccccagccg

SEQ ID NO: 1011644 - RNA, 22 nt, Mycobacterium avium subsp. paratuberculosis
accacggcccgcgccccggcgg

SEQ ID NO: 1011645 - RNA, 16 nt, Mycobacterium avium subsp. paratuberculosis
accacggccgcagcgg

SEQ ID NO: 1011646 - RNA, 23 nt, Mycobacterium avium subsp. paratuberculosis
accacgaccgggucugccacgcc

SEQ ID NO: 1011647 - RNA, 13 nt, Mycobacterium avium subsp. paratuberculosis
accacgaccagug

SEQ ID NO: 1011648 - RNA, 17 nt, Mycobacterium avium subsp. paratuberculosis
accacgaccagugcccg

SEQ ID NO: 1011649 - RNA, 19 nt, Mycobacterium avium subsp. paratuberculosis
accaccuugcgcagcagca

SEQ ID NO: 1011650 - RNA, 21 nt, Mycobacterium avium subsp. paratuberculosis
accaccuugcgcagcagcagg

SEQ ID NO: 1011651 - RNA, 14 nt, Mycobacterium avium subsp. paratuberculosis
accaccggccgccc

SEQ ID NO: 1011652 - RNA, 14 nt, Mycobacterium avium subsp. paratuberculosis
accacgagcagccg

SEQ ID NO: 1011653 - RNA, 18 nt, Mycobacterium avium subsp. paratuberculosis
accacgaggaccagcaug

SEQ ID NO: 1011654 - RNA, 20 nt, Mycobacterium avium subsp. paratuberculosis
accacgaugaagccgugccc

SEQ ID NO: 1011655 - RNA, 21 nt, Mycobacterium avium subsp. paratuberculosis
accacgaugaagccgugcccg

SEQ ID NO: 1011656 - RNA, 20 nt, Mycobacterium avium subsp. paratuberculosis
accacccggucgaugugcgc

SEQ ID NO: 1011657 - RNA, 20 nt, Mycobacterium avium subsp. paratuberculosis
accacccgcagcucgccggu

SEQ ID NO: 1011658 - RNA, 14 nt, Mycobacterium avium subsp. paratuberculosis
accaccacggccag

SEQ ID NO: 1011659 - RNA, 15 nt, Mycobacterium avium subsp. paratuberculosis
accaccaacccgguc

SEQ ID NO: 1011660 - RNA, 17 nt, Mycobacterium avium subsp. paratuberculosis
accaccaacggcucgcc

SEQ ID NO: 1011661 - RNA, 13 nt, Mycobacterium avium subsp. paratuberculosis
accaccacccccg

SEQ ID NO: 1011662 - RNA, 14 nt, Mycobacterium avium subsp. paratuberculosis
accaccacccccga

SEQ ID NO: 1011663 - RNA, 18 nt, Mycobacterium avium subsp. paratuberculosis
accaccaccgcccacagc

SEQ ID NO: 1011664 - RNA, 22 nt, Mycobacterium avium subsp. paratuberculosis
accaccacgaccagugcccggc

SEQ ID NO: 1011665 - RNA, 23 nt, Mycobacterium avium subsp. paratuberculosis
accaccgagguggcccagccgcu

SEQ ID NO: 1011666 - RNA, 14 nt, Mycobacterium avium subsp. paratuberculosis
accaccgcccacag

SEQ ID NO: 1011667 - RNA, 16 nt, Mycobacterium avium subsp. paratuberculosis
accaccggcaaccgcc

SEQ ID NO: 1011668 - RNA, 17 nt, Mycobacterium avium subsp. paratuberculosis
accaccgcccacagcaa

SEQ ID NO: 1011669 - RNA, 15 nt, Mycobacterium avium subsp. paratuberculosis
accaccgccggcccg

SEQ ID NO: 1011670 - RNA, 20 nt, Mycobacterium avium subsp. paratuberculosis
accaccgccgucaccgccag

SEQ ID NO: 1011671 - RNA, 13 nt, Mycobacterium avium subsp. paratuberculosis
accaccgcgccca

SEQ ID NO: 1011672 - RNA, 19 nt, Mycobacterium avium subsp. paratuberculosis
accaccgcgcugcgcgcgu

SEQ ID NO: 1011673 - RNA, 20 nt, Mycobacterium avium subsp. paratuberculosis
accagccguucucguccugg

SEQ ID NO: 1011674 - RNA, 22 nt, Mycobacterium avium subsp. paratuberculosis
accagcauggcgaucaccccgg

SEQ ID NO: 1011675 - RNA, 14 nt, Mycobacterium avium subsp. paratuberculosis
accagcaggucgag

SEQ ID NO: 1011676 - RNA, 23 nt, Mycobacterium avium subsp. paratuberculosis
accagaugccgcucggcgcucca

SEQ ID NO: 1011677 - RNA, 19 nt, Mycobacterium avium subsp. paratuberculosis
accacugcgcgcccgagca

SEQ ID NO: 1011678 - RNA, 16 nt, Mycobacterium avium subsp. paratuberculosis
accaauugcgagcagg

SEQ ID NO: 1011679 - RNA, 21 nt, Mycobacterium avium subsp. paratuberculosis
accacaugccguugccaggcc

SEQ ID NO: 1011680 - RNA, 15 nt, Mycobacterium avium subsp. paratuberculosis
accaacuccaccgcc

SEQ ID NO: 1011681 - RNA, 13 nt, Mycobacterium avium subsp. paratuberculosis
accaacagcggcc

SEQ ID NO: 1011682 - RNA, 18 nt, Mycobacterium avium subsp. paratuberculosis
accaacagcggcccgauc

SEQ ID NO: 1011683 - RNA, 19 nt, Mycobacterium avium subsp. paratuberculosis
accaacaggucggcgugca

SEQ ID NO: 1011684 - RNA, 24 nt, Mycobacterium avium subsp. paratuberculosis
acauggucgcccacaccggauggc

SEQ ID NO: 1011685 - RNA, 18 nt, Mycobacterium avium subsp. paratuberculosis
acauggacgcggccucac

SEQ ID NO: 1011686 - RNA, 14 nt, Mycobacterium avium subsp. paratuberculosis
acauggccagcacc

SEQ ID NO: 1011687 - RNA, 12 nt, Mycobacterium avium subsp. paratuberculosis
acaugggccacg

SEQ ID NO: 1011688 - RNA, 16 nt, Mycobacterium avium subsp. paratuberculosis
acgagcccagccgucg

SEQ ID NO: 1011689 - RNA, 14 nt, Mycobacterium avium subsp. paratuberculosis
acgagcucaccgcc

SEQ ID NO: 1011690 - RNA, 21 nt, Mycobacterium avium subsp. paratuberculosis
acgaggugaugccguccagca

SEQ ID NO: 1011691 - RNA, 18 nt, Mycobacterium avium subsp. paratuberculosis
acgaggccagggcccgca

SEQ ID NO: 1011692 - RNA, 21 nt, Mycobacterium avium subsp. paratuberculosis
acgaggccgcgccgugcgcca

SEQ ID NO: 1011693 - RNA, 20 nt, Mycobacterium avium subsp. paratuberculosis
acgauccgggccggucgguc

SEQ ID NO: 1011694 - RNA, 13 nt, Mycobacterium avium subsp. paratuberculosis
acgaucugcacac

SEQ ID NO: 1011695 - RNA, 16 nt, Mycobacterium avium subsp. paratuberculosis
acgaucggcuccagcg

SEQ ID NO: 1011696 - RNA, 21 nt, Mycobacterium avium subsp. paratuberculosis
acgaucuugccgaacaggcgc

SEQ ID NO: 1011697 - RNA, 15 nt, Mycobacterium avium subsp. paratuberculosis
acgaugaaaccccag

SEQ ID NO: 1011698 - RNA, 18 nt, Mycobacterium avium subsp. paratuberculosis
acgauggcgcggcgcacc

SEQ ID NO: 1011699 - RNA, 23 nt, Mycobacterium avium subsp. paratuberculosis
acgauggcgcggcgcaccgcccg

SEQ ID NO: 1011700 - RNA, 16 nt, Mycobacterium avium subsp. paratuberculosis
acgauggcggcccaga

SEQ ID NO: 1011701 - RNA, 13 nt, Mycobacterium avium subsp. paratuberculosis
acgaugcgcugcu

SEQ ID NO: 1011702 - RNA, 22 nt, Mycobacterium avium subsp. paratuberculosis
acgaugcccuuggccagcagug

SEQ ID NO: 1011703 - RNA, 23 nt, Mycobacterium avium subsp. paratuberculosis
acgaugcccuuggccagcagugc

SEQ ID NO: 1011704 - RNA, 13 nt, Mycobacterium avium subsp. paratuberculosis
acgaugccgggca

SEQ ID NO: 1011705 - RNA, 19 nt, Mycobacterium avium subsp. paratuberculosis
acgcaaaacggugcggccu

SEQ ID NO: 1011706 - RNA, 17 nt, Mycobacterium avium subsp. paratuberculosis
acgaacgcggccagcgg

SEQ ID NO: 1011707 - RNA, 18 nt, Mycobacterium avium subsp. paratuberculosis
acgaacgcuuccagcacc

SEQ ID NO: 1011708 - RNA, 15 nt, Mycobacterium avium subsp. paratuberculosis
acgaaccgccacacg

SEQ ID NO: 1011709 - RNA, 15 nt, Mycobacterium avium subsp. paratuberculosis
acgaacgccaccacg

SEQ ID NO: 1011710 - RNA, 13 nt, Mycobacterium avium subsp. paratuberculosis
acgaaccaggcgc

SEQ ID NO: 1011711 - RNA, 13 nt, Mycobacterium avium subsp. paratuberculosis
acgaaguacagcg

SEQ ID NO: 1011712 - RNA, 12 nt, Mycobacterium avium subsp. paratuberculosis
acgaagucgacg

SEQ ID NO: 1011713 - RNA, 15 nt, Mycobacterium avium subsp. paratuberculosis
acgaagggcgccagc

SEQ ID NO: 1011714 - RNA, 23 nt, Mycobacterium avium subsp. paratuberculosis
acgaaguugaucgcggcggacag

SEQ ID NO: 1011715 - RNA, 12 nt, Mycobacterium avium subsp. paratuberculosis
acgacaacagug

SEQ ID NO: 1011716 - RNA, 16 nt, Mycobacterium avium subsp. paratuberculosis
acgaauucggagacca

SEQ ID NO: 1011717 - RNA, 16 nt, Mycobacterium avium subsp. paratuberculosis
acgacacgauggguca

SEQ ID NO: 1011718 - RNA, 13 nt, Mycobacterium avium subsp. paratuberculosis
acgacgugcccuu

SEQ ID NO: 1011719 - RNA, 18 nt, Mycobacterium avium subsp. paratuberculosis
acgacgucgaugugcucg

SEQ ID NO: 1011720 - RNA, 13 nt, Mycobacterium avium subsp. paratuberculosis
acgacuccuggcc

SEQ ID NO: 1011721 - RNA, 13 nt, Mycobacterium avium subsp. paratuberculosis
acgacggcgcugg

SEQ ID NO: 1011722 - RNA, 17 nt, Mycobacterium avium subsp. paratuberculosis
acgacggucacggccgc

SEQ ID NO: 1011723 - RNA, 13 nt, Mycobacterium avium subsp. paratuberculosis
acgagaugcccca

SEQ ID NO: 1011724 - RNA, 13 nt, Mycobacterium avium subsp. paratuberculosis
acgaccaucagcg

SEQ ID NO: 1011725 - RNA, 21 nt, Mycobacterium avium subsp. paratuberculosis
acgaccaguucgcccuggccg

SEQ ID NO: 1011726 - RNA, 11 nt, Mycobacterium avium subsp. paratuberculosis
acgaccagugc

SEQ ID NO: 1011727 - RNA, 21 nt, Mycobacterium avium subsp. paratuberculosis
acgaccaggaugcccaggaug

SEQ ID NO: 1011728 - RNA, 20 nt, Mycobacterium avium subsp. paratuberculosis
acgacaucucgacggugacc

SEQ ID NO: 1011729 - RNA, 22 nt, Mycobacterium avium subsp. paratuberculosis
acgaccucgaagaagagggcgu

SEQ ID NO: 1011730 - RNA, 14 nt, Mycobacterium avium subsp. paratuberculosis
acgaccggcagcac

SEQ ID NO: 1011731 - RNA, 18 nt, Mycobacterium avium subsp. paratuberculosis
acgacgaccucccccgac

SEQ ID NO: 1011732 - RNA, 21 nt, Mycobacterium avium subsp. paratuberculosis
acgacgaacaccaccggcaac

SEQ ID NO: 1011733 - RNA, 13 nt, Mycobacterium avium subsp. paratuberculosis
acgacgaacuccg

SEQ ID NO: 1011734 - RNA, 23 nt, Mycobacterium avium subsp. paratuberculosis
acgaccgcguccgaggcgguucc

SEQ ID NO: 1011735 - RNA, 15 nt, Mycobacterium avium subsp. paratuberculosis
acgaccgcaccgacc

SEQ ID NO: 1011736 - RNA, 16 nt, Mycobacterium avium subsp. paratuberculosis
acgaccgcaccgacca

SEQ ID NO: 1011737 - RNA, 17 nt, Mycobacterium avium subsp. paratuberculosis
acgaccgcaccgaccag

SEQ ID NO: 1011738 - RNA, 15 nt, Mycobacterium avium subsp. paratuberculosis
acgaccgccagcagc

SEQ ID NO: 1011739 - RNA, 13 nt, Mycobacterium avium subsp. paratuberculosis
accuuucggccgc

SEQ ID NO: 1011740 - RNA, 19 nt, Mycobacterium avium subsp. paratuberculosis
accuugaucggccccuugg

SEQ ID NO: 1011741 - RNA, 20 nt, Mycobacterium avium subsp. paratuberculosis
accuugaucggccccuuggc

SEQ ID NO: 1011742 - RNA, 17 nt, Mycobacterium avium subsp. paratuberculosis
accuugcccgucgcguc

SEQ ID NO: 1011743 - RNA, 14 nt, Mycobacterium avium subsp. paratuberculosis
accuugcccugcgu

SEQ ID NO: 1011744 - RNA, 12 nt, Mycobacterium avium subsp. paratuberculosis
accuugaccacc

SEQ ID NO: 1011745 - RNA, 11 nt, Mycobacterium avium subsp. paratuberculosis
accuugaccag

SEQ ID NO: 1011746 - RNA, 21 nt, Mycobacterium avium subsp. paratuberculosis
accuugacccaggcccgggau

SEQ ID NO: 1011747 - RNA, 12 nt, Mycobacterium avium subsp. paratuberculosis
accuucuugucc

SEQ ID NO: 1011748 - RNA, 20 nt, Mycobacterium avium subsp. paratuberculosis
accuuggucagcucccggca

SEQ ID NO: 1011749 - RNA, 15 nt, Mycobacterium avium subsp. paratuberculosis
accuugucgcgcacc

SEQ ID NO: 1011750 - RNA, 18 nt, Mycobacterium avium subsp. paratuberculosis
accuucaccgaccagcug

SEQ ID NO: 1011751 - RNA, 20 nt, Mycobacterium avium subsp. paratuberculosis
accuucucccgcggcagccg

SEQ ID NO: 1011752 - RNA, 16 nt, Mycobacterium avium subsp. paratuberculosis
accuucgagccgccgc

SEQ ID NO: 1011753 - RNA, 17 nt, Mycobacterium avium subsp. paratuberculosis
accuucgagccgccgcc

SEQ ID NO: 1011754 - RNA, 23 nt, Mycobacterium avium subsp. paratuberculosis
accugcacgcugaagcacaccgu

SEQ ID NO: 1011755 - RNA, 18 nt, Mycobacterium avium subsp. paratuberculosis
accugcaguucgaucacc

SEQ ID NO: 1011756 - RNA, 14 nt, Mycobacterium avium subsp. paratuberculosis
accugcagccgguc

SEQ ID NO: 1011757 - RNA, 22 nt, Mycobacterium avium subsp. paratuberculosis
accugcagccggucggaggccu

SEQ ID NO: 1011758 - RNA, 13 nt, Mycobacterium avium subsp. paratuberculosis
accugcaucucga

SEQ ID NO: 1011759 - RNA, 12 nt, Mycobacterium avium subsp. paratuberculosis
accugccgcaca

SEQ ID NO: 1011760 - RNA, 14 nt, Mycobacterium avium subsp. paratuberculosis
accugcggccccug

SEQ ID NO: 1011761 - RNA, 14 nt, Mycobacterium avium subsp. paratuberculosis
accugcggugccaa

SEQ ID NO: 1011762 - RNA, 23 nt, Mycobacterium avium subsp. paratuberculosis
accugcgugccuugcacccagcg

SEQ ID NO: 1011763 - RNA, 17 nt, Mycobacterium avium subsp. paratuberculosis
accugcgggcccaccgc

SEQ ID NO: 1011764 - RNA, 19 nt, Mycobacterium avium subsp. paratuberculosis
accuggcgggccagcuugu

SEQ ID NO: 1011765 - RNA, 18 nt, Mycobacterium avium subsp. paratuberculosis
accuggcugccugguugg

SEQ ID NO: 1011766 - RNA, 16 nt, Mycobacterium avium subsp. paratuberculosis
accuggccaccagcag

SEQ ID NO: 1011767 - RNA, 19 nt, Mycobacterium avium subsp. paratuberculosis
accuggccggccucgaugu

SEQ ID NO: 1011768 - RNA, 14 nt, Mycobacterium avium subsp. paratuberculosis
accuggagcggguc

SEQ ID NO: 1011769 - RNA, 16 nt, Mycobacterium avium subsp. paratuberculosis
accugcuuggcggccu

SEQ ID NO: 1011770 - RNA, 21 nt, Mycobacterium avium subsp. paratuberculosis
accugcucaccgagcugggcc

SEQ ID NO: 1011771 - RNA, 14 nt, Mycobacterium avium subsp. paratuberculosis
accugugcgcccca

SEQ ID NO: 1011772 - RNA, 16 nt, Mycobacterium avium subsp. paratuberculosis
accugguugccgcccu

SEQ ID NO: 1011773 - RNA, 20 nt, Mycobacterium avium subsp. paratuberculosis
accugguugccgcccucggc

SEQ ID NO: 1011774 - RNA, 17 nt, Mycobacterium avium subsp. paratuberculosis
accuguacgugucccug

SEQ ID NO: 1011775 - RNA, 20 nt, Mycobacterium avium subsp. paratuberculosis
accugggcgucgucggccgg

SEQ ID NO: 1011776 - RNA, 17 nt, Mycobacterium avium subsp. paratuberculosis
accugggucaucaccuu

SEQ ID NO: 1011777 - RNA, 18 nt, Mycobacterium avium subsp. paratuberculosis
accugggucaucaccuug

SEQ ID NO: 1011778 - RNA, 19 nt, Mycobacterium avium subsp. paratuberculosis
accugggucaucaccuugu

SEQ ID NO: 1011779 - RNA, 15 nt, Mycobacterium avium subsp. paratuberculosis
accuggucggucagc

SEQ ID NO: 1011780 - RNA, 15 nt, Mycobacterium avium subsp. paratuberculosis
accugggucugcggc

SEQ ID NO: 1011781 - RNA, 20 nt, Mycobacterium avium subsp. paratuberculosis
accugggugaucuuggugaa

SEQ ID NO: 1011782 - RNA, 22 nt, Mycobacterium avium subsp. paratuberculosis
accucgagcacgcccugcggcu

SEQ ID NO: 1011783 - RNA, 16 nt, Mycobacterium avium subsp. paratuberculosis
accucgagcagcgcgc

SEQ ID NO: 1011784 - RNA, 19 nt, Mycobacterium avium subsp. paratuberculosis
accucgaccgugaggcccg

SEQ ID NO: 1011785 - RNA, 18 nt, Mycobacterium avium subsp. paratuberculosis
accucgacggugcugccg

SEQ ID NO: 1011786 - RNA, 20 nt, Mycobacterium avium subsp. paratuberculosis
accucgagauucugcagccg

SEQ ID NO: 1011787 - RNA, 20 nt, Mycobacterium avium subsp. paratuberculosis
accucgaggaacuugcgccg

SEQ ID NO: 1011788 - RNA, 21 nt, Mycobacterium avium subsp. paratuberculosis
accucgccgacgucccagcac

SEQ ID NO: 1011789 - RNA, 22 nt, Mycobacterium avium subsp. paratuberculosis
accuccucgguguacagcgcca

SEQ ID NO: 1011790 - RNA, 23 nt, Mycobacterium avium subsp. paratuberculosis
accuccugcaaggcccccgccuc

SEQ ID NO: 1011791 - RNA, 13 nt, Mycobacterium avium subsp. paratuberculosis
accuccugcaccc

SEQ ID NO: 1011792 - RNA, 17 nt, Mycobacterium avium subsp. paratuberculosis
accuccuuggccaggcg

SEQ ID NO: 1011793 - RNA, 22 nt, Mycobacterium avium subsp. paratuberculosis
accucgaagcagccuucuuggc

SEQ ID NO: 1011794 - RNA, 22 nt, Mycobacterium avium subsp. paratuberculosis
accuccgugccgauggccaccg

SEQ ID NO: 1011795 - RNA, 21 nt, Mycobacterium avium subsp. paratuberculosis
accuccccgcggugccgcagc

SEQ ID NO: 1011796 - RNA, 22 nt, Mycobacterium avium subsp. paratuberculosis
accuccccgcggugccgcagcu

SEQ ID NO: 1011797 - RNA, 20 nt, Mycobacterium avium subsp. paratuberculosis
accuccagauagaggaacag

SEQ ID NO: 1011798 - RNA, 16 nt, Mycobacterium avium subsp. paratuberculosis
accucaucgcccagcc

SEQ ID NO: 1011799 - RNA, 14 nt, Mycobacterium avium subsp. paratuberculosis
accugaaccgcgca

SEQ ID NO: 1011800 - RNA, 17 nt, Mycobacterium avium subsp. paratuberculosis
accugaacggccgcgca

SEQ ID NO: 1011801 - RNA, 15 nt, Mycobacterium avium subsp. paratuberculosis
accugaccgcgggcc

SEQ ID NO: 1011802 - RNA, 15 nt, Mycobacterium avium subsp. paratuberculosis
accucuucgacccgc

SEQ ID NO: 1011803 - RNA, 15 nt, Mycobacterium avium subsp. paratuberculosis
accucuugcggcgca

SEQ ID NO: 1011804 - RNA, 20 nt, Mycobacterium avium subsp. paratuberculosis
accucgucgccgucgggguc

SEQ ID NO: 1011805 - RNA, 21 nt, Mycobacterium avium subsp. paratuberculosis
accucgucgggcgccagcccg

SEQ ID NO: 1011806 - RNA, 18 nt, Mycobacterium avium subsp. paratuberculosis
accucgugcacaugcccg

SEQ ID NO: 1011807 - RNA, 21 nt, Mycobacterium avium subsp. paratuberculosis
accucgcugcgcgaggagauu

SEQ ID NO: 1011808 - RNA, 20 nt, Mycobacterium avium subsp. paratuberculosis
accucggagaugauggccgc

SEQ ID NO: 1011809 - RNA, 23 nt, Mycobacterium avium subsp. paratuberculosis
accucggagaugauggccgcgcc

SEQ ID NO: 1011810 - RNA, 15 nt, Mycobacterium avium subsp. paratuberculosis
accucgcgcagcccc

SEQ ID NO: 1011811 - RNA, 15 nt, Mycobacterium avium subsp. paratuberculosis
accucgcgcccggcg

SEQ ID NO: 1011812 - RNA, 20 nt, Mycobacterium avium subsp. paratuberculosis
accucgcgccgcgaucucgg

SEQ ID NO: 1011813 - RNA, 19 nt, Mycobacterium avium subsp. paratuberculosis
accucgcuacgcgagcugc

SEQ ID NO: 1011814 - RNA, 20 nt, Mycobacterium avium subsp. paratuberculosis
accucgcuacgcgagcugcu

SEQ ID NO: 1011815 - RNA, 19 nt, Mycobacterium avium subsp. paratuberculosis
accucgcgcgucacgcugg

SEQ ID NO: 1011816 - RNA, 16 nt, Mycobacterium avium subsp. paratuberculosis
accucggcggcggcgc

SEQ ID NO: 1011817 - RNA, 19 nt, Mycobacterium avium subsp. paratuberculosis
accucgggaugggcauugc

SEQ ID NO: 1011818 - RNA, 14 nt, Mycobacterium avium subsp. paratuberculosis
accucggccuugcc

SEQ ID NO: 1011819 - RNA, 13 nt, Mycobacterium avium subsp. paratuberculosis
accucggccaggu

SEQ ID NO: 1011820 - RNA, 15 nt, Mycobacterium avium subsp. paratuberculosis
accguucaccucuuc

SEQ ID NO: 1011821 - RNA, 19 nt, Mycobacterium avium subsp. paratuberculosis
accguucauuaucccgcac

SEQ ID NO: 1011822 - RNA, 15 nt, Mycobacterium avium subsp. paratuberculosis
accguugcagaacaa

SEQ ID NO: 1011823 - RNA, 18 nt, Mycobacterium avium subsp. paratuberculosis
accguagccggucggccc

SEQ ID NO: 1011824 - RNA, 21 nt, Mycobacterium avium subsp. paratuberculosis
accgucaucgugugggcgccc

SEQ ID NO: 1011825 - RNA, 13 nt, Mycobacterium avium subsp. paratuberculosis
accgucacgcugg

SEQ ID NO: 1011826 - RNA, 13 nt, Mycobacterium avium subsp. paratuberculosis
accgucagccagg

SEQ ID NO: 1011827 - RNA, 15 nt, Mycobacterium avium subsp. paratuberculosis
accgucagcagggcc

SEQ ID NO: 1011828 - RNA, 20 nt, Mycobacterium avium subsp. paratuberculosis
accgucagcagggccucgcc

SEQ ID NO: 1011829 - RNA, 20 nt, Mycobacterium avium subsp. paratuberculosis
accguggucggcagcaccgg

SEQ ID NO: 1011830 - RNA, 17 nt, Mycobacterium avium subsp. paratuberculosis
accguggugacccggac

SEQ ID NO: 1011831 - RNA, 22 nt, Mycobacterium avium subsp. paratuberculosis
accgugguggacaacuccugga

SEQ ID NO: 1011832 - RNA, 19 nt, Mycobacterium avium subsp. paratuberculosis
accgugugacgaugcugag

SEQ ID NO: 1011833 - RNA, 15 nt, Mycobacterium avium subsp. paratuberculosis
accguggccccacgg

SEQ ID NO: 1011834 - RNA, 23 nt, Mycobacterium avium subsp. paratuberculosis
accgugcuuggcggcgcacucca

SEQ ID NO: 1011835 - RNA, 17 nt, Mycobacterium avium subsp. paratuberculosis
accgugcuggccaccac

SEQ ID NO: 1011836 - RNA, 16 nt, Mycobacterium avium subsp. paratuberculosis
accgugcgcgcgcacc

SEQ ID NO: 1011837 - RNA, 17 nt, Mycobacterium avium subsp. paratuberculosis
accgugaucgccaccac

SEQ ID NO: 1011838 - RNA, 18 nt, Mycobacterium avium subsp. paratuberculosis
accgugaucgccaccacc

SEQ ID NO: 1011839 - RNA, 17 nt, Mycobacterium avium subsp. paratuberculosis
accgugaggcccggcgu

SEQ ID NO: 1011840 - RNA, 18 nt, Mycobacterium avium subsp. paratuberculosis
accgucgucgcaccggca

SEQ ID NO: 1011841 - RNA, 19 nt, Mycobacterium avium subsp. paratuberculosis
accgucgucgcaccggcag

SEQ ID NO: 1011842 - RNA, 17 nt, Mycobacterium avium subsp. paratuberculosis
accgucgggacggccag

SEQ ID NO: 1011843 - RNA, 16 nt, Mycobacterium avium subsp. paratuberculosis
accggugucacgcugg

SEQ ID NO: 1011844 - RNA, 23 nt, Mycobacterium avium subsp. paratuberculosis
accgguagaagaugcgccggguc

SEQ ID NO: 1011845 - RNA, 14 nt, Mycobacterium avium subsp. paratuberculosis
accgguaggcgcac

SEQ ID NO: 1011846 - RNA, 20 nt, Mycobacterium avium subsp. paratuberculosis
accgguaggcgcaccgccgg

SEQ ID NO: 1011847 - RNA, 16 nt, Mycobacterium avium subsp. paratuberculosis
accggucguuggccuc

SEQ ID NO: 1011848 - RNA, 16 nt, Mycobacterium avium subsp. paratuberculosis
accgguccgccgccgg

SEQ ID NO: 1011849 - RNA, 14 nt, Mycobacterium avium subsp. paratuberculosis
accgggccaggaug

SEQ ID NO: 1011850 - RNA, 16 nt, Mycobacterium avium subsp. paratuberculosis
accgggccaggaugac

SEQ ID NO: 1011851 - RNA, 18 nt, Mycobacterium avium subsp. paratuberculosis
accgggccaggaugaccg

SEQ ID NO: 1011852 - RNA, 18 nt, Mycobacterium avium subsp. paratuberculosis
accgggacgacggcgccg

SEQ ID NO: 1011853 - RNA, 18 nt, Mycobacterium avium subsp. paratuberculosis
accgggaaguagggcagc

SEQ ID NO: 1011854 - RNA, 18 nt, Mycobacterium avium subsp. paratuberculosis
accgggaucacccucggc

SEQ ID NO: 1011855 - RNA, 17 nt, Mycobacterium avium subsp. paratuberculosis
accgggauccggcgcgc

SEQ ID NO: 1011856 - RNA, 17 nt, Mycobacterium avium subsp. paratuberculosis
accggcuuggccacgau

SEQ ID NO: 1011857 - RNA, 14 nt, Mycobacterium avium subsp. paratuberculosis
accggcuuggcggu

SEQ ID NO: 1011858 - RNA, 15 nt, Mycobacterium avium subsp. paratuberculosis
accggcuggugcagc

SEQ ID NO: 1011859 - RNA, 15 nt, Mycobacterium avium subsp. paratuberculosis
accggggccagcacg

SEQ ID NO: 1011860 - RNA, 19 nt, Mycobacterium avium subsp. paratuberculosis
accggggccagcacgcccc

SEQ ID NO: 1011861 - RNA, 14 nt, Mycobacterium avium subsp. paratuberculosis
accggggccgcacc

SEQ ID NO: 1011862 - RNA, 13 nt, Mycobacterium avium subsp. paratuberculosis
accgggggccguc

SEQ ID NO: 1011863 - RNA, 24 nt, Mycobacterium avium subsp. paratuberculosis
accgggccgcuggugaggucgcgc

SEQ ID NO: 1011864 - RNA, 16 nt, Mycobacterium avium subsp. paratuberculosis
accgggcggugaccac

SEQ ID NO: 1011865 - RNA, 19 nt, Mycobacterium avium subsp. paratuberculosis
accggguuggcgcgcacca

SEQ ID NO: 1011866 - RNA, 15 nt, Mycobacterium avium subsp. paratuberculosis
accgggucagcacca

SEQ ID NO: 1011867 - RNA, 22 nt, Mycobacterium avium subsp. paratuberculosis
accgggugaacgaggccgcgcc

SEQ ID NO: 1011868 - RNA, 14 nt, Mycobacterium avium subsp. paratuberculosis
accgggugacgacc

SEQ ID NO: 1011869 - RNA, 22 nt, Mycobacterium avium subsp. paratuberculosis
accgggucugccacgcccaccg

SEQ ID NO: 1011870 - RNA, 18 nt, Mycobacterium avium subsp. paratuberculosis
accggcgccggccgccgg

SEQ ID NO: 1011871 - RNA, 22 nt, Mycobacterium avium subsp. paratuberculosis
accggcggauucucgcucugcc

SEQ ID NO: 1011872 - RNA, 20 nt, Mycobacterium avium subsp. paratuberculosis
accggcgucgacagccgguc

SEQ ID NO: 1011873 - RNA, 16 nt, Mycobacterium avium subsp. paratuberculosis
accggcggcggccuuc

SEQ ID NO: 1011874 - RNA, 18 nt, Mycobacterium avium subsp. paratuberculosis
accggcggcggugagcgc

SEQ ID NO: 1011875 - RNA, 22 nt, Mycobacterium avium subsp. paratuberculosis
accggcggcugggcagccgcgc

SEQ ID NO: 1011876 - RNA, 18 nt, Mycobacterium avium subsp. paratuberculosis
accggcggccagcgagga

SEQ ID NO: 1011877 - RNA, 14 nt, Mycobacterium avium subsp. paratuberculosis
accggcggccgcca

SEQ ID NO: 1011878 - RNA, 17 nt, Mycobacterium avium subsp. paratuberculosis
accggcuccuugcgccg

SEQ ID NO: 1011879 - RNA, 19 nt, Mycobacterium avium subsp. paratuberculosis
accggcuccuugcgccgca

SEQ ID NO: 1011880 - RNA, 13 nt, Mycobacterium avium subsp. paratuberculosis
accggccgcccgg

SEQ ID NO: 1011881 - RNA, 17 nt, Mycobacterium avium subsp. paratuberculosis
accggccggccgccugg

SEQ ID NO: 1011882 - RNA, 22 nt, Mycobacterium avium subsp. paratuberculosis
accggccggcgcgcacggcagc

SEQ ID NO: 1011883 - RNA, 16 nt, Mycobacterium avium subsp. paratuberculosis
accggccgggacgggu

SEQ ID NO: 1011884 - RNA, 18 nt, Mycobacterium avium subsp. paratuberculosis
accggccgguccgcccag

SEQ ID NO: 1011885 - RNA, 19 nt, Mycobacterium avium subsp. paratuberculosis
accggccugcagcgcgguc

SEQ ID NO: 1011886 - RNA, 23 nt, Mycobacterium avium subsp. paratuberculosis
accggcgccgggcagcccggguc

SEQ ID NO: 1011887 - RNA, 19 nt, Mycobacterium avium subsp. paratuberculosis
accggcgccgaagcccgca

SEQ ID NO: 1011888 - RNA, 17 nt, Mycobacterium avium subsp. paratuberculosis
accggcaaccgccacga

SEQ ID NO: 1011889 - RNA, 14 nt, Mycobacterium avium subsp. paratuberculosis
accggcaccagcag

SEQ ID NO: 1011890 - RNA, 15 nt, Mycobacterium avium subsp. paratuberculosis
accggcaccagcagc

SEQ ID NO: 1011891 - RNA, 23 nt, Mycobacterium avium subsp. paratuberculosis
accggcacccccaauugccgggc

SEQ ID NO: 1011892 - RNA, 12 nt, Mycobacterium avium subsp. paratuberculosis
accggcaccgcc

SEQ ID NO: 1011893 - RNA, 23 nt, Mycobacterium avium subsp. paratuberculosis
accggcaccgccagccaccacau

SEQ ID NO: 1011894 - RNA, 17 nt, Mycobacterium avium subsp. paratuberculosis
accggcaugugccacag

SEQ ID NO: 1011895 - RNA, 19 nt, Mycobacterium avium subsp. paratuberculosis
accggcaugugccacaggu

SEQ ID NO: 1011896 - RNA, 12 nt, Mycobacterium avium subsp. paratuberculosis
accggcauucgu

SEQ ID NO: 1011897 - RNA, 14 nt, Mycobacterium avium subsp. paratuberculosis
accggccaccacgu

SEQ ID NO: 1011898 - RNA, 18 nt, Mycobacterium avium subsp. paratuberculosis
accggccagcauggucuc

SEQ ID NO: 1011899 - RNA, 15 nt, Mycobacterium avium subsp. paratuberculosis
accggcagcaccgcc

SEQ ID NO: 1011900 - RNA, 17 nt, Mycobacterium avium subsp. paratuberculosis
accggcacgucgagcuc

SEQ ID NO: 1011901 - RNA, 20 nt, Mycobacterium avium subsp. paratuberculosis
accggcacgucggccacgcc

SEQ ID NO: 1011902 - RNA, 21 nt, Mycobacterium avium subsp. paratuberculosis
accggcacgucggccacgccg

SEQ ID NO: 1011903 - RNA, 14 nt, Mycobacterium avium subsp. paratuberculosis
accggcagcaggug

SEQ ID NO: 1011904 - RNA, 15 nt, Mycobacterium avium subsp. paratuberculosis
accggcagccgcagc

SEQ ID NO: 1011905 - RNA, 20 nt, Mycobacterium avium subsp. paratuberculosis
accgaucgcgagggccguug

SEQ ID NO: 1011906 - RNA, 15 nt, Mycobacterium avium subsp. paratuberculosis
accgauggccgcccg

SEQ ID NO: 1011907 - RNA, 19 nt, Mycobacterium avium subsp. paratuberculosis
accgauggccgcccgcagg

SEQ ID NO: 1011908 - RNA, 20 nt, Mycobacterium avium subsp. paratuberculosis
accccgaucaacaccgccag

SEQ ID NO: 1011909 - RNA, 14 nt, Mycobacterium avium subsp. paratuberculosis
accccgcagaacac

SEQ ID NO: 1011910 - RNA, 22 nt, Mycobacterium avium subsp. paratuberculosis
accccgcccagcgacucggcca

SEQ ID NO: 1011911 - RNA, 14 nt, Mycobacterium avium subsp. paratuberculosis
accccgcccagcgc

SEQ ID NO: 1011912 - RNA, 14 nt, Mycobacterium avium subsp. paratuberculosis
accccgccgcagcc

SEQ ID NO: 1011913 - RNA, 14 nt, Mycobacterium avium subsp. paratuberculosis
accccgccggcccg

SEQ ID NO: 1011914 - RNA, 20 nt, Mycobacterium avium subsp. paratuberculosis
accccgcgagucaccggcuc

SEQ ID NO: 1011915 - RNA, 14 nt, Mycobacterium avium subsp. paratuberculosis
accccgccagcacc

SEQ ID NO: 1011916 - RNA, 19 nt, Mycobacterium avium subsp. paratuberculosis
accccgucgcggacccugg

SEQ ID NO: 1011917 - RNA, 15 nt, Mycobacterium avium subsp. paratuberculosis
accgccaccagcagg

SEQ ID NO: 1011918 - RNA, 19 nt, Mycobacterium avium subsp. paratuberculosis
accgccaccagcaggccca

SEQ ID NO: 1011919 - RNA, 18 nt, Mycobacterium avium subsp. paratuberculosis
accgcacgagcacccaga

SEQ ID NO: 1011920 - RNA, 21 nt, Mycobacterium avium subsp. paratuberculosis
accgcaccgaccagcgggaug

SEQ ID NO: 1011921 - RNA, 22 nt, Mycobacterium avium subsp. paratuberculosis
accgcaccgaccagcgggauga

SEQ ID NO: 1011922 - RNA, 11 nt, Mycobacterium avium subsp. paratuberculosis
accgcaccacc

SEQ ID NO: 1011923 - RNA, 14 nt, Mycobacterium avium subsp. paratuberculosis
accgauguggacga

SEQ ID NO: 1011924 - RNA, 15 nt, Mycobacterium avium subsp. paratuberculosis
accgcgcgccagguc

SEQ ID NO: 1011925 - RNA, 14 nt, Mycobacterium avium subsp. paratuberculosis
accgcgcggcgccc

SEQ ID NO: 1011926 - RNA, 13 nt, Mycobacterium avium subsp. paratuberculosis
accgcgcgggcca

SEQ ID NO: 1011927 - RNA, 18 nt, Mycobacterium avium subsp. paratuberculosis
accgcgcgccggccagca

SEQ ID NO: 1011928 - RNA, 23 nt, Mycobacterium avium subsp. paratuberculosis
accgcgcgcaggccccggcgcgc

SEQ ID NO: 1011929 - RNA, 16 nt, Mycobacterium avium subsp. paratuberculosis
accgcgcgcaccacgu

SEQ ID NO: 1011930 - RNA, 15 nt, Mycobacterium avium subsp. paratuberculosis
accgcgccgcgggug

SEQ ID NO: 1011931 - RNA, 20 nt, Mycobacterium avium subsp. paratuberculosis
accgcgccgucuuccgggcc

SEQ ID NO: 1011932 - RNA, 21 nt, Mycobacterium avium subsp. paratuberculosis
accgcucgaacacccggcuuc

SEQ ID NO: 1011933 - RNA, 16 nt, Mycobacterium avium subsp. paratuberculosis
accgcggccagcgcgc

SEQ ID NO: 1011934 - RNA, 14 nt, Mycobacterium avium subsp. paratuberculosis
accgcucgucggga

SEQ ID NO: 1011935 - RNA, 22 nt, Mycobacterium avium subsp. paratuberculosis
accgcucgucgggaacgccgau

SEQ ID NO: 1011936 - RNA, 17 nt, Mycobacterium avium subsp. paratuberculosis
accgcugaugccgccga

SEQ ID NO: 1011937 - RNA, 14 nt, Mycobacterium avium subsp. paratuberculosis
accgcugcaugccg

SEQ ID NO: 1011938 - RNA, 15 nt, Mycobacterium avium subsp. paratuberculosis
accgcuggccgaggc

SEQ ID NO: 1011939 - RNA, 16 nt, Mycobacterium avium subsp. paratuberculosis
accgccucgccagccc

SEQ ID NO: 1011940 - RNA, 23 nt, Mycobacterium avium subsp. paratuberculosis
accgccuccucgaugucgguggu

SEQ ID NO: 1011941 - RNA, 22 nt, Mycobacterium avium subsp. paratuberculosis
accgcgaagguggcacgccacu

SEQ ID NO: 1011942 - RNA, 17 nt, Mycobacterium avium subsp. paratuberculosis
accgcgacccaggccgc

SEQ ID NO: 1011943 - RNA, 15 nt, Mycobacterium avium subsp. paratuberculosis
accgccuuggccacg

SEQ ID NO: 1011944 - RNA, 13 nt, Mycobacterium avium subsp. paratuberculosis
accgccuuggcgc

SEQ ID NO: 1011945 - RNA, 16 nt, Mycobacterium avium subsp. paratuberculosis
accgccuugucggcga

SEQ ID NO: 1011946 - RNA, 22 nt, Mycobacterium avium subsp. paratuberculosis
accgcgaacgucucgcgggagu

SEQ ID NO: 1011947 - RNA, 23 nt, Mycobacterium avium subsp. paratuberculosis
accgccguuccgaugaagaacac

SEQ ID NO: 1011948 - RNA, 13 nt, Mycobacterium avium subsp. paratuberculosis
accgccguggcag

SEQ ID NO: 1011949 - RNA, 17 nt, Mycobacterium avium subsp. paratuberculosis
accgccguggcagggcc

SEQ ID NO: 1011950 - RNA, 14 nt, Mycobacterium avium subsp. paratuberculosis
accgccgggcaucc

SEQ ID NO: 1011951 - RNA, 19 nt, Mycobacterium avium subsp. paratuberculosis
accgccgggcauccgggcc

SEQ ID NO: 1011952 - RNA, 24 nt, Mycobacterium avium subsp. paratuberculosis
accgccggggugugcagcgggaug

SEQ ID NO: 1011953 - RNA, 14 nt, Mycobacterium avium subsp. paratuberculosis
accgccagucugag

SEQ ID NO: 1011954 - RNA, 22 nt, Mycobacterium avium subsp. paratuberculosis
accgccaucgcggcguuguggc

SEQ ID NO: 1011955 - RNA, 13 nt, Mycobacterium avium subsp. paratuberculosis
accgcccacagca

SEQ ID NO: 1011956 - RNA, 14 nt, Mycobacterium avium subsp. paratuberculosis
accgcccacagcaa

SEQ ID NO: 1011957 - RNA, 18 nt, Mycobacterium avium subsp. paratuberculosis
accgccaugcuugccaac

SEQ ID NO: 1011958 - RNA, 17 nt, Mycobacterium avium subsp. paratuberculosis
accgccccagccgacca

SEQ ID NO: 1011959 - RNA, 14 nt, Mycobacterium avium subsp. paratuberculosis
acuucgcguuccgc

SEQ ID NO: 1011960 - RNA, 16 nt, Mycobacterium avium subsp. paratuberculosis
acuucgcgggcggcgc

SEQ ID NO: 1011961 - RNA, 14 nt, Mycobacterium avium subsp. paratuberculosis
acuucgacggcagc

SEQ ID NO: 1011962 - RNA, 18 nt, Mycobacterium avium subsp. paratuberculosis
acuucgacggcagcggca

SEQ ID NO: 1011963 - RNA, 23 nt, Mycobacterium avium subsp. paratuberculosis
agaacgacgcgcucagccccagc

SEQ ID NO: 1011964 - RNA, 17 nt, Mycobacterium avium subsp. paratuberculosis
agaacgcgucccacauc

SEQ ID NO: 1011965 - RNA, 16 nt, Mycobacterium avium subsp. paratuberculosis
agaaccucaacgugac

SEQ ID NO: 1011966 - RNA, 12 nt, Mycobacterium avium subsp. paratuberculosis
agaaccggggcc

SEQ ID NO: 1011967 - RNA, 17 nt, Mycobacterium avium subsp. paratuberculosis
agaaccggcaacacagc

SEQ ID NO: 1011968 - RNA, 21 nt, Mycobacterium avium subsp. paratuberculosis
agaaccggcaggacgggggcc

SEQ ID NO: 1011969 - RNA, 14 nt, Mycobacterium avium subsp. paratuberculosis
agaacccggcgugc

SEQ ID NO: 1011970 - RNA, 22 nt, Mycobacterium avium subsp. paratuberculosis
agaacuggcugagcaccggggu

SEQ ID NO: 1011971 - RNA, 21 nt, Mycobacterium avium subsp. paratuberculosis
agaacucggcggcgguuucuu

SEQ ID NO: 1011972 - RNA, 21 nt, Mycobacterium avium subsp. paratuberculosis
agaacucaauaguguguuugg

SEQ ID NO: 1011973 - RNA, 18 nt, Mycobacterium avium subsp. paratuberculosis
agaacggaauucagugag

SEQ ID NO: 1011974 - RNA, 16 nt, Mycobacterium avium subsp. paratuberculosis
agaacaccaccgccag

SEQ ID NO: 1011975 - RNA, 18 nt, Mycobacterium avium subsp. paratuberculosis
agaaccauuugcccagca

SEQ ID NO: 1011976 - RNA, 16 nt, Mycobacterium avium subsp. paratuberculosis
agaaccagcccggccc

SEQ ID NO: 1011977 - RNA, 22 nt, Mycobacterium avium subsp. paratuberculosis
agaccagcgugucgccggggcg

SEQ ID NO: 1011978 - RNA, 19 nt, Mycobacterium avium subsp. paratuberculosis
agacgugcacgugcaggug

SEQ ID NO: 1011979 - RNA, 18 nt, Mycobacterium avium subsp. paratuberculosis
agacguugccgcacaccg

SEQ ID NO: 1011980 - RNA, 14 nt, Mycobacterium avium subsp. paratuberculosis
agacgaugcccagc

SEQ ID NO: 1011981 - RNA, 19 nt, Mycobacterium avium subsp. paratuberculosis
agaccaggucggccuucag

SEQ ID NO: 1011982 - RNA, 18 nt, Mycobacterium avium subsp. paratuberculosis
agaccaugucggccaggu

SEQ ID NO: 1011983 - RNA, 12 nt, Mycobacterium avium subsp. paratuberculosis
agacccagcagc

SEQ ID NO: 1011984 - RNA, 15 nt, Mycobacterium avium subsp. paratuberculosis
agacccacagcugcc

SEQ ID NO: 1011985 - RNA, 21 nt, Mycobacterium avium subsp. paratuberculosis
agacgacgacgaacgcgguga

SEQ ID NO: 1011986 - RNA, 19 nt, Mycobacterium avium subsp. paratuberculosis
agacgacgucgaccgcgcc

SEQ ID NO: 1011987 - RNA, 19 nt, Mycobacterium avium subsp. paratuberculosis
agacgacucuuccaggaca

SEQ ID NO: 1011988 - RNA, 21 nt, Mycobacterium avium subsp. paratuberculosis
agaagcuccacgccgccggga

SEQ ID NO: 1011989 - RNA, 20 nt, Mycobacterium avium subsp. paratuberculosis
agaaguccuuguggcccagg

SEQ ID NO: 1011990 - RNA, 18 nt, Mycobacterium avium subsp. paratuberculosis
agauguuggagaucucgg

SEQ ID NO: 1011991 - RNA, 21 nt, Mycobacterium avium subsp. paratuberculosis
agauguuggagaucucggcgu

SEQ ID NO: 1011992 - RNA, 13 nt, Mycobacterium avium subsp. paratuberculosis
agauguugcggcc

SEQ ID NO: 1011993 - RNA, 16 nt, Mycobacterium avium subsp. paratuberculosis
agaugcguuccaggug

SEQ ID NO: 1011994 - RNA, 16 nt, Mycobacterium avium subsp. paratuberculosis
agaugcggcaccagcc

SEQ ID NO: 1011995 - RNA, 17 nt, Mycobacterium avium subsp. paratuberculosis
agaugcggcccagcccg

SEQ ID NO: 1011996 - RNA, 13 nt, Mycobacterium avium subsp. paratuberculosis
agauggggugaug

SEQ ID NO: 1011997 - RNA, 15 nt, Mycobacterium avium subsp. paratuberculosis
agauggccaggaacg

SEQ ID NO: 1011998 - RNA, 16 nt, Mycobacterium avium subsp. paratuberculosis
agauggccagcaccac

SEQ ID NO: 1011999 - RNA, 22 nt, Mycobacterium avium subsp. paratuberculosis
agauggccagcaccaccgcgag

SEQ ID NO: 1012000 - RNA, 21 nt, Mycobacterium avium subsp. paratuberculosis
agauucaccagcgccucggcc

SEQ ID NO: 1012001 - RNA, 12 nt, Mycobacterium avium subsp. paratuberculosis
agauugggccac

SEQ ID NO: 1012002 - RNA, 16 nt, Mycobacterium avium subsp. paratuberculosis
agaucgcugaugcgca

SEQ ID NO: 1012003 - RNA, 19 nt, Mycobacterium avium subsp. paratuberculosis
agaucgcggcccgccgcuc

SEQ ID NO: 1012004 - RNA, 14 nt, Mycobacterium avium subsp. paratuberculosis
agaucggccagguu

SEQ ID NO: 1012005 - RNA, 20 nt, Mycobacterium avium subsp. paratuberculosis
agaucggcgucacugcccag

SEQ ID NO: 1012006 - RNA, 18 nt, Mycobacterium avium subsp. paratuberculosis
agauccuuugcggcccca

SEQ ID NO: 1012007 - RNA, 16 nt, Mycobacterium avium subsp. paratuberculosis
agaucgacagggcguc

SEQ ID NO: 1012008 - RNA, 18 nt, Mycobacterium avium subsp. paratuberculosis
agaucgcagcggugacac

SEQ ID NO: 1012009 - RNA, 18 nt, Mycobacterium avium subsp. paratuberculosis
agaucgccagcaccggcg

SEQ ID NO: 1012010 - RNA, 15 nt, Mycobacterium avium subsp. paratuberculosis
agaucugcacgcugu

SEQ ID NO: 1012011 - RNA, 22 nt, Mycobacterium avium subsp. paratuberculosis
agaucuuccaucacgccccggc

SEQ ID NO: 1012012 - RNA, 21 nt, Mycobacterium avium subsp. paratuberculosis
agaucuguauuaagcuggcag

SEQ ID NO: 1012013 - RNA, 21 nt, Mycobacterium avium subsp. paratuberculosis
agaugaagacccggccgugga

SEQ ID NO: 1012014 - RNA, 15 nt, Mycobacterium avium subsp. paratuberculosis
agaugcccagcagga

SEQ ID NO: 1012015 - RNA, 15 nt, Mycobacterium avium subsp. paratuberculosis
agaugcccagcggca

SEQ ID NO: 1012016 - RNA, 21 nt, Mycobacterium avium subsp. paratuberculosis
agaugcccgccccgcccggcg

SEQ ID NO: 1012017 - RNA, 22 nt, Mycobacterium avium subsp. paratuberculosis
agaugccgggcuccgcguucga

SEQ ID NO: 1012018 - RNA, 17 nt, Mycobacterium avium subsp. paratuberculosis
agaugaucagcgcgccc

SEQ ID NO: 1012019 - RNA, 21 nt, Mycobacterium avium subsp. paratuberculosis
agaugaucagcgcgcccaggc

SEQ ID NO: 1012020 - RNA, 17 nt, Mycobacterium avium subsp. paratuberculosis
agaugaccgucguugcc

SEQ ID NO: 1012021 - RNA, 22 nt, Mycobacterium avium subsp. paratuberculosis
agaugagauccuuugcggcccc

SEQ ID NO: 1012022 - RNA, 15 nt, Mycobacterium avium subsp. paratuberculosis
agaucaacagccgcc

SEQ ID NO: 1012023 - RNA, 14 nt, Mycobacterium avium subsp. paratuberculosis
agaucacagcgccc

SEQ ID NO: 1012024 - RNA, 13 nt, Mycobacterium avium subsp. paratuberculosis
agaucacgccggu

SEQ ID NO: 1012025 - RNA, 17 nt, Mycobacterium avium subsp. paratuberculosis
agaucagggugcucagc

SEQ ID NO: 1012026 - RNA, 22 nt, Mycobacterium avium subsp. paratuberculosis
agaucagggugcucagccgcac

SEQ ID NO: 1012027 - RNA, 16 nt, Mycobacterium avium subsp. paratuberculosis
agaucagcguggucag

SEQ ID NO: 1012028 - RNA, 17 nt, Mycobacterium avium subsp. paratuberculosis
agaucagcguggucagc

SEQ ID NO: 1012029 - RNA, 15 nt, Mycobacterium avium subsp. paratuberculosis
agaucacguucaccu

SEQ ID NO: 1012030 - RNA, 21 nt, Mycobacterium avium subsp. paratuberculosis
agaucaccgcguagcgccgcc

SEQ ID NO: 1012031 - RNA, 18 nt, Mycobacterium avium subsp. paratuberculosis
agaucaccggcaccccca

SEQ ID NO: 1012032 - RNA, 14 nt, Mycobacterium avium subsp. paratuberculosis
agaucagcaccagg

SEQ ID NO: 1012033 - RNA, 22 nt, Mycobacterium avium subsp. paratuberculosis
agaucagcaccguccacagccg

SEQ ID NO: 1012034 - RNA, 16 nt, Mycobacterium avium subsp. paratuberculosis
agaucagcaggcccuc

SEQ ID NO: 1012035 - RNA, 23 nt, Mycobacterium avium subsp. paratuberculosis
agaucagcaggcccucggccagc

SEQ ID NO: 1012036 - RNA, 17 nt, Mycobacterium avium subsp. paratuberculosis
agaucagcgccaugcug

SEQ ID NO: 1012037 - RNA, 13 nt, Mycobacterium avium subsp. paratuberculosis
agauaggcggcga

SEQ ID NO: 1012038 - RNA, 23 nt, Mycobacterium avium subsp. paratuberculosis
agauagggauucgucauggacag

SEQ ID NO: 1012039 - RNA, 19 nt, Mycobacterium avium subsp. paratuberculosis
agauacggucgcaccgcgg

SEQ ID NO: 1012040 - RNA, 15 nt, Mycobacterium avium subsp. paratuberculosis
agauaccggccagca

SEQ ID NO: 1012041 - RNA, 20 nt, Mycobacterium avium subsp. paratuberculosis
agagcugcugccgccgcagc

SEQ ID NO: 1012042 - RNA, 12 nt, Mycobacterium avium subsp. paratuberculosis
agagcgcgggca

SEQ ID NO: 1012043 - RNA, 21 nt, Mycobacterium avium subsp. paratuberculosis
agagcgcgucgacgcggucga

SEQ ID NO: 1012044 - RNA, 19 nt, Mycobacterium avium subsp. paratuberculosis
agagcgcgaaaaccagcac

SEQ ID NO: 1012045 - RNA, 17 nt, Mycobacterium avium subsp. paratuberculosis
agagucgcuggcgcgcu

SEQ ID NO: 1012046 - RNA, 17 nt, Mycobacterium avium subsp. paratuberculosis
agagaucgccccgccgu

SEQ ID NO: 1012047 - RNA, 15 nt, Mycobacterium avium subsp. paratuberculosis
acuucacaggccgcc

SEQ ID NO: 1012048 - RNA, 13 nt, Mycobacterium avium subsp. paratuberculosis
acuucaggucucc

SEQ ID NO: 1012049 - RNA, 18 nt, Mycobacterium avium subsp. paratuberculosis
acuucaggcccucaucgu

SEQ ID NO: 1012050 - RNA, 16 nt, Mycobacterium avium subsp. paratuberculosis
acugucggcgcggacg

SEQ ID NO: 1012051 - RNA, 16 nt, Mycobacterium avium subsp. paratuberculosis
acuguuacgcccgauc

SEQ ID NO: 1012052 - RNA, 14 nt, Mycobacterium avium subsp. paratuberculosis
acugcgguagaggc

SEQ ID NO: 1012053 - RNA, 19 nt, Mycobacterium avium subsp. paratuberculosis
acugcugcgggugcggcca

SEQ ID NO: 1012054 - RNA, 21 nt, Mycobacterium avium subsp. paratuberculosis
acugcugcgggugcggccagc

SEQ ID NO: 1012055 - RNA, 19 nt, Mycobacterium avium subsp. paratuberculosis
acuggcccacgcagccguc

SEQ ID NO: 1012056 - RNA, 12 nt, Mycobacterium avium subsp. paratuberculosis
acugggccaggu

SEQ ID NO: 1012057 - RNA, 15 nt, Mycobacterium avium subsp. paratuberculosis
acugggccgccgucg

SEQ ID NO: 1012058 - RNA, 15 nt, Mycobacterium avium subsp. paratuberculosis
acugggcggccugca

SEQ ID NO: 1012059 - RNA, 18 nt, Mycobacterium avium subsp. paratuberculosis
acugggcguggucgccgu

SEQ ID NO: 1012060 - RNA, 15 nt, Mycobacterium avium subsp. paratuberculosis
acugggcgcccaccc

SEQ ID NO: 1012061 - RNA, 17 nt, Mycobacterium avium subsp. paratuberculosis
acugguccugcggcugg

SEQ ID NO: 1012062 - RNA, 17 nt, Mycobacterium avium subsp. paratuberculosis
acuggucgucgagcuga

SEQ ID NO: 1012063 - RNA, 22 nt, Mycobacterium avium subsp. paratuberculosis
acuggucgugcagcaccgccag

SEQ ID NO: 1012064 - RNA, 20 nt, Mycobacterium avium subsp. paratuberculosis
acugguuccacaccaccaug

SEQ ID NO: 1012065 - RNA, 13 nt, Mycobacterium avium subsp. paratuberculosis
acugggugggacg

SEQ ID NO: 1012066 - RNA, 20 nt, Mycobacterium avium subsp. paratuberculosis
acugcaucucgaccuggguc

SEQ ID NO: 1012067 - RNA, 14 nt, Mycobacterium avium subsp. paratuberculosis
acugcaccagcacg

SEQ ID NO: 1012068 - RNA, 20 nt, Mycobacterium avium subsp. paratuberculosis
acugccaucccucguucagc

SEQ ID NO: 1012069 - RNA, 23 nt, Mycobacterium avium subsp. paratuberculosis
acugcccaaugaucugggccgcc

SEQ ID NO: 1012070 - RNA, 21 nt, Mycobacterium avium subsp. paratuberculosis
acugcgaucgccgacgccagc

SEQ ID NO: 1012071 - RNA, 23 nt, Mycobacterium avium subsp. paratuberculosis
acugcgaucgccgacgccagcac

SEQ ID NO: 1012072 - RNA, 17 nt, Mycobacterium avium subsp. paratuberculosis
acugcgcaccgccagca

SEQ ID NO: 1012073 - RNA, 18 nt, Mycobacterium avium subsp. paratuberculosis
acugcgcgcccgagcauu

SEQ ID NO: 1012074 - RNA, 15 nt, Mycobacterium avium subsp. paratuberculosis
acugcgcgucggaga

SEQ ID NO: 1012075 - RNA, 20 nt, Mycobacterium avium subsp. paratuberculosis
acugccgagcaucagcugcc

SEQ ID NO: 1012076 - RNA, 15 nt, Mycobacterium avium subsp. paratuberculosis
acugauccaccaucu

SEQ ID NO: 1012077 - RNA, 19 nt, Mycobacterium avium subsp. paratuberculosis
acucgacguucggcgggca

SEQ ID NO: 1012078 - RNA, 17 nt, Mycobacterium avium subsp. paratuberculosis
acucgaucagcaccgcc

SEQ ID NO: 1012079 - RNA, 19 nt, Mycobacterium avium subsp. paratuberculosis
acucgaucagcaccgccac

SEQ ID NO: 1012080 - RNA, 19 nt, Mycobacterium avium subsp. paratuberculosis
acucgauguagccgggcuc

SEQ ID NO: 1012081 - RNA, 15 nt, Mycobacterium avium subsp. paratuberculosis
acucgaucugcagcc

SEQ ID NO: 1012082 - RNA, 15 nt, Mycobacterium avium subsp. paratuberculosis
acucggccuucgccu

SEQ ID NO: 1012083 - RNA, 22 nt, Mycobacterium avium subsp. paratuberculosis
acuccgcucgggcccgcgcacc

SEQ ID NO: 1012084 - RNA, 12 nt, Mycobacterium avium subsp. paratuberculosis
acuccggcgccg

SEQ ID NO: 1012085 - RNA, 23 nt, Mycobacterium avium subsp. paratuberculosis
acuccggcgacacguccagcucu

SEQ ID NO: 1012086 - RNA, 13 nt, Mycobacterium avium subsp. paratuberculosis
acuccuggccccg

SEQ ID NO: 1012087 - RNA, 18 nt, Mycobacterium avium subsp. paratuberculosis
acuccucgguggccucgc

SEQ ID NO: 1012088 - RNA, 15 nt, Mycobacterium avium subsp. paratuberculosis
acuccucacaccucg

SEQ ID NO: 1012089 - RNA, 15 nt, Mycobacterium avium subsp. paratuberculosis
acuccuccucggcca

SEQ ID NO: 1012090 - RNA, 21 nt, Mycobacterium avium subsp. paratuberculosis
acuccuccucggccagcccca

SEQ ID NO: 1012091 - RNA, 19 nt, Mycobacterium avium subsp. paratuberculosis
acuacgagcagcaagagca

SEQ ID NO: 1012092 - RNA, 15 nt, Mycobacterium avium subsp. paratuberculosis
acguuggcggccagc

SEQ ID NO: 1012093 - RNA, 18 nt, Mycobacterium avium subsp. paratuberculosis
acgucucauaccagugcc

SEQ ID NO: 1012094 - RNA, 15 nt, Mycobacterium avium subsp. paratuberculosis
acgucgucguccucg

SEQ ID NO: 1012095 - RNA, 20 nt, Mycobacterium avium subsp. paratuberculosis
acgucggccgccagggccag

SEQ ID NO: 1012096 - RNA, 14 nt, Mycobacterium avium subsp. paratuberculosis
acgucggccggguc

SEQ ID NO: 1012097 - RNA, 15 nt, Mycobacterium avium subsp. paratuberculosis
acgucggccugcacg

SEQ ID NO: 1012098 - RNA, 24 nt, Mycobacterium avium subsp. paratuberculosis
acgucggggaugguuuccacugcc

SEQ ID NO: 1012099 - RNA, 15 nt, Mycobacterium avium subsp. paratuberculosis
acgugcccuuccccg

SEQ ID NO: 1012100 - RNA, 16 nt, Mycobacterium avium subsp. paratuberculosis
acgugccguugacgaa

SEQ ID NO: 1012101 - RNA, 18 nt, Mycobacterium avium subsp. paratuberculosis
acgucucgcgggaguggc

SEQ ID NO: 1012102 - RNA, 20 nt, Mycobacterium avium subsp. paratuberculosis
acgugccacuggcgccaccu

SEQ ID NO: 1012103 - RNA, 23 nt, Mycobacterium avium subsp. paratuberculosis
acguacccccgcacgccagcauc

SEQ ID NO: 1012104 - RNA, 15 nt, Mycobacterium avium subsp. paratuberculosis
acguccagcgccgcc

SEQ ID NO: 1012105 - RNA, 13 nt, Mycobacterium avium subsp. paratuberculosis
acgucccgcccgg

SEQ ID NO: 1012106 - RNA, 14 nt, Mycobacterium avium subsp. paratuberculosis
acgucccgcccggc

SEQ ID NO: 1012107 - RNA, 19 nt, Mycobacterium avium subsp. paratuberculosis
acguccaucgggaccgcgg

SEQ ID NO: 1012108 - RNA, 15 nt, Mycobacterium avium subsp. paratuberculosis
acgucccagcacaac

SEQ ID NO: 1012109 - RNA, 22 nt, Mycobacterium avium subsp. paratuberculosis
acgucgaccuugcagcccgcgu

SEQ ID NO: 1012110 - RNA, 15 nt, Mycobacterium avium subsp. paratuberculosis
acgucgacgcccugc

SEQ ID NO: 1012111 - RNA, 17 nt, Mycobacterium avium subsp. paratuberculosis
acgucgagcaccgcguc

SEQ ID NO: 1012112 - RNA, 17 nt, Mycobacterium avium subsp. paratuberculosis
acguccgggccgccucg

SEQ ID NO: 1012113 - RNA, 17 nt, Mycobacterium avium subsp. paratuberculosis
acguccgcggugagcac

SEQ ID NO: 1012114 - RNA, 22 nt, Mycobacterium avium subsp. paratuberculosis
acguccgcgucggcgccggcca

SEQ ID NO: 1012115 - RNA, 17 nt, Mycobacterium avium subsp. paratuberculosis
acguccuugacccggcc

SEQ ID NO: 1012116 - RNA, 16 nt, Mycobacterium avium subsp. paratuberculosis
acgucgccggccugcc

SEQ ID NO: 1012117 - RNA, 16 nt, Mycobacterium avium subsp. paratuberculosis
acgucgagcggcgccu

SEQ ID NO: 1012118 - RNA, 15 nt, Mycobacterium avium subsp. paratuberculosis
acgucgagggugaug

SEQ ID NO: 1012119 - RNA, 15 nt, Mycobacterium avium subsp. paratuberculosis
acggugaucaggguc

SEQ ID NO: 1012120 - RNA, 17 nt, Mycobacterium avium subsp. paratuberculosis
acggugauuccggcacc

SEQ ID NO: 1012121 - RNA, 12 nt, Mycobacterium avium subsp. paratuberculosis
acggugcagcag

SEQ ID NO: 1012122 - RNA, 18 nt, Mycobacterium avium subsp. paratuberculosis
acggugaacgggccgcac

SEQ ID NO: 1012123 - RNA, 23 nt, Mycobacterium avium subsp. paratuberculosis
acggugguggcgaacagcggguu

SEQ ID NO: 1012124 - RNA, 19 nt, Mycobacterium avium subsp. paratuberculosis
acggugcgugccagcagcu

SEQ ID NO: 1012125 - RNA, 16 nt, Mycobacterium avium subsp. paratuberculosis
acgguggccgccacca

SEQ ID NO: 1012126 - RNA, 18 nt, Mycobacterium avium subsp. paratuberculosis
acgguggcgggccgccgg

SEQ ID NO: 1012127 - RNA, 17 nt, Mycobacterium avium subsp. paratuberculosis
acggugcccgccgaucg

SEQ ID NO: 1012128 - RNA, 21 nt, Mycobacterium avium subsp. paratuberculosis
acggucacggccgccagcagc

SEQ ID NO: 1012129 - RNA, 22 nt, Mycobacterium avium subsp. paratuberculosis
acggucacggccgccagcagca

SEQ ID NO: 1012130 - RNA, 17 nt, Mycobacterium avium subsp. paratuberculosis
acgguccccgcgcccgc

SEQ ID NO: 1012131 - RNA, 16 nt, Mycobacterium avium subsp. paratuberculosis
acggucaggguguugu

SEQ ID NO: 1012132 - RNA, 19 nt, Mycobacterium avium subsp. paratuberculosis
acggucaugccgagccgcu

SEQ ID NO: 1012133 - RNA, 11 nt, Mycobacterium avium subsp. paratuberculosis
acggucggagc

SEQ ID NO: 1012134 - RNA, 19 nt, Mycobacterium avium subsp. paratuberculosis
acggucggccccgcgcauc

SEQ ID NO: 1012135 - RNA, 22 nt, Mycobacterium avium subsp. paratuberculosis
acggucugcaccgggaugacaa

SEQ ID NO: 1012136 - RNA, 17 nt, Mycobacterium avium subsp. paratuberculosis
acggucugccgggacag

SEQ ID NO: 1012137 - RNA, 14 nt, Mycobacterium avium subsp. paratuberculosis
acggucuggcuggu

SEQ ID NO: 1012138 - RNA, 15 nt, Mycobacterium avium subsp. paratuberculosis
acgguuugcccggcg

SEQ ID NO: 1012139 - RNA, 20 nt, Mycobacterium avium subsp. paratuberculosis
acgguuucggaguggaacag

SEQ ID NO: 1012140 - RNA, 18 nt, Mycobacterium avium subsp. paratuberculosis
acgguugccucggccagc

SEQ ID NO: 1012141 - RNA, 20 nt, Mycobacterium avium subsp. paratuberculosis
acgguguuguucaccggcgu

SEQ ID NO: 1012142 - RNA, 22 nt, Mycobacterium avium subsp. paratuberculosis
acgguguccgcggcgucgggua

SEQ ID NO: 1012143 - RNA, 22 nt, Mycobacterium avium subsp. paratuberculosis
acguaagccauggcggcccgcg

SEQ ID NO: 1012144 - RNA, 20 nt, Mycobacterium avium subsp. paratuberculosis
acggguugggcgccagcagc

SEQ ID NO: 1012145 - RNA, 17 nt, Mycobacterium avium subsp. paratuberculosis
acggguugggcggggcg

SEQ ID NO: 1012146 - RNA, 22 nt, Mycobacterium avium subsp. paratuberculosis
acggguugcaggccacgcccac

SEQ ID NO: 1012147 - RNA, 14 nt, Mycobacterium avium subsp. paratuberculosis
acggguugccgucg

SEQ ID NO: 1012148 - RNA, 18 nt, Mycobacterium avium subsp. paratuberculosis
acgggucguaggacacca

SEQ ID NO: 1012149 - RNA, 23 nt, Mycobacterium avium subsp. paratuberculosis
acgggucgggggugggcucccag

SEQ ID NO: 1012150 - RNA, 21 nt, Mycobacterium avium subsp. paratuberculosis
acgggucucagcgcccgcccg

SEQ ID NO: 1012151 - RNA, 21 nt, Mycobacterium avium subsp. paratuberculosis
acgggcguccgagaagggccg

SEQ ID NO: 1012152 - RNA, 21 nt, Mycobacterium avium subsp. paratuberculosis
acgggcguguagccugcggcc

SEQ ID NO: 1012153 - RNA, 19 nt, Mycobacterium avium subsp. paratuberculosis
acgggcucggcguacaggc

SEQ ID NO: 1012154 - RNA, 15 nt, Mycobacterium avium subsp. paratuberculosis
acgggcuggccaggc

SEQ ID NO: 1012155 - RNA, 19 nt, Mycobacterium avium subsp. paratuberculosis
acggcggcgucccagugcu

SEQ ID NO: 1012156 - RNA, 17 nt, Mycobacterium avium subsp. paratuberculosis
acgggccgcagccgcgc

SEQ ID NO: 1012157 - RNA, 20 nt, Mycobacterium avium subsp. paratuberculosis
acgggcgcagcgccgucucg

SEQ ID NO: 1012158 - RNA, 12 nt, Mycobacterium avium subsp. paratuberculosis
acgggccgggca

SEQ ID NO: 1012159 - RNA, 20 nt, Mycobacterium avium subsp. paratuberculosis
acggcggaccggcggccgcc

SEQ ID NO: 1012160 - RNA, 23 nt, Mycobacterium avium subsp. paratuberculosis
acggcggaccggcggccgccauc

SEQ ID NO: 1012161 - RNA, 20 nt, Mycobacterium avium subsp. paratuberculosis
acggcggcgaacgccgccgu

SEQ ID NO: 1012162 - RNA, 21 nt, Mycobacterium avium subsp. paratuberculosis
acggcggcagcgaggcgcgca

SEQ ID NO: 1012163 - RNA, 16 nt, Mycobacterium avium subsp. paratuberculosis
acggcggccgcggacc

SEQ ID NO: 1012164 - RNA, 13 nt, Mycobacterium avium subsp. paratuberculosis
acggcggcgcccu

SEQ ID NO: 1012165 - RNA, 13 nt, Mycobacterium avium subsp. paratuberculosis
acgcaaucgccca

SEQ ID NO: 1012166 - RNA, 16 nt, Mycobacterium avium subsp. paratuberculosis
acgcaaucgcccaguc

SEQ ID NO: 1012167 - RNA, 14 nt, Mycobacterium avium subsp. paratuberculosis
acgcaagaagucgg

SEQ ID NO: 1012168 - RNA, 23 nt, Mycobacterium avium subsp. paratuberculosis
acgcuggcgugacgcucgccggc

SEQ ID NO: 1012169 - RNA, 23 nt, Mycobacterium avium subsp. paratuberculosis
acgcuggcgugacgcucggccgu

SEQ ID NO: 1012170 - RNA, 20 nt, Mycobacterium avium subsp. paratuberculosis
acgcuggugacgugcaccug

SEQ ID NO: 1012171 - RNA, 14 nt, Mycobacterium avium subsp. paratuberculosis
acgcugugcucgac

SEQ ID NO: 1012172 - RNA, 21 nt, Mycobacterium avium subsp. paratuberculosis
acgcuuuuucgcgaacuucag

SEQ ID NO: 1012173 - RNA, 20 nt, Mycobacterium avium subsp. paratuberculosis
acgcuguuggaaccggccac

SEQ ID NO: 1012174 - RNA, 19 nt, Mycobacterium avium subsp. paratuberculosis
acggaaaccgcugcggcac

SEQ ID NO: 1012175 - RNA, 20 nt, Mycobacterium avium subsp. paratuberculosis
acggaaaccgcugcggcaca

SEQ ID NO: 1012176 - RNA, 23 nt, Mycobacterium avium subsp. paratuberculosis
acggaaaccgcugcggcacacca

SEQ ID NO: 1012177 - RNA, 20 nt, Mycobacterium avium subsp. paratuberculosis
acggaagcgguugagccaca

SEQ ID NO: 1012178 - RNA, 14 nt, Mycobacterium avium subsp. paratuberculosis
acggcaaccugggc

SEQ ID NO: 1012179 - RNA, 19 nt, Mycobacterium avium subsp. paratuberculosis
acggauguggucggccacg

SEQ ID NO: 1012180 - RNA, 20 nt, Mycobacterium avium subsp. paratuberculosis
acggaucgagucccgcgcgg

SEQ ID NO: 1012181 - RNA, 15 nt, Mycobacterium avium subsp. paratuberculosis
acggaucgcccaccc

SEQ ID NO: 1012182 - RNA, 13 nt, Mycobacterium avium subsp. paratuberculosis
acggccaccagca

SEQ ID NO: 1012183 - RNA, 16 nt, Mycobacterium avium subsp. paratuberculosis
acggccaccagcagcg

SEQ ID NO: 1012184 - RNA, 20 nt, Mycobacterium avium subsp. paratuberculosis
acggccagccagccgcccag

SEQ ID NO: 1012185 - RNA, 22 nt, Mycobacterium avium subsp. paratuberculosis
acggccagccagccgcccagca

SEQ ID NO: 1012186 - RNA, 18 nt, Mycobacterium avium subsp. paratuberculosis
acggccagcgccgucauc

SEQ ID NO: 1012187 - RNA, 20 nt, Mycobacterium avium subsp. paratuberculosis
acggccagcugauagccgcc

SEQ ID NO: 1012188 - RNA, 23 nt, Mycobacterium avium subsp. paratuberculosis
acggccagcugauagccgcccug

SEQ ID NO: 1012189 - RNA, 14 nt, Mycobacterium avium subsp. paratuberculosis
acggcgaggauggc

SEQ ID NO: 1012190 - RNA, 18 nt, Mycobacterium avium subsp. paratuberculosis
acggcgacgaccaccagg

SEQ ID NO: 1012191 - RNA, 18 nt, Mycobacterium avium subsp. paratuberculosis
acggcgacgaccgucauc

SEQ ID NO: 1012192 - RNA, 16 nt, Mycobacterium avium subsp. paratuberculosis
acggcgaccacaccgu

SEQ ID NO: 1012193 - RNA, 14 nt, Mycobacterium avium subsp. paratuberculosis
acggcgaauauuuc

SEQ ID NO: 1012194 - RNA, 21 nt, Mycobacterium avium subsp. paratuberculosis
acggccugguacagcaccgcc

SEQ ID NO: 1012195 - RNA, 22 nt, Mycobacterium avium subsp. paratuberculosis
acggccucgaucaucaccaccg

SEQ ID NO: 1012196 - RNA, 13 nt, Mycobacterium avium subsp. paratuberculosis
acggccugcacca

SEQ ID NO: 1012197 - RNA, 15 nt, Mycobacterium avium subsp. paratuberculosis
acggcccggucuugc

SEQ ID NO: 1012198 - RNA, 15 nt, Mycobacterium avium subsp. paratuberculosis
acggccgccagcagc

SEQ ID NO: 1012199 - RNA, 16 nt, Mycobacterium avium subsp. paratuberculosis
acggccgccagcagca

SEQ ID NO: 1012200 - RNA, 22 nt, Mycobacterium avium subsp. paratuberculosis
acggccgcgcagaucgccagca

SEQ ID NO: 1012201 - RNA, 20 nt, Mycobacterium avium subsp. paratuberculosis
acggccgcggcgcggcccgg

SEQ ID NO: 1012202 - RNA, 17 nt, Mycobacterium avium subsp. paratuberculosis
acggccgaaacgcccgg

SEQ ID NO: 1012203 - RNA, 20 nt, Mycobacterium avium subsp. paratuberculosis
acggccgaaacgcccggcuc

SEQ ID NO: 1012204 - RNA, 22 nt, Mycobacterium avium subsp. paratuberculosis
acggccgaugcaguuauccaca

SEQ ID NO: 1012205 - RNA, 17 nt, Mycobacterium avium subsp. paratuberculosis
acggccgcaccccaccc

SEQ ID NO: 1012206 - RNA, 20 nt, Mycobacterium avium subsp. paratuberculosis
acggccggggccagcaccca

SEQ ID NO: 1012207 - RNA, 23 nt, Mycobacterium avium subsp. paratuberculosis
acggccguacgcgguucgugcgc

SEQ ID NO: 1012208 - RNA, 17 nt, Mycobacterium avium subsp. paratuberculosis
acggccggcgccgccgg

SEQ ID NO: 1012209 - RNA, 17 nt, Mycobacterium avium subsp. paratuberculosis
acggccccagccgccgc

SEQ ID NO: 1012210 - RNA, 21 nt, Mycobacterium avium subsp. paratuberculosis
acggcccgccgccggcggcgu

SEQ ID NO: 1012211 - RNA, 15 nt, Mycobacterium avium subsp. paratuberculosis
acggcccaucaccag

SEQ ID NO: 1012212 - RNA, 15 nt, Mycobacterium avium subsp. paratuberculosis
acggccagcagggcg

SEQ ID NO: 1012213 - RNA, 23 nt, Mycobacterium avium subsp. paratuberculosis
aggaagaugccgaucaggcugga

SEQ ID NO: 1012214 - RNA, 22 nt, Mycobacterium avium subsp. paratuberculosis
aggaacgguuuuucccagcggc

SEQ ID NO: 1012215 - RNA, 16 nt, Mycobacterium avium subsp. paratuberculosis
aggaacucagcgccca

SEQ ID NO: 1012216 - RNA, 22 nt, Mycobacterium avium subsp. paratuberculosis
aggaacucagcgcccaggauga

SEQ ID NO: 1012217 - RNA, 23 nt, Mycobacterium avium subsp. paratuberculosis
aggaacucagcgcccaggaugac

SEQ ID NO: 1012218 - RNA, 16 nt, Mycobacterium avium subsp. paratuberculosis
aggaacuccagcagcu

SEQ ID NO: 1012219 - RNA, 18 nt, Mycobacterium avium subsp. paratuberculosis
aggaacuccagcagcugu

SEQ ID NO: 1012220 - RNA, 12 nt, Mycobacterium avium subsp. paratuberculosis
aggaacugcagc

SEQ ID NO: 1012221 - RNA, 18 nt, Mycobacterium avium subsp. paratuberculosis
aggaacugcagcgacugg

SEQ ID NO: 1012222 - RNA, 12 nt, Mycobacterium avium subsp. paratuberculosis
aggaaccgugcg

SEQ ID NO: 1012223 - RNA, 21 nt, Mycobacterium avium subsp. paratuberculosis
aggaaccacaccccggccacc

SEQ ID NO: 1012224 - RNA, 22 nt, Mycobacterium avium subsp. paratuberculosis
aggaaccacaccccggccacca

SEQ ID NO: 1012225 - RNA, 19 nt, Mycobacterium avium subsp. paratuberculosis
aggaacaccgagccggcgg

SEQ ID NO: 1012226 - RNA, 22 nt, Mycobacterium avium subsp. paratuberculosis
aggaacaccgagccggcggcgu

SEQ ID NO: 1012227 - RNA, 15 nt, Mycobacterium avium subsp. paratuberculosis
aggaacaaccgcagc

SEQ ID NO: 1012228 - RNA, 18 nt, Mycobacterium avium subsp. paratuberculosis
aggaaagcgucacaguga

SEQ ID NO: 1012229 - RNA, 22 nt, Mycobacterium avium subsp. paratuberculosis
aggaguuuuucgggguggugga

SEQ ID NO: 1012230 - RNA, 15 nt, Mycobacterium avium subsp. paratuberculosis
aggaggcacuggcgc

SEQ ID NO: 1012231 - RNA, 15 nt, Mycobacterium avium subsp. paratuberculosis
aggaggcggccaaca

SEQ ID NO: 1012232 - RNA, 17 nt, Mycobacterium avium subsp. paratuberculosis
aggauccaguuccagug

SEQ ID NO: 1012233 - RNA, 19 nt, Mycobacterium avium subsp. paratuberculosis
aggaucgcaggauggccug

SEQ ID NO: 1012234 - RNA, 22 nt, Mycobacterium avium subsp. paratuberculosis
aggagaacgucaggcccagcga

SEQ ID NO: 1012235 - RNA, 14 nt, Mycobacterium avium subsp. paratuberculosis
aggacuggcccacg

SEQ ID NO: 1012236 - RNA, 14 nt, Mycobacterium avium subsp. paratuberculosis
aggaccagguugga

SEQ ID NO: 1012237 - RNA, 24 nt, Mycobacterium avium subsp. paratuberculosis
aggaccggaugaaggacuggccca

SEQ ID NO: 1012238 - RNA, 18 nt, Mycobacterium avium subsp. paratuberculosis
aggacacguuggccagau

SEQ ID NO: 1012239 - RNA, 13 nt, Mycobacterium avium subsp. paratuberculosis
aggacaccccggc

SEQ ID NO: 1012240 - RNA, 22 nt, Mycobacterium avium subsp. paratuberculosis
aggacaccccggcgaugaccgg

SEQ ID NO: 1012241 - RNA, 23 nt, Mycobacterium avium subsp. paratuberculosis
aggaccuugucgggccgcgggcc

SEQ ID NO: 1012242 - RNA, 19 nt, Mycobacterium avium subsp. paratuberculosis
aggacgcgcccggcgacgc

SEQ ID NO: 1012243 - RNA, 18 nt, Mycobacterium avium subsp. paratuberculosis
aggacgguuucugccggc

SEQ ID NO: 1012244 - RNA, 15 nt, Mycobacterium avium subsp. paratuberculosis
aggacgucggccggc

SEQ ID NO: 1012245 - RNA, 21 nt, Mycobacterium avium subsp. paratuberculosis
aggacgucggccggcugcagc

SEQ ID NO: 1012246 - RNA, 22 nt, Mycobacterium avium subsp. paratuberculosis
aggcauuagcgcguguccagaa

SEQ ID NO: 1012247 - RNA, 20 nt, Mycobacterium avium subsp. paratuberculosis
aggcaugggaucagcagcac

SEQ ID NO: 1012248 - RNA, 13 nt, Mycobacterium avium subsp. paratuberculosis
aggccaacagcag

SEQ ID NO: 1012249 - RNA, 15 nt, Mycobacterium avium subsp. paratuberculosis
aggccaacagcagca

SEQ ID NO: 1012250 - RNA, 19 nt, Mycobacterium avium subsp. paratuberculosis
aggccaacgagcgcgccga

SEQ ID NO: 1012251 - RNA, 14 nt, Mycobacterium avium subsp. paratuberculosis
aggccaaggccagc

SEQ ID NO: 1012252 - RNA, 15 nt, Mycobacterium avium subsp. paratuberculosis
aggccaaggccagca

SEQ ID NO: 1012253 - RNA, 20 nt, Mycobacterium avium subsp. paratuberculosis
aggcaguucgaugccgggca

SEQ ID NO: 1012254 - RNA, 14 nt, Mycobacterium avium subsp. paratuberculosis
aggcagcccggcug

SEQ ID NO: 1012255 - RNA, 21 nt, Mycobacterium avium subsp. paratuberculosis
aggcagcgcacgaugugaugg

SEQ ID NO: 1012256 - RNA, 20 nt, Mycobacterium avium subsp. paratuberculosis
aggcaggccccuccagcugg

SEQ ID NO: 1012257 - RNA, 15 nt, Mycobacterium avium subsp. paratuberculosis
aggcaggccggcagc

SEQ ID NO: 1012258 - RNA, 19 nt, Mycobacterium avium subsp. paratuberculosis
aggcaggccggcagccggc

SEQ ID NO: 1012259 - RNA, 13 nt, Mycobacterium avium subsp. paratuberculosis
aggcaggcggcca

SEQ ID NO: 1012260 - RNA, 16 nt, Mycobacterium avium subsp. paratuberculosis
aggcaggcggccaggg

SEQ ID NO: 1012261 - RNA, 23 nt, Mycobacterium avium subsp. paratuberculosis
aggccagcaaccggaauggcagc

SEQ ID NO: 1012262 - RNA, 23 nt, Mycobacterium avium subsp. paratuberculosis
aggccagcaccuggcgcaccgcc

SEQ ID NO: 1012263 - RNA, 15 nt, Mycobacterium avium subsp. paratuberculosis
aggccagcacgcagg

SEQ ID NO: 1012264 - RNA, 15 nt, Mycobacterium avium subsp. paratuberculosis
aggccaucagcccgg

SEQ ID NO: 1012265 - RNA, 17 nt, Mycobacterium avium subsp. paratuberculosis
aggcccacguugagcac

SEQ ID NO: 1012266 - RNA, 18 nt, Mycobacterium avium subsp. paratuberculosis
aggcccacguugagcacg

SEQ ID NO: 1012267 - RNA, 20 nt, Mycobacterium avium subsp. paratuberculosis
aggccaggugcacgccgagc

SEQ ID NO: 1012268 - RNA, 21 nt, Mycobacterium avium subsp. paratuberculosis
aggccaggugcacgccgagca

SEQ ID NO: 1012269 - RNA, 15 nt, Mycobacterium avium subsp. paratuberculosis
aggccagcugcaccg

SEQ ID NO: 1012270 - RNA, 15 nt, Mycobacterium avium subsp. paratuberculosis
aggccagggcccgca

SEQ ID NO: 1012271 - RNA, 18 nt, Mycobacterium avium subsp. paratuberculosis
aggccagggcccgcagcc

SEQ ID NO: 1012272 - RNA, 10 nt, Mycobacterium avium subsp. paratuberculosis
aggccaggcg

SEQ ID NO: 1012273 - RNA, 19 nt, Mycobacterium avium subsp. paratuberculosis
aggcccgcaagaugugggc

SEQ ID NO: 1012274 - RNA, 21 nt, Mycobacterium avium subsp. paratuberculosis
aggccccgccagauagggcag

SEQ ID NO: 1012275 - RNA, 22 nt, Mycobacterium avium subsp. paratuberculosis
aggccccguucgguggccaccg

SEQ ID NO: 1012276 - RNA, 17 nt, Mycobacterium avium subsp. paratuberculosis
aggcccggacggccacc

SEQ ID NO: 1012277 - RNA, 15 nt, Mycobacterium avium subsp. paratuberculosis
aggcccggcagccgg

SEQ ID NO: 1012278 - RNA, 23 nt, Mycobacterium avium subsp. paratuberculosis
aggccccggauccgucgccccgc

SEQ ID NO: 1012279 - RNA, 12 nt, Mycobacterium avium subsp. paratuberculosis
aggccccggcgc

SEQ ID NO: 1012280 - RNA, 16 nt, Mycobacterium avium subsp. paratuberculosis
aggccccggcgcgcgu

SEQ ID NO: 1012281 - RNA, 18 nt, Mycobacterium avium subsp. paratuberculosis
aggcccaguccugcagcu

SEQ ID NO: 1012282 - RNA, 13 nt, Mycobacterium avium subsp. paratuberculosis
aggcccagcagca

SEQ ID NO: 1012283 - RNA, 18 nt, Mycobacterium avium subsp. paratuberculosis
aggcccagcagcaccgcg

SEQ ID NO: 1012284 - RNA, 15 nt, Mycobacterium avium subsp. paratuberculosis
aggcccugcugcagc

SEQ ID NO: 1012285 - RNA, 21 nt, Mycobacterium avium subsp. paratuberculosis
aggcccggcgugggccgcagc

SEQ ID NO: 1012286 - RNA, 21 nt, Mycobacterium avium subsp. paratuberculosis
aggcccucggccagccaggcc

SEQ ID NO: 1012287 - RNA, 19 nt, Mycobacterium avium subsp. paratuberculosis
aggccgacagguagcaggc

SEQ ID NO: 1012288 - RNA, 16 nt, Mycobacterium avium subsp. paratuberculosis
aggccgaggcgaguga

SEQ ID NO: 1012289 - RNA, 13 nt, Mycobacterium avium subsp. paratuberculosis
aggcacacgaaca

SEQ ID NO: 1012290 - RNA, 19 nt, Mycobacterium avium subsp. paratuberculosis
aggcacccgcugcaccagc

SEQ ID NO: 1012291 - RNA, 23 nt, Mycobacterium avium subsp. paratuberculosis
aggcaccgaacgccagcagcugc

SEQ ID NO: 1012292 - RNA, 15 nt, Mycobacterium avium subsp. paratuberculosis
aggcacagcagggca

SEQ ID NO: 1012293 - RNA, 22 nt, Mycobacterium avium subsp. paratuberculosis
aggcagacccccagcagcgggg

SEQ ID NO: 1012294 - RNA, 19 nt, Mycobacterium avium subsp. paratuberculosis
aggauuccgucggcggccg

SEQ ID NO: 1012295 - RNA, 21 nt, Mycobacterium avium subsp. paratuberculosis
aggaucugcagcacgcccaga

SEQ ID NO: 1012296 - RNA, 19 nt, Mycobacterium avium subsp. paratuberculosis
aggaucugcucggcgucgc

SEQ ID NO: 1012297 - RNA, 21 nt, Mycobacterium avium subsp. paratuberculosis
aggaucucccggguggccucc

SEQ ID NO: 1012298 - RNA, 19 nt, Mycobacterium avium subsp. paratuberculosis
aggaucuugucggcggccu

SEQ ID NO: 1012299 - RNA, 19 nt, Mycobacterium avium subsp. paratuberculosis
aggauguucaccccggcgc

SEQ ID NO: 1012300 - RNA, 12 nt, Mycobacterium avium subsp. paratuberculosis
aggauggugaaa

SEQ ID NO: 1012301 - RNA, 21 nt, Mycobacterium avium subsp. paratuberculosis
aggaugccgcccaccaccggc

SEQ ID NO: 1012302 - RNA, 15 nt, Mycobacterium avium subsp. paratuberculosis
aggaugcagccggcc

SEQ ID NO: 1012303 - RNA, 17 nt, Mycobacterium avium subsp. paratuberculosis
aggaugagcugggcggc

SEQ ID NO: 1012304 - RNA, 19 nt, Mycobacterium avium subsp. paratuberculosis
aggaugagcugggcggcgc

SEQ ID NO: 1012305 - RNA, 18 nt, Mycobacterium avium subsp. paratuberculosis
aggaugcccagcaccacu

SEQ ID NO: 1012306 - RNA, 17 nt, Mycobacterium avium subsp. paratuberculosis
aggaugcccaggaugau

SEQ ID NO: 1012307 - RNA, 21 nt, Mycobacterium avium subsp. paratuberculosis
agcuugauguugccgugcugg

SEQ ID NO: 1012308 - RNA, 16 nt, Mycobacterium avium subsp. paratuberculosis
agcuuguccugcaccg

SEQ ID NO: 1012309 - RNA, 17 nt, Mycobacterium avium subsp. paratuberculosis
agcuugggagacuucca

SEQ ID NO: 1012310 - RNA, 15 nt, Mycobacterium avium subsp. paratuberculosis
agcuuggcgcagccg

SEQ ID NO: 1012311 - RNA, 14 nt, Mycobacterium avium subsp. paratuberculosis
agcuuggcgcccuu

SEQ ID NO: 1012312 - RNA, 17 nt, Mycobacterium avium subsp. paratuberculosis
agcuuggcgcccuugcc

SEQ ID NO: 1012313 - RNA, 14 nt, Mycobacterium avium subsp. paratuberculosis
agcuucacgcucgg

SEQ ID NO: 1012314 - RNA, 21 nt, Mycobacterium avium subsp. paratuberculosis
agcuucacguucggcgaguga

SEQ ID NO: 1012315 - RNA, 16 nt, Mycobacterium avium subsp. paratuberculosis
agcuucggcgccgagc

SEQ ID NO: 1012316 - RNA, 13 nt, Mycobacterium avium subsp. paratuberculosis
agcuucccggcgg

SEQ ID NO: 1012317 - RNA, 13 nt, Mycobacterium avium subsp. paratuberculosis
agcuucccuugcc

SEQ ID NO: 1012318 - RNA, 21 nt, Mycobacterium avium subsp. paratuberculosis
agcuugacgucggucagcauc

SEQ ID NO: 1012319 - RNA, 18 nt, Mycobacterium avium subsp. paratuberculosis
agcuucugcccggccagc

SEQ ID NO: 1012320 - RNA, 19 nt, Mycobacterium avium subsp. paratuberculosis
agcuucugcccggccagca

SEQ ID NO: 1012321 - RNA, 15 nt, Mycobacterium avium subsp. paratuberculosis
agcugguuucggguc

SEQ ID NO: 1012322 - RNA, 20 nt, Mycobacterium avium subsp. paratuberculosis
agcuggucccacagcggggu

SEQ ID NO: 1012323 - RNA, 16 nt, Mycobacterium avium subsp. paratuberculosis
agcugguccggccggc

SEQ ID NO: 1012324 - RNA, 22 nt, Mycobacterium avium subsp. paratuberculosis
agcuggucgccaaacugcgcaa

SEQ ID NO: 1012325 - RNA, 22 nt, Mycobacterium avium subsp. paratuberculosis
agcugguggugaucggccaggc

SEQ ID NO: 1012326 - RNA, 21 nt, Mycobacterium avium subsp. paratuberculosis
agcugguugagugugaagacc

SEQ ID NO: 1012327 - RNA, 18 nt, Mycobacterium avium subsp. paratuberculosis
agcugcuucgucgccggg

SEQ ID NO: 1012328 - RNA, 16 nt, Mycobacterium avium subsp. paratuberculosis
agcugcgcccacgugc

SEQ ID NO: 1012329 - RNA, 23 nt, Mycobacterium avium subsp. paratuberculosis
agcugcgcgccggcggccgccgc

SEQ ID NO: 1012330 - RNA, 17 nt, Mycobacterium avium subsp. paratuberculosis
agcugcgcgccccggcc

SEQ ID NO: 1012331 - RNA, 19 nt, Mycobacterium avium subsp. paratuberculosis
agcugcgcgccccggcccg

SEQ ID NO: 1012332 - RNA, 22 nt, Mycobacterium avium subsp. paratuberculosis
agcugcgcgccccggcccggcg

SEQ ID NO: 1012333 - RNA, 17 nt, Mycobacterium avium subsp. paratuberculosis
agcuggauggcgcccag

SEQ ID NO: 1012334 - RNA, 18 nt, Mycobacterium avium subsp. paratuberculosis
agcuggagaggcccggca

SEQ ID NO: 1012335 - RNA, 20 nt, Mycobacterium avium subsp. paratuberculosis
agcuggaaauaggccgggca

SEQ ID NO: 1012336 - RNA, 18 nt, Mycobacterium avium subsp. paratuberculosis
agcugguagaugguggcc

SEQ ID NO: 1012337 - RNA, 13 nt, Mycobacterium avium subsp. paratuberculosis
agcugggcagcca

SEQ ID NO: 1012338 - RNA, 12 nt, Mycobacterium avium subsp. paratuberculosis
agcugggccagc

SEQ ID NO: 1012339 - RNA, 23 nt, Mycobacterium avium subsp. paratuberculosis
agcugggccccuccagccgccgg

SEQ ID NO: 1012340 - RNA, 15 nt, Mycobacterium avium subsp. paratuberculosis
agcugggcgcccaga

SEQ ID NO: 1012341 - RNA, 16 nt, Mycobacterium avium subsp. paratuberculosis
agcugggcggcgcgcu

SEQ ID NO: 1012342 - RNA, 16 nt, Mycobacterium avium subsp. paratuberculosis
agcugaaguucaccac

SEQ ID NO: 1012343 - RNA, 16 nt, Mycobacterium avium subsp. paratuberculosis
agcugcccgucggagg

SEQ ID NO: 1012344 - RNA, 11 nt, Mycobacterium avium subsp. paratuberculosis
agcugccccuu

SEQ ID NO: 1012345 - RNA, 20 nt, Mycobacterium avium subsp. paratuberculosis
agcugccggcgaccagcccc

SEQ ID NO: 1012346 - RNA, 22 nt, Mycobacterium avium subsp. paratuberculosis
agcugccggcgaccagccccuc

SEQ ID NO: 1012347 - RNA, 14 nt, Mycobacterium avium subsp. paratuberculosis
agcugccggcggcc

SEQ ID NO: 1012348 - RNA, 19 nt, Mycobacterium avium subsp. paratuberculosis
agcugccggcggccgccgg

SEQ ID NO: 1012349 - RNA, 21 nt, Mycobacterium avium subsp. paratuberculosis
agcugccggcggccgccggca

SEQ ID NO: 1012350 - RNA, 14 nt, Mycobacterium avium subsp. paratuberculosis
agcugcacgggcgu

SEQ ID NO: 1012351 - RNA, 22 nt, Mycobacterium avium subsp. paratuberculosis
agcugcagcuccucggcggccu

SEQ ID NO: 1012352 - RNA, 21 nt, Mycobacterium avium subsp. paratuberculosis
agcucaucaccggcgcgccgu

SEQ ID NO: 1012353 - RNA, 19 nt, Mycobacterium avium subsp. paratuberculosis
agcucguugccggcggcca

SEQ ID NO: 1012354 - RNA, 21 nt, Mycobacterium avium subsp. paratuberculosis
agcucguugugaauccagccg

SEQ ID NO: 1012355 - RNA, 16 nt, Mycobacterium avium subsp. paratuberculosis
agcucaccggccaggg

SEQ ID NO: 1012356 - RNA, 21 nt, Mycobacterium avium subsp. paratuberculosis
agcucaccggccagggccgcc

SEQ ID NO: 1012357 - RNA, 13 nt, Mycobacterium avium subsp. paratuberculosis
agcucaccgggcu

SEQ ID NO: 1012358 - RNA, 21 nt, Mycobacterium avium subsp. paratuberculosis
agcucaccgggcucggucacc

SEQ ID NO: 1012359 - RNA, 14 nt, Mycobacterium avium subsp. paratuberculosis
agcucaccgccgau

SEQ ID NO: 1012360 - RNA, 19 nt, Mycobacterium avium subsp. paratuberculosis
agcucaggccggccuugcu

SEQ ID NO: 1012361 - RNA, 17 nt, Mycobacterium avium subsp. paratuberculosis
agcucagcugcugcgcg

SEQ ID NO: 1012362 - RNA, 18 nt, Mycobacterium avium subsp. paratuberculosis
agcgcucgucgucggaga

SEQ ID NO: 1012363 - RNA, 19 nt, Mycobacterium avium subsp. paratuberculosis
agcgcggugaugugcagga

SEQ ID NO: 1012364 - RNA, 18 nt, Mycobacterium avium subsp. paratuberculosis
agcgcggggucggccagu

SEQ ID NO: 1012365 - RNA, 22 nt, Mycobacterium avium subsp. paratuberculosis
agcgcggucgccaccaccagcg

SEQ ID NO: 1012366 - RNA, 15 nt, Mycobacterium avium subsp. paratuberculosis
agcgcggucucgauc

SEQ ID NO: 1012367 - RNA, 22 nt, Mycobacterium avium subsp. paratuberculosis
agcgcggucucgaucugcacca

SEQ ID NO: 1012368 - RNA, 19 nt, Mycobacterium avium subsp. paratuberculosis
agcgcggcgaucagcagca

SEQ ID NO: 1012369 - RNA, 21 nt, Mycobacterium avium subsp. paratuberculosis
agcgcggcgaucucggcggcc

SEQ ID NO: 1012370 - RNA, 20 nt, Mycobacterium avium subsp. paratuberculosis
agcgcggcgaugaccgccug

SEQ ID NO: 1012371 - RNA, 16 nt, Mycobacterium avium subsp. paratuberculosis
agcgcggcggagguca

SEQ ID NO: 1012372 - RNA, 13 nt, Mycobacterium avium subsp. paratuberculosis
agcgcggcggcca

SEQ ID NO: 1012373 - RNA, 19 nt, Mycobacterium avium subsp. paratuberculosis
agcgcggcguucagcagcg

SEQ ID NO: 1012374 - RNA, 17 nt, Mycobacterium avium subsp. paratuberculosis
agcgcgggcagcccagg

SEQ ID NO: 1012375 - RNA, 16 nt, Mycobacterium avium subsp. paratuberculosis
agcgcgggccagcagu

SEQ ID NO: 1012376 - RNA, 18 nt, Mycobacterium avium subsp. paratuberculosis
agcgcggcaugccgcccg

SEQ ID NO: 1012377 - RNA, 14 nt, Mycobacterium avium subsp. paratuberculosis
agcgcggccgggcg

SEQ ID NO: 1012378 - RNA, 19 nt, Mycobacterium avium subsp. paratuberculosis
agcgcggccgggcgccccg

SEQ ID NO: 1012379 - RNA, 13 nt, Mycobacterium avium subsp. paratuberculosis
agcgcggccggaa

SEQ ID NO: 1012380 - RNA, 12 nt, Mycobacterium avium subsp. paratuberculosis
agcgcggccaca

SEQ ID NO: 1012381 - RNA, 23 nt, Mycobacterium avium subsp. paratuberculosis
agcgcggccaccaccacggccau

SEQ ID NO: 1012382 - RNA, 13 nt, Mycobacterium avium subsp. paratuberculosis
agcgcgcggguga

SEQ ID NO: 1012383 - RNA, 17 nt, Mycobacterium avium subsp. paratuberculosis
agcgcgcggugaugacc

SEQ ID NO: 1012384 - RNA, 16 nt, Mycobacterium avium subsp. paratuberculosis
agcgcgcgagacaccu

SEQ ID NO: 1012385 - RNA, 21 nt, Mycobacterium avium subsp. paratuberculosis
agcgcgccggccagcagcagg

SEQ ID NO: 1012386 - RNA, 16 nt, Mycobacterium avium subsp. paratuberculosis
agcgcgccgcccagcg

SEQ ID NO: 1012387 - RNA, 13 nt, Mycobacterium avium subsp. paratuberculosis
agcgcgccgaaca

SEQ ID NO: 1012388 - RNA, 16 nt, Mycobacterium avium subsp. paratuberculosis
agcgcgccgaccacgg

SEQ ID NO: 1012389 - RNA, 20 nt, Mycobacterium avium subsp. paratuberculosis
agcgcgccccagugcaggca

SEQ ID NO: 1012390 - RNA, 19 nt, Mycobacterium avium subsp. paratuberculosis
agcgcgaugccggccaggc

SEQ ID NO: 1012391 - RNA, 19 nt, Mycobacterium avium subsp. paratuberculosis
agcgcgauccggggggcgg

SEQ ID NO: 1012392 - RNA, 19 nt, Mycobacterium avium subsp. paratuberculosis
agcggacgacggccagcug

SEQ ID NO: 1012393 - RNA, 15 nt, Mycobacterium avium subsp. paratuberculosis
agcggcaucgaggac

SEQ ID NO: 1012394 - RNA, 20 nt, Mycobacterium avium subsp. paratuberculosis
agcggcaucgaggaccggcg

SEQ ID NO: 1012395 - RNA, 17 nt, Mycobacterium avium subsp. paratuberculosis
agcggcgacagcggccu

SEQ ID NO: 1012396 - RNA, 22 nt, Mycobacterium avium subsp. paratuberculosis
agcggcgaaaucggugaagccg

SEQ ID NO: 1012397 - RNA, 23 nt, Mycobacterium avium subsp. paratuberculosis
agcggccuaacgaguaggcggcu

SEQ ID NO: 1012398 - RNA, 13 nt, Mycobacterium avium subsp. paratuberculosis
agcggcgccaccg

SEQ ID NO: 1012399 - RNA, 19 nt, Mycobacterium avium subsp. paratuberculosis
agcggcgccacguggucga

SEQ ID NO: 1012400 - RNA, 13 nt, Mycobacterium avium subsp. paratuberculosis
agcggccacaccg

SEQ ID NO: 1012401 - RNA, 20 nt, Mycobacterium avium subsp. paratuberculosis
agcggcccaacacgcccugc

SEQ ID NO: 1012402 - RNA, 21 nt, Mycobacterium avium subsp. paratuberculosis
agcggcccaacacgcccugca

SEQ ID NO: 1012403 - RNA, 22 nt, Mycobacterium avium subsp. paratuberculosis
agcggccgaucauggucggcga

SEQ ID NO: 1012404 - RNA, 17 nt, Mycobacterium avium subsp. paratuberculosis
agcggccggaacagcug

SEQ ID NO: 1012405 - RNA, 18 nt, Mycobacterium avium subsp. paratuberculosis
agcggcugacccgcccgg

SEQ ID NO: 1012406 - RNA, 18 nt, Mycobacterium avium subsp. paratuberculosis
agcggcugcagcagaugc

SEQ ID NO: 1012407 - RNA, 16 nt, Mycobacterium avium subsp. paratuberculosis
agcggcucgccaccuc

SEQ ID NO: 1012408 - RNA, 21 nt, Mycobacterium avium subsp. paratuberculosis
agcggcucgccaccucggaga

SEQ ID NO: 1012409 - RNA, 21 nt, Mycobacterium avium subsp. paratuberculosis
agcggcugcugcagcgcccgg

SEQ ID NO: 1012410 - RNA, 17 nt, Mycobacterium avium subsp. paratuberculosis
agcgggagccggccagg

SEQ ID NO: 1012411 - RNA, 18 nt, Mycobacterium avium subsp. paratuberculosis
agcgggauguacuugaug

SEQ ID NO: 1012412 - RNA, 14 nt, Mycobacterium avium subsp. paratuberculosis
agcggcgggcccag

SEQ ID NO: 1012413 - RNA, 19 nt, Mycobacterium avium subsp. paratuberculosis
agcggcgggcccagcagau

SEQ ID NO: 1012414 - RNA, 19 nt, Mycobacterium avium subsp. paratuberculosis
agcggcgcgguuucggcgu

SEQ ID NO: 1012415 - RNA, 23 nt, Mycobacterium avium subsp. paratuberculosis
agcggcgcgucgcugggcagccg

SEQ ID NO: 1012416 - RNA, 18 nt, Mycobacterium avium subsp. paratuberculosis
agcggcgcugcagcagcc

SEQ ID NO: 1012417 - RNA, 16 nt, Mycobacterium avium subsp. paratuberculosis
agcggcgcgccgggca

SEQ ID NO: 1012418 - RNA, 22 nt, Mycobacterium avium subsp. paratuberculosis
agcggcgccuggucaaggugcu

SEQ ID NO: 1012419 - RNA, 12 nt, Mycobacterium avium subsp. paratuberculosis
agcggcggccuu

SEQ ID NO: 1012420 - RNA, 19 nt, Mycobacterium avium subsp. paratuberculosis
agcggcgacuccagcagcg

SEQ ID NO: 1012421 - RNA, 18 nt, Mycobacterium avium subsp. paratuberculosis
agcggucacggacaggug

SEQ ID NO: 1012422 - RNA, 23 nt, Mycobacterium avium subsp. paratuberculosis
agcggggcgcgcaggcgcaccac

SEQ ID NO: 1012423 - RNA, 21 nt, Mycobacterium avium subsp. paratuberculosis
agcggggcgcuguccuggucg

SEQ ID NO: 1012424 - RNA, 15 nt, Mycobacterium avium subsp. paratuberculosis
agcgggcccgggcug

SEQ ID NO: 1012425 - RNA, 12 nt, Mycobacterium avium subsp. paratuberculosis
agcgggccagga

SEQ ID NO: 1012426 - RNA, 22 nt, Mycobacterium avium subsp. paratuberculosis
agcgggccaggauguucacccc

SEQ ID NO: 1012427 - RNA, 15 nt, Mycobacterium avium subsp. paratuberculosis
agcggucgugcggga

SEQ ID NO: 1012428 - RNA, 18 nt, Mycobacterium avium subsp. paratuberculosis
agcggugacaucgccacc

SEQ ID NO: 1012429 - RNA, 17 nt, Mycobacterium avium subsp. paratuberculosis
agcggugaccucgagca

SEQ ID NO: 1012430 - RNA, 13 nt, Mycobacterium avium subsp. paratuberculosis
agcggugcagccc

SEQ ID NO: 1012431 - RNA, 14 nt, Mycobacterium avium subsp. paratuberculosis
agcgguggccacgc

SEQ ID NO: 1012432 - RNA, 15 nt, Mycobacterium avium subsp. paratuberculosis
agcgucugcgccccg

SEQ ID NO: 1012433 - RNA, 21 nt, Mycobacterium avium subsp. paratuberculosis
agcgucucgccggggaacacc

SEQ ID NO: 1012434 - RNA, 20 nt, Mycobacterium avium subsp. paratuberculosis
agcgucuggcagccggccgg

SEQ ID NO: 1012435 - RNA, 14 nt, Mycobacterium avium subsp. paratuberculosis
agcgugcgcccgac

SEQ ID NO: 1012436 - RNA, 18 nt, Mycobacterium avium subsp. paratuberculosis
agcguggccggcagguug

SEQ ID NO: 1012437 - RNA, 13 nt, Mycobacterium avium subsp. paratuberculosis
agcgugggcaccg

SEQ ID NO: 1012438 - RNA, 23 nt, Mycobacterium avium subsp. paratuberculosis
agcguggcgcgccccggcccguc

SEQ ID NO: 1012439 - RNA, 17 nt, Mycobacterium avium subsp. paratuberculosis
agcgucuccggcgggcu

SEQ ID NO: 1012440 - RNA, 20 nt, Mycobacterium avium subsp. paratuberculosis
agcgucgugcgggcuccgca

SEQ ID NO: 1012441 - RNA, 13 nt, Mycobacterium avium subsp. paratuberculosis
agcuaucagcucg

SEQ ID NO: 1012442 - RNA, 18 nt, Mycobacterium avium subsp. paratuberculosis
agcguucacgucgaucac

SEQ ID NO: 1012443 - RNA, 16 nt, Mycobacterium avium subsp. paratuberculosis
agcguuccggcggccg

SEQ ID NO: 1012444 - RNA, 17 nt, Mycobacterium avium subsp. paratuberculosis
agcgugucgccggggcg

SEQ ID NO: 1012445 - RNA, 16 nt, Mycobacterium avium subsp. paratuberculosis
agcgugugcaccugag

SEQ ID NO: 1012446 - RNA, 22 nt, Mycobacterium avium subsp. paratuberculosis
agcguggucucguugugcaccg

SEQ ID NO: 1012447 - RNA, 13 nt, Mycobacterium avium subsp. paratuberculosis
agggaaaggcagc

SEQ ID NO: 1012448 - RNA, 15 nt, Mycobacterium avium subsp. paratuberculosis
agggaaaggcagcag

SEQ ID NO: 1012449 - RNA, 17 nt, Mycobacterium avium subsp. paratuberculosis
agggaaaggcagcagcc

SEQ ID NO: 1012450 - RNA, 21 nt, Mycobacterium avium subsp. paratuberculosis
agggacauccgugagggaccu

SEQ ID NO: 1012451 - RNA, 20 nt, Mycobacterium avium subsp. paratuberculosis
agggacaugccgagcagcac

SEQ ID NO: 1012452 - RNA, 22 nt, Mycobacterium avium subsp. paratuberculosis
agggagcacucgauggcggcga

SEQ ID NO: 1012453 - RNA, 16 nt, Mycobacterium avium subsp. paratuberculosis
agggagccgacgaaga

SEQ ID NO: 1012454 - RNA, 17 nt, Mycobacterium avium subsp. paratuberculosis
agggacugcgccggggc

SEQ ID NO: 1012455 - RNA, 19 nt, Mycobacterium avium subsp. paratuberculosis
agggacugcgccggggccg

SEQ ID NO: 1012456 - RNA, 14 nt, Mycobacterium avium subsp. paratuberculosis
agggaggacagcac

SEQ ID NO: 1012457 - RNA, 17 nt, Mycobacterium avium subsp. paratuberculosis
agggaggacagcaccgc

SEQ ID NO: 1012458 - RNA, 11 nt, Mycobacterium avium subsp. paratuberculosis
aggcuuggccc

SEQ ID NO: 1012459 - RNA, 20 nt, Mycobacterium avium subsp. paratuberculosis
aggcugccgcugcgccggcg

SEQ ID NO: 1012460 - RNA, 23 nt, Mycobacterium avium subsp. paratuberculosis
aggcugcccucuuccucgcuguc

SEQ ID NO: 1012461 - RNA, 16 nt, Mycobacterium avium subsp. paratuberculosis
aggcugcucggcgggc

SEQ ID NO: 1012462 - RNA, 13 nt, Mycobacterium avium subsp. paratuberculosis
aggcuggaguagg

SEQ ID NO: 1012463 - RNA, 12 nt, Mycobacterium avium subsp. paratuberculosis
aggcuggguugc

SEQ ID NO: 1012464 - RNA, 12 nt, Mycobacterium avium subsp. paratuberculosis
aggcuggucugg

SEQ ID NO: 1012465 - RNA, 16 nt, Mycobacterium avium subsp. paratuberculosis
aggcuggucugguggg

SEQ ID NO: 1012466 - RNA, 16 nt, Mycobacterium avium subsp. paratuberculosis
aggggcagaccaggac

SEQ ID NO: 1012467 - RNA, 17 nt, Mycobacterium avium subsp. paratuberculosis
agggcuccgcgcugacc

SEQ ID NO: 1012468 - RNA, 20 nt, Mycobacterium avium subsp. paratuberculosis
agggcucgcaaccgucuugg

SEQ ID NO: 1012469 - RNA, 19 nt, Mycobacterium avium subsp. paratuberculosis
agggcucgugcagccggcg

SEQ ID NO: 1012470 - RNA, 17 nt, Mycobacterium avium subsp. paratuberculosis
agggcguuugccacuga

SEQ ID NO: 1012471 - RNA, 23 nt, Mycobacterium avium subsp. paratuberculosis
agggcguuugccacugagcgcag

SEQ ID NO: 1012472 - RNA, 21 nt, Mycobacterium avium subsp. paratuberculosis
agggcguguugcaggcggacc

SEQ ID NO: 1012473 - RNA, 12 nt, Mycobacterium avium subsp. paratuberculosis
agggcggggcag

SEQ ID NO: 1012474 - RNA, 12 nt, Mycobacterium avium subsp. paratuberculosis
aggggccgggcu

SEQ ID NO: 1012475 - RNA, 19 nt, Mycobacterium avium subsp. paratuberculosis
aggggcagggcauccggga

SEQ ID NO: 1012476 - RNA, 22 nt, Mycobacterium avium subsp. paratuberculosis
agggggucaucagugaccgcac

SEQ ID NO: 1012477 - RNA, 16 nt, Mycobacterium avium subsp. paratuberculosis
agggccuccaccacca

SEQ ID NO: 1012478 - RNA, 19 nt, Mycobacterium avium subsp. paratuberculosis
agggcgacauguccgggau

SEQ ID NO: 1012479 - RNA, 21 nt, Mycobacterium avium subsp. paratuberculosis
agggcgcggcguagccgccgg

SEQ ID NO: 1012480 - RNA, 13 nt, Mycobacterium avium subsp. paratuberculosis
agggcggcgaccu

SEQ ID NO: 1012481 - RNA, 22 nt, Mycobacterium avium subsp. paratuberculosis
agggcggguaggcgccgaugcc

SEQ ID NO: 1012482 - RNA, 13 nt, Mycobacterium avium subsp. paratuberculosis
agggcggcaccga

SEQ ID NO: 1012483 - RNA, 22 nt, Mycobacterium avium subsp. paratuberculosis
agggcgauggccauggccagga

SEQ ID NO: 1012484 - RNA, 23 nt, Mycobacterium avium subsp. paratuberculosis
agggcgaucaccgcggccaccug

SEQ ID NO: 1012485 - RNA, 17 nt, Mycobacterium avium subsp. paratuberculosis
agggcgcggcgcaccga

SEQ ID NO: 1012486 - RNA, 12 nt, Mycobacterium avium subsp. paratuberculosis
agggcagccaca

SEQ ID NO: 1012487 - RNA, 13 nt, Mycobacterium avium subsp. paratuberculosis
agggcagccagcc

SEQ ID NO: 1012488 - RNA, 23 nt, Mycobacterium avium subsp. paratuberculosis
agggcaccgacggccgcacccca

SEQ ID NO: 1012489 - RNA, 23 nt, Mycobacterium avium subsp. paratuberculosis
agggcaaccgcagcaucuuggcc

SEQ ID NO: 1012490 - RNA, 17 nt, Mycobacterium avium subsp. paratuberculosis
agggcccgggcaggcau

SEQ ID NO: 1012491 - RNA, 14 nt, Mycobacterium avium subsp. paratuberculosis
agggccgcagcgca

SEQ ID NO: 1012492 - RNA, 14 nt, Mycobacterium avium subsp. paratuberculosis
agggccaccggcuc

SEQ ID NO: 1012493 - RNA, 13 nt, Mycobacterium avium subsp. paratuberculosis
agggccaccacgc

SEQ ID NO: 1012494 - RNA, 17 nt, Mycobacterium avium subsp. paratuberculosis
agggccagcaacaccag

SEQ ID NO: 1012495 - RNA, 22 nt, Mycobacterium avium subsp. paratuberculosis
agggccagcaacaccagcugga

SEQ ID NO: 1012496 - RNA, 20 nt, Mycobacterium avium subsp. paratuberculosis
agggccagggcuuugcccug

SEQ ID NO: 1012497 - RNA, 17 nt, Mycobacterium avium subsp. paratuberculosis
aggcgaccaugcccagc

SEQ ID NO: 1012498 - RNA, 18 nt, Mycobacterium avium subsp. paratuberculosis
aggcgaccaugcccagca

SEQ ID NO: 1012499 - RNA, 15 nt, Mycobacterium avium subsp. paratuberculosis
aggcgagcacggcac

SEQ ID NO: 1012500 - RNA, 21 nt, Mycobacterium avium subsp. paratuberculosis
aggcgacgucggucggcagga

SEQ ID NO: 1012501 - RNA, 16 nt, Mycobacterium avium subsp. paratuberculosis
aggccugcgccuuggc

SEQ ID NO: 1012502 - RNA, 14 nt, Mycobacterium avium subsp. paratuberculosis
aggccugcgcggcc

SEQ ID NO: 1012503 - RNA, 19 nt, Mycobacterium avium subsp. paratuberculosis
aggccuggaacacccaggu

SEQ ID NO: 1012504 - RNA, 18 nt, Mycobacterium avium subsp. paratuberculosis
aggccuggaugccgcccu

SEQ ID NO: 1012505 - RNA, 22 nt, Mycobacterium avium subsp. paratuberculosis
aggcgaacauggcggccagccg

SEQ ID NO: 1012506 - RNA, 14 nt, Mycobacterium avium subsp. paratuberculosis
aggcgcaacagcac

SEQ ID NO: 1012507 - RNA, 13 nt, Mycobacterium avium subsp. paratuberculosis
aggcgcaccgcca

SEQ ID NO: 1012508 - RNA, 14 nt, Mycobacterium avium subsp. paratuberculosis
aggcgcaccagcug

SEQ ID NO: 1012509 - RNA, 15 nt, Mycobacterium avium subsp. paratuberculosis
aggcgcaccagcuga

SEQ ID NO: 1012510 - RNA, 19 nt, Mycobacterium avium subsp. paratuberculosis
aggcgauggugccggccau

SEQ ID NO: 1012511 - RNA, 15 nt, Mycobacterium avium subsp. paratuberculosis
aggcgaucgggaaca

SEQ ID NO: 1012512 - RNA, 17 nt, Mycobacterium avium subsp. paratuberculosis
aggcgaucgggaacagc

SEQ ID NO: 1012513 - RNA, 21 nt, Mycobacterium avium subsp. paratuberculosis
aggcgaucgggaacagcccgc

SEQ ID NO: 1012514 - RNA, 13 nt, Mycobacterium avium subsp. paratuberculosis
aggcgccacagca

SEQ ID NO: 1012515 - RNA, 16 nt, Mycobacterium avium subsp. paratuberculosis
aggcgccacagcagca

SEQ ID NO: 1012516 - RNA, 14 nt, Mycobacterium avium subsp. paratuberculosis
aggcgcagccagcg

SEQ ID NO: 1012517 - RNA, 20 nt, Mycobacterium avium subsp. paratuberculosis
aggcgcagcccgagcggcau

SEQ ID NO: 1012518 - RNA, 20 nt, Mycobacterium avium subsp. paratuberculosis
aggcgccguauuggcaggcg

SEQ ID NO: 1012519 - RNA, 17 nt, Mycobacterium avium subsp. paratuberculosis
aggcgccggccagcacg

SEQ ID NO: 1012520 - RNA, 22 nt, Mycobacterium avium subsp. paratuberculosis
aggcgccggguuguagcaggcg

SEQ ID NO: 1012521 - RNA, 18 nt, Mycobacterium avium subsp. paratuberculosis
aggcgcccugcacgaaca

SEQ ID NO: 1012522 - RNA, 15 nt, Mycobacterium avium subsp. paratuberculosis
aggcgcccaggauca

SEQ ID NO: 1012523 - RNA, 16 nt, Mycobacterium avium subsp. paratuberculosis
aggccguccagcagca

SEQ ID NO: 1012524 - RNA, 17 nt, Mycobacterium avium subsp. paratuberculosis
aggccgucggcgcggcc

SEQ ID NO: 1012525 - RNA, 15 nt, Mycobacterium avium subsp. paratuberculosis
aggccgugguuggcg

SEQ ID NO: 1012526 - RNA, 21 nt, Mycobacterium avium subsp. paratuberculosis
aggccgggauagagcaccgcg

SEQ ID NO: 1012527 - RNA, 15 nt, Mycobacterium avium subsp. paratuberculosis
aggccggucacccag

SEQ ID NO: 1012528 - RNA, 18 nt, Mycobacterium avium subsp. paratuberculosis
aggccgggcuggcgcugg

SEQ ID NO: 1012529 - RNA, 16 nt, Mycobacterium avium subsp. paratuberculosis
aggccgggcugguccg

SEQ ID NO: 1012530 - RNA, 23 nt, Mycobacterium avium subsp. paratuberculosis
aggccgucucgagccggcgcacu

SEQ ID NO: 1012531 - RNA, 12 nt, Mycobacterium avium subsp. paratuberculosis
aggccguucagg

SEQ ID NO: 1012532 - RNA, 18 nt, Mycobacterium avium subsp. paratuberculosis
aggccguuguggccaccc

SEQ ID NO: 1012533 - RNA, 15 nt, Mycobacterium avium subsp. paratuberculosis
aggccuccaggcuga

SEQ ID NO: 1012534 - RNA, 17 nt, Mycobacterium avium subsp. paratuberculosis
aggccucguggaacacc

SEQ ID NO: 1012535 - RNA, 22 nt, Mycobacterium avium subsp. paratuberculosis
aggccggcgccgggaaaguugu

SEQ ID NO: 1012536 - RNA, 22 nt, Mycobacterium avium subsp. paratuberculosis
aggccggcgacgccggcgaggc

SEQ ID NO: 1012537 - RNA, 16 nt, Mycobacterium avium subsp. paratuberculosis
aggccggccugccacc

SEQ ID NO: 1012538 - RNA, 23 nt, Mycobacterium avium subsp. paratuberculosis
aggccggaccguucgguccggaa

SEQ ID NO: 1012539 - RNA, 18 nt, Mycobacterium avium subsp. paratuberculosis
aggccgcugcccggcgcu

SEQ ID NO: 1012540 - RNA, 17 nt, Mycobacterium avium subsp. paratuberculosis
aggccgcguagcucgcc

SEQ ID NO: 1012541 - RNA, 17 nt, Mycobacterium avium subsp. paratuberculosis
aggccgcugacaagcgc

SEQ ID NO: 1012542 - RNA, 14 nt, Mycobacterium avium subsp. paratuberculosis
aggccgccccggcc

SEQ ID NO: 1012543 - RNA, 19 nt, Mycobacterium avium subsp. paratuberculosis
aggccgccagccgcgucuu

SEQ ID NO: 1012544 - RNA, 10 nt, Mycobacterium avium subsp. paratuberculosis
aggccgccgg

SEQ ID NO: 1012545 - RNA, 14 nt, Mycobacterium avium subsp. paratuberculosis
aggccgccgcgacc

SEQ ID NO: 1012546 - RNA, 21 nt, Mycobacterium avium subsp. paratuberculosis
aggccgcgagcacgacgucga

SEQ ID NO: 1012547 - RNA, 15 nt, Mycobacterium avium subsp. paratuberculosis
aggccgcgcagaugg

SEQ ID NO: 1012548 - RNA, 13 nt, Mycobacterium avium subsp. paratuberculosis
aggcgcugggugc

SEQ ID NO: 1012549 - RNA, 19 nt, Mycobacterium avium subsp. paratuberculosis
aggcgcugggugcgggcug

SEQ ID NO: 1012550 - RNA, 22 nt, Mycobacterium avium subsp. paratuberculosis
aggcgcugggugcgggcugcac

SEQ ID NO: 1012551 - RNA, 12 nt, Mycobacterium avium subsp. paratuberculosis
aggcggaaugca

SEQ ID NO: 1012552 - RNA, 15 nt, Mycobacterium avium subsp. paratuberculosis
aggcggacggcgacc

SEQ ID NO: 1012553 - RNA, 17 nt, Mycobacterium avium subsp. paratuberculosis
aggcgcggcgcgaggcg

SEQ ID NO: 1012554 - RNA, 19 nt, Mycobacterium avium subsp. paratuberculosis
aggcgcgcggccagccccg

SEQ ID NO: 1012555 - RNA, 12 nt, Mycobacterium avium subsp. paratuberculosis
aggcgcggggcg

SEQ ID NO: 1012556 - RNA, 14 nt, Mycobacterium avium subsp. paratuberculosis
aggcgcgcagggcg

SEQ ID NO: 1012557 - RNA, 22 nt, Mycobacterium avium subsp. paratuberculosis
aggcgcgcaccaucgcgaugga

SEQ ID NO: 1012558 - RNA, 15 nt, Mycobacterium avium subsp. paratuberculosis
aggcggugguggggu

SEQ ID NO: 1012559 - RNA, 20 nt, Mycobacterium avium subsp. paratuberculosis
aggcgucaucguggacagga

SEQ ID NO: 1012560 - RNA, 13 nt, Mycobacterium avium subsp. paratuberculosis
aggcguccagcac

SEQ ID NO: 1012561 - RNA, 16 nt, Mycobacterium avium subsp. paratuberculosis
aggcguccagccagcg

SEQ ID NO: 1012562 - RNA, 17 nt, Mycobacterium avium subsp. paratuberculosis
aggcgguuucaccgagg

SEQ ID NO: 1012563 - RNA, 20 nt, Mycobacterium avium subsp. paratuberculosis
aggcggucgugucagggaug

SEQ ID NO: 1012564 - RNA, 22 nt, Mycobacterium avium subsp. paratuberculosis
aggcgggcgaucucgauguaga

SEQ ID NO: 1012565 - RNA, 13 nt, Mycobacterium avium subsp. paratuberculosis
aggcgggugagga

SEQ ID NO: 1012566 - RNA, 20 nt, Mycobacterium avium subsp. paratuberculosis
aggcggguguauucgcccac

SEQ ID NO: 1012567 - RNA, 21 nt, Mycobacterium avium subsp. paratuberculosis
aggcggccauauagggguggg

SEQ ID NO: 1012568 - RNA, 16 nt, Mycobacterium avium subsp. paratuberculosis
aggcggcggcgggcca

SEQ ID NO: 1012569 - RNA, 19 nt, Mycobacterium avium subsp. paratuberculosis
aggcggcggcgggccaggg

SEQ ID NO: 1012570 - RNA, 19 nt, Mycobacterium avium subsp. paratuberculosis
aggcggcgccggccgggcu

SEQ ID NO: 1012571 - RNA, 22 nt, Mycobacterium avium subsp. paratuberculosis
aggcggcgccgucgaccagcuu

SEQ ID NO: 1012572 - RNA, 21 nt, Mycobacterium avium subsp. paratuberculosis
aggcggcgcgcagccggccgu

SEQ ID NO: 1012573 - RNA, 14 nt, Mycobacterium avium subsp. paratuberculosis
aggcggccagcacc

SEQ ID NO: 1012574 - RNA, 17 nt, Mycobacterium avium subsp. paratuberculosis
aggcggccagcaccagu

SEQ ID NO: 1012575 - RNA, 20 nt, Mycobacterium avium subsp. paratuberculosis
aggcggccaccgcggccagc

SEQ ID NO: 1012576 - RNA, 22 nt, Mycobacterium avium subsp. paratuberculosis
aggcggccaccgcggccagcug

SEQ ID NO: 1012577 - RNA, 12 nt, Mycobacterium avium subsp. paratuberculosis
aggcugaacacc

SEQ ID NO: 1012578 - RNA, 22 nt, Mycobacterium avium subsp. paratuberculosis
aggcugaaucccuccggcaggc

SEQ ID NO: 1012579 - RNA, 16 nt, Mycobacterium avium subsp. paratuberculosis
aggcugacgccacgcg

SEQ ID NO: 1012580 - RNA, 14 nt, Mycobacterium avium subsp. paratuberculosis
aggcugacgcgacc

SEQ ID NO: 1012581 - RNA, 20 nt, Mycobacterium avium subsp. paratuberculosis
aggcugacgcgaccgcgcgg

SEQ ID NO: 1012582 - RNA, 20 nt, Mycobacterium avium subsp. paratuberculosis
aggcugaucuggaugcggcc

SEQ ID NO: 1012583 - RNA, 13 nt, Mycobacterium avium subsp. paratuberculosis
aggcugaucucgg

SEQ ID NO: 1012584 - RNA, 18 nt, Mycobacterium avium subsp. paratuberculosis
aggcucgcgagggcgggc

SEQ ID NO: 1012585 - RNA, 13 nt, Mycobacterium avium subsp. paratuberculosis
aggcuccgccgau

SEQ ID NO: 1012586 - RNA, 19 nt, Mycobacterium avium subsp. paratuberculosis
aggcucaggaucagcagcc

SEQ ID NO: 1012587 - RNA, 13 nt, Mycobacterium avium subsp. paratuberculosis
aggcucacgcugc

SEQ ID NO: 1012588 - RNA, 17 nt, Mycobacterium avium subsp. paratuberculosis
aggcucacgcugccaaa

SEQ ID NO: 1012589 - RNA, 23 nt, Mycobacterium avium subsp. paratuberculosis
aggcucacgcugccaaaguuggc

SEQ ID NO: 1012590 - RNA, 19 nt, Mycobacterium avium subsp. paratuberculosis
aggcgucggucagcaggcg

SEQ ID NO: 1012591 - RNA, 23 nt, Mycobacterium avium subsp. paratuberculosis
aggcgucgaacgggccgggcacc

SEQ ID NO: 1012592 - RNA, 18 nt, Mycobacterium avium subsp. paratuberculosis
aggcguccagggccaccg

SEQ ID NO: 1012593 - RNA, 13 nt, Mycobacterium avium subsp. paratuberculosis
aggcgugcagccc

SEQ ID NO: 1012594 - RNA, 16 nt, Mycobacterium avium subsp. paratuberculosis
aggcgugcagcccgca

SEQ ID NO: 1012595 - RNA, 22 nt, Mycobacterium avium subsp. paratuberculosis
aggcguugcgucccgcgccgga

SEQ ID NO: 1012596 - RNA, 19 nt, Mycobacterium avium subsp. paratuberculosis
aggcguuggacuccaccgc

SEQ ID NO: 1012597 - RNA, 17 nt, Mycobacterium avium subsp. paratuberculosis
aguacagcuaggccagc

SEQ ID NO: 1012598 - RNA, 14 nt, Mycobacterium avium subsp. paratuberculosis
aguacaccaccgcg

SEQ ID NO: 1012599 - RNA, 18 nt, Mycobacterium avium subsp. paratuberculosis
aguacaccaccgcggcga

SEQ ID NO: 1012600 - RNA, 18 nt, Mycobacterium avium subsp. paratuberculosis
aguacaccucgagcuugc

SEQ ID NO: 1012601 - RNA, 17 nt, Mycobacterium avium subsp. paratuberculosis
agguucagcccggcgcu

SEQ ID NO: 1012602 - RNA, 13 nt, Mycobacterium avium subsp. paratuberculosis
agguucaggcuga

SEQ ID NO: 1012603 - RNA, 22 nt, Mycobacterium avium subsp. paratuberculosis
agguucaggcugaucuggaugc

SEQ ID NO: 1012604 - RNA, 12 nt, Mycobacterium avium subsp. paratuberculosis
agguucgccgga

SEQ ID NO: 1012605 - RNA, 16 nt, Mycobacterium avium subsp. paratuberculosis
agguugcgcagcagcc

SEQ ID NO: 1012606 - RNA, 16 nt, Mycobacterium avium subsp. paratuberculosis
aggugugcggcaagcg

SEQ ID NO: 1012607 - RNA, 15 nt, Mycobacterium avium subsp. paratuberculosis
aggugucgcacugcu

SEQ ID NO: 1012608 - RNA, 15 nt, Mycobacterium avium subsp. paratuberculosis
aggugugaggagucg

SEQ ID NO: 1012609 - RNA, 17 nt, Mycobacterium avium subsp. paratuberculosis
aggugugaggagucggg

SEQ ID NO: 1012610 - RNA, 20 nt, Mycobacterium avium subsp. paratuberculosis
agguuugagcgugccgccgg

SEQ ID NO: 1012611 - RNA, 15 nt, Mycobacterium avium subsp. paratuberculosis
aggguugccccaaaa

SEQ ID NO: 1012612 - RNA, 18 nt, Mycobacterium avium subsp. paratuberculosis
agggugucggcggggccg

SEQ ID NO: 1012613 - RNA, 17 nt, Mycobacterium avium subsp. paratuberculosis
aggguggccccagcccg

SEQ ID NO: 1012614 - RNA, 18 nt, Mycobacterium avium subsp. paratuberculosis
aggguggccgccaccagg

SEQ ID NO: 1012615 - RNA, 16 nt, Mycobacterium avium subsp. paratuberculosis
agggugacggaguugg

SEQ ID NO: 1012616 - RNA, 15 nt, Mycobacterium avium subsp. paratuberculosis
aggguggccagcacg

SEQ ID NO: 1012617 - RNA, 17 nt, Mycobacterium avium subsp. paratuberculosis
agggugccgccgcccgu

SEQ ID NO: 1012618 - RNA, 18 nt, Mycobacterium avium subsp. paratuberculosis
agggugccggccaccggc

SEQ ID NO: 1012619 - RNA, 20 nt, Mycobacterium avium subsp. paratuberculosis
agggucagcagcacccgguc

SEQ ID NO: 1012620 - RNA, 21 nt, Mycobacterium avium subsp. paratuberculosis
agggucugcgaagacccgaaa

SEQ ID NO: 1012621 - RNA, 22 nt, Mycobacterium avium subsp. paratuberculosis
agggucgagaucagcaccgggu

SEQ ID NO: 1012622 - RNA, 21 nt, Mycobacterium avium subsp. paratuberculosis
agguauucgcgggaggacagc

SEQ ID NO: 1012623 - RNA, 13 nt, Mycobacterium avium subsp. paratuberculosis
agguagccgccgu

SEQ ID NO: 1012624 - RNA, 14 nt, Mycobacterium avium subsp. paratuberculosis
agguagcaggcgcg

SEQ ID NO: 1012625 - RNA, 22 nt, Mycobacterium avium subsp. paratuberculosis
agguagucggcccaggccaaca

SEQ ID NO: 1012626 - RNA, 18 nt, Mycobacterium avium subsp. paratuberculosis
agguaggcgagaucaaca

SEQ ID NO: 1012627 - RNA, 13 nt, Mycobacterium avium subsp. paratuberculosis
agguaggcggcgc

SEQ ID NO: 1012628 - RNA, 14 nt, Mycobacterium avium subsp. paratuberculosis
agguagaggcuguc

SEQ ID NO: 1012629 - RNA, 14 nt, Mycobacterium avium subsp. paratuberculosis
aggugaacagcagc

SEQ ID NO: 1012630 - RNA, 15 nt, Mycobacterium avium subsp. paratuberculosis
aggugaacagcagcc

SEQ ID NO: 1012631 - RNA, 22 nt, Mycobacterium avium subsp. paratuberculosis
aggucuuucaucgccccggcga

SEQ ID NO: 1012632 - RNA, 15 nt, Mycobacterium avium subsp. paratuberculosis
aggucugcagcagcc

SEQ ID NO: 1012633 - RNA, 19 nt, Mycobacterium avium subsp. paratuberculosis
aggucuucggucccggcgg

SEQ ID NO: 1012634 - RNA, 17 nt, Mycobacterium avium subsp. paratuberculosis
aggucguggcgccgagg

SEQ ID NO: 1012635 - RNA, 16 nt, Mycobacterium avium subsp. paratuberculosis
aggucgguggccacca

SEQ ID NO: 1012636 - RNA, 22 nt, Mycobacterium avium subsp. paratuberculosis
aggucguccgacaggaugcugg

SEQ ID NO: 1012637 - RNA, 19 nt, Mycobacterium avium subsp. paratuberculosis
aggucgucgagggccaccg

SEQ ID NO: 1012638 - RNA, 22 nt, Mycobacterium avium subsp. paratuberculosis
aggucgucgcguccagcaugcc

SEQ ID NO: 1012639 - RNA, 17 nt, Mycobacterium avium subsp. paratuberculosis
aggucgggguccaggcc

SEQ ID NO: 1012640 - RNA, 19 nt, Mycobacterium avium subsp. paratuberculosis
aggucggacgccuccccca

SEQ ID NO: 1012641 - RNA, 20 nt, Mycobacterium avium subsp. paratuberculosis
aggucggacgccucccccac

SEQ ID NO: 1012642 - RNA, 16 nt, Mycobacterium avium subsp. paratuberculosis
aggucgccggugucau

SEQ ID NO: 1012643 - RNA, 18 nt, Mycobacterium avium subsp. paratuberculosis
aggucgccuccaggugaa

SEQ ID NO: 1012644 - RNA, 12 nt, Mycobacterium avium subsp. paratuberculosis
aggucgcggacu

SEQ ID NO: 1012645 - RNA, 17 nt, Mycobacterium avium subsp. paratuberculosis
aggucgcggugggcgcg

SEQ ID NO: 1012646 - RNA, 16 nt, Mycobacterium avium subsp. paratuberculosis
aggucccaggccagga

SEQ ID NO: 1012647 - RNA, 13 nt, Mycobacterium avium subsp. paratuberculosis
agguccaggauca

SEQ ID NO: 1012648 - RNA, 17 nt, Mycobacterium avium subsp. paratuberculosis
aggucgacggggucgga

SEQ ID NO: 1012649 - RNA, 20 nt, Mycobacterium avium subsp. paratuberculosis
aggucgaucagcgguccacc

SEQ ID NO: 1012650 - RNA, 17 nt, Mycobacterium avium subsp. paratuberculosis
aggucgaucugcggcac

SEQ ID NO: 1012651 - RNA, 13 nt, Mycobacterium avium subsp. paratuberculosis
aggucgcccagau

SEQ ID NO: 1012652 - RNA, 16 nt, Mycobacterium avium subsp. paratuberculosis
aggucgaaggcggccg

SEQ ID NO: 1012653 - RNA, 14 nt, Mycobacterium avium subsp. paratuberculosis
aggucgaagggcau

SEQ ID NO: 1012654 - RNA, 15 nt, Mycobacterium avium subsp. paratuberculosis
agguccuugcccagc

SEQ ID NO: 1012655 - RNA, 23 nt, Mycobacterium avium subsp. paratuberculosis
agguccuugcggaaccgcugcau

SEQ ID NO: 1012656 - RNA, 15 nt, Mycobacterium avium subsp. paratuberculosis
agguccggcgcgacc

SEQ ID NO: 1012657 - RNA, 14 nt, Mycobacterium avium subsp. paratuberculosis
agguccucgaccuc

SEQ ID NO: 1012658 - RNA, 16 nt, Mycobacterium avium subsp. paratuberculosis
agguccucgaccucuu

SEQ ID NO: 1012659 - RNA, 15 nt, Mycobacterium avium subsp. paratuberculosis
aggugcaccacccag

SEQ ID NO: 1012660 - RNA, 19 nt, Mycobacterium avium subsp. paratuberculosis
aggugcacgccgagcagca

SEQ ID NO: 1012661 - RNA, 18 nt, Mycobacterium avium subsp. paratuberculosis
aggugaugccguccagca

SEQ ID NO: 1012662 - RNA, 18 nt, Mycobacterium avium subsp. paratuberculosis
aggugauucgcgcggcgc

SEQ ID NO: 1012663 - RNA, 23 nt, Mycobacterium avium subsp. paratuberculosis
aggugcagcgggcuggcguagga

SEQ ID NO: 1012664 - RNA, 14 nt, Mycobacterium avium subsp. paratuberculosis
aggugcagcuccuu

SEQ ID NO: 1012665 - RNA, 19 nt, Mycobacterium avium subsp. paratuberculosis
aggugcauccagucggcgc

SEQ ID NO: 1012666 - RNA, 15 nt, Mycobacterium avium subsp. paratuberculosis
aggugaccucgagca

SEQ ID NO: 1012667 - RNA, 13 nt, Mycobacterium avium subsp. paratuberculosis
aggugagccgggu

SEQ ID NO: 1012668 - RNA, 16 nt, Mycobacterium avium subsp. paratuberculosis
aggugaucguguuguu

SEQ ID NO: 1012669 - RNA, 15 nt, Mycobacterium avium subsp. paratuberculosis
aggugaaugcucagc

SEQ ID NO: 1012670 - RNA, 21 nt, Mycobacterium avium subsp. paratuberculosis
aggugcuuggucagcgcggcc

SEQ ID NO: 1012671 - RNA, 17 nt, Mycobacterium avium subsp. paratuberculosis
agguggacagaugccag

SEQ ID NO: 1012672 - RNA, 22 nt, Mycobacterium avium subsp. paratuberculosis
agguggauugucggccgcccgu

SEQ ID NO: 1012673 - RNA, 20 nt, Mycobacterium avium subsp. paratuberculosis
aggugcgggcggggcccggg

SEQ ID NO: 1012674 - RNA, 20 nt, Mycobacterium avium subsp. paratuberculosis
aggugcucgacggcacccgg

SEQ ID NO: 1012675 - RNA, 16 nt, Mycobacterium avium subsp. paratuberculosis
aggugcucgccggcgc

SEQ ID NO: 1012676 - RNA, 19 nt, Mycobacterium avium subsp. paratuberculosis
aggugcucgccggcgcgga

SEQ ID NO: 1012677 - RNA, 21 nt, Mycobacterium avium subsp. paratuberculosis
aggugcucgccggcgcggaac

SEQ ID NO: 1012678 - RNA, 13 nt, Mycobacterium avium subsp. paratuberculosis
aggugcgcgagga

SEQ ID NO: 1012679 - RNA, 13 nt, Mycobacterium avium subsp. paratuberculosis
aggugcggcaacc

SEQ ID NO: 1012680 - RNA, 15 nt, Mycobacterium avium subsp. paratuberculosis
aggugcccuccucgc

SEQ ID NO: 1012681 - RNA, 15 nt, Mycobacterium avium subsp. paratuberculosis
aggugccggcggcgc

SEQ ID NO: 1012682 - RNA, 15 nt, Mycobacterium avium subsp. paratuberculosis
agguggccgaucagc

SEQ ID NO: 1012683 - RNA, 14 nt, Mycobacterium avium subsp. paratuberculosis
agguggcccacacg

SEQ ID NO: 1012684 - RNA, 22 nt, Mycobacterium avium subsp. paratuberculosis
agguggccagcacgaucgggua

SEQ ID NO: 1012685 - RNA, 23 nt, Mycobacterium avium subsp. paratuberculosis
agguggccaugggguugaccuug

SEQ ID NO: 1012686 - RNA, 14 nt, Mycobacterium avium subsp. paratuberculosis
agguggcgaccacc

SEQ ID NO: 1012687 - RNA, 18 nt, Mycobacterium avium subsp. paratuberculosis
agguggcgcccggagcug

SEQ ID NO: 1012688 - RNA, 21 nt, Mycobacterium avium subsp. paratuberculosis
aggugguuucggggucgccgu

SEQ ID NO: 1012689 - RNA, 12 nt, Mycobacterium avium subsp. paratuberculosis
aggugggcgcgc

SEQ ID NO: 1012690 - RNA, 15 nt, Mycobacterium avium subsp. paratuberculosis
aggugggcggccacc

SEQ ID NO: 1012691 - RNA, 13 nt, Mycobacterium avium subsp. paratuberculosis
aggugggcggugc

SEQ ID NO: 1012692 - RNA, 13 nt, Mycobacterium avium subsp. paratuberculosis
agguggggcacca

SEQ ID NO: 1012693 - RNA, 19 nt, Mycobacterium avium subsp. paratuberculosis
aggugggguugaagcuggc

SEQ ID NO: 1012694 - RNA, 22 nt, Mycobacterium avium subsp. paratuberculosis
aucagaacgcccgcaacuccac

SEQ ID NO: 1012695 - RNA, 18 nt, Mycobacterium avium subsp. paratuberculosis
aucagaugcucgucgguc

SEQ ID NO: 1012696 - RNA, 16 nt, Mycobacterium avium subsp. paratuberculosis
aucagacccagcguca

SEQ ID NO: 1012697 - RNA, 12 nt, Mycobacterium avium subsp. paratuberculosis
aucagccgccgu

SEQ ID NO: 1012698 - RNA, 17 nt, Mycobacterium avium subsp. paratuberculosis
aucagcgacgucagguc

SEQ ID NO: 1012699 - RNA, 16 nt, Mycobacterium avium subsp. paratuberculosis
aucagcccgcccacca

SEQ ID NO: 1012700 - RNA, 17 nt, Mycobacterium avium subsp. paratuberculosis
aucagcccgcccaccac

SEQ ID NO: 1012701 - RNA, 18 nt, Mycobacterium avium subsp. paratuberculosis
aucagccaguugaucagc

SEQ ID NO: 1012702 - RNA, 15 nt, Mycobacterium avium subsp. paratuberculosis
aucagcgccaccagc

SEQ ID NO: 1012703 - RNA, 14 nt, Mycobacterium avium subsp. paratuberculosis
aucagcgcccgcgc

SEQ ID NO: 1012704 - RNA, 19 nt, Mycobacterium avium subsp. paratuberculosis
aucagcgccagguggguga

SEQ ID NO: 1012705 - RNA, 19 nt, Mycobacterium avium subsp. paratuberculosis
aucagcgccugguccuccc

SEQ ID NO: 1012706 - RNA, 20 nt, Mycobacterium avium subsp. paratuberculosis
aucagcggagugaccgccag

SEQ ID NO: 1012707 - RNA, 12 nt, Mycobacterium avium subsp. paratuberculosis
aucagcgcgccg

SEQ ID NO: 1012708 - RNA, 19 nt, Mycobacterium avium subsp. paratuberculosis
aucagcggcgggcccagca

SEQ ID NO: 1012709 - RNA, 20 nt, Mycobacterium avium subsp. paratuberculosis
aucagcaugucgcccgcguc

SEQ ID NO: 1012710 - RNA, 16 nt, Mycobacterium avium subsp. paratuberculosis
aucagcaggaccaggc

SEQ ID NO: 1012711 - RNA, 11 nt, Mycobacterium avium subsp. paratuberculosis
aucagcagcac

SEQ ID NO: 1012712 - RNA, 20 nt, Mycobacterium avium subsp. paratuberculosis
aucagcagcaccuggaucca

SEQ ID NO: 1012713 - RNA, 20 nt, Mycobacterium avium subsp. paratuberculosis
aucagcagcagguccugucc

SEQ ID NO: 1012714 - RNA, 24 nt, Mycobacterium avium subsp. paratuberculosis
aucagcaccgcgaacaucgccagc

SEQ ID NO: 1012715 - RNA, 19 nt, Mycobacterium avium subsp. paratuberculosis
aucagcaccgggugauacc

SEQ ID NO: 1012716 - RNA, 17 nt, Mycobacterium avium subsp. paratuberculosis
aucacguugucgcggcc

SEQ ID NO: 1012717 - RNA, 22 nt, Mycobacterium avium subsp. paratuberculosis
aucacguugucgcggcccagca

SEQ ID NO: 1012718 - RNA, 22 nt, Mycobacterium avium subsp. paratuberculosis
aucacgguggccgccaccaaca

SEQ ID NO: 1012719 - RNA, 17 nt, Mycobacterium avium subsp. paratuberculosis
aucacgccgccggggcg

SEQ ID NO: 1012720 - RNA, 18 nt, Mycobacterium avium subsp. paratuberculosis
aucaccaugaucagcgcc

SEQ ID NO: 1012721 - RNA, 13 nt, Mycobacterium avium subsp. paratuberculosis
aucaccccgaagc

SEQ ID NO: 1012722 - RNA, 18 nt, Mycobacterium avium subsp. paratuberculosis
aucacccccgacaccgug

SEQ ID NO: 1012723 - RNA, 14 nt, Mycobacterium avium subsp. paratuberculosis
aucacccgccgggu

SEQ ID NO: 1012724 - RNA, 18 nt, Mycobacterium avium subsp. paratuberculosis
aucacccgccggguggcc

SEQ ID NO: 1012725 - RNA, 19 nt, Mycobacterium avium subsp. paratuberculosis
aucaccuccuuggccaggc

SEQ ID NO: 1012726 - RNA, 20 nt, Mycobacterium avium subsp. paratuberculosis
aucaccuccuuggccaggcg

SEQ ID NO: 1012727 - RNA, 12 nt, Mycobacterium avium subsp. paratuberculosis
aucaccagcaga

SEQ ID NO: 1012728 - RNA, 21 nt, Mycobacterium avium subsp. paratuberculosis
aucaccacggucagggccagc

SEQ ID NO: 1012729 - RNA, 22 nt, Mycobacterium avium subsp. paratuberculosis
aucaacggcuugaugaugcugu

SEQ ID NO: 1012730 - RNA, 14 nt, Mycobacterium avium subsp. paratuberculosis
aucaaccacaccag

SEQ ID NO: 1012731 - RNA, 22 nt, Mycobacterium avium subsp. paratuberculosis
auaucgacggccccccgggcac

SEQ ID NO: 1012732 - RNA, 13 nt, Mycobacterium avium subsp. paratuberculosis
auagcucaggugc

SEQ ID NO: 1012733 - RNA, 16 nt, Mycobacterium avium subsp. paratuberculosis
auagccccgccaggcg

SEQ ID NO: 1012734 - RNA, 13 nt, Mycobacterium avium subsp. paratuberculosis
auagaugcuuugg

SEQ ID NO: 1012735 - RNA, 15 nt, Mycobacterium avium subsp. paratuberculosis
auacucguccucccg

SEQ ID NO: 1012736 - RNA, 18 nt, Mycobacterium avium subsp. paratuberculosis
auacgccaucagcaccac

SEQ ID NO: 1012737 - RNA, 23 nt, Mycobacterium avium subsp. paratuberculosis
auacgacgggauggucucguaga

SEQ ID NO: 1012738 - RNA, 14 nt, Mycobacterium avium subsp. paratuberculosis
auaccggcagcagg

SEQ ID NO: 1012739 - RNA, 18 nt, Mycobacterium avium subsp. paratuberculosis
aguuuaccgugccucgcc

SEQ ID NO: 1012740 - RNA, 18 nt, Mycobacterium avium subsp. paratuberculosis
aguuuccccaccaggcgc

SEQ ID NO: 1012741 - RNA, 22 nt, Mycobacterium avium subsp. paratuberculosis
aguuguucgacugcaggaacaa

SEQ ID NO: 1012742 - RNA, 14 nt, Mycobacterium avium subsp. paratuberculosis
aguuguuuccccag

SEQ ID NO: 1012743 - RNA, 18 nt, Mycobacterium avium subsp. paratuberculosis
aguuguuuccccagcccg

SEQ ID NO: 1012744 - RNA, 19 nt, Mycobacterium avium subsp. paratuberculosis
aguuccugcaugccgggca

SEQ ID NO: 1012745 - RNA, 15 nt, Mycobacterium avium subsp. paratuberculosis
aguucgacguagccc

SEQ ID NO: 1012746 - RNA, 22 nt, Mycobacterium avium subsp. paratuberculosis
aguucgaccggcaccagcagcc

SEQ ID NO: 1012747 - RNA, 17 nt, Mycobacterium avium subsp. paratuberculosis
aguuccuugcgcagcac

SEQ ID NO: 1012748 - RNA, 20 nt, Mycobacterium avium subsp. paratuberculosis
aguucggugaacugcagccc

SEQ ID NO: 1012749 - RNA, 14 nt, Mycobacterium avium subsp. paratuberculosis
aguucggccgccgu

SEQ ID NO: 1012750 - RNA, 22 nt, Mycobacterium avium subsp. paratuberculosis
aguucgagguaggcgagaucaa

SEQ ID NO: 1012751 - RNA, 18 nt, Mycobacterium avium subsp. paratuberculosis
aguucugcuugagccgcc

SEQ ID NO: 1012752 - RNA, 12 nt, Mycobacterium avium subsp. paratuberculosis
aguuccagccga

SEQ ID NO: 1012753 - RNA, 18 nt, Mycobacterium avium subsp. paratuberculosis
aguggcuggucacacccu

SEQ ID NO: 1012754 - RNA, 14 nt, Mycobacterium avium subsp. paratuberculosis
agugucgcaaagac

SEQ ID NO: 1012755 - RNA, 18 nt, Mycobacterium avium subsp. paratuberculosis
agugcgucagaaccgggg

SEQ ID NO: 1012756 - RNA, 17 nt, Mycobacterium avium subsp. paratuberculosis
agugcgucgcccaucac

SEQ ID NO: 1012757 - RNA, 16 nt, Mycobacterium avium subsp. paratuberculosis
agugcgucuuuuccca

SEQ ID NO: 1012758 - RNA, 20 nt, Mycobacterium avium subsp. paratuberculosis
agugcgugaccugcugggcg

SEQ ID NO: 1012759 - RNA, 15 nt, Mycobacterium avium subsp. paratuberculosis
agugcgcccagaugc

SEQ ID NO: 1012760 - RNA, 16 nt, Mycobacterium avium subsp. paratuberculosis
aguggacaugcagccg

SEQ ID NO: 1012761 - RNA, 22 nt, Mycobacterium avium subsp. paratuberculosis
aguggacaugcagccgccgcgg

SEQ ID NO: 1012762 - RNA, 18 nt, Mycobacterium avium subsp. paratuberculosis
agugcucgauggccagcg

SEQ ID NO: 1012763 - RNA, 16 nt, Mycobacterium avium subsp. paratuberculosis
agugccgguccagccg

SEQ ID NO: 1012764 - RNA, 18 nt, Mycobacterium avium subsp. paratuberculosis
agugccgguccagccgcc

SEQ ID NO: 1012765 - RNA, 20 nt, Mycobacterium avium subsp. paratuberculosis
agugccgguccagccgccgc

SEQ ID NO: 1012766 - RNA, 14 nt, Mycobacterium avium subsp. paratuberculosis
agugcagccgcccg

SEQ ID NO: 1012767 - RNA, 14 nt, Mycobacterium avium subsp. paratuberculosis
agugacgccugcgg

SEQ ID NO: 1012768 - RNA, 18 nt, Mycobacterium avium subsp. paratuberculosis
aguccuugaccuugggca

SEQ ID NO: 1012769 - RNA, 22 nt, Mycobacterium avium subsp. paratuberculosis
aguaccgacgagaucagcacca

SEQ ID NO: 1012770 - RNA, 15 nt, Mycobacterium avium subsp. paratuberculosis
aguccggcagcagcg

SEQ ID NO: 1012771 - RNA, 17 nt, Mycobacterium avium subsp. paratuberculosis
aguccggcgcccggcuc

SEQ ID NO: 1012772 - RNA, 17 nt, Mycobacterium avium subsp. paratuberculosis
aguccggcgcgcccgga

SEQ ID NO: 1012773 - RNA, 19 nt, Mycobacterium avium subsp. paratuberculosis
aguccgggaugacaccgcg

SEQ ID NO: 1012774 - RNA, 18 nt, Mycobacterium avium subsp. paratuberculosis
aguccggacacggccagc

SEQ ID NO: 1012775 - RNA, 22 nt, Mycobacterium avium subsp. paratuberculosis
aguccgcggaggcgagcagccg

SEQ ID NO: 1012776 - RNA, 16 nt, Mycobacterium avium subsp. paratuberculosis
agucguucggccagca

SEQ ID NO: 1012777 - RNA, 19 nt, Mycobacterium avium subsp. paratuberculosis
agucuacuuggccagcugc

SEQ ID NO: 1012778 - RNA, 14 nt, Mycobacterium avium subsp. paratuberculosis
agucgaccacccgc

SEQ ID NO: 1012779 - RNA, 15 nt, Mycobacterium avium subsp. paratuberculosis
agucgccggccagga

SEQ ID NO: 1012780 - RNA, 17 nt, Mycobacterium avium subsp. paratuberculosis
agucgccguccggggcc

SEQ ID NO: 1012781 - RNA, 20 nt, Mycobacterium avium subsp. paratuberculosis
agucgcggaugcgggcgcug

SEQ ID NO: 1012782 - RNA, 18 nt, Mycobacterium avium subsp. paratuberculosis
agucgcggcgaaccagca

SEQ ID NO: 1012783 - RNA, 18 nt, Mycobacterium avium subsp. paratuberculosis
agucgcgggcgagccgac

SEQ ID NO: 1012784 - RNA, 23 nt, Mycobacterium avium subsp. paratuberculosis
agucgcgggcgagccgacagucg

SEQ ID NO: 1012785 - RNA, 19 nt, Mycobacterium avium subsp. paratuberculosis
agucugagcccgggcaggc

SEQ ID NO: 1012786 - RNA, 19 nt, Mycobacterium avium subsp. paratuberculosis
agugaccgccagcaccgcg

SEQ ID NO: 1012787 - RNA, 20 nt, Mycobacterium avium subsp. paratuberculosis
agugaccgccagcaccgcgg

SEQ ID NO: 1012788 - RNA, 20 nt, Mycobacterium avium subsp. paratuberculosis
agugacgccgcucggccagc

SEQ ID NO: 1012789 - RNA, 17 nt, Mycobacterium avium subsp. paratuberculosis
auaaccguucaccucuu

SEQ ID NO: 1012790 - RNA, 18 nt, Mycobacterium avium subsp. paratuberculosis
auaaggggguagauguca

SEQ ID NO: 1012791 - RNA, 17 nt, Mycobacterium avium subsp. paratuberculosis
auaagcggauugaccag

SEQ ID NO: 1012792 - RNA, 13 nt, Mycobacterium avium subsp. paratuberculosis
aucgcagcgcgcg

SEQ ID NO: 1012793 - RNA, 15 nt, Mycobacterium avium subsp. paratuberculosis
aucgcccagccggcg

SEQ ID NO: 1012794 - RNA, 13 nt, Mycobacterium avium subsp. paratuberculosis
aucgcccagcgca

SEQ ID NO: 1012795 - RNA, 13 nt, Mycobacterium avium subsp. paratuberculosis
aucgcccaccugg

SEQ ID NO: 1012796 - RNA, 20 nt, Mycobacterium avium subsp. paratuberculosis
aucgcccgguaggccgccgc

SEQ ID NO: 1012797 - RNA, 14 nt, Mycobacterium avium subsp. paratuberculosis
aucgcccggcgccc

SEQ ID NO: 1012798 - RNA, 13 nt, Mycobacterium avium subsp. paratuberculosis
aucgccggcgccg

SEQ ID NO: 1012799 - RNA, 17 nt, Mycobacterium avium subsp. paratuberculosis
aucgccggcgcgcugaa

SEQ ID NO: 1012800 - RNA, 21 nt, Mycobacterium avium subsp. paratuberculosis
aucgccucgaccagcaccgca

SEQ ID NO: 1012801 - RNA, 15 nt, Mycobacterium avium subsp. paratuberculosis
aucgcgauggaagcg

SEQ ID NO: 1012802 - RNA, 13 nt, Mycobacterium avium subsp. paratuberculosis
aucgcgcaucacc

SEQ ID NO: 1012803 - RNA, 13 nt, Mycobacterium avium subsp. paratuberculosis
aucgcgcgcagga

SEQ ID NO: 1012804 - RNA, 21 nt, Mycobacterium avium subsp. paratuberculosis
aucgcgcgcggcggccaccgc

SEQ ID NO: 1012805 - RNA, 16 nt, Mycobacterium avium subsp. paratuberculosis
aucgcggcgagcagcg

SEQ ID NO: 1012806 - RNA, 23 nt, Mycobacterium avium subsp. paratuberculosis
aucgagcacgggaugaucggcgc

SEQ ID NO: 1012807 - RNA, 22 nt, Mycobacterium avium subsp. paratuberculosis
aucgagcccaccgcgcccagcc

SEQ ID NO: 1012808 - RNA, 15 nt, Mycobacterium avium subsp. paratuberculosis
aucgagcgcaccgcc

SEQ ID NO: 1012809 - RNA, 15 nt, Mycobacterium avium subsp. paratuberculosis
aucgagcaccagcaa

SEQ ID NO: 1012810 - RNA, 23 nt, Mycobacterium avium subsp. paratuberculosis
aucgagcaccagcaacaccaggg

SEQ ID NO: 1012811 - RNA, 11 nt, Mycobacterium avium subsp. paratuberculosis
aucgagcaccc

SEQ ID NO: 1012812 - RNA, 14 nt, Mycobacterium avium subsp. paratuberculosis
aucagcguguugga

SEQ ID NO: 1012813 - RNA, 15 nt, Mycobacterium avium subsp. paratuberculosis
aucagcugcucggcc

SEQ ID NO: 1012814 - RNA, 13 nt, Mycobacterium avium subsp. paratuberculosis
aucagcugcucgu

SEQ ID NO: 1012815 - RNA, 23 nt, Mycobacterium avium subsp. paratuberculosis
aucagcugcccggaguccggcuc

SEQ ID NO: 1012816 - RNA, 14 nt, Mycobacterium avium subsp. paratuberculosis
aucguugagcacca

SEQ ID NO: 1012817 - RNA, 22 nt, Mycobacterium avium subsp. paratuberculosis
aucgugucgaucgucuacucca

SEQ ID NO: 1012818 - RNA, 18 nt, Mycobacterium avium subsp. paratuberculosis
aucgugucuggccccguc

SEQ ID NO: 1012819 - RNA, 16 nt, Mycobacterium avium subsp. paratuberculosis
aucguggccgcguaga

SEQ ID NO: 1012820 - RNA, 23 nt, Mycobacterium avium subsp. paratuberculosis
aucguccgaggccccgccagaua

SEQ ID NO: 1012821 - RNA, 14 nt, Mycobacterium avium subsp. paratuberculosis
aucguccggcgcca

SEQ ID NO: 1012822 - RNA, 15 nt, Mycobacterium avium subsp. paratuberculosis
aucgucgaccaccac

SEQ ID NO: 1012823 - RNA, 12 nt, Mycobacterium avium subsp. paratuberculosis
aucgucgccggg

SEQ ID NO: 1012824 - RNA, 20 nt, Mycobacterium avium subsp. paratuberculosis
aucggagguugauggccaga

SEQ ID NO: 1012825 - RNA, 23 nt, Mycobacterium avium subsp. paratuberculosis
aucgcgguagcgcucggucaggc

SEQ ID NO: 1012826 - RNA, 14 nt, Mycobacterium avium subsp. paratuberculosis
aucgcggugcugca

SEQ ID NO: 1012827 - RNA, 14 nt, Mycobacterium avium subsp. paratuberculosis
aucgcgguggccgu

SEQ ID NO: 1012828 - RNA, 19 nt, Mycobacterium avium subsp. paratuberculosis
aucgcggcgcugccgccgg

SEQ ID NO: 1012829 - RNA, 17 nt, Mycobacterium avium subsp. paratuberculosis
aucgcguaguccagcac

SEQ ID NO: 1012830 - RNA, 18 nt, Mycobacterium avium subsp. paratuberculosis
aucgcguaguccagcacg

SEQ ID NO: 1012831 - RNA, 11 nt, Mycobacterium avium subsp. paratuberculosis
aucggccaggu

SEQ ID NO: 1012832 - RNA, 19 nt, Mycobacterium avium subsp. paratuberculosis
aucgggugagacggccagc

SEQ ID NO: 1012833 - RNA, 20 nt, Mycobacterium avium subsp. paratuberculosis
aucgggcguggcgucgguga

SEQ ID NO: 1012834 - RNA, 13 nt, Mycobacterium avium subsp. paratuberculosis
aucgggcccagca

SEQ ID NO: 1012835 - RNA, 15 nt, Mycobacterium avium subsp. paratuberculosis
aucgggcccagcagc

SEQ ID NO: 1012836 - RNA, 13 nt, Mycobacterium avium subsp. paratuberculosis
aucggggccagga

SEQ ID NO: 1012837 - RNA, 18 nt, Mycobacterium avium subsp. paratuberculosis
aucggguaacccuccggc

SEQ ID NO: 1012838 - RNA, 17 nt, Mycobacterium avium subsp. paratuberculosis
aucgggauuggcggcca

SEQ ID NO: 1012839 - RNA, 17 nt, Mycobacterium avium subsp. paratuberculosis
aucggcgacgccgccgu

SEQ ID NO: 1012840 - RNA, 16 nt, Mycobacterium avium subsp. paratuberculosis
aucgggaccgggaagc

SEQ ID NO: 1012841 - RNA, 20 nt, Mycobacterium avium subsp. paratuberculosis
aucggccagcgcggccgggc

SEQ ID NO: 1012842 - RNA, 22 nt, Mycobacterium avium subsp. paratuberculosis
aucggcccggccaacgggaaga

SEQ ID NO: 1012843 - RNA, 16 nt, Mycobacterium avium subsp. paratuberculosis
aucggccgcugcccgg

SEQ ID NO: 1012844 - RNA, 20 nt, Mycobacterium avium subsp. paratuberculosis
aucggccgggucgcaggcag

SEQ ID NO: 1012845 - RNA, 16 nt, Mycobacterium avium subsp. paratuberculosis
aucugaccgagcagcg

SEQ ID NO: 1012846 - RNA, 12 nt, Mycobacterium avium subsp. paratuberculosis
aucugccgggcg

SEQ ID NO: 1012847 - RNA, 18 nt, Mycobacterium avium subsp. paratuberculosis
aucugccggugccgccgg

SEQ ID NO: 1012848 - RNA, 14 nt, Mycobacterium avium subsp. paratuberculosis
aucugcggcaccac

SEQ ID NO: 1012849 - RNA, 16 nt, Mycobacterium avium subsp. paratuberculosis
aucugcaggccgaggc

SEQ ID NO: 1012850 - RNA, 23 nt, Mycobacterium avium subsp. paratuberculosis
aucugcaccagcgcggacaccag

SEQ ID NO: 1012851 - RNA, 17 nt, Mycobacterium avium subsp. paratuberculosis
aucucgucgaugacgau

SEQ ID NO: 1012852 - RNA, 18 nt, Mycobacterium avium subsp. paratuberculosis
aucucgucgcgcagcugg

SEQ ID NO: 1012853 - RNA, 14 nt, Mycobacterium avium subsp. paratuberculosis
aucucgucgggcca

SEQ ID NO: 1012854 - RNA, 18 nt, Mycobacterium avium subsp. paratuberculosis
aucucgggcaccccugcc

SEQ ID NO: 1012855 - RNA, 17 nt, Mycobacterium avium subsp. paratuberculosis
aucucguagcccaccuc

SEQ ID NO: 1012856 - RNA, 18 nt, Mycobacterium avium subsp. paratuberculosis
aucucggucgccagcacc

SEQ ID NO: 1012857 - RNA, 13 nt, Mycobacterium avium subsp. paratuberculosis
aucucgcgggccc

SEQ ID NO: 1012858 - RNA, 22 nt, Mycobacterium avium subsp. paratuberculosis
aucucgcgggcccgcgcggcgg

SEQ ID NO: 1012859 - RNA, 19 nt, Mycobacterium avium subsp. paratuberculosis
aucucgccgcggugguggg

SEQ ID NO: 1012860 - RNA, 17 nt, Mycobacterium avium subsp. paratuberculosis
aucucggccaccgucag

SEQ ID NO: 1012861 - RNA, 18 nt, Mycobacterium avium subsp. paratuberculosis
aucucaccggcggcggcc

SEQ ID NO: 1012862 - RNA, 12 nt, Mycobacterium avium subsp. paratuberculosis
aucuccagcagc

SEQ ID NO: 1012863 - RNA, 13 nt, Mycobacterium avium subsp. paratuberculosis
aucuccagcagcu

SEQ ID NO: 1012864 - RNA, 14 nt, Mycobacterium avium subsp. paratuberculosis
aucuccagcagcuu

SEQ ID NO: 1012865 - RNA, 20 nt, Mycobacterium avium subsp. paratuberculosis
aucuccagcagcuucaugcc

SEQ ID NO: 1012866 - RNA, 19 nt, Mycobacterium avium subsp. paratuberculosis
aucuccgggaacgcggcga

SEQ ID NO: 1012867 - RNA, 14 nt, Mycobacterium avium subsp. paratuberculosis
aucucgaccuucuu

SEQ ID NO: 1012868 - RNA, 17 nt, Mycobacterium avium subsp. paratuberculosis
aucucgaccuucuuguc

SEQ ID NO: 1012869 - RNA, 20 nt, Mycobacterium avium subsp. paratuberculosis
aucucgacggugaccggcuc

SEQ ID NO: 1012870 - RNA, 23 nt, Mycobacterium avium subsp. paratuberculosis
augccaguccugggccggggcuu

SEQ ID NO: 1012871 - RNA, 14 nt, Mycobacterium avium subsp. paratuberculosis
augcccagcagcgg

SEQ ID NO: 1012872 - RNA, 17 nt, Mycobacterium avium subsp. paratuberculosis
augcccaggaugaucuu

SEQ ID NO: 1012873 - RNA, 15 nt, Mycobacterium avium subsp. paratuberculosis
augcccagggcgcgu

SEQ ID NO: 1012874 - RNA, 17 nt, Mycobacterium avium subsp. paratuberculosis
augcccgccacggccag

SEQ ID NO: 1012875 - RNA, 19 nt, Mycobacterium avium subsp. paratuberculosis
augcccgccacggccagca

SEQ ID NO: 1012876 - RNA, 12 nt, Mycobacterium avium subsp. paratuberculosis
augcccgccccg

SEQ ID NO: 1012877 - RNA, 17 nt, Mycobacterium avium subsp. paratuberculosis
augcccgcggugcaguc

SEQ ID NO: 1012878 - RNA, 15 nt, Mycobacterium avium subsp. paratuberculosis
augcccgcguccugc

SEQ ID NO: 1012879 - RNA, 16 nt, Mycobacterium avium subsp. paratuberculosis
augccgaggcacagca

SEQ ID NO: 1012880 - RNA, 18 nt, Mycobacterium avium subsp. paratuberculosis
augccgagcagcaccgcg

SEQ ID NO: 1012881 - RNA, 15 nt, Mycobacterium avium subsp. paratuberculosis
augccgaucaggcug

SEQ ID NO: 1012882 - RNA, 19 nt, Mycobacterium avium subsp. paratuberculosis
augccgccgagggccagca

SEQ ID NO: 1012883 - RNA, 22 nt, Mycobacterium avium subsp. paratuberculosis
augccgccgagggccagcagcc

SEQ ID NO: 1012884 - RNA, 19 nt, Mycobacterium avium subsp. paratuberculosis
augccgacaccccacaccg

SEQ ID NO: 1012885 - RNA, 14 nt, Mycobacterium avium subsp. paratuberculosis
augcccuuggccag

SEQ ID NO: 1012886 - RNA, 22 nt, Mycobacterium avium subsp. paratuberculosis
augcccgucgggcgggguggcc

SEQ ID NO: 1012887 - RNA, 20 nt, Mycobacterium avium subsp. paratuberculosis
augcccgggccgucaucgcc

SEQ ID NO: 1012888 - RNA, 17 nt, Mycobacterium avium subsp. paratuberculosis
augcccggggugcuggc

SEQ ID NO: 1012889 - RNA, 17 nt, Mycobacterium avium subsp. paratuberculosis
augcccgucacggccgu

SEQ ID NO: 1012890 - RNA, 20 nt, Mycobacterium avium subsp. paratuberculosis
augccuuggcggcguggggu

SEQ ID NO: 1012891 - RNA, 11 nt, Mycobacterium avium subsp. paratuberculosis
augccuccucg

SEQ ID NO: 1012892 - RNA, 13 nt, Mycobacterium avium subsp. paratuberculosis
augccugcccagc

SEQ ID NO: 1012893 - RNA, 15 nt, Mycobacterium avium subsp. paratuberculosis
augccguugccaggc

SEQ ID NO: 1012894 - RNA, 16 nt, Mycobacterium avium subsp. paratuberculosis
augccguugccaggcc

SEQ ID NO: 1012895 - RNA, 16 nt, Mycobacterium avium subsp. paratuberculosis
augccguucgcgccgu

SEQ ID NO: 1012896 - RNA, 19 nt, Mycobacterium avium subsp. paratuberculosis
augccuacaggugccggcg

SEQ ID NO: 1012897 - RNA, 10 nt, Mycobacterium avium subsp. paratuberculosis
augccgccgg

SEQ ID NO: 1012898 - RNA, 15 nt, Mycobacterium avium subsp. paratuberculosis
augccggaucgggac

SEQ ID NO: 1012899 - RNA, 19 nt, Mycobacterium avium subsp. paratuberculosis
augccggacuugaugcugc

SEQ ID NO: 1012900 - RNA, 16 nt, Mycobacterium avium subsp. paratuberculosis
augccggcgcccagcg

SEQ ID NO: 1012901 - RNA, 13 nt, Mycobacterium avium subsp. paratuberculosis
augccggccaggc

SEQ ID NO: 1012902 - RNA, 19 nt, Mycobacterium avium subsp. paratuberculosis
augccggccaggcacagca

SEQ ID NO: 1012903 - RNA, 14 nt, Mycobacterium avium subsp. paratuberculosis
augccgguguucaa

SEQ ID NO: 1012904 - RNA, 20 nt, Mycobacterium avium subsp. paratuberculosis
augccggguuucggcccggc

SEQ ID NO: 1012905 - RNA, 16 nt, Mycobacterium avium subsp. paratuberculosis
augccgugcgcgcugg

SEQ ID NO: 1012906 - RNA, 22 nt, Mycobacterium avium subsp. paratuberculosis
augcaggcccugcccgaagcug

SEQ ID NO: 1012907 - RNA, 13 nt, Mycobacterium avium subsp. paratuberculosis
augcagccgccgc

SEQ ID NO: 1012908 - RNA, 22 nt, Mycobacterium avium subsp. paratuberculosis
augcagccgccgcggagcggcg

SEQ ID NO: 1012909 - RNA, 23 nt, Mycobacterium avium subsp. paratuberculosis
augcagugguugagcagcagacc

SEQ ID NO: 1012910 - RNA, 19 nt, Mycobacterium avium subsp. paratuberculosis
augccagacgcgcaccgcc

SEQ ID NO: 1012911 - RNA, 20 nt, Mycobacterium avium subsp. paratuberculosis
augauguucuccggcccggc

SEQ ID NO: 1012912 - RNA, 22 nt, Mycobacterium avium subsp. paratuberculosis
augauguagcggcggucggcgc

SEQ ID NO: 1012913 - RNA, 14 nt, Mycobacterium avium subsp. paratuberculosis
augaugucggccgg

SEQ ID NO: 1012914 - RNA, 16 nt, Mycobacterium avium subsp. paratuberculosis
augaugucggccggca

SEQ ID NO: 1012915 - RNA, 18 nt, Mycobacterium avium subsp. paratuberculosis
augauggucagccgcacc

SEQ ID NO: 1012916 - RNA, 18 nt, Mycobacterium avium subsp. paratuberculosis
augaugaaaccggccagc

SEQ ID NO: 1012917 - RNA, 22 nt, Mycobacterium avium subsp. paratuberculosis
augaugaaaccggccagcagca

SEQ ID NO: 1012918 - RNA, 14 nt, Mycobacterium avium subsp. paratuberculosis
augaccaggucgcc

SEQ ID NO: 1012919 - RNA, 17 nt, Mycobacterium avium subsp. paratuberculosis
augaauccgcgcagcag

SEQ ID NO: 1012920 - RNA, 22 nt, Mycobacterium avium subsp. paratuberculosis
augacgcgcuuguacaggucga

SEQ ID NO: 1012921 - RNA, 13 nt, Mycobacterium avium subsp. paratuberculosis
augacgaacaugc

SEQ ID NO: 1012922 - RNA, 22 nt, Mycobacterium avium subsp. paratuberculosis
augacgacggucaccggcaggc

SEQ ID NO: 1012923 - RNA, 17 nt, Mycobacterium avium subsp. paratuberculosis
augaccuucugaucggg

SEQ ID NO: 1012924 - RNA, 19 nt, Mycobacterium avium subsp. paratuberculosis
augaaaccggccagcagca

SEQ ID NO: 1012925 - RNA, 20 nt, Mycobacterium avium subsp. paratuberculosis
augaaaccggccagcagcag

SEQ ID NO: 1012926 - RNA, 18 nt, Mycobacterium avium subsp. paratuberculosis
augaagccccggaccgga

SEQ ID NO: 1012927 - RNA, 21 nt, Mycobacterium avium subsp. paratuberculosis
augaagccgccgacgguggcc

SEQ ID NO: 1012928 - RNA, 19 nt, Mycobacterium avium subsp. paratuberculosis
augaagccguugccgccgc

SEQ ID NO: 1012929 - RNA, 14 nt, Mycobacterium avium subsp. paratuberculosis
augaagaccuggcc

SEQ ID NO: 1012930 - RNA, 13 nt, Mycobacterium avium subsp. paratuberculosis
aucuugaccaggg

SEQ ID NO: 1012931 - RNA, 15 nt, Mycobacterium avium subsp. paratuberculosis
aucuugaccaggguu

SEQ ID NO: 1012932 - RNA, 18 nt, Mycobacterium avium subsp. paratuberculosis
aucuggcgguuggacagg

SEQ ID NO: 1012933 - RNA, 19 nt, Mycobacterium avium subsp. paratuberculosis
aucuggcgguuggacaggc

SEQ ID NO: 1012934 - RNA, 18 nt, Mycobacterium avium subsp. paratuberculosis
aucuggcuggugauggcc

SEQ ID NO: 1012935 - RNA, 23 nt, Mycobacterium avium subsp. paratuberculosis
aucuggcgaucgaugcccagcgc

SEQ ID NO: 1012936 - RNA, 13 nt, Mycobacterium avium subsp. paratuberculosis
auguggucggcca

SEQ ID NO: 1012937 - RNA, 14 nt, Mycobacterium avium subsp. paratuberculosis
augugggccgcagc

SEQ ID NO: 1012938 - RNA, 18 nt, Mycobacterium avium subsp. paratuberculosis
augugggccgcagcagcg

SEQ ID NO: 1012939 - RNA, 19 nt, Mycobacterium avium subsp. paratuberculosis
augucgacgccgugcugcc

SEQ ID NO: 1012940 - RNA, 20 nt, Mycobacterium avium subsp. paratuberculosis
augucgaccucggccaccac

SEQ ID NO: 1012941 - RNA, 17 nt, Mycobacterium avium subsp. paratuberculosis
auguccucgggaaccca

SEQ ID NO: 1012942 - RNA, 18 nt, Mycobacterium avium subsp. paratuberculosis
augugaucggcggccacc

SEQ ID NO: 1012943 - RNA, 17 nt, Mycobacterium avium subsp. paratuberculosis
auguaguucagcagccg

SEQ ID NO: 1012944 - RNA, 18 nt, Mycobacterium avium subsp. paratuberculosis
auguaguucagcagccgg

SEQ ID NO: 1012945 - RNA, 19 nt, Mycobacterium avium subsp. paratuberculosis
auguaguucagcagccggc

SEQ ID NO: 1012946 - RNA, 15 nt, Mycobacterium avium subsp. paratuberculosis
augguuuccacugcc

SEQ ID NO: 1012947 - RNA, 16 nt, Mycobacterium avium subsp. paratuberculosis
auguaagcgaauacca

SEQ ID NO: 1012948 - RNA, 23 nt, Mycobacterium avium subsp. paratuberculosis
auguaagcgaauaccaucaaccc

SEQ ID NO: 1012949 - RNA, 12 nt, Mycobacterium avium subsp. paratuberculosis
auggcagcagcc

SEQ ID NO: 1012950 - RNA, 14 nt, Mycobacterium avium subsp. paratuberculosis
augcgaugagcucg

SEQ ID NO: 1012951 - RNA, 17 nt, Mycobacterium avium subsp. paratuberculosis
augcgcagcgcccaggc

SEQ ID NO: 1012952 - RNA, 13 nt, Mycobacterium avium subsp. paratuberculosis
augcgcaucaugu

SEQ ID NO: 1012953 - RNA, 15 nt, Mycobacterium avium subsp. paratuberculosis
augcgcaccugcggc

SEQ ID NO: 1012954 - RNA, 21 nt, Mycobacterium avium subsp. paratuberculosis
auggccagcgcgucgcacagc

SEQ ID NO: 1012955 - RNA, 21 nt, Mycobacterium avium subsp. paratuberculosis
auggccagcucgucgcggaac

SEQ ID NO: 1012956 - RNA, 17 nt, Mycobacterium avium subsp. paratuberculosis
auggccaggaacggcgc

SEQ ID NO: 1012957 - RNA, 16 nt, Mycobacterium avium subsp. paratuberculosis
auggccagcaccaccg

SEQ ID NO: 1012958 - RNA, 22 nt, Mycobacterium avium subsp. paratuberculosis
auggggaucgaacggcaccucg

SEQ ID NO: 1012959 - RNA, 21 nt, Mycobacterium avium subsp. paratuberculosis
augggcgcgaucaggcugccg

SEQ ID NO: 1012960 - RNA, 21 nt, Mycobacterium avium subsp. paratuberculosis
augggcauugcccaucgccac

SEQ ID NO: 1012961 - RNA, 13 nt, Mycobacterium avium subsp. paratuberculosis
auggucgccugcu

SEQ ID NO: 1012962 - RNA, 22 nt, Mycobacterium avium subsp. paratuberculosis
auggugaacuccgucucgccgu

SEQ ID NO: 1012963 - RNA, 14 nt, Mycobacterium avium subsp. paratuberculosis
auggugucccauuc

SEQ ID NO: 1012964 - RNA, 22 nt, Mycobacterium avium subsp. paratuberculosis
augguguuccaccagcggccgu

SEQ ID NO: 1012965 - RNA, 14 nt, Mycobacterium avium subsp. paratuberculosis
auguugggccaugc

SEQ ID NO: 1012966 - RNA, 17 nt, Mycobacterium avium subsp. paratuberculosis
auguuguccggaacacc

SEQ ID NO: 1012967 - RNA, 23 nt, Mycobacterium avium subsp. paratuberculosis
auuagcgcguguccagaacucgg

SEQ ID NO: 1012968 - RNA, 22 nt, Mycobacterium avium subsp. paratuberculosis
auuggguugcggugcuugcuga

SEQ ID NO: 1012969 - RNA, 11 nt, Mycobacterium avium subsp. paratuberculosis
auugucaucau

SEQ ID NO: 1012970 - RNA, 14 nt, Mycobacterium avium subsp. paratuberculosis
auuguucggccacc

SEQ ID NO: 1012971 - RNA, 16 nt, Mycobacterium avium subsp. paratuberculosis
auuguucggccaccgc

SEQ ID NO: 1012972 - RNA, 18 nt, Mycobacterium avium subsp. paratuberculosis
auugccuugcuccacacu

SEQ ID NO: 1012973 - RNA, 11 nt, Mycobacterium avium subsp. paratuberculosis
auugggcuggg

SEQ ID NO: 1012974 - RNA, 22 nt, Mycobacterium avium subsp. paratuberculosis
auugcccgacuccucacaccuc

SEQ ID NO: 1012975 - RNA, 19 nt, Mycobacterium avium subsp. paratuberculosis
auugcccuuggacaccugc

SEQ ID NO: 1012976 - RNA, 15 nt, Mycobacterium avium subsp. paratuberculosis
auugccgggcaccag

SEQ ID NO: 1012977 - RNA, 13 nt, Mycobacterium avium subsp. paratuberculosis
auugacggcccac

SEQ ID NO: 1012978 - RNA, 18 nt, Mycobacterium avium subsp. paratuberculosis
auucagcaccuuccaucg

SEQ ID NO: 1012979 - RNA, 15 nt, Mycobacterium avium subsp. paratuberculosis
auuucaucgcggcga

SEQ ID NO: 1012980 - RNA, 17 nt, Mycobacterium avium subsp. paratuberculosis
caaaaacgagaugcccc

SEQ ID NO: 1012981 - RNA, 17 nt, Mycobacterium avium subsp. paratuberculosis
caaaagcauccggccgu

SEQ ID NO: 1012982 - RNA, 12 nt, Mycobacterium avium subsp. paratuberculosis
caaaacaucccg

SEQ ID NO: 1012983 - RNA, 16 nt, Mycobacterium avium subsp. paratuberculosis
caaggucuccgggcug

SEQ ID NO: 1012984 - RNA, 23 nt, Mycobacterium avium subsp. paratuberculosis
caaggugauucgcgcggcgccca

SEQ ID NO: 1012985 - RNA, 14 nt, Mycobacterium avium subsp. paratuberculosis
caaggggaacaacg

SEQ ID NO: 1012986 - RNA, 14 nt, Mycobacterium avium subsp. paratuberculosis
caaggggccgggcu

SEQ ID NO: 1012987 - RNA, 11 nt, Mycobacterium avium subsp. paratuberculosis
caaggcgagca

SEQ ID NO: 1012988 - RNA, 18 nt, Mycobacterium avium subsp. paratuberculosis
caagcguauccggccagc

SEQ ID NO: 1012989 - RNA, 14 nt, Mycobacterium avium subsp. paratuberculosis
caagcaccggcugg

SEQ ID NO: 1012990 - RNA, 19 nt, Mycobacterium avium subsp. paratuberculosis
caagcaguaugcccgccgc

SEQ ID NO: 1012991 - RNA, 17 nt, Mycobacterium avium subsp. paratuberculosis
caagccggccagcagcg

SEQ ID NO: 1012992 - RNA, 16 nt, Mycobacterium avium subsp. paratuberculosis
caagccggccaggccc

SEQ ID NO: 1012993 - RNA, 18 nt, Mycobacterium avium subsp. paratuberculosis
caagcccuuuggcggcca

SEQ ID NO: 1012994 - RNA, 16 nt, Mycobacterium avium subsp. paratuberculosis
caauacggggcauccc

SEQ ID NO: 1012995 - RNA, 20 nt, Mycobacterium avium subsp. paratuberculosis
caaugaccggcaccagcagg

SEQ ID NO: 1012996 - RNA, 13 nt, Mycobacterium avium subsp. paratuberculosis
caaucuucuccgc

SEQ ID NO: 1012997 - RNA, 16 nt, Mycobacterium avium subsp. paratuberculosis
caaugauggucagccg

SEQ ID NO: 1012998 - RNA, 23 nt, Mycobacterium avium subsp. paratuberculosis
caauccggcgggccucgccgcuu

SEQ ID NO: 1012999 - RNA, 19 nt, Mycobacterium avium subsp. paratuberculosis
caaucggauuucccgcuug

SEQ ID NO: 1013000 - RNA, 15 nt, Mycobacterium avium subsp. paratuberculosis
caaucggcgccggcu

SEQ ID NO: 1013001 - RNA, 18 nt, Mycobacterium avium subsp. paratuberculosis
caaucucgggcaccccug

SEQ ID NO: 1013002 - RNA, 20 nt, Mycobacterium avium subsp. paratuberculosis
caaccgugacugggugggac

SEQ ID NO: 1013003 - RNA, 19 nt, Mycobacterium avium subsp. paratuberculosis
caacgccacguagcagcag

SEQ ID NO: 1013004 - RNA, 19 nt, Mycobacterium avium subsp. paratuberculosis
caacgccagcgugagcuca

SEQ ID NO: 1013005 - RNA, 15 nt, Mycobacterium avium subsp. paratuberculosis
caacggcuggcgcag

SEQ ID NO: 1013006 - RNA, 18 nt, Mycobacterium avium subsp. paratuberculosis
caacggcucgccgcgcau

SEQ ID NO: 1013007 - RNA, 20 nt, Mycobacterium avium subsp. paratuberculosis
caacggcucggucaagccgg

SEQ ID NO: 1013008 - RNA, 14 nt, Mycobacterium avium subsp. paratuberculosis
caacgcguucuccu

SEQ ID NO: 1013009 - RNA, 19 nt, Mycobacterium avium subsp. paratuberculosis
caacgcugaccgcaggaaa

SEQ ID NO: 1013010 - RNA, 14 nt, Mycobacterium avium subsp. paratuberculosis
caacggccaaccgc

SEQ ID NO: 1013011 - RNA, 20 nt, Mycobacterium avium subsp. paratuberculosis
caacgucucugucgucgacc

SEQ ID NO: 1013012 - RNA, 14 nt, Mycobacterium avium subsp. paratuberculosis
caacgugccacagg

SEQ ID NO: 1013013 - RNA, 18 nt, Mycobacterium avium subsp. paratuberculosis
caacugcaucgccagcac

SEQ ID NO: 1013014 - RNA, 19 nt, Mycobacterium avium subsp. paratuberculosis
caacuggcgaccgguccgc

SEQ ID NO: 1013015 - RNA, 18 nt, Mycobacterium avium subsp. paratuberculosis
caacuguucgcggcuggc

SEQ ID NO: 1013016 - RNA, 20 nt, Mycobacterium avium subsp. paratuberculosis
caacuggucgugcagcaccg

SEQ ID NO: 1013017 - RNA, 21 nt, Mycobacterium avium subsp. paratuberculosis
caacuggucgugcagcaccgc

SEQ ID NO: 1013018 - RNA, 20 nt, Mycobacterium avium subsp. paratuberculosis
caacugggcggccugcaccc

SEQ ID NO: 1013019 - RNA, 20 nt, Mycobacterium avium subsp. paratuberculosis
caaccacugauccgucaucu

SEQ ID NO: 1013020 - RNA, 14 nt, Mycobacterium avium subsp. paratuberculosis
caacaggcccagca

SEQ ID NO: 1013021 - RNA, 19 nt, Mycobacterium avium subsp. paratuberculosis
caaccccgcgcgcgggcca

SEQ ID NO: 1013022 - RNA, 16 nt, Mycobacterium avium subsp. paratuberculosis
caacccgagcaccggg

SEQ ID NO: 1013023 - RNA, 21 nt, Mycobacterium avium subsp. paratuberculosis
caacccgaaagcccccagcuc

SEQ ID NO: 1013024 - RNA, 19 nt, Mycobacterium avium subsp. paratuberculosis
caaccgagucgcugcagca

SEQ ID NO: 1013025 - RNA, 12 nt, Mycobacterium avium subsp. paratuberculosis
caaccgccggca

SEQ ID NO: 1013026 - RNA, 16 nt, Mycobacterium avium subsp. paratuberculosis
caaccgcagcaucuug

SEQ ID NO: 1013027 - RNA, 20 nt, Mycobacterium avium subsp. paratuberculosis
caaccgcagucguucggcca

SEQ ID NO: 1013028 - RNA, 21 nt, Mycobacterium avium subsp. paratuberculosis
caaccgccgaaacaccggcuu

SEQ ID NO: 1013029 - RNA, 19 nt, Mycobacterium avium subsp. paratuberculosis
caaccgcucggcgaucugg

SEQ ID NO: 1013030 - RNA, 21 nt, Mycobacterium avium subsp. paratuberculosis
caaccggaauggcagcagccg

SEQ ID NO: 1013031 - RNA, 23 nt, Mycobacterium avium subsp. paratuberculosis
caaccgggucacgaacuccuuga

SEQ ID NO: 1013032 - RNA, 20 nt, Mycobacterium avium subsp. paratuberculosis
caaccgguagcgguccucga

SEQ ID NO: 1013033 - RNA, 14 nt, Mycobacterium avium subsp. paratuberculosis
caacaccaccuugg

SEQ ID NO: 1013034 - RNA, 16 nt, Mycobacterium avium subsp. paratuberculosis
caacaccaacgacagc

SEQ ID NO: 1013035 - RNA, 14 nt, Mycobacterium avium subsp. paratuberculosis
caacacgcccugca

SEQ ID NO: 1013036 - RNA, 19 nt, Mycobacterium avium subsp. paratuberculosis
caacacuuuuaaggagcaa

SEQ ID NO: 1013037 - RNA, 18 nt, Mycobacterium avium subsp. paratuberculosis
caaaucgcuugcgccgca

SEQ ID NO: 1013038 - RNA, 17 nt, Mycobacterium avium subsp. paratuberculosis
caaauagccgucggcgg

SEQ ID NO: 1013039 - RNA, 19 nt, Mycobacterium avium subsp. paratuberculosis
caaagguaguccagcacag

SEQ ID NO: 1013040 - RNA, 19 nt, Mycobacterium avium subsp. paratuberculosis
caaagcaccgcgaacagca

SEQ ID NO: 1013041 - RNA, 19 nt, Mycobacterium avium subsp. paratuberculosis
cagcaacugcucgaccagc

SEQ ID NO: 1013042 - RNA, 22 nt, Mycobacterium avium subsp. paratuberculosis
cagcaacugcucgaccagcccc

SEQ ID NO: 1013043 - RNA, 16 nt, Mycobacterium avium subsp. paratuberculosis
cagcaacucgcgcucc

SEQ ID NO: 1013044 - RNA, 14 nt, Mycobacterium avium subsp. paratuberculosis
cagcaacagcagcg

SEQ ID NO: 1013045 - RNA, 19 nt, Mycobacterium avium subsp. paratuberculosis
cagcaacccgaaagccccc

SEQ ID NO: 1013046 - RNA, 17 nt, Mycobacterium avium subsp. paratuberculosis
cagcaacgccagggccc

SEQ ID NO: 1013047 - RNA, 16 nt, Mycobacterium avium subsp. paratuberculosis
cagcaacgacccggcc

SEQ ID NO: 1013048 - RNA, 17 nt, Mycobacterium avium subsp. paratuberculosis
cagcacaaaagggccca

SEQ ID NO: 1013049 - RNA, 22 nt, Mycobacterium avium subsp. paratuberculosis
cagcacaaaagggcccaugccg

SEQ ID NO: 1013050 - RNA, 12 nt, Mycobacterium avium subsp. paratuberculosis
cagcaccaccuu

SEQ ID NO: 1013051 - RNA, 19 nt, Mycobacterium avium subsp. paratuberculosis
cagcaccacgaacgcugcc

SEQ ID NO: 1013052 - RNA, 16 nt, Mycobacterium avium subsp. paratuberculosis
cagcaccaccgcgagc

SEQ ID NO: 1013053 - RNA, 13 nt, Mycobacterium avium subsp. paratuberculosis
cagcaccaccgug

SEQ ID NO: 1013054 - RNA, 16 nt, Mycobacterium avium subsp. paratuberculosis
cagcaccaccaggucu

SEQ ID NO: 1013055 - RNA, 22 nt, Mycobacterium avium subsp. paratuberculosis
cagcaccacuuccagcaccggc

SEQ ID NO: 1013056 - RNA, 22 nt, Mycobacterium avium subsp. paratuberculosis
cagcaccagaugcaccucgccc

SEQ ID NO: 1013057 - RNA, 16 nt, Mycobacterium avium subsp. paratuberculosis
cagcaccagcaccacc

SEQ ID NO: 1013058 - RNA, 18 nt, Mycobacterium avium subsp. paratuberculosis
cagcaccagcccgaugcc

SEQ ID NO: 1013059 - RNA, 13 nt, Mycobacterium avium subsp. paratuberculosis
cagcaccaggccc

SEQ ID NO: 1013060 - RNA, 23 nt, Mycobacterium avium subsp. paratuberculosis
cagcaccaggcccuccuggguga

SEQ ID NO: 1013061 - RNA, 16 nt, Mycobacterium avium subsp. paratuberculosis
cagcaccagcgcgcgg

SEQ ID NO: 1013062 - RNA, 23 nt, Mycobacterium avium subsp. paratuberculosis
cagcaccagcggcaccagguacc

SEQ ID NO: 1013063 - RNA, 19 nt, Mycobacterium avium subsp. paratuberculosis
cagcaccagcguggccggc

SEQ ID NO: 1013064 - RNA, 14 nt, Mycobacterium avium subsp. paratuberculosis
cagcaccagcgccg

SEQ ID NO: 1013065 - RNA, 16 nt, Mycobacterium avium subsp. paratuberculosis
cagcaccagcgccgcg

SEQ ID NO: 1013066 - RNA, 22 nt, Mycobacterium avium subsp. paratuberculosis
cagcacauccgguugcaccgcg

SEQ ID NO: 1013067 - RNA, 13 nt, Mycobacterium avium subsp. paratuberculosis
cagcaccaccaac

SEQ ID NO: 1013068 - RNA, 15 nt, Mycobacterium avium subsp. paratuberculosis
cagcaccaccaacag

SEQ ID NO: 1013069 - RNA, 12 nt, Mycobacterium avium subsp. paratuberculosis
cagcaccaccac

SEQ ID NO: 1013070 - RNA, 11 nt, Mycobacterium avium subsp. paratuberculosis
cagcaaaaccc

SEQ ID NO: 1013071 - RNA, 15 nt, Mycobacterium avium subsp. paratuberculosis
cagcaaacccagcac

SEQ ID NO: 1013072 - RNA, 17 nt, Mycobacterium avium subsp. paratuberculosis
cagcaaacccagcacca

SEQ ID NO: 1013073 - RNA, 21 nt, Mycobacterium avium subsp. paratuberculosis
cagcaaaccgaccgccgcggc

SEQ ID NO: 1013074 - RNA, 17 nt, Mycobacterium avium subsp. paratuberculosis
cagaugucgcguucccg

SEQ ID NO: 1013075 - RNA, 22 nt, Mycobacterium avium subsp. paratuberculosis
cagaugucgcguucccgggccc

SEQ ID NO: 1013076 - RNA, 19 nt, Mycobacterium avium subsp. paratuberculosis
cagaugucgguggccuugg

SEQ ID NO: 1013077 - RNA, 20 nt, Mycobacterium avium subsp. paratuberculosis
cagauggugaaggugcccuc

SEQ ID NO: 1013078 - RNA, 22 nt, Mycobacterium avium subsp. paratuberculosis
cagauggugaaggugcccuccu

SEQ ID NO: 1013079 - RNA, 18 nt, Mycobacterium avium subsp. paratuberculosis
cagauucuucuucagccc

SEQ ID NO: 1013080 - RNA, 22 nt, Mycobacterium avium subsp. paratuberculosis
cagaucgcugaugcgcaacagc

SEQ ID NO: 1013081 - RNA, 22 nt, Mycobacterium avium subsp. paratuberculosis
cagaucgcccgggcggcggggc

SEQ ID NO: 1013082 - RNA, 18 nt, Mycobacterium avium subsp. paratuberculosis
cagaucgccaucaggguc

SEQ ID NO: 1013083 - RNA, 19 nt, Mycobacterium avium subsp. paratuberculosis
cagaucgcccaucaccgca

SEQ ID NO: 1013084 - RNA, 18 nt, Mycobacterium avium subsp. paratuberculosis
cagaucgcggcccgccgc

SEQ ID NO: 1013085 - RNA, 15 nt, Mycobacterium avium subsp. paratuberculosis
cagauccucagcagc

SEQ ID NO: 1013086 - RNA, 23 nt, Mycobacterium avium subsp. paratuberculosis
cagauccucgaauccgcgggcgu

SEQ ID NO: 1013087 - RNA, 18 nt, Mycobacterium avium subsp. paratuberculosis
cagaucgacccccaccgc

SEQ ID NO: 1013088 - RNA, 19 nt, Mycobacterium avium subsp. paratuberculosis
cagaucgacccccaccgcg

SEQ ID NO: 1013089 - RNA, 23 nt, Mycobacterium avium subsp. paratuberculosis
cagaucgacccccaccgcgacac

SEQ ID NO: 1013090 - RNA, 16 nt, Mycobacterium avium subsp. paratuberculosis
cagaucgccagcaccg

SEQ ID NO: 1013091 - RNA, 21 nt, Mycobacterium avium subsp. paratuberculosis
cagaucgucucggccagccgg

SEQ ID NO: 1013092 - RNA, 16 nt, Mycobacterium avium subsp. paratuberculosis
cagaucggccagccac

SEQ ID NO: 1013093 - RNA, 14 nt, Mycobacterium avium subsp. paratuberculosis
cagaucguccaucg

SEQ ID NO: 1013094 - RNA, 17 nt, Mycobacterium avium subsp. paratuberculosis
cagaucgucggcacugc

SEQ ID NO: 1013095 - RNA, 20 nt, Mycobacterium avium subsp. paratuberculosis
cagaucgucggcacugcccg

SEQ ID NO: 1013096 - RNA, 22 nt, Mycobacterium avium subsp. paratuberculosis
cagaugccagacgaacgcggcc

SEQ ID NO: 1013097 - RNA, 16 nt, Mycobacterium avium subsp. paratuberculosis
cagaugccggugcaga

SEQ ID NO: 1013098 - RNA, 16 nt, Mycobacterium avium subsp. paratuberculosis
cagaugccgcccaggu

SEQ ID NO: 1013099 - RNA, 19 nt, Mycobacterium avium subsp. paratuberculosis
cagaugccgcucggcgcuc

SEQ ID NO: 1013100 - RNA, 14 nt, Mycobacterium avium subsp. paratuberculosis
cagaugcggcacca

SEQ ID NO: 1013101 - RNA, 17 nt, Mycobacterium avium subsp. paratuberculosis
cagaugcggcaccagcc

SEQ ID NO: 1013102 - RNA, 15 nt, Mycobacterium avium subsp. paratuberculosis
cagaugcccagcagg

SEQ ID NO: 1013103 - RNA, 14 nt, Mycobacterium avium subsp. paratuberculosis
cagaugcccgcccc

SEQ ID NO: 1013104 - RNA, 15 nt, Mycobacterium avium subsp. paratuberculosis
cagauaggccagcgc

SEQ ID NO: 1013105 - RNA, 20 nt, Mycobacterium avium subsp. paratuberculosis
cagauagguggucucccaga

SEQ ID NO: 1013106 - RNA, 20 nt, Mycobacterium avium subsp. paratuberculosis
cagauagccuuugccgugcu

SEQ ID NO: 1013107 - RNA, 16 nt, Mycobacterium avium subsp. paratuberculosis
cagauagaugagccgc

SEQ ID NO: 1013108 - RNA, 22 nt, Mycobacterium avium subsp. paratuberculosis
cagaggcguuuucggugugccg

SEQ ID NO: 1013109 - RNA, 20 nt, Mycobacterium avium subsp. paratuberculosis
cagagcgcgaaaaccagcac

SEQ ID NO: 1013110 - RNA, 22 nt, Mycobacterium avium subsp. paratuberculosis
cagagcgcgaaaaccagcaccg

SEQ ID NO: 1013111 - RNA, 19 nt, Mycobacterium avium subsp. paratuberculosis
cagagcggugacaucgcca

SEQ ID NO: 1013112 - RNA, 17 nt, Mycobacterium avium subsp. paratuberculosis
cagacuugggcagcagg

SEQ ID NO: 1013113 - RNA, 19 nt, Mycobacterium avium subsp. paratuberculosis
cagacucacggcggcagcg

SEQ ID NO: 1013114 - RNA, 22 nt, Mycobacterium avium subsp. paratuberculosis
cagacguagcaccagucggcca

SEQ ID NO: 1013115 - RNA, 18 nt, Mycobacterium avium subsp. paratuberculosis
cagacguccagcgccgcc

SEQ ID NO: 1013116 - RNA, 19 nt, Mycobacterium avium subsp. paratuberculosis
cagacgugacgugccccuc

SEQ ID NO: 1013117 - RNA, 19 nt, Mycobacterium avium subsp. paratuberculosis
cagacgcgggcgcccagca

SEQ ID NO: 1013118 - RNA, 21 nt, Mycobacterium avium subsp. paratuberculosis
cagacgcgggcgcccagcaaa

SEQ ID NO: 1013119 - RNA, 17 nt, Mycobacterium avium subsp. paratuberculosis
cagacgaugggccgccc

SEQ ID NO: 1013120 - RNA, 18 nt, Mycobacterium avium subsp. paratuberculosis
cagacgaugggccgcccg

SEQ ID NO: 1013121 - RNA, 18 nt, Mycobacterium avium subsp. paratuberculosis
cagacgaaguagaagauc

SEQ ID NO: 1013122 - RNA, 23 nt, Mycobacterium avium subsp. paratuberculosis
cagacgaauucggagaccagguc

SEQ ID NO: 1013123 - RNA, 13 nt, Mycobacterium avium subsp. paratuberculosis
cagaccguggagg

SEQ ID NO: 1013124 - RNA, 14 nt, Mycobacterium avium subsp. paratuberculosis
cagaauucgccggg

SEQ ID NO: 1013125 - RNA, 17 nt, Mycobacterium avium subsp. paratuberculosis
cagacacaaaagcgccc

SEQ ID NO: 1013126 - RNA, 13 nt, Mycobacterium avium subsp. paratuberculosis
cagacacagcacg

SEQ ID NO: 1013127 - RNA, 16 nt, Mycobacterium avium subsp. paratuberculosis
cagaccacaagggcca

SEQ ID NO: 1013128 - RNA, 14 nt, Mycobacterium avium subsp. paratuberculosis
cagacccagcagcg

SEQ ID NO: 1013129 - RNA, 17 nt, Mycobacterium avium subsp. paratuberculosis
cagacccagcagcggcc

SEQ ID NO: 1013130 - RNA, 20 nt, Mycobacterium avium subsp. paratuberculosis
cagacccagcagcggccggc

SEQ ID NO: 1013131 - RNA, 18 nt, Mycobacterium avium subsp. paratuberculosis
cagaccaggaccagguug

SEQ ID NO: 1013132 - RNA, 20 nt, Mycobacterium avium subsp. paratuberculosis
cagaccggguuugaggccca

SEQ ID NO: 1013133 - RNA, 23 nt, Mycobacterium avium subsp. paratuberculosis
cagaccggugagcaccgggaaca

SEQ ID NO: 1013134 - RNA, 18 nt, Mycobacterium avium subsp. paratuberculosis
cagaccgcgaucagcccc

SEQ ID NO: 1013135 - RNA, 16 nt, Mycobacterium avium subsp. paratuberculosis
cagacccccagcagcg

SEQ ID NO: 1013136 - RNA, 22 nt, Mycobacterium avium subsp. paratuberculosis
cagaccgaacccgggcgcgccc

SEQ ID NO: 1013137 - RNA, 18 nt, Mycobacterium avium subsp. paratuberculosis
cagaagcuaacgccagcu

SEQ ID NO: 1013138 - RNA, 17 nt, Mycobacterium avium subsp. paratuberculosis
cagaagcuccacgccgc

SEQ ID NO: 1013139 - RNA, 21 nt, Mycobacterium avium subsp. paratuberculosis
cagaagcuccacgccgccggg

SEQ ID NO: 1013140 - RNA, 18 nt, Mycobacterium avium subsp. paratuberculosis
cagaaccguugagcagca

SEQ ID NO: 1013141 - RNA, 22 nt, Mycobacterium avium subsp. paratuberculosis
cagaaccggggccagcacgccc

SEQ ID NO: 1013142 - RNA, 20 nt, Mycobacterium avium subsp. paratuberculosis
cagaaccgcucggcggcgcc

SEQ ID NO: 1013143 - RNA, 16 nt, Mycobacterium avium subsp. paratuberculosis
cagaaccagcaccgcc

SEQ ID NO: 1013144 - RNA, 23 nt, Mycobacterium avium subsp. paratuberculosis
cagaacgacgcgcucagccccag

SEQ ID NO: 1013145 - RNA, 21 nt, Mycobacterium avium subsp. paratuberculosis
cagaacugcugccguccaaca

SEQ ID NO: 1013146 - RNA, 14 nt, Mycobacterium avium subsp. paratuberculosis
cagaaacaccaucg

SEQ ID NO: 1013147 - RNA, 12 nt, Mycobacterium avium subsp. paratuberculosis
cagaacaccagc

SEQ ID NO: 1013148 - RNA, 13 nt, Mycobacterium avium subsp. paratuberculosis
cagaacaccagcg

SEQ ID NO: 1013149 - RNA, 14 nt, Mycobacterium avium subsp. paratuberculosis
cagaacaccaccgc

SEQ ID NO: 1013150 - RNA, 13 nt, Mycobacterium avium subsp. paratuberculosis
cagaacagccagu

SEQ ID NO: 1013151 - RNA, 20 nt, Mycobacterium avium subsp. paratuberculosis
cagaacagccgguccgaccg

SEQ ID NO: 1013152 - RNA, 23 nt, Mycobacterium avium subsp. paratuberculosis
cagaacagccgguccgaccgcca

SEQ ID NO: 1013153 - RNA, 12 nt, Mycobacterium avium subsp. paratuberculosis
cacuucgccggg

SEQ ID NO: 1013154 - RNA, 21 nt, Mycobacterium avium subsp. paratuberculosis
cacuucgcuguaguagccggg

SEQ ID NO: 1013155 - RNA, 21 nt, Mycobacterium avium subsp. paratuberculosis
cacugcuucgggucgccgguc

SEQ ID NO: 1013156 - RNA, 19 nt, Mycobacterium avium subsp. paratuberculosis
cacugggcgucggcgcccc

SEQ ID NO: 1013157 - RNA, 18 nt, Mycobacterium avium subsp. paratuberculosis
cacuggucguugcacacc

SEQ ID NO: 1013158 - RNA, 18 nt, Mycobacterium avium subsp. paratuberculosis
cacuuaacaccucgccuc

SEQ ID NO: 1013159 - RNA, 18 nt, Mycobacterium avium subsp. paratuberculosis
cacugcacggccucgguc

SEQ ID NO: 1013160 - RNA, 15 nt, Mycobacterium avium subsp. paratuberculosis
cacugccgccgccca

SEQ ID NO: 1013161 - RNA, 12 nt, Mycobacterium avium subsp. paratuberculosis
cagccacaccgc

SEQ ID NO: 1013162 - RNA, 18 nt, Mycobacterium avium subsp. paratuberculosis
cagccacaccgccgcggc

SEQ ID NO: 1013163 - RNA, 15 nt, Mycobacterium avium subsp. paratuberculosis
cagccacaccgccgg

SEQ ID NO: 1013164 - RNA, 21 nt, Mycobacterium avium subsp. paratuberculosis
cagccacaucugguugcggua

SEQ ID NO: 1013165 - RNA, 17 nt, Mycobacterium avium subsp. paratuberculosis
cagccaccacaucgcug

SEQ ID NO: 1013166 - RNA, 21 nt, Mycobacterium avium subsp. paratuberculosis
cagccaaagccuacggcgccg

SEQ ID NO: 1013167 - RNA, 17 nt, Mycobacterium avium subsp. paratuberculosis
cagcauuucgcgcggca

SEQ ID NO: 1013168 - RNA, 15 nt, Mycobacterium avium subsp. paratuberculosis
cagcauuuccgagcg

SEQ ID NO: 1013169 - RNA, 20 nt, Mycobacterium avium subsp. paratuberculosis
cagcauggucucgcugaucu

SEQ ID NO: 1013170 - RNA, 20 nt, Mycobacterium avium subsp. paratuberculosis
cagcauccgcuggugcgcgc

SEQ ID NO: 1013171 - RNA, 14 nt, Mycobacterium avium subsp. paratuberculosis
cagcaucgccgucg

SEQ ID NO: 1013172 - RNA, 23 nt, Mycobacterium avium subsp. paratuberculosis
cagcaucuccgagucggcgucgg

SEQ ID NO: 1013173 - RNA, 18 nt, Mycobacterium avium subsp. paratuberculosis
cagcaucgggacgccugc

SEQ ID NO: 1013174 - RNA, 17 nt, Mycobacterium avium subsp. paratuberculosis
cagcaucggucccaguc

SEQ ID NO: 1013175 - RNA, 19 nt, Mycobacterium avium subsp. paratuberculosis
cagcaucggucccaguccc

SEQ ID NO: 1013176 - RNA, 15 nt, Mycobacterium avium subsp. paratuberculosis
cagcaugccgagcac

SEQ ID NO: 1013177 - RNA, 20 nt, Mycobacterium avium subsp. paratuberculosis
cagcaugaucaccgccagcg

SEQ ID NO: 1013178 - RNA, 21 nt, Mycobacterium avium subsp. paratuberculosis
cagcaugaucaccgccagcgc

SEQ ID NO: 1013179 - RNA, 22 nt, Mycobacterium avium subsp. paratuberculosis
cagcaucucuugaugcagcgcc

SEQ ID NO: 1013180 - RNA, 23 nt, Mycobacterium avium subsp. paratuberculosis
cagcaucucuugaugcagcgccu

SEQ ID NO: 1013181 - RNA, 19 nt, Mycobacterium avium subsp. paratuberculosis
cagcaugaagaucagcacc

SEQ ID NO: 1013182 - RNA, 14 nt, Mycobacterium avium subsp. paratuberculosis
cagcaguuuguccu

SEQ ID NO: 1013183 - RNA, 18 nt, Mycobacterium avium subsp. paratuberculosis
cagcaucauugagccgcu

SEQ ID NO: 1013184 - RNA, 21 nt, Mycobacterium avium subsp. paratuberculosis
cagcaucauugagccgcucgc

SEQ ID NO: 1013185 - RNA, 14 nt, Mycobacterium avium subsp. paratuberculosis
cagcauccaggugg

SEQ ID NO: 1013186 - RNA, 17 nt, Mycobacterium avium subsp. paratuberculosis
cagccccaccggccacu

SEQ ID NO: 1013187 - RNA, 13 nt, Mycobacterium avium subsp. paratuberculosis
cagccccagcacg

SEQ ID NO: 1013188 - RNA, 20 nt, Mycobacterium avium subsp. paratuberculosis
cagccccagcacgaugacga

SEQ ID NO: 1013189 - RNA, 13 nt, Mycobacterium avium subsp. paratuberculosis
cagccccucgacc

SEQ ID NO: 1013190 - RNA, 17 nt, Mycobacterium avium subsp. paratuberculosis
cagccccucgaccaccu

SEQ ID NO: 1013191 - RNA, 19 nt, Mycobacterium avium subsp. paratuberculosis
cagccccucguccaggugc

SEQ ID NO: 1013192 - RNA, 14 nt, Mycobacterium avium subsp. paratuberculosis
cagccccugcacca

SEQ ID NO: 1013193 - RNA, 22 nt, Mycobacterium avium subsp. paratuberculosis
cagcccgaacagccgggccagc

SEQ ID NO: 1013194 - RNA, 14 nt, Mycobacterium avium subsp. paratuberculosis
cagcccgaccaccu

SEQ ID NO: 1013195 - RNA, 17 nt, Mycobacterium avium subsp. paratuberculosis
cagcccgaccaccuccc

SEQ ID NO: 1013196 - RNA, 19 nt, Mycobacterium avium subsp. paratuberculosis
cagcccgaccaccuccccg

SEQ ID NO: 1013197 - RNA, 15 nt, Mycobacterium avium subsp. paratuberculosis
cagcccccaccgcgc

SEQ ID NO: 1013198 - RNA, 18 nt, Mycobacterium avium subsp. paratuberculosis
cagcccccaccgcgccgu

SEQ ID NO: 1013199 - RNA, 14 nt, Mycobacterium avium subsp. paratuberculosis
cagcccccacgcuc

SEQ ID NO: 1013200 - RNA, 15 nt, Mycobacterium avium subsp. paratuberculosis
cagccccagcggagc

SEQ ID NO: 1013201 - RNA, 20 nt, Mycobacterium avium subsp. paratuberculosis
cagccccaggaggcacuggc

SEQ ID NO: 1013202 - RNA, 19 nt, Mycobacterium avium subsp. paratuberculosis
cagccagguggugaacucu

SEQ ID NO: 1013203 - RNA, 16 nt, Mycobacterium avium subsp. paratuberculosis
cagccaggugugcggc

SEQ ID NO: 1013204 - RNA, 14 nt, Mycobacterium avium subsp. paratuberculosis
cagccagguccggg

SEQ ID NO: 1013205 - RNA, 18 nt, Mycobacterium avium subsp. paratuberculosis
cagccaguccgccgccgu

SEQ ID NO: 1013206 - RNA, 23 nt, Mycobacterium avium subsp. paratuberculosis
cagccaguccgccgccgucccac

SEQ ID NO: 1013207 - RNA, 11 nt, Mycobacterium avium subsp. paratuberculosis
cagccagccgg

SEQ ID NO: 1013208 - RNA, 13 nt, Mycobacterium avium subsp. paratuberculosis
cagccagccgcgc

SEQ ID NO: 1013209 - RNA, 15 nt, Mycobacterium avium subsp. paratuberculosis
cagccagccggugcg

SEQ ID NO: 1013210 - RNA, 23 nt, Mycobacterium avium subsp. paratuberculosis
cagccagcguuuggccugcggca

SEQ ID NO: 1013211 - RNA, 14 nt, Mycobacterium avium subsp. paratuberculosis
cagccaggccgccg

SEQ ID NO: 1013212 - RNA, 16 nt, Mycobacterium avium subsp. paratuberculosis
cagccaggccgccggg

SEQ ID NO: 1013213 - RNA, 18 nt, Mycobacterium avium subsp. paratuberculosis
cagccaggccgucggcgc

SEQ ID NO: 1013214 - RNA, 15 nt, Mycobacterium avium subsp. paratuberculosis
cagccagcucggcgu

SEQ ID NO: 1013215 - RNA, 22 nt, Mycobacterium avium subsp. paratuberculosis
cagccagcuggugaagcugccg

SEQ ID NO: 1013216 - RNA, 14 nt, Mycobacterium avium subsp. paratuberculosis
cagccaggacagcg

SEQ ID NO: 1013217 - RNA, 17 nt, Mycobacterium avium subsp. paratuberculosis
cagccacuccaccaccg

SEQ ID NO: 1013218 - RNA, 20 nt, Mycobacterium avium subsp. paratuberculosis
cagccagaacacgccccggc

SEQ ID NO: 1013219 - RNA, 23 nt, Mycobacterium avium subsp. paratuberculosis
cagccagaacacgccccggcggg

SEQ ID NO: 1013220 - RNA, 20 nt, Mycobacterium avium subsp. paratuberculosis
cagccacgacaccagcgucg

SEQ ID NO: 1013221 - RNA, 12 nt, Mycobacterium avium subsp. paratuberculosis
cagccaccgccc

SEQ ID NO: 1013222 - RNA, 12 nt, Mycobacterium avium subsp. paratuberculosis
cagccacggcag

SEQ ID NO: 1013223 - RNA, 17 nt, Mycobacterium avium subsp. paratuberculosis
cagcaguuccggagcgc

SEQ ID NO: 1013224 - RNA, 16 nt, Mycobacterium avium subsp. paratuberculosis
cagcagugccaccacc

SEQ ID NO: 1013225 - RNA, 17 nt, Mycobacterium avium subsp. paratuberculosis
cagcagugccaccacca

SEQ ID NO: 1013226 - RNA, 14 nt, Mycobacterium avium subsp. paratuberculosis
cagcagucccucga

SEQ ID NO: 1013227 - RNA, 15 nt, Mycobacterium avium subsp. paratuberculosis
cagcaguccggcggu

SEQ ID NO: 1013228 - RNA, 20 nt, Mycobacterium avium subsp. paratuberculosis
cagcaguccggcggucagca

SEQ ID NO: 1013229 - RNA, 14 nt, Mycobacterium avium subsp. paratuberculosis
cagcagguugaucc

SEQ ID NO: 1013230 - RNA, 22 nt, Mycobacterium avium subsp. paratuberculosis
cagcagguugauccgcgcgucu

SEQ ID NO: 1013231 - RNA, 13 nt, Mycobacterium avium subsp. paratuberculosis
cagcaggucggcc

SEQ ID NO: 1013232 - RNA, 16 nt, Mycobacterium avium subsp. paratuberculosis
cagcaggucggccagc

SEQ ID NO: 1013233 - RNA, 20 nt, Mycobacterium avium subsp. paratuberculosis
cagcaggucggccagcugcg

SEQ ID NO: 1013234 - RNA, 17 nt, Mycobacterium avium subsp. paratuberculosis
cagcaggugcaccaccc

SEQ ID NO: 1013235 - RNA, 14 nt, Mycobacterium avium subsp. paratuberculosis
cagcaggugcgcca

SEQ ID NO: 1013236 - RNA, 22 nt, Mycobacterium avium subsp. paratuberculosis
cagcagguccuguccggucucg

SEQ ID NO: 1013237 - RNA, 21 nt, Mycobacterium avium subsp. paratuberculosis
cagcaggucgaaggcggccgc

SEQ ID NO: 1013238 - RNA, 22 nt, Mycobacterium avium subsp. paratuberculosis
cagcagggucagcgacaacggc

SEQ ID NO: 1013239 - RNA, 19 nt, Mycobacterium avium subsp. paratuberculosis
cagcagguaaaccagcagc

SEQ ID NO: 1013240 - RNA, 20 nt, Mycobacterium avium subsp. paratuberculosis
cagcagguaaaccagcagcg

SEQ ID NO: 1013241 - RNA, 12 nt, Mycobacterium avium subsp. paratuberculosis
cagcagguagau

SEQ ID NO: 1013242 - RNA, 20 nt, Mycobacterium avium subsp. paratuberculosis
cagcagguagaucgccagcg

SEQ ID NO: 1013243 - RNA, 21 nt, Mycobacterium avium subsp. paratuberculosis
cagcaggcuggcggcgaucac

SEQ ID NO: 1013244 - RNA, 14 nt, Mycobacterium avium subsp. paratuberculosis
cagcagggcaucuc

SEQ ID NO: 1013245 - RNA, 17 nt, Mycobacterium avium subsp. paratuberculosis
cagcagggugccgccgc

SEQ ID NO: 1013246 - RNA, 11 nt, Mycobacterium avium subsp. paratuberculosis
cagcagggucg

SEQ ID NO: 1013247 - RNA, 12 nt, Mycobacterium avium subsp. paratuberculosis
cagcagggcgcc

SEQ ID NO: 1013248 - RNA, 14 nt, Mycobacterium avium subsp. paratuberculosis
cagcagggcgccga

SEQ ID NO: 1013249 - RNA, 15 nt, Mycobacterium avium subsp. paratuberculosis
cagcagggcgccgac

SEQ ID NO: 1013250 - RNA, 14 nt, Mycobacterium avium subsp. paratuberculosis
cagcagggcgcgca

SEQ ID NO: 1013251 - RNA, 20 nt, Mycobacterium avium subsp. paratuberculosis
cagcagggcgcgcaucugcu

SEQ ID NO: 1013252 - RNA, 14 nt, Mycobacterium avium subsp. paratuberculosis
cagcaggcgccggu

SEQ ID NO: 1013253 - RNA, 13 nt, Mycobacterium avium subsp. paratuberculosis
cagcaggcgcgcc

SEQ ID NO: 1013254 - RNA, 13 nt, Mycobacterium avium subsp. paratuberculosis
cagcaggccccgu

SEQ ID NO: 1013255 - RNA, 23 nt, Mycobacterium avium subsp. paratuberculosis
cagcagcucgguggcgucggcgg

SEQ ID NO: 1013256 - RNA, 21 nt, Mycobacterium avium subsp. paratuberculosis
cagcagcuugaucgccggggc

SEQ ID NO: 1013257 - RNA, 21 nt, Mycobacterium avium subsp. paratuberculosis
cagcagcuugacgucggucag

SEQ ID NO: 1013258 - RNA, 17 nt, Mycobacterium avium subsp. paratuberculosis
cagcagcuuggcgaagu

SEQ ID NO: 1013259 - RNA, 22 nt, Mycobacterium avium subsp. paratuberculosis
cagcagcuugggggccgacgcu

SEQ ID NO: 1013260 - RNA, 17 nt, Mycobacterium avium subsp. paratuberculosis
cagcagcugcgggacca

SEQ ID NO: 1013261 - RNA, 22 nt, Mycobacterium avium subsp. paratuberculosis
cagcagcugcgggaccagcgcc

SEQ ID NO: 1013262 - RNA, 23 nt, Mycobacterium avium subsp. paratuberculosis
cagcagcugcgucggcaccagcg

SEQ ID NO: 1013263 - RNA, 16 nt, Mycobacterium avium subsp. paratuberculosis
cagcagcuagcccaga

SEQ ID NO: 1013264 - RNA, 19 nt, Mycobacterium avium subsp. paratuberculosis
cagcagcucauacagcggc

SEQ ID NO: 1013265 - RNA, 15 nt, Mycobacterium avium subsp. paratuberculosis
cagcagcgucugcgc

SEQ ID NO: 1013266 - RNA, 19 nt, Mycobacterium avium subsp. paratuberculosis
cagcaggaugaugaccgac

SEQ ID NO: 1013267 - RNA, 14 nt, Mycobacterium avium subsp. paratuberculosis
cagcaggaccaggc

SEQ ID NO: 1013268 - RNA, 20 nt, Mycobacterium avium subsp. paratuberculosis
cagcagcggccggcgcagcc

SEQ ID NO: 1013269 - RNA, 13 nt, Mycobacterium avium subsp. paratuberculosis
cagcagcggcagc

SEQ ID NO: 1013270 - RNA, 21 nt, Mycobacterium avium subsp. paratuberculosis
cagcagcggggcgagcuggcc

SEQ ID NO: 1013271 - RNA, 19 nt, Mycobacterium avium subsp. paratuberculosis
cagcagcggcuugagcgcc

SEQ ID NO: 1013272 - RNA, 23 nt, Mycobacterium avium subsp. paratuberculosis
cagcagcggcuugagcgccagcg

SEQ ID NO: 1013273 - RNA, 13 nt, Mycobacterium avium subsp. paratuberculosis
cagcagcgcggcg

SEQ ID NO: 1013274 - RNA, 13 nt, Mycobacterium avium subsp. paratuberculosis
cagcagcgcggca

SEQ ID NO: 1013275 - RNA, 17 nt, Mycobacterium avium subsp. paratuberculosis
cagcagcgcgccgcgcu

SEQ ID NO: 1013276 - RNA, 12 nt, Mycobacterium avium subsp. paratuberculosis
cagcagcgcgcc

SEQ ID NO: 1013277 - RNA, 17 nt, Mycobacterium avium subsp. paratuberculosis
cagcagcgcgacgcauu

SEQ ID NO: 1013278 - RNA, 19 nt, Mycobacterium avium subsp. paratuberculosis
cagcagcgccgccaccggc

SEQ ID NO: 1013279 - RNA, 13 nt, Mycobacterium avium subsp. paratuberculosis
cagcagcgccgcu

SEQ ID NO: 1013280 - RNA, 16 nt, Mycobacterium avium subsp. paratuberculosis
cagcagcgaacccgcc

SEQ ID NO: 1013281 - RNA, 14 nt, Mycobacterium avium subsp. paratuberculosis
cagcagccgcugcu

SEQ ID NO: 1013282 - RNA, 18 nt, Mycobacterium avium subsp. paratuberculosis
cagcagccggaaggccaa

SEQ ID NO: 1013283 - RNA, 15 nt, Mycobacterium avium subsp. paratuberculosis
cagcagccggaccca

SEQ ID NO: 1013284 - RNA, 16 nt, Mycobacterium avium subsp. paratuberculosis
cagcagccgggccugc

SEQ ID NO: 1013285 - RNA, 17 nt, Mycobacterium avium subsp. paratuberculosis
cagcagccgccgggcca

SEQ ID NO: 1013286 - RNA, 12 nt, Mycobacterium avium subsp. paratuberculosis
cagcagccgcgc

SEQ ID NO: 1013287 - RNA, 14 nt, Mycobacterium avium subsp. paratuberculosis
cagcagccgcgcca

SEQ ID NO: 1013288 - RNA, 18 nt, Mycobacterium avium subsp. paratuberculosis
cagcagccgcagcaguuc

SEQ ID NO: 1013289 - RNA, 19 nt, Mycobacterium avium subsp. paratuberculosis
cagcagcccgaucaccccc

SEQ ID NO: 1013290 - RNA, 23 nt, Mycobacterium avium subsp. paratuberculosis
cagcagcccgggcugcagcagcg

SEQ ID NO: 1013291 - RNA, 15 nt, Mycobacterium avium subsp. paratuberculosis
cagcagcccgggucc

SEQ ID NO: 1013292 - RNA, 14 nt, Mycobacterium avium subsp. paratuberculosis
cagcagcgccagca

SEQ ID NO: 1013293 - RNA, 17 nt, Mycobacterium avium subsp. paratuberculosis
cagcagcgccagcagcg

SEQ ID NO: 1013294 - RNA, 12 nt, Mycobacterium avium subsp. paratuberculosis
cagcagcgccca

SEQ ID NO: 1013295 - RNA, 21 nt, Mycobacterium avium subsp. paratuberculosis
cagcagcgaggccucgccgcu

SEQ ID NO: 1013296 - RNA, 21 nt, Mycobacterium avium subsp. paratuberculosis
cagcagcgaggcguccagcgc

SEQ ID NO: 1013297 - RNA, 15 nt, Mycobacterium avium subsp. paratuberculosis
cagcagcagcaccag

SEQ ID NO: 1013298 - RNA, 13 nt, Mycobacterium avium subsp. paratuberculosis
cagcagcaccggc

SEQ ID NO: 1013299 - RNA, 16 nt, Mycobacterium avium subsp. paratuberculosis
cagcagcaccggcacc

SEQ ID NO: 1013300 - RNA, 15 nt, Mycobacterium avium subsp. paratuberculosis
cagcagcagcgccgc

SEQ ID NO: 1013301 - RNA, 16 nt, Mycobacterium avium subsp. paratuberculosis
cagcagcagcgcggca

SEQ ID NO: 1013302 - RNA, 16 nt, Mycobacterium avium subsp. paratuberculosis
cagcagcagcggcagc

SEQ ID NO: 1013303 - RNA, 14 nt, Mycobacterium avium subsp. paratuberculosis
cagcagcagcuccc

SEQ ID NO: 1013304 - RNA, 13 nt, Mycobacterium avium subsp. paratuberculosis
cagcagcagcgcc

SEQ ID NO: 1013305 - RNA, 16 nt, Mycobacterium avium subsp. paratuberculosis
cagcagcagcccgaac

SEQ ID NO: 1013306 - RNA, 15 nt, Mycobacterium avium subsp. paratuberculosis
cagcagcagccgcgc

SEQ ID NO: 1013307 - RNA, 12 nt, Mycobacterium avium subsp. paratuberculosis
cagcagccagcu

SEQ ID NO: 1013308 - RNA, 15 nt, Mycobacterium avium subsp. paratuberculosis
cagcagccagcuggu

SEQ ID NO: 1013309 - RNA, 16 nt, Mycobacterium avium subsp. paratuberculosis
cagcagccaggacagc

SEQ ID NO: 1013310 - RNA, 16 nt, Mycobacterium avium subsp. paratuberculosis
cagcagccacgccagc

SEQ ID NO: 1013311 - RNA, 13 nt, Mycobacterium avium subsp. paratuberculosis
cagcagcaccuga

SEQ ID NO: 1013312 - RNA, 14 nt, Mycobacterium avium subsp. paratuberculosis
cagcagcaccugaa

SEQ ID NO: 1013313 - RNA, 17 nt, Mycobacterium avium subsp. paratuberculosis
cagcagcaccuggaucc

SEQ ID NO: 1013314 - RNA, 16 nt, Mycobacterium avium subsp. paratuberculosis
cagcagcaccgcgacc

SEQ ID NO: 1013315 - RNA, 18 nt, Mycobacterium avium subsp. paratuberculosis
cagcagcaccagcgccgc

SEQ ID NO: 1013316 - RNA, 14 nt, Mycobacterium avium subsp. paratuberculosis
cagcagcaccaggg

SEQ ID NO: 1013317 - RNA, 16 nt, Mycobacterium avium subsp. paratuberculosis
cagcagcaccccgauc

SEQ ID NO: 1013318 - RNA, 13 nt, Mycobacterium avium subsp. paratuberculosis
cagcagcacccgg

SEQ ID NO: 1013319 - RNA, 15 nt, Mycobacterium avium subsp. paratuberculosis
cagcagcaccgcaug

SEQ ID NO: 1013320 - RNA, 16 nt, Mycobacterium avium subsp. paratuberculosis
cagcagauagcccagc

SEQ ID NO: 1013321 - RNA, 17 nt, Mycobacterium avium subsp. paratuberculosis
cagcagauagcccagcc

SEQ ID NO: 1013322 - RNA, 19 nt, Mycobacterium avium subsp. paratuberculosis
cagcagauagcccagccag

SEQ ID NO: 1013323 - RNA, 15 nt, Mycobacterium avium subsp. paratuberculosis
cagcagaugccgccc

SEQ ID NO: 1013324 - RNA, 21 nt, Mycobacterium avium subsp. paratuberculosis
cagcagaugccgcccaggugc

SEQ ID NO: 1013325 - RNA, 11 nt, Mycobacterium avium subsp. paratuberculosis
cagcagaugcg

SEQ ID NO: 1013326 - RNA, 13 nt, Mycobacterium avium subsp. paratuberculosis
cagcagaugcgcc

SEQ ID NO: 1013327 - RNA, 22 nt, Mycobacterium avium subsp. paratuberculosis
cagcagaugcgcgucgcggcgc

SEQ ID NO: 1013328 - RNA, 17 nt, Mycobacterium avium subsp. paratuberculosis
cagcagaaccagcaccg

SEQ ID NO: 1013329 - RNA, 19 nt, Mycobacterium avium subsp. paratuberculosis
cagcagaaccagcaccgcc

SEQ ID NO: 1013330 - RNA, 20 nt, Mycobacterium avium subsp. paratuberculosis
cagcagaaaauagcccagcc

SEQ ID NO: 1013331 - RNA, 21 nt, Mycobacterium avium subsp. paratuberculosis
cagcagaaaauagcccagcca

SEQ ID NO: 1013332 - RNA, 22 nt, Mycobacterium avium subsp. paratuberculosis
cagcagaaaauagcccagccag

SEQ ID NO: 1013333 - RNA, 18 nt, Mycobacterium avium subsp. paratuberculosis
cagcacuucauggucguc

SEQ ID NO: 1013334 - RNA, 16 nt, Mycobacterium avium subsp. paratuberculosis
cagcacugagcggcag

SEQ ID NO: 1013335 - RNA, 20 nt, Mycobacterium avium subsp. paratuberculosis
cagcacugagcggcagaagu

SEQ ID NO: 1013336 - RNA, 20 nt, Mycobacterium avium subsp. paratuberculosis
cagcacgugcccgccgugcg

SEQ ID NO: 1013337 - RNA, 15 nt, Mycobacterium avium subsp. paratuberculosis
cagcacguugugcuc

SEQ ID NO: 1013338 - RNA, 20 nt, Mycobacterium avium subsp. paratuberculosis
cagcacguugugcucgucga

SEQ ID NO: 1013339 - RNA, 19 nt, Mycobacterium avium subsp. paratuberculosis
cagcacgugcccagcccgc

SEQ ID NO: 1013340 - RNA, 15 nt, Mycobacterium avium subsp. paratuberculosis
cagcacgucggggug

SEQ ID NO: 1013341 - RNA, 22 nt, Mycobacterium avium subsp. paratuberculosis
cagcacgucggucagcgagcgg

SEQ ID NO: 1013342 - RNA, 17 nt, Mycobacterium avium subsp. paratuberculosis
cagcacguccccgggca

SEQ ID NO: 1013343 - RNA, 19 nt, Mycobacterium avium subsp. paratuberculosis
cagcacggggacgcugaac

SEQ ID NO: 1013344 - RNA, 19 nt, Mycobacterium avium subsp. paratuberculosis
cagcacgcugaucaccacg

SEQ ID NO: 1013345 - RNA, 16 nt, Mycobacterium avium subsp. paratuberculosis
cagcacggccacugcc

SEQ ID NO: 1013346 - RNA, 21 nt, Mycobacterium avium subsp. paratuberculosis
cagcacggccacugccccggc

SEQ ID NO: 1013347 - RNA, 22 nt, Mycobacterium avium subsp. paratuberculosis
cagcacggccagccagccgccc

SEQ ID NO: 1013348 - RNA, 16 nt, Mycobacterium avium subsp. paratuberculosis
cagcacggccgccagg

SEQ ID NO: 1013349 - RNA, 15 nt, Mycobacterium avium subsp. paratuberculosis
cagcacggccgcggc

SEQ ID NO: 1013350 - RNA, 19 nt, Mycobacterium avium subsp. paratuberculosis
cagcacggccgcggccagc

SEQ ID NO: 1013351 - RNA, 15 nt, Mycobacterium avium subsp. paratuberculosis
cagcacggcggcgcu

SEQ ID NO: 1013352 - RNA, 14 nt, Mycobacterium avium subsp. paratuberculosis
cagcacggcggcgu

SEQ ID NO: 1013353 - RNA, 17 nt, Mycobacterium avium subsp. paratuberculosis
cagcacggcggcgugca

SEQ ID NO: 1013354 - RNA, 23 nt, Mycobacterium avium subsp. paratuberculosis
cagcacggcggcgugcaccgccc

SEQ ID NO: 1013355 - RNA, 17 nt, Mycobacterium avium subsp. paratuberculosis
cagcacggccaccagca

SEQ ID NO: 1013356 - RNA, 16 nt, Mycobacterium avium subsp. paratuberculosis
cagcacggcgaccagc

SEQ ID NO: 1013357 - RNA, 22 nt, Mycobacterium avium subsp. paratuberculosis
cagcacgcugaagcccaccgcc

SEQ ID NO: 1013358 - RNA, 19 nt, Mycobacterium avium subsp. paratuberculosis
cagcacgccgggcaugccg

SEQ ID NO: 1013359 - RNA, 22 nt, Mycobacterium avium subsp. paratuberculosis
cagcacgccuuccacgaccugg

SEQ ID NO: 1013360 - RNA, 23 nt, Mycobacterium avium subsp. paratuberculosis
cagcacgccgcggaaggccagcu

SEQ ID NO: 1013361 - RNA, 19 nt, Mycobacterium avium subsp. paratuberculosis
cagcaccgccucggccacc

SEQ ID NO: 1013362 - RNA, 20 nt, Mycobacterium avium subsp. paratuberculosis
cagcaccgccucggccaccu

SEQ ID NO: 1013363 - RNA, 20 nt, Mycobacterium avium subsp. paratuberculosis
cagcaccgccgacaucgccc

SEQ ID NO: 1013364 - RNA, 12 nt, Mycobacterium avium subsp. paratuberculosis
cagcaccgccgc

SEQ ID NO: 1013365 - RNA, 16 nt, Mycobacterium avium subsp. paratuberculosis
cagcaccgcgcggcgg

SEQ ID NO: 1013366 - RNA, 20 nt, Mycobacterium avium subsp. paratuberculosis
cagcaccgcggcguagcgcc

SEQ ID NO: 1013367 - RNA, 17 nt, Mycobacterium avium subsp. paratuberculosis
cagcaccgcgacccagg

SEQ ID NO: 1013368 - RNA, 18 nt, Mycobacterium avium subsp. paratuberculosis
cagcaccgcgacccaggc

SEQ ID NO: 1013369 - RNA, 16 nt, Mycobacterium avium subsp. paratuberculosis
cagcaccgccagcgcc

SEQ ID NO: 1013370 - RNA, 19 nt, Mycobacterium avium subsp. paratuberculosis
cagcaccgccagcgccggc

SEQ ID NO: 1013371 - RNA, 15 nt, Mycobacterium avium subsp. paratuberculosis
cagcaccgcaugggg

SEQ ID NO: 1013372 - RNA, 11 nt, Mycobacterium avium subsp. paratuberculosis
cagcaccgcca

SEQ ID NO: 1013373 - RNA, 21 nt, Mycobacterium avium subsp. paratuberculosis
cagcaccgccagcauccgcug

SEQ ID NO: 1013374 - RNA, 13 nt, Mycobacterium avium subsp. paratuberculosis
cagcaccgccacc

SEQ ID NO: 1013375 - RNA, 12 nt, Mycobacterium avium subsp. paratuberculosis
cagcacccgggu

SEQ ID NO: 1013376 - RNA, 20 nt, Mycobacterium avium subsp. paratuberculosis
cagcacccgacuucggcucg

SEQ ID NO: 1013377 - RNA, 18 nt, Mycobacterium avium subsp. paratuberculosis
cagcaccccgccgcagcc

SEQ ID NO: 1013378 - RNA, 21 nt, Mycobacterium avium subsp. paratuberculosis
cagcacccgcaacgcgcgcga

SEQ ID NO: 1013379 - RNA, 20 nt, Mycobacterium avium subsp. paratuberculosis
cagcacccgcucgcgggccc

SEQ ID NO: 1013380 - RNA, 13 nt, Mycobacterium avium subsp. paratuberculosis
cagcacccgggcc

SEQ ID NO: 1013381 - RNA, 14 nt, Mycobacterium avium subsp. paratuberculosis
cagcacccagaugc

SEQ ID NO: 1013382 - RNA, 15 nt, Mycobacterium avium subsp. paratuberculosis
cagcacccagcacag

SEQ ID NO: 1013383 - RNA, 19 nt, Mycobacterium avium subsp. paratuberculosis
cagcaccaugaucaggccc

SEQ ID NO: 1013384 - RNA, 13 nt, Mycobacterium avium subsp. paratuberculosis
cagcaccauggcg

SEQ ID NO: 1013385 - RNA, 14 nt, Mycobacterium avium subsp. paratuberculosis
cagcaccaggcuga

SEQ ID NO: 1013386 - RNA, 16 nt, Mycobacterium avium subsp. paratuberculosis
cagcaccaggcugacc

SEQ ID NO: 1013387 - RNA, 13 nt, Mycobacterium avium subsp. paratuberculosis
cagcaccaggugg

SEQ ID NO: 1013388 - RNA, 22 nt, Mycobacterium avium subsp. paratuberculosis
cagcaccagguggcccgacccg

SEQ ID NO: 1013389 - RNA, 19 nt, Mycobacterium avium subsp. paratuberculosis
cagcaccuccgacagcccc

SEQ ID NO: 1013390 - RNA, 22 nt, Mycobacterium avium subsp. paratuberculosis
cagcaccuccgacagcccccgc

SEQ ID NO: 1013391 - RNA, 13 nt, Mycobacterium avium subsp. paratuberculosis
cagcaccuccugg

SEQ ID NO: 1013392 - RNA, 17 nt, Mycobacterium avium subsp. paratuberculosis
cagcaccuccuggguga

SEQ ID NO: 1013393 - RNA, 19 nt, Mycobacterium avium subsp. paratuberculosis
cagcaccucggcgaccacg

SEQ ID NO: 1013394 - RNA, 20 nt, Mycobacterium avium subsp. paratuberculosis
cagcaccucggcgaccacgu

SEQ ID NO: 1013395 - RNA, 16 nt, Mycobacterium avium subsp. paratuberculosis
cagcaccucgcgcagc

SEQ ID NO: 1013396 - RNA, 19 nt, Mycobacterium avium subsp. paratuberculosis
cagcaccucgcgcagcacc

SEQ ID NO: 1013397 - RNA, 17 nt, Mycobacterium avium subsp. paratuberculosis
cagcaccucgcggcagc

SEQ ID NO: 1013398 - RNA, 18 nt, Mycobacterium avium subsp. paratuberculosis
cagcaccgucaccgccuc

SEQ ID NO: 1013399 - RNA, 22 nt, Mycobacterium avium subsp. paratuberculosis
cagcaccgucaccuucaccccc

SEQ ID NO: 1013400 - RNA, 16 nt, Mycobacterium avium subsp. paratuberculosis
cagcaccguccgcaga

SEQ ID NO: 1013401 - RNA, 15 nt, Mycobacterium avium subsp. paratuberculosis
cagcaccgugcugau

SEQ ID NO: 1013402 - RNA, 19 nt, Mycobacterium avium subsp. paratuberculosis
cagcaccgggcccagcucg

SEQ ID NO: 1013403 - RNA, 19 nt, Mycobacterium avium subsp. paratuberculosis
cagcaccggcgucgacagc

SEQ ID NO: 1013404 - RNA, 20 nt, Mycobacterium avium subsp. paratuberculosis
cagcaccggcgucgacagcc

SEQ ID NO: 1013405 - RNA, 16 nt, Mycobacterium avium subsp. paratuberculosis
cagcaccggcgcgccg

SEQ ID NO: 1013406 - RNA, 19 nt, Mycobacterium avium subsp. paratuberculosis
cagcaccggcgcgccgcgu

SEQ ID NO: 1013407 - RNA, 14 nt, Mycobacterium avium subsp. paratuberculosis
cagcaccggcaccg

SEQ ID NO: 1013408 - RNA, 16 nt, Mycobacterium avium subsp. paratuberculosis
cagcaccggcaccgcg

SEQ ID NO: 1013409 - RNA, 14 nt, Mycobacterium avium subsp. paratuberculosis
cagcacgcaggcgu

SEQ ID NO: 1013410 - RNA, 15 nt, Mycobacterium avium subsp. paratuberculosis
cagcacgcccagccc

SEQ ID NO: 1013411 - RNA, 19 nt, Mycobacterium avium subsp. paratuberculosis
cagcacgaucccgccgccc

SEQ ID NO: 1013412 - RNA, 15 nt, Mycobacterium avium subsp. paratuberculosis
cagcacgaccccgcc

SEQ ID NO: 1013413 - RNA, 18 nt, Mycobacterium avium subsp. paratuberculosis
cagcacgaccccgcccac

SEQ ID NO: 1013414 - RNA, 20 nt, Mycobacterium avium subsp. paratuberculosis
cagcacgaccccgcccacga

SEQ ID NO: 1013415 - RNA, 16 nt, Mycobacterium avium subsp. paratuberculosis
cagcacgacgccgcug

SEQ ID NO: 1013416 - RNA, 16 nt, Mycobacterium avium subsp. paratuberculosis
cagcacgaacaccacg

SEQ ID NO: 1013417 - RNA, 22 nt, Mycobacterium avium subsp. paratuberculosis
cagcaccugcucgaugcgcgcc

SEQ ID NO: 1013418 - RNA, 23 nt, Mycobacterium avium subsp. paratuberculosis
cagcaccugcucgaugcgcgcca

SEQ ID NO: 1013419 - RNA, 20 nt, Mycobacterium avium subsp. paratuberculosis
cagcaccuucagcgggcgca

SEQ ID NO: 1013420 - RNA, 20 nt, Mycobacterium avium subsp. paratuberculosis
cagccgaugcgcccgcgcca

SEQ ID NO: 1013421 - RNA, 20 nt, Mycobacterium avium subsp. paratuberculosis
cagccgagauggcaacacgu

SEQ ID NO: 1013422 - RNA, 19 nt, Mycobacterium avium subsp. paratuberculosis
cagcccuacccguccagcg

SEQ ID NO: 1013423 - RNA, 19 nt, Mycobacterium avium subsp. paratuberculosis
cagcccguuguggcggcca

SEQ ID NO: 1013424 - RNA, 22 nt, Mycobacterium avium subsp. paratuberculosis
cagcccggcuaauucgggccgc

SEQ ID NO: 1013425 - RNA, 15 nt, Mycobacterium avium subsp. paratuberculosis
cagcccgucccggcc

SEQ ID NO: 1013426 - RNA, 16 nt, Mycobacterium avium subsp. paratuberculosis
cagcccgucccggccc

SEQ ID NO: 1013427 - RNA, 20 nt, Mycobacterium avium subsp. paratuberculosis
cagcccgucggccuccagcc

SEQ ID NO: 1013428 - RNA, 21 nt, Mycobacterium avium subsp. paratuberculosis
cagcccugcucggccagcggg

SEQ ID NO: 1013429 - RNA, 18 nt, Mycobacterium avium subsp. paratuberculosis
cagcccggaggcgaugcg

SEQ ID NO: 1013430 - RNA, 20 nt, Mycobacterium avium subsp. paratuberculosis
cagcccggcccgucgagcgg

SEQ ID NO: 1013431 - RNA, 20 nt, Mycobacterium avium subsp. paratuberculosis
cagcccggccgaggucacca

SEQ ID NO: 1013432 - RNA, 16 nt, Mycobacterium avium subsp. paratuberculosis
cagcccggccagccgg

SEQ ID NO: 1013433 - RNA, 16 nt, Mycobacterium avium subsp. paratuberculosis
cagcccggcccagccg

SEQ ID NO: 1013434 - RNA, 18 nt, Mycobacterium avium subsp. paratuberculosis
cagcccggcccagccggu

SEQ ID NO: 1013435 - RNA, 12 nt, Mycobacterium avium subsp. paratuberculosis
cagcccggcccc

SEQ ID NO: 1013436 - RNA, 19 nt, Mycobacterium avium subsp. paratuberculosis
cagcccggccccaccgccg

SEQ ID NO: 1013437 - RNA, 21 nt, Mycobacterium avium subsp. paratuberculosis
cagcccggccccaccgccgcu

SEQ ID NO: 1013438 - RNA, 18 nt, Mycobacterium avium subsp. paratuberculosis
cagcccggcgcugcgccc

SEQ ID NO: 1013439 - RNA, 19 nt, Mycobacterium avium subsp. paratuberculosis
cagcccggcgaugaucagg

SEQ ID NO: 1013440 - RNA, 16 nt, Mycobacterium avium subsp. paratuberculosis
cagcccgggcugcagc

SEQ ID NO: 1013441 - RNA, 17 nt, Mycobacterium avium subsp. paratuberculosis
cagcccgggcugcagca

SEQ ID NO: 1013442 - RNA, 15 nt, Mycobacterium avium subsp. paratuberculosis
cagcccggugacgaa

SEQ ID NO: 1013443 - RNA, 20 nt, Mycobacterium avium subsp. paratuberculosis
cagcccggugaucgccgccc

SEQ ID NO: 1013444 - RNA, 16 nt, Mycobacterium avium subsp. paratuberculosis
cagcccggcguccugc

SEQ ID NO: 1013445 - RNA, 19 nt, Mycobacterium avium subsp. paratuberculosis
cagcccgauguuggccuca

SEQ ID NO: 1013446 - RNA, 21 nt, Mycobacterium avium subsp. paratuberculosis
cagcccgauucagccggcggu

SEQ ID NO: 1013447 - RNA, 15 nt, Mycobacterium avium subsp. paratuberculosis
cagcccgagcaccag

SEQ ID NO: 1013448 - RNA, 12 nt, Mycobacterium avium subsp. paratuberculosis
cagcccgagcgg

SEQ ID NO: 1013449 - RNA, 19 nt, Mycobacterium avium subsp. paratuberculosis
cagcccgaucgccagcgcc

SEQ ID NO: 1013450 - RNA, 20 nt, Mycobacterium avium subsp. paratuberculosis
cagcccgaucgccagcgccc

SEQ ID NO: 1013451 - RNA, 15 nt, Mycobacterium avium subsp. paratuberculosis
cagcccgcgggcggc

SEQ ID NO: 1013452 - RNA, 13 nt, Mycobacterium avium subsp. paratuberculosis
cagcccgcgucgu

SEQ ID NO: 1013453 - RNA, 17 nt, Mycobacterium avium subsp. paratuberculosis
cagcccgcugaccaggc

SEQ ID NO: 1013454 - RNA, 22 nt, Mycobacterium avium subsp. paratuberculosis
cagcccggaaaaccccaccccg

SEQ ID NO: 1013455 - RNA, 13 nt, Mycobacterium avium subsp. paratuberculosis
cagcccgcgccga

SEQ ID NO: 1013456 - RNA, 22 nt, Mycobacterium avium subsp. paratuberculosis
cagcccgcgccgagcaaccggg

SEQ ID NO: 1013457 - RNA, 14 nt, Mycobacterium avium subsp. paratuberculosis
cagcccgccgggcu

SEQ ID NO: 1013458 - RNA, 19 nt, Mycobacterium avium subsp. paratuberculosis
cagcccgccgauggacacg

SEQ ID NO: 1013459 - RNA, 14 nt, Mycobacterium avium subsp. paratuberculosis
cagcccgcccuggc

SEQ ID NO: 1013460 - RNA, 16 nt, Mycobacterium avium subsp. paratuberculosis
cagcccgcccuggcug

SEQ ID NO: 1013461 - RNA, 14 nt, Mycobacterium avium subsp. paratuberculosis
cagcccgccgcguc

SEQ ID NO: 1013462 - RNA, 18 nt, Mycobacterium avium subsp. paratuberculosis
cagcccgccgcguccggg

SEQ ID NO: 1013463 - RNA, 20 nt, Mycobacterium avium subsp. paratuberculosis
cagccgcggucuuuggcgua

SEQ ID NO: 1013464 - RNA, 23 nt, Mycobacterium avium subsp. paratuberculosis
cagccgcgucacgucggccugca

SEQ ID NO: 1013465 - RNA, 17 nt, Mycobacterium avium subsp. paratuberculosis
cagccgcggacggccag

SEQ ID NO: 1013466 - RNA, 16 nt, Mycobacterium avium subsp. paratuberculosis
cagccgcugcagcgcc

SEQ ID NO: 1013467 - RNA, 17 nt, Mycobacterium avium subsp. paratuberculosis
cagccgcugcagcgccg

SEQ ID NO: 1013468 - RNA, 18 nt, Mycobacterium avium subsp. paratuberculosis
cagccgcugcagcgccgc

SEQ ID NO: 1013469 - RNA, 13 nt, Mycobacterium avium subsp. paratuberculosis
cagccgcucccgg

SEQ ID NO: 1013470 - RNA, 14 nt, Mycobacterium avium subsp. paratuberculosis
cagccgcuccucgu

SEQ ID NO: 1013471 - RNA, 17 nt, Mycobacterium avium subsp. paratuberculosis
cagccggagccggccuc

SEQ ID NO: 1013472 - RNA, 21 nt, Mycobacterium avium subsp. paratuberculosis
cagccggccaccgccccagcc

SEQ ID NO: 1013473 - RNA, 23 nt, Mycobacterium avium subsp. paratuberculosis
cagccggccaccgccccagccga

SEQ ID NO: 1013474 - RNA, 23 nt, Mycobacterium avium subsp. paratuberculosis
cagccgcuuggcgcgccgcaccu

SEQ ID NO: 1013475 - RNA, 13 nt, Mycobacterium avium subsp. paratuberculosis
cagccgggccgcc

SEQ ID NO: 1013476 - RNA, 20 nt, Mycobacterium avium subsp. paratuberculosis
cagccgggccgcccgcgcgu

SEQ ID NO: 1013477 - RNA, 14 nt, Mycobacterium avium subsp. paratuberculosis
cagccgggccugcg

SEQ ID NO: 1013478 - RNA, 13 nt, Mycobacterium avium subsp. paratuberculosis
cagccgggccagc

SEQ ID NO: 1013479 - RNA, 15 nt, Mycobacterium avium subsp. paratuberculosis
cagccgggccagccc

SEQ ID NO: 1013480 - RNA, 20 nt, Mycobacterium avium subsp. paratuberculosis
cagccgggccgagcgcgccg

SEQ ID NO: 1013481 - RNA, 22 nt, Mycobacterium avium subsp. paratuberculosis
cagccgggccgagcgcgccgcc

SEQ ID NO: 1013482 - RNA, 20 nt, Mycobacterium avium subsp. paratuberculosis
cagccgggcggccgggccgg

SEQ ID NO: 1013483 - RNA, 16 nt, Mycobacterium avium subsp. paratuberculosis
cagccgggcggccucg

SEQ ID NO: 1013484 - RNA, 19 nt, Mycobacterium avium subsp. paratuberculosis
cagccgggcggcgccgaac

SEQ ID NO: 1013485 - RNA, 15 nt, Mycobacterium avium subsp. paratuberculosis
cagccgggcggcgcu

SEQ ID NO: 1013486 - RNA, 20 nt, Mycobacterium avium subsp. paratuberculosis
cagccgggcggcggccuccg

SEQ ID NO: 1013487 - RNA, 17 nt, Mycobacterium avium subsp. paratuberculosis
cagccgggugcgggcca

SEQ ID NO: 1013488 - RNA, 19 nt, Mycobacterium avium subsp. paratuberculosis
cagccgggugcgggccagc

SEQ ID NO: 1013489 - RNA, 19 nt, Mycobacterium avium subsp. paratuberculosis
cagccgggggcggugcagc

SEQ ID NO: 1013490 - RNA, 20 nt, Mycobacterium avium subsp. paratuberculosis
cagccgggggcggugcagcc

SEQ ID NO: 1013491 - RNA, 14 nt, Mycobacterium avium subsp. paratuberculosis
cagccggguagcgc

SEQ ID NO: 1013492 - RNA, 21 nt, Mycobacterium avium subsp. paratuberculosis
cagccggguagcgccgccggg

SEQ ID NO: 1013493 - RNA, 23 nt, Mycobacterium avium subsp. paratuberculosis
cagccggguccgcacccgggccc

SEQ ID NO: 1013494 - RNA, 23 nt, Mycobacterium avium subsp. paratuberculosis
cagccggguggcccgcgcgcuga

SEQ ID NO: 1013495 - RNA, 14 nt, Mycobacterium avium subsp. paratuberculosis
cagccggcgcggca

SEQ ID NO: 1013496 - RNA, 20 nt, Mycobacterium avium subsp. paratuberculosis
cagccggcgcggcagggcca

SEQ ID NO: 1013497 - RNA, 14 nt, Mycobacterium avium subsp. paratuberculosis
cagccggcgggcgc

SEQ ID NO: 1013498 - RNA, 15 nt, Mycobacterium avium subsp. paratuberculosis
cagccggcgggcgcu

SEQ ID NO: 1013499 - RNA, 14 nt, Mycobacterium avium subsp. paratuberculosis
cagccggcucaggg

SEQ ID NO: 1013500 - RNA, 22 nt, Mycobacterium avium subsp. paratuberculosis
cagccggcccgcaucgcggcga

SEQ ID NO: 1013501 - RNA, 16 nt, Mycobacterium avium subsp. paratuberculosis
cagccggcccuccagg

SEQ ID NO: 1013502 - RNA, 13 nt, Mycobacterium avium subsp. paratuberculosis
cagccggcgagcg

SEQ ID NO: 1013503 - RNA, 19 nt, Mycobacterium avium subsp. paratuberculosis
cagccggcgcaccagggug

SEQ ID NO: 1013504 - RNA, 21 nt, Mycobacterium avium subsp. paratuberculosis
cagccggcgcccgcaggccgc

SEQ ID NO: 1013505 - RNA, 14 nt, Mycobacterium avium subsp. paratuberculosis
cagccgccggccac

SEQ ID NO: 1013506 - RNA, 16 nt, Mycobacterium avium subsp. paratuberculosis
cagccgccggccacca

SEQ ID NO: 1013507 - RNA, 15 nt, Mycobacterium avium subsp. paratuberculosis
cagccgccggcucag

SEQ ID NO: 1013508 - RNA, 19 nt, Mycobacterium avium subsp. paratuberculosis
cagccgccgggcuucccca

SEQ ID NO: 1013509 - RNA, 17 nt, Mycobacterium avium subsp. paratuberculosis
cagccgccgucgcgcca

SEQ ID NO: 1013510 - RNA, 20 nt, Mycobacterium avium subsp. paratuberculosis
cagccgccgcgacacccgcg

SEQ ID NO: 1013511 - RNA, 14 nt, Mycobacterium avium subsp. paratuberculosis
cagccgcaucaccu

SEQ ID NO: 1013512 - RNA, 20 nt, Mycobacterium avium subsp. paratuberculosis
cagccgcccggcgccccgcc

SEQ ID NO: 1013513 - RNA, 14 nt, Mycobacterium avium subsp. paratuberculosis
cagccgcccguccu

SEQ ID NO: 1013514 - RNA, 19 nt, Mycobacterium avium subsp. paratuberculosis
cagccgcgcggccggccac

SEQ ID NO: 1013515 - RNA, 14 nt, Mycobacterium avium subsp. paratuberculosis
cagccgcgcggcgu

SEQ ID NO: 1013516 - RNA, 20 nt, Mycobacterium avium subsp. paratuberculosis
cagccgcggcggcagcaccc

SEQ ID NO: 1013517 - RNA, 21 nt, Mycobacterium avium subsp. paratuberculosis
cagccgcgacacgugcaucug

SEQ ID NO: 1013518 - RNA, 16 nt, Mycobacterium avium subsp. paratuberculosis
cagccgcgccaccgcg

SEQ ID NO: 1013519 - RNA, 24 nt, Mycobacterium avium subsp. paratuberculosis
cagccgcgcccacccgcgcacgcu

SEQ ID NO: 1013520 - RNA, 13 nt, Mycobacterium avium subsp. paratuberculosis
cagccgcgcccga

SEQ ID NO: 1013521 - RNA, 13 nt, Mycobacterium avium subsp. paratuberculosis
cagccgcgccgcc

SEQ ID NO: 1013522 - RNA, 17 nt, Mycobacterium avium subsp. paratuberculosis
cagccgcgccgccgcgu

SEQ ID NO: 1013523 - RNA, 17 nt, Mycobacterium avium subsp. paratuberculosis
cagccgcgccgcgccgc

SEQ ID NO: 1013524 - RNA, 14 nt, Mycobacterium avium subsp. paratuberculosis
cagccgcaccaggu

SEQ ID NO: 1013525 - RNA, 13 nt, Mycobacterium avium subsp. paratuberculosis
cagccgcaccgcg

SEQ ID NO: 1013526 - RNA, 20 nt, Mycobacterium avium subsp. paratuberculosis
cagccgcaccggcgccgcca

SEQ ID NO: 1013527 - RNA, 17 nt, Mycobacterium avium subsp. paratuberculosis
cagccgcaccucggggc

SEQ ID NO: 1013528 - RNA, 19 nt, Mycobacterium avium subsp. paratuberculosis
cagccgcaggugcucgccg

SEQ ID NO: 1013529 - RNA, 14 nt, Mycobacterium avium subsp. paratuberculosis
cagccgcaacacgg

SEQ ID NO: 1013530 - RNA, 21 nt, Mycobacterium avium subsp. paratuberculosis
cagccgcaacacggccucgau

SEQ ID NO: 1013531 - RNA, 13 nt, Mycobacterium avium subsp. paratuberculosis
cagccgcacaccg

SEQ ID NO: 1013532 - RNA, 14 nt, Mycobacterium avium subsp. paratuberculosis
cagccgcccagcau

SEQ ID NO: 1013533 - RNA, 18 nt, Mycobacterium avium subsp. paratuberculosis
cagcgaagcgaggcgcca

SEQ ID NO: 1013534 - RNA, 20 nt, Mycobacterium avium subsp. paratuberculosis
cagcgacaacgggccgccuc

SEQ ID NO: 1013535 - RNA, 23 nt, Mycobacterium avium subsp. paratuberculosis
cagcgacaacgggccgccucacg

SEQ ID NO: 1013536 - RNA, 22 nt, Mycobacterium avium subsp. paratuberculosis
cagcgacagggugccgaacagc

SEQ ID NO: 1013537 - RNA, 18 nt, Mycobacterium avium subsp. paratuberculosis
cagcgacaugaccaccgc

SEQ ID NO: 1013538 - RNA, 22 nt, Mycobacterium avium subsp. paratuberculosis
cagcgaaccgacauaggucagg

SEQ ID NO: 1013539 - RNA, 14 nt, Mycobacterium avium subsp. paratuberculosis
cagcgaacgcggcu

SEQ ID NO: 1013540 - RNA, 19 nt, Mycobacterium avium subsp. paratuberculosis
cagcgaacgcggcugauca

SEQ ID NO: 1013541 - RNA, 18 nt, Mycobacterium avium subsp. paratuberculosis
cagcgaacgucaggaucc

SEQ ID NO: 1013542 - RNA, 18 nt, Mycobacterium avium subsp. paratuberculosis
cagcgagcaggucaccgg

SEQ ID NO: 1013543 - RNA, 21 nt, Mycobacterium avium subsp. paratuberculosis
cagcgagaccucccggcgcca

SEQ ID NO: 1013544 - RNA, 17 nt, Mycobacterium avium subsp. paratuberculosis
cagcgagacgaccagga

SEQ ID NO: 1013545 - RNA, 18 nt, Mycobacterium avium subsp. paratuberculosis
cagcgagacgaccaggau

SEQ ID NO: 1013546 - RNA, 23 nt, Mycobacterium avium subsp. paratuberculosis
cagcgagcccagcugcgcggagc

SEQ ID NO: 1013547 - RNA, 14 nt, Mycobacterium avium subsp. paratuberculosis
cagcgaggcggcca

SEQ ID NO: 1013548 - RNA, 17 nt, Mycobacterium avium subsp. paratuberculosis
cagcgaggcggccagcg

SEQ ID NO: 1013549 - RNA, 21 nt, Mycobacterium avium subsp. paratuberculosis
cagcgagcucaggccggccuu

SEQ ID NO: 1013550 - RNA, 13 nt, Mycobacterium avium subsp. paratuberculosis
cagcgaggccucg

SEQ ID NO: 1013551 - RNA, 20 nt, Mycobacterium avium subsp. paratuberculosis
cagcgaguccagccagccgc

SEQ ID NO: 1013552 - RNA, 23 nt, Mycobacterium avium subsp. paratuberculosis
cagcgaguccagccagccgcgcc

SEQ ID NO: 1013553 - RNA, 15 nt, Mycobacterium avium subsp. paratuberculosis
cagcgagucgaaggc

SEQ ID NO: 1013554 - RNA, 23 nt, Mycobacterium avium subsp. paratuberculosis
cagcgagucgaaggcgcgggcgu

SEQ ID NO: 1013555 - RNA, 13 nt, Mycobacterium avium subsp. paratuberculosis
cagcgacuugacc

SEQ ID NO: 1013556 - RNA, 14 nt, Mycobacterium avium subsp. paratuberculosis
cagcgacucggcca

SEQ ID NO: 1013557 - RNA, 19 nt, Mycobacterium avium subsp. paratuberculosis
cagcgacuggaccaccaug

SEQ ID NO: 1013558 - RNA, 13 nt, Mycobacterium avium subsp. paratuberculosis
cagcgacggcccg

SEQ ID NO: 1013559 - RNA, 15 nt, Mycobacterium avium subsp. paratuberculosis
cagcgacggccgggu

SEQ ID NO: 1013560 - RNA, 19 nt, Mycobacterium avium subsp. paratuberculosis
cagcgacgucugcggcucg

SEQ ID NO: 1013561 - RNA, 15 nt, Mycobacterium avium subsp. paratuberculosis
cagcgacuccagcgc

SEQ ID NO: 1013562 - RNA, 13 nt, Mycobacterium avium subsp. paratuberculosis
cagcgacuccuga

SEQ ID NO: 1013563 - RNA, 14 nt, Mycobacterium avium subsp. paratuberculosis
cagcgacuccuggu

SEQ ID NO: 1013564 - RNA, 20 nt, Mycobacterium avium subsp. paratuberculosis
cagcgacuccugguccucga

SEQ ID NO: 1013565 - RNA, 17 nt, Mycobacterium avium subsp. paratuberculosis
cagcgacucgaccccgc

SEQ ID NO: 1013566 - RNA, 20 nt, Mycobacterium avium subsp. paratuberculosis
cagcgacucgaccccgccca

SEQ ID NO: 1013567 - RNA, 23 nt, Mycobacterium avium subsp. paratuberculosis
cagcgacucgaccccgcccagcg

SEQ ID NO: 1013568 - RNA, 22 nt, Mycobacterium avium subsp. paratuberculosis
cagcgaccugguccaccgcggc

SEQ ID NO: 1013569 - RNA, 23 nt, Mycobacterium avium subsp. paratuberculosis
cagcgacgccagcggcagcgcca

SEQ ID NO: 1013570 - RNA, 19 nt, Mycobacterium avium subsp. paratuberculosis
cagcgacggaucggccgcg

SEQ ID NO: 1013571 - RNA, 12 nt, Mycobacterium avium subsp. paratuberculosis
cagccuucuugg

SEQ ID NO: 1013572 - RNA, 21 nt, Mycobacterium avium subsp. paratuberculosis
cagccuucuuggcgggcgccu

SEQ ID NO: 1013573 - RNA, 23 nt, Mycobacterium avium subsp. paratuberculosis
cagccugcggugaugcgcggcga

SEQ ID NO: 1013574 - RNA, 15 nt, Mycobacterium avium subsp. paratuberculosis
cagccugccuccacg

SEQ ID NO: 1013575 - RNA, 15 nt, Mycobacterium avium subsp. paratuberculosis
cagccugaccgcggg

SEQ ID NO: 1013576 - RNA, 22 nt, Mycobacterium avium subsp. paratuberculosis
cagccuagccuuggccgcaggc

SEQ ID NO: 1013577 - RNA, 17 nt, Mycobacterium avium subsp. paratuberculosis
cagccgucgaugccggc

SEQ ID NO: 1013578 - RNA, 17 nt, Mycobacterium avium subsp. paratuberculosis
cagccgguccaugugcc

SEQ ID NO: 1013579 - RNA, 19 nt, Mycobacterium avium subsp. paratuberculosis
cagccgguccgaccgccac

SEQ ID NO: 1013580 - RNA, 20 nt, Mycobacterium avium subsp. paratuberculosis
cagccgguccggcggcacca

SEQ ID NO: 1013581 - RNA, 22 nt, Mycobacterium avium subsp. paratuberculosis
cagccgguccggcggcaccacc

SEQ ID NO: 1013582 - RNA, 16 nt, Mycobacterium avium subsp. paratuberculosis
cagccgguccugggcc

SEQ ID NO: 1013583 - RNA, 19 nt, Mycobacterium avium subsp. paratuberculosis
cagccggucgccgggccgg

SEQ ID NO: 1013584 - RNA, 14 nt, Mycobacterium avium subsp. paratuberculosis
cagccggugcacca

SEQ ID NO: 1013585 - RNA, 18 nt, Mycobacterium avium subsp. paratuberculosis
cagccggugcgagccgcu

SEQ ID NO: 1013586 - RNA, 15 nt, Mycobacterium avium subsp. paratuberculosis
cagccggugcugacc

SEQ ID NO: 1013587 - RNA, 14 nt, Mycobacterium avium subsp. paratuberculosis
cagccgguggcggc

SEQ ID NO: 1013588 - RNA, 16 nt, Mycobacterium avium subsp. paratuberculosis
cagccgguggcggcca

SEQ ID NO: 1013589 - RNA, 13 nt, Mycobacterium avium subsp. paratuberculosis
cagccguccagcc

SEQ ID NO: 1013590 - RNA, 13 nt, Mycobacterium avium subsp. paratuberculosis
cagccgucccagg

SEQ ID NO: 1013591 - RNA, 22 nt, Mycobacterium avium subsp. paratuberculosis
cagcgcacacagcagcagcacc

SEQ ID NO: 1013592 - RNA, 20 nt, Mycobacterium avium subsp. paratuberculosis
cagcgcaccgccgucggggc

SEQ ID NO: 1013593 - RNA, 14 nt, Mycobacterium avium subsp. paratuberculosis
cagcgcaccgggcc

SEQ ID NO: 1013594 - RNA, 19 nt, Mycobacterium avium subsp. paratuberculosis
cagcgcaccgggcccgccc

SEQ ID NO: 1013595 - RNA, 18 nt, Mycobacterium avium subsp. paratuberculosis
cagcgcaaccgcggcggc

SEQ ID NO: 1013596 - RNA, 22 nt, Mycobacterium avium subsp. paratuberculosis
cagcgauacccguugcgcccca

SEQ ID NO: 1013597 - RNA, 19 nt, Mycobacterium avium subsp. paratuberculosis
cagcgcagguacgcggcgu

SEQ ID NO: 1013598 - RNA, 22 nt, Mycobacterium avium subsp. paratuberculosis
cagcgcauccucauagccggcc

SEQ ID NO: 1013599 - RNA, 12 nt, Mycobacterium avium subsp. paratuberculosis
cagcgccaccag

SEQ ID NO: 1013600 - RNA, 12 nt, Mycobacterium avium subsp. paratuberculosis
cagcgcauggag

SEQ ID NO: 1013601 - RNA, 23 nt, Mycobacterium avium subsp. paratuberculosis
cagcgcaucggucaccagcuccc

SEQ ID NO: 1013602 - RNA, 21 nt, Mycobacterium avium subsp. paratuberculosis
cagcgcaucguugccggcggc

SEQ ID NO: 1013603 - RNA, 22 nt, Mycobacterium avium subsp. paratuberculosis
cagcgccaacauggcgcagaac

SEQ ID NO: 1013604 - RNA, 13 nt, Mycobacterium avium subsp. paratuberculosis
cagcgccgcgcgc

SEQ ID NO: 1013605 - RNA, 18 nt, Mycobacterium avium subsp. paratuberculosis
cagcgccgccagccgcag

SEQ ID NO: 1013606 - RNA, 16 nt, Mycobacterium avium subsp. paratuberculosis
cagcgccgccaccggc

SEQ ID NO: 1013607 - RNA, 15 nt, Mycobacterium avium subsp. paratuberculosis
cagcgccgcccgggc

SEQ ID NO: 1013608 - RNA, 17 nt, Mycobacterium avium subsp. paratuberculosis
cagcgcccgcgcgggcu

SEQ ID NO: 1013609 - RNA, 14 nt, Mycobacterium avium subsp. paratuberculosis
cagcgcccgcgggu

SEQ ID NO: 1013610 - RNA, 17 nt, Mycobacterium avium subsp. paratuberculosis
cagcgcccgggccagga

SEQ ID NO: 1013611 - RNA, 11 nt, Mycobacterium avium subsp. paratuberculosis
cagcgccucca

SEQ ID NO: 1013612 - RNA, 17 nt, Mycobacterium avium subsp. paratuberculosis
cagcgccgucaucaccg

SEQ ID NO: 1013613 - RNA, 17 nt, Mycobacterium avium subsp. paratuberculosis
cagcgccguccgcaccg

SEQ ID NO: 1013614 - RNA, 20 nt, Mycobacterium avium subsp. paratuberculosis
cagcgccgucucgacccggg

SEQ ID NO: 1013615 - RNA, 16 nt, Mycobacterium avium subsp. paratuberculosis
cagcgccguggcccgg

SEQ ID NO: 1013616 - RNA, 16 nt, Mycobacterium avium subsp. paratuberculosis
cagcgccuccagccgc

SEQ ID NO: 1013617 - RNA, 18 nt, Mycobacterium avium subsp. paratuberculosis
cagcgccuccagccgcuc

SEQ ID NO: 1013618 - RNA, 17 nt, Mycobacterium avium subsp. paratuberculosis
cagcgccggcagcgccu

SEQ ID NO: 1013619 - RNA, 14 nt, Mycobacterium avium subsp. paratuberculosis
cagcgccgcggcca

SEQ ID NO: 1013620 - RNA, 14 nt, Mycobacterium avium subsp. paratuberculosis
cagcgccgcggcgc

SEQ ID NO: 1013621 - RNA, 16 nt, Mycobacterium avium subsp. paratuberculosis
cagcgccagcaccggg

SEQ ID NO: 1013622 - RNA, 17 nt, Mycobacterium avium subsp. paratuberculosis
cagcgccagcacggcca

SEQ ID NO: 1013623 - RNA, 18 nt, Mycobacterium avium subsp. paratuberculosis
cagcgccagcaccgccug

SEQ ID NO: 1013624 - RNA, 22 nt, Mycobacterium avium subsp. paratuberculosis
cagcgccacgcucaugcccgcc

SEQ ID NO: 1013625 - RNA, 17 nt, Mycobacterium avium subsp. paratuberculosis
cagcgccaugcugcccu

SEQ ID NO: 1013626 - RNA, 14 nt, Mycobacterium avium subsp. paratuberculosis
cagcgcccgauucg

SEQ ID NO: 1013627 - RNA, 20 nt, Mycobacterium avium subsp. paratuberculosis
cagcgcccgauucgcggcca

SEQ ID NO: 1013628 - RNA, 14 nt, Mycobacterium avium subsp. paratuberculosis
cagcgcccgcccgg

SEQ ID NO: 1013629 - RNA, 15 nt, Mycobacterium avium subsp. paratuberculosis
cagcgcccgcccggc

SEQ ID NO: 1013630 - RNA, 16 nt, Mycobacterium avium subsp. paratuberculosis
cagcgcccgcccggcc

SEQ ID NO: 1013631 - RNA, 17 nt, Mycobacterium avium subsp. paratuberculosis
cagcgcccgcccggccc

SEQ ID NO: 1013632 - RNA, 18 nt, Mycobacterium avium subsp. paratuberculosis
cagcgcccgcccggcccg

SEQ ID NO: 1013633 - RNA, 19 nt, Mycobacterium avium subsp. paratuberculosis
cagcgcccgcccggcccgg

SEQ ID NO: 1013634 - RNA, 19 nt, Mycobacterium avium subsp. paratuberculosis
cagcgcccagccgagccgg

SEQ ID NO: 1013635 - RNA, 15 nt, Mycobacterium avium subsp. paratuberculosis
cagcgcccaggauga

SEQ ID NO: 1013636 - RNA, 15 nt, Mycobacterium avium subsp. paratuberculosis
cagcgcccaccgcuc

SEQ ID NO: 1013637 - RNA, 14 nt, Mycobacterium avium subsp. paratuberculosis
cagcgccucgccgg

SEQ ID NO: 1013638 - RNA, 18 nt, Mycobacterium avium subsp. paratuberculosis
cagcgccucgccgggccc

SEQ ID NO: 1013639 - RNA, 21 nt, Mycobacterium avium subsp. paratuberculosis
cagcgccucgcuaaucgccgc

SEQ ID NO: 1013640 - RNA, 18 nt, Mycobacterium avium subsp. paratuberculosis
cagcgccucggcggcccc

SEQ ID NO: 1013641 - RNA, 23 nt, Mycobacterium avium subsp. paratuberculosis
cagcgccucggcgucaccgcggg

SEQ ID NO: 1013642 - RNA, 20 nt, Mycobacterium avium subsp. paratuberculosis
cagcgccugcugccaggaca

SEQ ID NO: 1013643 - RNA, 15 nt, Mycobacterium avium subsp. paratuberculosis
cagcgccugcccgga

SEQ ID NO: 1013644 - RNA, 18 nt, Mycobacterium avium subsp. paratuberculosis
cagcgccuugggucccau

SEQ ID NO: 1013645 - RNA, 23 nt, Mycobacterium avium subsp. paratuberculosis
cagcgccuugggucccaucgcug

SEQ ID NO: 1013646 - RNA, 19 nt, Mycobacterium avium subsp. paratuberculosis
cagcgcgaccagcccggcc

SEQ ID NO: 1013647 - RNA, 17 nt, Mycobacterium avium subsp. paratuberculosis
cagcgccuucuccagcu

SEQ ID NO: 1013648 - RNA, 17 nt, Mycobacterium avium subsp. paratuberculosis
cagcgcgaugccggcca

SEQ ID NO: 1013649 - RNA, 20 nt, Mycobacterium avium subsp. paratuberculosis
cagcgcgaugccggccaggc

SEQ ID NO: 1013650 - RNA, 23 nt, Mycobacterium avium subsp. paratuberculosis
cagcgcgaugccggccaggcaca

SEQ ID NO: 1013651 - RNA, 24 nt, Mycobacterium avium subsp. paratuberculosis
cagcgcgaugccggccaggcacag

SEQ ID NO: 1013652 - RNA, 21 nt, Mycobacterium avium subsp. paratuberculosis
cagcgcgauguccgacagccc

SEQ ID NO: 1013653 - RNA, 14 nt, Mycobacterium avium subsp. paratuberculosis
cagcgcgcagaaca

SEQ ID NO: 1013654 - RNA, 15 nt, Mycobacterium avium subsp. paratuberculosis
cagcgcgcagaacac

SEQ ID NO: 1013655 - RNA, 14 nt, Mycobacterium avium subsp. paratuberculosis
cagcgcgcccaggc

SEQ ID NO: 1013656 - RNA, 20 nt, Mycobacterium avium subsp. paratuberculosis
cagcgcgcccugaggcccgg

SEQ ID NO: 1013657 - RNA, 13 nt, Mycobacterium avium subsp. paratuberculosis
cagcgcgccgacc

SEQ ID NO: 1013658 - RNA, 14 nt, Mycobacterium avium subsp. paratuberculosis
cagcgcgccgaucg

SEQ ID NO: 1013659 - RNA, 16 nt, Mycobacterium avium subsp. paratuberculosis
cagcgcgccgcgcugg

SEQ ID NO: 1013660 - RNA, 13 nt, Mycobacterium avium subsp. paratuberculosis
cagcgcgccgccc

SEQ ID NO: 1013661 - RNA, 12 nt, Mycobacterium avium subsp. paratuberculosis
cagcgcgccgcc

SEQ ID NO: 1013662 - RNA, 18 nt, Mycobacterium avium subsp. paratuberculosis
cagcgcgcgaucagcgcc

SEQ ID NO: 1013663 - RNA, 12 nt, Mycobacterium avium subsp. paratuberculosis
cagcgcgccgcu

SEQ ID NO: 1013664 - RNA, 23 nt, Mycobacterium avium subsp. paratuberculosis
cagcgcgcgagacaccucgucga

SEQ ID NO: 1013665 - RNA, 20 nt, Mycobacterium avium subsp. paratuberculosis
cagcgcgcggugcgccagcg

SEQ ID NO: 1013666 - RNA, 14 nt, Mycobacterium avium subsp. paratuberculosis
cagcgcgcggccca

SEQ ID NO: 1013667 - RNA, 20 nt, Mycobacterium avium subsp. paratuberculosis
cagcgcgcgggcgcgcgccg

SEQ ID NO: 1013668 - RNA, 21 nt, Mycobacterium avium subsp. paratuberculosis
cagcgcgcgggcguccucguc

SEQ ID NO: 1013669 - RNA, 12 nt, Mycobacterium avium subsp. paratuberculosis
cagcgcgcggcg

SEQ ID NO: 1013670 - RNA, 20 nt, Mycobacterium avium subsp. paratuberculosis
cagcgcgcgcucggucagca

SEQ ID NO: 1013671 - RNA, 23 nt, Mycobacterium avium subsp. paratuberculosis
cagcgcgcgcucggucagcaccg

SEQ ID NO: 1013672 - RNA, 15 nt, Mycobacterium avium subsp. paratuberculosis
cagcgcggacaccag

SEQ ID NO: 1013673 - RNA, 17 nt, Mycobacterium avium subsp. paratuberculosis
cagcgcggccaccacca

SEQ ID NO: 1013674 - RNA, 23 nt, Mycobacterium avium subsp. paratuberculosis
cagcgcggccaccaccacggcca

SEQ ID NO: 1013675 - RNA, 14 nt, Mycobacterium avium subsp. paratuberculosis
cagcgcggccaccu

SEQ ID NO: 1013676 - RNA, 19 nt, Mycobacterium avium subsp. paratuberculosis
cagcgcggccaccuccagc

SEQ ID NO: 1013677 - RNA, 19 nt, Mycobacterium avium subsp. paratuberculosis
cagcgcgucgcacagcgcc

SEQ ID NO: 1013678 - RNA, 20 nt, Mycobacterium avium subsp. paratuberculosis
cagcgcgucgcgcccggcgu

SEQ ID NO: 1013679 - RNA, 22 nt, Mycobacterium avium subsp. paratuberculosis
cagcgcgucgcgggcccgggcc

SEQ ID NO: 1013680 - RNA, 14 nt, Mycobacterium avium subsp. paratuberculosis
cagcgcgucggcca

SEQ ID NO: 1013681 - RNA, 23 nt, Mycobacterium avium subsp. paratuberculosis
cagcgcgucggccagcaccacca

SEQ ID NO: 1013682 - RNA, 22 nt, Mycobacterium avium subsp. paratuberculosis
cagcgcguccaggugcgccgcc

SEQ ID NO: 1013683 - RNA, 15 nt, Mycobacterium avium subsp. paratuberculosis
cagcgcggcgggcca

SEQ ID NO: 1013684 - RNA, 17 nt, Mycobacterium avium subsp. paratuberculosis
cagcgcggggucggcca

SEQ ID NO: 1013685 - RNA, 16 nt, Mycobacterium avium subsp. paratuberculosis
cagcgcggucaaaccc

SEQ ID NO: 1013686 - RNA, 21 nt, Mycobacterium avium subsp. paratuberculosis
cagcgcggucgccaccaccag

SEQ ID NO: 1013687 - RNA, 19 nt, Mycobacterium avium subsp. paratuberculosis
cagcgcggugcccagccag

SEQ ID NO: 1013688 - RNA, 17 nt, Mycobacterium avium subsp. paratuberculosis
cagcgcgguggucagca

SEQ ID NO: 1013689 - RNA, 23 nt, Mycobacterium avium subsp. paratuberculosis
cagcgcgguggucagcggcgcca

SEQ ID NO: 1013690 - RNA, 20 nt, Mycobacterium avium subsp. paratuberculosis
cagcgcgguguacagcgcgc

SEQ ID NO: 1013691 - RNA, 22 nt, Mycobacterium avium subsp. paratuberculosis
cagcgcgguguacagcgcgccg

SEQ ID NO: 1013692 - RNA, 23 nt, Mycobacterium avium subsp. paratuberculosis
cagcgcgguguacagcgcgccgc

SEQ ID NO: 1013693 - RNA, 14 nt, Mycobacterium avium subsp. paratuberculosis
cagcgcguagagca

SEQ ID NO: 1013694 - RNA, 19 nt, Mycobacterium avium subsp. paratuberculosis
cagcgcggcuuggccacca

SEQ ID NO: 1013695 - RNA, 19 nt, Mycobacterium avium subsp. paratuberculosis
cagcgcggcgucacccugg

SEQ ID NO: 1013696 - RNA, 23 nt, Mycobacterium avium subsp. paratuberculosis
cagcgcggcggaggucagcggcc

SEQ ID NO: 1013697 - RNA, 17 nt, Mycobacterium avium subsp. paratuberculosis
cagcgcggcggcgccgu

SEQ ID NO: 1013698 - RNA, 10 nt, Mycobacterium avium subsp. paratuberculosis
cagcgcggcg

SEQ ID NO: 1013699 - RNA, 23 nt, Mycobacterium avium subsp. paratuberculosis
cagcgcggcgaucagcagcaccc

SEQ ID NO: 1013700 - RNA, 22 nt, Mycobacterium avium subsp. paratuberculosis
cagcgcggcgaugaccgccugc

SEQ ID NO: 1013701 - RNA, 18 nt, Mycobacterium avium subsp. paratuberculosis
cagcgcggccggaagacc

SEQ ID NO: 1013702 - RNA, 22 nt, Mycobacterium avium subsp. paratuberculosis
cagcgcggccgggcgccccgac

SEQ ID NO: 1013703 - RNA, 22 nt, Mycobacterium avium subsp. paratuberculosis
cagcggccagcccgcggcagcc

SEQ ID NO: 1013704 - RNA, 23 nt, Mycobacterium avium subsp. paratuberculosis
cagcggccagcccgcggcagcca

SEQ ID NO: 1013705 - RNA, 13 nt, Mycobacterium avium subsp. paratuberculosis
cagcggcagcacg

SEQ ID NO: 1013706 - RNA, 19 nt, Mycobacterium avium subsp. paratuberculosis
cagcggaugccggaggcgc

SEQ ID NO: 1013707 - RNA, 22 nt, Mycobacterium avium subsp. paratuberculosis
cagcggaugccggaggcgccgu

SEQ ID NO: 1013708 - RNA, 20 nt, Mycobacterium avium subsp. paratuberculosis
cagcggauagaggcggcgca

SEQ ID NO: 1013709 - RNA, 14 nt, Mycobacterium avium subsp. paratuberculosis
cagcggcaacacgc

SEQ ID NO: 1013710 - RNA, 23 nt, Mycobacterium avium subsp. paratuberculosis
cagcggcaacacgccggcggcca

SEQ ID NO: 1013711 - RNA, 15 nt, Mycobacterium avium subsp. paratuberculosis
cagcggcaccaaccc

SEQ ID NO: 1013712 - RNA, 14 nt, Mycobacterium avium subsp. paratuberculosis
cagcggcaccguca

SEQ ID NO: 1013713 - RNA, 23 nt, Mycobacterium avium subsp. paratuberculosis
cagcggcaccagguaccggcggg

SEQ ID NO: 1013714 - RNA, 15 nt, Mycobacterium avium subsp. paratuberculosis
cagcggcacccgguc

SEQ ID NO: 1013715 - RNA, 20 nt, Mycobacterium avium subsp. paratuberculosis
cagcgcgucggcgaccgcgc

SEQ ID NO: 1013716 - RNA, 23 nt, Mycobacterium avium subsp. paratuberculosis
cagcgcgucgugcaacucccgcg

SEQ ID NO: 1013717 - RNA, 22 nt, Mycobacterium avium subsp. paratuberculosis
cagcgcgugaugggugggcagc

SEQ ID NO: 1013718 - RNA, 20 nt, Mycobacterium avium subsp. paratuberculosis
cagcgcgucggccagcgcgc

SEQ ID NO: 1013719 - RNA, 17 nt, Mycobacterium avium subsp. paratuberculosis
cagcgcuaaccgcgggc

SEQ ID NO: 1013720 - RNA, 20 nt, Mycobacterium avium subsp. paratuberculosis
cagcgcuggccggccaccag

SEQ ID NO: 1013721 - RNA, 22 nt, Mycobacterium avium subsp. paratuberculosis
cagcgcuggccggccaccagcg

SEQ ID NO: 1013722 - RNA, 20 nt, Mycobacterium avium subsp. paratuberculosis
cagcgcuuucgcgcacgcca

SEQ ID NO: 1013723 - RNA, 21 nt, Mycobacterium avium subsp. paratuberculosis
cagcgcuuucgcgcacgccau

SEQ ID NO: 1013724 - RNA, 20 nt, Mycobacterium avium subsp. paratuberculosis
cagcggacccggucggccgc

SEQ ID NO: 1013725 - RNA, 19 nt, Mycobacterium avium subsp. paratuberculosis
cagcggacccuucagccag

SEQ ID NO: 1013726 - RNA, 15 nt, Mycobacterium avium subsp. paratuberculosis
cagcggaaccggggg

SEQ ID NO: 1013727 - RNA, 15 nt, Mycobacterium avium subsp. paratuberculosis
cauucguccauccgc

SEQ ID NO: 1013728 - RNA, 18 nt, Mycobacterium avium subsp. paratuberculosis
cauucguggcugaacagc

SEQ ID NO: 1013729 - RNA, 13 nt, Mycobacterium avium subsp. paratuberculosis
cauucguguggcg

SEQ ID NO: 1013730 - RNA, 16 nt, Mycobacterium avium subsp. paratuberculosis
cauguuggugaucagc

SEQ ID NO: 1013731 - RNA, 15 nt, Mycobacterium avium subsp. paratuberculosis
caugucgucgagcuc

SEQ ID NO: 1013732 - RNA, 22 nt, Mycobacterium avium subsp. paratuberculosis
caugugaccggggucggcgccc

SEQ ID NO: 1013733 - RNA, 20 nt, Mycobacterium avium subsp. paratuberculosis
caugugaugauuccgcgucu

SEQ ID NO: 1013734 - RNA, 18 nt, Mycobacterium avium subsp. paratuberculosis
caugugccacagguacag

SEQ ID NO: 1013735 - RNA, 16 nt, Mycobacterium avium subsp. paratuberculosis
cauguggaagccgcga

SEQ ID NO: 1013736 - RNA, 20 nt, Mycobacterium avium subsp. paratuberculosis
cauguucucgagcccgaucu

SEQ ID NO: 1013737 - RNA, 15 nt, Mycobacterium avium subsp. paratuberculosis
caugugcucccagcu

SEQ ID NO: 1013738 - RNA, 20 nt, Mycobacterium avium subsp. paratuberculosis
caugugcucccagcucagac

SEQ ID NO: 1013739 - RNA, 21 nt, Mycobacterium avium subsp. paratuberculosis
caugguggucgaacuggcgca

SEQ ID NO: 1013740 - RNA, 17 nt, Mycobacterium avium subsp. paratuberculosis
cauggugaacugguuga

SEQ ID NO: 1013741 - RNA, 16 nt, Mycobacterium avium subsp. paratuberculosis
cauggucgcccacacc

SEQ ID NO: 1013742 - RNA, 19 nt, Mycobacterium avium subsp. paratuberculosis
caugcaccggugcaccgcg

SEQ ID NO: 1013743 - RNA, 22 nt, Mycobacterium avium subsp. paratuberculosis
caugcgaugaccacccucgguc

SEQ ID NO: 1013744 - RNA, 13 nt, Mycobacterium avium subsp. paratuberculosis
caugcgcgggcaa

SEQ ID NO: 1013745 - RNA, 15 nt, Mycobacterium avium subsp. paratuberculosis
caugccgggccagcc

SEQ ID NO: 1013746 - RNA, 20 nt, Mycobacterium avium subsp. paratuberculosis
caugccucuucggcgcgccg

SEQ ID NO: 1013747 - RNA, 21 nt, Mycobacterium avium subsp. paratuberculosis
caugcccgccacggccagcac

SEQ ID NO: 1013748 - RNA, 23 nt, Mycobacterium avium subsp. paratuberculosis
cauggacaugugagguggcuggg

SEQ ID NO: 1013749 - RNA, 12 nt, Mycobacterium avium subsp. paratuberculosis
cauggacagcca

SEQ ID NO: 1013750 - RNA, 20 nt, Mycobacterium avium subsp. paratuberculosis
caugggcaucgucucggacc

SEQ ID NO: 1013751 - RNA, 14 nt, Mycobacterium avium subsp. paratuberculosis
caugggcugcaaca

SEQ ID NO: 1013752 - RNA, 17 nt, Mycobacterium avium subsp. paratuberculosis
caucuugaucugggugc

SEQ ID NO: 1013753 - RNA, 18 nt, Mycobacterium avium subsp. paratuberculosis
caucuuggucagccgcgg

SEQ ID NO: 1013754 - RNA, 20 nt, Mycobacterium avium subsp. paratuberculosis
caucuucacgugcgcggcgu

SEQ ID NO: 1013755 - RNA, 14 nt, Mycobacterium avium subsp. paratuberculosis
caucugcacagcuu

SEQ ID NO: 1013756 - RNA, 16 nt, Mycobacterium avium subsp. paratuberculosis
caucugcucggcgucc

SEQ ID NO: 1013757 - RNA, 22 nt, Mycobacterium avium subsp. paratuberculosis
caucucuuucgauuucgccugc

SEQ ID NO: 1013758 - RNA, 15 nt, Mycobacterium avium subsp. paratuberculosis
caucucgagcaggaa

SEQ ID NO: 1013759 - RNA, 14 nt, Mycobacterium avium subsp. paratuberculosis
caucuccuccgggc

SEQ ID NO: 1013760 - RNA, 21 nt, Mycobacterium avium subsp. paratuberculosis
caucuccuccgggcugaccuc

SEQ ID NO: 1013761 - RNA, 24 nt, Mycobacterium avium subsp. paratuberculosis
caucuccggcacguugacguagac

SEQ ID NO: 1013762 - RNA, 14 nt, Mycobacterium avium subsp. paratuberculosis
caucuccgacucga

SEQ ID NO: 1013763 - RNA, 14 nt, Mycobacterium avium subsp. paratuberculosis
caucucgacgguga

SEQ ID NO: 1013764 - RNA, 20 nt, Mycobacterium avium subsp. paratuberculosis
caucuccugcacgcgcgggu

SEQ ID NO: 1013765 - RNA, 15 nt, Mycobacterium avium subsp. paratuberculosis
caucuacgaccucga

SEQ ID NO: 1013766 - RNA, 18 nt, Mycobacterium avium subsp. paratuberculosis
caucgggauuggcggcca

SEQ ID NO: 1013767 - RNA, 20 nt, Mycobacterium avium subsp. paratuberculosis
caucggguagaucuccucgg

SEQ ID NO: 1013768 - RNA, 16 nt, Mycobacterium avium subsp. paratuberculosis
caucgggcccagcagc

SEQ ID NO: 1013769 - RNA, 19 nt, Mycobacterium avium subsp. paratuberculosis
caucggguugccggcggcc

SEQ ID NO: 1013770 - RNA, 20 nt, Mycobacterium avium subsp. paratuberculosis
caucggguugccggcggcca

SEQ ID NO: 1013771 - RNA, 16 nt, Mycobacterium avium subsp. paratuberculosis
caucggucagcaacag

SEQ ID NO: 1013772 - RNA, 19 nt, Mycobacterium avium subsp. paratuberculosis
caucgaaugcagcggcucc

SEQ ID NO: 1013773 - RNA, 19 nt, Mycobacterium avium subsp. paratuberculosis
cauccucauagccggccgc

SEQ ID NO: 1013774 - RNA, 20 nt, Mycobacterium avium subsp. paratuberculosis
cauccucauagccggccgcg

SEQ ID NO: 1013775 - RNA, 13 nt, Mycobacterium avium subsp. paratuberculosis
cauccacucggcc

SEQ ID NO: 1013776 - RNA, 16 nt, Mycobacterium avium subsp. paratuberculosis
cauccgccacccgcug

SEQ ID NO: 1013777 - RNA, 19 nt, Mycobacterium avium subsp. paratuberculosis
cauccgccacccgcugcuc

SEQ ID NO: 1013778 - RNA, 20 nt, Mycobacterium avium subsp. paratuberculosis
cauccgccagaucgccuggc

SEQ ID NO: 1013779 - RNA, 17 nt, Mycobacterium avium subsp. paratuberculosis
cauccgcgacgccagca

SEQ ID NO: 1013780 - RNA, 18 nt, Mycobacterium avium subsp. paratuberculosis
cauccgcgacgccagcac

SEQ ID NO: 1013781 - RNA, 19 nt, Mycobacterium avium subsp. paratuberculosis
cauccgcgagccgagccgg

SEQ ID NO: 1013782 - RNA, 22 nt, Mycobacterium avium subsp. paratuberculosis
cauccggaaccgggcacccggc

SEQ ID NO: 1013783 - RNA, 14 nt, Mycobacterium avium subsp. paratuberculosis
cauccgggccacca

SEQ ID NO: 1013784 - RNA, 17 nt, Mycobacterium avium subsp. paratuberculosis
cauccgggaggccagca

SEQ ID NO: 1013785 - RNA, 16 nt, Mycobacterium avium subsp. paratuberculosis
cauccgggccgccgcg

SEQ ID NO: 1013786 - RNA, 15 nt, Mycobacterium avium subsp. paratuberculosis
cauccgggcggccag

SEQ ID NO: 1013787 - RNA, 23 nt, Mycobacterium avium subsp. paratuberculosis
cauccgugagggaccuccagcgg

SEQ ID NO: 1013788 - RNA, 23 nt, Mycobacterium avium subsp. paratuberculosis
cauccggucauccucgccgcgcc

SEQ ID NO: 1013789 - RNA, 22 nt, Mycobacterium avium subsp. paratuberculosis
cauccgguccagaucggcgcgc

SEQ ID NO: 1013790 - RNA, 16 nt, Mycobacterium avium subsp. paratuberculosis
cauccggugccgagcg

SEQ ID NO: 1013791 - RNA, 23 nt, Mycobacterium avium subsp. paratuberculosis
cauccggguuucgaagacgcccc

SEQ ID NO: 1013792 - RNA, 18 nt, Mycobacterium avium subsp. paratuberculosis
caucgaggaccggcgccg

SEQ ID NO: 1013793 - RNA, 18 nt, Mycobacterium avium subsp. paratuberculosis
caucgccucggcggccgc

SEQ ID NO: 1013794 - RNA, 16 nt, Mycobacterium avium subsp. paratuberculosis
caucgccucgucccuc

SEQ ID NO: 1013795 - RNA, 20 nt, Mycobacterium avium subsp. paratuberculosis
caucgcccggugcgccagcg

SEQ ID NO: 1013796 - RNA, 22 nt, Mycobacterium avium subsp. paratuberculosis
caucgcccggugcgccagcgug

SEQ ID NO: 1013797 - RNA, 14 nt, Mycobacterium avium subsp. paratuberculosis
caucgcccagccgg

SEQ ID NO: 1013798 - RNA, 17 nt, Mycobacterium avium subsp. paratuberculosis
caucgccaucagcagcg

SEQ ID NO: 1013799 - RNA, 19 nt, Mycobacterium avium subsp. paratuberculosis
caucgccaggaaccacacc

SEQ ID NO: 1013800 - RNA, 21 nt, Mycobacterium avium subsp. paratuberculosis
caucgagccgagcaccggcag

SEQ ID NO: 1013801 - RNA, 14 nt, Mycobacterium avium subsp. paratuberculosis
caucgacuccagca

SEQ ID NO: 1013802 - RNA, 15 nt, Mycobacterium avium subsp. paratuberculosis
caucgacuccagcac

SEQ ID NO: 1013803 - RNA, 12 nt, Mycobacterium avium subsp. paratuberculosis
caucgcgccgca

SEQ ID NO: 1013804 - RNA, 18 nt, Mycobacterium avium subsp. paratuberculosis
caucgcgcgcggcggcca

SEQ ID NO: 1013805 - RNA, 17 nt, Mycobacterium avium subsp. paratuberculosis
caucgcgccgcaugaug

SEQ ID NO: 1013806 - RNA, 13 nt, Mycobacterium avium subsp. paratuberculosis
caucgcgcaccag

SEQ ID NO: 1013807 - RNA, 14 nt, Mycobacterium avium subsp. paratuberculosis
caucgcggccgccc

SEQ ID NO: 1013808 - RNA, 15 nt, Mycobacterium avium subsp. paratuberculosis
caucgcggccgcccg

SEQ ID NO: 1013809 - RNA, 19 nt, Mycobacterium avium subsp. paratuberculosis
caucgcggcgacccgcuuc

SEQ ID NO: 1013810 - RNA, 18 nt, Mycobacterium avium subsp. paratuberculosis
caucgcggcgaugguguc

SEQ ID NO: 1013811 - RNA, 19 nt, Mycobacterium avium subsp. paratuberculosis
caucgcggcguuguggcca

SEQ ID NO: 1013812 - RNA, 23 nt, Mycobacterium avium subsp. paratuberculosis
caucggcgccggauugucgcugu

SEQ ID NO: 1013813 - RNA, 11 nt, Mycobacterium avium subsp. paratuberculosis
caucggcgccu

SEQ ID NO: 1013814 - RNA, 15 nt, Mycobacterium avium subsp. paratuberculosis
caucggcgacgccgc

SEQ ID NO: 1013815 - RNA, 22 nt, Mycobacterium avium subsp. paratuberculosis
caucaggcggccggcccggccc

SEQ ID NO: 1013816 - RNA, 15 nt, Mycobacterium avium subsp. paratuberculosis
caucagcgccaccag

SEQ ID NO: 1013817 - RNA, 18 nt, Mycobacterium avium subsp. paratuberculosis
caucagcgccaccagcac

SEQ ID NO: 1013818 - RNA, 23 nt, Mycobacterium avium subsp. paratuberculosis
caucagcgagacgaccaggaugc

SEQ ID NO: 1013819 - RNA, 20 nt, Mycobacterium avium subsp. paratuberculosis
caucagccgccgucgcgcca

SEQ ID NO: 1013820 - RNA, 12 nt, Mycobacterium avium subsp. paratuberculosis
caucagccccuu

SEQ ID NO: 1013821 - RNA, 14 nt, Mycobacterium avium subsp. paratuberculosis
caucagcccggcgu

SEQ ID NO: 1013822 - RNA, 23 nt, Mycobacterium avium subsp. paratuberculosis
caucagcccggcguccugcagca

SEQ ID NO: 1013823 - RNA, 14 nt, Mycobacterium avium subsp. paratuberculosis
caucaccggggauc

SEQ ID NO: 1013824 - RNA, 23 nt, Mycobacterium avium subsp. paratuberculosis
caucaccgccgagggcccgggca

SEQ ID NO: 1013825 - RNA, 17 nt, Mycobacterium avium subsp. paratuberculosis
caucacgaccucgaaca

SEQ ID NO: 1013826 - RNA, 16 nt, Mycobacterium avium subsp. paratuberculosis
caucacgccccggcgu

SEQ ID NO: 1013827 - RNA, 22 nt, Mycobacterium avium subsp. paratuberculosis
caucaucggcacgccggggccc

SEQ ID NO: 1013828 - RNA, 18 nt, Mycobacterium avium subsp. paratuberculosis
caucaugccgcccaucac

SEQ ID NO: 1013829 - RNA, 15 nt, Mycobacterium avium subsp. paratuberculosis
caucaugcccaccau

SEQ ID NO: 1013830 - RNA, 14 nt, Mycobacterium avium subsp. paratuberculosis
caucaacccgagca

SEQ ID NO: 1013831 - RNA, 15 nt, Mycobacterium avium subsp. paratuberculosis
caucaacugcaccag

SEQ ID NO: 1013832 - RNA, 19 nt, Mycobacterium avium subsp. paratuberculosis
caucaacugcaccagcggc

SEQ ID NO: 1013833 - RNA, 16 nt, Mycobacterium avium subsp. paratuberculosis
cauauaggggugggcg

SEQ ID NO: 1013834 - RNA, 20 nt, Mycobacterium avium subsp. paratuberculosis
cauaccagccguucucgucc

SEQ ID NO: 1013835 - RNA, 18 nt, Mycobacterium avium subsp. paratuberculosis
cauaccagugcccgagca

SEQ ID NO: 1013836 - RNA, 15 nt, Mycobacterium avium subsp. paratuberculosis
cauacagcaggcugu

SEQ ID NO: 1013837 - RNA, 22 nt, Mycobacterium avium subsp. paratuberculosis
cauaacgcucccgguagagcgg

SEQ ID NO: 1013838 - RNA, 21 nt, Mycobacterium avium subsp. paratuberculosis
cauacacgggccguccauccc

SEQ ID NO: 1013839 - RNA, 21 nt, Mycobacterium avium subsp. paratuberculosis
caguguccgaucgccuccuca

SEQ ID NO: 1013840 - RNA, 17 nt, Mycobacterium avium subsp. paratuberculosis
caguugggggccagcgc

SEQ ID NO: 1013841 - RNA, 17 nt, Mycobacterium avium subsp. paratuberculosis
cagggugucgucgcgca

SEQ ID NO: 1013842 - RNA, 14 nt, Mycobacterium avium subsp. paratuberculosis
caggguugccgcac

SEQ ID NO: 1013843 - RNA, 14 nt, Mycobacterium avium subsp. paratuberculosis
caggguuuccucga

SEQ ID NO: 1013844 - RNA, 16 nt, Mycobacterium avium subsp. paratuberculosis
cagguggcgucggcgu

SEQ ID NO: 1013845 - RNA, 14 nt, Mycobacterium avium subsp. paratuberculosis
cagguggcccacac

SEQ ID NO: 1013846 - RNA, 17 nt, Mycobacterium avium subsp. paratuberculosis
cagguggcccgacccgu

SEQ ID NO: 1013847 - RNA, 22 nt, Mycobacterium avium subsp. paratuberculosis
cagguggauugucggccgcccg

SEQ ID NO: 1013848 - RNA, 13 nt, Mycobacterium avium subsp. paratuberculosis
caggugcgccgcu

SEQ ID NO: 1013849 - RNA, 19 nt, Mycobacterium avium subsp. paratuberculosis
caggugcggcaccuccagc

SEQ ID NO: 1013850 - RNA, 20 nt, Mycobacterium avium subsp. paratuberculosis
caggugcggggacagugcgg

SEQ ID NO: 1013851 - RNA, 15 nt, Mycobacterium avium subsp. paratuberculosis
caggugcucgccggc

SEQ ID NO: 1013852 - RNA, 20 nt, Mycobacterium avium subsp. paratuberculosis
caggugcucgccggcgcgga

SEQ ID NO: 1013853 - RNA, 22 nt, Mycobacterium avium subsp. paratuberculosis
cagguuggucagcagcagcgcc

SEQ ID NO: 1013854 - RNA, 14 nt, Mycobacterium avium subsp. paratuberculosis
caggugugcccgcc

SEQ ID NO: 1013855 - RNA, 22 nt, Mycobacterium avium subsp. paratuberculosis
cagguggugggcgugcaggccg

SEQ ID NO: 1013856 - RNA, 17 nt, Mycobacterium avium subsp. paratuberculosis
cagguggggcaggaacg

SEQ ID NO: 1013857 - RNA, 20 nt, Mycobacterium avium subsp. paratuberculosis
caggugggcggccaccacuu

SEQ ID NO: 1013858 - RNA, 21 nt, Mycobacterium avium subsp. paratuberculosis
cagguugcgccguccggccac

SEQ ID NO: 1013859 - RNA, 15 nt, Mycobacterium avium subsp. paratuberculosis
caguagacgccgccg

SEQ ID NO: 1013860 - RNA, 23 nt, Mycobacterium avium subsp. paratuberculosis
caguaccggcgaugccagcgcac

SEQ ID NO: 1013861 - RNA, 15 nt, Mycobacterium avium subsp. paratuberculosis
caguaccgggccugu

SEQ ID NO: 1013862 - RNA, 20 nt, Mycobacterium avium subsp. paratuberculosis
caguacagcuaggccagcag

SEQ ID NO: 1013863 - RNA, 13 nt, Mycobacterium avium subsp. paratuberculosis
cagugaccagugc

SEQ ID NO: 1013864 - RNA, 18 nt, Mycobacterium avium subsp. paratuberculosis
cagugaggccagcacccg

SEQ ID NO: 1013865 - RNA, 16 nt, Mycobacterium avium subsp. paratuberculosis
cagugacgccugcggc

SEQ ID NO: 1013866 - RNA, 15 nt, Mycobacterium avium subsp. paratuberculosis
cagugcucuccgcug

SEQ ID NO: 1013867 - RNA, 20 nt, Mycobacterium avium subsp. paratuberculosis
cagugccaacacggcggcgc

SEQ ID NO: 1013868 - RNA, 13 nt, Mycobacterium avium subsp. paratuberculosis
cagugcaccucga

SEQ ID NO: 1013869 - RNA, 13 nt, Mycobacterium avium subsp. paratuberculosis
cagugcaggcuga

SEQ ID NO: 1013870 - RNA, 14 nt, Mycobacterium avium subsp. paratuberculosis
cagucgcagcagca

SEQ ID NO: 1013871 - RNA, 14 nt, Mycobacterium avium subsp. paratuberculosis
cagucgcaggcccc

SEQ ID NO: 1013872 - RNA, 17 nt, Mycobacterium avium subsp. paratuberculosis
cagucgccgcgcagauc

SEQ ID NO: 1013873 - RNA, 19 nt, Mycobacterium avium subsp. paratuberculosis
cagucgcggcgaaccagca

SEQ ID NO: 1013874 - RNA, 22 nt, Mycobacterium avium subsp. paratuberculosis
cagucgcggcgaaccagcaugc

SEQ ID NO: 1013875 - RNA, 13 nt, Mycobacterium avium subsp. paratuberculosis
cagucgcgccgcc

SEQ ID NO: 1013876 - RNA, 15 nt, Mycobacterium avium subsp. paratuberculosis
cagucgccggccagg

SEQ ID NO: 1013877 - RNA, 14 nt, Mycobacterium avium subsp. paratuberculosis
cagucggccggcgu

SEQ ID NO: 1013878 - RNA, 15 nt, Mycobacterium avium subsp. paratuberculosis
cagucggccugcagc

SEQ ID NO: 1013879 - RNA, 16 nt, Mycobacterium avium subsp. paratuberculosis
cagucggccugcagcu

SEQ ID NO: 1013880 - RNA, 17 nt, Mycobacterium avium subsp. paratuberculosis
cagucgucgaugaaguc

SEQ ID NO: 1013881 - RNA, 20 nt, Mycobacterium avium subsp. paratuberculosis
cagucguacucccaggccgc

SEQ ID NO: 1013882 - RNA, 19 nt, Mycobacterium avium subsp. paratuberculosis
cagucugagcccgggcagg

SEQ ID NO: 1013883 - RNA, 23 nt, Mycobacterium avium subsp. paratuberculosis
caggauguucaccccggcgcgga

SEQ ID NO: 1013884 - RNA, 17 nt, Mycobacterium avium subsp. paratuberculosis
caggauucucagcagcg

SEQ ID NO: 1013885 - RNA, 14 nt, Mycobacterium avium subsp. paratuberculosis
caggauuccgucgg

SEQ ID NO: 1013886 - RNA, 15 nt, Mycobacterium avium subsp. paratuberculosis
caggauucccgaccc

SEQ ID NO: 1013887 - RNA, 20 nt, Mycobacterium avium subsp. paratuberculosis
caggcacucgaucagcaccg

SEQ ID NO: 1013888 - RNA, 17 nt, Mycobacterium avium subsp. paratuberculosis
caggcacucgcccaggg

SEQ ID NO: 1013889 - RNA, 19 nt, Mycobacterium avium subsp. paratuberculosis
caggcacucgcccagggcg

SEQ ID NO: 1013890 - RNA, 22 nt, Mycobacterium avium subsp. paratuberculosis
caggaugucguccucggucagg

SEQ ID NO: 1013891 - RNA, 20 nt, Mycobacterium avium subsp. paratuberculosis
caggaugucuccgcgcagcc

SEQ ID NO: 1013892 - RNA, 23 nt, Mycobacterium avium subsp. paratuberculosis
caggaugguguucugcucgucgg

SEQ ID NO: 1013893 - RNA, 20 nt, Mycobacterium avium subsp. paratuberculosis
caggauguacccgcaggcca

SEQ ID NO: 1013894 - RNA, 23 nt, Mycobacterium avium subsp. paratuberculosis
caggaucuggugcgcgcgcauca

SEQ ID NO: 1013895 - RNA, 14 nt, Mycobacterium avium subsp. paratuberculosis
caggagggccaggg

SEQ ID NO: 1013896 - RNA, 17 nt, Mycobacterium avium subsp. paratuberculosis
caggagaucggcgcgga

SEQ ID NO: 1013897 - RNA, 14 nt, Mycobacterium avium subsp. paratuberculosis
caggacgcgcccgg

SEQ ID NO: 1013898 - RNA, 18 nt, Mycobacterium avium subsp. paratuberculosis
cagcuugccggagcccag

SEQ ID NO: 1013899 - RNA, 18 nt, Mycobacterium avium subsp. paratuberculosis
cagcuugaagcccucguc

SEQ ID NO: 1013900 - RNA, 20 nt, Mycobacterium avium subsp. paratuberculosis
cagcuugaagcccucgucga

SEQ ID NO: 1013901 - RNA, 14 nt, Mycobacterium avium subsp. paratuberculosis
caggaacuccagca

SEQ ID NO: 1013902 - RNA, 17 nt, Mycobacterium avium subsp. paratuberculosis
caggaacuggucgaaca

SEQ ID NO: 1013903 - RNA, 14 nt, Mycobacterium avium subsp. paratuberculosis
caggaacggcgcca

SEQ ID NO: 1013904 - RNA, 23 nt, Mycobacterium avium subsp. paratuberculosis
caggaaccgggucagcaccacca

SEQ ID NO: 1013905 - RNA, 20 nt, Mycobacterium avium subsp. paratuberculosis
caggaagacguaggcggcca

SEQ ID NO: 1013906 - RNA, 19 nt, Mycobacterium avium subsp. paratuberculosis
caggaagaugccgaucagg

SEQ ID NO: 1013907 - RNA, 15 nt, Mycobacterium avium subsp. paratuberculosis
caggaauuccagcga

SEQ ID NO: 1013908 - RNA, 13 nt, Mycobacterium avium subsp. paratuberculosis
caggacaggaugc

SEQ ID NO: 1013909 - RNA, 15 nt, Mycobacterium avium subsp. paratuberculosis
caggacaucaagugc

SEQ ID NO: 1013910 - RNA, 15 nt, Mycobacterium avium subsp. paratuberculosis
caggaccacccacuc

SEQ ID NO: 1013911 - RNA, 15 nt, Mycobacterium avium subsp. paratuberculosis
caggaccacuccugg

SEQ ID NO: 1013912 - RNA, 13 nt, Mycobacterium avium subsp. paratuberculosis
cagcuguugcggc

SEQ ID NO: 1013913 - RNA, 23 nt, Mycobacterium avium subsp. paratuberculosis
cagcuggaacaccacggccggca

SEQ ID NO: 1013914 - RNA, 22 nt, Mycobacterium avium subsp. paratuberculosis
cagcuggagaggcccggcagcc

SEQ ID NO: 1013915 - RNA, 15 nt, Mycobacterium avium subsp. paratuberculosis
cagcuggaucaucuc

SEQ ID NO: 1013916 - RNA, 20 nt, Mycobacterium avium subsp. paratuberculosis
cagcuggaucaucucguagc

SEQ ID NO: 1013917 - RNA, 20 nt, Mycobacterium avium subsp. paratuberculosis
cagcuggauggcgcccagcc

SEQ ID NO: 1013918 - RNA, 21 nt, Mycobacterium avium subsp. paratuberculosis
cagcuggauggcgcccagccc

SEQ ID NO: 1013919 - RNA, 18 nt, Mycobacterium avium subsp. paratuberculosis
cagcuggccgugcaccgu

SEQ ID NO: 1013920 - RNA, 12 nt, Mycobacterium avium subsp. paratuberculosis
cagcugcuggaa

SEQ ID NO: 1013921 - RNA, 16 nt, Mycobacterium avium subsp. paratuberculosis
cagcugcugcgcggcg

SEQ ID NO: 1013922 - RNA, 18 nt, Mycobacterium avium subsp. paratuberculosis
cagcugcugcgcggcggc

SEQ ID NO: 1013923 - RNA, 16 nt, Mycobacterium avium subsp. paratuberculosis
cagcugcucggccacc

SEQ ID NO: 1013924 - RNA, 17 nt, Mycobacterium avium subsp. paratuberculosis
cagcugcucggccaccg

SEQ ID NO: 1013925 - RNA, 18 nt, Mycobacterium avium subsp. paratuberculosis
cagcucgucgagccggcc

SEQ ID NO: 1013926 - RNA, 22 nt, Mycobacterium avium subsp. paratuberculosis
cagcucgucgugggugacccgg

SEQ ID NO: 1013927 - RNA, 17 nt, Mycobacterium avium subsp. paratuberculosis
cagcucguggcgggccc

SEQ ID NO: 1013928 - RNA, 19 nt, Mycobacterium avium subsp. paratuberculosis
cagcucguggcgggcccgg

SEQ ID NO: 1013929 - RNA, 22 nt, Mycobacterium avium subsp. paratuberculosis
cagcucggcgggcucccucguc

SEQ ID NO: 1013930 - RNA, 17 nt, Mycobacterium avium subsp. paratuberculosis
cagcucggcggcccgcc

SEQ ID NO: 1013931 - RNA, 14 nt, Mycobacterium avium subsp. paratuberculosis
cagcucgggcagcc

SEQ ID NO: 1013932 - RNA, 18 nt, Mycobacterium avium subsp. paratuberculosis
cagcucgggcagcccgcc

SEQ ID NO: 1013933 - RNA, 23 nt, Mycobacterium avium subsp. paratuberculosis
cagcucgggguaguucagcgcgc

SEQ ID NO: 1013934 - RNA, 20 nt, Mycobacterium avium subsp. paratuberculosis
cagcucggucaccagcggcc

SEQ ID NO: 1013935 - RNA, 23 nt, Mycobacterium avium subsp. paratuberculosis
cagcucggucgcggucggcgccc

SEQ ID NO: 1013936 - RNA, 23 nt, Mycobacterium avium subsp. paratuberculosis
cagcucggugcagaccccggcgu

SEQ ID NO: 1013937 - RNA, 15 nt, Mycobacterium avium subsp. paratuberculosis
cagcucggugcgcac

SEQ ID NO: 1013938 - RNA, 22 nt, Mycobacterium avium subsp. paratuberculosis
cagcucggugcgcauggcgugc

SEQ ID NO: 1013939 - RNA, 20 nt, Mycobacterium avium subsp. paratuberculosis
cagcucgucagcgcgggcca

SEQ ID NO: 1013940 - RNA, 22 nt, Mycobacterium avium subsp. paratuberculosis
cagcucgucagcgcgggccagc

SEQ ID NO: 1013941 - RNA, 14 nt, Mycobacterium avium subsp. paratuberculosis
cagcucguccagcg

SEQ ID NO: 1013942 - RNA, 20 nt, Mycobacterium avium subsp. paratuberculosis
cagcucguccagcgugccgc

SEQ ID NO: 1013943 - RNA, 18 nt, Mycobacterium avium subsp. paratuberculosis
cagcucggcagccccguc

SEQ ID NO: 1013944 - RNA, 13 nt, Mycobacterium avium subsp. paratuberculosis
cagcucggcccgc

SEQ ID NO: 1013945 - RNA, 14 nt, Mycobacterium avium subsp. paratuberculosis
cagcucggcccgcu

SEQ ID NO: 1013946 - RNA, 17 nt, Mycobacterium avium subsp. paratuberculosis
cagcucggcccgcugcg

SEQ ID NO: 1013947 - RNA, 18 nt, Mycobacterium avium subsp. paratuberculosis
cagcucgcguucgggccc

SEQ ID NO: 1013948 - RNA, 22 nt, Mycobacterium avium subsp. paratuberculosis
cagcucgcguucgggcccggcc

SEQ ID NO: 1013949 - RNA, 16 nt, Mycobacterium avium subsp. paratuberculosis
cagcucgcgggccugc

SEQ ID NO: 1013950 - RNA, 18 nt, Mycobacterium avium subsp. paratuberculosis
cagcucgcgcagccggcc

SEQ ID NO: 1013951 - RNA, 21 nt, Mycobacterium avium subsp. paratuberculosis
cagcucgcgcugaagccgcug

SEQ ID NO: 1013952 - RNA, 15 nt, Mycobacterium avium subsp. paratuberculosis
cagcucccgagcauc

SEQ ID NO: 1013953 - RNA, 15 nt, Mycobacterium avium subsp. paratuberculosis
cagcucccaggacgc

SEQ ID NO: 1013954 - RNA, 22 nt, Mycobacterium avium subsp. paratuberculosis
cagcucccccgacaccgccagc

SEQ ID NO: 1013955 - RNA, 18 nt, Mycobacterium avium subsp. paratuberculosis
cagcucccgggcggcgcc

SEQ ID NO: 1013956 - RNA, 14 nt, Mycobacterium avium subsp. paratuberculosis
cagcuccgccaccc

SEQ ID NO: 1013957 - RNA, 17 nt, Mycobacterium avium subsp. paratuberculosis
cagcuccgcggccagcu

SEQ ID NO: 1013958 - RNA, 15 nt, Mycobacterium avium subsp. paratuberculosis
cagcuccgccgacac

SEQ ID NO: 1013959 - RNA, 23 nt, Mycobacterium avium subsp. paratuberculosis
cagcuccgccgacaccagggugc

SEQ ID NO: 1013960 - RNA, 18 nt, Mycobacterium avium subsp. paratuberculosis
cagcuccggucggcgcuc

SEQ ID NO: 1013961 - RNA, 14 nt, Mycobacterium avium subsp. paratuberculosis
cagcuccuccugcg

SEQ ID NO: 1013962 - RNA, 15 nt, Mycobacterium avium subsp. paratuberculosis
cagcucgcgaagcgc

SEQ ID NO: 1013963 - RNA, 20 nt, Mycobacterium avium subsp. paratuberculosis
cagcucgccguccgggaaca

SEQ ID NO: 1013964 - RNA, 13 nt, Mycobacterium avium subsp. paratuberculosis
cagcucgccggcc

SEQ ID NO: 1013965 - RNA, 15 nt, Mycobacterium avium subsp. paratuberculosis
cagcucgccggccgc

SEQ ID NO: 1013966 - RNA, 18 nt, Mycobacterium avium subsp. paratuberculosis
cagcuccagcagcccggg

SEQ ID NO: 1013967 - RNA, 19 nt, Mycobacterium avium subsp. paratuberculosis
cagcuccagcagcccgggc

SEQ ID NO: 1013968 - RNA, 16 nt, Mycobacterium avium subsp. paratuberculosis
cagcuccaccugcggc

SEQ ID NO: 1013969 - RNA, 17 nt, Mycobacterium avium subsp. paratuberculosis
cagcuaggaagccagcc

SEQ ID NO: 1013970 - RNA, 14 nt, Mycobacterium avium subsp. paratuberculosis
cagcuaggccagca

SEQ ID NO: 1013971 - RNA, 16 nt, Mycobacterium avium subsp. paratuberculosis
cagcuaggccagcagc

SEQ ID NO: 1013972 - RNA, 15 nt, Mycobacterium avium subsp. paratuberculosis
cagcggcuccgagcg

SEQ ID NO: 1013973 - RNA, 13 nt, Mycobacterium avium subsp. paratuberculosis
cagcggcgggccc

SEQ ID NO: 1013974 - RNA, 15 nt, Mycobacterium avium subsp. paratuberculosis
cagcggcgggcccag

SEQ ID NO: 1013975 - RNA, 18 nt, Mycobacterium avium subsp. paratuberculosis
cagcggcgggcccagcag

SEQ ID NO: 1013976 - RNA, 14 nt, Mycobacterium avium subsp. paratuberculosis
cagcggcucggugu

SEQ ID NO: 1013977 - RNA, 19 nt, Mycobacterium avium subsp. paratuberculosis
cagcggcugcagcagaugc

SEQ ID NO: 1013978 - RNA, 14 nt, Mycobacterium avium subsp. paratuberculosis
cagcggcugcugca

SEQ ID NO: 1013979 - RNA, 19 nt, Mycobacterium avium subsp. paratuberculosis
cagcggcugcugcagcgcc

SEQ ID NO: 1013980 - RNA, 19 nt, Mycobacterium avium subsp. paratuberculosis
cagcggcuguagcacccgg

SEQ ID NO: 1013981 - RNA, 21 nt, Mycobacterium avium subsp. paratuberculosis
cagcggcuguagcacccggcc

SEQ ID NO: 1013982 - RNA, 13 nt, Mycobacterium avium subsp. paratuberculosis
cagcggcggccuu

SEQ ID NO: 1013983 - RNA, 12 nt, Mycobacterium avium subsp. paratuberculosis
cagcggcgcggu

SEQ ID NO: 1013984 - RNA, 15 nt, Mycobacterium avium subsp. paratuberculosis
cagcggcgcgcgccg

SEQ ID NO: 1013985 - RNA, 16 nt, Mycobacterium avium subsp. paratuberculosis
cagcggcgcgcgccgc

SEQ ID NO: 1013986 - RNA, 17 nt, Mycobacterium avium subsp. paratuberculosis
cagcggcgcgcgccgca

SEQ ID NO: 1013987 - RNA, 22 nt, Mycobacterium avium subsp. paratuberculosis
cagcggcgcccacggccaccac

SEQ ID NO: 1013988 - RNA, 17 nt, Mycobacterium avium subsp. paratuberculosis
cagcggccggaacagcu

SEQ ID NO: 1013989 - RNA, 14 nt, Mycobacterium avium subsp. paratuberculosis
cagcggccggcgca

SEQ ID NO: 1013990 - RNA, 22 nt, Mycobacterium avium subsp. paratuberculosis
cagcggccggcgcagccggcca

SEQ ID NO: 1013991 - RNA, 18 nt, Mycobacterium avium subsp. paratuberculosis
cagcggccucggaagggc

SEQ ID NO: 1013992 - RNA, 17 nt, Mycobacterium avium subsp. paratuberculosis
cagggccugcagcacca

SEQ ID NO: 1013993 - RNA, 20 nt, Mycobacterium avium subsp. paratuberculosis
cagggccugcagcaccaggc

SEQ ID NO: 1013994 - RNA, 19 nt, Mycobacterium avium subsp. paratuberculosis
cagggcgacgccgcggaag

SEQ ID NO: 1013995 - RNA, 19 nt, Mycobacterium avium subsp. paratuberculosis
cagggcgacggcggcgacg

SEQ ID NO: 1013996 - RNA, 20 nt, Mycobacterium avium subsp. paratuberculosis
cagggcgaggaacccgaccg

SEQ ID NO: 1013997 - RNA, 16 nt, Mycobacterium avium subsp. paratuberculosis
cagggcgcgcaccggu

SEQ ID NO: 1013998 - RNA, 14 nt, Mycobacterium avium subsp. paratuberculosis
cagggcccgcagcc

SEQ ID NO: 1013999 - RNA, 18 nt, Mycobacterium avium subsp. paratuberculosis
cagggcccgcagccgcug

SEQ ID NO: 1014000 - RNA, 21 nt, Mycobacterium avium subsp. paratuberculosis
cagggcccgcagccgcuggcc

SEQ ID NO: 1014001 - RNA, 16 nt, Mycobacterium avium subsp. paratuberculosis
cagggcccacagcagc

SEQ ID NO: 1014002 - RNA, 19 nt, Mycobacterium avium subsp. paratuberculosis
cagggccagguucaggccc

SEQ ID NO: 1014003 - RNA, 11 nt, Mycobacterium avium subsp. paratuberculosis
cagggccagca

SEQ ID NO: 1014004 - RNA, 14 nt, Mycobacterium avium subsp. paratuberculosis
cagggccagcacca

SEQ ID NO: 1014005 - RNA, 17 nt, Mycobacterium avium subsp. paratuberculosis
cagggccagcaccauga

SEQ ID NO: 1014006 - RNA, 14 nt, Mycobacterium avium subsp. paratuberculosis
cagggccagcgccu

SEQ ID NO: 1014007 - RNA, 16 nt, Mycobacterium avium subsp. paratuberculosis
cagggccagcggcaac

SEQ ID NO: 1014008 - RNA, 14 nt, Mycobacterium avium subsp. paratuberculosis
cagggccagcagcc

SEQ ID NO: 1014009 - RNA, 15 nt, Mycobacterium avium subsp. paratuberculosis
cagggccagcagccc

SEQ ID NO: 1014010 - RNA, 11 nt, Mycobacterium avium subsp. paratuberculosis
cagggccaggc

SEQ ID NO: 1014011 - RNA, 18 nt, Mycobacterium avium subsp. paratuberculosis
cagggccgcgcgggcgac

SEQ ID NO: 1014012 - RNA, 12 nt, Mycobacterium avium subsp. paratuberculosis
cagggccgcgcg

SEQ ID NO: 1014013 - RNA, 17 nt, Mycobacterium avium subsp. paratuberculosis
caggcucagcagcaccg

SEQ ID NO: 1014014 - RNA, 23 nt, Mycobacterium avium subsp. paratuberculosis
caggcucagguaauugggaaagu

SEQ ID NO: 1014015 - RNA, 14 nt, Mycobacterium avium subsp. paratuberculosis
caggcucagguagg

SEQ ID NO: 1014016 - RNA, 20 nt, Mycobacterium avium subsp. paratuberculosis
cagggagcugcccgcacugg

SEQ ID NO: 1014017 - RNA, 12 nt, Mycobacterium avium subsp. paratuberculosis
cagggcagcgcc

SEQ ID NO: 1014018 - RNA, 23 nt, Mycobacterium avium subsp. paratuberculosis
cagggcagcgcgaccagcccggc

SEQ ID NO: 1014019 - RNA, 12 nt, Mycobacterium avium subsp. paratuberculosis
cagggccaccgc

SEQ ID NO: 1014020 - RNA, 15 nt, Mycobacterium avium subsp. paratuberculosis
cagggggcgcagccg

SEQ ID NO: 1014021 - RNA, 15 nt, Mycobacterium avium subsp. paratuberculosis
cagggcggugcggug

SEQ ID NO: 1014022 - RNA, 22 nt, Mycobacterium avium subsp. paratuberculosis
cagggcggugcggugcgccgca

SEQ ID NO: 1014023 - RNA, 15 nt, Mycobacterium avium subsp. paratuberculosis
cagggcggcgggccc

SEQ ID NO: 1014024 - RNA, 19 nt, Mycobacterium avium subsp. paratuberculosis
cagggcggcgggcccggcg

SEQ ID NO: 1014025 - RNA, 15 nt, Mycobacterium avium subsp. paratuberculosis
cagggcggccggcca

SEQ ID NO: 1014026 - RNA, 19 nt, Mycobacterium avium subsp. paratuberculosis
cagggcggcgaucgagggg

SEQ ID NO: 1014027 - RNA, 16 nt, Mycobacterium avium subsp. paratuberculosis
cagggcggcgcgcgcc

SEQ ID NO: 1014028 - RNA, 23 nt, Mycobacterium avium subsp. paratuberculosis
cagggugacguggcggccgucgc

SEQ ID NO: 1014029 - RNA, 17 nt, Mycobacterium avium subsp. paratuberculosis
cagggucucgcgcagca

SEQ ID NO: 1014030 - RNA, 20 nt, Mycobacterium avium subsp. paratuberculosis
cagggucucgggcagcagca

SEQ ID NO: 1014031 - RNA, 22 nt, Mycobacterium avium subsp. paratuberculosis
cagggucucgggcagcagcacc

SEQ ID NO: 1014032 - RNA, 23 nt, Mycobacterium avium subsp. paratuberculosis
cagggugccccgcgaccgcagca

SEQ ID NO: 1014033 - RNA, 22 nt, Mycobacterium avium subsp. paratuberculosis
cagggugccgauguaggacagg

SEQ ID NO: 1014034 - RNA, 23 nt, Mycobacterium avium subsp. paratuberculosis
cagggugccgauguaggacaggu

SEQ ID NO: 1014035 - RNA, 16 nt, Mycobacterium avium subsp. paratuberculosis
cagggugccgccgccc

SEQ ID NO: 1014036 - RNA, 21 nt, Mycobacterium avium subsp. paratuberculosis
cagggugccgcugcccgccgc

SEQ ID NO: 1014037 - RNA, 16 nt, Mycobacterium avium subsp. paratuberculosis
cagggugucccagcgc

SEQ ID NO: 1014038 - RNA, 17 nt, Mycobacterium avium subsp. paratuberculosis
cagggugucccagcgcc

SEQ ID NO: 1014039 - RNA, 17 nt, Mycobacterium avium subsp. paratuberculosis
caggguggccagcacgc

SEQ ID NO: 1014040 - RNA, 15 nt, Mycobacterium avium subsp. paratuberculosis
caggguggccccagc

SEQ ID NO: 1014041 - RNA, 17 nt, Mycobacterium avium subsp. paratuberculosis
caggguggccccagccc

SEQ ID NO: 1014042 - RNA, 14 nt, Mycobacterium avium subsp. paratuberculosis
caggguggccgcca

SEQ ID NO: 1014043 - RNA, 16 nt, Mycobacterium avium subsp. paratuberculosis
cagggugcucagccgc

SEQ ID NO: 1014044 - RNA, 18 nt, Mycobacterium avium subsp. paratuberculosis
cagggugcucagccgcac

SEQ ID NO: 1014045 - RNA, 14 nt, Mycobacterium avium subsp. paratuberculosis
cagggucagcagca

SEQ ID NO: 1014046 - RNA, 18 nt, Mycobacterium avium subsp. paratuberculosis
cagggucaucgcgccgga

SEQ ID NO: 1014047 - RNA, 12 nt, Mycobacterium avium subsp. paratuberculosis
caggguccaggg

SEQ ID NO: 1014048 - RNA, 20 nt, Mycobacterium avium subsp. paratuberculosis
cagggucgcggagcggguca

SEQ ID NO: 1014049 - RNA, 16 nt, Mycobacterium avium subsp. paratuberculosis
caggcguggucggcgc

SEQ ID NO: 1014050 - RNA, 13 nt, Mycobacterium avium subsp. paratuberculosis
caggcgggccacc

SEQ ID NO: 1014051 - RNA, 21 nt, Mycobacterium avium subsp. paratuberculosis
caggcgggccaccacaguggc

SEQ ID NO: 1014052 - RNA, 16 nt, Mycobacterium avium subsp. paratuberculosis
caggcggcgacggccg

SEQ ID NO: 1014053 - RNA, 13 nt, Mycobacterium avium subsp. paratuberculosis
caggcggcgcgca

SEQ ID NO: 1014054 - RNA, 15 nt, Mycobacterium avium subsp. paratuberculosis
caggcguggcccagc

SEQ ID NO: 1014055 - RNA, 20 nt, Mycobacterium avium subsp. paratuberculosis
caggcggucgaacgcggcgc

SEQ ID NO: 1014056 - RNA, 15 nt, Mycobacterium avium subsp. paratuberculosis
caggcgggugauccc

SEQ ID NO: 1014057 - RNA, 16 nt, Mycobacterium avium subsp. paratuberculosis
caggcgguagcggcag

SEQ ID NO: 1014058 - RNA, 22 nt, Mycobacterium avium subsp. paratuberculosis
caggccgucgaggcgcugcagc

SEQ ID NO: 1014059 - RNA, 15 nt, Mycobacterium avium subsp. paratuberculosis
caggccguccaccag

SEQ ID NO: 1014060 - RNA, 19 nt, Mycobacterium avium subsp. paratuberculosis
caggccguuguggccaccc

SEQ ID NO: 1014061 - RNA, 19 nt, Mycobacterium avium subsp. paratuberculosis
caggcgcgcggccagcccc

SEQ ID NO: 1014062 - RNA, 20 nt, Mycobacterium avium subsp. paratuberculosis
caggcgcgcggccagccccg

SEQ ID NO: 1014063 - RNA, 22 nt, Mycobacterium avium subsp. paratuberculosis
caggcgcgcacguuggcggcca

SEQ ID NO: 1014064 - RNA, 13 nt, Mycobacterium avium subsp. paratuberculosis
caggcgcgcagca

SEQ ID NO: 1014065 - RNA, 21 nt, Mycobacterium avium subsp. paratuberculosis
caggcgccccagcuccucggc

SEQ ID NO: 1014066 - RNA, 11 nt, Mycobacterium avium subsp. paratuberculosis
caggcgccggg

SEQ ID NO: 1014067 - RNA, 20 nt, Mycobacterium avium subsp. paratuberculosis
caggccgcgacgggcugucc

SEQ ID NO: 1014068 - RNA, 22 nt, Mycobacterium avium subsp. paratuberculosis
caggccgcgacgggcugucccg

SEQ ID NO: 1014069 - RNA, 16 nt, Mycobacterium avium subsp. paratuberculosis
caggccgcgagcccgc

SEQ ID NO: 1014070 - RNA, 23 nt, Mycobacterium avium subsp. paratuberculosis
caggccgcccgacccguccagca

SEQ ID NO: 1014071 - RNA, 14 nt, Mycobacterium avium subsp. paratuberculosis
caggccgccagcuc

SEQ ID NO: 1014072 - RNA, 21 nt, Mycobacterium avium subsp. paratuberculosis
caggccgcggccaagugcggu

SEQ ID NO: 1014073 - RNA, 16 nt, Mycobacterium avium subsp. paratuberculosis
caggccgcgccgggcg

SEQ ID NO: 1014074 - RNA, 14 nt, Mycobacterium avium subsp. paratuberculosis
caggccggccacca

SEQ ID NO: 1014075 - RNA, 15 nt, Mycobacterium avium subsp. paratuberculosis
caggccggccaccag

SEQ ID NO: 1014076 - RNA, 20 nt, Mycobacterium avium subsp. paratuberculosis
caggccggccuugcucgccg

SEQ ID NO: 1014077 - RNA, 16 nt, Mycobacterium avium subsp. paratuberculosis
caggccggcgagcucg

SEQ ID NO: 1014078 - RNA, 15 nt, Mycobacterium avium subsp. paratuberculosis
caggccggcgccgcg

SEQ ID NO: 1014079 - RNA, 19 nt, Mycobacterium avium subsp. paratuberculosis
caggccggccugccaccgc

SEQ ID NO: 1014080 - RNA, 22 nt, Mycobacterium avium subsp. paratuberculosis
caggccgggaaugucgcgcagc

SEQ ID NO: 1014081 - RNA, 20 nt, Mycobacterium avium subsp. paratuberculosis
caggccgggauagagcaccg

SEQ ID NO: 1014082 - RNA, 21 nt, Mycobacterium avium subsp. paratuberculosis
caggccgggauagagcaccgc

SEQ ID NO: 1014083 - RNA, 16 nt, Mycobacterium avium subsp. paratuberculosis
caggccgaggccaacu

SEQ ID NO: 1014084 - RNA, 17 nt, Mycobacterium avium subsp. paratuberculosis
caggccgaggccaacuc

SEQ ID NO: 1014085 - RNA, 16 nt, Mycobacterium avium subsp. paratuberculosis
caggccgaggcugacg

SEQ ID NO: 1014086 - RNA, 17 nt, Mycobacterium avium subsp. paratuberculosis
caggccgacgccggcca

SEQ ID NO: 1014087 - RNA, 20 nt, Mycobacterium avium subsp. paratuberculosis
caggccgacgccggccacca

SEQ ID NO: 1014088 - RNA, 14 nt, Mycobacterium avium subsp. paratuberculosis
caggccgagccgcc

SEQ ID NO: 1014089 - RNA, 15 nt, Mycobacterium avium subsp. paratuberculosis
caggccgagcgcgcu

SEQ ID NO: 1014090 - RNA, 17 nt, Mycobacterium avium subsp. paratuberculosis
caggccgagcgcgcugg

SEQ ID NO: 1014091 - RNA, 12 nt, Mycobacterium avium subsp. paratuberculosis
caggcagcagca

SEQ ID NO: 1014092 - RNA, 15 nt, Mycobacterium avium subsp. paratuberculosis
caggcagcagcaccc

SEQ ID NO: 1014093 - RNA, 22 nt, Mycobacterium avium subsp. paratuberculosis
caggcaguagccgaucuccacc

SEQ ID NO: 1014094 - RNA, 23 nt, Mycobacterium avium subsp. paratuberculosis
caggcaguagccgaucuccaccg

SEQ ID NO: 1014095 - RNA, 17 nt, Mycobacterium avium subsp. paratuberculosis
caggcaggcggccaggg

SEQ ID NO: 1014096 - RNA, 14 nt, Mycobacterium avium subsp. paratuberculosis
ccuucaccgaccag

SEQ ID NO: 1014097 - RNA, 18 nt, Mycobacterium avium subsp. paratuberculosis
ccuucaccgaccagcugu

SEQ ID NO: 1014098 - RNA, 20 nt, Mycobacterium avium subsp. paratuberculosis
ccuucaccgcgccgguccgg

SEQ ID NO: 1014099 - RNA, 18 nt, Mycobacterium avium subsp. paratuberculosis
ccuucacgaccggcagca

SEQ ID NO: 1014100 - RNA, 22 nt, Mycobacterium avium subsp. paratuberculosis
ccuuacaaagccggucuugggc

SEQ ID NO: 1014101 - RNA, 15 nt, Mycobacterium avium subsp. paratuberculosis
ccuguuggcccugcu

SEQ ID NO: 1014102 - RNA, 18 nt, Mycobacterium avium subsp. paratuberculosis
ccuguugguagcccagga

SEQ ID NO: 1014103 - RNA, 20 nt, Mycobacterium avium subsp. paratuberculosis
ccugguuggcccgcaccacc

SEQ ID NO: 1014104 - RNA, 18 nt, Mycobacterium avium subsp. paratuberculosis
ccugguugaacggcaccc

SEQ ID NO: 1014105 - RNA, 18 nt, Mycobacterium avium subsp. paratuberculosis
ccugguugaggaucugca

SEQ ID NO: 1014106 - RNA, 15 nt, Mycobacterium avium subsp. paratuberculosis
ccugguugauccagc

SEQ ID NO: 1014107 - RNA, 16 nt, Mycobacterium avium subsp. paratuberculosis
ccuguuccccggcggg

SEQ ID NO: 1014108 - RNA, 15 nt, Mycobacterium avium subsp. paratuberculosis
ccuguucgccgucgc

SEQ ID NO: 1014109 - RNA, 14 nt, Mycobacterium avium subsp. paratuberculosis
ccuggaacuuguug

SEQ ID NO: 1014110 - RNA, 17 nt, Mycobacterium avium subsp. paratuberculosis
ccugcuucucgccgucg

SEQ ID NO: 1014111 - RNA, 12 nt, Mycobacterium avium subsp. paratuberculosis
ccugcuuccagg

SEQ ID NO: 1014112 - RNA, 19 nt, Mycobacterium avium subsp. paratuberculosis
ccugcuugggcagcagcuc

SEQ ID NO: 1014113 - RNA, 21 nt, Mycobacterium avium subsp. paratuberculosis
ccugcuugggcagcagcucga

SEQ ID NO: 1014114 - RNA, 20 nt, Mycobacterium avium subsp. paratuberculosis
ccugcuuggucuccggcccc

SEQ ID NO: 1014115 - RNA, 21 nt, Mycobacterium avium subsp. paratuberculosis
ccugcuuggucuccggccccg

SEQ ID NO: 1014116 - RNA, 18 nt, Mycobacterium avium subsp. paratuberculosis
ccugcugggagcggccca

SEQ ID NO: 1014117 - RNA, 15 nt, Mycobacterium avium subsp. paratuberculosis
ccugcuggccgggcu

SEQ ID NO: 1014118 - RNA, 18 nt, Mycobacterium avium subsp. paratuberculosis
ccugcugggcgggcagcc

SEQ ID NO: 1014119 - RNA, 19 nt, Mycobacterium avium subsp. paratuberculosis
ccugcugggcgggcagccg

SEQ ID NO: 1014120 - RNA, 22 nt, Mycobacterium avium subsp. paratuberculosis
ccugcugcucgucgcgggcgcc

SEQ ID NO: 1014121 - RNA, 12 nt, Mycobacterium avium subsp. paratuberculosis
ccugcuccagcg

SEQ ID NO: 1014122 - RNA, 22 nt, Mycobacterium avium subsp. paratuberculosis
ccugcucgcagauggucgggac

SEQ ID NO: 1014123 - RNA, 22 nt, Mycobacterium avium subsp. paratuberculosis
ccugcuccucgaaccucgcggc

SEQ ID NO: 1014124 - RNA, 18 nt, Mycobacterium avium subsp. paratuberculosis
ccugcucagcggccaucg

SEQ ID NO: 1014125 - RNA, 19 nt, Mycobacterium avium subsp. paratuberculosis
ccugcucaccgagcugggc

SEQ ID NO: 1014126 - RNA, 14 nt, Mycobacterium avium subsp. paratuberculosis
ccugccccacacgc

SEQ ID NO: 1014127 - RNA, 15 nt, Mycobacterium avium subsp. paratuberculosis
ccugccccacggccc

SEQ ID NO: 1014128 - RNA, 13 nt, Mycobacterium avium subsp. paratuberculosis
ccugcccagcggc

SEQ ID NO: 1014129 - RNA, 20 nt, Mycobacterium avium subsp. paratuberculosis
ccugccagaagaucugccgg

SEQ ID NO: 1014130 - RNA, 23 nt, Mycobacterium avium subsp. paratuberculosis
ccuggcgaugaucaacaggauuc

SEQ ID NO: 1014131 - RNA, 18 nt, Mycobacterium avium subsp. paratuberculosis
ccuggcgcaccgccgcgg

SEQ ID NO: 1014132 - RNA, 21 nt, Mycobacterium avium subsp. paratuberculosis
ccuggccuggucggccggcag

SEQ ID NO: 1014133 - RNA, 20 nt, Mycobacterium avium subsp. paratuberculosis
ccuggcgcuccagccacucc

SEQ ID NO: 1014134 - RNA, 16 nt, Mycobacterium avium subsp. paratuberculosis
ccuggcgcgcaacgcu

SEQ ID NO: 1014135 - RNA, 22 nt, Mycobacterium avium subsp. paratuberculosis
ccuggcgcgcaacgcuuucggg

SEQ ID NO: 1014136 - RNA, 17 nt, Mycobacterium avium subsp. paratuberculosis
ccuggcccccgccccag

SEQ ID NO: 1014137 - RNA, 19 nt, Mycobacterium avium subsp. paratuberculosis
ccuggccgccggccgcgca

SEQ ID NO: 1014138 - RNA, 17 nt, Mycobacterium avium subsp. paratuberculosis
ccuggccgauggucagc

SEQ ID NO: 1014139 - RNA, 14 nt, Mycobacterium avium subsp. paratuberculosis
ccuggugcucgcgc

SEQ ID NO: 1014140 - RNA, 15 nt, Mycobacterium avium subsp. paratuberculosis
ccuggucgucccagg

SEQ ID NO: 1014141 - RNA, 20 nt, Mycobacterium avium subsp. paratuberculosis
ccuggugaccgacgacguga

SEQ ID NO: 1014142 - RNA, 19 nt, Mycobacterium avium subsp. paratuberculosis
ccuggucggccggcaggcc

SEQ ID NO: 1014143 - RNA, 16 nt, Mycobacterium avium subsp. paratuberculosis
ccugggauugccgggc

SEQ ID NO: 1014144 - RNA, 19 nt, Mycobacterium avium subsp. paratuberculosis
ccuggucgaacagcacgcc

SEQ ID NO: 1014145 - RNA, 19 nt, Mycobacterium avium subsp. paratuberculosis
ccugguccucccggguggg

SEQ ID NO: 1014146 - RNA, 13 nt, Mycobacterium avium subsp. paratuberculosis
ccugguccugccc

SEQ ID NO: 1014147 - RNA, 13 nt, Mycobacterium avium subsp. paratuberculosis
ccugggcaauggc

SEQ ID NO: 1014148 - RNA, 18 nt, Mycobacterium avium subsp. paratuberculosis
ccuggcugccugguuggu

SEQ ID NO: 1014149 - RNA, 19 nt, Mycobacterium avium subsp. paratuberculosis
ccucgagcaccggcggcag

SEQ ID NO: 1014150 - RNA, 21 nt, Mycobacterium avium subsp. paratuberculosis
ccucgagcaccggcggcagcg

SEQ ID NO: 1014151 - RNA, 17 nt, Mycobacterium avium subsp. paratuberculosis
ccucgagccguuugaug

SEQ ID NO: 1014152 - RNA, 20 nt, Mycobacterium avium subsp. paratuberculosis
ccucgagcgcgucgaccagc

SEQ ID NO: 1014153 - RNA, 13 nt, Mycobacterium avium subsp. paratuberculosis
ccucgagcuugcc

SEQ ID NO: 1014154 - RNA, 19 nt, Mycobacterium avium subsp. paratuberculosis
ccucgagcugcacgggcgu

SEQ ID NO: 1014155 - RNA, 17 nt, Mycobacterium avium subsp. paratuberculosis
ccucgagcuugccgucg

SEQ ID NO: 1014156 - RNA, 19 nt, Mycobacterium avium subsp. paratuberculosis
ccucgaucaacgccggguc

SEQ ID NO: 1014157 - RNA, 22 nt, Mycobacterium avium subsp. paratuberculosis
ccucgaguacucgguguagagc

SEQ ID NO: 1014158 - RNA, 22 nt, Mycobacterium avium subsp. paratuberculosis
ccucgaggaucgcggccacgcc

SEQ ID NO: 1014159 - RNA, 19 nt, Mycobacterium avium subsp. paratuberculosis
ccucgaucaccgggcggcc

SEQ ID NO: 1014160 - RNA, 21 nt, Mycobacterium avium subsp. paratuberculosis
ccucgaucagccacaccgccg

SEQ ID NO: 1014161 - RNA, 20 nt, Mycobacterium avium subsp. paratuberculosis
ccucgauccgguccagcccg

SEQ ID NO: 1014162 - RNA, 14 nt, Mycobacterium avium subsp. paratuberculosis
ccucagcccggcag

SEQ ID NO: 1014163 - RNA, 16 nt, Mycobacterium avium subsp. paratuberculosis
ccucagcccggcagcg

SEQ ID NO: 1014164 - RNA, 23 nt, Mycobacterium avium subsp. paratuberculosis
ccucaggcguccagcaccugcuc

SEQ ID NO: 1014165 - RNA, 14 nt, Mycobacterium avium subsp. paratuberculosis
ccucaguccgcccc

SEQ ID NO: 1014166 - RNA, 14 nt, Mycobacterium avium subsp. paratuberculosis
ccucgccgcgccag

SEQ ID NO: 1014167 - RNA, 15 nt, Mycobacterium avium subsp. paratuberculosis
ccucgccgaccuugg

SEQ ID NO: 1014168 - RNA, 23 nt, Mycobacterium avium subsp. paratuberculosis
ccucgccggaguucagccugaug

SEQ ID NO: 1014169 - RNA, 13 nt, Mycobacterium avium subsp. paratuberculosis
ccucgccggccgg

SEQ ID NO: 1014170 - RNA, 14 nt, Mycobacterium avium subsp. paratuberculosis
ccucgccggcgccg

SEQ ID NO: 1014171 - RNA, 19 nt, Mycobacterium avium subsp. paratuberculosis
ccucgccggcgccgggcgg

SEQ ID NO: 1014172 - RNA, 16 nt, Mycobacterium avium subsp. paratuberculosis
ccucgccgggcccgcu

SEQ ID NO: 1014173 - RNA, 17 nt, Mycobacterium avium subsp. paratuberculosis
ccucgccgggcccgcuc

SEQ ID NO: 1014174 - RNA, 14 nt, Mycobacterium avium subsp. paratuberculosis
ccucgcucagcccg

SEQ ID NO: 1014175 - RNA, 17 nt, Mycobacterium avium subsp. paratuberculosis
ccucgcugccggccggg

SEQ ID NO: 1014176 - RNA, 18 nt, Mycobacterium avium subsp. paratuberculosis
ccucgcugaucuucugga

SEQ ID NO: 1014177 - RNA, 14 nt, Mycobacterium avium subsp. paratuberculosis
ccucggaagggcuu

SEQ ID NO: 1014178 - RNA, 19 nt, Mycobacterium avium subsp. paratuberculosis
ccucgcuggcgaucaccuu

SEQ ID NO: 1014179 - RNA, 19 nt, Mycobacterium avium subsp. paratuberculosis
ccucgccgaucucgaccag

SEQ ID NO: 1014180 - RNA, 21 nt, Mycobacterium avium subsp. paratuberculosis
ccucgccgaucucgaccagcg

SEQ ID NO: 1014181 - RNA, 16 nt, Mycobacterium avium subsp. paratuberculosis
ccucgccagccccacc

SEQ ID NO: 1014182 - RNA, 14 nt, Mycobacterium avium subsp. paratuberculosis
ccucgucgcccggc

SEQ ID NO: 1014183 - RNA, 15 nt, Mycobacterium avium subsp. paratuberculosis
ccucgucgccgcggu

SEQ ID NO: 1014184 - RNA, 16 nt, Mycobacterium avium subsp. paratuberculosis
ccucgucgagccgggc

SEQ ID NO: 1014185 - RNA, 20 nt, Mycobacterium avium subsp. paratuberculosis
ccucgucgagccgggcccgg

SEQ ID NO: 1014186 - RNA, 22 nt, Mycobacterium avium subsp. paratuberculosis
ccucgucgaagccgaucaccgg

SEQ ID NO: 1014187 - RNA, 19 nt, Mycobacterium avium subsp. paratuberculosis
ccucgucgaccgcggccug

SEQ ID NO: 1014188 - RNA, 16 nt, Mycobacterium avium subsp. paratuberculosis
ccucgucgagcuccau

SEQ ID NO: 1014189 - RNA, 22 nt, Mycobacterium avium subsp. paratuberculosis
ccucguccgacagcgccugccc

SEQ ID NO: 1014190 - RNA, 22 nt, Mycobacterium avium subsp. paratuberculosis
ccucggccuuggccaccgccug

SEQ ID NO: 1014191 - RNA, 17 nt, Mycobacterium avium subsp. paratuberculosis
ccucggcgaucucgucc

SEQ ID NO: 1014192 - RNA, 19 nt, Mycobacterium avium subsp. paratuberculosis
ccucguagacgaagcggcc

SEQ ID NO: 1014193 - RNA, 20 nt, Mycobacterium avium subsp. paratuberculosis
ccucggcaccgugccgcgcg

SEQ ID NO: 1014194 - RNA, 20 nt, Mycobacterium avium subsp. paratuberculosis
ccucggaggccaccgcgccg

SEQ ID NO: 1014195 - RNA, 18 nt, Mycobacterium avium subsp. paratuberculosis
ccucggccagcucaccgg

SEQ ID NO: 1014196 - RNA, 19 nt, Mycobacterium avium subsp. paratuberculosis
ccucggccagcucaccggc

SEQ ID NO: 1014197 - RNA, 23 nt, Mycobacterium avium subsp. paratuberculosis
ccucggccagcaccagcagccgg

SEQ ID NO: 1014198 - RNA, 14 nt, Mycobacterium avium subsp. paratuberculosis
ccucggccagcccc

SEQ ID NO: 1014199 - RNA, 22 nt, Mycobacterium avium subsp. paratuberculosis
ccucggccaccaccucgcgggc

SEQ ID NO: 1014200 - RNA, 13 nt, Mycobacterium avium subsp. paratuberculosis
ccucggccaccag

SEQ ID NO: 1014201 - RNA, 19 nt, Mycobacterium avium subsp. paratuberculosis
ccucggcgaccacguccaa

SEQ ID NO: 1014202 - RNA, 21 nt, Mycobacterium avium subsp. paratuberculosis
ccucggcgacgauggccaggc

SEQ ID NO: 1014203 - RNA, 20 nt, Mycobacterium avium subsp. paratuberculosis
ccucggcgagccgcucccgc

SEQ ID NO: 1014204 - RNA, 17 nt, Mycobacterium avium subsp. paratuberculosis
ccugcaggcaggccggc

SEQ ID NO: 1014205 - RNA, 14 nt, Mycobacterium avium subsp. paratuberculosis
ccugccaccgcgaa

SEQ ID NO: 1014206 - RNA, 20 nt, Mycobacterium avium subsp. paratuberculosis
ccugcaggccgagccgccgg

SEQ ID NO: 1014207 - RNA, 15 nt, Mycobacterium avium subsp. paratuberculosis
ccugcagccggucgg

SEQ ID NO: 1014208 - RNA, 17 nt, Mycobacterium avium subsp. paratuberculosis
ccugcagccgccgcgcc

SEQ ID NO: 1014209 - RNA, 21 nt, Mycobacterium avium subsp. paratuberculosis
ccugcagcgccuuggguccca

SEQ ID NO: 1014210 - RNA, 14 nt, Mycobacterium avium subsp. paratuberculosis
ccugcagcgcgaac

SEQ ID NO: 1014211 - RNA, 16 nt, Mycobacterium avium subsp. paratuberculosis
ccugaucgcggcgagc

SEQ ID NO: 1014212 - RNA, 20 nt, Mycobacterium avium subsp. paratuberculosis
ccugaucgcggcgagcagcg

SEQ ID NO: 1014213 - RNA, 14 nt, Mycobacterium avium subsp. paratuberculosis
ccugaucuugcugg

SEQ ID NO: 1014214 - RNA, 14 nt, Mycobacterium avium subsp. paratuberculosis
ccugaggcccggug

SEQ ID NO: 1014215 - RNA, 20 nt, Mycobacterium avium subsp. paratuberculosis
ccucuucgaaagccacccgc

SEQ ID NO: 1014216 - RNA, 22 nt, Mycobacterium avium subsp. paratuberculosis
ccucuucgaaagccacccgcgc

SEQ ID NO: 1014217 - RNA, 17 nt, Mycobacterium avium subsp. paratuberculosis
ccucuucgcugccgccg

SEQ ID NO: 1014218 - RNA, 18 nt, Mycobacterium avium subsp. paratuberculosis
ccucuucgcuggacagcc

SEQ ID NO: 1014219 - RNA, 24 nt, Mycobacterium avium subsp. paratuberculosis
ccucuucgcuggacagccacagcu

SEQ ID NO: 1014220 - RNA, 13 nt, Mycobacterium avium subsp. paratuberculosis
ccugaccaaggac

SEQ ID NO: 1014221 - RNA, 16 nt, Mycobacterium avium subsp. paratuberculosis
ccugaccgugcuuggc

SEQ ID NO: 1014222 - RNA, 18 nt, Mycobacterium avium subsp. paratuberculosis
ccugacuaagucaccagg

SEQ ID NO: 1014223 - RNA, 12 nt, Mycobacterium avium subsp. paratuberculosis
ccguccacccgg

SEQ ID NO: 1014224 - RNA, 14 nt, Mycobacterium avium subsp. paratuberculosis
ccguccacccggcc

SEQ ID NO: 1014225 - RNA, 23 nt, Mycobacterium avium subsp. paratuberculosis
ccgucauccccaucucgagcagg

SEQ ID NO: 1014226 - RNA, 21 nt, Mycobacterium avium subsp. paratuberculosis
ccgucagggugacguggcggc

SEQ ID NO: 1014227 - RNA, 18 nt, Mycobacterium avium subsp. paratuberculosis
ccgucacgcuggcgugac

SEQ ID NO: 1014228 - RNA, 20 nt, Mycobacterium avium subsp. paratuberculosis
ccgucacggccguccaggcg

SEQ ID NO: 1014229 - RNA, 22 nt, Mycobacterium avium subsp. paratuberculosis
ccgucacgggcugaccgccagg

SEQ ID NO: 1014230 - RNA, 14 nt, Mycobacterium avium subsp. paratuberculosis
ccgucaucaccgcc

SEQ ID NO: 1014231 - RNA, 22 nt, Mycobacterium avium subsp. paratuberculosis
ccgucccgguugaccccggccc

SEQ ID NO: 1014232 - RNA, 12 nt, Mycobacterium avium subsp. paratuberculosis
ccguccccaccg

SEQ ID NO: 1014233 - RNA, 18 nt, Mycobacterium avium subsp. paratuberculosis
ccguccgcggcggccagg

SEQ ID NO: 1014234 - RNA, 19 nt, Mycobacterium avium subsp. paratuberculosis
ccguccggauagccgucgg

SEQ ID NO: 1014235 - RNA, 23 nt, Mycobacterium avium subsp. paratuberculosis
ccguccagcuccgccgacaccag

SEQ ID NO: 1014236 - RNA, 12 nt, Mycobacterium avium subsp. paratuberculosis
ccguccaggccg

SEQ ID NO: 1014237 - RNA, 18 nt, Mycobacterium avium subsp. paratuberculosis
ccguccagcccagcgccc

SEQ ID NO: 1014238 - RNA, 21 nt, Mycobacterium avium subsp. paratuberculosis
ccguccagccgugcggcacgc

SEQ ID NO: 1014239 - RNA, 13 nt, Mycobacterium avium subsp. paratuberculosis
ccguccagcgcau

SEQ ID NO: 1014240 - RNA, 23 nt, Mycobacterium avium subsp. paratuberculosis
ccguccagaucggccagcgcggc

SEQ ID NO: 1014241 - RNA, 13 nt, Mycobacterium avium subsp. paratuberculosis
ccguccagcagca

SEQ ID NO: 1014242 - RNA, 15 nt, Mycobacterium avium subsp. paratuberculosis
ccguccagcagcagc

SEQ ID NO: 1014243 - RNA, 13 nt, Mycobacterium avium subsp. paratuberculosis
ccgucaccgccgc

SEQ ID NO: 1014244 - RNA, 14 nt, Mycobacterium avium subsp. paratuberculosis
ccgucaccgccucc

SEQ ID NO: 1014245 - RNA, 21 nt, Mycobacterium avium subsp. paratuberculosis
ccgucaccuucacccccaccc

SEQ ID NO: 1014246 - RNA, 17 nt, Mycobacterium avium subsp. paratuberculosis
ccgucaccggccauccg

SEQ ID NO: 1014247 - RNA, 12 nt, Mycobacterium avium subsp. paratuberculosis
ccgucaccgugg

SEQ ID NO: 1014248 - RNA, 23 nt, Mycobacterium avium subsp. paratuberculosis
ccguacagcugguccggccggcc

SEQ ID NO: 1014249 - RNA, 17 nt, Mycobacterium avium subsp. paratuberculosis
ccguaccgcuuggccca

SEQ ID NO: 1014250 - RNA, 18 nt, Mycobacterium avium subsp. paratuberculosis
ccguaccgcuuggcccac

SEQ ID NO: 1014251 - RNA, 20 nt, Mycobacterium avium subsp. paratuberculosis
ccguaccgcuuggcccaccg

SEQ ID NO: 1014252 - RNA, 13 nt, Mycobacterium avium subsp. paratuberculosis
ccguaccgcaaca

SEQ ID NO: 1014253 - RNA, 17 nt, Mycobacterium avium subsp. paratuberculosis
ccguaccgcaacaccga

SEQ ID NO: 1014254 - RNA, 19 nt, Mycobacterium avium subsp. paratuberculosis
ccgguucgucaacgccccg

SEQ ID NO: 1014255 - RNA, 14 nt, Mycobacterium avium subsp. paratuberculosis
ccgguucggcggca

SEQ ID NO: 1014256 - RNA, 18 nt, Mycobacterium avium subsp. paratuberculosis
ccgguuccaccgggccgc

SEQ ID NO: 1014257 - RNA, 22 nt, Mycobacterium avium subsp. paratuberculosis
ccgguuccaccgggccgccauc

SEQ ID NO: 1014258 - RNA, 17 nt, Mycobacterium avium subsp. paratuberculosis
ccgguucccgugcuggc

SEQ ID NO: 1014259 - RNA, 15 nt, Mycobacterium avium subsp. paratuberculosis
ccgguuccgggcgac

SEQ ID NO: 1014260 - RNA, 14 nt, Mycobacterium avium subsp. paratuberculosis
ccgguguucggcgc

SEQ ID NO: 1014261 - RNA, 19 nt, Mycobacterium avium subsp. paratuberculosis
ccgguguugccgacggcgc

SEQ ID NO: 1014262 - RNA, 19 nt, Mycobacterium avium subsp. paratuberculosis
ccggugugccuggcucccc

SEQ ID NO: 1014263 - RNA, 20 nt, Mycobacterium avium subsp. paratuberculosis
ccgguuccaaccaccguggc

SEQ ID NO: 1014264 - RNA, 20 nt, Mycobacterium avium subsp. paratuberculosis
ccguaaguggcgccgcgguc

SEQ ID NO: 1014265 - RNA, 14 nt, Mycobacterium avium subsp. paratuberculosis
ccgguuggccaggu

SEQ ID NO: 1014266 - RNA, 17 nt, Mycobacterium avium subsp. paratuberculosis
ccgguuggccagguggc

SEQ ID NO: 1014267 - RNA, 15 nt, Mycobacterium avium subsp. paratuberculosis
ccgguugcggcagca

SEQ ID NO: 1014268 - RNA, 20 nt, Mycobacterium avium subsp. paratuberculosis
ccgguugcgguugccccacc

SEQ ID NO: 1014269 - RNA, 16 nt, Mycobacterium avium subsp. paratuberculosis
ccgguugaaggccgcg

SEQ ID NO: 1014270 - RNA, 13 nt, Mycobacterium avium subsp. paratuberculosis
ccgguugaccccg

SEQ ID NO: 1014271 - RNA, 18 nt, Mycobacterium avium subsp. paratuberculosis
ccggugcgacgccgcgca

SEQ ID NO: 1014272 - RNA, 16 nt, Mycobacterium avium subsp. paratuberculosis
ccggugcucuccugcu

SEQ ID NO: 1014273 - RNA, 15 nt, Mycobacterium avium subsp. paratuberculosis
ccggugcugacccgg

SEQ ID NO: 1014274 - RNA, 22 nt, Mycobacterium avium subsp. paratuberculosis
ccggugcugcucgagggccucc

SEQ ID NO: 1014275 - RNA, 12 nt, Mycobacterium avium subsp. paratuberculosis
ccggugcucccc

SEQ ID NO: 1014276 - RNA, 15 nt, Mycobacterium avium subsp. paratuberculosis
ccggugcggucccgg

SEQ ID NO: 1014277 - RNA, 16 nt, Mycobacterium avium subsp. paratuberculosis
ccggugcggucggcgu

SEQ ID NO: 1014278 - RNA, 16 nt, Mycobacterium avium subsp. paratuberculosis
ccgguggacuccagca

SEQ ID NO: 1014279 - RNA, 19 nt, Mycobacterium avium subsp. paratuberculosis
ccgguggacuccagcacca

SEQ ID NO: 1014280 - RNA, 21 nt, Mycobacterium avium subsp. paratuberculosis
ccgguggagauggccagcacc

SEQ ID NO: 1014281 - RNA, 21 nt, Mycobacterium avium subsp. paratuberculosis
ccgguggauauuucgcggccg

SEQ ID NO: 1014282 - RNA, 19 nt, Mycobacterium avium subsp. paratuberculosis
ccggugucgccgucgccgc

SEQ ID NO: 1014283 - RNA, 21 nt, Mycobacterium avium subsp. paratuberculosis
ccggugugaucgagcaccagc

SEQ ID NO: 1014284 - RNA, 14 nt, Mycobacterium avium subsp. paratuberculosis
ccgguggccgccgg

SEQ ID NO: 1014285 - RNA, 14 nt, Mycobacterium avium subsp. paratuberculosis
ccgguggccgcgcu

SEQ ID NO: 1014286 - RNA, 13 nt, Mycobacterium avium subsp. paratuberculosis
ccgguggccgcgu

SEQ ID NO: 1014287 - RNA, 21 nt, Mycobacterium avium subsp. paratuberculosis
ccgguggccgcgucgaccagc

SEQ ID NO: 1014288 - RNA, 21 nt, Mycobacterium avium subsp. paratuberculosis
ccgguggcgcgaaucccggcc

SEQ ID NO: 1014289 - RNA, 16 nt, Mycobacterium avium subsp. paratuberculosis
ccgguggcggcgagga

SEQ ID NO: 1014290 - RNA, 14 nt, Mycobacterium avium subsp. paratuberculosis
ccggugggcggcgc

SEQ ID NO: 1014291 - RNA, 16 nt, Mycobacterium avium subsp. paratuberculosis
ccggugggcggcgccc

SEQ ID NO: 1014292 - RNA, 19 nt, Mycobacterium avium subsp. paratuberculosis
ccggucucgaccgcggcgc

SEQ ID NO: 1014293 - RNA, 21 nt, Mycobacterium avium subsp. paratuberculosis
ccggucucgaccgcggcgccg

SEQ ID NO: 1014294 - RNA, 17 nt, Mycobacterium avium subsp. paratuberculosis
ccggucguuggccuccu

SEQ ID NO: 1014295 - RNA, 21 nt, Mycobacterium avium subsp. paratuberculosis
ccggucguuucggccggcccc

SEQ ID NO: 1014296 - RNA, 23 nt, Mycobacterium avium subsp. paratuberculosis
ccggucggugagcuggccgcgca

SEQ ID NO: 1014297 - RNA, 17 nt, Mycobacterium avium subsp. paratuberculosis
ccggucggugcccagca

SEQ ID NO: 1014298 - RNA, 16 nt, Mycobacterium avium subsp. paratuberculosis
ccggucguagucggcc

SEQ ID NO: 1014299 - RNA, 21 nt, Mycobacterium avium subsp. paratuberculosis
ccggucguagucggcccgccg

SEQ ID NO: 1014300 - RNA, 14 nt, Mycobacterium avium subsp. paratuberculosis
ccgguccgccgucg

SEQ ID NO: 1014301 - RNA, 15 nt, Mycobacterium avium subsp. paratuberculosis
ccgguccgccgucgg

SEQ ID NO: 1014302 - RNA, 19 nt, Mycobacterium avium subsp. paratuberculosis
ccggucggaguccagcacg

SEQ ID NO: 1014303 - RNA, 22 nt, Mycobacterium avium subsp. paratuberculosis
ccgguccgaccagcggcccacc

SEQ ID NO: 1014304 - RNA, 23 nt, Mycobacterium avium subsp. paratuberculosis
ccgguccgaccgccaccacccgg

SEQ ID NO: 1014305 - RNA, 14 nt, Mycobacterium avium subsp. paratuberculosis
ccgguccgccgccg

SEQ ID NO: 1014306 - RNA, 16 nt, Mycobacterium avium subsp. paratuberculosis
ccgguccgccgccggc

SEQ ID NO: 1014307 - RNA, 14 nt, Mycobacterium avium subsp. paratuberculosis
ccggucggcccgcu

SEQ ID NO: 1014308 - RNA, 14 nt, Mycobacterium avium subsp. paratuberculosis
ccggucggccgcgu

SEQ ID NO: 1014309 - RNA, 19 nt, Mycobacterium avium subsp. paratuberculosis
ccgguccacucgucggcgg

SEQ ID NO: 1014310 - RNA, 17 nt, Mycobacterium avium subsp. paratuberculosis
ccgguccagaucggcgc

SEQ ID NO: 1014311 - RNA, 18 nt, Mycobacterium avium subsp. paratuberculosis
ccggucauccucgccgcg

SEQ ID NO: 1014312 - RNA, 15 nt, Mycobacterium avium subsp. paratuberculosis
ccgguccagccgccg

SEQ ID NO: 1014313 - RNA, 19 nt, Mycobacterium avium subsp. paratuberculosis
ccggucagcgcuccuggcc

SEQ ID NO: 1014314 - RNA, 19 nt, Mycobacterium avium subsp. paratuberculosis
ccggucagcguggcgucgg

SEQ ID NO: 1014315 - RNA, 15 nt, Mycobacterium avium subsp. paratuberculosis
ccggucagcgccagc

SEQ ID NO: 1014316 - RNA, 16 nt, Mycobacterium avium subsp. paratuberculosis
ccgguaggccgcgccg

SEQ ID NO: 1014317 - RNA, 16 nt, Mycobacterium avium subsp. paratuberculosis
ccggucagcacgucgg

SEQ ID NO: 1014318 - RNA, 22 nt, Mycobacterium avium subsp. paratuberculosis
ccggucagcccccaccgcgccg

SEQ ID NO: 1014319 - RNA, 14 nt, Mycobacterium avium subsp. paratuberculosis
ccgguagcgcagca

SEQ ID NO: 1014320 - RNA, 22 nt, Mycobacterium avium subsp. paratuberculosis
ccgguacggaucgccggacagc

SEQ ID NO: 1014321 - RNA, 22 nt, Mycobacterium avium subsp. paratuberculosis
ccgguacggccgacgcccagca

SEQ ID NO: 1014322 - RNA, 17 nt, Mycobacterium avium subsp. paratuberculosis
ccgguagauauggcccu

SEQ ID NO: 1014323 - RNA, 18 nt, Mycobacterium avium subsp. paratuberculosis
ccgguagaucagcgccug

SEQ ID NO: 1014324 - RNA, 16 nt, Mycobacterium avium subsp. paratuberculosis
ccgguagccgcucgcc

SEQ ID NO: 1014325 - RNA, 22 nt, Mycobacterium avium subsp. paratuberculosis
ccgguaaugggcgaucgauccc

SEQ ID NO: 1014326 - RNA, 14 nt, Mycobacterium avium subsp. paratuberculosis
ccgggugggcagcc

SEQ ID NO: 1014327 - RNA, 17 nt, Mycobacterium avium subsp. paratuberculosis
ccgguaccacgccgucg

SEQ ID NO: 1014328 - RNA, 13 nt, Mycobacterium avium subsp. paratuberculosis
ccggguggcccgc

SEQ ID NO: 1014329 - RNA, 14 nt, Mycobacterium avium subsp. paratuberculosis
ccgggugucgacgc

SEQ ID NO: 1014330 - RNA, 14 nt, Mycobacterium avium subsp. paratuberculosis
ccgggugcgauggc

SEQ ID NO: 1014331 - RNA, 14 nt, Mycobacterium avium subsp. paratuberculosis
ccgggugcccggcu

SEQ ID NO: 1014332 - RNA, 23 nt, Mycobacterium avium subsp. paratuberculosis
ccgggugcccggcugggcgcgca

SEQ ID NO: 1014333 - RNA, 20 nt, Mycobacterium avium subsp. paratuberculosis
ccgggugcgcuugucggcgu

SEQ ID NO: 1014334 - RNA, 18 nt, Mycobacterium avium subsp. paratuberculosis
ccgggugauggucucccg

SEQ ID NO: 1014335 - RNA, 22 nt, Mycobacterium avium subsp. paratuberculosis
ccgggugaccgccuuggcgcgc

SEQ ID NO: 1014336 - RNA, 23 nt, Mycobacterium avium subsp. paratuberculosis
ccgggugaccgccuuggcgcgcu

SEQ ID NO: 1014337 - RNA, 17 nt, Mycobacterium avium subsp. paratuberculosis
ccgggugaccggcgcgc

SEQ ID NO: 1014338 - RNA, 18 nt, Mycobacterium avium subsp. paratuberculosis
ccgggugaccggcgcgca

SEQ ID NO: 1014339 - RNA, 18 nt, Mycobacterium avium subsp. paratuberculosis
ccgggugcaggcccagcu

SEQ ID NO: 1014340 - RNA, 20 nt, Mycobacterium avium subsp. paratuberculosis
ccgggugaacgaggccgcgc

SEQ ID NO: 1014341 - RNA, 21 nt, Mycobacterium avium subsp. paratuberculosis
ccgggugaacgaggccgcgcc

SEQ ID NO: 1014342 - RNA, 23 nt, Mycobacterium avium subsp. paratuberculosis
ccgggucguagccgaagccgccg

SEQ ID NO: 1014343 - RNA, 15 nt, Mycobacterium avium subsp. paratuberculosis
ccgggucgucggugc

SEQ ID NO: 1014344 - RNA, 17 nt, Mycobacterium avium subsp. paratuberculosis
ccgggucgugcggcggc

SEQ ID NO: 1014345 - RNA, 16 nt, Mycobacterium avium subsp. paratuberculosis
ccgggucugccacgcc

SEQ ID NO: 1014346 - RNA, 23 nt, Mycobacterium avium subsp. paratuberculosis
ccgggucgcggcuggugccgccg

SEQ ID NO: 1014347 - RNA, 14 nt, Mycobacterium avium subsp. paratuberculosis
ccgggucgccgucg

SEQ ID NO: 1014348 - RNA, 17 nt, Mycobacterium avium subsp. paratuberculosis
ccgggucgcggugggcu

SEQ ID NO: 1014349 - RNA, 20 nt, Mycobacterium avium subsp. paratuberculosis
ccggggugggcacgucggcc

SEQ ID NO: 1014350 - RNA, 17 nt, Mycobacterium avium subsp. paratuberculosis
ccgggguguagcggaug

SEQ ID NO: 1014351 - RNA, 18 nt, Mycobacterium avium subsp. paratuberculosis
ccgggguguaggcgucgg

SEQ ID NO: 1014352 - RNA, 21 nt, Mycobacterium avium subsp. paratuberculosis
ccgggguguaggcgucggcgg

SEQ ID NO: 1014353 - RNA, 18 nt, Mycobacterium avium subsp. paratuberculosis
ccggguccuggcccccgc

SEQ ID NO: 1014354 - RNA, 13 nt, Mycobacterium avium subsp. paratuberculosis
ccggguccuugcg

SEQ ID NO: 1014355 - RNA, 18 nt, Mycobacterium avium subsp. paratuberculosis
ccggguccuugcgccccg

SEQ ID NO: 1014356 - RNA, 18 nt, Mycobacterium avium subsp. paratuberculosis
ccgggucgaccgccucgg

SEQ ID NO: 1014357 - RNA, 14 nt, Mycobacterium avium subsp. paratuberculosis
ccgggucgcacgcc

SEQ ID NO: 1014358 - RNA, 15 nt, Mycobacterium avium subsp. paratuberculosis
ccgggucgcaggcag

SEQ ID NO: 1014359 - RNA, 17 nt, Mycobacterium avium subsp. paratuberculosis
ccgggauuucccgggcg

SEQ ID NO: 1014360 - RNA, 21 nt, Mycobacterium avium subsp. paratuberculosis
ccgggaugacaccgcggacca

SEQ ID NO: 1014361 - RNA, 22 nt, Mycobacterium avium subsp. paratuberculosis
ccgggauggugaccagcgcccc

SEQ ID NO: 1014362 - RNA, 20 nt, Mycobacterium avium subsp. paratuberculosis
ccgggcaaccacagcggcgc

SEQ ID NO: 1014363 - RNA, 21 nt, Mycobacterium avium subsp. paratuberculosis
ccgggcaaccacagcggcgca

SEQ ID NO: 1014364 - RNA, 21 nt, Mycobacterium avium subsp. paratuberculosis
ccgggauccggcgcgccgcga

SEQ ID NO: 1014365 - RNA, 13 nt, Mycobacterium avium subsp. paratuberculosis
ccggcggacccag

SEQ ID NO: 1014366 - RNA, 13 nt, Mycobacterium avium subsp. paratuberculosis
ccggcggacccgg

SEQ ID NO: 1014367 - RNA, 19 nt, Mycobacterium avium subsp. paratuberculosis
ccgggaugccugcccgcgc

SEQ ID NO: 1014368 - RNA, 22 nt, Mycobacterium avium subsp. paratuberculosis
ccgggaucgggcguugcgccgc

SEQ ID NO: 1014369 - RNA, 15 nt, Mycobacterium avium subsp. paratuberculosis
ccgggcauccgcccg

SEQ ID NO: 1014370 - RNA, 21 nt, Mycobacterium avium subsp. paratuberculosis
ccgggcaguuccuugcgcagc

SEQ ID NO: 1014371 - RNA, 19 nt, Mycobacterium avium subsp. paratuberculosis
ccgggcagguggucggcga

SEQ ID NO: 1014372 - RNA, 18 nt, Mycobacterium avium subsp. paratuberculosis
ccgggccgccacggcgcc

SEQ ID NO: 1014373 - RNA, 19 nt, Mycobacterium avium subsp. paratuberculosis
ccgggccgccacggcgcca

SEQ ID NO: 1014374 - RNA, 20 nt, Mycobacterium avium subsp. paratuberculosis
ccgggccgcauccagcgccg

SEQ ID NO: 1014375 - RNA, 22 nt, Mycobacterium avium subsp. paratuberculosis
ccgggccgcauccagcgccgcc

SEQ ID NO: 1014376 - RNA, 16 nt, Mycobacterium avium subsp. paratuberculosis
ccgggccgccaucacc

SEQ ID NO: 1014377 - RNA, 20 nt, Mycobacterium avium subsp. paratuberculosis
ccgggccgccaucaccgcgc

SEQ ID NO: 1014378 - RNA, 17 nt, Mycobacterium avium subsp. paratuberculosis
ccgggccgcuggccgcc

SEQ ID NO: 1014379 - RNA, 18 nt, Mycobacterium avium subsp. paratuberculosis
ccgggccggacacggcug

SEQ ID NO: 1014380 - RNA, 14 nt, Mycobacterium avium subsp. paratuberculosis
ccgggccggccaga

SEQ ID NO: 1014381 - RNA, 18 nt, Mycobacterium avium subsp. paratuberculosis
ccgggcaccucggcgucg

SEQ ID NO: 1014382 - RNA, 18 nt, Mycobacterium avium subsp. paratuberculosis
ccgggcaccagcgacagc

SEQ ID NO: 1014383 - RNA, 14 nt, Mycobacterium avium subsp. paratuberculosis
ccgggcaccaccac

SEQ ID NO: 1014384 - RNA, 15 nt, Mycobacterium avium subsp. paratuberculosis
ccgggcaccaccacc

SEQ ID NO: 1014385 - RNA, 21 nt, Mycobacterium avium subsp. paratuberculosis
ccgggcacccggcgcggccgc

SEQ ID NO: 1014386 - RNA, 12 nt, Mycobacterium avium subsp. paratuberculosis
ccgggcaccgcg

SEQ ID NO: 1014387 - RNA, 23 nt, Mycobacterium avium subsp. paratuberculosis
ccgggcacgcgagacgagccgcc

SEQ ID NO: 1014388 - RNA, 18 nt, Mycobacterium avium subsp. paratuberculosis
ccgggguagaggccgcgg

SEQ ID NO: 1014389 - RNA, 19 nt, Mycobacterium avium subsp. paratuberculosis
ccgggggauagggcgugau

SEQ ID NO: 1014390 - RNA, 14 nt, Mycobacterium avium subsp. paratuberculosis
ccgggggcaccgcc

SEQ ID NO: 1014391 - RNA, 15 nt, Mycobacterium avium subsp. paratuberculosis
ccggggguggcgguc

SEQ ID NO: 1014392 - RNA, 15 nt, Mycobacterium avium subsp. paratuberculosis
ccggggguagcggug

SEQ ID NO: 1014393 - RNA, 21 nt, Mycobacterium avium subsp. paratuberculosis
ccggggugagcagggccagcg

SEQ ID NO: 1014394 - RNA, 12 nt, Mycobacterium avium subsp. paratuberculosis
ccggggucgcgc

SEQ ID NO: 1014395 - RNA, 17 nt, Mycobacterium avium subsp. paratuberculosis
ccggggucggcgcccuc

SEQ ID NO: 1014396 - RNA, 19 nt, Mycobacterium avium subsp. paratuberculosis
ccggggucggcgcccucgg

SEQ ID NO: 1014397 - RNA, 15 nt, Mycobacterium avium subsp. paratuberculosis
ccgggcggcagcagc

SEQ ID NO: 1014398 - RNA, 15 nt, Mycobacterium avium subsp. paratuberculosis
ccgggcggccagcgu

SEQ ID NO: 1014399 - RNA, 19 nt, Mycobacterium avium subsp. paratuberculosis
ccgggggaagcccagcacc

SEQ ID NO: 1014400 - RNA, 22 nt, Mycobacterium avium subsp. paratuberculosis
ccgggggaagcccagcacccgc

SEQ ID NO: 1014401 - RNA, 14 nt, Mycobacterium avium subsp. paratuberculosis
ccgggcgauggugc

SEQ ID NO: 1014402 - RNA, 20 nt, Mycobacterium avium subsp. paratuberculosis
ccgggcgcgcccacccgcgc

SEQ ID NO: 1014403 - RNA, 19 nt, Mycobacterium avium subsp. paratuberculosis
ccgggcgccgagaacaggc

SEQ ID NO: 1014404 - RNA, 12 nt, Mycobacterium avium subsp. paratuberculosis
ccgggcgccggc

SEQ ID NO: 1014405 - RNA, 20 nt, Mycobacterium avium subsp. paratuberculosis
ccgggcgagcgucgccgcgu

SEQ ID NO: 1014406 - RNA, 20 nt, Mycobacterium avium subsp. paratuberculosis
ccgggcgaucauccagguga

SEQ ID NO: 1014407 - RNA, 16 nt, Mycobacterium avium subsp. paratuberculosis
ccgggcgacaccccgc

SEQ ID NO: 1014408 - RNA, 20 nt, Mycobacterium avium subsp. paratuberculosis
ccgggcgaccccggccagga

SEQ ID NO: 1014409 - RNA, 23 nt, Mycobacterium avium subsp. paratuberculosis
ccgggcgacugcgugcugggcac

SEQ ID NO: 1014410 - RNA, 21 nt, Mycobacterium avium subsp. paratuberculosis
ccgggccgccgcggccacacu

SEQ ID NO: 1014411 - RNA, 19 nt, Mycobacterium avium subsp. paratuberculosis
ccgggccguaucggccccg

SEQ ID NO: 1014412 - RNA, 22 nt, Mycobacterium avium subsp. paratuberculosis
ccgggccguaucggccccggcc

SEQ ID NO: 1014413 - RNA, 15 nt, Mycobacterium avium subsp. paratuberculosis
ccgggccugcggcgc

SEQ ID NO: 1014414 - RNA, 17 nt, Mycobacterium avium subsp. paratuberculosis
ccgggccugcggcggcc

SEQ ID NO: 1014415 - RNA, 22 nt, Mycobacterium avium subsp. paratuberculosis
ccgggccugcggcggccgcagc

SEQ ID NO: 1014416 - RNA, 20 nt, Mycobacterium avium subsp. paratuberculosis
ccgggccuugacggccuggg

SEQ ID NO: 1014417 - RNA, 20 nt, Mycobacterium avium subsp. paratuberculosis
ccgggccuuguugcggcgca

SEQ ID NO: 1014418 - RNA, 22 nt, Mycobacterium avium subsp. paratuberculosis
ccuagcgggccaggauguucac

SEQ ID NO: 1014419 - RNA, 21 nt, Mycobacterium avium subsp. paratuberculosis
ccuacuugcguugcgcggcgg

SEQ ID NO: 1014420 - RNA, 16 nt, Mycobacterium avium subsp. paratuberculosis
ccuacacagcccccac

SEQ ID NO: 1014421 - RNA, 16 nt, Mycobacterium avium subsp. paratuberculosis
ccuaugaggcgacccc

SEQ ID NO: 1014422 - RNA, 14 nt, Mycobacterium avium subsp. paratuberculosis
ccuagggcccacgc

SEQ ID NO: 1014423 - RNA, 15 nt, Mycobacterium avium subsp. paratuberculosis
ccuaggacgccgccc

SEQ ID NO: 1014424 - RNA, 21 nt, Mycobacterium avium subsp. paratuberculosis
ccucagaccauggcgcggcgg

SEQ ID NO: 1014425 - RNA, 17 nt, Mycobacterium avium subsp. paratuberculosis
ccucaccugcguugcgg

SEQ ID NO: 1014426 - RNA, 15 nt, Mycobacterium avium subsp. paratuberculosis
ccucacggucggcgu

SEQ ID NO: 1014427 - RNA, 17 nt, Mycobacterium avium subsp. paratuberculosis
ccucacggucggcgucc

SEQ ID NO: 1014428 - RNA, 24 nt, Mycobacterium avium subsp. paratuberculosis
ccucacggucggcguccagcgcgg

SEQ ID NO: 1014429 - RNA, 22 nt, Mycobacterium avium subsp. paratuberculosis
ccucacaccucgcuacgcgagc

SEQ ID NO: 1014430 - RNA, 22 nt, Mycobacterium avium subsp. paratuberculosis
ccucaccccgcuugcgcagcgu

SEQ ID NO: 1014431 - RNA, 18 nt, Mycobacterium avium subsp. paratuberculosis
ccgugaucgccaccacca

SEQ ID NO: 1014432 - RNA, 16 nt, Mycobacterium avium subsp. paratuberculosis
ccgugaucggccagcc

SEQ ID NO: 1014433 - RNA, 14 nt, Mycobacterium avium subsp. paratuberculosis
ccgugaugccgggc

SEQ ID NO: 1014434 - RNA, 21 nt, Mycobacterium avium subsp. paratuberculosis
ccgugaugcgcaagcaccggc

SEQ ID NO: 1014435 - RNA, 17 nt, Mycobacterium avium subsp. paratuberculosis
ccgugaugcgccggcgg

SEQ ID NO: 1014436 - RNA, 14 nt, Mycobacterium avium subsp. paratuberculosis
ccgucgcgcagccc

SEQ ID NO: 1014437 - RNA, 18 nt, Mycobacterium avium subsp. paratuberculosis
ccgugagggaccuccagc

SEQ ID NO: 1014438 - RNA, 15 nt, Mycobacterium avium subsp. paratuberculosis
ccguggcagggccag

SEQ ID NO: 1014439 - RNA, 12 nt, Mycobacterium avium subsp. paratuberculosis
ccgugcagcgcc

SEQ ID NO: 1014440 - RNA, 16 nt, Mycobacterium avium subsp. paratuberculosis
ccgugcacgccgucgu

SEQ ID NO: 1014441 - RNA, 14 nt, Mycobacterium avium subsp. paratuberculosis
ccgugcagcacgcc

SEQ ID NO: 1014442 - RNA, 18 nt, Mycobacterium avium subsp. paratuberculosis
ccgugcagcacgccgcgg

SEQ ID NO: 1014443 - RNA, 17 nt, Mycobacterium avium subsp. paratuberculosis
ccgugaugggccgucag

SEQ ID NO: 1014444 - RNA, 20 nt, Mycobacterium avium subsp. paratuberculosis
ccgugcaccgucgccggcgg

SEQ ID NO: 1014445 - RNA, 19 nt, Mycobacterium avium subsp. paratuberculosis
ccgucgcacuagguccggc

SEQ ID NO: 1014446 - RNA, 21 nt, Mycobacterium avium subsp. paratuberculosis
ccgucgcacuagguccggcgc

SEQ ID NO: 1014447 - RNA, 20 nt, Mycobacterium avium subsp. paratuberculosis
ccgucgccaccaccgcgccg

SEQ ID NO: 1014448 - RNA, 14 nt, Mycobacterium avium subsp. paratuberculosis
ccgucgccaccacg

SEQ ID NO: 1014449 - RNA, 16 nt, Mycobacterium avium subsp. paratuberculosis
ccgucgccaccacggc

SEQ ID NO: 1014450 - RNA, 13 nt, Mycobacterium avium subsp. paratuberculosis
ccgucgccacgau

SEQ ID NO: 1014451 - RNA, 16 nt, Mycobacterium avium subsp. paratuberculosis
ccgucgccggcgcgca

SEQ ID NO: 1014452 - RNA, 18 nt, Mycobacterium avium subsp. paratuberculosis
ccgucgccggcgcgcagc

SEQ ID NO: 1014453 - RNA, 21 nt, Mycobacterium avium subsp. paratuberculosis
ccgucgccgaucagcaccagg

SEQ ID NO: 1014454 - RNA, 21 nt, Mycobacterium avium subsp. paratuberculosis
ccgucgauuucaaggggccgg

SEQ ID NO: 1014455 - RNA, 22 nt, Mycobacterium avium subsp. paratuberculosis
ccgucgauuucaaggggccggg

SEQ ID NO: 1014456 - RNA, 21 nt, Mycobacterium avium subsp. paratuberculosis
ccguccuggaugaacagcacg

SEQ ID NO: 1014457 - RNA, 15 nt, Mycobacterium avium subsp. paratuberculosis
ccguccucggccgcc

SEQ ID NO: 1014458 - RNA, 17 nt, Mycobacterium avium subsp. paratuberculosis
ccguccgguucggcggc

SEQ ID NO: 1014459 - RNA, 14 nt, Mycobacterium avium subsp. paratuberculosis
ccguccggggccgg

SEQ ID NO: 1014460 - RNA, 20 nt, Mycobacterium avium subsp. paratuberculosis
ccguccggccgguuggcggc

SEQ ID NO: 1014461 - RNA, 20 nt, Mycobacterium avium subsp. paratuberculosis
ccguucggccagcgccgcca

SEQ ID NO: 1014462 - RNA, 22 nt, Mycobacterium avium subsp. paratuberculosis
ccguucggccagcgccgccagc

SEQ ID NO: 1014463 - RNA, 22 nt, Mycobacterium avium subsp. paratuberculosis
ccguucuccgaggcguccuccu

SEQ ID NO: 1014464 - RNA, 24 nt, Mycobacterium avium subsp. paratuberculosis
ccgugggggucgacccgccgcagc

SEQ ID NO: 1014465 - RNA, 16 nt, Mycobacterium avium subsp. paratuberculosis
ccgugcauccagccgu

SEQ ID NO: 1014466 - RNA, 17 nt, Mycobacterium avium subsp. paratuberculosis
ccguggcggcccgacca

SEQ ID NO: 1014467 - RNA, 19 nt, Mycobacterium avium subsp. paratuberculosis
ccguggcggcgggccagcu

SEQ ID NO: 1014468 - RNA, 17 nt, Mycobacterium avium subsp. paratuberculosis
ccguggccagcgccagc

SEQ ID NO: 1014469 - RNA, 15 nt, Mycobacterium avium subsp. paratuberculosis
ccguggccccagcca

SEQ ID NO: 1014470 - RNA, 16 nt, Mycobacterium avium subsp. paratuberculosis
ccguggcccgcccagc

SEQ ID NO: 1014471 - RNA, 15 nt, Mycobacterium avium subsp. paratuberculosis
ccguuguggccaccc

SEQ ID NO: 1014472 - RNA, 17 nt, Mycobacterium avium subsp. paratuberculosis
ccguuguggccacccuc

SEQ ID NO: 1014473 - RNA, 13 nt, Mycobacterium avium subsp. paratuberculosis
ccguuguggcggc

SEQ ID NO: 1014474 - RNA, 21 nt, Mycobacterium avium subsp. paratuberculosis
ccguucuugcgggugauccag

SEQ ID NO: 1014475 - RNA, 16 nt, Mycobacterium avium subsp. paratuberculosis
ccguugaucgagcacc

SEQ ID NO: 1014476 - RNA, 17 nt, Mycobacterium avium subsp. paratuberculosis
ccguugaccgcggcgau

SEQ ID NO: 1014477 - RNA, 16 nt, Mycobacterium avium subsp. paratuberculosis
ccguugaccggccggu

SEQ ID NO: 1014478 - RNA, 15 nt, Mycobacterium avium subsp. paratuberculosis
ccguugaccggugcg

SEQ ID NO: 1014479 - RNA, 15 nt, Mycobacterium avium subsp. paratuberculosis
ccguugugcaccauc

SEQ ID NO: 1014480 - RNA, 18 nt, Mycobacterium avium subsp. paratuberculosis
ccguugugccaccgccga

SEQ ID NO: 1014481 - RNA, 16 nt, Mycobacterium avium subsp. paratuberculosis
ccguuggcuuuucggg

SEQ ID NO: 1014482 - RNA, 22 nt, Mycobacterium avium subsp. paratuberculosis
ccguugggcagcucggcgggcu

SEQ ID NO: 1014483 - RNA, 15 nt, Mycobacterium avium subsp. paratuberculosis
ccgcuugacgccgcc

SEQ ID NO: 1014484 - RNA, 16 nt, Mycobacterium avium subsp. paratuberculosis
ccgcuugacgccgccg

SEQ ID NO: 1014485 - RNA, 15 nt, Mycobacterium avium subsp. paratuberculosis
ccgcuugauggcggc

SEQ ID NO: 1014486 - RNA, 19 nt, Mycobacterium avium subsp. paratuberculosis
ccgcuucgucgccggccgc

SEQ ID NO: 1014487 - RNA, 21 nt, Mycobacterium avium subsp. paratuberculosis
ccgcuucggcucggggucggc

SEQ ID NO: 1014488 - RNA, 17 nt, Mycobacterium avium subsp. paratuberculosis
ccggaccucgaccagcc

SEQ ID NO: 1014489 - RNA, 20 nt, Mycobacterium avium subsp. paratuberculosis
ccggaccucgaccagccggu

SEQ ID NO: 1014490 - RNA, 17 nt, Mycobacterium avium subsp. paratuberculosis
ccggaccgccgcggcgc

SEQ ID NO: 1014491 - RNA, 19 nt, Mycobacterium avium subsp. paratuberculosis
ccggaccgccgcggcgccc

SEQ ID NO: 1014492 - RNA, 15 nt, Mycobacterium avium subsp. paratuberculosis
ccggaccgcggucgg

SEQ ID NO: 1014493 - RNA, 22 nt, Mycobacterium avium subsp. paratuberculosis
ccggaccggccagcagccgcuc

SEQ ID NO: 1014494 - RNA, 19 nt, Mycobacterium avium subsp. paratuberculosis
ccggaccacguccccgggc

SEQ ID NO: 1014495 - RNA, 21 nt, Mycobacterium avium subsp. paratuberculosis
ccggaccacguccccgggcgu

SEQ ID NO: 1014496 - RNA, 21 nt, Mycobacterium avium subsp. paratuberculosis
ccggagaugaucaugucgucc

SEQ ID NO: 1014497 - RNA, 20 nt, Mycobacterium avium subsp. paratuberculosis
ccggacgaugacccagccca

SEQ ID NO: 1014498 - RNA, 23 nt, Mycobacterium avium subsp. paratuberculosis
ccggacgaggaucgcaggauggc

SEQ ID NO: 1014499 - RNA, 18 nt, Mycobacterium avium subsp. paratuberculosis
ccggaguccggcucggug

SEQ ID NO: 1014500 - RNA, 19 nt, Mycobacterium avium subsp. paratuberculosis
ccggaggcgaucagguggg

SEQ ID NO: 1014501 - RNA, 18 nt, Mycobacterium avium subsp. paratuberculosis
ccggagccggccucgccg

SEQ ID NO: 1014502 - RNA, 12 nt, Mycobacterium avium subsp. paratuberculosis
ccggagccgucg

SEQ ID NO: 1014503 - RNA, 15 nt, Mycobacterium avium subsp. paratuberculosis
ccggauuggcgucgg

SEQ ID NO: 1014504 - RNA, 24 nt, Mycobacterium avium subsp. paratuberculosis
ccggauucggcuccugccguucgg

SEQ ID NO: 1014505 - RNA, 16 nt, Mycobacterium avium subsp. paratuberculosis
ccggaugucgggcgag

SEQ ID NO: 1014506 - RNA, 19 nt, Mycobacterium avium subsp. paratuberculosis
ccggauuacucgccggcgg

SEQ ID NO: 1014507 - RNA, 22 nt, Mycobacterium avium subsp. paratuberculosis
ccggauuacucgccggcggcgc

SEQ ID NO: 1014508 - RNA, 23 nt, Mycobacterium avium subsp. paratuberculosis
ccggaugcggccgaaguccaagu

SEQ ID NO: 1014509 - RNA, 13 nt, Mycobacterium avium subsp. paratuberculosis
ccggaugcggcgc

SEQ ID NO: 1014510 - RNA, 15 nt, Mycobacterium avium subsp. paratuberculosis
ccggaugcggucgau

SEQ ID NO: 1014511 - RNA, 16 nt, Mycobacterium avium subsp. paratuberculosis
ccggaugcugcggguc

SEQ ID NO: 1014512 - RNA, 16 nt, Mycobacterium avium subsp. paratuberculosis
ccggaucggccagcag

SEQ ID NO: 1014513 - RNA, 21 nt, Mycobacterium avium subsp. paratuberculosis
ccggaucggcuagcagcuccg

SEQ ID NO: 1014514 - RNA, 18 nt, Mycobacterium avium subsp. paratuberculosis
ccggaucggcugcgggcc

SEQ ID NO: 1014515 - RNA, 22 nt, Mycobacterium avium subsp. paratuberculosis
ccggaucucgucgggcaccgcc

SEQ ID NO: 1014516 - RNA, 22 nt, Mycobacterium avium subsp. paratuberculosis
ccggaucuugccgucggccgcc

SEQ ID NO: 1014517 - RNA, 18 nt, Mycobacterium avium subsp. paratuberculosis
ccggaugccgcgcggcgc

SEQ ID NO: 1014518 - RNA, 20 nt, Mycobacterium avium subsp. paratuberculosis
ccggaugccgcgcggcgcca

SEQ ID NO: 1014519 - RNA, 19 nt, Mycobacterium avium subsp. paratuberculosis
ccggaucagcagugccccg

SEQ ID NO: 1014520 - RNA, 20 nt, Mycobacterium avium subsp. paratuberculosis
ccggaucaaccacaccagca

SEQ ID NO: 1014521 - RNA, 23 nt, Mycobacterium avium subsp. paratuberculosis
ccggaucaaccacaccagcauga

SEQ ID NO: 1014522 - RNA, 15 nt, Mycobacterium avium subsp. paratuberculosis
ccggagugacgucgc

SEQ ID NO: 1014523 - RNA, 17 nt, Mycobacterium avium subsp. paratuberculosis
ccggagugacgucgcgc

SEQ ID NO: 1014524 - RNA, 22 nt, Mycobacterium avium subsp. paratuberculosis
ccggaucgaauccggcggcgcu

SEQ ID NO: 1014525 - RNA, 22 nt, Mycobacterium avium subsp. paratuberculosis
ccggaucgaccaacuccaccgc

SEQ ID NO: 1014526 - RNA, 15 nt, Mycobacterium avium subsp. paratuberculosis
ccggauccgucgccc

SEQ ID NO: 1014527 - RNA, 22 nt, Mycobacterium avium subsp. paratuberculosis
ccggcccagccgcugcgacagg

SEQ ID NO: 1014528 - RNA, 13 nt, Mycobacterium avium subsp. paratuberculosis
ccggcccagccgg

SEQ ID NO: 1014529 - RNA, 19 nt, Mycobacterium avium subsp. paratuberculosis
ccggcccaccaccgccucg

SEQ ID NO: 1014530 - RNA, 15 nt, Mycobacterium avium subsp. paratuberculosis
ccggcccaccggccc

SEQ ID NO: 1014531 - RNA, 16 nt, Mycobacterium avium subsp. paratuberculosis
ccggcccaccggcccg

SEQ ID NO: 1014532 - RNA, 18 nt, Mycobacterium avium subsp. paratuberculosis
ccggcccaccggcccggc

SEQ ID NO: 1014533 - RNA, 16 nt, Mycobacterium avium subsp. paratuberculosis
ccggcccacgccgucg

SEQ ID NO: 1014534 - RNA, 22 nt, Mycobacterium avium subsp. paratuberculosis
ccggccaugaccaugucgacgc

SEQ ID NO: 1014535 - RNA, 15 nt, Mycobacterium avium subsp. paratuberculosis
ccggccagccgcgcg

SEQ ID NO: 1014536 - RNA, 17 nt, Mycobacterium avium subsp. paratuberculosis
ccggccagcagcggcuu

SEQ ID NO: 1014537 - RNA, 12 nt, Mycobacterium avium subsp. paratuberculosis
ccggccagcaca

SEQ ID NO: 1014538 - RNA, 15 nt, Mycobacterium avium subsp. paratuberculosis
ccggccagcacccgc

SEQ ID NO: 1014539 - RNA, 13 nt, Mycobacterium avium subsp. paratuberculosis
ccggccagcagca

SEQ ID NO: 1014540 - RNA, 22 nt, Mycobacterium avium subsp. paratuberculosis
ccggccagaucgacgccgcggu

SEQ ID NO: 1014541 - RNA, 15 nt, Mycobacterium avium subsp. paratuberculosis
ccggccacucgccgc

SEQ ID NO: 1014542 - RNA, 17 nt, Mycobacterium avium subsp. paratuberculosis
ccggccacucgcguccc

SEQ ID NO: 1014543 - RNA, 22 nt, Mycobacterium avium subsp. paratuberculosis
ccggccacucgcguccccgcgc

SEQ ID NO: 1014544 - RNA, 19 nt, Mycobacterium avium subsp. paratuberculosis
ccggccccgcugccguccg

SEQ ID NO: 1014545 - RNA, 12 nt, Mycobacterium avium subsp. paratuberculosis
ccggccccgccc

SEQ ID NO: 1014546 - RNA, 17 nt, Mycobacterium avium subsp. paratuberculosis
ccggcccgagcaccacc

SEQ ID NO: 1014547 - RNA, 22 nt, Mycobacterium avium subsp. paratuberculosis
ccggcccgagcaccaccaggcc

SEQ ID NO: 1014548 - RNA, 20 nt, Mycobacterium avium subsp. paratuberculosis
ccggcccgaucgcggcgagc

SEQ ID NO: 1014549 - RNA, 15 nt, Mycobacterium avium subsp. paratuberculosis
ccggcccgcccggcg

SEQ ID NO: 1014550 - RNA, 21 nt, Mycobacterium avium subsp. paratuberculosis
ccggccccaacggcgugcagc

SEQ ID NO: 1014551 - RNA, 14 nt, Mycobacterium avium subsp. paratuberculosis
ccggccccgcccgg

SEQ ID NO: 1014552 - RNA, 21 nt, Mycobacterium avium subsp. paratuberculosis
ccggcccuauggcaucgccaa

SEQ ID NO: 1014553 - RNA, 21 nt, Mycobacterium avium subsp. paratuberculosis
ccggcccugcggccagugccg

SEQ ID NO: 1014554 - RNA, 16 nt, Mycobacterium avium subsp. paratuberculosis
ccggccgaacacggcc

SEQ ID NO: 1014555 - RNA, 18 nt, Mycobacterium avium subsp. paratuberculosis
ccggccgaagaccgccga

SEQ ID NO: 1014556 - RNA, 19 nt, Mycobacterium avium subsp. paratuberculosis
ccggccgacauggacgcgg

SEQ ID NO: 1014557 - RNA, 21 nt, Mycobacterium avium subsp. paratuberculosis
ccggccgacauggacgcggcc

SEQ ID NO: 1014558 - RNA, 22 nt, Mycobacterium avium subsp. paratuberculosis
ccggccgagccgagccgacccg

SEQ ID NO: 1014559 - RNA, 21 nt, Mycobacterium avium subsp. paratuberculosis
ccggccgagccgaugcccagc

SEQ ID NO: 1014560 - RNA, 15 nt, Mycobacterium avium subsp. paratuberculosis
ccggcccgucaggcc

SEQ ID NO: 1014561 - RNA, 13 nt, Mycobacterium avium subsp. paratuberculosis
ccggcccggcccg

SEQ ID NO: 1014562 - RNA, 20 nt, Mycobacterium avium subsp. paratuberculosis
ccggccacgcucggcggcgc

SEQ ID NO: 1014563 - RNA, 14 nt, Mycobacterium avium subsp. paratuberculosis
ccggccaccuggcc

SEQ ID NO: 1014564 - RNA, 15 nt, Mycobacterium avium subsp. paratuberculosis
ccggccacgaccucg

SEQ ID NO: 1014565 - RNA, 21 nt, Mycobacterium avium subsp. paratuberculosis
ccggcauccucggcgcgucgg

SEQ ID NO: 1014566 - RNA, 15 nt, Mycobacterium avium subsp. paratuberculosis
ccggcaucgaccgcc

SEQ ID NO: 1014567 - RNA, 14 nt, Mycobacterium avium subsp. paratuberculosis
ccggcaucggcucg

SEQ ID NO: 1014568 - RNA, 15 nt, Mycobacterium avium subsp. paratuberculosis
ccggcauaggccagc

SEQ ID NO: 1014569 - RNA, 13 nt, Mycobacterium avium subsp. paratuberculosis
ccggcagugaucg

SEQ ID NO: 1014570 - RNA, 14 nt, Mycobacterium avium subsp. paratuberculosis
ccggcaccagcagc

SEQ ID NO: 1014571 - RNA, 15 nt, Mycobacterium avium subsp. paratuberculosis
ccggcaccagcagcc

SEQ ID NO: 1014572 - RNA, 17 nt, Mycobacterium avium subsp. paratuberculosis
ccggcaccagcaggccc

SEQ ID NO: 1014573 - RNA, 18 nt, Mycobacterium avium subsp. paratuberculosis
ccggcaacaccggcggcg

SEQ ID NO: 1014574 - RNA, 17 nt, Mycobacterium avium subsp. paratuberculosis
ccggauuucgucccagu

SEQ ID NO: 1014575 - RNA, 16 nt, Mycobacterium avium subsp. paratuberculosis
ccggcgcaccaggcgc

SEQ ID NO: 1014576 - RNA, 23 nt, Mycobacterium avium subsp. paratuberculosis
ccggcgcaccagggugucgucgc

SEQ ID NO: 1014577 - RNA, 14 nt, Mycobacterium avium subsp. paratuberculosis
ccggcgaucaccgg

SEQ ID NO: 1014578 - RNA, 18 nt, Mycobacterium avium subsp. paratuberculosis
ccggcgaucucgucgcgc

SEQ ID NO: 1014579 - RNA, 19 nt, Mycobacterium avium subsp. paratuberculosis
ccggcgaucucgucgcgca

SEQ ID NO: 1014580 - RNA, 13 nt, Mycobacterium avium subsp. paratuberculosis
ccggcgaugaccg

SEQ ID NO: 1014581 - RNA, 17 nt, Mycobacterium avium subsp. paratuberculosis
ccggcgaugaccgggac

SEQ ID NO: 1014582 - RNA, 23 nt, Mycobacterium avium subsp. paratuberculosis
ccggcgaugaccgggacgaaggu

SEQ ID NO: 1014583 - RNA, 19 nt, Mycobacterium avium subsp. paratuberculosis
ccggcgauaggcggccagc

SEQ ID NO: 1014584 - RNA, 20 nt, Mycobacterium avium subsp. paratuberculosis
ccggcgauaggcggccagcu

SEQ ID NO: 1014585 - RNA, 13 nt, Mycobacterium avium subsp. paratuberculosis
ccggcgcagcgcc

SEQ ID NO: 1014586 - RNA, 12 nt, Mycobacterium avium subsp. paratuberculosis
ccggcgccgccg

SEQ ID NO: 1014587 - RNA, 13 nt, Mycobacterium avium subsp. paratuberculosis
ccggcgcccggcc

SEQ ID NO: 1014588 - RNA, 12 nt, Mycobacterium avium subsp. paratuberculosis
ccggcgccgcca

SEQ ID NO: 1014589 - RNA, 18 nt, Mycobacterium avium subsp. paratuberculosis
ccggcgccgaucugcucg

SEQ ID NO: 1014590 - RNA, 18 nt, Mycobacterium avium subsp. paratuberculosis
ccggcgcccggcgcgcca

SEQ ID NO: 1014591 - RNA, 19 nt, Mycobacterium avium subsp. paratuberculosis
ccggcgccgaagccgucga

SEQ ID NO: 1014592 - RNA, 16 nt, Mycobacterium avium subsp. paratuberculosis
ccggcgccgaccgagg

SEQ ID NO: 1014593 - RNA, 12 nt, Mycobacterium avium subsp. paratuberculosis
ccggcgcccgau

SEQ ID NO: 1014594 - RNA, 17 nt, Mycobacterium avium subsp. paratuberculosis
ccggcgcccgaucggca

SEQ ID NO: 1014595 - RNA, 18 nt, Mycobacterium avium subsp. paratuberculosis
ccggcgcccagcggcgau

SEQ ID NO: 1014596 - RNA, 15 nt, Mycobacterium avium subsp. paratuberculosis
ccggcgccacgccgc

SEQ ID NO: 1014597 - RNA, 17 nt, Mycobacterium avium subsp. paratuberculosis
ccggcgccacgccgcga

SEQ ID NO: 1014598 - RNA, 20 nt, Mycobacterium avium subsp. paratuberculosis
ccggcgcgguucuugcgcca

SEQ ID NO: 1014599 - RNA, 18 nt, Mycobacterium avium subsp. paratuberculosis
ccggcgcguuccaucagc

SEQ ID NO: 1014600 - RNA, 13 nt, Mycobacterium avium subsp. paratuberculosis
ccggcgcggcggc

SEQ ID NO: 1014601 - RNA, 20 nt, Mycobacterium avium subsp. paratuberculosis
ccggcgcgggccgcagcgcg

SEQ ID NO: 1014602 - RNA, 16 nt, Mycobacterium avium subsp. paratuberculosis
ccggcgcgggggcggc

SEQ ID NO: 1014603 - RNA, 20 nt, Mycobacterium avium subsp. paratuberculosis
ccggcgcggcagggccaggc

SEQ ID NO: 1014604 - RNA, 13 nt, Mycobacterium avium subsp. paratuberculosis
ccggcgcggcauc

SEQ ID NO: 1014605 - RNA, 17 nt, Mycobacterium avium subsp. paratuberculosis
ccggcgcucgucgucgc

SEQ ID NO: 1014606 - RNA, 23 nt, Mycobacterium avium subsp. paratuberculosis
ccggcgcuaaagccgaccgcccc

SEQ ID NO: 1014607 - RNA, 19 nt, Mycobacterium avium subsp. paratuberculosis
ccggcgcgcggagaucacc

SEQ ID NO: 1014608 - RNA, 15 nt, Mycobacterium avium subsp. paratuberculosis
ccggcgcgccgcgau

SEQ ID NO: 1014609 - RNA, 11 nt, Mycobacterium avium subsp. paratuberculosis
ccggcgcgccc

SEQ ID NO: 1014610 - RNA, 17 nt, Mycobacterium avium subsp. paratuberculosis
ccggcgcgcaccccggc

SEQ ID NO: 1014611 - RNA, 22 nt, Mycobacterium avium subsp. paratuberculosis
ccggcgcgaucggccgcugccc

SEQ ID NO: 1014612 - RNA, 13 nt, Mycobacterium avium subsp. paratuberculosis
ccggcgccggcgg

SEQ ID NO: 1014613 - RNA, 17 nt, Mycobacterium avium subsp. paratuberculosis
ccggcgccucgugcaug

SEQ ID NO: 1014614 - RNA, 16 nt, Mycobacterium avium subsp. paratuberculosis
ccggcgccgucgaucc

SEQ ID NO: 1014615 - RNA, 23 nt, Mycobacterium avium subsp. paratuberculosis
ccggcgccgucgauccacccacc

SEQ ID NO: 1014616 - RNA, 12 nt, Mycobacterium avium subsp. paratuberculosis
ccggcgccgcgc

SEQ ID NO: 1014617 - RNA, 19 nt, Mycobacterium avium subsp. paratuberculosis
ccggcgccggacggcccgc

SEQ ID NO: 1014618 - RNA, 15 nt, Mycobacterium avium subsp. paratuberculosis
ccggccugcagcgcg

SEQ ID NO: 1014619 - RNA, 15 nt, Mycobacterium avium subsp. paratuberculosis
ccggccuccagcugu

SEQ ID NO: 1014620 - RNA, 14 nt, Mycobacterium avium subsp. paratuberculosis
ccggccucgccggc

SEQ ID NO: 1014621 - RNA, 21 nt, Mycobacterium avium subsp. paratuberculosis
ccggccucgucggcgagcagc

SEQ ID NO: 1014622 - RNA, 14 nt, Mycobacterium avium subsp. paratuberculosis
ccggccgugccgug

SEQ ID NO: 1014623 - RNA, 22 nt, Mycobacterium avium subsp. paratuberculosis
ccggccgugccguggucggugc

SEQ ID NO: 1014624 - RNA, 21 nt, Mycobacterium avium subsp. paratuberculosis
ccggccguucgccggccagca

SEQ ID NO: 1014625 - RNA, 17 nt, Mycobacterium avium subsp. paratuberculosis
ccggccguugggccagc

SEQ ID NO: 1014626 - RNA, 20 nt, Mycobacterium avium subsp. paratuberculosis
ccggccguugggccagcggc

SEQ ID NO: 1014627 - RNA, 22 nt, Mycobacterium avium subsp. paratuberculosis
ccggccguugggccagcggcgc

SEQ ID NO: 1014628 - RNA, 13 nt, Mycobacterium avium subsp. paratuberculosis
ccggccgccgugg

SEQ ID NO: 1014629 - RNA, 16 nt, Mycobacterium avium subsp. paratuberculosis
ccggccgucgucgggc

SEQ ID NO: 1014630 - RNA, 19 nt, Mycobacterium avium subsp. paratuberculosis
ccggccgugaugcgccggc

SEQ ID NO: 1014631 - RNA, 14 nt, Mycobacterium avium subsp. paratuberculosis
ccggccggggcgcc

SEQ ID NO: 1014632 - RNA, 14 nt, Mycobacterium avium subsp. paratuberculosis
ccggccggggcggc

SEQ ID NO: 1014633 - RNA, 19 nt, Mycobacterium avium subsp. paratuberculosis
ccggccggucgccugcuuc

SEQ ID NO: 1014634 - RNA, 18 nt, Mycobacterium avium subsp. paratuberculosis
ccggccgguggccggugg

SEQ ID NO: 1014635 - RNA, 21 nt, Mycobacterium avium subsp. paratuberculosis
ccggccggccccuaccgccga

SEQ ID NO: 1014636 - RNA, 14 nt, Mycobacterium avium subsp. paratuberculosis
ccggccggcgagga

SEQ ID NO: 1014637 - RNA, 22 nt, Mycobacterium avium subsp. paratuberculosis
ccggccggcggacgcggccagc

SEQ ID NO: 1014638 - RNA, 13 nt, Mycobacterium avium subsp. paratuberculosis
ccggccggccgcc

SEQ ID NO: 1014639 - RNA, 15 nt, Mycobacterium avium subsp. paratuberculosis
ccggccggccgccgg

SEQ ID NO: 1014640 - RNA, 16 nt, Mycobacterium avium subsp. paratuberculosis
ccggccggccgugccg

SEQ ID NO: 1014641 - RNA, 14 nt, Mycobacterium avium subsp. paratuberculosis
ccggccggcacgau

SEQ ID NO: 1014642 - RNA, 16 nt, Mycobacterium avium subsp. paratuberculosis
ccggccggcagcugcc

SEQ ID NO: 1014643 - RNA, 23 nt, Mycobacterium avium subsp. paratuberculosis
ccggccggcaggucgaggccggc

SEQ ID NO: 1014644 - RNA, 14 nt, Mycobacterium avium subsp. paratuberculosis
ccggccggacaccg

SEQ ID NO: 1014645 - RNA, 22 nt, Mycobacterium avium subsp. paratuberculosis
ccggccggacaccgaaccgccc

SEQ ID NO: 1014646 - RNA, 17 nt, Mycobacterium avium subsp. paratuberculosis
ccggccgcgcaccgccc

SEQ ID NO: 1014647 - RNA, 19 nt, Mycobacterium avium subsp. paratuberculosis
ccggccgcgcaccgccccg

SEQ ID NO: 1014648 - RNA, 22 nt, Mycobacterium avium subsp. paratuberculosis
ccggccgcggaugaccaggucg

SEQ ID NO: 1014649 - RNA, 14 nt, Mycobacterium avium subsp. paratuberculosis
ccggccgcgacagc

SEQ ID NO: 1014650 - RNA, 20 nt, Mycobacterium avium subsp. paratuberculosis
ccggccgcgauccagcgcug

SEQ ID NO: 1014651 - RNA, 13 nt, Mycobacterium avium subsp. paratuberculosis
ccggccgcgcacc

SEQ ID NO: 1014652 - RNA, 14 nt, Mycobacterium avium subsp. paratuberculosis
ccggccgccgcgau

SEQ ID NO: 1014653 - RNA, 14 nt, Mycobacterium avium subsp. paratuberculosis
ccggccgccgcgca

SEQ ID NO: 1014654 - RNA, 23 nt, Mycobacterium avium subsp. paratuberculosis
ccggccgccgcgcauccgcaccg

SEQ ID NO: 1014655 - RNA, 16 nt, Mycobacterium avium subsp. paratuberculosis
ccggccgcagcugcug

SEQ ID NO: 1014656 - RNA, 15 nt, Mycobacterium avium subsp. paratuberculosis
ccggccgagcgcagc

SEQ ID NO: 1014657 - RNA, 16 nt, Mycobacterium avium subsp. paratuberculosis
ccggccgagcgcgccg

SEQ ID NO: 1014658 - RNA, 18 nt, Mycobacterium avium subsp. paratuberculosis
ccggccgagcgcgccgag

SEQ ID NO: 1014659 - RNA, 18 nt, Mycobacterium avium subsp. paratuberculosis
ccggccgaggucaccacc

SEQ ID NO: 1014660 - RNA, 15 nt, Mycobacterium avium subsp. paratuberculosis
ccggcgaaggacagc

SEQ ID NO: 1014661 - RNA, 15 nt, Mycobacterium avium subsp. paratuberculosis
ccggcgaccacccuc

SEQ ID NO: 1014662 - RNA, 13 nt, Mycobacterium avium subsp. paratuberculosis
ccggcgacgccgc

SEQ ID NO: 1014663 - RNA, 16 nt, Mycobacterium avium subsp. paratuberculosis
ccggcgacgccgcgcu

SEQ ID NO: 1014664 - RNA, 15 nt, Mycobacterium avium subsp. paratuberculosis
ccggcgacggccagc

SEQ ID NO: 1014665 - RNA, 14 nt, Mycobacterium avium subsp. paratuberculosis
ccggcgaccgccac

SEQ ID NO: 1014666 - RNA, 15 nt, Mycobacterium avium subsp. paratuberculosis
ccggcgaccgccacc

SEQ ID NO: 1014667 - RNA, 20 nt, Mycobacterium avium subsp. paratuberculosis
ccggcgaccgugcccaccag

SEQ ID NO: 1014668 - RNA, 21 nt, Mycobacterium avium subsp. paratuberculosis
ccggcgaccgugcccaccagc

SEQ ID NO: 1014669 - RNA, 17 nt, Mycobacterium avium subsp. paratuberculosis
ccggcgacgaagcagcu

SEQ ID NO: 1014670 - RNA, 14 nt, Mycobacterium avium subsp. paratuberculosis
ccggcgagcggcac

SEQ ID NO: 1014671 - RNA, 16 nt, Mycobacterium avium subsp. paratuberculosis
ccggcgaggugcgcca

SEQ ID NO: 1014672 - RNA, 16 nt, Mycobacterium avium subsp. paratuberculosis
ccggcgaguacccgcc

SEQ ID NO: 1014673 - RNA, 15 nt, Mycobacterium avium subsp. paratuberculosis
ccggcgaguggaagu

SEQ ID NO: 1014674 - RNA, 21 nt, Mycobacterium avium subsp. paratuberculosis
ccggcgaguggaagucagcgc

SEQ ID NO: 1014675 - RNA, 16 nt, Mycobacterium avium subsp. paratuberculosis
ccggcgagcacgccgc

SEQ ID NO: 1014676 - RNA, 19 nt, Mycobacterium avium subsp. paratuberculosis
ccggcgagcacgccgccgg

SEQ ID NO: 1014677 - RNA, 16 nt, Mycobacterium avium subsp. paratuberculosis
ccggcgacgguggcgc

SEQ ID NO: 1014678 - RNA, 16 nt, Mycobacterium avium subsp. paratuberculosis
ccggccuggcccagcc

SEQ ID NO: 1014679 - RNA, 18 nt, Mycobacterium avium subsp. paratuberculosis
ccggccugcccgccgcgg

SEQ ID NO: 1014680 - RNA, 19 nt, Mycobacterium avium subsp. paratuberculosis
ccggccuuggcccgcgccc

SEQ ID NO: 1014681 - RNA, 15 nt, Mycobacterium avium subsp. paratuberculosis
ccggccuucaccagg

SEQ ID NO: 1014682 - RNA, 17 nt, Mycobacterium avium subsp. paratuberculosis
ccggccuucaccagggu

SEQ ID NO: 1014683 - RNA, 23 nt, Mycobacterium avium subsp. paratuberculosis
ccggccuucaccagggugccccg

SEQ ID NO: 1014684 - RNA, 20 nt, Mycobacterium avium subsp. paratuberculosis
ccggcgaaacacagcagcac

SEQ ID NO: 1014685 - RNA, 15 nt, Mycobacterium avium subsp. paratuberculosis
ccggcgaaccgccgc

SEQ ID NO: 1014686 - RNA, 15 nt, Mycobacterium avium subsp. paratuberculosis
ccggcgaacgccucg

SEQ ID NO: 1014687 - RNA, 16 nt, Mycobacterium avium subsp. paratuberculosis
ccggcgaacgccucgg

SEQ ID NO: 1014688 - RNA, 20 nt, Mycobacterium avium subsp. paratuberculosis
ccgcgaaaacagcgaccagu

SEQ ID NO: 1014689 - RNA, 14 nt, Mycobacterium avium subsp. paratuberculosis
ccgccugcggcagg

SEQ ID NO: 1014690 - RNA, 20 nt, Mycobacterium avium subsp. paratuberculosis
ccgccugugcgacggcgucg

SEQ ID NO: 1014691 - RNA, 17 nt, Mycobacterium avium subsp. paratuberculosis
ccgccugcgcgaucgcc

SEQ ID NO: 1014692 - RNA, 14 nt, Mycobacterium avium subsp. paratuberculosis
ccgccugcgcgccg

SEQ ID NO: 1014693 - RNA, 20 nt, Mycobacterium avium subsp. paratuberculosis
ccgccgcccacgccgcccag

SEQ ID NO: 1014694 - RNA, 13 nt, Mycobacterium avium subsp. paratuberculosis
ccgccgccgucgg

SEQ ID NO: 1014695 - RNA, 11 nt, Mycobacterium avium subsp. paratuberculosis
ccgccgccuca

SEQ ID NO: 1014696 - RNA, 14 nt, Mycobacterium avium subsp. paratuberculosis
ccgccgccggcggu

SEQ ID NO: 1014697 - RNA, 12 nt, Mycobacterium avium subsp. paratuberculosis
ccgccgccgccc

SEQ ID NO: 1014698 - RNA, 21 nt, Mycobacterium avium subsp. paratuberculosis
ccgccgccgaucuugagccgg

SEQ ID NO: 1014699 - RNA, 13 nt, Mycobacterium avium subsp. paratuberculosis
ccgcgaccgcagc

SEQ ID NO: 1014700 - RNA, 13 nt, Mycobacterium avium subsp. paratuberculosis
ccgcgaccgccuc

SEQ ID NO: 1014701 - RNA, 14 nt, Mycobacterium avium subsp. paratuberculosis
ccgcgaccgccucg

SEQ ID NO: 1014702 - RNA, 22 nt, Mycobacterium avium subsp. paratuberculosis
ccgcgacgaccucgcccgccgc

SEQ ID NO: 1014703 - RNA, 21 nt, Mycobacterium avium subsp. paratuberculosis
ccgcgacgacaccaccgugcu

SEQ ID NO: 1014704 - RNA, 21 nt, Mycobacterium avium subsp. paratuberculosis
ccgcgaugucggugggccgca

SEQ ID NO: 1014705 - RNA, 17 nt, Mycobacterium avium subsp. paratuberculosis
ccgcgaugcgacaccgc

SEQ ID NO: 1014706 - RNA, 14 nt, Mycobacterium avium subsp. paratuberculosis
ccgcgauggcacac

SEQ ID NO: 1014707 - RNA, 23 nt, Mycobacterium avium subsp. paratuberculosis
ccgcgauggccuccgacccgucc

SEQ ID NO: 1014708 - RNA, 19 nt, Mycobacterium avium subsp. paratuberculosis
ccgcgaucgccgacgucgg

SEQ ID NO: 1014709 - RNA, 14 nt, Mycobacterium avium subsp. paratuberculosis
ccgcgaucuugccg

SEQ ID NO: 1014710 - RNA, 20 nt, Mycobacterium avium subsp. paratuberculosis
ccgcgaugcagaacagccgg

SEQ ID NO: 1014711 - RNA, 19 nt, Mycobacterium avium subsp. paratuberculosis
ccgcgauccagcgcuggcc

SEQ ID NO: 1014712 - RNA, 14 nt, Mycobacterium avium subsp. paratuberculosis
ccgcgaucagcccc

SEQ ID NO: 1014713 - RNA, 23 nt, Mycobacterium avium subsp. paratuberculosis
ccgcgaucagggcccacagcagc

SEQ ID NO: 1014714 - RNA, 17 nt, Mycobacterium avium subsp. paratuberculosis
ccgcgaucagggccgcg

SEQ ID NO: 1014715 - RNA, 18 nt, Mycobacterium avium subsp. paratuberculosis
ccgcgaucagggccgcgg

SEQ ID NO: 1014716 - RNA, 14 nt, Mycobacterium avium subsp. paratuberculosis
ccgcgaacgccucg

SEQ ID NO: 1014717 - RNA, 19 nt, Mycobacterium avium subsp. paratuberculosis
ccgcgaacgggugcggcgc

SEQ ID NO: 1014718 - RNA, 20 nt, Mycobacterium avium subsp. paratuberculosis
ccgcgaacgggugcggcgcu

SEQ ID NO: 1014719 - RNA, 18 nt, Mycobacterium avium subsp. paratuberculosis
ccgcgaacucaggcgcgc

SEQ ID NO: 1014720 - RNA, 22 nt, Mycobacterium avium subsp. paratuberculosis
ccgcgaauugagguagucggcc

SEQ ID NO: 1014721 - RNA, 19 nt, Mycobacterium avium subsp. paratuberculosis
ccgcgaauuugguugcggu

SEQ ID NO: 1014722 - RNA, 14 nt, Mycobacterium avium subsp. paratuberculosis
ccgcgacacgccgc

SEQ ID NO: 1014723 - RNA, 24 nt, Mycobacterium avium subsp. paratuberculosis
ccgcgacacgucgacacgccggcc

SEQ ID NO: 1014724 - RNA, 21 nt, Mycobacterium avium subsp. paratuberculosis
ccgcgaaucgauaacgcgcgc

SEQ ID NO: 1014725 - RNA, 17 nt, Mycobacterium avium subsp. paratuberculosis
ccgcgacagccgcccgg

SEQ ID NO: 1014726 - RNA, 14 nt, Mycobacterium avium subsp. paratuberculosis
ccgcgacccaggcc

SEQ ID NO: 1014727 - RNA, 15 nt, Mycobacterium avium subsp. paratuberculosis
ccgcgacccaggccg

SEQ ID NO: 1014728 - RNA, 17 nt, Mycobacterium avium subsp. paratuberculosis
ccgcgaccccggaccgc

SEQ ID NO: 1014729 - RNA, 24 nt, Mycobacterium avium subsp. paratuberculosis
ccgcgcugaacgcggugggcacca

SEQ ID NO: 1014730 - RNA, 21 nt, Mycobacterium avium subsp. paratuberculosis
ccgcgcuggccgaucccggcc

SEQ ID NO: 1014731 - RNA, 20 nt, Mycobacterium avium subsp. paratuberculosis
ccgcgcuugcgaccgccgcu

SEQ ID NO: 1014732 - RNA, 19 nt, Mycobacterium avium subsp. paratuberculosis
ccgcgcuugcgaucgccgc

SEQ ID NO: 1014733 - RNA, 12 nt, Mycobacterium avium subsp. paratuberculosis
ccgcgcugggcu

SEQ ID NO: 1014734 - RNA, 17 nt, Mycobacterium avium subsp. paratuberculosis
ccgcgcuuuggaccagg

SEQ ID NO: 1014735 - RNA, 16 nt, Mycobacterium avium subsp. paratuberculosis
ccgcggaaggccagcu

SEQ ID NO: 1014736 - RNA, 21 nt, Mycobacterium avium subsp. paratuberculosis
ccgcgcuugguggcgacgaag

SEQ ID NO: 1014737 - RNA, 12 nt, Mycobacterium avium subsp. paratuberculosis
ccgcggacccga

SEQ ID NO: 1014738 - RNA, 18 nt, Mycobacterium avium subsp. paratuberculosis
ccgcggaggcgagcagcc

SEQ ID NO: 1014739 - RNA, 15 nt, Mycobacterium avium subsp. paratuberculosis
ccgcggaguaggcgc

SEQ ID NO: 1014740 - RNA, 16 nt, Mycobacterium avium subsp. paratuberculosis
ccgcggaguaggcgcc

SEQ ID NO: 1014741 - RNA, 21 nt, Mycobacterium avium subsp. paratuberculosis
ccgcgcggguacggcggccgc

SEQ ID NO: 1014742 - RNA, 13 nt, Mycobacterium avium subsp. paratuberculosis
ccgcgcgucgcgc

SEQ ID NO: 1014743 - RNA, 17 nt, Mycobacterium avium subsp. paratuberculosis
ccgcgcgucgggggugc

SEQ ID NO: 1014744 - RNA, 23 nt, Mycobacterium avium subsp. paratuberculosis
ccgcgcgucucccccgaucagcg

SEQ ID NO: 1014745 - RNA, 20 nt, Mycobacterium avium subsp. paratuberculosis
ccgcgcguggucccacacca

SEQ ID NO: 1014746 - RNA, 17 nt, Mycobacterium avium subsp. paratuberculosis
ccgcgcggcucacagcg

SEQ ID NO: 1014747 - RNA, 20 nt, Mycobacterium avium subsp. paratuberculosis
ccgcgcggcucgcgggcgau

SEQ ID NO: 1014748 - RNA, 14 nt, Mycobacterium avium subsp. paratuberculosis
ccgcgcgggggccg

SEQ ID NO: 1014749 - RNA, 17 nt, Mycobacterium avium subsp. paratuberculosis
ccgcgcgggggccgccg

SEQ ID NO: 1014750 - RNA, 18 nt, Mycobacterium avium subsp. paratuberculosis
ccgcgcgggggccgccgc

SEQ ID NO: 1014751 - RNA, 15 nt, Mycobacterium avium subsp. paratuberculosis
ccgcgcugaccagcg

SEQ ID NO: 1014752 - RNA, 19 nt, Mycobacterium avium subsp. paratuberculosis
ccgcgcucgcaccagcgcu

SEQ ID NO: 1014753 - RNA, 23 nt, Mycobacterium avium subsp. paratuberculosis
ccgcgcucaccgucgcggucagc

SEQ ID NO: 1014754 - RNA, 17 nt, Mycobacterium avium subsp. paratuberculosis
ccgcgcucaacccgggc

SEQ ID NO: 1014755 - RNA, 20 nt, Mycobacterium avium subsp. paratuberculosis
ccgcgcggcgcagguccggc

SEQ ID NO: 1014756 - RNA, 23 nt, Mycobacterium avium subsp. paratuberculosis
ccgcgcggcgcagguccggcagc

SEQ ID NO: 1014757 - RNA, 14 nt, Mycobacterium avium subsp. paratuberculosis
ccgcgcggcgcagu

SEQ ID NO: 1014758 - RNA, 13 nt, Mycobacterium avium subsp. paratuberculosis
ccgcgcggcgcca

SEQ ID NO: 1014759 - RNA, 15 nt, Mycobacterium avium subsp. paratuberculosis
ccgcgcggcggugcu

SEQ ID NO: 1014760 - RNA, 16 nt, Mycobacterium avium subsp. paratuberculosis
ccgcgcggcgucggcc

SEQ ID NO: 1014761 - RNA, 22 nt, Mycobacterium avium subsp. paratuberculosis
ccgcgcggcgucggccugcccg

SEQ ID NO: 1014762 - RNA, 14 nt, Mycobacterium avium subsp. paratuberculosis
ccgcgcgggccagc

SEQ ID NO: 1014763 - RNA, 15 nt, Mycobacterium avium subsp. paratuberculosis
ccgcgcgggccagcg

SEQ ID NO: 1014764 - RNA, 12 nt, Mycobacterium avium subsp. paratuberculosis
ccgcgcggcagg

SEQ ID NO: 1014765 - RNA, 18 nt, Mycobacterium avium subsp. paratuberculosis
ccgcgcggccagcggcgc

SEQ ID NO: 1014766 - RNA, 14 nt, Mycobacterium avium subsp. paratuberculosis
ccgcgcggccgcca

SEQ ID NO: 1014767 - RNA, 16 nt, Mycobacterium avium subsp. paratuberculosis
ccgcgcggccgccagg

SEQ ID NO: 1014768 - RNA, 14 nt, Mycobacterium avium subsp. paratuberculosis
ccgcgcggccggcc

SEQ ID NO: 1014769 - RNA, 20 nt, Mycobacterium avium subsp. paratuberculosis
ccgcgcggauuucucagcgg

SEQ ID NO: 1014770 - RNA, 17 nt, Mycobacterium avium subsp. paratuberculosis
ccgcgcggccaccagcg

SEQ ID NO: 1014771 - RNA, 14 nt, Mycobacterium avium subsp. paratuberculosis
ccgcgcgcugcagc

SEQ ID NO: 1014772 - RNA, 20 nt, Mycobacterium avium subsp. paratuberculosis
ccgcgcgcugccgcgccccg

SEQ ID NO: 1014773 - RNA, 16 nt, Mycobacterium avium subsp. paratuberculosis
ccgcgcgcgggccagc

SEQ ID NO: 1014774 - RNA, 13 nt, Mycobacterium avium subsp. paratuberculosis
ccgcgcgcggcac

SEQ ID NO: 1014775 - RNA, 15 nt, Mycobacterium avium subsp. paratuberculosis
ccgcgcgcggccacc

SEQ ID NO: 1014776 - RNA, 13 nt, Mycobacterium avium subsp. paratuberculosis
ccgcgcgcggcgc

SEQ ID NO: 1014777 - RNA, 15 nt, Mycobacterium avium subsp. paratuberculosis
ccgcgcgcggcgccg

SEQ ID NO: 1014778 - RNA, 23 nt, Mycobacterium avium subsp. paratuberculosis
ccgcgcgcggcgcggagccggcc

SEQ ID NO: 1014779 - RNA, 19 nt, Mycobacterium avium subsp. paratuberculosis
ccgcgcgcgcggccuccag

SEQ ID NO: 1014780 - RNA, 14 nt, Mycobacterium avium subsp. paratuberculosis
ccgcgcgccgacag

SEQ ID NO: 1014781 - RNA, 15 nt, Mycobacterium avium subsp. paratuberculosis
ccgcgcgccggccag

SEQ ID NO: 1014782 - RNA, 15 nt, Mycobacterium avium subsp. paratuberculosis
ccgcgcgagcgcagc

SEQ ID NO: 1014783 - RNA, 15 nt, Mycobacterium avium subsp. paratuberculosis
ccgcgcgagcgcgcu

SEQ ID NO: 1014784 - RNA, 17 nt, Mycobacterium avium subsp. paratuberculosis
ccgcgcgcaggccccgg

SEQ ID NO: 1014785 - RNA, 18 nt, Mycobacterium avium subsp. paratuberculosis
ccgcgcgcaggccccggc

SEQ ID NO: 1014786 - RNA, 22 nt, Mycobacterium avium subsp. paratuberculosis
ccgcgcgaugcgggcgccgaac

SEQ ID NO: 1014787 - RNA, 15 nt, Mycobacterium avium subsp. paratuberculosis
ccgcgccagccgccg

SEQ ID NO: 1014788 - RNA, 16 nt, Mycobacterium avium subsp. paratuberculosis
ccgcgccagccgccgc

SEQ ID NO: 1014789 - RNA, 20 nt, Mycobacterium avium subsp. paratuberculosis
ccgcgcagucggcgucgcgg

SEQ ID NO: 1014790 - RNA, 23 nt, Mycobacterium avium subsp. paratuberculosis
ccgcgauuuccgguugcggcagc

SEQ ID NO: 1014791 - RNA, 14 nt, Mycobacterium avium subsp. paratuberculosis
ccgcgcaggccccg

SEQ ID NO: 1014792 - RNA, 17 nt, Mycobacterium avium subsp. paratuberculosis
ccgcgcaggccguccag

SEQ ID NO: 1014793 - RNA, 19 nt, Mycobacterium avium subsp. paratuberculosis
ccgcgcauucaccagcugu

SEQ ID NO: 1014794 - RNA, 20 nt, Mycobacterium avium subsp. paratuberculosis
ccgcuggaacagcgggccgg

SEQ ID NO: 1014795 - RNA, 22 nt, Mycobacterium avium subsp. paratuberculosis
ccgcugcaccagcccgucggcc

SEQ ID NO: 1014796 - RNA, 13 nt, Mycobacterium avium subsp. paratuberculosis
ccgcugccguccg

SEQ ID NO: 1014797 - RNA, 18 nt, Mycobacterium avium subsp. paratuberculosis
ccgcugcgcccagcgcgc

SEQ ID NO: 1014798 - RNA, 21 nt, Mycobacterium avium subsp. paratuberculosis
ccgcugcgccggcgcggccag

SEQ ID NO: 1014799 - RNA, 17 nt, Mycobacterium avium subsp. paratuberculosis
ccgcugcggcacaccag

SEQ ID NO: 1014800 - RNA, 14 nt, Mycobacterium avium subsp. paratuberculosis
ccgcuucgcccggc

SEQ ID NO: 1014801 - RNA, 19 nt, Mycobacterium avium subsp. paratuberculosis
ccgcuggugcgcgccggcg

SEQ ID NO: 1014802 - RNA, 23 nt, Mycobacterium avium subsp. paratuberculosis
ccgcuggugaacucgccgaucgg

SEQ ID NO: 1014803 - RNA, 18 nt, Mycobacterium avium subsp. paratuberculosis
ccgcuggugaggucgcgc

SEQ ID NO: 1014804 - RNA, 18 nt, Mycobacterium avium subsp. paratuberculosis
ccgcugggugguguucug

SEQ ID NO: 1014805 - RNA, 22 nt, Mycobacterium avium subsp. paratuberculosis
ccgcugggugguguucuggaug

SEQ ID NO: 1014806 - RNA, 14 nt, Mycobacterium avium subsp. paratuberculosis
ccgcuggggcccag

SEQ ID NO: 1014807 - RNA, 16 nt, Mycobacterium avium subsp. paratuberculosis
ccgcuggggcccagcu

SEQ ID NO: 1014808 - RNA, 20 nt, Mycobacterium avium subsp. paratuberculosis
ccgcuggggcgcaccgccug

SEQ ID NO: 1014809 - RNA, 18 nt, Mycobacterium avium subsp. paratuberculosis
ccgcugaugccgccgaag

SEQ ID NO: 1014810 - RNA, 18 nt, Mycobacterium avium subsp. paratuberculosis
ccgcucggccagcagcac

SEQ ID NO: 1014811 - RNA, 15 nt, Mycobacterium avium subsp. paratuberculosis
ccgcucggcgaucug

SEQ ID NO: 1014812 - RNA, 18 nt, Mycobacterium avium subsp. paratuberculosis
ccgcucggcgcuccagcg

SEQ ID NO: 1014813 - RNA, 14 nt, Mycobacterium avium subsp. paratuberculosis
ccgcucggcggcgc

SEQ ID NO: 1014814 - RNA, 15 nt, Mycobacterium avium subsp. paratuberculosis
ccgcucggcggcgcc

SEQ ID NO: 1014815 - RNA, 20 nt, Mycobacterium avium subsp. paratuberculosis
ccgcucggcggcgccgucgu

SEQ ID NO: 1014816 - RNA, 22 nt, Mycobacterium avium subsp. paratuberculosis
ccgcucggcguggcgcucagcg

SEQ ID NO: 1014817 - RNA, 22 nt, Mycobacterium avium subsp. paratuberculosis
ccgcugaccgccgcgcucggcc

SEQ ID NO: 1014818 - RNA, 13 nt, Mycobacterium avium subsp. paratuberculosis
ccgcucgccgcgg

SEQ ID NO: 1014819 - RNA, 14 nt, Mycobacterium avium subsp. paratuberculosis
ccgcucgcgggccc

SEQ ID NO: 1014820 - RNA, 20 nt, Mycobacterium avium subsp. paratuberculosis
ccgcucgcgggcccgcgccg

SEQ ID NO: 1014821 - RNA, 14 nt, Mycobacterium avium subsp. paratuberculosis
ccgcucgccgucgg

SEQ ID NO: 1014822 - RNA, 20 nt, Mycobacterium avium subsp. paratuberculosis
ccgcuccagcggccacaccg

SEQ ID NO: 1014823 - RNA, 17 nt, Mycobacterium avium subsp. paratuberculosis
ccgcuccaugaaccggu

SEQ ID NO: 1014824 - RNA, 17 nt, Mycobacterium avium subsp. paratuberculosis
ccgcucgaacacccggc

SEQ ID NO: 1014825 - RNA, 23 nt, Mycobacterium avium subsp. paratuberculosis
ccgcuccuccucgcgccgccacg

SEQ ID NO: 1014826 - RNA, 16 nt, Mycobacterium avium subsp. paratuberculosis
ccgcuccgcgggcagc

SEQ ID NO: 1014827 - RNA, 18 nt, Mycobacterium avium subsp. paratuberculosis
ccgcuagguuuggccagc

SEQ ID NO: 1014828 - RNA, 13 nt, Mycobacterium avium subsp. paratuberculosis
ccgcuagucgccc

SEQ ID NO: 1014829 - RNA, 13 nt, Mycobacterium avium subsp. paratuberculosis
ccgcuacccggcg

SEQ ID NO: 1014830 - RNA, 17 nt, Mycobacterium avium subsp. paratuberculosis
ccgcucaguccagcucc

SEQ ID NO: 1014831 - RNA, 20 nt, Mycobacterium avium subsp. paratuberculosis
ccgcgugacggccgcggcgc

SEQ ID NO: 1014832 - RNA, 17 nt, Mycobacterium avium subsp. paratuberculosis
ccgcgugucggcacacc

SEQ ID NO: 1014833 - RNA, 18 nt, Mycobacterium avium subsp. paratuberculosis
ccgcgguucuuguccucg

SEQ ID NO: 1014834 - RNA, 17 nt, Mycobacterium avium subsp. paratuberculosis
ccgcgguuucaccgugc

SEQ ID NO: 1014835 - RNA, 23 nt, Mycobacterium avium subsp. paratuberculosis
ccgcgguuucaccgugcgcgcgc

SEQ ID NO: 1014836 - RNA, 18 nt, Mycobacterium avium subsp. paratuberculosis
ccgcgguuuggucagcgc

SEQ ID NO: 1014837 - RNA, 21 nt, Mycobacterium avium subsp. paratuberculosis
ccgcgguuuggucagcgcccc

SEQ ID NO: 1014838 - RNA, 20 nt, Mycobacterium avium subsp. paratuberculosis
ccgcgucgaugcgggcccgc

SEQ ID NO: 1014839 - RNA, 14 nt, Mycobacterium avium subsp. paratuberculosis
ccgcgucgccgacc

SEQ ID NO: 1014840 - RNA, 20 nt, Mycobacterium avium subsp. paratuberculosis
ccgcgucggcgcuggccagc

SEQ ID NO: 1014841 - RNA, 18 nt, Mycobacterium avium subsp. paratuberculosis
ccgcggugugcuggccag

SEQ ID NO: 1014842 - RNA, 17 nt, Mycobacterium avium subsp. paratuberculosis
ccgcgucgcgccgccgc

SEQ ID NO: 1014843 - RNA, 13 nt, Mycobacterium avium subsp. paratuberculosis
ccgcgugaaugcc

SEQ ID NO: 1014844 - RNA, 14 nt, Mycobacterium avium subsp. paratuberculosis
ccgcgugaaugccc

SEQ ID NO: 1014845 - RNA, 14 nt, Mycobacterium avium subsp. paratuberculosis
ccgcgugacagggg

SEQ ID NO: 1014846 - RNA, 16 nt, Mycobacterium avium subsp. paratuberculosis
ccgcgucggcggcggc

SEQ ID NO: 1014847 - RNA, 17 nt, Mycobacterium avium subsp. paratuberculosis
ccgcggaucagcaggac

SEQ ID NO: 1014848 - RNA, 16 nt, Mycobacterium avium subsp. paratuberculosis
ccgcggauguggaggc

SEQ ID NO: 1014849 - RNA, 15 nt, Mycobacterium avium subsp. paratuberculosis
ccgcggccaccuggg

SEQ ID NO: 1014850 - RNA, 11 nt, Mycobacterium avium subsp. paratuberculosis
ccgcggccucc

SEQ ID NO: 1014851 - RNA, 16 nt, Mycobacterium avium subsp. paratuberculosis
ccgcggccggcccagc

SEQ ID NO: 1014852 - RNA, 20 nt, Mycobacterium avium subsp. paratuberculosis
ccgcggccggcccagcgcgc

SEQ ID NO: 1014853 - RNA, 15 nt, Mycobacterium avium subsp. paratuberculosis
ccgcggccggcggca

SEQ ID NO: 1014854 - RNA, 17 nt, Mycobacterium avium subsp. paratuberculosis
ccgcggccggcggcagu

SEQ ID NO: 1014855 - RNA, 14 nt, Mycobacterium avium subsp. paratuberculosis
ccgcggccgccgcc

SEQ ID NO: 1014856 - RNA, 13 nt, Mycobacterium avium subsp. paratuberculosis
ccgcggccgccuc

SEQ ID NO: 1014857 - RNA, 16 nt, Mycobacterium avium subsp. paratuberculosis
ccgcggccgccucccg

SEQ ID NO: 1014858 - RNA, 15 nt, Mycobacterium avium subsp. paratuberculosis
ccgcggccgcggcgc

SEQ ID NO: 1014859 - RNA, 17 nt, Mycobacterium avium subsp. paratuberculosis
ccgcggccgcggcgggc

SEQ ID NO: 1014860 - RNA, 20 nt, Mycobacterium avium subsp. paratuberculosis
ccgcggccgcugcgcccagc

SEQ ID NO: 1014861 - RNA, 12 nt, Mycobacterium avium subsp. paratuberculosis
ccgcggccagcu

SEQ ID NO: 1014862 - RNA, 18 nt, Mycobacterium avium subsp. paratuberculosis
ccgcggcccggccaccag

SEQ ID NO: 1014863 - RNA, 14 nt, Mycobacterium avium subsp. paratuberculosis
ccgcgguggugggc

SEQ ID NO: 1014864 - RNA, 16 nt, Mycobacterium avium subsp. paratuberculosis
ccgcgguggugggcgc

SEQ ID NO: 1014865 - RNA, 18 nt, Mycobacterium avium subsp. paratuberculosis
ccgcgguggguccgccgg

SEQ ID NO: 1014866 - RNA, 20 nt, Mycobacterium avium subsp. paratuberculosis
ccgcggugagcggccgcagc

SEQ ID NO: 1014867 - RNA, 16 nt, Mycobacterium avium subsp. paratuberculosis
ccgcggugccgcagcu

SEQ ID NO: 1014868 - RNA, 13 nt, Mycobacterium avium subsp. paratuberculosis
ccgcggugcgcca

SEQ ID NO: 1014869 - RNA, 18 nt, Mycobacterium avium subsp. paratuberculosis
ccgcggugcugcagcgcg

SEQ ID NO: 1014870 - RNA, 16 nt, Mycobacterium avium subsp. paratuberculosis
ccgcggucugcgccag

SEQ ID NO: 1014871 - RNA, 17 nt, Mycobacterium avium subsp. paratuberculosis
ccgcggucugcgccagc

SEQ ID NO: 1014872 - RNA, 17 nt, Mycobacterium avium subsp. paratuberculosis
ccgcggugaccgcccgc

SEQ ID NO: 1014873 - RNA, 18 nt, Mycobacterium avium subsp. paratuberculosis
ccgcggcgaugaccggac

SEQ ID NO: 1014874 - RNA, 17 nt, Mycobacterium avium subsp. paratuberculosis
ccgcggucgcacuugaa

SEQ ID NO: 1014875 - RNA, 17 nt, Mycobacterium avium subsp. paratuberculosis
ccgcggcgcccucgccg

SEQ ID NO: 1014876 - RNA, 18 nt, Mycobacterium avium subsp. paratuberculosis
ccgcggucaucgagccgg

SEQ ID NO: 1014877 - RNA, 19 nt, Mycobacterium avium subsp. paratuberculosis
ccgcggucaucgagccggu

SEQ ID NO: 1014878 - RNA, 21 nt, Mycobacterium avium subsp. paratuberculosis
ccgcggucaugcgcgggcaau

SEQ ID NO: 1014879 - RNA, 17 nt, Mycobacterium avium subsp. paratuberculosis
ccgcggcgauggugggc

SEQ ID NO: 1014880 - RNA, 20 nt, Mycobacterium avium subsp. paratuberculosis
ccgcggcgauggugggcagc

SEQ ID NO: 1014881 - RNA, 21 nt, Mycobacterium avium subsp. paratuberculosis
ccgcggcgauggugggcagcc

SEQ ID NO: 1014882 - RNA, 23 nt, Mycobacterium avium subsp. paratuberculosis
ccgcggcgauggugggcagccgg

SEQ ID NO: 1014883 - RNA, 13 nt, Mycobacterium avium subsp. paratuberculosis
ccgcggcgaaaac

SEQ ID NO: 1014884 - RNA, 18 nt, Mycobacterium avium subsp. paratuberculosis
ccgcggcagccgggcgau

SEQ ID NO: 1014885 - RNA, 16 nt, Mycobacterium avium subsp. paratuberculosis
ccgcggcgagccggcc

SEQ ID NO: 1014886 - RNA, 18 nt, Mycobacterium avium subsp. paratuberculosis
ccgcggcgagccggccgu

SEQ ID NO: 1014887 - RNA, 24 nt, Mycobacterium avium subsp. paratuberculosis
ccgagcgugcauucagugcgagaa

SEQ ID NO: 1014888 - RNA, 18 nt, Mycobacterium avium subsp. paratuberculosis
ccgaguaacucggccuuc

SEQ ID NO: 1014889 - RNA, 17 nt, Mycobacterium avium subsp. paratuberculosis
ccgaguccgggccgccg

SEQ ID NO: 1014890 - RNA, 19 nt, Mycobacterium avium subsp. paratuberculosis
ccgaguccgggccgccggc

SEQ ID NO: 1014891 - RNA, 17 nt, Mycobacterium avium subsp. paratuberculosis
ccgauagcuugagcccc

SEQ ID NO: 1014892 - RNA, 16 nt, Mycobacterium avium subsp. paratuberculosis
ccgauccagacggucu

SEQ ID NO: 1014893 - RNA, 16 nt, Mycobacterium avium subsp. paratuberculosis
ccgauccagccgucgu

SEQ ID NO: 1014894 - RNA, 23 nt, Mycobacterium avium subsp. paratuberculosis
ccgauccgcgccgccgccagcca

SEQ ID NO: 1014895 - RNA, 14 nt, Mycobacterium avium subsp. paratuberculosis
ccgauccggcgccg

SEQ ID NO: 1014896 - RNA, 21 nt, Mycobacterium avium subsp. paratuberculosis
ccgauccgagcgcugcccgug

SEQ ID NO: 1014897 - RNA, 14 nt, Mycobacterium avium subsp. paratuberculosis
ccgauccgcagccg

SEQ ID NO: 1014898 - RNA, 22 nt, Mycobacterium avium subsp. paratuberculosis
ccgaugcggugccgggccaggu

SEQ ID NO: 1014899 - RNA, 23 nt, Mycobacterium avium subsp. paratuberculosis
ccgaugcugagcgggucggccgg

SEQ ID NO: 1014900 - RNA, 22 nt, Mycobacterium avium subsp. paratuberculosis
ccgaugcuggccaucgccgagc

SEQ ID NO: 1014901 - RNA, 14 nt, Mycobacterium avium subsp. paratuberculosis
ccgaucgcccggua

SEQ ID NO: 1014902 - RNA, 22 nt, Mycobacterium avium subsp. paratuberculosis
ccgaugcggaccggggacuuga

SEQ ID NO: 1014903 - RNA, 16 nt, Mycobacterium avium subsp. paratuberculosis
ccgaucgccuccucau

SEQ ID NO: 1014904 - RNA, 21 nt, Mycobacterium avium subsp. paratuberculosis
ccgaucgcgaucaccgcggcc

SEQ ID NO: 1014905 - RNA, 14 nt, Mycobacterium avium subsp. paratuberculosis
ccgaugcgccgcac

SEQ ID NO: 1014906 - RNA, 13 nt, Mycobacterium avium subsp. paratuberculosis
ccgagucgcgccg

SEQ ID NO: 1014907 - RNA, 18 nt, Mycobacterium avium subsp. paratuberculosis
ccgagucgucgcgcacca

SEQ ID NO: 1014908 - RNA, 22 nt, Mycobacterium avium subsp. paratuberculosis
ccgaguagaacuucgccagcgg

SEQ ID NO: 1014909 - RNA, 17 nt, Mycobacterium avium subsp. paratuberculosis
ccgagucacccggcugg

SEQ ID NO: 1014910 - RNA, 17 nt, Mycobacterium avium subsp. paratuberculosis
ccgaguccacgacgucc

SEQ ID NO: 1014911 - RNA, 19 nt, Mycobacterium avium subsp. paratuberculosis
ccgaggugacgucgcgccg

SEQ ID NO: 1014912 - RNA, 18 nt, Mycobacterium avium subsp. paratuberculosis
ccgaggugcugucgucgc

SEQ ID NO: 1014913 - RNA, 16 nt, Mycobacterium avium subsp. paratuberculosis
ccgagguggccgccag

SEQ ID NO: 1014914 - RNA, 12 nt, Mycobacterium avium subsp. paratuberculosis
ccgaggccgccc

SEQ ID NO: 1014915 - RNA, 14 nt, Mycobacterium avium subsp. paratuberculosis
ccgaggccagcacg

SEQ ID NO: 1014916 - RNA, 14 nt, Mycobacterium avium subsp. paratuberculosis
ccgaggucggucgc

SEQ ID NO: 1014917 - RNA, 19 nt, Mycobacterium avium subsp. paratuberculosis
ccgaggcgcaggaggcggc

SEQ ID NO: 1014918 - RNA, 15 nt, Mycobacterium avium subsp. paratuberculosis
ccgagguagucggcc

SEQ ID NO: 1014919 - RNA, 13 nt, Mycobacterium avium subsp. paratuberculosis
ccgaggucagcgc

SEQ ID NO: 1014920 - RNA, 18 nt, Mycobacterium avium subsp. paratuberculosis
ccgagguccucgaccucu

SEQ ID NO: 1014921 - RNA, 15 nt, Mycobacterium avium subsp. paratuberculosis
ccgaggucgccgacg

SEQ ID NO: 1014922 - RNA, 19 nt, Mycobacterium avium subsp. paratuberculosis
ccgagcggccguccaccac

SEQ ID NO: 1014923 - RNA, 14 nt, Mycobacterium avium subsp. paratuberculosis
ccgagcggggugug

SEQ ID NO: 1014924 - RNA, 19 nt, Mycobacterium avium subsp. paratuberculosis
ccgagcggcugcuggucga

SEQ ID NO: 1014925 - RNA, 15 nt, Mycobacterium avium subsp. paratuberculosis
ccgagcguucggcgc

SEQ ID NO: 1014926 - RNA, 18 nt, Mycobacterium avium subsp. paratuberculosis
ccgagcguucggcgcgga

SEQ ID NO: 1014927 - RNA, 23 nt, Mycobacterium avium subsp. paratuberculosis
ccgagcgucauuccgccgcgccc

SEQ ID NO: 1014928 - RNA, 15 nt, Mycobacterium avium subsp. paratuberculosis
ccgaggaugccgccc

SEQ ID NO: 1014929 - RNA, 20 nt, Mycobacterium avium subsp. paratuberculosis
ccgaggauggggucgcgggc

SEQ ID NO: 1014930 - RNA, 19 nt, Mycobacterium avium subsp. paratuberculosis
ccgaggagacgucggccgg

SEQ ID NO: 1014931 - RNA, 13 nt, Mycobacterium avium subsp. paratuberculosis
ccgaccucggcca

SEQ ID NO: 1014932 - RNA, 14 nt, Mycobacterium avium subsp. paratuberculosis
ccgaccugggcggc

SEQ ID NO: 1014933 - RNA, 15 nt, Mycobacterium avium subsp. paratuberculosis
ccgacggcgccgcgg

SEQ ID NO: 1014934 - RNA, 13 nt, Mycobacterium avium subsp. paratuberculosis
ccgacggccagca

SEQ ID NO: 1014935 - RNA, 15 nt, Mycobacterium avium subsp. paratuberculosis
ccgacggccagcagg

SEQ ID NO: 1014936 - RNA, 20 nt, Mycobacterium avium subsp. paratuberculosis
ccgacggagccgagcaccag

SEQ ID NO: 1014937 - RNA, 20 nt, Mycobacterium avium subsp. paratuberculosis
ccgacggauucccgaacagg

SEQ ID NO: 1014938 - RNA, 16 nt, Mycobacterium avium subsp. paratuberculosis
ccgaccgacagccgca

SEQ ID NO: 1014939 - RNA, 15 nt, Mycobacterium avium subsp. paratuberculosis
ccgaccgacccggcc

SEQ ID NO: 1014940 - RNA, 15 nt, Mycobacterium avium subsp. paratuberculosis
ccgacccccgccgcg

SEQ ID NO: 1014941 - RNA, 18 nt, Mycobacterium avium subsp. paratuberculosis
ccgaccgcgaugcagaac

SEQ ID NO: 1014942 - RNA, 20 nt, Mycobacterium avium subsp. paratuberculosis
ccgaccgccgagcgggcgau

SEQ ID NO: 1014943 - RNA, 16 nt, Mycobacterium avium subsp. paratuberculosis
ccgaccgggcgcuccg

SEQ ID NO: 1014944 - RNA, 19 nt, Mycobacterium avium subsp. paratuberculosis
ccgaccccggcgagcgcgu

SEQ ID NO: 1014945 - RNA, 14 nt, Mycobacterium avium subsp. paratuberculosis
ccgaccccugcacu

SEQ ID NO: 1014946 - RNA, 14 nt, Mycobacterium avium subsp. paratuberculosis
ccgaccccgccagc

SEQ ID NO: 1014947 - RNA, 12 nt, Mycobacterium avium subsp. paratuberculosis
ccgacccgucca

SEQ ID NO: 1014948 - RNA, 15 nt, Mycobacterium avium subsp. paratuberculosis
ccgacccguccagcg

SEQ ID NO: 1014949 - RNA, 16 nt, Mycobacterium avium subsp. paratuberculosis
ccgacccguccagcgu

SEQ ID NO: 1014950 - RNA, 20 nt, Mycobacterium avium subsp. paratuberculosis
ccgacccugcguccggcccg

SEQ ID NO: 1014951 - RNA, 17 nt, Mycobacterium avium subsp. paratuberculosis
ccgacccggccagcggc

SEQ ID NO: 1014952 - RNA, 14 nt, Mycobacterium avium subsp. paratuberculosis
ccgacccggccgau

SEQ ID NO: 1014953 - RNA, 22 nt, Mycobacterium avium subsp. paratuberculosis
ccgagcaggcggaucggcccga

SEQ ID NO: 1014954 - RNA, 19 nt, Mycobacterium avium subsp. paratuberculosis
ccgagcagcgggucgucgg

SEQ ID NO: 1014955 - RNA, 16 nt, Mycobacterium avium subsp. paratuberculosis
ccgagcagcucagccg

SEQ ID NO: 1014956 - RNA, 11 nt, Mycobacterium avium subsp. paratuberculosis
ccgagcagccg

SEQ ID NO: 1014957 - RNA, 15 nt, Mycobacterium avium subsp. paratuberculosis
ccgagcagcaccggc

SEQ ID NO: 1014958 - RNA, 13 nt, Mycobacterium avium subsp. paratuberculosis
ccgagcagcagcc

SEQ ID NO: 1014959 - RNA, 13 nt, Mycobacterium avium subsp. paratuberculosis
ccgagcacgcggc

SEQ ID NO: 1014960 - RNA, 14 nt, Mycobacterium avium subsp. paratuberculosis
ccgagcacgcggcc

SEQ ID NO: 1014961 - RNA, 16 nt, Mycobacterium avium subsp. paratuberculosis
ccgagcacgcggccgc

SEQ ID NO: 1014962 - RNA, 19 nt, Mycobacterium avium subsp. paratuberculosis
ccgagcacgcggccgcgcc

SEQ ID NO: 1014963 - RNA, 20 nt, Mycobacterium avium subsp. paratuberculosis
ccgagcacgcggccgcgccg

SEQ ID NO: 1014964 - RNA, 23 nt, Mycobacterium avium subsp. paratuberculosis
ccgagcacggcucguccaucagc

SEQ ID NO: 1014965 - RNA, 16 nt, Mycobacterium avium subsp. paratuberculosis
ccgagcaucagcugcc

SEQ ID NO: 1014966 - RNA, 21 nt, Mycobacterium avium subsp. paratuberculosis
ccgagcaucagcugccguccg

SEQ ID NO: 1014967 - RNA, 17 nt, Mycobacterium avium subsp. paratuberculosis
ccgagcccgacggcagc

SEQ ID NO: 1014968 - RNA, 21 nt, Mycobacterium avium subsp. paratuberculosis
ccgagcgcugguugucgacgc

SEQ ID NO: 1014969 - RNA, 19 nt, Mycobacterium avium subsp. paratuberculosis
ccgagcgcgccgagcagcu

SEQ ID NO: 1014970 - RNA, 21 nt, Mycobacterium avium subsp. paratuberculosis
ccgagcgcgccgagcagcugg

SEQ ID NO: 1014971 - RNA, 12 nt, Mycobacterium avium subsp. paratuberculosis
ccgagcgcgccg

SEQ ID NO: 1014972 - RNA, 16 nt, Mycobacterium avium subsp. paratuberculosis
ccgacggucgccacca

SEQ ID NO: 1014973 - RNA, 21 nt, Mycobacterium avium subsp. paratuberculosis
ccgacggucgggcccagguag

SEQ ID NO: 1014974 - RNA, 20 nt, Mycobacterium avium subsp. paratuberculosis
ccgacucgauguagccgggc

SEQ ID NO: 1014975 - RNA, 15 nt, Mycobacterium avium subsp. paratuberculosis
ccgacgggcccagcg

SEQ ID NO: 1014976 - RNA, 23 nt, Mycobacterium avium subsp. paratuberculosis
ccgacgggguucaguagcagcgu

SEQ ID NO: 1014977 - RNA, 15 nt, Mycobacterium avium subsp. paratuberculosis
ccgacuccucacacc

SEQ ID NO: 1014978 - RNA, 15 nt, Mycobacterium avium subsp. paratuberculosis
ccgacugccccgcuc

SEQ ID NO: 1014979 - RNA, 21 nt, Mycobacterium avium subsp. paratuberculosis
ccgacugugcgaugucggugc

SEQ ID NO: 1014980 - RNA, 21 nt, Mycobacterium avium subsp. paratuberculosis
ccgacuguuugaugccgucgg

SEQ ID NO: 1014981 - RNA, 21 nt, Mycobacterium avium subsp. paratuberculosis
ccgacuggugauagaucaucc

SEQ ID NO: 1014982 - RNA, 16 nt, Mycobacterium avium subsp. paratuberculosis
ccgacuucauggcgaa

SEQ ID NO: 1014983 - RNA, 21 nt, Mycobacterium avium subsp. paratuberculosis
ccgaagggaaaggcagcagcc

SEQ ID NO: 1014984 - RNA, 17 nt, Mycobacterium avium subsp. paratuberculosis
ccgaagcgccacggggc

SEQ ID NO: 1014985 - RNA, 12 nt, Mycobacterium avium subsp. paratuberculosis
ccgaagcccgca

SEQ ID NO: 1014986 - RNA, 15 nt, Mycobacterium avium subsp. paratuberculosis
ccgaagccggcgcag

SEQ ID NO: 1014987 - RNA, 22 nt, Mycobacterium avium subsp. paratuberculosis
ccgaagcucaucaccggcgcgc

SEQ ID NO: 1014988 - RNA, 13 nt, Mycobacterium avium subsp. paratuberculosis
ccgaagcggcgca

SEQ ID NO: 1014989 - RNA, 15 nt, Mycobacterium avium subsp. paratuberculosis
ccgacaagggccggg

SEQ ID NO: 1014990 - RNA, 15 nt, Mycobacterium avium subsp. paratuberculosis
ccgacaccggccggg

SEQ ID NO: 1014991 - RNA, 20 nt, Mycobacterium avium subsp. paratuberculosis
ccgacaccgccccgccgcgc

SEQ ID NO: 1014992 - RNA, 16 nt, Mycobacterium avium subsp. paratuberculosis
ccgacaccgccuucga

SEQ ID NO: 1014993 - RNA, 17 nt, Mycobacterium avium subsp. paratuberculosis
ccgacaccucgccgucc

SEQ ID NO: 1014994 - RNA, 19 nt, Mycobacterium avium subsp. paratuberculosis
ccgacaccgggucccccgc

SEQ ID NO: 1014995 - RNA, 13 nt, Mycobacterium avium subsp. paratuberculosis
ccgacaccccaca

SEQ ID NO: 1014996 - RNA, 17 nt, Mycobacterium avium subsp. paratuberculosis
ccgacaccaccggccgc

SEQ ID NO: 1014997 - RNA, 16 nt, Mycobacterium avium subsp. paratuberculosis
ccgacaccagcgcgca

SEQ ID NO: 1014998 - RNA, 18 nt, Mycobacterium avium subsp. paratuberculosis
ccgacacguaggccgccu

SEQ ID NO: 1014999 - RNA, 19 nt, Mycobacterium avium subsp. paratuberculosis
ccgacagcacccggccccc

SEQ ID NO: 1015000 - RNA, 15 nt, Mycobacterium avium subsp. paratuberculosis
ccgacagggccagcg

SEQ ID NO: 1015001 - RNA, 15 nt, Mycobacterium avium subsp. paratuberculosis
ccgacagcgcgucgg

SEQ ID NO: 1015002 - RNA, 18 nt, Mycobacterium avium subsp. paratuberculosis
ccgacagcgcgucggcga

SEQ ID NO: 1015003 - RNA, 16 nt, Mycobacterium avium subsp. paratuberculosis
ccgacagccgcaccag

SEQ ID NO: 1015004 - RNA, 13 nt, Mycobacterium avium subsp. paratuberculosis
ccgacagcgggau

SEQ ID NO: 1015005 - RNA, 18 nt, Mycobacterium avium subsp. paratuberculosis
ccgacagcgggauguagc

SEQ ID NO: 1015006 - RNA, 19 nt, Mycobacterium avium subsp. paratuberculosis
ccgacaucagugcgggcau

SEQ ID NO: 1015007 - RNA, 21 nt, Mycobacterium avium subsp. paratuberculosis
ccgacauccaggaccgcgcgc

SEQ ID NO: 1015008 - RNA, 14 nt, Mycobacterium avium subsp. paratuberculosis
ccgacauccgggua

SEQ ID NO: 1015009 - RNA, 16 nt, Mycobacterium avium subsp. paratuberculosis
ccgacaucgcccgguc

SEQ ID NO: 1015010 - RNA, 17 nt, Mycobacterium avium subsp. paratuberculosis
ccgacaucgucggcucg

SEQ ID NO: 1015011 - RNA, 23 nt, Mycobacterium avium subsp. paratuberculosis
ccgacagguagcaggcgcgcagc

SEQ ID NO: 1015012 - RNA, 20 nt, Mycobacterium avium subsp. paratuberculosis
ccgacagucgcgggcagccg

SEQ ID NO: 1015013 - RNA, 16 nt, Mycobacterium avium subsp. paratuberculosis
ccgaccaguucggcca

SEQ ID NO: 1015014 - RNA, 16 nt, Mycobacterium avium subsp. paratuberculosis
ccgaccagcaggacgc

SEQ ID NO: 1015015 - RNA, 20 nt, Mycobacterium avium subsp. paratuberculosis
ccgaccagcaggacgcgccc

SEQ ID NO: 1015016 - RNA, 14 nt, Mycobacterium avium subsp. paratuberculosis
ccgaccagcgggau

SEQ ID NO: 1015017 - RNA, 16 nt, Mycobacterium avium subsp. paratuberculosis
ccgaccagcgggauga

SEQ ID NO: 1015018 - RNA, 17 nt, Mycobacterium avium subsp. paratuberculosis
ccgaccagcgggccgac

SEQ ID NO: 1015019 - RNA, 12 nt, Mycobacterium avium subsp. paratuberculosis
ccgaccagcugu

SEQ ID NO: 1015020 - RNA, 11 nt, Mycobacterium avium subsp. paratuberculosis
ccgaccaggaa

SEQ ID NO: 1015021 - RNA, 17 nt, Mycobacterium avium subsp. paratuberculosis
ccgaccaacacccccgc

SEQ ID NO: 1015022 - RNA, 20 nt, Mycobacterium avium subsp. paratuberculosis
ccgacaucugccgggcggcg

SEQ ID NO: 1015023 - RNA, 15 nt, Mycobacterium avium subsp. paratuberculosis
ccgaccaccuccccg

SEQ ID NO: 1015024 - RNA, 19 nt, Mycobacterium avium subsp. paratuberculosis
ccgaaacgucgcagcccgg

SEQ ID NO: 1015025 - RNA, 21 nt, Mycobacterium avium subsp. paratuberculosis
ccgaaagccguaccgcaacac

SEQ ID NO: 1015026 - RNA, 19 nt, Mycobacterium avium subsp. paratuberculosis
ccgaaccggggccgcaccu

SEQ ID NO: 1015027 - RNA, 19 nt, Mycobacterium avium subsp. paratuberculosis
ccgaacaacagggccgcgc

SEQ ID NO: 1015028 - RNA, 24 nt, Mycobacterium avium subsp. paratuberculosis
ccgaacaacugaccgauggccgcc

SEQ ID NO: 1015029 - RNA, 20 nt, Mycobacterium avium subsp. paratuberculosis
ccgaaaugccgugccagccg

SEQ ID NO: 1015030 - RNA, 15 nt, Mycobacterium avium subsp. paratuberculosis
ccgaaccgcccgccc

SEQ ID NO: 1015031 - RNA, 22 nt, Mycobacterium avium subsp. paratuberculosis
ccgaacgugcugugcgggcggu

SEQ ID NO: 1015032 - RNA, 16 nt, Mycobacterium avium subsp. paratuberculosis
ccgaacgggucggcga

SEQ ID NO: 1015033 - RNA, 19 nt, Mycobacterium avium subsp. paratuberculosis
ccgaacgacgagccgucga

SEQ ID NO: 1015034 - RNA, 20 nt, Mycobacterium avium subsp. paratuberculosis
ccgaacgauggugugcagca

SEQ ID NO: 1015035 - RNA, 16 nt, Mycobacterium avium subsp. paratuberculosis
ccgaaccgggcgcgca

SEQ ID NO: 1015036 - RNA, 20 nt, Mycobacterium avium subsp. paratuberculosis
ccgaacgccgaggugcaaca

SEQ ID NO: 1015037 - RNA, 15 nt, Mycobacterium avium subsp. paratuberculosis
cccuuggccagcagu

SEQ ID NO: 1015038 - RNA, 13 nt, Mycobacterium avium subsp. paratuberculosis
cccucgccccgga

SEQ ID NO: 1015039 - RNA, 12 nt, Mycobacterium avium subsp. paratuberculosis
cccucgccgccg

SEQ ID NO: 1015040 - RNA, 13 nt, Mycobacterium avium subsp. paratuberculosis
cccucgccgccgc

SEQ ID NO: 1015041 - RNA, 18 nt, Mycobacterium avium subsp. paratuberculosis
cccucgccggucagcgca

SEQ ID NO: 1015042 - RNA, 16 nt, Mycobacterium avium subsp. paratuberculosis
cccucgaugcgcaccg

SEQ ID NO: 1015043 - RNA, 21 nt, Mycobacterium avium subsp. paratuberculosis
cccucgaucgcgaccaccggc

SEQ ID NO: 1015044 - RNA, 21 nt, Mycobacterium avium subsp. paratuberculosis
cccucgagccauaaaccggcc

SEQ ID NO: 1015045 - RNA, 16 nt, Mycobacterium avium subsp. paratuberculosis
cccucgacccgaagcc

SEQ ID NO: 1015046 - RNA, 18 nt, Mycobacterium avium subsp. paratuberculosis
cccucgcgcaauaacgga

SEQ ID NO: 1015047 - RNA, 20 nt, Mycobacterium avium subsp. paratuberculosis
cccucggcauaacgcaaccg

SEQ ID NO: 1015048 - RNA, 15 nt, Mycobacterium avium subsp. paratuberculosis
cccucggcccgccac

SEQ ID NO: 1015049 - RNA, 16 nt, Mycobacterium avium subsp. paratuberculosis
cccuuggacaccugca

SEQ ID NO: 1015050 - RNA, 21 nt, Mycobacterium avium subsp. paratuberculosis
ccgcauuccgucuuggccagg

SEQ ID NO: 1015051 - RNA, 18 nt, Mycobacterium avium subsp. paratuberculosis
ccgcauuccucggccagc

SEQ ID NO: 1015052 - RNA, 15 nt, Mycobacterium avium subsp. paratuberculosis
ccgcauucggccgcc

SEQ ID NO: 1015053 - RNA, 17 nt, Mycobacterium avium subsp. paratuberculosis
ccgcaugcccuugucgc

SEQ ID NO: 1015054 - RNA, 18 nt, Mycobacterium avium subsp. paratuberculosis
ccgcaugcccgggcgacu

SEQ ID NO: 1015055 - RNA, 16 nt, Mycobacterium avium subsp. paratuberculosis
ccgcaugucgaccucg

SEQ ID NO: 1015056 - RNA, 17 nt, Mycobacterium avium subsp. paratuberculosis
ccgcauccagcgccgcc

SEQ ID NO: 1015057 - RNA, 15 nt, Mycobacterium avium subsp. paratuberculosis
ccgcagcggggcgcu

SEQ ID NO: 1015058 - RNA, 20 nt, Mycobacterium avium subsp. paratuberculosis
ccgcagcgcgacgaacagca

SEQ ID NO: 1015059 - RNA, 12 nt, Mycobacterium avium subsp. paratuberculosis
ccgcagcggcgc

SEQ ID NO: 1015060 - RNA, 14 nt, Mycobacterium avium subsp. paratuberculosis
ccgcagcggcggca

SEQ ID NO: 1015061 - RNA, 15 nt, Mycobacterium avium subsp. paratuberculosis
ccgcagcggcggcac

SEQ ID NO: 1015062 - RNA, 16 nt, Mycobacterium avium subsp. paratuberculosis
ccgcagcggcggcucg

SEQ ID NO: 1015063 - RNA, 23 nt, Mycobacterium avium subsp. paratuberculosis
ccgcagcggcgguugcucgucgg

SEQ ID NO: 1015064 - RNA, 19 nt, Mycobacterium avium subsp. paratuberculosis
ccgcaucaauuacaacugu

SEQ ID NO: 1015065 - RNA, 21 nt, Mycobacterium avium subsp. paratuberculosis
ccgccaaggggaacaacgcgc

SEQ ID NO: 1015066 - RNA, 21 nt, Mycobacterium avium subsp. paratuberculosis
ccgccaaccaggucgcggcgc

SEQ ID NO: 1015067 - RNA, 20 nt, Mycobacterium avium subsp. paratuberculosis
ccgcauuggugccggccucg

SEQ ID NO: 1015068 - RNA, 12 nt, Mycobacterium avium subsp. paratuberculosis
ccgccaccagca

SEQ ID NO: 1015069 - RNA, 18 nt, Mycobacterium avium subsp. paratuberculosis
ccgccaccacccggcgau

SEQ ID NO: 1015070 - RNA, 14 nt, Mycobacterium avium subsp. paratuberculosis
ccgccacagcgccu

SEQ ID NO: 1015071 - RNA, 14 nt, Mycobacterium avium subsp. paratuberculosis
ccgcacgcugucgg

SEQ ID NO: 1015072 - RNA, 21 nt, Mycobacterium avium subsp. paratuberculosis
ccgcacggcccaucaccagcg

SEQ ID NO: 1015073 - RNA, 13 nt, Mycobacterium avium subsp. paratuberculosis
ccgcacggccgcc

SEQ ID NO: 1015074 - RNA, 13 nt, Mycobacterium avium subsp. paratuberculosis
ccgcacgaccaug

SEQ ID NO: 1015075 - RNA, 20 nt, Mycobacterium avium subsp. paratuberculosis
ccgcacgaccaugucggcga

SEQ ID NO: 1015076 - RNA, 18 nt, Mycobacterium avium subsp. paratuberculosis
ccgcacgagcacccagaa

SEQ ID NO: 1015077 - RNA, 13 nt, Mycobacterium avium subsp. paratuberculosis
ccgcacgaucagg

SEQ ID NO: 1015078 - RNA, 17 nt, Mycobacterium avium subsp. paratuberculosis
ccgcacgaucagggugu

SEQ ID NO: 1015079 - RNA, 17 nt, Mycobacterium avium subsp. paratuberculosis
ccgcacgaaaugcgggc

SEQ ID NO: 1015080 - RNA, 14 nt, Mycobacterium avium subsp. paratuberculosis
ccgcagccuucuuc

SEQ ID NO: 1015081 - RNA, 20 nt, Mycobacterium avium subsp. paratuberculosis
ccgcagccuucuuggcgggc

SEQ ID NO: 1015082 - RNA, 17 nt, Mycobacterium avium subsp. paratuberculosis
ccgcagcggcaggucgu

SEQ ID NO: 1015083 - RNA, 17 nt, Mycobacterium avium subsp. paratuberculosis
ccgcagcgccagcgcgc

SEQ ID NO: 1015084 - RNA, 21 nt, Mycobacterium avium subsp. paratuberculosis
ccgcagcgcccggcagcgguc

SEQ ID NO: 1015085 - RNA, 14 nt, Mycobacterium avium subsp. paratuberculosis
ccgcagcgccucgg

SEQ ID NO: 1015086 - RNA, 21 nt, Mycobacterium avium subsp. paratuberculosis
ccgauggugaaccacuucugg

SEQ ID NO: 1015087 - RNA, 18 nt, Mycobacterium avium subsp. paratuberculosis
ccgauggguuggccgucg

SEQ ID NO: 1015088 - RNA, 19 nt, Mycobacterium avium subsp. paratuberculosis
ccgauggcccaggccgcgg

SEQ ID NO: 1015089 - RNA, 13 nt, Mycobacterium avium subsp. paratuberculosis
ccgauggccgccc

SEQ ID NO: 1015090 - RNA, 15 nt, Mycobacterium avium subsp. paratuberculosis
ccgaugcgggccagg

SEQ ID NO: 1015091 - RNA, 15 nt, Mycobacterium avium subsp. paratuberculosis
ccgcacaccaccacg

SEQ ID NO: 1015092 - RNA, 16 nt, Mycobacterium avium subsp. paratuberculosis
ccgcacaccgcggcgg

SEQ ID NO: 1015093 - RNA, 21 nt, Mycobacterium avium subsp. paratuberculosis
ccgcacaccgcggcggcgucg

SEQ ID NO: 1015094 - RNA, 12 nt, Mycobacterium avium subsp. paratuberculosis
ccgcacaugccg

SEQ ID NO: 1015095 - RNA, 23 nt, Mycobacterium avium subsp. paratuberculosis
ccgcacaugccgaggcacagcag

SEQ ID NO: 1015096 - RNA, 15 nt, Mycobacterium avium subsp. paratuberculosis
ccgcacagccggcgg

SEQ ID NO: 1015097 - RNA, 15 nt, Mycobacterium avium subsp. paratuberculosis
ccgcaccgaccagcg

SEQ ID NO: 1015098 - RNA, 16 nt, Mycobacterium avium subsp. paratuberculosis
ccgcaccgaccagcgg

SEQ ID NO: 1015099 - RNA, 23 nt, Mycobacterium avium subsp. paratuberculosis
ccgcacccuugacuaccgcgccc

SEQ ID NO: 1015100 - RNA, 16 nt, Mycobacterium avium subsp. paratuberculosis
ccgcaccucgcccggc

SEQ ID NO: 1015101 - RNA, 17 nt, Mycobacterium avium subsp. paratuberculosis
ccgcaccucgcccggcu

SEQ ID NO: 1015102 - RNA, 20 nt, Mycobacterium avium subsp. paratuberculosis
ccgcaccucgcuggcggcgc

SEQ ID NO: 1015103 - RNA, 14 nt, Mycobacterium avium subsp. paratuberculosis
ccgcaccgggcagc

SEQ ID NO: 1015104 - RNA, 20 nt, Mycobacterium avium subsp. paratuberculosis
ccgcaccgucgugccagcgc

SEQ ID NO: 1015105 - RNA, 14 nt, Mycobacterium avium subsp. paratuberculosis
ccgcaccggcgccg

SEQ ID NO: 1015106 - RNA, 20 nt, Mycobacterium avium subsp. paratuberculosis
ccgcaccggcgccgccacca

SEQ ID NO: 1015107 - RNA, 14 nt, Mycobacterium avium subsp. paratuberculosis
ccgcaccggaaagc

SEQ ID NO: 1015108 - RNA, 13 nt, Mycobacterium avium subsp. paratuberculosis
ccgcaccgccccg

SEQ ID NO: 1015109 - RNA, 12 nt, Mycobacterium avium subsp. paratuberculosis
ccgccgaggcga

SEQ ID NO: 1015110 - RNA, 21 nt, Mycobacterium avium subsp. paratuberculosis
ccgccgaggcgaugccgugcu

SEQ ID NO: 1015111 - RNA, 16 nt, Mycobacterium avium subsp. paratuberculosis
ccgccgagggccagca

SEQ ID NO: 1015112 - RNA, 19 nt, Mycobacterium avium subsp. paratuberculosis
ccgccgagggccagcagcc

SEQ ID NO: 1015113 - RNA, 20 nt, Mycobacterium avium subsp. paratuberculosis
ccgccgagggccagcagcca

SEQ ID NO: 1015114 - RNA, 14 nt, Mycobacterium avium subsp. paratuberculosis
ccgccgagggcccg

SEQ ID NO: 1015115 - RNA, 18 nt, Mycobacterium avium subsp. paratuberculosis
ccgccgaucgaucagccg

SEQ ID NO: 1015116 - RNA, 16 nt, Mycobacterium avium subsp. paratuberculosis
ccgccgaugacggcgc

SEQ ID NO: 1015117 - RNA, 18 nt, Mycobacterium avium subsp. paratuberculosis
ccgccgaaacaccggcuu

SEQ ID NO: 1015118 - RNA, 20 nt, Mycobacterium avium subsp. paratuberculosis
ccgccgaaacaccggcuucg

SEQ ID NO: 1015119 - RNA, 18 nt, Mycobacterium avium subsp. paratuberculosis
ccgccgaacaccggcagc

SEQ ID NO: 1015120 - RNA, 16 nt, Mycobacterium avium subsp. paratuberculosis
ccgccgaaagccuccg

SEQ ID NO: 1015121 - RNA, 13 nt, Mycobacterium avium subsp. paratuberculosis
ccgccgaacccca

SEQ ID NO: 1015122 - RNA, 17 nt, Mycobacterium avium subsp. paratuberculosis
ccgccgaacccgcccuc

SEQ ID NO: 1015123 - RNA, 19 nt, Mycobacterium avium subsp. paratuberculosis
ccgccgaaccgaucaccgg

SEQ ID NO: 1015124 - RNA, 16 nt, Mycobacterium avium subsp. paratuberculosis
ccgccgagccggcacg

SEQ ID NO: 1015125 - RNA, 16 nt, Mycobacterium avium subsp. paratuberculosis
ccgcccggaccgcggu

SEQ ID NO: 1015126 - RNA, 22 nt, Mycobacterium avium subsp. paratuberculosis
ccgcccgcuggggcgcaccgcc

SEQ ID NO: 1015127 - RNA, 22 nt, Mycobacterium avium subsp. paratuberculosis
ccgcccggcccaagacccgcgu

SEQ ID NO: 1015128 - RNA, 14 nt, Mycobacterium avium subsp. paratuberculosis
ccgcccggcccggc

SEQ ID NO: 1015129 - RNA, 15 nt, Mycobacterium avium subsp. paratuberculosis
ccgcccgcgcggcgg

SEQ ID NO: 1015130 - RNA, 21 nt, Mycobacterium avium subsp. paratuberculosis
ccgcccgggaaaauuuccugg

SEQ ID NO: 1015131 - RNA, 13 nt, Mycobacterium avium subsp. paratuberculosis
ccgcccgggccgc

SEQ ID NO: 1015132 - RNA, 17 nt, Mycobacterium avium subsp. paratuberculosis
ccgcccgggccgcgccc

SEQ ID NO: 1015133 - RNA, 21 nt, Mycobacterium avium subsp. paratuberculosis
ccgcccggccggucgccgaug

SEQ ID NO: 1015134 - RNA, 22 nt, Mycobacterium avium subsp. paratuberculosis
ccgcccuugaacggcaccagcg

SEQ ID NO: 1015135 - RNA, 23 nt, Mycobacterium avium subsp. paratuberculosis
ccgcccuugaacggcaccagcgg

SEQ ID NO: 1015136 - RNA, 16 nt, Mycobacterium avium subsp. paratuberculosis
ccgcccggagaacucc

SEQ ID NO: 1015137 - RNA, 16 nt, Mycobacterium avium subsp. paratuberculosis
ccgcccuuggccgcgg

SEQ ID NO: 1015138 - RNA, 21 nt, Mycobacterium avium subsp. paratuberculosis
ccgcccacaccgacaccggcc

SEQ ID NO: 1015139 - RNA, 14 nt, Mycobacterium avium subsp. paratuberculosis
ccgccaucgccucg

SEQ ID NO: 1015140 - RNA, 17 nt, Mycobacterium avium subsp. paratuberculosis
ccgcccacgggucgccg

SEQ ID NO: 1015141 - RNA, 22 nt, Mycobacterium avium subsp. paratuberculosis
ccgcccacuggucguugcacac

SEQ ID NO: 1015142 - RNA, 12 nt, Mycobacterium avium subsp. paratuberculosis
ccgcccaccacc

SEQ ID NO: 1015143 - RNA, 13 nt, Mycobacterium avium subsp. paratuberculosis
ccgcccaccagca

SEQ ID NO: 1015144 - RNA, 14 nt, Mycobacterium avium subsp. paratuberculosis
ccgcccagcgcagc

SEQ ID NO: 1015145 - RNA, 21 nt, Mycobacterium avium subsp. paratuberculosis
ccgcccagcgacucggccagg

SEQ ID NO: 1015146 - RNA, 15 nt, Mycobacterium avium subsp. paratuberculosis
ccgccaucaccgcgc

SEQ ID NO: 1015147 - RNA, 14 nt, Mycobacterium avium subsp. paratuberculosis
ccgccagucugagc

SEQ ID NO: 1015148 - RNA, 20 nt, Mycobacterium avium subsp. paratuberculosis
ccgccaguuguuggccgggc

SEQ ID NO: 1015149 - RNA, 14 nt, Mycobacterium avium subsp. paratuberculosis
ccgccacggccagc

SEQ ID NO: 1015150 - RNA, 18 nt, Mycobacterium avium subsp. paratuberculosis
ccgccacgacgcggcgau

SEQ ID NO: 1015151 - RNA, 23 nt, Mycobacterium avium subsp. paratuberculosis
ccgccacccgcugcucgaccucg

SEQ ID NO: 1015152 - RNA, 16 nt, Mycobacterium avium subsp. paratuberculosis
ccgccaccggcccggc

SEQ ID NO: 1015153 - RNA, 13 nt, Mycobacterium avium subsp. paratuberculosis
ccgccaccgcccg

SEQ ID NO: 1015154 - RNA, 20 nt, Mycobacterium avium subsp. paratuberculosis
ccgccacgucgaacccgacc

SEQ ID NO: 1015155 - RNA, 14 nt, Mycobacterium avium subsp. paratuberculosis
ccgccagaacgggu

SEQ ID NO: 1015156 - RNA, 22 nt, Mycobacterium avium subsp. paratuberculosis
ccgccacgugcggcugcgcguu

SEQ ID NO: 1015157 - RNA, 16 nt, Mycobacterium avium subsp. paratuberculosis
ccgccagaucgccauc

SEQ ID NO: 1015158 - RNA, 19 nt, Mycobacterium avium subsp. paratuberculosis
ccgccagcaaccccgcggu

SEQ ID NO: 1015159 - RNA, 23 nt, Mycobacterium avium subsp. paratuberculosis
ccgccagauagggcagcgucccg

SEQ ID NO: 1015160 - RNA, 22 nt, Mycobacterium avium subsp. paratuberculosis
ccgccagguuggcggcggcccg

SEQ ID NO: 1015161 - RNA, 16 nt, Mycobacterium avium subsp. paratuberculosis
ccgccaggucggggcc

SEQ ID NO: 1015162 - RNA, 21 nt, Mycobacterium avium subsp. paratuberculosis
ccgccaggucggggcccgucc

SEQ ID NO: 1015163 - RNA, 13 nt, Mycobacterium avium subsp. paratuberculosis
ccgccagggccag

SEQ ID NO: 1015164 - RNA, 22 nt, Mycobacterium avium subsp. paratuberculosis
ccgccagggugccgcugcccgc

SEQ ID NO: 1015165 - RNA, 19 nt, Mycobacterium avium subsp. paratuberculosis
ccgccaggaugucguccuc

SEQ ID NO: 1015166 - RNA, 17 nt, Mycobacterium avium subsp. paratuberculosis
ccgccaggcuggccagg

SEQ ID NO: 1015167 - RNA, 14 nt, Mycobacterium avium subsp. paratuberculosis
ccgccagggcgacg

SEQ ID NO: 1015168 - RNA, 20 nt, Mycobacterium avium subsp. paratuberculosis
ccgccagggcgacgccgcgg

SEQ ID NO: 1015169 - RNA, 15 nt, Mycobacterium avium subsp. paratuberculosis
ccgccagggcgcggc

SEQ ID NO: 1015170 - RNA, 17 nt, Mycobacterium avium subsp. paratuberculosis
ccgccagggcgcggcgc

SEQ ID NO: 1015171 - RNA, 15 nt, Mycobacterium avium subsp. paratuberculosis
ccgccagcgccaccc

SEQ ID NO: 1015172 - RNA, 15 nt, Mycobacterium avium subsp. paratuberculosis
ccgccagcgcaccga

SEQ ID NO: 1015173 - RNA, 15 nt, Mycobacterium avium subsp. paratuberculosis
ccgccagcgcggcgg

SEQ ID NO: 1015174 - RNA, 17 nt, Mycobacterium avium subsp. paratuberculosis
ccgccagcgccggcagc

SEQ ID NO: 1015175 - RNA, 13 nt, Mycobacterium avium subsp. paratuberculosis
ccgccagccgcag

SEQ ID NO: 1015176 - RNA, 13 nt, Mycobacterium avium subsp. paratuberculosis
ccgccagcauggu

SEQ ID NO: 1015177 - RNA, 14 nt, Mycobacterium avium subsp. paratuberculosis
ccgccagcagcagc

SEQ ID NO: 1015178 - RNA, 22 nt, Mycobacterium avium subsp. paratuberculosis
ccgccagcagcagccgcgccgc

SEQ ID NO: 1015179 - RNA, 15 nt, Mycobacterium avium subsp. paratuberculosis
cccuauggcaucgcc

SEQ ID NO: 1015180 - RNA, 21 nt, Mycobacterium avium subsp. paratuberculosis
cccuauggcaucgccaaggcg

SEQ ID NO: 1015181 - RNA, 13 nt, Mycobacterium avium subsp. paratuberculosis
cccuacgggcgca

SEQ ID NO: 1015182 - RNA, 17 nt, Mycobacterium avium subsp. paratuberculosis
cccuacgggcgcaccgc

SEQ ID NO: 1015183 - RNA, 15 nt, Mycobacterium avium subsp. paratuberculosis
cccuccgggcggcac

SEQ ID NO: 1015184 - RNA, 22 nt, Mycobacterium avium subsp. paratuberculosis
cccucgaagcagaacuucuccg

SEQ ID NO: 1015185 - RNA, 15 nt, Mycobacterium avium subsp. paratuberculosis
cccucgaaguagagc

SEQ ID NO: 1015186 - RNA, 20 nt, Mycobacterium avium subsp. paratuberculosis
cccucgaaguagagccgcug

SEQ ID NO: 1015187 - RNA, 21 nt, Mycobacterium avium subsp. paratuberculosis
cccucgacguccaggccggcg

SEQ ID NO: 1015188 - RNA, 18 nt, Mycobacterium avium subsp. paratuberculosis
cccucgaccaccucuucg

SEQ ID NO: 1015189 - RNA, 12 nt, Mycobacterium avium subsp. paratuberculosis
cccuccggcgcc

SEQ ID NO: 1015190 - RNA, 18 nt, Mycobacterium avium subsp. paratuberculosis
cccuccggcaggccgcgg

SEQ ID NO: 1015191 - RNA, 14 nt, Mycobacterium avium subsp. paratuberculosis
cccuccccgcuagc

SEQ ID NO: 1015192 - RNA, 17 nt, Mycobacterium avium subsp. paratuberculosis
cccuccacacggcaggc

SEQ ID NO: 1015193 - RNA, 21 nt, Mycobacterium avium subsp. paratuberculosis
cccuccacggugcgcaccgac

SEQ ID NO: 1015194 - RNA, 15 nt, Mycobacterium avium subsp. paratuberculosis
cccuccagcaccguc

SEQ ID NO: 1015195 - RNA, 12 nt, Mycobacterium avium subsp. paratuberculosis
cccuccagccgc

SEQ ID NO: 1015196 - RNA, 15 nt, Mycobacterium avium subsp. paratuberculosis
cccucaccccgccca

SEQ ID NO: 1015197 - RNA, 18 nt, Mycobacterium avium subsp. paratuberculosis
cccucaggcguccagcac

SEQ ID NO: 1015198 - RNA, 15 nt, Mycobacterium avium subsp. paratuberculosis
cccucagggagcugc

SEQ ID NO: 1015199 - RNA, 22 nt, Mycobacterium avium subsp. paratuberculosis
cccgucacggcugccgaccucg

SEQ ID NO: 1015200 - RNA, 13 nt, Mycobacterium avium subsp. paratuberculosis
cccguccugggcc

SEQ ID NO: 1015201 - RNA, 14 nt, Mycobacterium avium subsp. paratuberculosis
cccguccugggccu

SEQ ID NO: 1015202 - RNA, 23 nt, Mycobacterium avium subsp. paratuberculosis
cccguccugggccuggcgcucca

SEQ ID NO: 1015203 - RNA, 13 nt, Mycobacterium avium subsp. paratuberculosis
cccguccgccccg

SEQ ID NO: 1015204 - RNA, 18 nt, Mycobacterium avium subsp. paratuberculosis
cccguccgccccgcugcc

SEQ ID NO: 1015205 - RNA, 14 nt, Mycobacterium avium subsp. paratuberculosis
cccguccccaccac

SEQ ID NO: 1015206 - RNA, 23 nt, Mycobacterium avium subsp. paratuberculosis
cccguccccaccaccgacagcac

SEQ ID NO: 1015207 - RNA, 15 nt, Mycobacterium avium subsp. paratuberculosis
cccgucgagcagccg

SEQ ID NO: 1015208 - RNA, 22 nt, Mycobacterium avium subsp. paratuberculosis
cccgucgagcggcuugccgccg

SEQ ID NO: 1015209 - RNA, 23 nt, Mycobacterium avium subsp. paratuberculosis
cccgucgagcggcuugccgccgc

SEQ ID NO: 1015210 - RNA, 21 nt, Mycobacterium avium subsp. paratuberculosis
cccgucgagcgucacgccgcg

SEQ ID NO: 1015211 - RNA, 22 nt, Mycobacterium avium subsp. paratuberculosis
cccgucgagcgucacgccgcgc

SEQ ID NO: 1015212 - RNA, 23 nt, Mycobacterium avium subsp. paratuberculosis
cccgucgagcgucacgccgcgcc

SEQ ID NO: 1015213 - RNA, 23 nt, Mycobacterium avium subsp. paratuberculosis
cccgucgagcgucauuccgccgc

SEQ ID NO: 1015214 - RNA, 21 nt, Mycobacterium avium subsp. paratuberculosis
cccgucgccaccacggcgccc

SEQ ID NO: 1015215 - RNA, 18 nt, Mycobacterium avium subsp. paratuberculosis
cccguccggcgccagccc

SEQ ID NO: 1015216 - RNA, 16 nt, Mycobacterium avium subsp. paratuberculosis
cccguccgggccggcc

SEQ ID NO: 1015217 - RNA, 15 nt, Mycobacterium avium subsp. paratuberculosis
cccgucgacgggcca

SEQ ID NO: 1015218 - RNA, 13 nt, Mycobacterium avium subsp. paratuberculosis
cccgucgccggcg

SEQ ID NO: 1015219 - RNA, 20 nt, Mycobacterium avium subsp. paratuberculosis
cccguaacacgaucaccccg

SEQ ID NO: 1015220 - RNA, 16 nt, Mycobacterium avium subsp. paratuberculosis
cccgguugucgcucag

SEQ ID NO: 1015221 - RNA, 22 nt, Mycobacterium avium subsp. paratuberculosis
cccguagcucgcgccgacccgc

SEQ ID NO: 1015222 - RNA, 17 nt, Mycobacterium avium subsp. paratuberculosis
cccgguucugggcgggc

SEQ ID NO: 1015223 - RNA, 20 nt, Mycobacterium avium subsp. paratuberculosis
cccgguuccaccgggccgcc

SEQ ID NO: 1015224 - RNA, 15 nt, Mycobacterium avium subsp. paratuberculosis
cccgguugagcaccg

SEQ ID NO: 1015225 - RNA, 16 nt, Mycobacterium avium subsp. paratuberculosis
cccgguugagcaccgc

SEQ ID NO: 1015226 - RNA, 19 nt, Mycobacterium avium subsp. paratuberculosis
cccgguugaccccggcccc

SEQ ID NO: 1015227 - RNA, 16 nt, Mycobacterium avium subsp. paratuberculosis
cccggugucugaccuc

SEQ ID NO: 1015228 - RNA, 22 nt, Mycobacterium avium subsp. paratuberculosis
cccggugucugaccucgcgccg

SEQ ID NO: 1015229 - RNA, 20 nt, Mycobacterium avium subsp. paratuberculosis
cccguucagugaccagugca

SEQ ID NO: 1015230 - RNA, 22 nt, Mycobacterium avium subsp. paratuberculosis
cccguguuguggucugaccccc

SEQ ID NO: 1015231 - RNA, 14 nt, Mycobacterium avium subsp. paratuberculosis
cccguugagcagcg

SEQ ID NO: 1015232 - RNA, 14 nt, Mycobacterium avium subsp. paratuberculosis
cccguuccccggcc

SEQ ID NO: 1015233 - RNA, 18 nt, Mycobacterium avium subsp. paratuberculosis
cccguucgccgacagcag

SEQ ID NO: 1015234 - RNA, 21 nt, Mycobacterium avium subsp. paratuberculosis
cccguucgccgacagcagcuc

SEQ ID NO: 1015235 - RNA, 14 nt, Mycobacterium avium subsp. paratuberculosis
cccguugucgagca

SEQ ID NO: 1015236 - RNA, 20 nt, Mycobacterium avium subsp. paratuberculosis
cccguugcgggacugggcga

SEQ ID NO: 1015237 - RNA, 13 nt, Mycobacterium avium subsp. paratuberculosis
cccgugcuggcca

SEQ ID NO: 1015238 - RNA, 14 nt, Mycobacterium avium subsp. paratuberculosis
cccgugcgccgccc

SEQ ID NO: 1015239 - RNA, 14 nt, Mycobacterium avium subsp. paratuberculosis
cccgucgccuccga

SEQ ID NO: 1015240 - RNA, 23 nt, Mycobacterium avium subsp. paratuberculosis
cccgucgcggacccuggccagca

SEQ ID NO: 1015241 - RNA, 19 nt, Mycobacterium avium subsp. paratuberculosis
cccgucgggccguccgccg

SEQ ID NO: 1015242 - RNA, 13 nt, Mycobacterium avium subsp. paratuberculosis
cccgucgggcgcg

SEQ ID NO: 1015243 - RNA, 18 nt, Mycobacterium avium subsp. paratuberculosis
cccgucgggcgcggcggc

SEQ ID NO: 1015244 - RNA, 22 nt, Mycobacterium avium subsp. paratuberculosis
cccgucggggugcgccaggcag

SEQ ID NO: 1015245 - RNA, 21 nt, Mycobacterium avium subsp. paratuberculosis
cccgucguccuugagccccca

SEQ ID NO: 1015246 - RNA, 13 nt, Mycobacterium avium subsp. paratuberculosis
cccgucgucgccg

SEQ ID NO: 1015247 - RNA, 20 nt, Mycobacterium avium subsp. paratuberculosis
cccgucucgagcuuccgccg

SEQ ID NO: 1015248 - RNA, 16 nt, Mycobacterium avium subsp. paratuberculosis
cccgucucggcgugcu

SEQ ID NO: 1015249 - RNA, 15 nt, Mycobacterium avium subsp. paratuberculosis
cccgguaggccgccg

SEQ ID NO: 1015250 - RNA, 13 nt, Mycobacterium avium subsp. paratuberculosis
cccgguaggcggc

SEQ ID NO: 1015251 - RNA, 15 nt, Mycobacterium avium subsp. paratuberculosis
cccgguacagcgccg

SEQ ID NO: 1015252 - RNA, 17 nt, Mycobacterium avium subsp. paratuberculosis
cccgguacagcgccgcg

SEQ ID NO: 1015253 - RNA, 20 nt, Mycobacterium avium subsp. paratuberculosis
cccgguacaggucgcugccc

SEQ ID NO: 1015254 - RNA, 16 nt, Mycobacterium avium subsp. paratuberculosis
cccgguagaucgccgg

SEQ ID NO: 1015255 - RNA, 15 nt, Mycobacterium avium subsp. paratuberculosis
cccgguagccagcac

SEQ ID NO: 1015256 - RNA, 16 nt, Mycobacterium avium subsp. paratuberculosis
cccgguagcgcagcac

SEQ ID NO: 1015257 - RNA, 15 nt, Mycobacterium avium subsp. paratuberculosis
cccggucaguucguc

SEQ ID NO: 1015258 - RNA, 15 nt, Mycobacterium avium subsp. paratuberculosis
cccggucagcucgcc

SEQ ID NO: 1015259 - RNA, 16 nt, Mycobacterium avium subsp. paratuberculosis
cccggucagcucgccg

SEQ ID NO: 1015260 - RNA, 20 nt, Mycobacterium avium subsp. paratuberculosis
cccggucagcucgccguccg

SEQ ID NO: 1015261 - RNA, 13 nt, Mycobacterium avium subsp. paratuberculosis
cccgguccggccc

SEQ ID NO: 1015262 - RNA, 12 nt, Mycobacterium avium subsp. paratuberculosis
cccggucgccgg

SEQ ID NO: 1015263 - RNA, 18 nt, Mycobacterium avium subsp. paratuberculosis
cccggucugaucgcccag

SEQ ID NO: 1015264 - RNA, 12 nt, Mycobacterium avium subsp. paratuberculosis
cccggucugcgg

SEQ ID NO: 1015265 - RNA, 17 nt, Mycobacterium avium subsp. paratuberculosis
cccggugaucgccgccc

SEQ ID NO: 1015266 - RNA, 16 nt, Mycobacterium avium subsp. paratuberculosis
cccggugcccaccguc

SEQ ID NO: 1015267 - RNA, 14 nt, Mycobacterium avium subsp. paratuberculosis
cccggugccggccg

SEQ ID NO: 1015268 - RNA, 22 nt, Mycobacterium avium subsp. paratuberculosis
cccggucguagucggcccgccg

SEQ ID NO: 1015269 - RNA, 18 nt, Mycobacterium avium subsp. paratuberculosis
cccggugcgacgccgcgc

SEQ ID NO: 1015270 - RNA, 19 nt, Mycobacterium avium subsp. paratuberculosis
cccggugggacugggcgcc

SEQ ID NO: 1015271 - RNA, 23 nt, Mycobacterium avium subsp. paratuberculosis
cccggugggacugggcgccgccg

SEQ ID NO: 1015272 - RNA, 19 nt, Mycobacterium avium subsp. paratuberculosis
cccgguguccacgucgccc

SEQ ID NO: 1015273 - RNA, 21 nt, Mycobacterium avium subsp. paratuberculosis
cccgguguccacgucgcccag

SEQ ID NO: 1015274 - RNA, 22 nt, Mycobacterium avium subsp. paratuberculosis
cccggguggcgacgaaccuggc

SEQ ID NO: 1015275 - RNA, 18 nt, Mycobacterium avium subsp. paratuberculosis
cccggguguuggagccgu

SEQ ID NO: 1015276 - RNA, 14 nt, Mycobacterium avium subsp. paratuberculosis
cccggguagcgcag

SEQ ID NO: 1015277 - RNA, 16 nt, Mycobacterium avium subsp. paratuberculosis
cccggguagggcagcc

SEQ ID NO: 1015278 - RNA, 21 nt, Mycobacterium avium subsp. paratuberculosis
cccggguagggcagccacauc

SEQ ID NO: 1015279 - RNA, 15 nt, Mycobacterium avium subsp. paratuberculosis
cccggguccuggccc

SEQ ID NO: 1015280 - RNA, 21 nt, Mycobacterium avium subsp. paratuberculosis
cccggguccuggcccccgccc

SEQ ID NO: 1015281 - RNA, 19 nt, Mycobacterium avium subsp. paratuberculosis
cccgggucuagaucuccag

SEQ ID NO: 1015282 - RNA, 13 nt, Mycobacterium avium subsp. paratuberculosis
cccggggguccag

SEQ ID NO: 1015283 - RNA, 14 nt, Mycobacterium avium subsp. paratuberculosis
cccggggguccagg

SEQ ID NO: 1015284 - RNA, 15 nt, Mycobacterium avium subsp. paratuberculosis
cccggggguccaggg

SEQ ID NO: 1015285 - RNA, 13 nt, Mycobacterium avium subsp. paratuberculosis
cccggggcgcgcu

SEQ ID NO: 1015286 - RNA, 12 nt, Mycobacterium avium subsp. paratuberculosis
cccgggcugccc

SEQ ID NO: 1015287 - RNA, 18 nt, Mycobacterium avium subsp. paratuberculosis
cccgggcgagcgucgccg

SEQ ID NO: 1015288 - RNA, 20 nt, Mycobacterium avium subsp. paratuberculosis
cccgggcuagacgcgcacca

SEQ ID NO: 1015289 - RNA, 15 nt, Mycobacterium avium subsp. paratuberculosis
cccgggcgcugagca

SEQ ID NO: 1015290 - RNA, 15 nt, Mycobacterium avium subsp. paratuberculosis
cccggcugcgcagcg

SEQ ID NO: 1015291 - RNA, 15 nt, Mycobacterium avium subsp. paratuberculosis
cccggcugcgccgcg

SEQ ID NO: 1015292 - RNA, 16 nt, Mycobacterium avium subsp. paratuberculosis
cccggcugcgccgcgc

SEQ ID NO: 1015293 - RNA, 23 nt, Mycobacterium avium subsp. paratuberculosis
cccggcuucgccgccgcaccggc

SEQ ID NO: 1015294 - RNA, 21 nt, Mycobacterium avium subsp. paratuberculosis
cccgggaagccgcagcaggug

SEQ ID NO: 1015295 - RNA, 21 nt, Mycobacterium avium subsp. paratuberculosis
cccgggcagcuuccgccucgg

SEQ ID NO: 1015296 - RNA, 17 nt, Mycobacterium avium subsp. paratuberculosis
cccgggcaggcggcgcg

SEQ ID NO: 1015297 - RNA, 21 nt, Mycobacterium avium subsp. paratuberculosis
cccgggcaggcggcgcgccag

SEQ ID NO: 1015298 - RNA, 12 nt, Mycobacterium avium subsp. paratuberculosis
cccgggccagga

SEQ ID NO: 1015299 - RNA, 15 nt, Mycobacterium avium subsp. paratuberculosis
cccgggccagguucg

SEQ ID NO: 1015300 - RNA, 15 nt, Mycobacterium avium subsp. paratuberculosis
cccgggccgcgccca

SEQ ID NO: 1015301 - RNA, 21 nt, Mycobacterium avium subsp. paratuberculosis
cccgggccgucaucgccgacg

SEQ ID NO: 1015302 - RNA, 11 nt, Mycobacterium avium subsp. paratuberculosis
cccgggccgca

SEQ ID NO: 1015303 - RNA, 16 nt, Mycobacterium avium subsp. paratuberculosis
cccggcgugggccgca

SEQ ID NO: 1015304 - RNA, 14 nt, Mycobacterium avium subsp. paratuberculosis
cccggcgucggagu

SEQ ID NO: 1015305 - RNA, 16 nt, Mycobacterium avium subsp. paratuberculosis
cccggcgucggagucg

SEQ ID NO: 1015306 - RNA, 20 nt, Mycobacterium avium subsp. paratuberculosis
cccggcggucggaucgagcu

SEQ ID NO: 1015307 - RNA, 17 nt, Mycobacterium avium subsp. paratuberculosis
cccggcguaguucgucg

SEQ ID NO: 1015308 - RNA, 16 nt, Mycobacterium avium subsp. paratuberculosis
cccggcggccaccaug

SEQ ID NO: 1015309 - RNA, 14 nt, Mycobacterium avium subsp. paratuberculosis
cccggcuggcaggu

SEQ ID NO: 1015310 - RNA, 19 nt, Mycobacterium avium subsp. paratuberculosis
cccggcuggcaggucgcgc

SEQ ID NO: 1015311 - RNA, 18 nt, Mycobacterium avium subsp. paratuberculosis
cccggcucggugcgccag

SEQ ID NO: 1015312 - RNA, 16 nt, Mycobacterium avium subsp. paratuberculosis
cccggcguuccagcgc

SEQ ID NO: 1015313 - RNA, 13 nt, Mycobacterium avium subsp. paratuberculosis
cccggcgccgccg

SEQ ID NO: 1015314 - RNA, 18 nt, Mycobacterium avium subsp. paratuberculosis
cccggcgcccggcgcgcc

SEQ ID NO: 1015315 - RNA, 17 nt, Mycobacterium avium subsp. paratuberculosis
cccggcgcccugcaccc

SEQ ID NO: 1015316 - RNA, 13 nt, Mycobacterium avium subsp. paratuberculosis
cccggcgcggccg

SEQ ID NO: 1015317 - RNA, 17 nt, Mycobacterium avium subsp. paratuberculosis
cccggcgcggcggcgcc

SEQ ID NO: 1015318 - RNA, 22 nt, Mycobacterium avium subsp. paratuberculosis
cccggcgcuaaagccgaccgcc

SEQ ID NO: 1015319 - RNA, 23 nt, Mycobacterium avium subsp. paratuberculosis
cccggcgcggccggugcgcguca

SEQ ID NO: 1015320 - RNA, 13 nt, Mycobacterium avium subsp. paratuberculosis
cccggcgcgccug

SEQ ID NO: 1015321 - RNA, 15 nt, Mycobacterium avium subsp. paratuberculosis
cccggcgcggccgcc

SEQ ID NO: 1015322 - RNA, 12 nt, Mycobacterium avium subsp. paratuberculosis
cccggcggcgcu

SEQ ID NO: 1015323 - RNA, 17 nt, Mycobacterium avium subsp. paratuberculosis
cccggcggcgcugcccc

SEQ ID NO: 1015324 - RNA, 15 nt, Mycobacterium avium subsp. paratuberculosis
cccggcggccggccc

SEQ ID NO: 1015325 - RNA, 15 nt, Mycobacterium avium subsp. paratuberculosis
cccggcgggccacga

SEQ ID NO: 1015326 - RNA, 15 nt, Mycobacterium avium subsp. paratuberculosis
cccggcgggccagau

SEQ ID NO: 1015327 - RNA, 15 nt, Mycobacterium avium subsp. paratuberculosis
cccggcggcaccgcc

SEQ ID NO: 1015328 - RNA, 15 nt, Mycobacterium avium subsp. paratuberculosis
cccggcgcugcgccc

SEQ ID NO: 1015329 - RNA, 12 nt, Mycobacterium avium subsp. paratuberculosis
cccggcccgccg

SEQ ID NO: 1015330 - RNA, 16 nt, Mycobacterium avium subsp. paratuberculosis
cccggccccaccgccg

SEQ ID NO: 1015331 - RNA, 19 nt, Mycobacterium avium subsp. paratuberculosis
cccggcccgucgagcggcu

SEQ ID NO: 1015332 - RNA, 13 nt, Mycobacterium avium subsp. paratuberculosis
cccggccgagccg

SEQ ID NO: 1015333 - RNA, 14 nt, Mycobacterium avium subsp. paratuberculosis
cccggccgagcgcg

SEQ ID NO: 1015334 - RNA, 17 nt, Mycobacterium avium subsp. paratuberculosis
cccggccgagcgcgccg

SEQ ID NO: 1015335 - RNA, 13 nt, Mycobacterium avium subsp. paratuberculosis
cccggccgccggg

SEQ ID NO: 1015336 - RNA, 15 nt, Mycobacterium avium subsp. paratuberculosis
cccggccgcgcaccg

SEQ ID NO: 1015337 - RNA, 18 nt, Mycobacterium avium subsp. paratuberculosis
cccggccgcacaccacca

SEQ ID NO: 1015338 - RNA, 19 nt, Mycobacterium avium subsp. paratuberculosis
cccggccgcacaccaccac

SEQ ID NO: 1015339 - RNA, 22 nt, Mycobacterium avium subsp. paratuberculosis
cccggccgcacaccaccacgug

SEQ ID NO: 1015340 - RNA, 22 nt, Mycobacterium avium subsp. paratuberculosis
cccggccucgugcaaggccugc

SEQ ID NO: 1015341 - RNA, 21 nt, Mycobacterium avium subsp. paratuberculosis
cccggccggcgcgaccagcgg

SEQ ID NO: 1015342 - RNA, 13 nt, Mycobacterium avium subsp. paratuberculosis
cccggccggcggg

SEQ ID NO: 1015343 - RNA, 21 nt, Mycobacterium avium subsp. paratuberculosis
cccggccgcgauccagcgcug

SEQ ID NO: 1015344 - RNA, 14 nt, Mycobacterium avium subsp. paratuberculosis
cccggccgcggccc

SEQ ID NO: 1015345 - RNA, 21 nt, Mycobacterium avium subsp. paratuberculosis
cccggccggucgccugcuucu

SEQ ID NO: 1015346 - RNA, 22 nt, Mycobacterium avium subsp. paratuberculosis
cccggccggucgccugcuucug

SEQ ID NO: 1015347 - RNA, 22 nt, Mycobacterium avium subsp. paratuberculosis
cccggccgguggccggugggcg

SEQ ID NO: 1015348 - RNA, 15 nt, Mycobacterium avium subsp. paratuberculosis
cccggccgugcgcag

SEQ ID NO: 1015349 - RNA, 21 nt, Mycobacterium avium subsp. paratuberculosis
cccggccguggacccgccccg

SEQ ID NO: 1015350 - RNA, 14 nt, Mycobacterium avium subsp. paratuberculosis
cccggcgccacgcc

SEQ ID NO: 1015351 - RNA, 16 nt, Mycobacterium avium subsp. paratuberculosis
cccggcgccacgccgc

SEQ ID NO: 1015352 - RNA, 17 nt, Mycobacterium avium subsp. paratuberculosis
cccggcgccacgccgcg

SEQ ID NO: 1015353 - RNA, 20 nt, Mycobacterium avium subsp. paratuberculosis
cccggcgauacccgggagca

SEQ ID NO: 1015354 - RNA, 17 nt, Mycobacterium avium subsp. paratuberculosis
cccggcgcagcgccgcg

SEQ ID NO: 1015355 - RNA, 17 nt, Mycobacterium avium subsp. paratuberculosis
cccggcgacggcgccug

SEQ ID NO: 1015356 - RNA, 18 nt, Mycobacterium avium subsp. paratuberculosis
cccggcgacggcggccgu

SEQ ID NO: 1015357 - RNA, 13 nt, Mycobacterium avium subsp. paratuberculosis
cccggcgaauucg

SEQ ID NO: 1015358 - RNA, 20 nt, Mycobacterium avium subsp. paratuberculosis
cccggcgacgucgccggccu

SEQ ID NO: 1015359 - RNA, 22 nt, Mycobacterium avium subsp. paratuberculosis
cccggcgacgucgccggccugc

SEQ ID NO: 1015360 - RNA, 13 nt, Mycobacterium avium subsp. paratuberculosis
cccggcgagcacg

SEQ ID NO: 1015361 - RNA, 16 nt, Mycobacterium avium subsp. paratuberculosis
cccggcgaggccaggc

SEQ ID NO: 1015362 - RNA, 18 nt, Mycobacterium avium subsp. paratuberculosis
cccggcgaggccaggcgu

SEQ ID NO: 1015363 - RNA, 19 nt, Mycobacterium avium subsp. paratuberculosis
cccggcgaggccaggcguu

SEQ ID NO: 1015364 - RNA, 15 nt, Mycobacterium avium subsp. paratuberculosis
cccggaucagcugac

SEQ ID NO: 1015365 - RNA, 16 nt, Mycobacterium avium subsp. paratuberculosis
cccggauccgucgccc

SEQ ID NO: 1015366 - RNA, 18 nt, Mycobacterium avium subsp. paratuberculosis
cccggauccgucgccccg

SEQ ID NO: 1015367 - RNA, 20 nt, Mycobacterium avium subsp. paratuberculosis
cccggagauccggccgcugg

SEQ ID NO: 1015368 - RNA, 14 nt, Mycobacterium avium subsp. paratuberculosis
cccggaccugccgg

SEQ ID NO: 1015369 - RNA, 14 nt, Mycobacterium avium subsp. paratuberculosis
cccggacagccacu

SEQ ID NO: 1015370 - RNA, 15 nt, Mycobacterium avium subsp. paratuberculosis
cccggacagccacuc

SEQ ID NO: 1015371 - RNA, 22 nt, Mycobacterium avium subsp. paratuberculosis
cccggacagcgcgacgcacgcc

SEQ ID NO: 1015372 - RNA, 22 nt, Mycobacterium avium subsp. paratuberculosis
cccggaccaggguggccccagc

SEQ ID NO: 1015373 - RNA, 17 nt, Mycobacterium avium subsp. paratuberculosis
cccggacccgcucgccg

SEQ ID NO: 1015374 - RNA, 14 nt, Mycobacterium avium subsp. paratuberculosis
cccggaccgccgcg

SEQ ID NO: 1015375 - RNA, 19 nt, Mycobacterium avium subsp. paratuberculosis
cccggaacgcgucgcccac

SEQ ID NO: 1015376 - RNA, 14 nt, Mycobacterium avium subsp. paratuberculosis
cccggaacggcggg

SEQ ID NO: 1015377 - RNA, 19 nt, Mycobacterium avium subsp. paratuberculosis
cccggaacccgcguggcag

SEQ ID NO: 1015378 - RNA, 16 nt, Mycobacterium avium subsp. paratuberculosis
cccggcccaccggccc

SEQ ID NO: 1015379 - RNA, 20 nt, Mycobacterium avium subsp. paratuberculosis
cccggcccacgccgucgucg

SEQ ID NO: 1015380 - RNA, 14 nt, Mycobacterium avium subsp. paratuberculosis
cccggcccagccgg

SEQ ID NO: 1015381 - RNA, 18 nt, Mycobacterium avium subsp. paratuberculosis
cccggcccaggcacagcg

SEQ ID NO: 1015382 - RNA, 17 nt, Mycobacterium avium subsp. paratuberculosis
cccggccacgccggguu

SEQ ID NO: 1015383 - RNA, 15 nt, Mycobacterium avium subsp. paratuberculosis
cccggccacucgccg

SEQ ID NO: 1015384 - RNA, 23 nt, Mycobacterium avium subsp. paratuberculosis
cccggccagcgucuccggcgggc

SEQ ID NO: 1015385 - RNA, 14 nt, Mycobacterium avium subsp. paratuberculosis
cccggccaccaggg

SEQ ID NO: 1015386 - RNA, 16 nt, Mycobacterium avium subsp. paratuberculosis
cccggccaccagggac

SEQ ID NO: 1015387 - RNA, 22 nt, Mycobacterium avium subsp. paratuberculosis
cccggccaccagggcgaccgcc

SEQ ID NO: 1015388 - RNA, 14 nt, Mycobacterium avium subsp. paratuberculosis
cccggccaccgccg

SEQ ID NO: 1015389 - RNA, 18 nt, Mycobacterium avium subsp. paratuberculosis
cccggccaccgccgccag

SEQ ID NO: 1015390 - RNA, 12 nt, Mycobacterium avium subsp. paratuberculosis
cccggccagccg

SEQ ID NO: 1015391 - RNA, 13 nt, Mycobacterium avium subsp. paratuberculosis
cccggccagccgg

SEQ ID NO: 1015392 - RNA, 21 nt, Mycobacterium avium subsp. paratuberculosis
cccggcagaucgcggcccgcc

SEQ ID NO: 1015393 - RNA, 22 nt, Mycobacterium avium subsp. paratuberculosis
cccggcagaucgcggcccgccg

SEQ ID NO: 1015394 - RNA, 20 nt, Mycobacterium avium subsp. paratuberculosis
cccggcagccgcuccggccc

SEQ ID NO: 1015395 - RNA, 20 nt, Mycobacterium avium subsp. paratuberculosis
cccggcagcggucauugaug

SEQ ID NO: 1015396 - RNA, 22 nt, Mycobacterium avium subsp. paratuberculosis
cccggaugccggcgcccagcgg

SEQ ID NO: 1015397 - RNA, 16 nt, Mycobacterium avium subsp. paratuberculosis
cccggauggagcgcga

SEQ ID NO: 1015398 - RNA, 23 nt, Mycobacterium avium subsp. paratuberculosis
cccggaugaucaacacgucgucg

SEQ ID NO: 1015399 - RNA, 21 nt, Mycobacterium avium subsp. paratuberculosis
cccgcucgcgggcccgcgccg

SEQ ID NO: 1015400 - RNA, 15 nt, Mycobacterium avium subsp. paratuberculosis
cccgcugaccaggcc

SEQ ID NO: 1015401 - RNA, 14 nt, Mycobacterium avium subsp. paratuberculosis
cccgcugcagccgg

SEQ ID NO: 1015402 - RNA, 15 nt, Mycobacterium avium subsp. paratuberculosis
cccgcugccggaccu

SEQ ID NO: 1015403 - RNA, 16 nt, Mycobacterium avium subsp. paratuberculosis
cccgcugccggaccuc

SEQ ID NO: 1015404 - RNA, 15 nt, Mycobacterium avium subsp. paratuberculosis
cccgcugcgcggccg

SEQ ID NO: 1015405 - RNA, 14 nt, Mycobacterium avium subsp. paratuberculosis
cccgcugcucgacc

SEQ ID NO: 1015406 - RNA, 18 nt, Mycobacterium avium subsp. paratuberculosis
cccgcuggggcgcaccgc

SEQ ID NO: 1015407 - RNA, 21 nt, Mycobacterium avium subsp. paratuberculosis
cccgcuggggcgcaccgccug

SEQ ID NO: 1015408 - RNA, 15 nt, Mycobacterium avium subsp. paratuberculosis
cccgcuggccgccgc

SEQ ID NO: 1015409 - RNA, 22 nt, Mycobacterium avium subsp. paratuberculosis
cccgcuggcgaauucggaaccc

SEQ ID NO: 1015410 - RNA, 20 nt, Mycobacterium avium subsp. paratuberculosis
cccgcuggaacagcgggccg

SEQ ID NO: 1015411 - RNA, 22 nt, Mycobacterium avium subsp. paratuberculosis
cccgcuggaacagcgggccggc

SEQ ID NO: 1015412 - RNA, 16 nt, Mycobacterium avium subsp. paratuberculosis
cccgcuggaacgccga

SEQ ID NO: 1015413 - RNA, 13 nt, Mycobacterium avium subsp. paratuberculosis
cccgcugcggcgc

SEQ ID NO: 1015414 - RNA, 19 nt, Mycobacterium avium subsp. paratuberculosis
cccgcucaggucggccgcg

SEQ ID NO: 1015415 - RNA, 23 nt, Mycobacterium avium subsp. paratuberculosis
cccgcucaggucggccgcggccg

SEQ ID NO: 1015416 - RNA, 18 nt, Mycobacterium avium subsp. paratuberculosis
cccgcuccgcgggcagcg

SEQ ID NO: 1015417 - RNA, 13 nt, Mycobacterium avium subsp. paratuberculosis
cccgcuccggcgg

SEQ ID NO: 1015418 - RNA, 14 nt, Mycobacterium avium subsp. paratuberculosis
cccgcucgaucugg

SEQ ID NO: 1015419 - RNA, 12 nt, Mycobacterium avium subsp. paratuberculosis
cccgcuccgcgg

SEQ ID NO: 1015420 - RNA, 13 nt, Mycobacterium avium subsp. paratuberculosis
cccgcuccuccuc

SEQ ID NO: 1015421 - RNA, 14 nt, Mycobacterium avium subsp. paratuberculosis
cccgcuccuccucg

SEQ ID NO: 1015422 - RNA, 21 nt, Mycobacterium avium subsp. paratuberculosis
cccgcuccuccucgcgccgcc

SEQ ID NO: 1015423 - RNA, 16 nt, Mycobacterium avium subsp. paratuberculosis
cccgcucggucuugau

SEQ ID NO: 1015424 - RNA, 20 nt, Mycobacterium avium subsp. paratuberculosis
cccgcucggccagcgcgccg

SEQ ID NO: 1015425 - RNA, 23 nt, Mycobacterium avium subsp. paratuberculosis
cccgcucggccagcgcgccgcac

SEQ ID NO: 1015426 - RNA, 13 nt, Mycobacterium avium subsp. paratuberculosis
cccgcuaaagccg

SEQ ID NO: 1015427 - RNA, 22 nt, Mycobacterium avium subsp. paratuberculosis
cccgcguugcggcgcagcgucu

SEQ ID NO: 1015428 - RNA, 18 nt, Mycobacterium avium subsp. paratuberculosis
cccgcguggccgccagga

SEQ ID NO: 1015429 - RNA, 19 nt, Mycobacterium avium subsp. paratuberculosis
cccgcgugggcaccccgau

SEQ ID NO: 1015430 - RNA, 18 nt, Mycobacterium avium subsp. paratuberculosis
cccgcggugugcuggcca

SEQ ID NO: 1015431 - RNA, 21 nt, Mycobacterium avium subsp. paratuberculosis
cccgcguccugcagcgccguc

SEQ ID NO: 1015432 - RNA, 23 nt, Mycobacterium avium subsp. paratuberculosis
cccgcggggcguacgcgcugccg

SEQ ID NO: 1015433 - RNA, 14 nt, Mycobacterium avium subsp. paratuberculosis
cccgcgggugcagc

SEQ ID NO: 1015434 - RNA, 13 nt, Mycobacterium avium subsp. paratuberculosis
cccgcggcgcgca

SEQ ID NO: 1015435 - RNA, 22 nt, Mycobacterium avium subsp. paratuberculosis
cccgcggcggauccagcaccgc

SEQ ID NO: 1015436 - RNA, 15 nt, Mycobacterium avium subsp. paratuberculosis
cccgcggcggcgcca

SEQ ID NO: 1015437 - RNA, 13 nt, Mycobacterium avium subsp. paratuberculosis
cccgcggccgccg

SEQ ID NO: 1015438 - RNA, 16 nt, Mycobacterium avium subsp. paratuberculosis
cccgcggccgccgccg

SEQ ID NO: 1015439 - RNA, 13 nt, Mycobacterium avium subsp. paratuberculosis
cccgcgggccaga

SEQ ID NO: 1015440 - RNA, 22 nt, Mycobacterium avium subsp. paratuberculosis
cccgcgggccagacugcgcacc

SEQ ID NO: 1015441 - RNA, 14 nt, Mycobacterium avium subsp. paratuberculosis
cccgcggccuccag

SEQ ID NO: 1015442 - RNA, 17 nt, Mycobacterium avium subsp. paratuberculosis
cccgcggccuccagccg

SEQ ID NO: 1015443 - RNA, 19 nt, Mycobacterium avium subsp. paratuberculosis
cccgcggccuccagccgcu

SEQ ID NO: 1015444 - RNA, 19 nt, Mycobacterium avium subsp. paratuberculosis
cccgcggccgcugcgccca

SEQ ID NO: 1015445 - RNA, 13 nt, Mycobacterium avium subsp. paratuberculosis
cccgcggccggcc

SEQ ID NO: 1015446 - RNA, 15 nt, Mycobacterium avium subsp. paratuberculosis
cccgcggccggccca

SEQ ID NO: 1015447 - RNA, 19 nt, Mycobacterium avium subsp. paratuberculosis
cccgcggcacgcugcgcca

SEQ ID NO: 1015448 - RNA, 23 nt, Mycobacterium avium subsp. paratuberculosis
cccgcggcacgcugcgccagccg

SEQ ID NO: 1015449 - RNA, 22 nt, Mycobacterium avium subsp. paratuberculosis
cccgcgcuggugcugcugcccc

SEQ ID NO: 1015450 - RNA, 15 nt, Mycobacterium avium subsp. paratuberculosis
cccgcgcggcggcca

SEQ ID NO: 1015451 - RNA, 17 nt, Mycobacterium avium subsp. paratuberculosis
cccgcgcgggcaagggc

SEQ ID NO: 1015452 - RNA, 12 nt, Mycobacterium avium subsp. paratuberculosis
cccgcgcugccc

SEQ ID NO: 1015453 - RNA, 15 nt, Mycobacterium avium subsp. paratuberculosis
cccgcgcugcccagc

SEQ ID NO: 1015454 - RNA, 17 nt, Mycobacterium avium subsp. paratuberculosis
cccgcgcgggggccgcc

SEQ ID NO: 1015455 - RNA, 16 nt, Mycobacterium avium subsp. paratuberculosis
cccgcgcgggguccca

SEQ ID NO: 1015456 - RNA, 17 nt, Mycobacterium avium subsp. paratuberculosis
cccgcgcggggucccaa

SEQ ID NO: 1015457 - RNA, 14 nt, Mycobacterium avium subsp. paratuberculosis
cccgcgcggugccc

SEQ ID NO: 1015458 - RNA, 13 nt, Mycobacterium avium subsp. paratuberculosis
cccgcgcggccgc

SEQ ID NO: 1015459 - RNA, 20 nt, Mycobacterium avium subsp. paratuberculosis
cccgcgcgagcgcagcgcca

SEQ ID NO: 1015460 - RNA, 21 nt, Mycobacterium avium subsp. paratuberculosis
cccgccagggcgacgccgcgg

SEQ ID NO: 1015461 - RNA, 22 nt, Mycobacterium avium subsp. paratuberculosis
cccgccagggcgacgccgcgga

SEQ ID NO: 1015462 - RNA, 20 nt, Mycobacterium avium subsp. paratuberculosis
cccgccaguucccggccagc

SEQ ID NO: 1015463 - RNA, 17 nt, Mycobacterium avium subsp. paratuberculosis
cccgccauggcggcauc

SEQ ID NO: 1015464 - RNA, 21 nt, Mycobacterium avium subsp. paratuberculosis
cccgccauggcggcaucccca

SEQ ID NO: 1015465 - RNA, 22 nt, Mycobacterium avium subsp. paratuberculosis
cccgccccgacgugcagcgcca

SEQ ID NO: 1015466 - RNA, 14 nt, Mycobacterium avium subsp. paratuberculosis
cccgcccaggccgc

SEQ ID NO: 1015467 - RNA, 17 nt, Mycobacterium avium subsp. paratuberculosis
cccgcccaggccgccag

SEQ ID NO: 1015468 - RNA, 19 nt, Mycobacterium avium subsp. paratuberculosis
cccgcccgagcgucauucc

SEQ ID NO: 1015469 - RNA, 11 nt, Mycobacterium avium subsp. paratuberculosis
cccgcccggcc

SEQ ID NO: 1015470 - RNA, 12 nt, Mycobacterium avium subsp. paratuberculosis
cccgcccggccc

SEQ ID NO: 1015471 - RNA, 14 nt, Mycobacterium avium subsp. paratuberculosis
cccgcccggcccgg

SEQ ID NO: 1015472 - RNA, 16 nt, Mycobacterium avium subsp. paratuberculosis
cccgcccggcgccggc

SEQ ID NO: 1015473 - RNA, 17 nt, Mycobacterium avium subsp. paratuberculosis
cccgcccggcgccggcc

SEQ ID NO: 1015474 - RNA, 15 nt, Mycobacterium avium subsp. paratuberculosis
cccgcccggcgcgca

SEQ ID NO: 1015475 - RNA, 22 nt, Mycobacterium avium subsp. paratuberculosis
cccgccgaacaccggcagcgcc

SEQ ID NO: 1015476 - RNA, 19 nt, Mycobacterium avium subsp. paratuberculosis
cccgccgaacccgcccucg

SEQ ID NO: 1015477 - RNA, 23 nt, Mycobacterium avium subsp. paratuberculosis
cccgccgaccaccuugcgcagca

SEQ ID NO: 1015478 - RNA, 15 nt, Mycobacterium avium subsp. paratuberculosis
cccgccacggccagc

SEQ ID NO: 1015479 - RNA, 16 nt, Mycobacterium avium subsp. paratuberculosis
cccgccacggccagca

SEQ ID NO: 1015480 - RNA, 18 nt, Mycobacterium avium subsp. paratuberculosis
cccgccagauagggcagc

SEQ ID NO: 1015481 - RNA, 13 nt, Mycobacterium avium subsp. paratuberculosis
cccgcauccgccg

SEQ ID NO: 1015482 - RNA, 18 nt, Mycobacterium avium subsp. paratuberculosis
cccgcauuccgucuuggc

SEQ ID NO: 1015483 - RNA, 23 nt, Mycobacterium avium subsp. paratuberculosis
cccgcaugcaccggugcaccgcg

SEQ ID NO: 1015484 - RNA, 13 nt, Mycobacterium avium subsp. paratuberculosis
cccgcagccgcga

SEQ ID NO: 1015485 - RNA, 15 nt, Mycobacterium avium subsp. paratuberculosis
cccgcagccgcgagu

SEQ ID NO: 1015486 - RNA, 12 nt, Mycobacterium avium subsp. paratuberculosis
cccgcagcacgc

SEQ ID NO: 1015487 - RNA, 16 nt, Mycobacterium avium subsp. paratuberculosis
cccgcagaacaccagc

SEQ ID NO: 1015488 - RNA, 17 nt, Mycobacterium avium subsp. paratuberculosis
cccgcagcgaacgcggc

SEQ ID NO: 1015489 - RNA, 14 nt, Mycobacterium avium subsp. paratuberculosis
cccgcagcgccagc

SEQ ID NO: 1015490 - RNA, 13 nt, Mycobacterium avium subsp. paratuberculosis
cccgcagcgccuc

SEQ ID NO: 1015491 - RNA, 16 nt, Mycobacterium avium subsp. paratuberculosis
cccgcagcgccucggc

SEQ ID NO: 1015492 - RNA, 23 nt, Mycobacterium avium subsp. paratuberculosis
cccgcagcgccucggcguggcag

SEQ ID NO: 1015493 - RNA, 14 nt, Mycobacterium avium subsp. paratuberculosis
cccgcagcgcggcg

SEQ ID NO: 1015494 - RNA, 14 nt, Mycobacterium avium subsp. paratuberculosis
cccgcaucgcacag

SEQ ID NO: 1015495 - RNA, 13 nt, Mycobacterium avium subsp. paratuberculosis
cccgccucgccgg

SEQ ID NO: 1015496 - RNA, 16 nt, Mycobacterium avium subsp. paratuberculosis
cccgccguuguugagc

SEQ ID NO: 1015497 - RNA, 18 nt, Mycobacterium avium subsp. paratuberculosis
cccgccguuucagcagcg

SEQ ID NO: 1015498 - RNA, 19 nt, Mycobacterium avium subsp. paratuberculosis
cccgccggguggccgccac

SEQ ID NO: 1015499 - RNA, 16 nt, Mycobacterium avium subsp. paratuberculosis
cccgccgucacgccgu

SEQ ID NO: 1015500 - RNA, 15 nt, Mycobacterium avium subsp. paratuberculosis
cccgccgugcgcccc

SEQ ID NO: 1015501 - RNA, 17 nt, Mycobacterium avium subsp. paratuberculosis
cccgccgguggccgcga

SEQ ID NO: 1015502 - RNA, 23 nt, Mycobacterium avium subsp. paratuberculosis
cccgccgggcugaccgucgacca

SEQ ID NO: 1015503 - RNA, 14 nt, Mycobacterium avium subsp. paratuberculosis
cccgccgggccgga

SEQ ID NO: 1015504 - RNA, 12 nt, Mycobacterium avium subsp. paratuberculosis
cccgccggcggc

SEQ ID NO: 1015505 - RNA, 14 nt, Mycobacterium avium subsp. paratuberculosis
cccgccggcggcca

SEQ ID NO: 1015506 - RNA, 15 nt, Mycobacterium avium subsp. paratuberculosis
cccgccggaacucgg

SEQ ID NO: 1015507 - RNA, 19 nt, Mycobacterium avium subsp. paratuberculosis
cccgccggaacucggccgg

SEQ ID NO: 1015508 - RNA, 21 nt, Mycobacterium avium subsp. paratuberculosis
cccgccggaacucggccggca

SEQ ID NO: 1015509 - RNA, 14 nt, Mycobacterium avium subsp. paratuberculosis
cccgccgcugcagc

SEQ ID NO: 1015510 - RNA, 15 nt, Mycobacterium avium subsp. paratuberculosis
cccgccggagccgau

SEQ ID NO: 1015511 - RNA, 14 nt, Mycobacterium avium subsp. paratuberculosis
cccgccgcggccag

SEQ ID NO: 1015512 - RNA, 15 nt, Mycobacterium avium subsp. paratuberculosis
cccgccgcggccgcu

SEQ ID NO: 1015513 - RNA, 21 nt, Mycobacterium avium subsp. paratuberculosis
cccgccgcggccgcuggcguu

SEQ ID NO: 1015514 - RNA, 16 nt, Mycobacterium avium subsp. paratuberculosis
cccgccgcggcgagcc

SEQ ID NO: 1015515 - RNA, 12 nt, Mycobacterium avium subsp. paratuberculosis
cccgccgcgccg

SEQ ID NO: 1015516 - RNA, 15 nt, Mycobacterium avium subsp. paratuberculosis
cccgccgccggcgcu

SEQ ID NO: 1015517 - RNA, 20 nt, Mycobacterium avium subsp. paratuberculosis
cccgccgcaccucgccggcc

SEQ ID NO: 1015518 - RNA, 14 nt, Mycobacterium avium subsp. paratuberculosis
cccgccgccaccac

SEQ ID NO: 1015519 - RNA, 22 nt, Mycobacterium avium subsp. paratuberculosis
cccgccgaccgguccgccgccg

SEQ ID NO: 1015520 - RNA, 14 nt, Mycobacterium avium subsp. paratuberculosis
cccgccgacgccug

SEQ ID NO: 1015521 - RNA, 15 nt, Mycobacterium avium subsp. paratuberculosis
cccgccgcaacagcc

SEQ ID NO: 1015522 - RNA, 18 nt, Mycobacterium avium subsp. paratuberculosis
cccgccgcaacagccggc

SEQ ID NO: 1015523 - RNA, 21 nt, Mycobacterium avium subsp. paratuberculosis
cccgccgcaacagccggcccg

SEQ ID NO: 1015524 - RNA, 23 nt, Mycobacterium avium subsp. paratuberculosis
cccgcgcaauacccgaccagcac

SEQ ID NO: 1015525 - RNA, 13 nt, Mycobacterium avium subsp. paratuberculosis
cccgcgcaccguc

SEQ ID NO: 1015526 - RNA, 22 nt, Mycobacterium avium subsp. paratuberculosis
cccgcgcaccgucaucgcggcg

SEQ ID NO: 1015527 - RNA, 15 nt, Mycobacterium avium subsp. paratuberculosis
cccgcgccacgccgc

SEQ ID NO: 1015528 - RNA, 17 nt, Mycobacterium avium subsp. paratuberculosis
cccgcgccacgccgccc

SEQ ID NO: 1015529 - RNA, 15 nt, Mycobacterium avium subsp. paratuberculosis
cccgcgccccggcgg

SEQ ID NO: 1015530 - RNA, 12 nt, Mycobacterium avium subsp. paratuberculosis
cccgcgcccgcc

SEQ ID NO: 1015531 - RNA, 11 nt, Mycobacterium avium subsp. paratuberculosis
cccgcgccgcc

SEQ ID NO: 1015532 - RNA, 12 nt, Mycobacterium avium subsp. paratuberculosis
cccgcgccgccc

SEQ ID NO: 1015533 - RNA, 13 nt, Mycobacterium avium subsp. paratuberculosis
cccgcgccgcccg

SEQ ID NO: 1015534 - RNA, 17 nt, Mycobacterium avium subsp. paratuberculosis
cccgcgccgcccggagg

SEQ ID NO: 1015535 - RNA, 12 nt, Mycobacterium avium subsp. paratuberculosis
cccgccuucucc

SEQ ID NO: 1015536 - RNA, 14 nt, Mycobacterium avium subsp. paratuberculosis
cccgcgagcugccc

SEQ ID NO: 1015537 - RNA, 14 nt, Mycobacterium avium subsp. paratuberculosis
cccgcgaucgccag

SEQ ID NO: 1015538 - RNA, 13 nt, Mycobacterium avium subsp. paratuberculosis
cccgcgacgucgg

SEQ ID NO: 1015539 - RNA, 21 nt, Mycobacterium avium subsp. paratuberculosis
cccgcgacugucggcgccccg

SEQ ID NO: 1015540 - RNA, 22 nt, Mycobacterium avium subsp. paratuberculosis
cccgcgacugucggcgccccgc

SEQ ID NO: 1015541 - RNA, 23 nt, Mycobacterium avium subsp. paratuberculosis
cccgcgacugucggcgccccgcc

SEQ ID NO: 1015542 - RNA, 16 nt, Mycobacterium avium subsp. paratuberculosis
cccgcgacggcgagcc

SEQ ID NO: 1015543 - RNA, 21 nt, Mycobacterium avium subsp. paratuberculosis
cccacagcugacgggccggcg

SEQ ID NO: 1015544 - RNA, 22 nt, Mycobacterium avium subsp. paratuberculosis
cccacagcugacgggccggcgg

SEQ ID NO: 1015545 - RNA, 21 nt, Mycobacterium avium subsp. paratuberculosis
cccaccacauucccgccgccg

SEQ ID NO: 1015546 - RNA, 14 nt, Mycobacterium avium subsp. paratuberculosis
cccaccaccagggg

SEQ ID NO: 1015547 - RNA, 13 nt, Mycobacterium avium subsp. paratuberculosis
cccaccaccgccg

SEQ ID NO: 1015548 - RNA, 15 nt, Mycobacterium avium subsp. paratuberculosis
cccaccaccgccggc

SEQ ID NO: 1015549 - RNA, 16 nt, Mycobacterium avium subsp. paratuberculosis
cccaccaccgccggcc

SEQ ID NO: 1015550 - RNA, 21 nt, Mycobacterium avium subsp. paratuberculosis
cccaccaccgccggcccaggc

SEQ ID NO: 1015551 - RNA, 23 nt, Mycobacterium avium subsp. paratuberculosis
cccaccagccgagaucgacccgc

SEQ ID NO: 1015552 - RNA, 13 nt, Mycobacterium avium subsp. paratuberculosis
cccaccaggcgcg

SEQ ID NO: 1015553 - RNA, 14 nt, Mycobacterium avium subsp. paratuberculosis
cccaccaggcgcgg

SEQ ID NO: 1015554 - RNA, 14 nt, Mycobacterium avium subsp. paratuberculosis
cccaccagccggcc

SEQ ID NO: 1015555 - RNA, 20 nt, Mycobacterium avium subsp. paratuberculosis
cccaccacgaacgcgccgcc

SEQ ID NO: 1015556 - RNA, 16 nt, Mycobacterium avium subsp. paratuberculosis
cccaccucgagcacgc

SEQ ID NO: 1015557 - RNA, 20 nt, Mycobacterium avium subsp. paratuberculosis
cccaccugaucgcggcgagc

SEQ ID NO: 1015558 - RNA, 15 nt, Mycobacterium avium subsp. paratuberculosis
cccaccgcgucgcag

SEQ ID NO: 1015559 - RNA, 20 nt, Mycobacterium avium subsp. paratuberculosis
cccaccgcgucgcagugccg

SEQ ID NO: 1015560 - RNA, 14 nt, Mycobacterium avium subsp. paratuberculosis
cccaccggcccggc

SEQ ID NO: 1015561 - RNA, 17 nt, Mycobacterium avium subsp. paratuberculosis
cccaccggcgcagcgcg

SEQ ID NO: 1015562 - RNA, 13 nt, Mycobacterium avium subsp. paratuberculosis
cccaccgggcagc

SEQ ID NO: 1015563 - RNA, 15 nt, Mycobacterium avium subsp. paratuberculosis
cccaccgggcagccg

SEQ ID NO: 1015564 - RNA, 22 nt, Mycobacterium avium subsp. paratuberculosis
cccacgccgucgacccguuccc

SEQ ID NO: 1015565 - RNA, 22 nt, Mycobacterium avium subsp. paratuberculosis
cccacgcccuagcgggccagga

SEQ ID NO: 1015566 - RNA, 20 nt, Mycobacterium avium subsp. paratuberculosis
cccaaccccccuuggcggca

SEQ ID NO: 1015567 - RNA, 20 nt, Mycobacterium avium subsp. paratuberculosis
cccaaccgcauucggccgcc

SEQ ID NO: 1015568 - RNA, 14 nt, Mycobacterium avium subsp. paratuberculosis
cccacaccguccga

SEQ ID NO: 1015569 - RNA, 17 nt, Mycobacterium avium subsp. paratuberculosis
cccacacgcucggcgag

SEQ ID NO: 1015570 - RNA, 19 nt, Mycobacterium avium subsp. paratuberculosis
cccacagcgccagcacggc

SEQ ID NO: 1015571 - RNA, 14 nt, Mycobacterium avium subsp. paratuberculosis
cccacagcgcgccc

SEQ ID NO: 1015572 - RNA, 18 nt, Mycobacterium avium subsp. paratuberculosis
cccaacacgcccugcagg

SEQ ID NO: 1015573 - RNA, 16 nt, Mycobacterium avium subsp. paratuberculosis
cccagcaguccggcgg

SEQ ID NO: 1015574 - RNA, 21 nt, Mycobacterium avium subsp. paratuberculosis
cccagccccuuguagcccucc

SEQ ID NO: 1015575 - RNA, 12 nt, Mycobacterium avium subsp. paratuberculosis
cccagcccgccg

SEQ ID NO: 1015576 - RNA, 16 nt, Mycobacterium avium subsp. paratuberculosis
cccagcccgccgcguc

SEQ ID NO: 1015577 - RNA, 22 nt, Mycobacterium avium subsp. paratuberculosis
cccagcccgcgcgagcgcagcg

SEQ ID NO: 1015578 - RNA, 17 nt, Mycobacterium avium subsp. paratuberculosis
cccagcccggaucccag

SEQ ID NO: 1015579 - RNA, 12 nt, Mycobacterium avium subsp. paratuberculosis
cccagcccggcc

SEQ ID NO: 1015580 - RNA, 23 nt, Mycobacterium avium subsp. paratuberculosis
cccagcagcggccggcgcagccg

SEQ ID NO: 1015581 - RNA, 23 nt, Mycobacterium avium subsp. paratuberculosis
cccagcagcgggcccgggcugcc

SEQ ID NO: 1015582 - RNA, 21 nt, Mycobacterium avium subsp. paratuberculosis
cccagcagcggggcgagcugg

SEQ ID NO: 1015583 - RNA, 16 nt, Mycobacterium avium subsp. paratuberculosis
cccagcagccugcccc

SEQ ID NO: 1015584 - RNA, 23 nt, Mycobacterium avium subsp. paratuberculosis
cccagccgcaggugcagcuccuu

SEQ ID NO: 1015585 - RNA, 15 nt, Mycobacterium avium subsp. paratuberculosis
cccagccgccagccg

SEQ ID NO: 1015586 - RNA, 18 nt, Mycobacterium avium subsp. paratuberculosis
cccagccggcggugcagg

SEQ ID NO: 1015587 - RNA, 13 nt, Mycobacterium avium subsp. paratuberculosis
cccagccgccgcg

SEQ ID NO: 1015588 - RNA, 13 nt, Mycobacterium avium subsp. paratuberculosis
cccagccggccga

SEQ ID NO: 1015589 - RNA, 12 nt, Mycobacterium avium subsp. paratuberculosis
cccagccgucgc

SEQ ID NO: 1015590 - RNA, 16 nt, Mycobacterium avium subsp. paratuberculosis
cccagcacggugaugc

SEQ ID NO: 1015591 - RNA, 17 nt, Mycobacterium avium subsp. paratuberculosis
cccagcacgacgccgcu

SEQ ID NO: 1015592 - RNA, 18 nt, Mycobacterium avium subsp. paratuberculosis
cccagcacgaucccgccg

SEQ ID NO: 1015593 - RNA, 18 nt, Mycobacterium avium subsp. paratuberculosis
cccagcacgaugacgacc

SEQ ID NO: 1015594 - RNA, 21 nt, Mycobacterium avium subsp. paratuberculosis
cccagcaccccgguccaggcg

SEQ ID NO: 1015595 - RNA, 17 nt, Mycobacterium avium subsp. paratuberculosis
cccagcacccgcucgcc

SEQ ID NO: 1015596 - RNA, 17 nt, Mycobacterium avium subsp. paratuberculosis
cccacucccagccgccg

SEQ ID NO: 1015597 - RNA, 15 nt, Mycobacterium avium subsp. paratuberculosis
cccagcaccaccuug

SEQ ID NO: 1015598 - RNA, 16 nt, Mycobacterium avium subsp. paratuberculosis
cccagcaccaccuugu

SEQ ID NO: 1015599 - RNA, 11 nt, Mycobacterium avium subsp. paratuberculosis
cccagcaccac

SEQ ID NO: 1015600 - RNA, 14 nt, Mycobacterium avium subsp. paratuberculosis
cccagcaccaccac

SEQ ID NO: 1015601 - RNA, 18 nt, Mycobacterium avium subsp. paratuberculosis
cccagcaccaccacguug

SEQ ID NO: 1015602 - RNA, 15 nt, Mycobacterium avium subsp. paratuberculosis
cccacgccgcccagg

SEQ ID NO: 1015603 - RNA, 19 nt, Mycobacterium avium subsp. paratuberculosis
cccacgggccauguccccg

SEQ ID NO: 1015604 - RNA, 19 nt, Mycobacterium avium subsp. paratuberculosis
cccacggugaggacaccac

SEQ ID NO: 1015605 - RNA, 14 nt, Mycobacterium avium subsp. paratuberculosis
cccacgucgcgccg

SEQ ID NO: 1015606 - RNA, 19 nt, Mycobacterium avium subsp. paratuberculosis
cccacguugagcacgcccg

SEQ ID NO: 1015607 - RNA, 19 nt, Mycobacterium avium subsp. paratuberculosis
cccacguugaucaugucga

SEQ ID NO: 1015608 - RNA, 15 nt, Mycobacterium avium subsp. paratuberculosis
cccagcgagcagguc

SEQ ID NO: 1015609 - RNA, 23 nt, Mycobacterium avium subsp. paratuberculosis
cccagcgagcucaggccggccuu

SEQ ID NO: 1015610 - RNA, 14 nt, Mycobacterium avium subsp. paratuberculosis
cccagcgagccgau

SEQ ID NO: 1015611 - RNA, 13 nt, Mycobacterium avium subsp. paratuberculosis
cccagcgagguga

SEQ ID NO: 1015612 - RNA, 16 nt, Mycobacterium avium subsp. paratuberculosis
cccagcgaggugaagc

SEQ ID NO: 1015613 - RNA, 20 nt, Mycobacterium avium subsp. paratuberculosis
cccagcgaggugaagccguu

SEQ ID NO: 1015614 - RNA, 15 nt, Mycobacterium avium subsp. paratuberculosis
cccagcgcagcgccu

SEQ ID NO: 1015615 - RNA, 19 nt, Mycobacterium avium subsp. paratuberculosis
cccagcgcagcgccucggc

SEQ ID NO: 1015616 - RNA, 12 nt, Mycobacterium avium subsp. paratuberculosis
cccagcgcagcg

SEQ ID NO: 1015617 - RNA, 13 nt, Mycobacterium avium subsp. paratuberculosis
cccagcgccagga

SEQ ID NO: 1015618 - RNA, 18 nt, Mycobacterium avium subsp. paratuberculosis
cccagcgccacuggcugg

SEQ ID NO: 1015619 - RNA, 21 nt, Mycobacterium avium subsp. paratuberculosis
cccagcggcacgggcaccgac

SEQ ID NO: 1015620 - RNA, 19 nt, Mycobacterium avium subsp. paratuberculosis
cccagcgcguugcggccgu

SEQ ID NO: 1015621 - RNA, 13 nt, Mycobacterium avium subsp. paratuberculosis
cccaggccccggc

SEQ ID NO: 1015622 - RNA, 13 nt, Mycobacterium avium subsp. paratuberculosis
cccaggcccgguu

SEQ ID NO: 1015623 - RNA, 23 nt, Mycobacterium avium subsp. paratuberculosis
cccaggccgauggugguaccgac

SEQ ID NO: 1015624 - RNA, 23 nt, Mycobacterium avium subsp. paratuberculosis
cccaggccgaguauccgcgcagc

SEQ ID NO: 1015625 - RNA, 21 nt, Mycobacterium avium subsp. paratuberculosis
cccaggccaggaucuggguga

SEQ ID NO: 1015626 - RNA, 15 nt, Mycobacterium avium subsp. paratuberculosis
cccagguacuccucg

SEQ ID NO: 1015627 - RNA, 22 nt, Mycobacterium avium subsp. paratuberculosis
cccagguacuccucggugugcu

SEQ ID NO: 1015628 - RNA, 14 nt, Mycobacterium avium subsp. paratuberculosis
cccaggggucccag

SEQ ID NO: 1015629 - RNA, 15 nt, Mycobacterium avium subsp. paratuberculosis
cccaggggagcggcg

SEQ ID NO: 1015630 - RNA, 15 nt, Mycobacterium avium subsp. paratuberculosis
cccagggcgcgucca

SEQ ID NO: 1015631 - RNA, 20 nt, Mycobacterium avium subsp. paratuberculosis
cccagggcgcguccacucca

SEQ ID NO: 1015632 - RNA, 16 nt, Mycobacterium avium subsp. paratuberculosis
cccagggcguuugcca

SEQ ID NO: 1015633 - RNA, 12 nt, Mycobacterium avium subsp. paratuberculosis
cccaggccgccg

SEQ ID NO: 1015634 - RNA, 19 nt, Mycobacterium avium subsp. paratuberculosis
cccagcggggcaagcagcg

SEQ ID NO: 1015635 - RNA, 17 nt, Mycobacterium avium subsp. paratuberculosis
cccagcggcgcggccga

SEQ ID NO: 1015636 - RNA, 20 nt, Mycobacterium avium subsp. paratuberculosis
cccagcgggacagcaccacc

SEQ ID NO: 1015637 - RNA, 13 nt, Mycobacterium avium subsp. paratuberculosis
cccagcgggcgac

SEQ ID NO: 1015638 - RNA, 23 nt, Mycobacterium avium subsp. paratuberculosis
cccaggauucccgaccccgccag

SEQ ID NO: 1015639 - RNA, 19 nt, Mycobacterium avium subsp. paratuberculosis
cccaggauuccgucggcgg

SEQ ID NO: 1015640 - RNA, 18 nt, Mycobacterium avium subsp. paratuberculosis
cccaggcacagcgaaagc

SEQ ID NO: 1015641 - RNA, 16 nt, Mycobacterium avium subsp. paratuberculosis
cccaggcagaccccca

SEQ ID NO: 1015642 - RNA, 15 nt, Mycobacterium avium subsp. paratuberculosis
cccccagcccgccgg

SEQ ID NO: 1015643 - RNA, 22 nt, Mycobacterium avium subsp. paratuberculosis
ccccagcacgaucccgccgccc

SEQ ID NO: 1015644 - RNA, 21 nt, Mycobacterium avium subsp. paratuberculosis
ccccacgccuggcggaaggcc

SEQ ID NO: 1015645 - RNA, 14 nt, Mycobacterium avium subsp. paratuberculosis
cccccgacccgaag

SEQ ID NO: 1015646 - RNA, 15 nt, Mycobacterium avium subsp. paratuberculosis
cccccgauagccccg

SEQ ID NO: 1015647 - RNA, 20 nt, Mycobacterium avium subsp. paratuberculosis
ccccccauacacgggccguc

SEQ ID NO: 1015648 - RNA, 19 nt, Mycobacterium avium subsp. paratuberculosis
ccccgagcgggccuucacg

SEQ ID NO: 1015649 - RNA, 14 nt, Mycobacterium avium subsp. paratuberculosis
cccccgcgccgccc

SEQ ID NO: 1015650 - RNA, 15 nt, Mycobacterium avium subsp. paratuberculosis
cccccgcgccgcccg

SEQ ID NO: 1015651 - RNA, 13 nt, Mycobacterium avium subsp. paratuberculosis
ccccgacgugcag

SEQ ID NO: 1015652 - RNA, 15 nt, Mycobacterium avium subsp. paratuberculosis
ccccgacgugcagcg

SEQ ID NO: 1015653 - RNA, 15 nt, Mycobacterium avium subsp. paratuberculosis
cccccgcacgccagc

SEQ ID NO: 1015654 - RNA, 12 nt, Mycobacterium avium subsp. paratuberculosis
cccccgcccggc

SEQ ID NO: 1015655 - RNA, 21 nt, Mycobacterium avium subsp. paratuberculosis
cccccgccgcgagcagacaca

SEQ ID NO: 1015656 - RNA, 13 nt, Mycobacterium avium subsp. paratuberculosis
ccccgccagcacc

SEQ ID NO: 1015657 - RNA, 16 nt, Mycobacterium avium subsp. paratuberculosis
ccccgcccggcaacac

SEQ ID NO: 1015658 - RNA, 11 nt, Mycobacterium avium subsp. paratuberculosis
ccccgcagcuc

SEQ ID NO: 1015659 - RNA, 19 nt, Mycobacterium avium subsp. paratuberculosis
ccccgcagaacaccagcgc

SEQ ID NO: 1015660 - RNA, 23 nt, Mycobacterium avium subsp. paratuberculosis
ccccgaggagacgucggccgggu

SEQ ID NO: 1015661 - RNA, 13 nt, Mycobacterium avium subsp. paratuberculosis
ccccgcacgccag

SEQ ID NO: 1015662 - RNA, 15 nt, Mycobacterium avium subsp. paratuberculosis
ccccgauccggcuga

SEQ ID NO: 1015663 - RNA, 20 nt, Mycobacterium avium subsp. paratuberculosis
ccccgaucaacaccgccagc

SEQ ID NO: 1015664 - RNA, 17 nt, Mycobacterium avium subsp. paratuberculosis
ccccaauugccgggcca

SEQ ID NO: 1015665 - RNA, 21 nt, Mycobacterium avium subsp. paratuberculosis
ccccacaccuucgcggucggc

SEQ ID NO: 1015666 - RNA, 21 nt, Mycobacterium avium subsp. paratuberculosis
ccccaccaccgacagcacccg

SEQ ID NO: 1015667 - RNA, 13 nt, Mycobacterium avium subsp. paratuberculosis
ccccaccaccgcc

SEQ ID NO: 1015668 - RNA, 23 nt, Mycobacterium avium subsp. paratuberculosis
ccccaccaccgccggcccaggca

SEQ ID NO: 1015669 - RNA, 17 nt, Mycobacterium avium subsp. paratuberculosis
ccccaccgagcagcugc

SEQ ID NO: 1015670 - RNA, 23 nt, Mycobacterium avium subsp. paratuberculosis
ccccacccagguguccggcccga

SEQ ID NO: 1015671 - RNA, 17 nt, Mycobacterium avium subsp. paratuberculosis
ccccacgccaugugccg

SEQ ID NO: 1015672 - RNA, 13 nt, Mycobacterium avium subsp. paratuberculosis
ccccaaccuggac

SEQ ID NO: 1015673 - RNA, 15 nt, Mycobacterium avium subsp. paratuberculosis
cccaugucgcgggcg

SEQ ID NO: 1015674 - RNA, 12 nt, Mycobacterium avium subsp. paratuberculosis
cccagggugcgc

SEQ ID NO: 1015675 - RNA, 14 nt, Mycobacterium avium subsp. paratuberculosis
cccaggucgcccag

SEQ ID NO: 1015676 - RNA, 18 nt, Mycobacterium avium subsp. paratuberculosis
cccaggugcagaccggac

SEQ ID NO: 1015677 - RNA, 13 nt, Mycobacterium avium subsp. paratuberculosis
cccaggucggcgu

SEQ ID NO: 1015678 - RNA, 21 nt, Mycobacterium avium subsp. paratuberculosis
cccaggucgggacguccgcgc

SEQ ID NO: 1015679 - RNA, 21 nt, Mycobacterium avium subsp. paratuberculosis
cccaggucuucucguccgcgc

SEQ ID NO: 1015680 - RNA, 19 nt, Mycobacterium avium subsp. paratuberculosis
cccauggcgaacaggaugc

SEQ ID NO: 1015681 - RNA, 13 nt, Mycobacterium avium subsp. paratuberculosis
cccaugccccagg

SEQ ID NO: 1015682 - RNA, 12 nt, Mycobacterium avium subsp. paratuberculosis
cccgaucaccag

SEQ ID NO: 1015683 - RNA, 13 nt, Mycobacterium avium subsp. paratuberculosis
cccgaucaccgcc

SEQ ID NO: 1015684 - RNA, 14 nt, Mycobacterium avium subsp. paratuberculosis
cccgaucaccgccg

SEQ ID NO: 1015685 - RNA, 16 nt, Mycobacterium avium subsp. paratuberculosis
cccgaucaccuugccc

SEQ ID NO: 1015686 - RNA, 18 nt, Mycobacterium avium subsp. paratuberculosis
cccgaucaggguccaggg

SEQ ID NO: 1015687 - RNA, 21 nt, Mycobacterium avium subsp. paratuberculosis
cccgaucggggccaggaugcc

SEQ ID NO: 1015688 - RNA, 16 nt, Mycobacterium avium subsp. paratuberculosis
cccgaucgugcgccca

SEQ ID NO: 1015689 - RNA, 17 nt, Mycobacterium avium subsp. paratuberculosis
cccgaucgugcgcccau

SEQ ID NO: 1015690 - RNA, 14 nt, Mycobacterium avium subsp. paratuberculosis
cccgagagcugcug

SEQ ID NO: 1015691 - RNA, 21 nt, Mycobacterium avium subsp. paratuberculosis
cccgacuucggcucggcgaca

SEQ ID NO: 1015692 - RNA, 16 nt, Mycobacterium avium subsp. paratuberculosis
cccgagaucccagcgg

SEQ ID NO: 1015693 - RNA, 18 nt, Mycobacterium avium subsp. paratuberculosis
cccgagcaccgggccgaa

SEQ ID NO: 1015694 - RNA, 19 nt, Mycobacterium avium subsp. paratuberculosis
cccgagcaccugaacggcc

SEQ ID NO: 1015695 - RNA, 18 nt, Mycobacterium avium subsp. paratuberculosis
cccgagcauuucgcgcac

SEQ ID NO: 1015696 - RNA, 13 nt, Mycobacterium avium subsp. paratuberculosis
cccgagcgggccu

SEQ ID NO: 1015697 - RNA, 23 nt, Mycobacterium avium subsp. paratuberculosis
cccgagcgucauuccgccgcgcc

SEQ ID NO: 1015698 - RNA, 16 nt, Mycobacterium avium subsp. paratuberculosis
cccgagcucgggcgcg

SEQ ID NO: 1015699 - RNA, 16 nt, Mycobacterium avium subsp. paratuberculosis
cccgaggaugccgccc

SEQ ID NO: 1015700 - RNA, 18 nt, Mycobacterium avium subsp. paratuberculosis
cccgaggaugccgcccac

SEQ ID NO: 1015701 - RNA, 16 nt, Mycobacterium avium subsp. paratuberculosis
cccgcaaggccgccag

SEQ ID NO: 1015702 - RNA, 17 nt, Mycobacterium avium subsp. paratuberculosis
cccgcaaggccgccagc

SEQ ID NO: 1015703 - RNA, 14 nt, Mycobacterium avium subsp. paratuberculosis
cccgcacaccggcc

SEQ ID NO: 1015704 - RNA, 13 nt, Mycobacterium avium subsp. paratuberculosis
cccgcaccaccca

SEQ ID NO: 1015705 - RNA, 17 nt, Mycobacterium avium subsp. paratuberculosis
cccgcacgugcgcgccg

SEQ ID NO: 1015706 - RNA, 13 nt, Mycobacterium avium subsp. paratuberculosis
cccgcaccgcccc

SEQ ID NO: 1015707 - RNA, 12 nt, Mycobacterium avium subsp. paratuberculosis
cccgcacccgcc

SEQ ID NO: 1015708 - RNA, 14 nt, Mycobacterium avium subsp. paratuberculosis
cccgcaccucgccc

SEQ ID NO: 1015709 - RNA, 17 nt, Mycobacterium avium subsp. paratuberculosis
cccgauucagccggcgg

SEQ ID NO: 1015710 - RNA, 17 nt, Mycobacterium avium subsp. paratuberculosis
cccgauuccccggcgug

SEQ ID NO: 1015711 - RNA, 19 nt, Mycobacterium avium subsp. paratuberculosis
cccgauggugaaccacuuc

SEQ ID NO: 1015712 - RNA, 16 nt, Mycobacterium avium subsp. paratuberculosis
cccgauggcggccugc

SEQ ID NO: 1015713 - RNA, 21 nt, Mycobacterium avium subsp. paratuberculosis
cccgaugcggugccgggccag

SEQ ID NO: 1015714 - RNA, 15 nt, Mycobacterium avium subsp. paratuberculosis
cccgaugcucccggu

SEQ ID NO: 1015715 - RNA, 15 nt, Mycobacterium avium subsp. paratuberculosis
cccgcaacgcgcgcg

SEQ ID NO: 1015716 - RNA, 21 nt, Mycobacterium avium subsp. paratuberculosis
cccgacaccgccagcagcgcc

SEQ ID NO: 1015717 - RNA, 22 nt, Mycobacterium avium subsp. paratuberculosis
cccgacaccgccagcagcgccg

SEQ ID NO: 1015718 - RNA, 15 nt, Mycobacterium avium subsp. paratuberculosis
cccgacaccgccccg

SEQ ID NO: 1015719 - RNA, 16 nt, Mycobacterium avium subsp. paratuberculosis
cccgaaccgcccgccc

SEQ ID NO: 1015720 - RNA, 19 nt, Mycobacterium avium subsp. paratuberculosis
cccgaacagccgggcggcc

SEQ ID NO: 1015721 - RNA, 17 nt, Mycobacterium avium subsp. paratuberculosis
cccgaaacugggaguug

SEQ ID NO: 1015722 - RNA, 14 nt, Mycobacterium avium subsp. paratuberculosis
cccgaaagggucug

SEQ ID NO: 1015723 - RNA, 21 nt, Mycobacterium avium subsp. paratuberculosis
cccgaaaagguauucgcgcaa

SEQ ID NO: 1015724 - RNA, 22 nt, Mycobacterium avium subsp. paratuberculosis
cccgaaaaauaggugaccucga

SEQ ID NO: 1015725 - RNA, 15 nt, Mycobacterium avium subsp. paratuberculosis
cccgacagcaacgcc

SEQ ID NO: 1015726 - RNA, 23 nt, Mycobacterium avium subsp. paratuberculosis
cccgacauccaggaccgcgcgcc

SEQ ID NO: 1015727 - RNA, 22 nt, Mycobacterium avium subsp. paratuberculosis
cccgacaucgccaucagcagcg

SEQ ID NO: 1015728 - RNA, 22 nt, Mycobacterium avium subsp. paratuberculosis
cccgaccacaccggcgcugccc

SEQ ID NO: 1015729 - RNA, 20 nt, Mycobacterium avium subsp. paratuberculosis
cccgaccgcgaugcagaaca

SEQ ID NO: 1015730 - RNA, 12 nt, Mycobacterium avium subsp. paratuberculosis
cccgaccagcug

SEQ ID NO: 1015731 - RNA, 20 nt, Mycobacterium avium subsp. paratuberculosis
cccgaccaucauggccuccc

SEQ ID NO: 1015732 - RNA, 20 nt, Mycobacterium avium subsp. paratuberculosis
cccgacccgcaccaccgccc

SEQ ID NO: 1015733 - RNA, 13 nt, Mycobacterium avium subsp. paratuberculosis
cccgacgcggcgc

SEQ ID NO: 1015734 - RNA, 17 nt, Mycobacterium avium subsp. paratuberculosis
cccgacggcagcaccgc

SEQ ID NO: 1015735 - RNA, 19 nt, Mycobacterium avium subsp. paratuberculosis
cccgacgggaacucggcca

SEQ ID NO: 1015736 - RNA, 20 nt, Mycobacterium avium subsp. paratuberculosis
cccgacgggcgugccggcgg

SEQ ID NO: 1015737 - RNA, 21 nt, Mycobacterium avium subsp. paratuberculosis
cccgacggguucgcgcagcca

SEQ ID NO: 1015738 - RNA, 19 nt, Mycobacterium avium subsp. paratuberculosis
cccgacuccucacaccucg

SEQ ID NO: 1015739 - RNA, 17 nt, Mycobacterium avium subsp. paratuberculosis
ccccucgacguccaggc

SEQ ID NO: 1015740 - RNA, 21 nt, Mycobacterium avium subsp. paratuberculosis
ccccucgacguccaggccggc

SEQ ID NO: 1015741 - RNA, 12 nt, Mycobacterium avium subsp. paratuberculosis
ccccucgcgcaa

SEQ ID NO: 1015742 - RNA, 17 nt, Mycobacterium avium subsp. paratuberculosis
ccccuuggcggcaagcc

SEQ ID NO: 1015743 - RNA, 15 nt, Mycobacterium avium subsp. paratuberculosis
ccccgcgccgcccgg

SEQ ID NO: 1015744 - RNA, 22 nt, Mycobacterium avium subsp. paratuberculosis
ccccgcgcgaucaggccggcca

SEQ ID NO: 1015745 - RNA, 18 nt, Mycobacterium avium subsp. paratuberculosis
ccccgcgcgcgggccagc

SEQ ID NO: 1015746 - RNA, 19 nt, Mycobacterium avium subsp. paratuberculosis
ccccgcgcgcgggccagcg

SEQ ID NO: 1015747 - RNA, 18 nt, Mycobacterium avium subsp. paratuberculosis
ccccgccggggccggcga

SEQ ID NO: 1015748 - RNA, 16 nt, Mycobacterium avium subsp. paratuberculosis
ccccgccgguggcggc

SEQ ID NO: 1015749 - RNA, 20 nt, Mycobacterium avium subsp. paratuberculosis
ccccgccgcgccgggcgccc

SEQ ID NO: 1015750 - RNA, 23 nt, Mycobacterium avium subsp. paratuberculosis
ccccgccgcgucggucagcgcca

SEQ ID NO: 1015751 - RNA, 15 nt, Mycobacterium avium subsp. paratuberculosis
ccccgcgugacggcc

SEQ ID NO: 1015752 - RNA, 18 nt, Mycobacterium avium subsp. paratuberculosis
ccccgcgugacggccgcg

SEQ ID NO: 1015753 - RNA, 15 nt, Mycobacterium avium subsp. paratuberculosis
ccccgcucccauccg

SEQ ID NO: 1015754 - RNA, 22 nt, Mycobacterium avium subsp. paratuberculosis
ccagcucgcguucgggcccggc

SEQ ID NO: 1015755 - RNA, 22 nt, Mycobacterium avium subsp. paratuberculosis
ccagcuccucgauggucgucgg

SEQ ID NO: 1015756 - RNA, 14 nt, Mycobacterium avium subsp. paratuberculosis
ccagcuccucggcc

SEQ ID NO: 1015757 - RNA, 17 nt, Mycobacterium avium subsp. paratuberculosis
ccagcuccucggccagc

SEQ ID NO: 1015758 - RNA, 17 nt, Mycobacterium avium subsp. paratuberculosis
ccagcuccucggucagc

SEQ ID NO: 1015759 - RNA, 17 nt, Mycobacterium avium subsp. paratuberculosis
ccagcucgacgacuucg

SEQ ID NO: 1015760 - RNA, 23 nt, Mycobacterium avium subsp. paratuberculosis
ccagcucgacgacuucggccucg

SEQ ID NO: 1015761 - RNA, 16 nt, Mycobacterium avium subsp. paratuberculosis
ccagcucgaggccgcg

SEQ ID NO: 1015762 - RNA, 17 nt, Mycobacterium avium subsp. paratuberculosis
ccagcucgaggccgcgg

SEQ ID NO: 1015763 - RNA, 17 nt, Mycobacterium avium subsp. paratuberculosis
ccagcgucgcgccgcca

SEQ ID NO: 1015764 - RNA, 15 nt, Mycobacterium avium subsp. paratuberculosis
ccagcgucgcggccg

SEQ ID NO: 1015765 - RNA, 17 nt, Mycobacterium avium subsp. paratuberculosis
ccagcgucuccggcggg

SEQ ID NO: 1015766 - RNA, 21 nt, Mycobacterium avium subsp. paratuberculosis
ccagcgucucgaugaccucgc

SEQ ID NO: 1015767 - RNA, 16 nt, Mycobacterium avium subsp. paratuberculosis
ccagcgucuggcagcc

SEQ ID NO: 1015768 - RNA, 23 nt, Mycobacterium avium subsp. paratuberculosis
ccagcgucuugacgaacuccugc

SEQ ID NO: 1015769 - RNA, 20 nt, Mycobacterium avium subsp. paratuberculosis
ccagcguuccagcacccggc

SEQ ID NO: 1015770 - RNA, 21 nt, Mycobacterium avium subsp. paratuberculosis
ccagcggggcgaccuugcgca

SEQ ID NO: 1015771 - RNA, 21 nt, Mycobacterium avium subsp. paratuberculosis
ccagcgggguguucaccgcgc

SEQ ID NO: 1015772 - RNA, 15 nt, Mycobacterium avium subsp. paratuberculosis
ccagcggguccagcc

SEQ ID NO: 1015773 - RNA, 22 nt, Mycobacterium avium subsp. paratuberculosis
ccagcgggucgugcaucggcgc

SEQ ID NO: 1015774 - RNA, 15 nt, Mycobacterium avium subsp. paratuberculosis
ccagcggggcaagca

SEQ ID NO: 1015775 - RNA, 13 nt, Mycobacterium avium subsp. paratuberculosis
ccagcgggcuguc

SEQ ID NO: 1015776 - RNA, 18 nt, Mycobacterium avium subsp. paratuberculosis
ccagcgggcugucggcgc

SEQ ID NO: 1015777 - RNA, 13 nt, Mycobacterium avium subsp. paratuberculosis
ccagcgggacagc

SEQ ID NO: 1015778 - RNA, 16 nt, Mycobacterium avium subsp. paratuberculosis
ccagcgggccgacagc

SEQ ID NO: 1015779 - RNA, 19 nt, Mycobacterium avium subsp. paratuberculosis
ccagcgggccgaccuggcg

SEQ ID NO: 1015780 - RNA, 16 nt, Mycobacterium avium subsp. paratuberculosis
ccagcgggccgugccg

SEQ ID NO: 1015781 - RNA, 20 nt, Mycobacterium avium subsp. paratuberculosis
ccagcgggccgugccgccau

SEQ ID NO: 1015782 - RNA, 22 nt, Mycobacterium avium subsp. paratuberculosis
ccagcggcuguagcacccggcc

SEQ ID NO: 1015783 - RNA, 16 nt, Mycobacterium avium subsp. paratuberculosis
ccagcgcuggccggcc

SEQ ID NO: 1015784 - RNA, 23 nt, Mycobacterium avium subsp. paratuberculosis
ccagcgcuggccggccaccagcg

SEQ ID NO: 1015785 - RNA, 17 nt, Mycobacterium avium subsp. paratuberculosis
ccagcgcgucggccagc

SEQ ID NO: 1015786 - RNA, 16 nt, Mycobacterium avium subsp. paratuberculosis
ccagcgcguugaagcu

SEQ ID NO: 1015787 - RNA, 19 nt, Mycobacterium avium subsp. paratuberculosis
ccagcgcguugaagcugac

SEQ ID NO: 1015788 - RNA, 16 nt, Mycobacterium avium subsp. paratuberculosis
ccagcggcacgaucuc

SEQ ID NO: 1015789 - RNA, 19 nt, Mycobacterium avium subsp. paratuberculosis
ccagcggacccuucagcca

SEQ ID NO: 1015790 - RNA, 17 nt, Mycobacterium avium subsp. paratuberculosis
ccagcgccacggguuga

SEQ ID NO: 1015791 - RNA, 12 nt, Mycobacterium avium subsp. paratuberculosis
ccagcgcccgcc

SEQ ID NO: 1015792 - RNA, 15 nt, Mycobacterium avium subsp. paratuberculosis
ccagcgccggcacca

SEQ ID NO: 1015793 - RNA, 21 nt, Mycobacterium avium subsp. paratuberculosis
ccagcgccggcaccagcagcc

SEQ ID NO: 1015794 - RNA, 20 nt, Mycobacterium avium subsp. paratuberculosis
ccagcgccgcgcgcgcggcc

SEQ ID NO: 1015795 - RNA, 23 nt, Mycobacterium avium subsp. paratuberculosis
ccagcgccgcgcgcgcggccucc

SEQ ID NO: 1015796 - RNA, 13 nt, Mycobacterium avium subsp. paratuberculosis
ccagcgccgcggc

SEQ ID NO: 1015797 - RNA, 20 nt, Mycobacterium avium subsp. paratuberculosis
ccagcgccgucaucaccgcc

SEQ ID NO: 1015798 - RNA, 22 nt, Mycobacterium avium subsp. paratuberculosis
ccagcgccgucaucaccgccga

SEQ ID NO: 1015799 - RNA, 21 nt, Mycobacterium avium subsp. paratuberculosis
ccagcgccgagccgaggcaga

SEQ ID NO: 1015800 - RNA, 15 nt, Mycobacterium avium subsp. paratuberculosis
ccagcgcgaacagcg

SEQ ID NO: 1015801 - RNA, 18 nt, Mycobacterium avium subsp. paratuberculosis
ccagcgcgacgcgcaugc

SEQ ID NO: 1015802 - RNA, 14 nt, Mycobacterium avium subsp. paratuberculosis
ccagcgccucggcc

SEQ ID NO: 1015803 - RNA, 17 nt, Mycobacterium avium subsp. paratuberculosis
ccagcgcgccggccagc

SEQ ID NO: 1015804 - RNA, 16 nt, Mycobacterium avium subsp. paratuberculosis
ccagcgcgccgcccag

SEQ ID NO: 1015805 - RNA, 17 nt, Mycobacterium avium subsp. paratuberculosis
ccagcgcgccgcccagc

SEQ ID NO: 1015806 - RNA, 14 nt, Mycobacterium avium subsp. paratuberculosis
ccagcgcgccgccg

SEQ ID NO: 1015807 - RNA, 16 nt, Mycobacterium avium subsp. paratuberculosis
ccagcgcgacgucgac

SEQ ID NO: 1015808 - RNA, 19 nt, Mycobacterium avium subsp. paratuberculosis
ccagcgcgcacgcggacac

SEQ ID NO: 1015809 - RNA, 18 nt, Mycobacterium avium subsp. paratuberculosis
ccagcgcgcagaacacca

SEQ ID NO: 1015810 - RNA, 20 nt, Mycobacterium avium subsp. paratuberculosis
ccagcgcgcagaacaccacc

SEQ ID NO: 1015811 - RNA, 14 nt, Mycobacterium avium subsp. paratuberculosis
ccagcgcgcccgcc

SEQ ID NO: 1015812 - RNA, 23 nt, Mycobacterium avium subsp. paratuberculosis
ccagcgcgccgaucgcccagugc

SEQ ID NO: 1015813 - RNA, 21 nt, Mycobacterium avium subsp. paratuberculosis
ccagcgcggccgggcgccccg

SEQ ID NO: 1015814 - RNA, 21 nt, Mycobacterium avium subsp. paratuberculosis
ccagcgcggcgaucagcagca

SEQ ID NO: 1015815 - RNA, 17 nt, Mycobacterium avium subsp. paratuberculosis
ccagcgcggccaccacc

SEQ ID NO: 1015816 - RNA, 20 nt, Mycobacterium avium subsp. paratuberculosis
ccagcgcggacaccagguug

SEQ ID NO: 1015817 - RNA, 20 nt, Mycobacterium avium subsp. paratuberculosis
ccagcgcgcgggcguccucg

SEQ ID NO: 1015818 - RNA, 15 nt, Mycobacterium avium subsp. paratuberculosis
ccagcgcgcgcagcg

SEQ ID NO: 1015819 - RNA, 14 nt, Mycobacterium avium subsp. paratuberculosis
ccagcgcgucggcc

SEQ ID NO: 1015820 - RNA, 18 nt, Mycobacterium avium subsp. paratuberculosis
ccagcgcguagucggcgu

SEQ ID NO: 1015821 - RNA, 22 nt, Mycobacterium avium subsp. paratuberculosis
ccagcgcgucgcacagcgccgc

SEQ ID NO: 1015822 - RNA, 17 nt, Mycobacterium avium subsp. paratuberculosis
ccagcgcggcggccacc

SEQ ID NO: 1015823 - RNA, 23 nt, Mycobacterium avium subsp. paratuberculosis
ccagcgcggcggccagcucggcc

SEQ ID NO: 1015824 - RNA, 21 nt, Mycobacterium avium subsp. paratuberculosis
ccagcgcggugaagucggugc

SEQ ID NO: 1015825 - RNA, 18 nt, Mycobacterium avium subsp. paratuberculosis
ccagcgcggugagcagca

SEQ ID NO: 1015826 - RNA, 23 nt, Mycobacterium avium subsp. paratuberculosis
ccagcgcggugagcagcaugccg

SEQ ID NO: 1015827 - RNA, 20 nt, Mycobacterium avium subsp. paratuberculosis
ccagcgcggugaugugcagg

SEQ ID NO: 1015828 - RNA, 17 nt, Mycobacterium avium subsp. paratuberculosis
ccagcgcggugcccagc

SEQ ID NO: 1015829 - RNA, 18 nt, Mycobacterium avium subsp. paratuberculosis
ccagcuggagaggcccgg

SEQ ID NO: 1015830 - RNA, 19 nt, Mycobacterium avium subsp. paratuberculosis
ccagcuggagaggcccggc

SEQ ID NO: 1015831 - RNA, 17 nt, Mycobacterium avium subsp. paratuberculosis
ccagcuggauggcgccc

SEQ ID NO: 1015832 - RNA, 17 nt, Mycobacterium avium subsp. paratuberculosis
ccagcugcgcgucggcc

SEQ ID NO: 1015833 - RNA, 21 nt, Mycobacterium avium subsp. paratuberculosis
ccagcugcggaaaugcccgcg

SEQ ID NO: 1015834 - RNA, 22 nt, Mycobacterium avium subsp. paratuberculosis
ccagcugcggaaaugcccgcgc

SEQ ID NO: 1015835 - RNA, 13 nt, Mycobacterium avium subsp. paratuberculosis
ccagcugcgcgcc

SEQ ID NO: 1015836 - RNA, 18 nt, Mycobacterium avium subsp. paratuberculosis
ccagcugcgcgccggcgg

SEQ ID NO: 1015837 - RNA, 21 nt, Mycobacterium avium subsp. paratuberculosis
ccagcugcgaaucgucggcga

SEQ ID NO: 1015838 - RNA, 14 nt, Mycobacterium avium subsp. paratuberculosis
ccagcugcgacagc

SEQ ID NO: 1015839 - RNA, 22 nt, Mycobacterium avium subsp. paratuberculosis
ccagcugauuguugacggugac

SEQ ID NO: 1015840 - RNA, 22 nt, Mycobacterium avium subsp. paratuberculosis
ccagcugcaccggggccggcgg

SEQ ID NO: 1015841 - RNA, 18 nt, Mycobacterium avium subsp. paratuberculosis
ccagcugauagccgcccu

SEQ ID NO: 1015842 - RNA, 16 nt, Mycobacterium avium subsp. paratuberculosis
ccagcugcccaccagc

SEQ ID NO: 1015843 - RNA, 18 nt, Mycobacterium avium subsp. paratuberculosis
ccagcucggcgcugucgg

SEQ ID NO: 1015844 - RNA, 22 nt, Mycobacterium avium subsp. paratuberculosis
ccaggaccacccacucccagcc

SEQ ID NO: 1015845 - RNA, 21 nt, Mycobacterium avium subsp. paratuberculosis
ccaggaucucgcgggcccgcg

SEQ ID NO: 1015846 - RNA, 20 nt, Mycobacterium avium subsp. paratuberculosis
ccaggaugaccgcccaggac

SEQ ID NO: 1015847 - RNA, 16 nt, Mycobacterium avium subsp. paratuberculosis
ccaggaugaucuucuc

SEQ ID NO: 1015848 - RNA, 14 nt, Mycobacterium avium subsp. paratuberculosis
ccaggaccgcgcgc

SEQ ID NO: 1015849 - RNA, 15 nt, Mycobacterium avium subsp. paratuberculosis
ccaggacuccuuggg

SEQ ID NO: 1015850 - RNA, 20 nt, Mycobacterium avium subsp. paratuberculosis
ccaggaucuugucggcggcc

SEQ ID NO: 1015851 - RNA, 14 nt, Mycobacterium avium subsp. paratuberculosis
ccaggacaacgcag

SEQ ID NO: 1015852 - RNA, 15 nt, Mycobacterium avium subsp. paratuberculosis
ccaggaauucgggca

SEQ ID NO: 1015853 - RNA, 15 nt, Mycobacterium avium subsp. paratuberculosis
ccaggcccagcccgg

SEQ ID NO: 1015854 - RNA, 12 nt, Mycobacterium avium subsp. paratuberculosis
ccaggcccuccu

SEQ ID NO: 1015855 - RNA, 16 nt, Mycobacterium avium subsp. paratuberculosis
ccaggcccaccgucgc

SEQ ID NO: 1015856 - RNA, 22 nt, Mycobacterium avium subsp. paratuberculosis
ccaggcccaccgucgccacgau

SEQ ID NO: 1015857 - RNA, 13 nt, Mycobacterium avium subsp. paratuberculosis
ccaggcccagccc

SEQ ID NO: 1015858 - RNA, 14 nt, Mycobacterium avium subsp. paratuberculosis
ccaggcccagccca

SEQ ID NO: 1015859 - RNA, 19 nt, Mycobacterium avium subsp. paratuberculosis
ccaggccaacagcagcaga

SEQ ID NO: 1015860 - RNA, 15 nt, Mycobacterium avium subsp. paratuberculosis
ccaggccacccgggc

SEQ ID NO: 1015861 - RNA, 19 nt, Mycobacterium avium subsp. paratuberculosis
ccaggauucccgaccccgc

SEQ ID NO: 1015862 - RNA, 15 nt, Mycobacterium avium subsp. paratuberculosis
ccaggaugcccagga

SEQ ID NO: 1015863 - RNA, 19 nt, Mycobacterium avium subsp. paratuberculosis
ccaggaugcccaggaugau

SEQ ID NO: 1015864 - RNA, 22 nt, Mycobacterium avium subsp. paratuberculosis
ccaggaugucggacucgcgccg

SEQ ID NO: 1015865 - RNA, 14 nt, Mycobacterium avium subsp. paratuberculosis
ccaggccggcgccg

SEQ ID NO: 1015866 - RNA, 15 nt, Mycobacterium avium subsp. paratuberculosis
ccaggccgccgccac

SEQ ID NO: 1015867 - RNA, 17 nt, Mycobacterium avium subsp. paratuberculosis
ccaggccggcgacgccg

SEQ ID NO: 1015868 - RNA, 23 nt, Mycobacterium avium subsp. paratuberculosis
ccaggccggcgagcucgcggccg

SEQ ID NO: 1015869 - RNA, 20 nt, Mycobacterium avium subsp. paratuberculosis
ccaggccggccugccggaug

SEQ ID NO: 1015870 - RNA, 13 nt, Mycobacterium avium subsp. paratuberculosis
ccaggccgccgcc

SEQ ID NO: 1015871 - RNA, 17 nt, Mycobacterium avium subsp. paratuberculosis
ccaggccgaagacgaug

SEQ ID NO: 1015872 - RNA, 14 nt, Mycobacterium avium subsp. paratuberculosis
ccaggccgaugaug

SEQ ID NO: 1015873 - RNA, 20 nt, Mycobacterium avium subsp. paratuberculosis
ccaggccgacgccggccacc

SEQ ID NO: 1015874 - RNA, 23 nt, Mycobacterium avium subsp. paratuberculosis
ccaggccgacgccggccaccaac

SEQ ID NO: 1015875 - RNA, 21 nt, Mycobacterium avium subsp. paratuberculosis
ccaggcgugcacccgguucug

SEQ ID NO: 1015876 - RNA, 17 nt, Mycobacterium avium subsp. paratuberculosis
ccaggcguugcaccgcg

SEQ ID NO: 1015877 - RNA, 22 nt, Mycobacterium avium subsp. paratuberculosis
ccaggcguuggucaccaucagc

SEQ ID NO: 1015878 - RNA, 21 nt, Mycobacterium avium subsp. paratuberculosis
ccaggcucacgcugccaaagu

SEQ ID NO: 1015879 - RNA, 21 nt, Mycobacterium avium subsp. paratuberculosis
ccaggcucaggaucagcagcc

SEQ ID NO: 1015880 - RNA, 22 nt, Mycobacterium avium subsp. paratuberculosis
ccaggcucaggaucagcagccg

SEQ ID NO: 1015881 - RNA, 17 nt, Mycobacterium avium subsp. paratuberculosis
ccaggcucgacaacugc

SEQ ID NO: 1015882 - RNA, 21 nt, Mycobacterium avium subsp. paratuberculosis
ccagguauucguugcccugcc

SEQ ID NO: 1015883 - RNA, 17 nt, Mycobacterium avium subsp. paratuberculosis
ccagggugccgccgggc

SEQ ID NO: 1015884 - RNA, 14 nt, Mycobacterium avium subsp. paratuberculosis
ccagguccuugagg

SEQ ID NO: 1015885 - RNA, 23 nt, Mycobacterium avium subsp. paratuberculosis
ccaggucgacggggucggacaga

SEQ ID NO: 1015886 - RNA, 17 nt, Mycobacterium avium subsp. paratuberculosis
ccagguccgcgguggug

SEQ ID NO: 1015887 - RNA, 20 nt, Mycobacterium avium subsp. paratuberculosis
ccagguauucaucgcggccg

SEQ ID NO: 1015888 - RNA, 22 nt, Mycobacterium avium subsp. paratuberculosis
ccagguauucaucgcggccgcc

SEQ ID NO: 1015889 - RNA, 22 nt, Mycobacterium avium subsp. paratuberculosis
ccagguagggcacaccggugcu

SEQ ID NO: 1015890 - RNA, 13 nt, Mycobacterium avium subsp. paratuberculosis
ccagggugccgcu

SEQ ID NO: 1015891 - RNA, 17 nt, Mycobacterium avium subsp. paratuberculosis
ccagggugccgcugccc

SEQ ID NO: 1015892 - RNA, 21 nt, Mycobacterium avium subsp. paratuberculosis
ccagggugccgcugcccgccg

SEQ ID NO: 1015893 - RNA, 16 nt, Mycobacterium avium subsp. paratuberculosis
ccagggugcgcagcgc

SEQ ID NO: 1015894 - RNA, 15 nt, Mycobacterium avium subsp. paratuberculosis
ccaggguggccccag

SEQ ID NO: 1015895 - RNA, 16 nt, Mycobacterium avium subsp. paratuberculosis
ccaggguggccccagc

SEQ ID NO: 1015896 - RNA, 20 nt, Mycobacterium avium subsp. paratuberculosis
ccaggguggccccagcccgg

SEQ ID NO: 1015897 - RNA, 17 nt, Mycobacterium avium subsp. paratuberculosis
ccaggguggccgccacc

SEQ ID NO: 1015898 - RNA, 17 nt, Mycobacterium avium subsp. paratuberculosis
ccaggcugcucggcggg

SEQ ID NO: 1015899 - RNA, 21 nt, Mycobacterium avium subsp. paratuberculosis
ccaggcugaccagcgccucgc

SEQ ID NO: 1015900 - RNA, 13 nt, Mycobacterium avium subsp. paratuberculosis
ccaggcugaacac

SEQ ID NO: 1015901 - RNA, 20 nt, Mycobacterium avium subsp. paratuberculosis
ccagggucuucagcccgcgc

SEQ ID NO: 1015902 - RNA, 21 nt, Mycobacterium avium subsp. paratuberculosis
ccagggucucgggcagcagca

SEQ ID NO: 1015903 - RNA, 15 nt, Mycobacterium avium subsp. paratuberculosis
ccaguccaggccgcc

SEQ ID NO: 1015904 - RNA, 13 nt, Mycobacterium avium subsp. paratuberculosis
ccaguaggccagc

SEQ ID NO: 1015905 - RNA, 13 nt, Mycobacterium avium subsp. paratuberculosis
ccaguagccgccg

SEQ ID NO: 1015906 - RNA, 19 nt, Mycobacterium avium subsp. paratuberculosis
ccaggucguuggagucguc

SEQ ID NO: 1015907 - RNA, 19 nt, Mycobacterium avium subsp. paratuberculosis
ccaggucgugaaacauggc

SEQ ID NO: 1015908 - RNA, 13 nt, Mycobacterium avium subsp. paratuberculosis
ccaggucggggug

SEQ ID NO: 1015909 - RNA, 14 nt, Mycobacterium avium subsp. paratuberculosis
ccaggucgcggcgc

SEQ ID NO: 1015910 - RNA, 15 nt, Mycobacterium avium subsp. paratuberculosis
ccaggucgcggcgcu

SEQ ID NO: 1015911 - RNA, 15 nt, Mycobacterium avium subsp. paratuberculosis
ccaggucgccgcgca

SEQ ID NO: 1015912 - RNA, 20 nt, Mycobacterium avium subsp. paratuberculosis
ccaggucgaucucggccagc

SEQ ID NO: 1015913 - RNA, 21 nt, Mycobacterium avium subsp. paratuberculosis
ccaggucgaucucggccagcg

SEQ ID NO: 1015914 - RNA, 17 nt, Mycobacterium avium subsp. paratuberculosis
ccaggucgcacaccagc

SEQ ID NO: 1015915 - RNA, 19 nt, Mycobacterium avium subsp. paratuberculosis
ccagguccucgcuggcgau

SEQ ID NO: 1015916 - RNA, 23 nt, Mycobacterium avium subsp. paratuberculosis
ccagucggucaacgugucgagca

SEQ ID NO: 1015917 - RNA, 13 nt, Mycobacterium avium subsp. paratuberculosis
ccagucggccgug

SEQ ID NO: 1015918 - RNA, 21 nt, Mycobacterium avium subsp. paratuberculosis
ccagucggcgccgaugcagca

SEQ ID NO: 1015919 - RNA, 20 nt, Mycobacterium avium subsp. paratuberculosis
ccagucgcggcgaaccagca

SEQ ID NO: 1015920 - RNA, 22 nt, Mycobacterium avium subsp. paratuberculosis
ccagucguacucccaggccgcg

SEQ ID NO: 1015921 - RNA, 17 nt, Mycobacterium avium subsp. paratuberculosis
ccagucgccgccgcgca

SEQ ID NO: 1015922 - RNA, 12 nt, Mycobacterium avium subsp. paratuberculosis
ccagucgccgcg

SEQ ID NO: 1015923 - RNA, 14 nt, Mycobacterium avium subsp. paratuberculosis
ccaguccugcagcu

SEQ ID NO: 1015924 - RNA, 15 nt, Mycobacterium avium subsp. paratuberculosis
ccaguccugcagcuc

SEQ ID NO: 1015925 - RNA, 13 nt, Mycobacterium avium subsp. paratuberculosis
ccaguccugggcc

SEQ ID NO: 1015926 - RNA, 14 nt, Mycobacterium avium subsp. paratuberculosis
ccaguccggcagca

SEQ ID NO: 1015927 - RNA, 18 nt, Mycobacterium avium subsp. paratuberculosis
ccaguccggcagcagcga

SEQ ID NO: 1015928 - RNA, 14 nt, Mycobacterium avium subsp. paratuberculosis
ccaguccggccagc

SEQ ID NO: 1015929 - RNA, 14 nt, Mycobacterium avium subsp. paratuberculosis
ccaguccggcgccg

SEQ ID NO: 1015930 - RNA, 14 nt, Mycobacterium avium subsp. paratuberculosis
ccaguccgccgccg

SEQ ID NO: 1015931 - RNA, 14 nt, Mycobacterium avium subsp. paratuberculosis
ccagugacgccugc

SEQ ID NO: 1015932 - RNA, 20 nt, Mycobacterium avium subsp. paratuberculosis
ccagugcaagcucgccagga

SEQ ID NO: 1015933 - RNA, 12 nt, Mycobacterium avium subsp. paratuberculosis
ccagugcccggc

SEQ ID NO: 1015934 - RNA, 14 nt, Mycobacterium avium subsp. paratuberculosis
ccagugcccggcca

SEQ ID NO: 1015935 - RNA, 15 nt, Mycobacterium avium subsp. paratuberculosis
ccagugccaguacca

SEQ ID NO: 1015936 - RNA, 17 nt, Mycobacterium avium subsp. paratuberculosis
ccagugcgugaccugcu

SEQ ID NO: 1015937 - RNA, 19 nt, Mycobacterium avium subsp. paratuberculosis
ccaguuguuuccccagccc

SEQ ID NO: 1015938 - RNA, 21 nt, Mycobacterium avium subsp. paratuberculosis
ccaguuguuuccccagcccgg

SEQ ID NO: 1015939 - RNA, 15 nt, Mycobacterium avium subsp. paratuberculosis
ccaguugcgaccccg

SEQ ID NO: 1015940 - RNA, 16 nt, Mycobacterium avium subsp. paratuberculosis
ccaguugcgaccccgc

SEQ ID NO: 1015941 - RNA, 14 nt, Mycobacterium avium subsp. paratuberculosis
ccauaaaccggccg

SEQ ID NO: 1015942 - RNA, 14 nt, Mycobacterium avium subsp. paratuberculosis
ccauccgccgucga

SEQ ID NO: 1015943 - RNA, 14 nt, Mycobacterium avium subsp. paratuberculosis
ccaucccgccgccg

SEQ ID NO: 1015944 - RNA, 14 nt, Mycobacterium avium subsp. paratuberculosis
ccaucgacuccagc

SEQ ID NO: 1015945 - RNA, 21 nt, Mycobacterium avium subsp. paratuberculosis
ccauccgcggccaccgggacc

SEQ ID NO: 1015946 - RNA, 24 nt, Mycobacterium avium subsp. paratuberculosis
ccauccgccagaucgccuggcagc

SEQ ID NO: 1015947 - RNA, 18 nt, Mycobacterium avium subsp. paratuberculosis
ccaucccgcugaagccga

SEQ ID NO: 1015948 - RNA, 15 nt, Mycobacterium avium subsp. paratuberculosis
ccauccccaggaugg

SEQ ID NO: 1015949 - RNA, 17 nt, Mycobacterium avium subsp. paratuberculosis
ccaucccucguucagca

SEQ ID NO: 1015950 - RNA, 18 nt, Mycobacterium avium subsp. paratuberculosis
ccaucggcagacccagca

SEQ ID NO: 1015951 - RNA, 15 nt, Mycobacterium avium subsp. paratuberculosis
ccaucgccaggaacc

SEQ ID NO: 1015952 - RNA, 23 nt, Mycobacterium avium subsp. paratuberculosis
ccaucguccucgcgccguggccc

SEQ ID NO: 1015953 - RNA, 15 nt, Mycobacterium avium subsp. paratuberculosis
ccaucgucacuucgc

SEQ ID NO: 1015954 - RNA, 20 nt, Mycobacterium avium subsp. paratuberculosis
ccaucggggcuacaaaacca

SEQ ID NO: 1015955 - RNA, 24 nt, Mycobacterium avium subsp. paratuberculosis
ccaucagaacgcccgcaacuccac

SEQ ID NO: 1015956 - RNA, 13 nt, Mycobacterium avium subsp. paratuberculosis
ccaucagcccggc

SEQ ID NO: 1015957 - RNA, 14 nt, Mycobacterium avium subsp. paratuberculosis
ccaucagcccggcg

SEQ ID NO: 1015958 - RNA, 13 nt, Mycobacterium avium subsp. paratuberculosis
ccaucagcccggu

SEQ ID NO: 1015959 - RNA, 16 nt, Mycobacterium avium subsp. paratuberculosis
ccaucagcagcgccuc

SEQ ID NO: 1015960 - RNA, 15 nt, Mycobacterium avium subsp. paratuberculosis
ccaucagcacgcccu

SEQ ID NO: 1015961 - RNA, 23 nt, Mycobacterium avium subsp. paratuberculosis
ccagcagucgugacgcggcgucg

SEQ ID NO: 1015962 - RNA, 15 nt, Mycobacterium avium subsp. paratuberculosis
ccagcaguguccagu

SEQ ID NO: 1015963 - RNA, 13 nt, Mycobacterium avium subsp. paratuberculosis
ccagcaguucguc

SEQ ID NO: 1015964 - RNA, 21 nt, Mycobacterium avium subsp. paratuberculosis
ccagcaguucguccacgcugg

SEQ ID NO: 1015965 - RNA, 15 nt, Mycobacterium avium subsp. paratuberculosis
ccagcaguccggcgg

SEQ ID NO: 1015966 - RNA, 21 nt, Mycobacterium avium subsp. paratuberculosis
ccagcagguagaagccgcgac

SEQ ID NO: 1015967 - RNA, 23 nt, Mycobacterium avium subsp. paratuberculosis
ccagcaggucgaaggcggccgcg

SEQ ID NO: 1015968 - RNA, 19 nt, Mycobacterium avium subsp. paratuberculosis
ccagcaggucgaucugcgg

SEQ ID NO: 1015969 - RNA, 21 nt, Mycobacterium avium subsp. paratuberculosis
ccagcaguuuggucauccgcu

SEQ ID NO: 1015970 - RNA, 14 nt, Mycobacterium avium subsp. paratuberculosis
ccagccaucugcug

SEQ ID NO: 1015971 - RNA, 16 nt, Mycobacterium avium subsp. paratuberculosis
ccagccccaccaccgc

SEQ ID NO: 1015972 - RNA, 23 nt, Mycobacterium avium subsp. paratuberculosis
ccagccccaccaccgccaccagc

SEQ ID NO: 1015973 - RNA, 18 nt, Mycobacterium avium subsp. paratuberculosis
ccagccccaccggccacu

SEQ ID NO: 1015974 - RNA, 21 nt, Mycobacterium avium subsp. paratuberculosis
ccagcccggaaucgucggcca

SEQ ID NO: 1015975 - RNA, 23 nt, Mycobacterium avium subsp. paratuberculosis
ccagcccggaaucgucggccacg

SEQ ID NO: 1015976 - RNA, 12 nt, Mycobacterium avium subsp. paratuberculosis
ccagccccagca

SEQ ID NO: 1015977 - RNA, 14 nt, Mycobacterium avium subsp. paratuberculosis
ccagcccggccagc

SEQ ID NO: 1015978 - RNA, 19 nt, Mycobacterium avium subsp. paratuberculosis
ccagcccggugaucgccgc

SEQ ID NO: 1015979 - RNA, 22 nt, Mycobacterium avium subsp. paratuberculosis
ccagcccggcgacgaagcagcu

SEQ ID NO: 1015980 - RNA, 14 nt, Mycobacterium avium subsp. paratuberculosis
ccagcccggccgcc

SEQ ID NO: 1015981 - RNA, 21 nt, Mycobacterium avium subsp. paratuberculosis
ccagccgagaucgacccgcuc

SEQ ID NO: 1015982 - RNA, 23 nt, Mycobacterium avium subsp. paratuberculosis
ccagccgagaucgacccgcuccg

SEQ ID NO: 1015983 - RNA, 17 nt, Mycobacterium avium subsp. paratuberculosis
ccagccgagccgggcca

SEQ ID NO: 1015984 - RNA, 14 nt, Mycobacterium avium subsp. paratuberculosis
ccagcccggcccgu

SEQ ID NO: 1015985 - RNA, 21 nt, Mycobacterium avium subsp. paratuberculosis
ccagcccguugucgagcaccg

SEQ ID NO: 1015986 - RNA, 20 nt, Mycobacterium avium subsp. paratuberculosis
ccagcccguuguggcggcca

SEQ ID NO: 1015987 - RNA, 15 nt, Mycobacterium avium subsp. paratuberculosis
ccagcccgucgggug

SEQ ID NO: 1015988 - RNA, 22 nt, Mycobacterium avium subsp. paratuberculosis
ccagcccgucguccuugagccc

SEQ ID NO: 1015989 - RNA, 17 nt, Mycobacterium avium subsp. paratuberculosis
ccagcccugcucggcca

SEQ ID NO: 1015990 - RNA, 19 nt, Mycobacterium avium subsp. paratuberculosis
ccagcccugcucggccagc

SEQ ID NO: 1015991 - RNA, 16 nt, Mycobacterium avium subsp. paratuberculosis
ccagccgcuccgcggc

SEQ ID NO: 1015992 - RNA, 13 nt, Mycobacterium avium subsp. paratuberculosis
ccagccgcuccuc

SEQ ID NO: 1015993 - RNA, 17 nt, Mycobacterium avium subsp. paratuberculosis
ccagccgcgcggccgcc

SEQ ID NO: 1015994 - RNA, 20 nt, Mycobacterium avium subsp. paratuberculosis
ccagccgcggacggccagcc

SEQ ID NO: 1015995 - RNA, 16 nt, Mycobacterium avium subsp. paratuberculosis
ccagccggcccgcauc

SEQ ID NO: 1015996 - RNA, 14 nt, Mycobacterium avium subsp. paratuberculosis
ccagccgcugacga

SEQ ID NO: 1015997 - RNA, 21 nt, Mycobacterium avium subsp. paratuberculosis
ccagccgaugcgcccgcgcca

SEQ ID NO: 1015998 - RNA, 13 nt, Mycobacterium avium subsp. paratuberculosis
ccagccgcccagc

SEQ ID NO: 1015999 - RNA, 16 nt, Mycobacterium avium subsp. paratuberculosis
ccagccgcccagcauc

SEQ ID NO: 1016000 - RNA, 20 nt, Mycobacterium avium subsp. paratuberculosis
ccagccgcgccgcgccgccu

SEQ ID NO: 1016001 - RNA, 16 nt, Mycobacterium avium subsp. paratuberculosis
ccagccgccggccacc

SEQ ID NO: 1016002 - RNA, 19 nt, Mycobacterium avium subsp. paratuberculosis
ccagccgccggcucagcgg

SEQ ID NO: 1016003 - RNA, 20 nt, Mycobacterium avium subsp. paratuberculosis
ccagccgccgccgaccacau

SEQ ID NO: 1016004 - RNA, 13 nt, Mycobacterium avium subsp. paratuberculosis
ccagccgccgcga

SEQ ID NO: 1016005 - RNA, 17 nt, Mycobacterium avium subsp. paratuberculosis
ccagcgcaacggcgucg

SEQ ID NO: 1016006 - RNA, 22 nt, Mycobacterium avium subsp. paratuberculosis
ccagcgcacacagcagcagcac

SEQ ID NO: 1016007 - RNA, 17 nt, Mycobacterium avium subsp. paratuberculosis
ccagcgcaccgagcccg

SEQ ID NO: 1016008 - RNA, 18 nt, Mycobacterium avium subsp. paratuberculosis
ccagcgcaccgagcccgu

SEQ ID NO: 1016009 - RNA, 14 nt, Mycobacterium avium subsp. paratuberculosis
ccagcgagcccagc

SEQ ID NO: 1016010 - RNA, 13 nt, Mycobacterium avium subsp. paratuberculosis
ccagcgacgccag

SEQ ID NO: 1016011 - RNA, 16 nt, Mycobacterium avium subsp. paratuberculosis
ccagcgacgccagcgg

SEQ ID NO: 1016012 - RNA, 21 nt, Mycobacterium avium subsp. paratuberculosis
ccagcgacggccgggucagga

SEQ ID NO: 1016013 - RNA, 18 nt, Mycobacterium avium subsp. paratuberculosis
ccagccgggcggccaggg

SEQ ID NO: 1016014 - RNA, 14 nt, Mycobacterium avium subsp. paratuberculosis
ccagccggccggcc

SEQ ID NO: 1016015 - RNA, 21 nt, Mycobacterium avium subsp. paratuberculosis
ccagccgggccgagcgcgccg

SEQ ID NO: 1016016 - RNA, 15 nt, Mycobacterium avium subsp. paratuberculosis
ccagccgggcggcca

SEQ ID NO: 1016017 - RNA, 23 nt, Mycobacterium avium subsp. paratuberculosis
ccagccggcucuuggcgaccucg

SEQ ID NO: 1016018 - RNA, 22 nt, Mycobacterium avium subsp. paratuberculosis
ccagccggccgacgcggccucg

SEQ ID NO: 1016019 - RNA, 20 nt, Mycobacterium avium subsp. paratuberculosis
ccagccguuguugaggauca

SEQ ID NO: 1016020 - RNA, 16 nt, Mycobacterium avium subsp. paratuberculosis
ccagccguugggcagc

SEQ ID NO: 1016021 - RNA, 20 nt, Mycobacterium avium subsp. paratuberculosis
ccagccgugggugucggcga

SEQ ID NO: 1016022 - RNA, 15 nt, Mycobacterium avium subsp. paratuberculosis
ccagccguucccggc

SEQ ID NO: 1016023 - RNA, 23 nt, Mycobacterium avium subsp. paratuberculosis
ccagccggucuuggacagcagca

SEQ ID NO: 1016024 - RNA, 20 nt, Mycobacterium avium subsp. paratuberculosis
ccagccgguggcggccacga

SEQ ID NO: 1016025 - RNA, 19 nt, Mycobacterium avium subsp. paratuberculosis
ccagccgucgcaccgccuc

SEQ ID NO: 1016026 - RNA, 21 nt, Mycobacterium avium subsp. paratuberculosis
ccagccgugccccaggucggg

SEQ ID NO: 1016027 - RNA, 11 nt, Mycobacterium avium subsp. paratuberculosis
ccagccgugcg

SEQ ID NO: 1016028 - RNA, 17 nt, Mycobacterium avium subsp. paratuberculosis
ccagcacgaaggccgcc

SEQ ID NO: 1016029 - RNA, 19 nt, Mycobacterium avium subsp. paratuberculosis
ccagcaccuggcgcaccgc

SEQ ID NO: 1016030 - RNA, 15 nt, Mycobacterium avium subsp. paratuberculosis
ccagcaccucgcggc

SEQ ID NO: 1016031 - RNA, 18 nt, Mycobacterium avium subsp. paratuberculosis
ccagcaccugaccgucgg

SEQ ID NO: 1016032 - RNA, 20 nt, Mycobacterium avium subsp. paratuberculosis
ccagcaccugaccgucggcc

SEQ ID NO: 1016033 - RNA, 21 nt, Mycobacterium avium subsp. paratuberculosis
ccagcaccugaccgucggcca

SEQ ID NO: 1016034 - RNA, 17 nt, Mycobacterium avium subsp. paratuberculosis
ccagcaccggcaccgcc

SEQ ID NO: 1016035 - RNA, 14 nt, Mycobacterium avium subsp. paratuberculosis
ccagcaccgggccc

SEQ ID NO: 1016036 - RNA, 16 nt, Mycobacterium avium subsp. paratuberculosis
ccagcaccgggcccag

SEQ ID NO: 1016037 - RNA, 20 nt, Mycobacterium avium subsp. paratuberculosis
ccagcaccgggcccagcucg

SEQ ID NO: 1016038 - RNA, 12 nt, Mycobacterium avium subsp. paratuberculosis
ccagcaccgucu

SEQ ID NO: 1016039 - RNA, 23 nt, Mycobacterium avium subsp. paratuberculosis
ccagcaccgucugcgccgucacc

SEQ ID NO: 1016040 - RNA, 15 nt, Mycobacterium avium subsp. paratuberculosis
ccagcaacaccagcu

SEQ ID NO: 1016041 - RNA, 19 nt, Mycobacterium avium subsp. paratuberculosis
ccagcaacacccagccgcu

SEQ ID NO: 1016042 - RNA, 22 nt, Mycobacterium avium subsp. paratuberculosis
ccagcaacaccuuucggccgcg

SEQ ID NO: 1016043 - RNA, 17 nt, Mycobacterium avium subsp. paratuberculosis
ccagcaccaacagcggc

SEQ ID NO: 1016044 - RNA, 18 nt, Mycobacterium avium subsp. paratuberculosis
ccagcaccaacagcggcc

SEQ ID NO: 1016045 - RNA, 23 nt, Mycobacterium avium subsp. paratuberculosis
ccagcaccaccaacggcucgccg

SEQ ID NO: 1016046 - RNA, 14 nt, Mycobacterium avium subsp. paratuberculosis
ccagcaccaccacg

SEQ ID NO: 1016047 - RNA, 20 nt, Mycobacterium avium subsp. paratuberculosis
ccagcaccaccgucaccgcc

SEQ ID NO: 1016048 - RNA, 15 nt, Mycobacterium avium subsp. paratuberculosis
ccagcaccaccgugg

SEQ ID NO: 1016049 - RNA, 19 nt, Mycobacterium avium subsp. paratuberculosis
ccagcaccaccguggcgau

SEQ ID NO: 1016050 - RNA, 14 nt, Mycobacterium avium subsp. paratuberculosis
ccagcacggccacc

SEQ ID NO: 1016051 - RNA, 17 nt, Mycobacterium avium subsp. paratuberculosis
ccagcacggccaccagc

SEQ ID NO: 1016052 - RNA, 14 nt, Mycobacterium avium subsp. paratuberculosis
ccagcacgccuucc

SEQ ID NO: 1016053 - RNA, 15 nt, Mycobacterium avium subsp. paratuberculosis
ccagcacgacgccgc

SEQ ID NO: 1016054 - RNA, 14 nt, Mycobacterium avium subsp. paratuberculosis
ccagcagcagcgcg

SEQ ID NO: 1016055 - RNA, 17 nt, Mycobacterium avium subsp. paratuberculosis
ccagcagcagcgccgcc

SEQ ID NO: 1016056 - RNA, 13 nt, Mycobacterium avium subsp. paratuberculosis
ccagcagcagccc

SEQ ID NO: 1016057 - RNA, 16 nt, Mycobacterium avium subsp. paratuberculosis
ccagcagcagcccgcc

SEQ ID NO: 1016058 - RNA, 17 nt, Mycobacterium avium subsp. paratuberculosis
ccagcagcagccgcgcc

SEQ ID NO: 1016059 - RNA, 12 nt, Mycobacterium avium subsp. paratuberculosis
ccagcagcuguu

SEQ ID NO: 1016060 - RNA, 18 nt, Mycobacterium avium subsp. paratuberculosis
ccagcagcggcucggccu

SEQ ID NO: 1016061 - RNA, 19 nt, Mycobacterium avium subsp. paratuberculosis
ccagcagcgggcccgggcu

SEQ ID NO: 1016062 - RNA, 22 nt, Mycobacterium avium subsp. paratuberculosis
ccagcagcgggcccgggcugcc

SEQ ID NO: 1016063 - RNA, 19 nt, Mycobacterium avium subsp. paratuberculosis
ccagcaggacgcgcccggc

SEQ ID NO: 1016064 - RNA, 16 nt, Mycobacterium avium subsp. paratuberculosis
ccagcaggccccguuc

SEQ ID NO: 1016065 - RNA, 23 nt, Mycobacterium avium subsp. paratuberculosis
ccagcaggaucuggugcgcgcgc

SEQ ID NO: 1016066 - RNA, 14 nt, Mycobacterium avium subsp. paratuberculosis
ccagauaggccagc

SEQ ID NO: 1016067 - RNA, 16 nt, Mycobacterium avium subsp. paratuberculosis
ccagauaggccagcgc

SEQ ID NO: 1016068 - RNA, 14 nt, Mycobacterium avium subsp. paratuberculosis
ccagauagggcagc

SEQ ID NO: 1016069 - RNA, 16 nt, Mycobacterium avium subsp. paratuberculosis
ccagauagggcagcgu

SEQ ID NO: 1016070 - RNA, 21 nt, Mycobacterium avium subsp. paratuberculosis
ccagauagggcagcgucccgu

SEQ ID NO: 1016071 - RNA, 13 nt, Mycobacterium avium subsp. paratuberculosis
ccagauacuccuc

SEQ ID NO: 1016072 - RNA, 20 nt, Mycobacterium avium subsp. paratuberculosis
ccagauagaggaacagacuc

SEQ ID NO: 1016073 - RNA, 22 nt, Mycobacterium avium subsp. paratuberculosis
ccagauagaugagccgcagccg

SEQ ID NO: 1016074 - RNA, 16 nt, Mycobacterium avium subsp. paratuberculosis
ccagauuccgaaaggg

SEQ ID NO: 1016075 - RNA, 18 nt, Mycobacterium avium subsp. paratuberculosis
ccagcaaaaccccgccgu

SEQ ID NO: 1016076 - RNA, 14 nt, Mycobacterium avium subsp. paratuberculosis
ccagcaaacccagc

SEQ ID NO: 1016077 - RNA, 16 nt, Mycobacterium avium subsp. paratuberculosis
ccagcaaacccagcac

SEQ ID NO: 1016078 - RNA, 19 nt, Mycobacterium avium subsp. paratuberculosis
ccagcaaacccagcaccaa

SEQ ID NO: 1016079 - RNA, 22 nt, Mycobacterium avium subsp. paratuberculosis
ccagcaaacccagcaccaacag

SEQ ID NO: 1016080 - RNA, 23 nt, Mycobacterium avium subsp. paratuberculosis
ccagaugcccgccccgcccggcg

SEQ ID NO: 1016081 - RNA, 22 nt, Mycobacterium avium subsp. paratuberculosis
ccagaugccgcucggcgcucca

SEQ ID NO: 1016082 - RNA, 14 nt, Mycobacterium avium subsp. paratuberculosis
ccagaugcgccgcg

SEQ ID NO: 1016083 - RNA, 16 nt, Mycobacterium avium subsp. paratuberculosis
ccagaugcccagcagg

SEQ ID NO: 1016084 - RNA, 15 nt, Mycobacterium avium subsp. paratuberculosis
ccagaugcgccgcgg

SEQ ID NO: 1016085 - RNA, 20 nt, Mycobacterium avium subsp. paratuberculosis
ccagaugcgcgacggccucg

SEQ ID NO: 1016086 - RNA, 12 nt, Mycobacterium avium subsp. paratuberculosis
ccacccgcagcu

SEQ ID NO: 1016087 - RNA, 14 nt, Mycobacterium avium subsp. paratuberculosis
ccacccgcagugcg

SEQ ID NO: 1016088 - RNA, 19 nt, Mycobacterium avium subsp. paratuberculosis
ccacccgaugaccggcccg

SEQ ID NO: 1016089 - RNA, 14 nt, Mycobacterium avium subsp. paratuberculosis
ccacccgccccgcc

SEQ ID NO: 1016090 - RNA, 16 nt, Mycobacterium avium subsp. paratuberculosis
ccacccgccccgccgc

SEQ ID NO: 1016091 - RNA, 19 nt, Mycobacterium avium subsp. paratuberculosis
ccacccgccccuccaggca

SEQ ID NO: 1016092 - RNA, 17 nt, Mycobacterium avium subsp. paratuberculosis
ccacccgcggccggccc

SEQ ID NO: 1016093 - RNA, 18 nt, Mycobacterium avium subsp. paratuberculosis
ccacccgcggccggccca

SEQ ID NO: 1016094 - RNA, 16 nt, Mycobacterium avium subsp. paratuberculosis
ccacccgggcgccggc

SEQ ID NO: 1016095 - RNA, 12 nt, Mycobacterium avium subsp. paratuberculosis
ccacccggggcc

SEQ ID NO: 1016096 - RNA, 20 nt, Mycobacterium avium subsp. paratuberculosis
ccaccgaggugacgaggccc

SEQ ID NO: 1016097 - RNA, 22 nt, Mycobacterium avium subsp. paratuberculosis
ccaccgagguggcccagccgcu

SEQ ID NO: 1016098 - RNA, 22 nt, Mycobacterium avium subsp. paratuberculosis
ccaccggcaccacgaucaccag

SEQ ID NO: 1016099 - RNA, 19 nt, Mycobacterium avium subsp. paratuberculosis
ccaccgcggugggccaguc

SEQ ID NO: 1016100 - RNA, 15 nt, Mycobacterium avium subsp. paratuberculosis
ccaccgcugggcggc

SEQ ID NO: 1016101 - RNA, 20 nt, Mycobacterium avium subsp. paratuberculosis
ccaccggcaaucgggacgcc

SEQ ID NO: 1016102 - RNA, 14 nt, Mycobacterium avium subsp. paratuberculosis
ccaccggcccagcc

SEQ ID NO: 1016103 - RNA, 22 nt, Mycobacterium avium subsp. paratuberculosis
ccaccggccgcccggcgagcag

SEQ ID NO: 1016104 - RNA, 14 nt, Mycobacterium avium subsp. paratuberculosis
ccaccgccggcccg

SEQ ID NO: 1016105 - RNA, 21 nt, Mycobacterium avium subsp. paratuberculosis
ccaccgcgccccggcgcagcg

SEQ ID NO: 1016106 - RNA, 15 nt, Mycobacterium avium subsp. paratuberculosis
ccaccgcgcgcugca

SEQ ID NO: 1016107 - RNA, 22 nt, Mycobacterium avium subsp. paratuberculosis
ccaccgcgcggcgcaguucgac

SEQ ID NO: 1016108 - RNA, 14 nt, Mycobacterium avium subsp. paratuberculosis
ccaccgcggccagc

SEQ ID NO: 1016109 - RNA, 19 nt, Mycobacterium avium subsp. paratuberculosis
ccaccgcggcgccgucgaa

SEQ ID NO: 1016110 - RNA, 21 nt, Mycobacterium avium subsp. paratuberculosis
ccaccgcggcgcgcggccgcg

SEQ ID NO: 1016111 - RNA, 21 nt, Mycobacterium avium subsp. paratuberculosis
ccaccgcggggcugggcgcca

SEQ ID NO: 1016112 - RNA, 15 nt, Mycobacterium avium subsp. paratuberculosis
ccaccgcgcggccag

SEQ ID NO: 1016113 - RNA, 18 nt, Mycobacterium avium subsp. paratuberculosis
ccaccgcggugaccgccc

SEQ ID NO: 1016114 - RNA, 20 nt, Mycobacterium avium subsp. paratuberculosis
ccaccgccccagccgaccag

SEQ ID NO: 1016115 - RNA, 21 nt, Mycobacterium avium subsp. paratuberculosis
ccaccgcccgcugaccgccgc

SEQ ID NO: 1016116 - RNA, 18 nt, Mycobacterium avium subsp. paratuberculosis
ccaccgcccggaccggcu

SEQ ID NO: 1016117 - RNA, 15 nt, Mycobacterium avium subsp. paratuberculosis
ccaccgcccacagca

SEQ ID NO: 1016118 - RNA, 21 nt, Mycobacterium avium subsp. paratuberculosis
ccaccgccgccagcagcagcg

SEQ ID NO: 1016119 - RNA, 13 nt, Mycobacterium avium subsp. paratuberculosis
ccaccgccgccga

SEQ ID NO: 1016120 - RNA, 23 nt, Mycobacterium avium subsp. paratuberculosis
ccaccugcggcaccucggccuug

SEQ ID NO: 1016121 - RNA, 12 nt, Mycobacterium avium subsp. paratuberculosis
ccaccuggaagc

SEQ ID NO: 1016122 - RNA, 21 nt, Mycobacterium avium subsp. paratuberculosis
ccaccggguagcccgcgugca

SEQ ID NO: 1016123 - RNA, 22 nt, Mycobacterium avium subsp. paratuberculosis
ccaccggugacgaccggcagcc

SEQ ID NO: 1016124 - RNA, 13 nt, Mycobacterium avium subsp. paratuberculosis
ccaccgggccgcc

SEQ ID NO: 1016125 - RNA, 13 nt, Mycobacterium avium subsp. paratuberculosis
ccaccgggcagcc

SEQ ID NO: 1016126 - RNA, 16 nt, Mycobacterium avium subsp. paratuberculosis
ccacgaccccggcggc

SEQ ID NO: 1016127 - RNA, 14 nt, Mycobacterium avium subsp. paratuberculosis
ccacgacgcggcgc

SEQ ID NO: 1016128 - RNA, 17 nt, Mycobacterium avium subsp. paratuberculosis
ccacgacguacccccgc

SEQ ID NO: 1016129 - RNA, 23 nt, Mycobacterium avium subsp. paratuberculosis
ccacgaagucguuggggaugucg

SEQ ID NO: 1016130 - RNA, 18 nt, Mycobacterium avium subsp. paratuberculosis
ccacgaagaugaucagcg

SEQ ID NO: 1016131 - RNA, 20 nt, Mycobacterium avium subsp. paratuberculosis
ccacgaagcuggcgaacagc

SEQ ID NO: 1016132 - RNA, 16 nt, Mycobacterium avium subsp. paratuberculosis
ccacgaagggcgccag

SEQ ID NO: 1016133 - RNA, 17 nt, Mycobacterium avium subsp. paratuberculosis
ccacgaagucaaacccc

SEQ ID NO: 1016134 - RNA, 17 nt, Mycobacterium avium subsp. paratuberculosis
ccacgaacgucaggccg

SEQ ID NO: 1016135 - RNA, 21 nt, Mycobacterium avium subsp. paratuberculosis
ccacgaacgucaggccgugca

SEQ ID NO: 1016136 - RNA, 22 nt, Mycobacterium avium subsp. paratuberculosis
ccaccuggccggccaucuucag

SEQ ID NO: 1016137 - RNA, 12 nt, Mycobacterium avium subsp. paratuberculosis
ccaccugggcgg

SEQ ID NO: 1016138 - RNA, 19 nt, Mycobacterium avium subsp. paratuberculosis
ccacgccgagggcggcggc

SEQ ID NO: 1016139 - RNA, 18 nt, Mycobacterium avium subsp. paratuberculosis
ccacgccgacaccgucgc

SEQ ID NO: 1016140 - RNA, 18 nt, Mycobacterium avium subsp. paratuberculosis
ccacgccgcccccgccgc

SEQ ID NO: 1016141 - RNA, 21 nt, Mycobacterium avium subsp. paratuberculosis
ccacgccgcccccgccgcgag

SEQ ID NO: 1016142 - RNA, 11 nt, Mycobacterium avium subsp. paratuberculosis
ccacgccgccg

SEQ ID NO: 1016143 - RNA, 19 nt, Mycobacterium avium subsp. paratuberculosis
ccacgccgccgggaacagc

SEQ ID NO: 1016144 - RNA, 19 nt, Mycobacterium avium subsp. paratuberculosis
ccacgccggcgaucuccac

SEQ ID NO: 1016145 - RNA, 18 nt, Mycobacterium avium subsp. paratuberculosis
ccacgccguggcccgccc

SEQ ID NO: 1016146 - RNA, 19 nt, Mycobacterium avium subsp. paratuberculosis
ccacgccguggcccgccca

SEQ ID NO: 1016147 - RNA, 13 nt, Mycobacterium avium subsp. paratuberculosis
ccacgccuccggc

SEQ ID NO: 1016148 - RNA, 23 nt, Mycobacterium avium subsp. paratuberculosis
ccacgcaggcguccagggccacc

SEQ ID NO: 1016149 - RNA, 19 nt, Mycobacterium avium subsp. paratuberculosis
ccacgcacaccaccgacgc

SEQ ID NO: 1016150 - RNA, 20 nt, Mycobacterium avium subsp. paratuberculosis
ccacgacuucacaggccgcc

SEQ ID NO: 1016151 - RNA, 18 nt, Mycobacterium avium subsp. paratuberculosis
ccacguccgcggugagca

SEQ ID NO: 1016152 - RNA, 14 nt, Mycobacterium avium subsp. paratuberculosis
ccacguugagcacg

SEQ ID NO: 1016153 - RNA, 17 nt, Mycobacterium avium subsp. paratuberculosis
ccacguugagcacgccc

SEQ ID NO: 1016154 - RNA, 13 nt, Mycobacterium avium subsp. paratuberculosis
ccacguccagcug

SEQ ID NO: 1016155 - RNA, 15 nt, Mycobacterium avium subsp. paratuberculosis
ccacguugcgcccgg

SEQ ID NO: 1016156 - RNA, 22 nt, Mycobacterium avium subsp. paratuberculosis
ccacguugcgcccggccaucug

SEQ ID NO: 1016157 - RNA, 17 nt, Mycobacterium avium subsp. paratuberculosis
ccacgcucaugcccgcc

SEQ ID NO: 1016158 - RNA, 17 nt, Mycobacterium avium subsp. paratuberculosis
ccacgcucgccagaccg

SEQ ID NO: 1016159 - RNA, 14 nt, Mycobacterium avium subsp. paratuberculosis
ccacguacuccugc

SEQ ID NO: 1016160 - RNA, 18 nt, Mycobacterium avium subsp. paratuberculosis
ccacucccagccgccggc

SEQ ID NO: 1016161 - RNA, 14 nt, Mycobacterium avium subsp. paratuberculosis
ccacucccgcgcgc

SEQ ID NO: 1016162 - RNA, 17 nt, Mycobacterium avium subsp. paratuberculosis
ccacuccaccaccggcc

SEQ ID NO: 1016163 - RNA, 21 nt, Mycobacterium avium subsp. paratuberculosis
ccacguugaugccgcccagca

SEQ ID NO: 1016164 - RNA, 13 nt, Mycobacterium avium subsp. paratuberculosis
ccacucggacagg

SEQ ID NO: 1016165 - RNA, 17 nt, Mycobacterium avium subsp. paratuberculosis
ccacucgccgugagaag

SEQ ID NO: 1016166 - RNA, 17 nt, Mycobacterium avium subsp. paratuberculosis
ccacuuccuucuugggc

SEQ ID NO: 1016167 - RNA, 14 nt, Mycobacterium avium subsp. paratuberculosis
ccacuuguccacca

SEQ ID NO: 1016168 - RNA, 23 nt, Mycobacterium avium subsp. paratuberculosis
ccagaacacguuucggcccucca

SEQ ID NO: 1016169 - RNA, 19 nt, Mycobacterium avium subsp. paratuberculosis
ccacugggcgucggcgccc

SEQ ID NO: 1016170 - RNA, 21 nt, Mycobacterium avium subsp. paratuberculosis
ccacugggcgucggcgccccc

SEQ ID NO: 1016171 - RNA, 16 nt, Mycobacterium avium subsp. paratuberculosis
ccacuggcggccggcc

SEQ ID NO: 1016172 - RNA, 15 nt, Mycobacterium avium subsp. paratuberculosis
ccacugcgcgcccga

SEQ ID NO: 1016173 - RNA, 19 nt, Mycobacterium avium subsp. paratuberculosis
cggaucgcgcugaccaggc

SEQ ID NO: 1016174 - RNA, 14 nt, Mycobacterium avium subsp. paratuberculosis
cggaucgcccuggc

SEQ ID NO: 1016175 - RNA, 22 nt, Mycobacterium avium subsp. paratuberculosis
cggaucgagguagcgugcgccc

SEQ ID NO: 1016176 - RNA, 21 nt, Mycobacterium avium subsp. paratuberculosis
cggaguugaugaaaaccaccu

SEQ ID NO: 1016177 - RNA, 20 nt, Mycobacterium avium subsp. paratuberculosis
cggagcgcgguccacggugg

SEQ ID NO: 1016178 - RNA, 21 nt, Mycobacterium avium subsp. paratuberculosis
cggagcguucuccacccgccc

SEQ ID NO: 1016179 - RNA, 14 nt, Mycobacterium avium subsp. paratuberculosis
cggagcgcccggcc

SEQ ID NO: 1016180 - RNA, 19 nt, Mycobacterium avium subsp. paratuberculosis
cggagccgucggcuuccuc

SEQ ID NO: 1016181 - RNA, 14 nt, Mycobacterium avium subsp. paratuberculosis
cggagccuucuuga

SEQ ID NO: 1016182 - RNA, 21 nt, Mycobacterium avium subsp. paratuberculosis
cggagccuucuugaccgcagc

SEQ ID NO: 1016183 - RNA, 20 nt, Mycobacterium avium subsp. paratuberculosis
cggagcccagcuuggcgccc

SEQ ID NO: 1016184 - RNA, 14 nt, Mycobacterium avium subsp. paratuberculosis
cggagccggccgcc

SEQ ID NO: 1016185 - RNA, 22 nt, Mycobacterium avium subsp. paratuberculosis
cggagaugaauucggcgaucuc

SEQ ID NO: 1016186 - RNA, 23 nt, Mycobacterium avium subsp. paratuberculosis
cggagaugauggccgcgccgccg

SEQ ID NO: 1016187 - RNA, 15 nt, Mycobacterium avium subsp. paratuberculosis
cggagaugcgggcca

SEQ ID NO: 1016188 - RNA, 17 nt, Mycobacterium avium subsp. paratuberculosis
cggagaugcgggccacc

SEQ ID NO: 1016189 - RNA, 17 nt, Mycobacterium avium subsp. paratuberculosis
cggagaugcuggugacg

SEQ ID NO: 1016190 - RNA, 22 nt, Mycobacterium avium subsp. paratuberculosis
cggagaugguggucaccaccac

SEQ ID NO: 1016191 - RNA, 19 nt, Mycobacterium avium subsp. paratuberculosis
cggagcaaauccggcagcg

SEQ ID NO: 1016192 - RNA, 22 nt, Mycobacterium avium subsp. paratuberculosis
cggagcaaauccggcagcgcuc

SEQ ID NO: 1016193 - RNA, 21 nt, Mycobacterium avium subsp. paratuberculosis
cggaaccgggcacccggcgcg

SEQ ID NO: 1016194 - RNA, 14 nt, Mycobacterium avium subsp. paratuberculosis
cggaaccggccggg

SEQ ID NO: 1016195 - RNA, 13 nt, Mycobacterium avium subsp. paratuberculosis
cggaacgcgccgg

SEQ ID NO: 1016196 - RNA, 14 nt, Mycobacterium avium subsp. paratuberculosis
cggaaccguagacc

SEQ ID NO: 1016197 - RNA, 18 nt, Mycobacterium avium subsp. paratuberculosis
cggaaccguagaccaccu

SEQ ID NO: 1016198 - RNA, 23 nt, Mycobacterium avium subsp. paratuberculosis
cggaaccguuugucccuugggcg

SEQ ID NO: 1016199 - RNA, 21 nt, Mycobacterium avium subsp. paratuberculosis
cggaacgcccgaucugggauc

SEQ ID NO: 1016200 - RNA, 14 nt, Mycobacterium avium subsp. paratuberculosis
cggaugucgggcga

SEQ ID NO: 1016201 - RNA, 20 nt, Mycobacterium avium subsp. paratuberculosis
cggauguuguccggaacacc

SEQ ID NO: 1016202 - RNA, 23 nt, Mycobacterium avium subsp. paratuberculosis
cggauugguacuagccuggcacg

SEQ ID NO: 1016203 - RNA, 14 nt, Mycobacterium avium subsp. paratuberculosis
cggauugcggacgc

SEQ ID NO: 1016204 - RNA, 15 nt, Mycobacterium avium subsp. paratuberculosis
cggauugucgcuguu

SEQ ID NO: 1016205 - RNA, 17 nt, Mycobacterium avium subsp. paratuberculosis
cggcaaaacgcugggcg

SEQ ID NO: 1016206 - RNA, 19 nt, Mycobacterium avium subsp. paratuberculosis
cggcaaaacgcugggcgcc

SEQ ID NO: 1016207 - RNA, 18 nt, Mycobacterium avium subsp. paratuberculosis
cggaugccagcagguccg

SEQ ID NO: 1016208 - RNA, 13 nt, Mycobacterium avium subsp. paratuberculosis
cggaugcccaggc

SEQ ID NO: 1016209 - RNA, 19 nt, Mycobacterium avium subsp. paratuberculosis
cggaugcgggccacacacu

SEQ ID NO: 1016210 - RNA, 18 nt, Mycobacterium avium subsp. paratuberculosis
cggauggccagcagguag

SEQ ID NO: 1016211 - RNA, 17 nt, Mycobacterium avium subsp. paratuberculosis
cggauggccccggcgag

SEQ ID NO: 1016212 - RNA, 16 nt, Mycobacterium avium subsp. paratuberculosis
cggaugcugcggguca

SEQ ID NO: 1016213 - RNA, 22 nt, Mycobacterium avium subsp. paratuberculosis
cggauggugcccaccgggcagc

SEQ ID NO: 1016214 - RNA, 21 nt, Mycobacterium avium subsp. paratuberculosis
cggaugggugcgguugagcac

SEQ ID NO: 1016215 - RNA, 20 nt, Mycobacterium avium subsp. paratuberculosis
cggauggcgacggcgacgac

SEQ ID NO: 1016216 - RNA, 15 nt, Mycobacterium avium subsp. paratuberculosis
cggauggcgccgucg

SEQ ID NO: 1016217 - RNA, 19 nt, Mycobacterium avium subsp. paratuberculosis
cggaugacgggugcucagg

SEQ ID NO: 1016218 - RNA, 17 nt, Mycobacterium avium subsp. paratuberculosis
cggaugacgugcaccac

SEQ ID NO: 1016219 - RNA, 20 nt, Mycobacterium avium subsp. paratuberculosis
cggaugcaccggcagccaga

SEQ ID NO: 1016220 - RNA, 21 nt, Mycobacterium avium subsp. paratuberculosis
cggaugauguucuccggcccg

SEQ ID NO: 1016221 - RNA, 14 nt, Mycobacterium avium subsp. paratuberculosis
cggaucuggcccug

SEQ ID NO: 1016222 - RNA, 21 nt, Mycobacterium avium subsp. paratuberculosis
cggaugaccaagccccgcagu

SEQ ID NO: 1016223 - RNA, 22 nt, Mycobacterium avium subsp. paratuberculosis
cggaugaccaagccccgcagug

SEQ ID NO: 1016224 - RNA, 18 nt, Mycobacterium avium subsp. paratuberculosis
cggaucggcuagcagcuc

SEQ ID NO: 1016225 - RNA, 22 nt, Mycobacterium avium subsp. paratuberculosis
cggaucggcuagcagcuccggu

SEQ ID NO: 1016226 - RNA, 17 nt, Mycobacterium avium subsp. paratuberculosis
cggaucggccgcgucgg

SEQ ID NO: 1016227 - RNA, 21 nt, Mycobacterium avium subsp. paratuberculosis
cggaucgugucccggcgcccu

SEQ ID NO: 1016228 - RNA, 19 nt, Mycobacterium avium subsp. paratuberculosis
cggaucgucaccgaccccu

SEQ ID NO: 1016229 - RNA, 20 nt, Mycobacterium avium subsp. paratuberculosis
cggaucuucuccgccacauc

SEQ ID NO: 1016230 - RNA, 22 nt, Mycobacterium avium subsp. paratuberculosis
cggaucucgaccucgucggcgg

SEQ ID NO: 1016231 - RNA, 19 nt, Mycobacterium avium subsp. paratuberculosis
cggaucucgucgggcaccg

SEQ ID NO: 1016232 - RNA, 16 nt, Mycobacterium avium subsp. paratuberculosis
cggaucugcucgugca

SEQ ID NO: 1016233 - RNA, 15 nt, Mycobacterium avium subsp. paratuberculosis
cggcaaagcguugcc

SEQ ID NO: 1016234 - RNA, 16 nt, Mycobacterium avium subsp. paratuberculosis
cggcaaccagcuccgg

SEQ ID NO: 1016235 - RNA, 14 nt, Mycobacterium avium subsp. paratuberculosis
cggcaacacagcca

SEQ ID NO: 1016236 - RNA, 16 nt, Mycobacterium avium subsp. paratuberculosis
cggcaacaacgccagc

SEQ ID NO: 1016237 - RNA, 22 nt, Mycobacterium avium subsp. paratuberculosis
cggcaacagcaccagcaccacc

SEQ ID NO: 1016238 - RNA, 20 nt, Mycobacterium avium subsp. paratuberculosis
cggcaacaccggcggcgacg

SEQ ID NO: 1016239 - RNA, 15 nt, Mycobacterium avium subsp. paratuberculosis
cggcaccagagcgcc

SEQ ID NO: 1016240 - RNA, 13 nt, Mycobacterium avium subsp. paratuberculosis
cggcaccagcagc

SEQ ID NO: 1016241 - RNA, 18 nt, Mycobacterium avium subsp. paratuberculosis
cggcaccagguaccggcg

SEQ ID NO: 1016242 - RNA, 12 nt, Mycobacterium avium subsp. paratuberculosis
cggcaccaccac

SEQ ID NO: 1016243 - RNA, 20 nt, Mycobacterium avium subsp. paratuberculosis
cggcaccaccacgguggcgc

SEQ ID NO: 1016244 - RNA, 14 nt, Mycobacterium avium subsp. paratuberculosis
cggcaccacccggu

SEQ ID NO: 1016245 - RNA, 22 nt, Mycobacterium avium subsp. paratuberculosis
cggcaccgacagggccagcgcc

SEQ ID NO: 1016246 - RNA, 23 nt, Mycobacterium avium subsp. paratuberculosis
cggcacccgggccuugacggccu

SEQ ID NO: 1016247 - RNA, 13 nt, Mycobacterium avium subsp. paratuberculosis
cggcaccgcccgg

SEQ ID NO: 1016248 - RNA, 14 nt, Mycobacterium avium subsp. paratuberculosis
cggcaccgcccggg

SEQ ID NO: 1016249 - RNA, 18 nt, Mycobacterium avium subsp. paratuberculosis
cggcacccgcagcuccag

SEQ ID NO: 1016250 - RNA, 20 nt, Mycobacterium avium subsp. paratuberculosis
cggcacccgcagcuccagcg

SEQ ID NO: 1016251 - RNA, 24 nt, Mycobacterium avium subsp. paratuberculosis
cggcacgaagccgaacgacagcag

SEQ ID NO: 1016252 - RNA, 20 nt, Mycobacterium avium subsp. paratuberculosis
cggcaccucggccuugacca

SEQ ID NO: 1016253 - RNA, 18 nt, Mycobacterium avium subsp. paratuberculosis
cggcaccuccagcccggc

SEQ ID NO: 1016254 - RNA, 22 nt, Mycobacterium avium subsp. paratuberculosis
cggcaccucgaagggcgccagc

SEQ ID NO: 1016255 - RNA, 23 nt, Mycobacterium avium subsp. paratuberculosis
cggcaccucgaagggcgccagcc

SEQ ID NO: 1016256 - RNA, 15 nt, Mycobacterium avium subsp. paratuberculosis
cggcaccucgaucac

SEQ ID NO: 1016257 - RNA, 21 nt, Mycobacterium avium subsp. paratuberculosis
cggcaccucgaucaccgggcg

SEQ ID NO: 1016258 - RNA, 20 nt, Mycobacterium avium subsp. paratuberculosis
cggcacucgccucggaggcc

SEQ ID NO: 1016259 - RNA, 13 nt, Mycobacterium avium subsp. paratuberculosis
cggcacgccgcuc

SEQ ID NO: 1016260 - RNA, 13 nt, Mycobacterium avium subsp. paratuberculosis
cggcacgccgacc

SEQ ID NO: 1016261 - RNA, 15 nt, Mycobacterium avium subsp. paratuberculosis
cggcacgccggggcc

SEQ ID NO: 1016262 - RNA, 20 nt, Mycobacterium avium subsp. paratuberculosis
cggcacgaucggcagcgcca

SEQ ID NO: 1016263 - RNA, 21 nt, Mycobacterium avium subsp. paratuberculosis
cggcaccuuggugagcaccgc

SEQ ID NO: 1016264 - RNA, 19 nt, Mycobacterium avium subsp. paratuberculosis
cggcacugaaggcgcgggc

SEQ ID NO: 1016265 - RNA, 15 nt, Mycobacterium avium subsp. paratuberculosis
cggcacugcccgcau

SEQ ID NO: 1016266 - RNA, 15 nt, Mycobacterium avium subsp. paratuberculosis
cggcagaacgacgcc

SEQ ID NO: 1016267 - RNA, 20 nt, Mycobacterium avium subsp. paratuberculosis
cggcagguugcgcuggauga

SEQ ID NO: 1016268 - RNA, 13 nt, Mycobacterium avium subsp. paratuberculosis
cggcaguccgcgc

SEQ ID NO: 1016269 - RNA, 17 nt, Mycobacterium avium subsp. paratuberculosis
cggcaguccgcgccggu

SEQ ID NO: 1016270 - RNA, 14 nt, Mycobacterium avium subsp. paratuberculosis
cggcaggucggugc

SEQ ID NO: 1016271 - RNA, 21 nt, Mycobacterium avium subsp. paratuberculosis
cggcaggucggugcgcggggu

SEQ ID NO: 1016272 - RNA, 13 nt, Mycobacterium avium subsp. paratuberculosis
cggcaggucggcc

SEQ ID NO: 1016273 - RNA, 18 nt, Mycobacterium avium subsp. paratuberculosis
cggcaggucggcgggagc

SEQ ID NO: 1016274 - RNA, 15 nt, Mycobacterium avium subsp. paratuberculosis
cggcagggccaccgu

SEQ ID NO: 1016275 - RNA, 22 nt, Mycobacterium avium subsp. paratuberculosis
cggcagggccaccgucagggug

SEQ ID NO: 1016276 - RNA, 14 nt, Mycobacterium avium subsp. paratuberculosis
cggcagggccaggc

SEQ ID NO: 1016277 - RNA, 21 nt, Mycobacterium avium subsp. paratuberculosis
cggcagugugauucgggucag

SEQ ID NO: 1016278 - RNA, 19 nt, Mycobacterium avium subsp. paratuberculosis
cggcaguuccucgccggag

SEQ ID NO: 1016279 - RNA, 18 nt, Mycobacterium avium subsp. paratuberculosis
cggcauaggccagcacca

SEQ ID NO: 1016280 - RNA, 18 nt, Mycobacterium avium subsp. paratuberculosis
cggcauagcgccgcucgg

SEQ ID NO: 1016281 - RNA, 21 nt, Mycobacterium avium subsp. paratuberculosis
cggcauagauaccggccagca

SEQ ID NO: 1016282 - RNA, 20 nt, Mycobacterium avium subsp. paratuberculosis
cggcaggaaccgggucagca

SEQ ID NO: 1016283 - RNA, 22 nt, Mycobacterium avium subsp. paratuberculosis
cggcagcgacucgggcaggaug

SEQ ID NO: 1016284 - RNA, 15 nt, Mycobacterium avium subsp. paratuberculosis
cggcagccgcuccgg

SEQ ID NO: 1016285 - RNA, 16 nt, Mycobacterium avium subsp. paratuberculosis
cggcagccggcguacu

SEQ ID NO: 1016286 - RNA, 20 nt, Mycobacterium avium subsp. paratuberculosis
cggcagcgcucgucgucgga

SEQ ID NO: 1016287 - RNA, 13 nt, Mycobacterium avium subsp. paratuberculosis
cggcagcgcgccc

SEQ ID NO: 1016288 - RNA, 17 nt, Mycobacterium avium subsp. paratuberculosis
cggcagcgcgauccggg

SEQ ID NO: 1016289 - RNA, 17 nt, Mycobacterium avium subsp. paratuberculosis
cggcagcgaggcgcgca

SEQ ID NO: 1016290 - RNA, 23 nt, Mycobacterium avium subsp. paratuberculosis
cggccucgaagcuggaauaccuu

SEQ ID NO: 1016291 - RNA, 14 nt, Mycobacterium avium subsp. paratuberculosis
cggccuccgcgcgc

SEQ ID NO: 1016292 - RNA, 19 nt, Mycobacterium avium subsp. paratuberculosis
cggccuccgccaccuccuc

SEQ ID NO: 1016293 - RNA, 20 nt, Mycobacterium avium subsp. paratuberculosis
cggccuccgccaccuccucc

SEQ ID NO: 1016294 - RNA, 19 nt, Mycobacterium avium subsp. paratuberculosis
cggccucaccgcgggccag

SEQ ID NO: 1016295 - RNA, 21 nt, Mycobacterium avium subsp. paratuberculosis
cggccucaccgcgggccaggc

SEQ ID NO: 1016296 - RNA, 22 nt, Mycobacterium avium subsp. paratuberculosis
cggccucaccgcgggccaggcc

SEQ ID NO: 1016297 - RNA, 12 nt, Mycobacterium avium subsp. paratuberculosis
cggccuccagcc

SEQ ID NO: 1016298 - RNA, 16 nt, Mycobacterium avium subsp. paratuberculosis
cggccuccagccgcgc

SEQ ID NO: 1016299 - RNA, 16 nt, Mycobacterium avium subsp. paratuberculosis
cggccuccagccgcuc

SEQ ID NO: 1016300 - RNA, 17 nt, Mycobacterium avium subsp. paratuberculosis
cggccuccagccggcgg

SEQ ID NO: 1016301 - RNA, 18 nt, Mycobacterium avium subsp. paratuberculosis
cggccuccagccggcgga

SEQ ID NO: 1016302 - RNA, 18 nt, Mycobacterium avium subsp. paratuberculosis
cggccuaggacgccgccc

SEQ ID NO: 1016303 - RNA, 21 nt, Mycobacterium avium subsp. paratuberculosis
cggccguugcucucggccucc

SEQ ID NO: 1016304 - RNA, 20 nt, Mycobacterium avium subsp. paratuberculosis
cggccguucgccggccagca

SEQ ID NO: 1016305 - RNA, 13 nt, Mycobacterium avium subsp. paratuberculosis
cggccguccaggc

SEQ ID NO: 1016306 - RNA, 13 nt, Mycobacterium avium subsp. paratuberculosis
cggccgucgccgg

SEQ ID NO: 1016307 - RNA, 18 nt, Mycobacterium avium subsp. paratuberculosis
cggccgucgccgggcggg

SEQ ID NO: 1016308 - RNA, 14 nt, Mycobacterium avium subsp. paratuberculosis
cggccgucgcgcac

SEQ ID NO: 1016309 - RNA, 14 nt, Mycobacterium avium subsp. paratuberculosis
cggccgucuugccc

SEQ ID NO: 1016310 - RNA, 17 nt, Mycobacterium avium subsp. paratuberculosis
cggccgucuugcccggc

SEQ ID NO: 1016311 - RNA, 18 nt, Mycobacterium avium subsp. paratuberculosis
cggccgugaugcgccggc

SEQ ID NO: 1016312 - RNA, 20 nt, Mycobacterium avium subsp. paratuberculosis
cggccgugaugcgccggcgg

SEQ ID NO: 1016313 - RNA, 18 nt, Mycobacterium avium subsp. paratuberculosis
cggccgguggccgguggg

SEQ ID NO: 1016314 - RNA, 17 nt, Mycobacterium avium subsp. paratuberculosis
cggccgguuggcggccg

SEQ ID NO: 1016315 - RNA, 23 nt, Mycobacterium avium subsp. paratuberculosis
cggccgguuguugcgguccagga

SEQ ID NO: 1016316 - RNA, 18 nt, Mycobacterium avium subsp. paratuberculosis
cggccggguuguccuggc

SEQ ID NO: 1016317 - RNA, 16 nt, Mycobacterium avium subsp. paratuberculosis
cggccgguccgcccag

SEQ ID NO: 1016318 - RNA, 18 nt, Mycobacterium avium subsp. paratuberculosis
cggccggucgccugcuuc

SEQ ID NO: 1016319 - RNA, 21 nt, Mycobacterium avium subsp. paratuberculosis
cggccggugacuccuccucgg

SEQ ID NO: 1016320 - RNA, 15 nt, Mycobacterium avium subsp. paratuberculosis
cggccggggcggcgg

SEQ ID NO: 1016321 - RNA, 20 nt, Mycobacterium avium subsp. paratuberculosis
cggccgggggcgcgggcggc

SEQ ID NO: 1016322 - RNA, 18 nt, Mycobacterium avium subsp. paratuberculosis
cggccgggucgcaggcag

SEQ ID NO: 1016323 - RNA, 20 nt, Mycobacterium avium subsp. paratuberculosis
cggccggguguagcugggcc

SEQ ID NO: 1016324 - RNA, 16 nt, Mycobacterium avium subsp. paratuberculosis
cggccugagccgccgg

SEQ ID NO: 1016325 - RNA, 17 nt, Mycobacterium avium subsp. paratuberculosis
cggccugagccgccggg

SEQ ID NO: 1016326 - RNA, 15 nt, Mycobacterium avium subsp. paratuberculosis
cggccugcacgucgg

SEQ ID NO: 1016327 - RNA, 22 nt, Mycobacterium avium subsp. paratuberculosis
cggccugcaccaccacacccag

SEQ ID NO: 1016328 - RNA, 22 nt, Mycobacterium avium subsp. paratuberculosis
cggccucgugcaaggccugcgc

SEQ ID NO: 1016329 - RNA, 18 nt, Mycobacterium avium subsp. paratuberculosis
cggccucggcguccgcgg

SEQ ID NO: 1016330 - RNA, 22 nt, Mycobacterium avium subsp. paratuberculosis
cggccucgcccagcgccgcggc

SEQ ID NO: 1016331 - RNA, 14 nt, Mycobacterium avium subsp. paratuberculosis
cggccucgccgucg

SEQ ID NO: 1016332 - RNA, 15 nt, Mycobacterium avium subsp. paratuberculosis
cggccucgccgucga

SEQ ID NO: 1016333 - RNA, 23 nt, Mycobacterium avium subsp. paratuberculosis
cggccucgccgucgaaggccggg

SEQ ID NO: 1016334 - RNA, 20 nt, Mycobacterium avium subsp. paratuberculosis
cggccuggccgucgcggcgc

SEQ ID NO: 1016335 - RNA, 17 nt, Mycobacterium avium subsp. paratuberculosis
cggccuggcccagccgc

SEQ ID NO: 1016336 - RNA, 15 nt, Mycobacterium avium subsp. paratuberculosis
cggccugcuccagcg

SEQ ID NO: 1016337 - RNA, 14 nt, Mycobacterium avium subsp. paratuberculosis
cggccugcggcggc

SEQ ID NO: 1016338 - RNA, 18 nt, Mycobacterium avium subsp. paratuberculosis
cggccugcgggcgccggc

SEQ ID NO: 1016339 - RNA, 14 nt, Mycobacterium avium subsp. paratuberculosis
cggccugccggccg

SEQ ID NO: 1016340 - RNA, 16 nt, Mycobacterium avium subsp. paratuberculosis
cggccugccaccgcga

SEQ ID NO: 1016341 - RNA, 17 nt, Mycobacterium avium subsp. paratuberculosis
cggccugcccgcgggug

SEQ ID NO: 1016342 - RNA, 17 nt, Mycobacterium avium subsp. paratuberculosis
cggccgcuucccacccg

SEQ ID NO: 1016343 - RNA, 19 nt, Mycobacterium avium subsp. paratuberculosis
cggccgcuucccacccggu

SEQ ID NO: 1016344 - RNA, 13 nt, Mycobacterium avium subsp. paratuberculosis
cggccggacaccg

SEQ ID NO: 1016345 - RNA, 19 nt, Mycobacterium avium subsp. paratuberculosis
cggccggacaccgaaccgc

SEQ ID NO: 1016346 - RNA, 15 nt, Mycobacterium avium subsp. paratuberculosis
cggccggagccgacc

SEQ ID NO: 1016347 - RNA, 14 nt, Mycobacterium avium subsp. paratuberculosis
cggccgcugcccgg

SEQ ID NO: 1016348 - RNA, 15 nt, Mycobacterium avium subsp. paratuberculosis
cggccgcugcccggg

SEQ ID NO: 1016349 - RNA, 16 nt, Mycobacterium avium subsp. paratuberculosis
cggccgcugcccgggc

SEQ ID NO: 1016350 - RNA, 17 nt, Mycobacterium avium subsp. paratuberculosis
cggccgcugcgcccagc

SEQ ID NO: 1016351 - RNA, 17 nt, Mycobacterium avium subsp. paratuberculosis
cggccgcugcgggcggg

SEQ ID NO: 1016352 - RNA, 16 nt, Mycobacterium avium subsp. paratuberculosis
cggccgcuggugguga

SEQ ID NO: 1016353 - RNA, 19 nt, Mycobacterium avium subsp. paratuberculosis
cggccgcggugugcccggc

SEQ ID NO: 1016354 - RNA, 14 nt, Mycobacterium avium subsp. paratuberculosis
cggccgcucagcgg

SEQ ID NO: 1016355 - RNA, 16 nt, Mycobacterium avium subsp. paratuberculosis
cggccggagcggaugg

SEQ ID NO: 1016356 - RNA, 15 nt, Mycobacterium avium subsp. paratuberculosis
cggccggauggccag

SEQ ID NO: 1016357 - RNA, 21 nt, Mycobacterium avium subsp. paratuberculosis
cggccgcguacuucgcgcccu

SEQ ID NO: 1016358 - RNA, 22 nt, Mycobacterium avium subsp. paratuberculosis
cggccggccacgcucggcggcg

SEQ ID NO: 1016359 - RNA, 13 nt, Mycobacterium avium subsp. paratuberculosis
cggccggccagca

SEQ ID NO: 1016360 - RNA, 21 nt, Mycobacterium avium subsp. paratuberculosis
cggccggcagcaucgggacgc

SEQ ID NO: 1016361 - RNA, 15 nt, Mycobacterium avium subsp. paratuberculosis
cggccggcaggccgc

SEQ ID NO: 1016362 - RNA, 19 nt, Mycobacterium avium subsp. paratuberculosis
cggccggcagcggugccgc

SEQ ID NO: 1016363 - RNA, 21 nt, Mycobacterium avium subsp. paratuberculosis
cggccggcagcggugccgccc

SEQ ID NO: 1016364 - RNA, 12 nt, Mycobacterium avium subsp. paratuberculosis
cggccgggcgau

SEQ ID NO: 1016365 - RNA, 17 nt, Mycobacterium avium subsp. paratuberculosis
cggccgggcgccccgac

SEQ ID NO: 1016366 - RNA, 13 nt, Mycobacterium avium subsp. paratuberculosis
cggccgggcccuc

SEQ ID NO: 1016367 - RNA, 17 nt, Mycobacterium avium subsp. paratuberculosis
cggccgggcugcgcagc

SEQ ID NO: 1016368 - RNA, 19 nt, Mycobacterium avium subsp. paratuberculosis
cggccgggcugcgcagcac

SEQ ID NO: 1016369 - RNA, 14 nt, Mycobacterium avium subsp. paratuberculosis
cggccggggccagc

SEQ ID NO: 1016370 - RNA, 15 nt, Mycobacterium avium subsp. paratuberculosis
cggccggggccagca

SEQ ID NO: 1016371 - RNA, 20 nt, Mycobacterium avium subsp. paratuberculosis
cggccggggccagcacccag

SEQ ID NO: 1016372 - RNA, 21 nt, Mycobacterium avium subsp. paratuberculosis
cggccgggauuucccgggcga

SEQ ID NO: 1016373 - RNA, 14 nt, Mycobacterium avium subsp. paratuberculosis
cggccggcggcagu

SEQ ID NO: 1016374 - RNA, 13 nt, Mycobacterium avium subsp. paratuberculosis
cggccggcggggc

SEQ ID NO: 1016375 - RNA, 16 nt, Mycobacterium avium subsp. paratuberculosis
cggccggcgccggcgg

SEQ ID NO: 1016376 - RNA, 19 nt, Mycobacterium avium subsp. paratuberculosis
cggccggcgccggcgguca

SEQ ID NO: 1016377 - RNA, 16 nt, Mycobacterium avium subsp. paratuberculosis
cggccggcgcgcacgg

SEQ ID NO: 1016378 - RNA, 14 nt, Mycobacterium avium subsp. paratuberculosis
cggccggcgccggc

SEQ ID NO: 1016379 - RNA, 15 nt, Mycobacterium avium subsp. paratuberculosis
cggccggccagcagc

SEQ ID NO: 1016380 - RNA, 16 nt, Mycobacterium avium subsp. paratuberculosis
cggccggcgagguggg

SEQ ID NO: 1016381 - RNA, 13 nt, Mycobacterium avium subsp. paratuberculosis
cggccggccagcg

SEQ ID NO: 1016382 - RNA, 19 nt, Mycobacterium avium subsp. paratuberculosis
cggccggccgccggcggcc

SEQ ID NO: 1016383 - RNA, 13 nt, Mycobacterium avium subsp. paratuberculosis
cggccggccgccu

SEQ ID NO: 1016384 - RNA, 15 nt, Mycobacterium avium subsp. paratuberculosis
cggccggccgcgccc

SEQ ID NO: 1016385 - RNA, 16 nt, Mycobacterium avium subsp. paratuberculosis
cggccggccgcgcgcg

SEQ ID NO: 1016386 - RNA, 13 nt, Mycobacterium avium subsp. paratuberculosis
cggccggccccgc

SEQ ID NO: 1016387 - RNA, 21 nt, Mycobacterium avium subsp. paratuberculosis
cggccggccccgcccggcgcg

SEQ ID NO: 1016388 - RNA, 16 nt, Mycobacterium avium subsp. paratuberculosis
cggccggccccggggg

SEQ ID NO: 1016389 - RNA, 19 nt, Mycobacterium avium subsp. paratuberculosis
cggccggcccgcccggcgg

SEQ ID NO: 1016390 - RNA, 21 nt, Mycobacterium avium subsp. paratuberculosis
cggccggcccgcccggcggcg

SEQ ID NO: 1016391 - RNA, 15 nt, Mycobacterium avium subsp. paratuberculosis
cggccgcuacccggc

SEQ ID NO: 1016392 - RNA, 15 nt, Mycobacterium avium subsp. paratuberculosis
cggccgcgucggcgg

SEQ ID NO: 1016393 - RNA, 14 nt, Mycobacterium avium subsp. paratuberculosis
cggccgcgucgggc

SEQ ID NO: 1016394 - RNA, 22 nt, Mycobacterium avium subsp. paratuberculosis
cggccgcggugaccgcgccgcg

SEQ ID NO: 1016395 - RNA, 21 nt, Mycobacterium avium subsp. paratuberculosis
cggccgcggccagcgaggugg

SEQ ID NO: 1016396 - RNA, 15 nt, Mycobacterium avium subsp. paratuberculosis
cggccgcggcccggc

SEQ ID NO: 1016397 - RNA, 16 nt, Mycobacterium avium subsp. paratuberculosis
cggccgcggccggcgg

SEQ ID NO: 1016398 - RNA, 17 nt, Mycobacterium avium subsp. paratuberculosis
cggccgcggcgcgcauc

SEQ ID NO: 1016399 - RNA, 17 nt, Mycobacterium avium subsp. paratuberculosis
cggccgcggcgcggccc

SEQ ID NO: 1016400 - RNA, 20 nt, Mycobacterium avium subsp. paratuberculosis
cggccgcggcgcggcccggc

SEQ ID NO: 1016401 - RNA, 20 nt, Mycobacterium avium subsp. paratuberculosis
cggccgcgcgugcccgcggu

SEQ ID NO: 1016402 - RNA, 22 nt, Mycobacterium avium subsp. paratuberculosis
cggccgcggaauucgcgggugc

SEQ ID NO: 1016403 - RNA, 20 nt, Mycobacterium avium subsp. paratuberculosis
cggccgcgccgaacaccacg

SEQ ID NO: 1016404 - RNA, 13 nt, Mycobacterium avium subsp. paratuberculosis
cggccgcgccggc

SEQ ID NO: 1016405 - RNA, 12 nt, Mycobacterium avium subsp. paratuberculosis
cggccgcgcaga

SEQ ID NO: 1016406 - RNA, 14 nt, Mycobacterium avium subsp. paratuberculosis
cggccgcgcagauc

SEQ ID NO: 1016407 - RNA, 17 nt, Mycobacterium avium subsp. paratuberculosis
cggccgccucccgcagc

SEQ ID NO: 1016408 - RNA, 18 nt, Mycobacterium avium subsp. paratuberculosis
cggccgccucccgcagcg

SEQ ID NO: 1016409 - RNA, 13 nt, Mycobacterium avium subsp. paratuberculosis
cggccgccuggac

SEQ ID NO: 1016410 - RNA, 18 nt, Mycobacterium avium subsp. paratuberculosis
cggccgccuuggugaucc

SEQ ID NO: 1016411 - RNA, 17 nt, Mycobacterium avium subsp. paratuberculosis
cggccgcgacgcgcggu

SEQ ID NO: 1016412 - RNA, 17 nt, Mycobacterium avium subsp. paratuberculosis
cggccgcgacugcaccc

SEQ ID NO: 1016413 - RNA, 16 nt, Mycobacterium avium subsp. paratuberculosis
cggccgcgagcccggc

SEQ ID NO: 1016414 - RNA, 18 nt, Mycobacterium avium subsp. paratuberculosis
cggccgcgaucgccaacg

SEQ ID NO: 1016415 - RNA, 22 nt, Mycobacterium avium subsp. paratuberculosis
cggccgcgauguagcggacggg

SEQ ID NO: 1016416 - RNA, 13 nt, Mycobacterium avium subsp. paratuberculosis
cggccgcgcaccg

SEQ ID NO: 1016417 - RNA, 22 nt, Mycobacterium avium subsp. paratuberculosis
cggccgcgcaccgccccgcccu

SEQ ID NO: 1016418 - RNA, 15 nt, Mycobacterium avium subsp. paratuberculosis
cggccgccgggacgg

SEQ ID NO: 1016419 - RNA, 13 nt, Mycobacterium avium subsp. paratuberculosis
cggccgccggcca

SEQ ID NO: 1016420 - RNA, 19 nt, Mycobacterium avium subsp. paratuberculosis
cggccgccggccagcuccg

SEQ ID NO: 1016421 - RNA, 13 nt, Mycobacterium avium subsp. paratuberculosis
cggccgccgcccg

SEQ ID NO: 1016422 - RNA, 22 nt, Mycobacterium avium subsp. paratuberculosis
cggccgccgaucaacaggccca

SEQ ID NO: 1016423 - RNA, 14 nt, Mycobacterium avium subsp. paratuberculosis
cggccgccgcgcau

SEQ ID NO: 1016424 - RNA, 15 nt, Mycobacterium avium subsp. paratuberculosis
cggccgccgcgcauc

SEQ ID NO: 1016425 - RNA, 12 nt, Mycobacterium avium subsp. paratuberculosis
cggccgcccggc

SEQ ID NO: 1016426 - RNA, 15 nt, Mycobacterium avium subsp. paratuberculosis
cggccgcccggcgag

SEQ ID NO: 1016427 - RNA, 19 nt, Mycobacterium avium subsp. paratuberculosis
cggccgcccggcgagcagc

SEQ ID NO: 1016428 - RNA, 14 nt, Mycobacterium avium subsp. paratuberculosis
cggccgccagggcc

SEQ ID NO: 1016429 - RNA, 15 nt, Mycobacterium avium subsp. paratuberculosis
cggccgccagggcca

SEQ ID NO: 1016430 - RNA, 16 nt, Mycobacterium avium subsp. paratuberculosis
cggccgcccgcaccag

SEQ ID NO: 1016431 - RNA, 17 nt, Mycobacterium avium subsp. paratuberculosis
cggccgcccgcaccagc

SEQ ID NO: 1016432 - RNA, 19 nt, Mycobacterium avium subsp. paratuberculosis
cggccgcccgcaccagcag

SEQ ID NO: 1016433 - RNA, 16 nt, Mycobacterium avium subsp. paratuberculosis
cggccgcccguccggg

SEQ ID NO: 1016434 - RNA, 15 nt, Mycobacterium avium subsp. paratuberculosis
cggccgcccgucggg

SEQ ID NO: 1016435 - RNA, 17 nt, Mycobacterium avium subsp. paratuberculosis
cggccgcccgucggggc

SEQ ID NO: 1016436 - RNA, 22 nt, Mycobacterium avium subsp. paratuberculosis
cggccgcccgucggggcccggc

SEQ ID NO: 1016437 - RNA, 17 nt, Mycobacterium avium subsp. paratuberculosis
cggccgccagcgcccgc

SEQ ID NO: 1016438 - RNA, 16 nt, Mycobacterium avium subsp. paratuberculosis
cggccgcaccccaccc

SEQ ID NO: 1016439 - RNA, 17 nt, Mycobacterium avium subsp. paratuberculosis
cggccgcaccccacccg

SEQ ID NO: 1016440 - RNA, 20 nt, Mycobacterium avium subsp. paratuberculosis
cggccgcaccccacccgcgc

SEQ ID NO: 1016441 - RNA, 16 nt, Mycobacterium avium subsp. paratuberculosis
cggccgcagcggcagg

SEQ ID NO: 1016442 - RNA, 22 nt, Mycobacterium avium subsp. paratuberculosis
cggccgcagcgugggcaccggc

SEQ ID NO: 1016443 - RNA, 22 nt, Mycobacterium avium subsp. paratuberculosis
cggcccugcggccagugccggg

SEQ ID NO: 1016444 - RNA, 17 nt, Mycobacterium avium subsp. paratuberculosis
cggcccguugagcaccg

SEQ ID NO: 1016445 - RNA, 18 nt, Mycobacterium avium subsp. paratuberculosis
cggcccguugagcaccgc

SEQ ID NO: 1016446 - RNA, 21 nt, Mycobacterium avium subsp. paratuberculosis
cggcccuauggcaucgccaag

SEQ ID NO: 1016447 - RNA, 15 nt, Mycobacterium avium subsp. paratuberculosis
cggcccuccagcacc

SEQ ID NO: 1016448 - RNA, 15 nt, Mycobacterium avium subsp. paratuberculosis
cggccgaaacgcccg

SEQ ID NO: 1016449 - RNA, 17 nt, Mycobacterium avium subsp. paratuberculosis
cggccgaaacgcccggc

SEQ ID NO: 1016450 - RNA, 17 nt, Mycobacterium avium subsp. paratuberculosis
cggcccuugcggccgau

SEQ ID NO: 1016451 - RNA, 21 nt, Mycobacterium avium subsp. paratuberculosis
cggcccugguugagcaccgcg

SEQ ID NO: 1016452 - RNA, 21 nt, Mycobacterium avium subsp. paratuberculosis
cggcccuggcgggcggcccgc

SEQ ID NO: 1016453 - RNA, 15 nt, Mycobacterium avium subsp. paratuberculosis
cggcccggucgacuu

SEQ ID NO: 1016454 - RNA, 18 nt, Mycobacterium avium subsp. paratuberculosis
cggcccguccgccccgcu

SEQ ID NO: 1016455 - RNA, 16 nt, Mycobacterium avium subsp. paratuberculosis
cggcccgucgagcggc

SEQ ID NO: 1016456 - RNA, 18 nt, Mycobacterium avium subsp. paratuberculosis
cggcccgucgccaccacg

SEQ ID NO: 1016457 - RNA, 23 nt, Mycobacterium avium subsp. paratuberculosis
cggcccgucgccgaucagcacca

SEQ ID NO: 1016458 - RNA, 17 nt, Mycobacterium avium subsp. paratuberculosis
cggcccgucgccgugcg

SEQ ID NO: 1016459 - RNA, 21 nt, Mycobacterium avium subsp. paratuberculosis
cggcccggcgaugccgagccc

SEQ ID NO: 1016460 - RNA, 15 nt, Mycobacterium avium subsp. paratuberculosis
cggcccggcgcggcc

SEQ ID NO: 1016461 - RNA, 13 nt, Mycobacterium avium subsp. paratuberculosis
cggcccggcgggc

SEQ ID NO: 1016462 - RNA, 19 nt, Mycobacterium avium subsp. paratuberculosis
cggcccgggaagccgcagc

SEQ ID NO: 1016463 - RNA, 16 nt, Mycobacterium avium subsp. paratuberculosis
cggccgcacaccacca

SEQ ID NO: 1016464 - RNA, 18 nt, Mycobacterium avium subsp. paratuberculosis
cggccgauucggcgccgc

SEQ ID NO: 1016465 - RNA, 19 nt, Mycobacterium avium subsp. paratuberculosis
cggccgauucggcgccgcg

SEQ ID NO: 1016466 - RNA, 21 nt, Mycobacterium avium subsp. paratuberculosis
cggccgaugaccucgcacagc

SEQ ID NO: 1016467 - RNA, 20 nt, Mycobacterium avium subsp. paratuberculosis
cggccgaucauggucggcga

SEQ ID NO: 1016468 - RNA, 16 nt, Mycobacterium avium subsp. paratuberculosis
cggccgagguccgcgg

SEQ ID NO: 1016469 - RNA, 18 nt, Mycobacterium avium subsp. paratuberculosis
cggccgagguccgcgguu

SEQ ID NO: 1016470 - RNA, 16 nt, Mycobacterium avium subsp. paratuberculosis
cggccgagccgaugcc

SEQ ID NO: 1016471 - RNA, 13 nt, Mycobacterium avium subsp. paratuberculosis
cggccgagcgcac

SEQ ID NO: 1016472 - RNA, 15 nt, Mycobacterium avium subsp. paratuberculosis
cggccgacgcccagc

SEQ ID NO: 1016473 - RNA, 19 nt, Mycobacterium avium subsp. paratuberculosis
cggccgacgcccagcaccg

SEQ ID NO: 1016474 - RNA, 19 nt, Mycobacterium avium subsp. paratuberculosis
cggccgaagcguuccgccg

SEQ ID NO: 1016475 - RNA, 18 nt, Mycobacterium avium subsp. paratuberculosis
cggccgaacacggccgcc

SEQ ID NO: 1016476 - RNA, 21 nt, Mycobacterium avium subsp. paratuberculosis
cggccgaacacggccgccucc

SEQ ID NO: 1016477 - RNA, 21 nt, Mycobacterium avium subsp. paratuberculosis
cggccgacaacgacagcaccc

SEQ ID NO: 1016478 - RNA, 22 nt, Mycobacterium avium subsp. paratuberculosis
cggccgacauggacgcggccuc

SEQ ID NO: 1016479 - RNA, 14 nt, Mycobacterium avium subsp. paratuberculosis
cggccccgcccggc

SEQ ID NO: 1016480 - RNA, 21 nt, Mycobacterium avium subsp. paratuberculosis
cggccccgcccggcgcgcagc

SEQ ID NO: 1016481 - RNA, 13 nt, Mycobacterium avium subsp. paratuberculosis
cggccccgcgcau

SEQ ID NO: 1016482 - RNA, 13 nt, Mycobacterium avium subsp. paratuberculosis
cggcccagcagcg

SEQ ID NO: 1016483 - RNA, 12 nt, Mycobacterium avium subsp. paratuberculosis
cggccccccggg

SEQ ID NO: 1016484 - RNA, 18 nt, Mycobacterium avium subsp. paratuberculosis
cggcccccgagcuucggg

SEQ ID NO: 1016485 - RNA, 14 nt, Mycobacterium avium subsp. paratuberculosis
cggcccccgggccc

SEQ ID NO: 1016486 - RNA, 11 nt, Mycobacterium avium subsp. paratuberculosis
cggccccgcca

SEQ ID NO: 1016487 - RNA, 13 nt, Mycobacterium avium subsp. paratuberculosis
cggccccgccagc

SEQ ID NO: 1016488 - RNA, 19 nt, Mycobacterium avium subsp. paratuberculosis
cggcccgaacaccuccucg

SEQ ID NO: 1016489 - RNA, 20 nt, Mycobacterium avium subsp. paratuberculosis
cggcccgaacaccuccucgg

SEQ ID NO: 1016490 - RNA, 16 nt, Mycobacterium avium subsp. paratuberculosis
cggcccgaccagcggg

SEQ ID NO: 1016491 - RNA, 20 nt, Mycobacterium avium subsp. paratuberculosis
cggcccgaccagcgggccga

SEQ ID NO: 1016492 - RNA, 21 nt, Mycobacterium avium subsp. paratuberculosis
cggcccgaucucgcgcggguc

SEQ ID NO: 1016493 - RNA, 15 nt, Mycobacterium avium subsp. paratuberculosis
cggcccgaucaccag

SEQ ID NO: 1016494 - RNA, 19 nt, Mycobacterium avium subsp. paratuberculosis
cggcccgaucaccaggccc

SEQ ID NO: 1016495 - RNA, 20 nt, Mycobacterium avium subsp. paratuberculosis
cggcccgaucaccaggccca

SEQ ID NO: 1016496 - RNA, 23 nt, Mycobacterium avium subsp. paratuberculosis
cggcccgaucaccaggcccaggc

SEQ ID NO: 1016497 - RNA, 16 nt, Mycobacterium avium subsp. paratuberculosis
cggcccgagcaccacc

SEQ ID NO: 1016498 - RNA, 14 nt, Mycobacterium avium subsp. paratuberculosis
cggcccgagcccug

SEQ ID NO: 1016499 - RNA, 15 nt, Mycobacterium avium subsp. paratuberculosis
cggcccgagcccugc

SEQ ID NO: 1016500 - RNA, 20 nt, Mycobacterium avium subsp. paratuberculosis
cggcccggaacgcgucgccc

SEQ ID NO: 1016501 - RNA, 17 nt, Mycobacterium avium subsp. paratuberculosis
cggcccggccaccaggg

SEQ ID NO: 1016502 - RNA, 13 nt, Mycobacterium avium subsp. paratuberculosis
cggcccggccacu

SEQ ID NO: 1016503 - RNA, 16 nt, Mycobacterium avium subsp. paratuberculosis
cggcccggccacucgc

SEQ ID NO: 1016504 - RNA, 14 nt, Mycobacterium avium subsp. paratuberculosis
cggcccgcucgggc

SEQ ID NO: 1016505 - RNA, 18 nt, Mycobacterium avium subsp. paratuberculosis
cggcccgcuucaggcagc

SEQ ID NO: 1016506 - RNA, 13 nt, Mycobacterium avium subsp. paratuberculosis
cggcccgcccggc

SEQ ID NO: 1016507 - RNA, 20 nt, Mycobacterium avium subsp. paratuberculosis
cggcccgccgaacgccuccg

SEQ ID NO: 1016508 - RNA, 13 nt, Mycobacterium avium subsp. paratuberculosis
cggcccgccgccg

SEQ ID NO: 1016509 - RNA, 17 nt, Mycobacterium avium subsp. paratuberculosis
cggcccgccgccggcgg

SEQ ID NO: 1016510 - RNA, 20 nt, Mycobacterium avium subsp. paratuberculosis
cggcccgcagccagcgcagc

SEQ ID NO: 1016511 - RNA, 16 nt, Mycobacterium avium subsp. paratuberculosis
cggcccgcagcgccuc

SEQ ID NO: 1016512 - RNA, 19 nt, Mycobacterium avium subsp. paratuberculosis
cggcccgcagcgccucggc

SEQ ID NO: 1016513 - RNA, 16 nt, Mycobacterium avium subsp. paratuberculosis
cggcccgccgcgcccg

SEQ ID NO: 1016514 - RNA, 18 nt, Mycobacterium avium subsp. paratuberculosis
cggcccgccgcgcccggc

SEQ ID NO: 1016515 - RNA, 13 nt, Mycobacterium avium subsp. paratuberculosis
cggcccgccgcuc

SEQ ID NO: 1016516 - RNA, 16 nt, Mycobacterium avium subsp. paratuberculosis
cggcccgccgggccgg

SEQ ID NO: 1016517 - RNA, 14 nt, Mycobacterium avium subsp. paratuberculosis
cggcccgccgggcg

SEQ ID NO: 1016518 - RNA, 14 nt, Mycobacterium avium subsp. paratuberculosis
cggcccgcgccccg

SEQ ID NO: 1016519 - RNA, 18 nt, Mycobacterium avium subsp. paratuberculosis
cggcccgcgccccggcgg

SEQ ID NO: 1016520 - RNA, 14 nt, Mycobacterium avium subsp. paratuberculosis
cggcccgccucggc

SEQ ID NO: 1016521 - RNA, 19 nt, Mycobacterium avium subsp. paratuberculosis
cggcccgccacccgaggcc

SEQ ID NO: 1016522 - RNA, 17 nt, Mycobacterium avium subsp. paratuberculosis
cggcccgcgccggcgug

SEQ ID NO: 1016523 - RNA, 15 nt, Mycobacterium avium subsp. paratuberculosis
cggcccaacacgccc

SEQ ID NO: 1016524 - RNA, 12 nt, Mycobacterium avium subsp. paratuberculosis
cggcccaaccgg

SEQ ID NO: 1016525 - RNA, 15 nt, Mycobacterium avium subsp. paratuberculosis
cggcccaagacccgc

SEQ ID NO: 1016526 - RNA, 23 nt, Mycobacterium avium subsp. paratuberculosis
cggccaguucggguccgcggucc

SEQ ID NO: 1016527 - RNA, 17 nt, Mycobacterium avium subsp. paratuberculosis
cggccaguucgagcgcc

SEQ ID NO: 1016528 - RNA, 19 nt, Mycobacterium avium subsp. paratuberculosis
cggccaguucgagcgccgc

SEQ ID NO: 1016529 - RNA, 22 nt, Mycobacterium avium subsp. paratuberculosis
cggccaguucgagcgccgcggc

SEQ ID NO: 1016530 - RNA, 15 nt, Mycobacterium avium subsp. paratuberculosis
cggccaguucgccgg

SEQ ID NO: 1016531 - RNA, 13 nt, Mycobacterium avium subsp. paratuberculosis
cggcccacgccgu

SEQ ID NO: 1016532 - RNA, 12 nt, Mycobacterium avium subsp. paratuberculosis
cggcccagccgg

SEQ ID NO: 1016533 - RNA, 16 nt, Mycobacterium avium subsp. paratuberculosis
cggcccagccggcggu

SEQ ID NO: 1016534 - RNA, 13 nt, Mycobacterium avium subsp. paratuberculosis
cggcccaccaccg

SEQ ID NO: 1016535 - RNA, 16 nt, Mycobacterium avium subsp. paratuberculosis
cggcccaccaccgccu

SEQ ID NO: 1016536 - RNA, 13 nt, Mycobacterium avium subsp. paratuberculosis
cggcccacccgga

SEQ ID NO: 1016537 - RNA, 14 nt, Mycobacterium avium subsp. paratuberculosis
cggcccaccggccc

SEQ ID NO: 1016538 - RNA, 20 nt, Mycobacterium avium subsp. paratuberculosis
cggccaguccggcagcagcg

SEQ ID NO: 1016539 - RNA, 16 nt, Mycobacterium avium subsp. paratuberculosis
cggccagugccgggcc

SEQ ID NO: 1016540 - RNA, 14 nt, Mycobacterium avium subsp. paratuberculosis
cggccagggugacg

SEQ ID NO: 1016541 - RNA, 13 nt, Mycobacterium avium subsp. paratuberculosis
cggccaguccagg

SEQ ID NO: 1016542 - RNA, 14 nt, Mycobacterium avium subsp. paratuberculosis
cggccaguccaggc

SEQ ID NO: 1016543 - RNA, 21 nt, Mycobacterium avium subsp. paratuberculosis
cggccagguugaccaccagcg

SEQ ID NO: 1016544 - RNA, 23 nt, Mycobacterium avium subsp. paratuberculosis
cggccaggucgacggggucggac

SEQ ID NO: 1016545 - RNA, 22 nt, Mycobacterium avium subsp. paratuberculosis
cggccaggucgagguagugcgc

SEQ ID NO: 1016546 - RNA, 21 nt, Mycobacterium avium subsp. paratuberculosis
cggccaggucgccgcgcagca

SEQ ID NO: 1016547 - RNA, 22 nt, Mycobacterium avium subsp. paratuberculosis
cggccagggugucccagcgcca

SEQ ID NO: 1016548 - RNA, 16 nt, Mycobacterium avium subsp. paratuberculosis
cggccagcgcgcggcc

SEQ ID NO: 1016549 - RNA, 22 nt, Mycobacterium avium subsp. paratuberculosis
cggccaggguagaggcggcgac

SEQ ID NO: 1016550 - RNA, 15 nt, Mycobacterium avium subsp. paratuberculosis
cggccagcgcgcgca

SEQ ID NO: 1016551 - RNA, 15 nt, Mycobacterium avium subsp. paratuberculosis
cggccagcgcgccgc

SEQ ID NO: 1016552 - RNA, 13 nt, Mycobacterium avium subsp. paratuberculosis
cggccagcgcgcc

SEQ ID NO: 1016553 - RNA, 22 nt, Mycobacterium avium subsp. paratuberculosis
cggccagcgcgaaagcagcaac

SEQ ID NO: 1016554 - RNA, 18 nt, Mycobacterium avium subsp. paratuberculosis
cggccagcgccuucucca

SEQ ID NO: 1016555 - RNA, 16 nt, Mycobacterium avium subsp. paratuberculosis
cggccagccgcucccg

SEQ ID NO: 1016556 - RNA, 17 nt, Mycobacterium avium subsp. paratuberculosis
cggccagcgcccgcggg

SEQ ID NO: 1016557 - RNA, 16 nt, Mycobacterium avium subsp. paratuberculosis
cggccagcgccgcccg

SEQ ID NO: 1016558 - RNA, 17 nt, Mycobacterium avium subsp. paratuberculosis
cggccagcgccgcccgg

SEQ ID NO: 1016559 - RNA, 19 nt, Mycobacterium avium subsp. paratuberculosis
cggccagcgccgcgcgcgc

SEQ ID NO: 1016560 - RNA, 12 nt, Mycobacterium avium subsp. paratuberculosis
cggccagcgccu

SEQ ID NO: 1016561 - RNA, 19 nt, Mycobacterium avium subsp. paratuberculosis
cggccagcgccccgccggg

SEQ ID NO: 1016562 - RNA, 14 nt, Mycobacterium avium subsp. paratuberculosis
cggccagcgcccgc

SEQ ID NO: 1016563 - RNA, 12 nt, Mycobacterium avium subsp. paratuberculosis
cggccagcagcg

SEQ ID NO: 1016564 - RNA, 12 nt, Mycobacterium avium subsp. paratuberculosis
cggccagcaggu

SEQ ID NO: 1016565 - RNA, 18 nt, Mycobacterium avium subsp. paratuberculosis
cggccagccccaccaccg

SEQ ID NO: 1016566 - RNA, 13 nt, Mycobacterium avium subsp. paratuberculosis
cggccagccccgg

SEQ ID NO: 1016567 - RNA, 19 nt, Mycobacterium avium subsp. paratuberculosis
cggccagccccgggaacca

SEQ ID NO: 1016568 - RNA, 22 nt, Mycobacterium avium subsp. paratuberculosis
cggccagcccgcggcagccagc

SEQ ID NO: 1016569 - RNA, 20 nt, Mycobacterium avium subsp. paratuberculosis
cggccagccagccgcccagc

SEQ ID NO: 1016570 - RNA, 13 nt, Mycobacterium avium subsp. paratuberculosis
cggccagcgcagc

SEQ ID NO: 1016571 - RNA, 19 nt, Mycobacterium avium subsp. paratuberculosis
cggccagccgggggaucac

SEQ ID NO: 1016572 - RNA, 21 nt, Mycobacterium avium subsp. paratuberculosis
cggccagccggucgucggggc

SEQ ID NO: 1016573 - RNA, 19 nt, Mycobacterium avium subsp. paratuberculosis
cggccagccggccgcugac

SEQ ID NO: 1016574 - RNA, 13 nt, Mycobacterium avium subsp. paratuberculosis
cggccagccgcgc

SEQ ID NO: 1016575 - RNA, 15 nt, Mycobacterium avium subsp. paratuberculosis
cggccagccgcgcga

SEQ ID NO: 1016576 - RNA, 16 nt, Mycobacterium avium subsp. paratuberculosis
cggccagccgcgcggc

SEQ ID NO: 1016577 - RNA, 13 nt, Mycobacterium avium subsp. paratuberculosis
cggcaucccggag

SEQ ID NO: 1016578 - RNA, 16 nt, Mycobacterium avium subsp. paratuberculosis
cggcaucgcgcgcggc

SEQ ID NO: 1016579 - RNA, 14 nt, Mycobacterium avium subsp. paratuberculosis
cggccagcagcacc

SEQ ID NO: 1016580 - RNA, 15 nt, Mycobacterium avium subsp. paratuberculosis
cggccagcagcacca

SEQ ID NO: 1016581 - RNA, 16 nt, Mycobacterium avium subsp. paratuberculosis
cggccagcagcaccgc

SEQ ID NO: 1016582 - RNA, 19 nt, Mycobacterium avium subsp. paratuberculosis
cggccagcagcaccgcguu

SEQ ID NO: 1016583 - RNA, 21 nt, Mycobacterium avium subsp. paratuberculosis
cggccagcagcagcccgccga

SEQ ID NO: 1016584 - RNA, 16 nt, Mycobacterium avium subsp. paratuberculosis
cggccagcagccgcuc

SEQ ID NO: 1016585 - RNA, 14 nt, Mycobacterium avium subsp. paratuberculosis
cgcgguccacgccg

SEQ ID NO: 1016586 - RNA, 21 nt, Mycobacterium avium subsp. paratuberculosis
cgcgguccaggaucugcagca

SEQ ID NO: 1016587 - RNA, 23 nt, Mycobacterium avium subsp. paratuberculosis
cgcgguccaucuccagcuccgcg

SEQ ID NO: 1016588 - RNA, 13 nt, Mycobacterium avium subsp. paratuberculosis
cgcggucagccgg

SEQ ID NO: 1016589 - RNA, 15 nt, Mycobacterium avium subsp. paratuberculosis
cgcggucagcgucug

SEQ ID NO: 1016590 - RNA, 16 nt, Mycobacterium avium subsp. paratuberculosis
cgcggucagcucgauc

SEQ ID NO: 1016591 - RNA, 21 nt, Mycobacterium avium subsp. paratuberculosis
cgcgguagaaccaacgcggcg

SEQ ID NO: 1016592 - RNA, 13 nt, Mycobacterium avium subsp. paratuberculosis
cgcggugagcagc

SEQ ID NO: 1016593 - RNA, 21 nt, Mycobacterium avium subsp. paratuberculosis
cgcggugugggcgauggcggc

SEQ ID NO: 1016594 - RNA, 22 nt, Mycobacterium avium subsp. paratuberculosis
cgcggugcacggucagcucgcg

SEQ ID NO: 1016595 - RNA, 17 nt, Mycobacterium avium subsp. paratuberculosis
cgcggugcagcaggaac

SEQ ID NO: 1016596 - RNA, 17 nt, Mycobacterium avium subsp. paratuberculosis
cgcggugugcggcagcu

SEQ ID NO: 1016597 - RNA, 21 nt, Mycobacterium avium subsp. paratuberculosis
cgcggugugcuggccagcacc

SEQ ID NO: 1016598 - RNA, 17 nt, Mycobacterium avium subsp. paratuberculosis
cgcggugagcggccgca

SEQ ID NO: 1016599 - RNA, 14 nt, Mycobacterium avium subsp. paratuberculosis
cgcggugaugaccu

SEQ ID NO: 1016600 - RNA, 15 nt, Mycobacterium avium subsp. paratuberculosis
cgcggugaugaccuc

SEQ ID NO: 1016601 - RNA, 22 nt, Mycobacterium avium subsp. paratuberculosis
cgcggugaccgccgccauccgc

SEQ ID NO: 1016602 - RNA, 16 nt, Mycobacterium avium subsp. paratuberculosis
cgcggugaccgcgccg

SEQ ID NO: 1016603 - RNA, 13 nt, Mycobacterium avium subsp. paratuberculosis
cgcggugacgcgc

SEQ ID NO: 1016604 - RNA, 19 nt, Mycobacterium avium subsp. paratuberculosis
cgcggugacgcgccggccc

SEQ ID NO: 1016605 - RNA, 20 nt, Mycobacterium avium subsp. paratuberculosis
cgcggugaaguugccgccgc

SEQ ID NO: 1016606 - RNA, 23 nt, Mycobacterium avium subsp. paratuberculosis
cgcggugacaugcccgggcucgc

SEQ ID NO: 1016607 - RNA, 14 nt, Mycobacterium avium subsp. paratuberculosis
cgcggugacgguga

SEQ ID NO: 1016608 - RNA, 17 nt, Mycobacterium avium subsp. paratuberculosis
cgcggucgggucccggc

SEQ ID NO: 1016609 - RNA, 22 nt, Mycobacterium avium subsp. paratuberculosis
cgcggucucgaucugcaccagc

SEQ ID NO: 1016610 - RNA, 18 nt, Mycobacterium avium subsp. paratuberculosis
cgcggucgguggcggugc

SEQ ID NO: 1016611 - RNA, 23 nt, Mycobacterium avium subsp. paratuberculosis
cgcggucgguggcggugccgcgg

SEQ ID NO: 1016612 - RNA, 14 nt, Mycobacterium avium subsp. paratuberculosis
cgcggucgucgccc

SEQ ID NO: 1016613 - RNA, 18 nt, Mycobacterium avium subsp. paratuberculosis
cgcggucgucuucuuggc

SEQ ID NO: 1016614 - RNA, 12 nt, Mycobacterium avium subsp. paratuberculosis
cgcggucggcgc

SEQ ID NO: 1016615 - RNA, 14 nt, Mycobacterium avium subsp. paratuberculosis
cgcggucggcgccc

SEQ ID NO: 1016616 - RNA, 14 nt, Mycobacterium avium subsp. paratuberculosis
cgcggucggcggcg

SEQ ID NO: 1016617 - RNA, 12 nt, Mycobacterium avium subsp. paratuberculosis
cgcggucggcgu

SEQ ID NO: 1016618 - RNA, 15 nt, Mycobacterium avium subsp. paratuberculosis
cgcggucgccaccac

SEQ ID NO: 1016619 - RNA, 19 nt, Mycobacterium avium subsp. paratuberculosis
cgcggucgcaggccgcccg

SEQ ID NO: 1016620 - RNA, 19 nt, Mycobacterium avium subsp. paratuberculosis
cgcggucgcugacccgccg

SEQ ID NO: 1016621 - RNA, 20 nt, Mycobacterium avium subsp. paratuberculosis
cgcggucggcaacccgaccu

SEQ ID NO: 1016622 - RNA, 16 nt, Mycobacterium avium subsp. paratuberculosis
cgcgucgaacagccgg

SEQ ID NO: 1016623 - RNA, 19 nt, Mycobacterium avium subsp. paratuberculosis
cgcgucgaacagccgggcc

SEQ ID NO: 1016624 - RNA, 14 nt, Mycobacterium avium subsp. paratuberculosis
cgcgucgaccaccg

SEQ ID NO: 1016625 - RNA, 15 nt, Mycobacterium avium subsp. paratuberculosis
cgcgucgaccaccgc

SEQ ID NO: 1016626 - RNA, 16 nt, Mycobacterium avium subsp. paratuberculosis
cgcgucgaccagccgc

SEQ ID NO: 1016627 - RNA, 18 nt, Mycobacterium avium subsp. paratuberculosis
cgcgucgaccagccgcau

SEQ ID NO: 1016628 - RNA, 23 nt, Mycobacterium avium subsp. paratuberculosis
cgcgucgacgauggcguccaccg

SEQ ID NO: 1016629 - RNA, 16 nt, Mycobacterium avium subsp. paratuberculosis
cgcgucgacggcgccg

SEQ ID NO: 1016630 - RNA, 14 nt, Mycobacterium avium subsp. paratuberculosis
cgcgucgagcaccu

SEQ ID NO: 1016631 - RNA, 15 nt, Mycobacterium avium subsp. paratuberculosis
cgcgucgagcaccug

SEQ ID NO: 1016632 - RNA, 22 nt, Mycobacterium avium subsp. paratuberculosis
cgcgucgacguucgccgccagc

SEQ ID NO: 1016633 - RNA, 22 nt, Mycobacterium avium subsp. paratuberculosis
cgcgucgagcagcaccacccgc

SEQ ID NO: 1016634 - RNA, 14 nt, Mycobacterium avium subsp. paratuberculosis
cgcgucgcccacgc

SEQ ID NO: 1016635 - RNA, 16 nt, Mycobacterium avium subsp. paratuberculosis
cgcguccugcaggcag

SEQ ID NO: 1016636 - RNA, 20 nt, Mycobacterium avium subsp. paratuberculosis
cgcguccgcgggcggggccu

SEQ ID NO: 1016637 - RNA, 20 nt, Mycobacterium avium subsp. paratuberculosis
cgcguccauggucgagccgc

SEQ ID NO: 1016638 - RNA, 16 nt, Mycobacterium avium subsp. paratuberculosis
cgcguccaggugcgcc

SEQ ID NO: 1016639 - RNA, 21 nt, Mycobacterium avium subsp. paratuberculosis
cgcguccaggugcgccgccgc

SEQ ID NO: 1016640 - RNA, 18 nt, Mycobacterium avium subsp. paratuberculosis
cgcguccccgcgccgggc

SEQ ID NO: 1016641 - RNA, 20 nt, Mycobacterium avium subsp. paratuberculosis
cgcgucccgggccuuggcca

SEQ ID NO: 1016642 - RNA, 23 nt, Mycobacterium avium subsp. paratuberculosis
cgcgucccgggccuuggccaacg

SEQ ID NO: 1016643 - RNA, 17 nt, Mycobacterium avium subsp. paratuberculosis
cgcgguuuugaugccgc

SEQ ID NO: 1016644 - RNA, 21 nt, Mycobacterium avium subsp. paratuberculosis
cgcgguuuugaugccgccggg

SEQ ID NO: 1016645 - RNA, 18 nt, Mycobacterium avium subsp. paratuberculosis
cgcguccaaccgcggacu

SEQ ID NO: 1016646 - RNA, 20 nt, Mycobacterium avium subsp. paratuberculosis
cgcgguuccggcgugcagca

SEQ ID NO: 1016647 - RNA, 19 nt, Mycobacterium avium subsp. paratuberculosis
cgcgguucgaucuccucgg

SEQ ID NO: 1016648 - RNA, 19 nt, Mycobacterium avium subsp. paratuberculosis
cgcgguugcggguggcggc

SEQ ID NO: 1016649 - RNA, 18 nt, Mycobacterium avium subsp. paratuberculosis
cgcgguucuuguccucga

SEQ ID NO: 1016650 - RNA, 17 nt, Mycobacterium avium subsp. paratuberculosis
cgcgguugaacaggcug

SEQ ID NO: 1016651 - RNA, 20 nt, Mycobacterium avium subsp. paratuberculosis
cgcgguugaccgccgacacc

SEQ ID NO: 1016652 - RNA, 14 nt, Mycobacterium avium subsp. paratuberculosis
cgcgguugggccgc

SEQ ID NO: 1016653 - RNA, 16 nt, Mycobacterium avium subsp. paratuberculosis
cgcgguugggccgccg

SEQ ID NO: 1016654 - RNA, 20 nt, Mycobacterium avium subsp. paratuberculosis
cgcgguuuggucagcgcccc

SEQ ID NO: 1016655 - RNA, 23 nt, Mycobacterium avium subsp. paratuberculosis
cgcgguuucaccgugcgcgcgca

SEQ ID NO: 1016656 - RNA, 15 nt, Mycobacterium avium subsp. paratuberculosis
cgcuaacaaaagccc

SEQ ID NO: 1016657 - RNA, 18 nt, Mycobacterium avium subsp. paratuberculosis
cgcuaacggcgcggcagu

SEQ ID NO: 1016658 - RNA, 17 nt, Mycobacterium avium subsp. paratuberculosis
cgcgugcacaccggccu

SEQ ID NO: 1016659 - RNA, 23 nt, Mycobacterium avium subsp. paratuberculosis
cgcgugcacgaacgcggccagcg

SEQ ID NO: 1016660 - RNA, 22 nt, Mycobacterium avium subsp. paratuberculosis
cgcgucggaccccgaugcgcuc

SEQ ID NO: 1016661 - RNA, 19 nt, Mycobacterium avium subsp. paratuberculosis
cgcgugacggccgcggcgc

SEQ ID NO: 1016662 - RNA, 16 nt, Mycobacterium avium subsp. paratuberculosis
cgcgucggccagcacc

SEQ ID NO: 1016663 - RNA, 14 nt, Mycobacterium avium subsp. paratuberculosis
cgcgucggccagcg

SEQ ID NO: 1016664 - RNA, 23 nt, Mycobacterium avium subsp. paratuberculosis
cgcgugaccccggcgaccagcag

SEQ ID NO: 1016665 - RNA, 13 nt, Mycobacterium avium subsp. paratuberculosis
cgcgucgcguggc

SEQ ID NO: 1016666 - RNA, 13 nt, Mycobacterium avium subsp. paratuberculosis
cgcgucgcggcgc

SEQ ID NO: 1016667 - RNA, 12 nt, Mycobacterium avium subsp. paratuberculosis
cgcgucgcgggc

SEQ ID NO: 1016668 - RNA, 17 nt, Mycobacterium avium subsp. paratuberculosis
cgcgucgcgggcccggg

SEQ ID NO: 1016669 - RNA, 15 nt, Mycobacterium avium subsp. paratuberculosis
cgcgugcgucacgcu

SEQ ID NO: 1016670 - RNA, 19 nt, Mycobacterium avium subsp. paratuberculosis
cgcgugcgucaucgcgcug

SEQ ID NO: 1016671 - RNA, 21 nt, Mycobacterium avium subsp. paratuberculosis
cgcgugcgagccgagcacgca

SEQ ID NO: 1016672 - RNA, 14 nt, Mycobacterium avium subsp. paratuberculosis
cgcuacucgcgcau

SEQ ID NO: 1016673 - RNA, 21 nt, Mycobacterium avium subsp. paratuberculosis
cgcuacggcagaggcguuuuc

SEQ ID NO: 1016674 - RNA, 18 nt, Mycobacterium avium subsp. paratuberculosis
cgcucaaaggcgggcacu

SEQ ID NO: 1016675 - RNA, 15 nt, Mycobacterium avium subsp. paratuberculosis
cgcucaacccgggcc

SEQ ID NO: 1016676 - RNA, 19 nt, Mycobacterium avium subsp. paratuberculosis
cgcucaacccgucgcgggu

SEQ ID NO: 1016677 - RNA, 19 nt, Mycobacterium avium subsp. paratuberculosis
cgcuauuggccgagccggg

SEQ ID NO: 1016678 - RNA, 12 nt, Mycobacterium avium subsp. paratuberculosis
cgcucagcccgg

SEQ ID NO: 1016679 - RNA, 14 nt, Mycobacterium avium subsp. paratuberculosis
cgcucagcggcagc

SEQ ID NO: 1016680 - RNA, 23 nt, Mycobacterium avium subsp. paratuberculosis
cgcucagcggcagcgucgccagc

SEQ ID NO: 1016681 - RNA, 15 nt, Mycobacterium avium subsp. paratuberculosis
cgcucagcgggcggc

SEQ ID NO: 1016682 - RNA, 23 nt, Mycobacterium avium subsp. paratuberculosis
cgcucagcgggcggccagccgcu

SEQ ID NO: 1016683 - RNA, 19 nt, Mycobacterium avium subsp. paratuberculosis
cgcucacucgucuugcagc

SEQ ID NO: 1016684 - RNA, 17 nt, Mycobacterium avium subsp. paratuberculosis
cgcucagagcugcaccg

SEQ ID NO: 1016685 - RNA, 18 nt, Mycobacterium avium subsp. paratuberculosis
cgcggcaggcgccccagc

SEQ ID NO: 1016686 - RNA, 15 nt, Mycobacterium avium subsp. paratuberculosis
cgcggcagggccagg

SEQ ID NO: 1016687 - RNA, 16 nt, Mycobacterium avium subsp. paratuberculosis
cgcggcagggccaggc

SEQ ID NO: 1016688 - RNA, 18 nt, Mycobacterium avium subsp. paratuberculosis
cgcggcagggccaggccg

SEQ ID NO: 1016689 - RNA, 19 nt, Mycobacterium avium subsp. paratuberculosis
cgcggcauggcuggcggca

SEQ ID NO: 1016690 - RNA, 21 nt, Mycobacterium avium subsp. paratuberculosis
cgcggcauggcuggcggcaac

SEQ ID NO: 1016691 - RNA, 17 nt, Mycobacterium avium subsp. paratuberculosis
cgcggcaugaccggcca

SEQ ID NO: 1016692 - RNA, 15 nt, Mycobacterium avium subsp. paratuberculosis
cgcggcaugccgccc

SEQ ID NO: 1016693 - RNA, 16 nt, Mycobacterium avium subsp. paratuberculosis
cgcggcaugccgcccg

SEQ ID NO: 1016694 - RNA, 22 nt, Mycobacterium avium subsp. paratuberculosis
cgcggcaugccgcccgggccgu

SEQ ID NO: 1016695 - RNA, 19 nt, Mycobacterium avium subsp. paratuberculosis
cgcggcaguccgccggaga

SEQ ID NO: 1016696 - RNA, 14 nt, Mycobacterium avium subsp. paratuberculosis
cgcggcaacgccag

SEQ ID NO: 1016697 - RNA, 15 nt, Mycobacterium avium subsp. paratuberculosis
cgcggcaacgccagc

SEQ ID NO: 1016698 - RNA, 16 nt, Mycobacterium avium subsp. paratuberculosis
cgcggaugcgggcgcu

SEQ ID NO: 1016699 - RNA, 18 nt, Mycobacterium avium subsp. paratuberculosis
cgcggaugacgugcacca

SEQ ID NO: 1016700 - RNA, 22 nt, Mycobacterium avium subsp. paratuberculosis
cgcggaugacgugcaccaccgc

SEQ ID NO: 1016701 - RNA, 18 nt, Mycobacterium avium subsp. paratuberculosis
cgcggauccgggccgccu

SEQ ID NO: 1016702 - RNA, 16 nt, Mycobacterium avium subsp. paratuberculosis
cgcggauccgggccgg

SEQ ID NO: 1016703 - RNA, 15 nt, Mycobacterium avium subsp. paratuberculosis
cgcgccgcucggcca

SEQ ID NO: 1016704 - RNA, 20 nt, Mycobacterium avium subsp. paratuberculosis
cgcgccgcucggccagcagc

SEQ ID NO: 1016705 - RNA, 13 nt, Mycobacterium avium subsp. paratuberculosis
cgcgccgcggcgc

SEQ ID NO: 1016706 - RNA, 20 nt, Mycobacterium avium subsp. paratuberculosis
cgcgccggaguugccgaugg

SEQ ID NO: 1016707 - RNA, 16 nt, Mycobacterium avium subsp. paratuberculosis
cgcgccggccagcacg

SEQ ID NO: 1016708 - RNA, 16 nt, Mycobacterium avium subsp. paratuberculosis
cgcgccggccggcacg

SEQ ID NO: 1016709 - RNA, 14 nt, Mycobacterium avium subsp. paratuberculosis
cgcgccggcgcagc

SEQ ID NO: 1016710 - RNA, 12 nt, Mycobacterium avium subsp. paratuberculosis
cgcgccggcccg

SEQ ID NO: 1016711 - RNA, 13 nt, Mycobacterium avium subsp. paratuberculosis
cgcgccggcccga

SEQ ID NO: 1016712 - RNA, 21 nt, Mycobacterium avium subsp. paratuberculosis
cgcggaucuucuccgccacau

SEQ ID NO: 1016713 - RNA, 23 nt, Mycobacterium avium subsp. paratuberculosis
cgcggaugaccaggucgccggcg

SEQ ID NO: 1016714 - RNA, 13 nt, Mycobacterium avium subsp. paratuberculosis
cgcgccggcggcg

SEQ ID NO: 1016715 - RNA, 13 nt, Mycobacterium avium subsp. paratuberculosis
cgcgccggcgcgc

SEQ ID NO: 1016716 - RNA, 15 nt, Mycobacterium avium subsp. paratuberculosis
cgcgccggcgcgcag

SEQ ID NO: 1016717 - RNA, 16 nt, Mycobacterium avium subsp. paratuberculosis
cgcgccggcgcgcagc

SEQ ID NO: 1016718 - RNA, 12 nt, Mycobacterium avium subsp. paratuberculosis
cgcgccggcggu

SEQ ID NO: 1016719 - RNA, 18 nt, Mycobacterium avium subsp. paratuberculosis
cgcgccggcggccgccgc

SEQ ID NO: 1016720 - RNA, 17 nt, Mycobacterium avium subsp. paratuberculosis
cgcggccguguacagca

SEQ ID NO: 1016721 - RNA, 23 nt, Mycobacterium avium subsp. paratuberculosis
cgcggccucaccgcgggccaggc

SEQ ID NO: 1016722 - RNA, 12 nt, Mycobacterium avium subsp. paratuberculosis
cgcggccuccag

SEQ ID NO: 1016723 - RNA, 13 nt, Mycobacterium avium subsp. paratuberculosis
cgcggccuccagc

SEQ ID NO: 1016724 - RNA, 16 nt, Mycobacterium avium subsp. paratuberculosis
cgcggccucggcgucg

SEQ ID NO: 1016725 - RNA, 14 nt, Mycobacterium avium subsp. paratuberculosis
cgcggccucgucga

SEQ ID NO: 1016726 - RNA, 18 nt, Mycobacterium avium subsp. paratuberculosis
cgcggccucucagcgcug

SEQ ID NO: 1016727 - RNA, 18 nt, Mycobacterium avium subsp. paratuberculosis
cgcggcgaugauccgcgg

SEQ ID NO: 1016728 - RNA, 19 nt, Mycobacterium avium subsp. paratuberculosis
cgcggcgagcgcguucucc

SEQ ID NO: 1016729 - RNA, 22 nt, Mycobacterium avium subsp. paratuberculosis
cgcggcgaucagcagcacccgg

SEQ ID NO: 1016730 - RNA, 15 nt, Mycobacterium avium subsp. paratuberculosis
cgcggcgaucagccc

SEQ ID NO: 1016731 - RNA, 16 nt, Mycobacterium avium subsp. paratuberculosis
cgcggcgaucagcccg

SEQ ID NO: 1016732 - RNA, 19 nt, Mycobacterium avium subsp. paratuberculosis
cgcggcgaucagcccggcc

SEQ ID NO: 1016733 - RNA, 20 nt, Mycobacterium avium subsp. paratuberculosis
cgcggcgaucagcccggccc

SEQ ID NO: 1016734 - RNA, 22 nt, Mycobacterium avium subsp. paratuberculosis
cgcggcgaucagcccggcccgc

SEQ ID NO: 1016735 - RNA, 18 nt, Mycobacterium avium subsp. paratuberculosis
cgcggcgaucagcugcuc

SEQ ID NO: 1016736 - RNA, 19 nt, Mycobacterium avium subsp. paratuberculosis
cgcggcgaucucggcggcc

SEQ ID NO: 1016737 - RNA, 21 nt, Mycobacterium avium subsp. paratuberculosis
cgcggcgaucucggcggccgc

SEQ ID NO: 1016738 - RNA, 21 nt, Mycobacterium avium subsp. paratuberculosis
cgcggcgaucuuugcggccgu

SEQ ID NO: 1016739 - RNA, 22 nt, Mycobacterium avium subsp. paratuberculosis
cgcggccggugcgcgucagccg

SEQ ID NO: 1016740 - RNA, 20 nt, Mycobacterium avium subsp. paratuberculosis
cgcggccguagccggaccgc

SEQ ID NO: 1016741 - RNA, 21 nt, Mycobacterium avium subsp. paratuberculosis
cgcggccgucgucgugcacca

SEQ ID NO: 1016742 - RNA, 13 nt, Mycobacterium avium subsp. paratuberculosis
cgcggccggccga

SEQ ID NO: 1016743 - RNA, 13 nt, Mycobacterium avium subsp. paratuberculosis
cgcggccgggcgc

SEQ ID NO: 1016744 - RNA, 15 nt, Mycobacterium avium subsp. paratuberculosis
cgcggccgggcgccc

SEQ ID NO: 1016745 - RNA, 14 nt, Mycobacterium avium subsp. paratuberculosis
cgcggccggcggca

SEQ ID NO: 1016746 - RNA, 17 nt, Mycobacterium avium subsp. paratuberculosis
cgcggccgcggcgcgca

SEQ ID NO: 1016747 - RNA, 19 nt, Mycobacterium avium subsp. paratuberculosis
cgcggccgcgucggcggcg

SEQ ID NO: 1016748 - RNA, 19 nt, Mycobacterium avium subsp. paratuberculosis
cgcggccgcguugucgacc

SEQ ID NO: 1016749 - RNA, 16 nt, Mycobacterium avium subsp. paratuberculosis
cgcggccgcugcgccc

SEQ ID NO: 1016750 - RNA, 17 nt, Mycobacterium avium subsp. paratuberculosis
cgcggccgcugcgccca

SEQ ID NO: 1016751 - RNA, 13 nt, Mycobacterium avium subsp. paratuberculosis
cgcggccgcgcgc

SEQ ID NO: 1016752 - RNA, 14 nt, Mycobacterium avium subsp. paratuberculosis
cgcggccgcgcgcc

SEQ ID NO: 1016753 - RNA, 13 nt, Mycobacterium avium subsp. paratuberculosis
cgcggccgccucc

SEQ ID NO: 1016754 - RNA, 23 nt, Mycobacterium avium subsp. paratuberculosis
cgcggccgccucccgcagcgcca

SEQ ID NO: 1016755 - RNA, 14 nt, Mycobacterium avium subsp. paratuberculosis
cgcggccgccuccg

SEQ ID NO: 1016756 - RNA, 20 nt, Mycobacterium avium subsp. paratuberculosis
cgcggccgccgcgacggccg

SEQ ID NO: 1016757 - RNA, 23 nt, Mycobacterium avium subsp. paratuberculosis
cgcggccgcccgguccgggucgc

SEQ ID NO: 1016758 - RNA, 13 nt, Mycobacterium avium subsp. paratuberculosis
cgcggccgccagc

SEQ ID NO: 1016759 - RNA, 22 nt, Mycobacterium avium subsp. paratuberculosis
cgcggccgccaggucggggccc

SEQ ID NO: 1016760 - RNA, 16 nt, Mycobacterium avium subsp. paratuberculosis
cgcggccgccaucgau

SEQ ID NO: 1016761 - RNA, 19 nt, Mycobacterium avium subsp. paratuberculosis
cgcggccgcccagcccgcg

SEQ ID NO: 1016762 - RNA, 14 nt, Mycobacterium avium subsp. paratuberculosis
cgcggcccugcagc

SEQ ID NO: 1016763 - RNA, 12 nt, Mycobacterium avium subsp. paratuberculosis
cgcggccgccag

SEQ ID NO: 1016764 - RNA, 18 nt, Mycobacterium avium subsp. paratuberculosis
cgcggcccggccaccagg

SEQ ID NO: 1016765 - RNA, 17 nt, Mycobacterium avium subsp. paratuberculosis
cgcggcccgcggcguca

SEQ ID NO: 1016766 - RNA, 12 nt, Mycobacterium avium subsp. paratuberculosis
cgcggcccaggg

SEQ ID NO: 1016767 - RNA, 21 nt, Mycobacterium avium subsp. paratuberculosis
cgcggcccccugaucggccgc

SEQ ID NO: 1016768 - RNA, 22 nt, Mycobacterium avium subsp. paratuberculosis
cgcggcccccugaucggccgca

SEQ ID NO: 1016769 - RNA, 18 nt, Mycobacterium avium subsp. paratuberculosis
cgcggccaacccgggcgc

SEQ ID NO: 1016770 - RNA, 14 nt, Mycobacterium avium subsp. paratuberculosis
cgcggcgcaccgcc

SEQ ID NO: 1016771 - RNA, 18 nt, Mycobacterium avium subsp. paratuberculosis
cgcggcucggucgcgaag

SEQ ID NO: 1016772 - RNA, 14 nt, Mycobacterium avium subsp. paratuberculosis
cgcggcucgcgggc

SEQ ID NO: 1016773 - RNA, 20 nt, Mycobacterium avium subsp. paratuberculosis
cgcggcucgauggacgccag

SEQ ID NO: 1016774 - RNA, 17 nt, Mycobacterium avium subsp. paratuberculosis
cgcggcugaucagccgg

SEQ ID NO: 1016775 - RNA, 23 nt, Mycobacterium avium subsp. paratuberculosis
cgcggcugaucagccggcgagcg

SEQ ID NO: 1016776 - RNA, 15 nt, Mycobacterium avium subsp. paratuberculosis
cgcggcugcucgaac

SEQ ID NO: 1016777 - RNA, 15 nt, Mycobacterium avium subsp. paratuberculosis
cgcggcuggcccggc

SEQ ID NO: 1016778 - RNA, 15 nt, Mycobacterium avium subsp. paratuberculosis
cgcggcuccggccgc

SEQ ID NO: 1016779 - RNA, 22 nt, Mycobacterium avium subsp. paratuberculosis
cgcggcucacgacuccuggccg

SEQ ID NO: 1016780 - RNA, 23 nt, Mycobacterium avium subsp. paratuberculosis
cgcggcucacgacuccuggccga

SEQ ID NO: 1016781 - RNA, 14 nt, Mycobacterium avium subsp. paratuberculosis
cgcggcggacgaug

SEQ ID NO: 1016782 - RNA, 15 nt, Mycobacterium avium subsp. paratuberculosis
cgcggcgcgggucgc

SEQ ID NO: 1016783 - RNA, 17 nt, Mycobacterium avium subsp. paratuberculosis
cgcggcgcggcccggcc

SEQ ID NO: 1016784 - RNA, 16 nt, Mycobacterium avium subsp. paratuberculosis
cgcggcgcgcggccgc

SEQ ID NO: 1016785 - RNA, 18 nt, Mycobacterium avium subsp. paratuberculosis
cgcggcgcgaagcccucg

SEQ ID NO: 1016786 - RNA, 22 nt, Mycobacterium avium subsp. paratuberculosis
cgcggcgcgaggcgcggggcgc

SEQ ID NO: 1016787 - RNA, 23 nt, Mycobacterium avium subsp. paratuberculosis
cgcggcgccguagguggccauga

SEQ ID NO: 1016788 - RNA, 18 nt, Mycobacterium avium subsp. paratuberculosis
cgcggcgccgcggcggca

SEQ ID NO: 1016789 - RNA, 13 nt, Mycobacterium avium subsp. paratuberculosis
cgcggcgccgcca

SEQ ID NO: 1016790 - RNA, 14 nt, Mycobacterium avium subsp. paratuberculosis
cgcggcgccagcgg

SEQ ID NO: 1016791 - RNA, 22 nt, Mycobacterium avium subsp. paratuberculosis
cgcggcgcccucgccggcggcg

SEQ ID NO: 1016792 - RNA, 14 nt, Mycobacterium avium subsp. paratuberculosis
cgcggcgcagcucg

SEQ ID NO: 1016793 - RNA, 19 nt, Mycobacterium avium subsp. paratuberculosis
cgcggcgcagcucgcgcag

SEQ ID NO: 1016794 - RNA, 22 nt, Mycobacterium avium subsp. paratuberculosis
cgcggcgcagggcggccggcca

SEQ ID NO: 1016795 - RNA, 20 nt, Mycobacterium avium subsp. paratuberculosis
cgcggcgaugcgcuccagca

SEQ ID NO: 1016796 - RNA, 15 nt, Mycobacterium avium subsp. paratuberculosis
cgcgggugcggcgcu

SEQ ID NO: 1016797 - RNA, 19 nt, Mycobacterium avium subsp. paratuberculosis
cgcgggucgucgggcggca

SEQ ID NO: 1016798 - RNA, 18 nt, Mycobacterium avium subsp. paratuberculosis
cgcgggugaccggcgccg

SEQ ID NO: 1016799 - RNA, 20 nt, Mycobacterium avium subsp. paratuberculosis
cgcgggugucgagccaccac

SEQ ID NO: 1016800 - RNA, 14 nt, Mycobacterium avium subsp. paratuberculosis
cgcgggucgagcag

SEQ ID NO: 1016801 - RNA, 20 nt, Mycobacterium avium subsp. paratuberculosis
cgcgggucgcggcccaccgc

SEQ ID NO: 1016802 - RNA, 18 nt, Mycobacterium avium subsp. paratuberculosis
cgcggguagacguucucc

SEQ ID NO: 1016803 - RNA, 16 nt, Mycobacterium avium subsp. paratuberculosis
cgcggggucgggccgg

SEQ ID NO: 1016804 - RNA, 16 nt, Mycobacterium avium subsp. paratuberculosis
cgcggguacggcggcc

SEQ ID NO: 1016805 - RNA, 15 nt, Mycobacterium avium subsp. paratuberculosis
cgcgggggccgcgau

SEQ ID NO: 1016806 - RNA, 19 nt, Mycobacterium avium subsp. paratuberculosis
cgcgggguggcgccggcca

SEQ ID NO: 1016807 - RNA, 18 nt, Mycobacterium avium subsp. paratuberculosis
cgcggggcgcgaggcgcg

SEQ ID NO: 1016808 - RNA, 19 nt, Mycobacterium avium subsp. paratuberculosis
cgcggggcgcgaggcgcga

SEQ ID NO: 1016809 - RNA, 15 nt, Mycobacterium avium subsp. paratuberculosis
cgcggggcggcggcg

SEQ ID NO: 1016810 - RNA, 18 nt, Mycobacterium avium subsp. paratuberculosis
cgcgggcgaccugcgggc

SEQ ID NO: 1016811 - RNA, 20 nt, Mycobacterium avium subsp. paratuberculosis
cgcgggcgaccugcgggccc

SEQ ID NO: 1016812 - RNA, 18 nt, Mycobacterium avium subsp. paratuberculosis
cgcgggcgaucuccagcg

SEQ ID NO: 1016813 - RNA, 14 nt, Mycobacterium avium subsp. paratuberculosis
cgcgggcccaccgc

SEQ ID NO: 1016814 - RNA, 18 nt, Mycobacterium avium subsp. paratuberculosis
cgcgggccgcagcgcgcg

SEQ ID NO: 1016815 - RNA, 20 nt, Mycobacterium avium subsp. paratuberculosis
cgcgggcccgggccacccgc

SEQ ID NO: 1016816 - RNA, 21 nt, Mycobacterium avium subsp. paratuberculosis
cgcgggcccgggccacccgcg

SEQ ID NO: 1016817 - RNA, 14 nt, Mycobacterium avium subsp. paratuberculosis
cgcgggccaggccc

SEQ ID NO: 1016818 - RNA, 14 nt, Mycobacterium avium subsp. paratuberculosis
cgcgggccagcagc

SEQ ID NO: 1016819 - RNA, 15 nt, Mycobacterium avium subsp. paratuberculosis
cgcgggccagcagca

SEQ ID NO: 1016820 - RNA, 18 nt, Mycobacterium avium subsp. paratuberculosis
cgcggcuggugccgccgg

SEQ ID NO: 1016821 - RNA, 15 nt, Mycobacterium avium subsp. paratuberculosis
cgcgggcagccggcg

SEQ ID NO: 1016822 - RNA, 20 nt, Mycobacterium avium subsp. paratuberculosis
cgcgggauugccgagcaccc

SEQ ID NO: 1016823 - RNA, 20 nt, Mycobacterium avium subsp. paratuberculosis
cgcgggcaaucgcugcgccc

SEQ ID NO: 1016824 - RNA, 23 nt, Mycobacterium avium subsp. paratuberculosis
cgcgggccaccgcggcguugccc

SEQ ID NO: 1016825 - RNA, 18 nt, Mycobacterium avium subsp. paratuberculosis
cgcgggccaccggcgcca

SEQ ID NO: 1016826 - RNA, 17 nt, Mycobacterium avium subsp. paratuberculosis
cgcuguagggccaccac

SEQ ID NO: 1016827 - RNA, 14 nt, Mycobacterium avium subsp. paratuberculosis
cgcuguagagcagu

SEQ ID NO: 1016828 - RNA, 15 nt, Mycobacterium avium subsp. paratuberculosis
cgcuguaggccagcc

SEQ ID NO: 1016829 - RNA, 13 nt, Mycobacterium avium subsp. paratuberculosis
cgcuguccucguc

SEQ ID NO: 1016830 - RNA, 16 nt, Mycobacterium avium subsp. paratuberculosis
cgcuguuagccucgcc

SEQ ID NO: 1016831 - RNA, 13 nt, Mycobacterium avium subsp. paratuberculosis
cgcuggugcugcc

SEQ ID NO: 1016832 - RNA, 15 nt, Mycobacterium avium subsp. paratuberculosis
cgcuggugcgcgccg

SEQ ID NO: 1016833 - RNA, 17 nt, Mycobacterium avium subsp. paratuberculosis
cgcuggugcgcgccggc

SEQ ID NO: 1016834 - RNA, 18 nt, Mycobacterium avium subsp. paratuberculosis
cgcuggugcgggccagca

SEQ ID NO: 1016835 - RNA, 17 nt, Mycobacterium avium subsp. paratuberculosis
cgcugggugcgggcugc

SEQ ID NO: 1016836 - RNA, 21 nt, Mycobacterium avium subsp. paratuberculosis
cgcugggugcgggcugcacca

SEQ ID NO: 1016837 - RNA, 21 nt, Mycobacterium avium subsp. paratuberculosis
cgcuggguguaaccggcuucc

SEQ ID NO: 1016838 - RNA, 22 nt, Mycobacterium avium subsp. paratuberculosis
cgcuggucaacucgacccgcac

SEQ ID NO: 1016839 - RNA, 22 nt, Mycobacterium avium subsp. paratuberculosis
cgcuggugacgugcaccugcag

SEQ ID NO: 1016840 - RNA, 14 nt, Mycobacterium avium subsp. paratuberculosis
cgcuggucgcgaag

SEQ ID NO: 1016841 - RNA, 14 nt, Mycobacterium avium subsp. paratuberculosis
cgcugggcagccgu

SEQ ID NO: 1016842 - RNA, 19 nt, Mycobacterium avium subsp. paratuberculosis
cgcugggagcacgugauga

SEQ ID NO: 1016843 - RNA, 18 nt, Mycobacterium avium subsp. paratuberculosis
cgcugggcggcgcggcgg

SEQ ID NO: 1016844 - RNA, 15 nt, Mycobacterium avium subsp. paratuberculosis
cgcuggggcgcaccg

SEQ ID NO: 1016845 - RNA, 16 nt, Mycobacterium avium subsp. paratuberculosis
cgcuggggcgcaccgc

SEQ ID NO: 1016846 - RNA, 13 nt, Mycobacterium avium subsp. paratuberculosis
cgcuggcggccag

SEQ ID NO: 1016847 - RNA, 18 nt, Mycobacterium avium subsp. paratuberculosis
cgcuggcggccagcgucu

SEQ ID NO: 1016848 - RNA, 18 nt, Mycobacterium avium subsp. paratuberculosis
cgcuggcguggcacccgg

SEQ ID NO: 1016849 - RNA, 20 nt, Mycobacterium avium subsp. paratuberculosis
cgcuggcguggcacccgggc

SEQ ID NO: 1016850 - RNA, 21 nt, Mycobacterium avium subsp. paratuberculosis
cgcuggcguggcgccggcgcg

SEQ ID NO: 1016851 - RNA, 23 nt, Mycobacterium avium subsp. paratuberculosis
cgcuggcgugacgcucgaggccc

SEQ ID NO: 1016852 - RNA, 18 nt, Mycobacterium avium subsp. paratuberculosis
cgcuggcgugacgcucgg

SEQ ID NO: 1016853 - RNA, 24 nt, Mycobacterium avium subsp. paratuberculosis
cgcuggcgugacgcucggcgccgc

SEQ ID NO: 1016854 - RNA, 21 nt, Mycobacterium avium subsp. paratuberculosis
cgcuggcgugacgcucggggc

SEQ ID NO: 1016855 - RNA, 14 nt, Mycobacterium avium subsp. paratuberculosis
cgcuggcgugacgg

SEQ ID NO: 1016856 - RNA, 13 nt, Mycobacterium avium subsp. paratuberculosis
cgcuugcgaccgc

SEQ ID NO: 1016857 - RNA, 16 nt, Mycobacterium avium subsp. paratuberculosis
cgcuugcgaccgccgc

SEQ ID NO: 1016858 - RNA, 17 nt, Mycobacterium avium subsp. paratuberculosis
cgcuugcgaccgccgcu

SEQ ID NO: 1016859 - RNA, 17 nt, Mycobacterium avium subsp. paratuberculosis
cgcuugccgacgugaug

SEQ ID NO: 1016860 - RNA, 19 nt, Mycobacterium avium subsp. paratuberculosis
cgcuugccagccgggccga

SEQ ID NO: 1016861 - RNA, 14 nt, Mycobacterium avium subsp. paratuberculosis
cgcuugcagcuugg

SEQ ID NO: 1016862 - RNA, 21 nt, Mycobacterium avium subsp. paratuberculosis
cggaaaaagcguugcgccagc

SEQ ID NO: 1016863 - RNA, 20 nt, Mycobacterium avium subsp. paratuberculosis
cggaaacgacgucgccacca

SEQ ID NO: 1016864 - RNA, 21 nt, Mycobacterium avium subsp. paratuberculosis
cgcuuuccaccucgagcaacc

SEQ ID NO: 1016865 - RNA, 22 nt, Mycobacterium avium subsp. paratuberculosis
cgcuggcaggacgggcaccagu

SEQ ID NO: 1016866 - RNA, 13 nt, Mycobacterium avium subsp. paratuberculosis
cgcuggccgcccc

SEQ ID NO: 1016867 - RNA, 14 nt, Mycobacterium avium subsp. paratuberculosis
cgcuggccguggcc

SEQ ID NO: 1016868 - RNA, 18 nt, Mycobacterium avium subsp. paratuberculosis
cgcuggccgcgccacagc

SEQ ID NO: 1016869 - RNA, 15 nt, Mycobacterium avium subsp. paratuberculosis
cgcuggccggcagcg

SEQ ID NO: 1016870 - RNA, 18 nt, Mycobacterium avium subsp. paratuberculosis
cgcuggccggcagcgucu

SEQ ID NO: 1016871 - RNA, 18 nt, Mycobacterium avium subsp. paratuberculosis
cgcuggccggccaccagc

SEQ ID NO: 1016872 - RNA, 21 nt, Mycobacterium avium subsp. paratuberculosis
cgcuggccacgauccggggca

SEQ ID NO: 1016873 - RNA, 14 nt, Mycobacterium avium subsp. paratuberculosis
cgcuggcgcaggcg

SEQ ID NO: 1016874 - RNA, 21 nt, Mycobacterium avium subsp. paratuberculosis
cgcuggcgauggugccgaagc

SEQ ID NO: 1016875 - RNA, 17 nt, Mycobacterium avium subsp. paratuberculosis
cgcuggcgaccaucagc

SEQ ID NO: 1016876 - RNA, 20 nt, Mycobacterium avium subsp. paratuberculosis
cgcuggcgaccaucagccug

SEQ ID NO: 1016877 - RNA, 17 nt, Mycobacterium avium subsp. paratuberculosis
cgcuggcgaucaccuug

SEQ ID NO: 1016878 - RNA, 18 nt, Mycobacterium avium subsp. paratuberculosis
cgcuggcgaucaccuugc

SEQ ID NO: 1016879 - RNA, 22 nt, Mycobacterium avium subsp. paratuberculosis
cgcugcucggaggaaccgugcg

SEQ ID NO: 1016880 - RNA, 21 nt, Mycobacterium avium subsp. paratuberculosis
cgcugcucgaccucggcgacc

SEQ ID NO: 1016881 - RNA, 19 nt, Mycobacterium avium subsp. paratuberculosis
cgcugcuccggguccgcgg

SEQ ID NO: 1016882 - RNA, 20 nt, Mycobacterium avium subsp. paratuberculosis
cgcugcggcacaccagcguu

SEQ ID NO: 1016883 - RNA, 13 nt, Mycobacterium avium subsp. paratuberculosis
cgcugcgcccgcc

SEQ ID NO: 1016884 - RNA, 15 nt, Mycobacterium avium subsp. paratuberculosis
cgcugcgcccgccgc

SEQ ID NO: 1016885 - RNA, 17 nt, Mycobacterium avium subsp. paratuberculosis
cgcugcgcccgccgcca

SEQ ID NO: 1016886 - RNA, 21 nt, Mycobacterium avium subsp. paratuberculosis
cgcugcgcccgccgccaccac

SEQ ID NO: 1016887 - RNA, 12 nt, Mycobacterium avium subsp. paratuberculosis
cgcugcgccggc

SEQ ID NO: 1016888 - RNA, 19 nt, Mycobacterium avium subsp. paratuberculosis
cgcugcgccggcgcggcca

SEQ ID NO: 1016889 - RNA, 22 nt, Mycobacterium avium subsp. paratuberculosis
cgcugcgcgccgauccggcucc

SEQ ID NO: 1016890 - RNA, 13 nt, Mycobacterium avium subsp. paratuberculosis
cgcugcgcgccgc

SEQ ID NO: 1016891 - RNA, 15 nt, Mycobacterium avium subsp. paratuberculosis
cgcugcgaggcgggc

SEQ ID NO: 1016892 - RNA, 13 nt, Mycobacterium avium subsp. paratuberculosis
cgcugcgaugaug

SEQ ID NO: 1016893 - RNA, 14 nt, Mycobacterium avium subsp. paratuberculosis
cgcugcgcacccgg

SEQ ID NO: 1016894 - RNA, 15 nt, Mycobacterium avium subsp. paratuberculosis
cgcugcgagcccggc

SEQ ID NO: 1016895 - RNA, 23 nt, Mycobacterium avium subsp. paratuberculosis
cgcugccgcccccgcuggcgaau

SEQ ID NO: 1016896 - RNA, 15 nt, Mycobacterium avium subsp. paratuberculosis
cgcugaacgggcagc

SEQ ID NO: 1016897 - RNA, 20 nt, Mycobacterium avium subsp. paratuberculosis
cgcugaacugcucgaccagc

SEQ ID NO: 1016898 - RNA, 19 nt, Mycobacterium avium subsp. paratuberculosis
cgcugaagcccaccgccgu

SEQ ID NO: 1016899 - RNA, 23 nt, Mycobacterium avium subsp. paratuberculosis
cgcucguaguuggggccggccgc

SEQ ID NO: 1016900 - RNA, 15 nt, Mycobacterium avium subsp. paratuberculosis
cgcucgucggccagc

SEQ ID NO: 1016901 - RNA, 17 nt, Mycobacterium avium subsp. paratuberculosis
cgcucgugaccggcggu

SEQ ID NO: 1016902 - RNA, 18 nt, Mycobacterium avium subsp. paratuberculosis
cgcucggucaggcccagg

SEQ ID NO: 1016903 - RNA, 18 nt, Mycobacterium avium subsp. paratuberculosis
cgcucggucagcaccggg

SEQ ID NO: 1016904 - RNA, 12 nt, Mycobacterium avium subsp. paratuberculosis
cgcucggcgcuc

SEQ ID NO: 1016905 - RNA, 16 nt, Mycobacterium avium subsp. paratuberculosis
cgcucggcgcuccagc

SEQ ID NO: 1016906 - RNA, 17 nt, Mycobacterium avium subsp. paratuberculosis
cgcucggcgcuccagcg

SEQ ID NO: 1016907 - RNA, 20 nt, Mycobacterium avium subsp. paratuberculosis
cgcucaggcguccagccagc

SEQ ID NO: 1016908 - RNA, 15 nt, Mycobacterium avium subsp. paratuberculosis
cgcucgggcccgcgc

SEQ ID NO: 1016909 - RNA, 16 nt, Mycobacterium avium subsp. paratuberculosis
cgcucggcguggcgcu

SEQ ID NO: 1016910 - RNA, 16 nt, Mycobacterium avium subsp. paratuberculosis
cgcucggcggcgccgu

SEQ ID NO: 1016911 - RNA, 12 nt, Mycobacterium avium subsp. paratuberculosis
cgcugaccaccg

SEQ ID NO: 1016912 - RNA, 16 nt, Mycobacterium avium subsp. paratuberculosis
cgcugaccccgcucgg

SEQ ID NO: 1016913 - RNA, 17 nt, Mycobacterium avium subsp. paratuberculosis
cgcugaccccgcucggc

SEQ ID NO: 1016914 - RNA, 19 nt, Mycobacterium avium subsp. paratuberculosis
cgcugaccccgcucggcgu

SEQ ID NO: 1016915 - RNA, 13 nt, Mycobacterium avium subsp. paratuberculosis
cgcugaccaggcc

SEQ ID NO: 1016916 - RNA, 14 nt, Mycobacterium avium subsp. paratuberculosis
cgcugaccaggccg

SEQ ID NO: 1016917 - RNA, 23 nt, Mycobacterium avium subsp. paratuberculosis
cgcugaccaggccguccaccaga

SEQ ID NO: 1016918 - RNA, 14 nt, Mycobacterium avium subsp. paratuberculosis
cgcugaucagcucu

SEQ ID NO: 1016919 - RNA, 15 nt, Mycobacterium avium subsp. paratuberculosis
cgcugaugcggccgg

SEQ ID NO: 1016920 - RNA, 15 nt, Mycobacterium avium subsp. paratuberculosis
cgcugccagggccgg

SEQ ID NO: 1016921 - RNA, 23 nt, Mycobacterium avium subsp. paratuberculosis
cgcugccccggcgaggccaggcg

SEQ ID NO: 1016922 - RNA, 21 nt, Mycobacterium avium subsp. paratuberculosis
cgcugcccgccgcguacagca

SEQ ID NO: 1016923 - RNA, 14 nt, Mycobacterium avium subsp. paratuberculosis
cgcugcccggcgcu

SEQ ID NO: 1016924 - RNA, 13 nt, Mycobacterium avium subsp. paratuberculosis
cgcugcccgaugg

SEQ ID NO: 1016925 - RNA, 13 nt, Mycobacterium avium subsp. paratuberculosis
cgcugcccgugcc

SEQ ID NO: 1016926 - RNA, 23 nt, Mycobacterium avium subsp. paratuberculosis
cgggcgcugagcacggugggcgc

SEQ ID NO: 1016927 - RNA, 15 nt, Mycobacterium avium subsp. paratuberculosis
cgggcgcugcgcggu

SEQ ID NO: 1016928 - RNA, 20 nt, Mycobacterium avium subsp. paratuberculosis
cgggcgcugcgcgguggcgc

SEQ ID NO: 1016929 - RNA, 14 nt, Mycobacterium avium subsp. paratuberculosis
cgggcgcgugcaca

SEQ ID NO: 1016930 - RNA, 18 nt, Mycobacterium avium subsp. paratuberculosis
cgggcgcucggccagcag

SEQ ID NO: 1016931 - RNA, 20 nt, Mycobacterium avium subsp. paratuberculosis
cgggcgcucuucgggcugcg

SEQ ID NO: 1016932 - RNA, 12 nt, Mycobacterium avium subsp. paratuberculosis
cgggcggcagca

SEQ ID NO: 1016933 - RNA, 20 nt, Mycobacterium avium subsp. paratuberculosis
cgggcggcagggccagcacc

SEQ ID NO: 1016934 - RNA, 22 nt, Mycobacterium avium subsp. paratuberculosis
cgggcggccagccgcucccggc

SEQ ID NO: 1016935 - RNA, 15 nt, Mycobacterium avium subsp. paratuberculosis
cgggcggcgcggcgc

SEQ ID NO: 1016936 - RNA, 21 nt, Mycobacterium avium subsp. paratuberculosis
cgggcggcguccucgaccacc

SEQ ID NO: 1016937 - RNA, 20 nt, Mycobacterium avium subsp. paratuberculosis
cgggcggcgaacaccagcac

SEQ ID NO: 1016938 - RNA, 14 nt, Mycobacterium avium subsp. paratuberculosis
cgggcggcggccuc

SEQ ID NO: 1016939 - RNA, 13 nt, Mycobacterium avium subsp. paratuberculosis
cgggcgcggacag

SEQ ID NO: 1016940 - RNA, 16 nt, Mycobacterium avium subsp. paratuberculosis
cgggcgcgcgccgccc

SEQ ID NO: 1016941 - RNA, 18 nt, Mycobacterium avium subsp. paratuberculosis
cgggcgcgcgccgccccc

SEQ ID NO: 1016942 - RNA, 14 nt, Mycobacterium avium subsp. paratuberculosis
cgggcgcgcgccuc

SEQ ID NO: 1016943 - RNA, 15 nt, Mycobacterium avium subsp. paratuberculosis
cgggcgcgccggcgc

SEQ ID NO: 1016944 - RNA, 12 nt, Mycobacterium avium subsp. paratuberculosis
cgggcgcgcagc

SEQ ID NO: 1016945 - RNA, 17 nt, Mycobacterium avium subsp. paratuberculosis
cgggcgcgcccacccgc

SEQ ID NO: 1016946 - RNA, 20 nt, Mycobacterium avium subsp. paratuberculosis
cgggcgccgguuccuccgac

SEQ ID NO: 1016947 - RNA, 13 nt, Mycobacterium avium subsp. paratuberculosis
cgggcgccgucgg

SEQ ID NO: 1016948 - RNA, 18 nt, Mycobacterium avium subsp. paratuberculosis
cgggcgccgucggggcug

SEQ ID NO: 1016949 - RNA, 21 nt, Mycobacterium avium subsp. paratuberculosis
cgggcgccgaacgucgagcgc

SEQ ID NO: 1016950 - RNA, 14 nt, Mycobacterium avium subsp. paratuberculosis
cgggcgccgagaac

SEQ ID NO: 1016951 - RNA, 19 nt, Mycobacterium avium subsp. paratuberculosis
cgggcgcagguccacccgc

SEQ ID NO: 1016952 - RNA, 13 nt, Mycobacterium avium subsp. paratuberculosis
cgggcgcccagca

SEQ ID NO: 1016953 - RNA, 14 nt, Mycobacterium avium subsp. paratuberculosis
cgggcgccagcccg

SEQ ID NO: 1016954 - RNA, 17 nt, Mycobacterium avium subsp. paratuberculosis
cgggcgccagcccgccc

SEQ ID NO: 1016955 - RNA, 19 nt, Mycobacterium avium subsp. paratuberculosis
cgggcgccagcccgcccag

SEQ ID NO: 1016956 - RNA, 20 nt, Mycobacterium avium subsp. paratuberculosis
cgggcgccauccgccacccg

SEQ ID NO: 1016957 - RNA, 13 nt, Mycobacterium avium subsp. paratuberculosis
cgggcgucggcgg

SEQ ID NO: 1016958 - RNA, 19 nt, Mycobacterium avium subsp. paratuberculosis
cgggcguccucgucggcga

SEQ ID NO: 1016959 - RNA, 15 nt, Mycobacterium avium subsp. paratuberculosis
cgggcguccugcggg

SEQ ID NO: 1016960 - RNA, 14 nt, Mycobacterium avium subsp. paratuberculosis
cgggcgugcccggc

SEQ ID NO: 1016961 - RNA, 15 nt, Mycobacterium avium subsp. paratuberculosis
cgggcgugcccggcg

SEQ ID NO: 1016962 - RNA, 19 nt, Mycobacterium avium subsp. paratuberculosis
cgggcguggcggucggugc

SEQ ID NO: 1016963 - RNA, 13 nt, Mycobacterium avium subsp. paratuberculosis
cgggcgguggcgc

SEQ ID NO: 1016964 - RNA, 22 nt, Mycobacterium avium subsp. paratuberculosis
cgggcggucgcgucgucggcgg

SEQ ID NO: 1016965 - RNA, 23 nt, Mycobacterium avium subsp. paratuberculosis
cgggcggucgcgucgucggcggg

SEQ ID NO: 1016966 - RNA, 15 nt, Mycobacterium avium subsp. paratuberculosis
cgggcggucggacgc

SEQ ID NO: 1016967 - RNA, 12 nt, Mycobacterium avium subsp. paratuberculosis
cgggcggggccc

SEQ ID NO: 1016968 - RNA, 23 nt, Mycobacterium avium subsp. paratuberculosis
cgggcggggggcgagccggcccg

SEQ ID NO: 1016969 - RNA, 18 nt, Mycobacterium avium subsp. paratuberculosis
cgggcgggguggccacca

SEQ ID NO: 1016970 - RNA, 16 nt, Mycobacterium avium subsp. paratuberculosis
cgggcgggcagauggu

SEQ ID NO: 1016971 - RNA, 15 nt, Mycobacterium avium subsp. paratuberculosis
cgggcgggccgcagc

SEQ ID NO: 1016972 - RNA, 14 nt, Mycobacterium avium subsp. paratuberculosis
cgggcguucaucac

SEQ ID NO: 1016973 - RNA, 15 nt, Mycobacterium avium subsp. paratuberculosis
cgggcguucaucacc

SEQ ID NO: 1016974 - RNA, 16 nt, Mycobacterium avium subsp. paratuberculosis
cgggcguucaucaccu

SEQ ID NO: 1016975 - RNA, 17 nt, Mycobacterium avium subsp. paratuberculosis
cgggcguucccgcgcgc

SEQ ID NO: 1016976 - RNA, 16 nt, Mycobacterium avium subsp. paratuberculosis
cgggcguugcgccgcg

SEQ ID NO: 1016977 - RNA, 19 nt, Mycobacterium avium subsp. paratuberculosis
cgggcguugcgccgcgagc

SEQ ID NO: 1016978 - RNA, 15 nt, Mycobacterium avium subsp. paratuberculosis
cgggcucgcggucgg

SEQ ID NO: 1016979 - RNA, 20 nt, Mycobacterium avium subsp. paratuberculosis
cgggcucggaguugcgcagc

SEQ ID NO: 1016980 - RNA, 21 nt, Mycobacterium avium subsp. paratuberculosis
cgggcucggaguugcgcagcc

SEQ ID NO: 1016981 - RNA, 15 nt, Mycobacterium avium subsp. paratuberculosis
cgggcucgagcaccg

SEQ ID NO: 1016982 - RNA, 22 nt, Mycobacterium avium subsp. paratuberculosis
cgggcucccucgucgcuaccuc

SEQ ID NO: 1016983 - RNA, 14 nt, Mycobacterium avium subsp. paratuberculosis
cgggcucggccgcc

SEQ ID NO: 1016984 - RNA, 20 nt, Mycobacterium avium subsp. paratuberculosis
cgggcucggucaccccggag

SEQ ID NO: 1016985 - RNA, 17 nt, Mycobacterium avium subsp. paratuberculosis
cgggcuaucgcccggcg

SEQ ID NO: 1016986 - RNA, 16 nt, Mycobacterium avium subsp. paratuberculosis
cgggcuagacgcgcac

SEQ ID NO: 1016987 - RNA, 21 nt, Mycobacterium avium subsp. paratuberculosis
cggggccuugacucccucgcc

SEQ ID NO: 1016988 - RNA, 15 nt, Mycobacterium avium subsp. paratuberculosis
cggggcgaccaguag

SEQ ID NO: 1016989 - RNA, 18 nt, Mycobacterium avium subsp. paratuberculosis
cggggcgaccuugcgcag

SEQ ID NO: 1016990 - RNA, 21 nt, Mycobacterium avium subsp. paratuberculosis
cggggcgaccuugcgcagccg

SEQ ID NO: 1016991 - RNA, 22 nt, Mycobacterium avium subsp. paratuberculosis
cggggcgaccuugcgcagccgg

SEQ ID NO: 1016992 - RNA, 22 nt, Mycobacterium avium subsp. paratuberculosis
cggggcgaacccggcgcccggc

SEQ ID NO: 1016993 - RNA, 20 nt, Mycobacterium avium subsp. paratuberculosis
cgggcuguugaccacggccu

SEQ ID NO: 1016994 - RNA, 15 nt, Mycobacterium avium subsp. paratuberculosis
cgggcugucgggcag

SEQ ID NO: 1016995 - RNA, 18 nt, Mycobacterium avium subsp. paratuberculosis
cgggcucgccucggggau

SEQ ID NO: 1016996 - RNA, 15 nt, Mycobacterium avium subsp. paratuberculosis
cgggcugugccggcg

SEQ ID NO: 1016997 - RNA, 21 nt, Mycobacterium avium subsp. paratuberculosis
cgggcuggugcgcagccgucg

SEQ ID NO: 1016998 - RNA, 17 nt, Mycobacterium avium subsp. paratuberculosis
cgggcugucccggccgc

SEQ ID NO: 1016999 - RNA, 23 nt, Mycobacterium avium subsp. paratuberculosis
cgggcugucccggccgcgacagc

SEQ ID NO: 1017000 - RNA, 17 nt, Mycobacterium avium subsp. paratuberculosis
cgggcuguccgcguggc

SEQ ID NO: 1017001 - RNA, 15 nt, Mycobacterium avium subsp. paratuberculosis
cggggcgcgcaggcg

SEQ ID NO: 1017002 - RNA, 14 nt, Mycobacterium avium subsp. paratuberculosis
cggggcgggcagca

SEQ ID NO: 1017003 - RNA, 23 nt, Mycobacterium avium subsp. paratuberculosis
cggggcgggcagcaccagcggca

SEQ ID NO: 1017004 - RNA, 16 nt, Mycobacterium avium subsp. paratuberculosis
cggggcggcgggcgaa

SEQ ID NO: 1017005 - RNA, 19 nt, Mycobacterium avium subsp. paratuberculosis
cggggcgagcuggccgccc

SEQ ID NO: 1017006 - RNA, 17 nt, Mycobacterium avium subsp. paratuberculosis
cggggcgcagaugggga

SEQ ID NO: 1017007 - RNA, 16 nt, Mycobacterium avium subsp. paratuberculosis
cggggcgcagcccggc

SEQ ID NO: 1017008 - RNA, 21 nt, Mycobacterium avium subsp. paratuberculosis
cggggcgccgccgaacagcag

SEQ ID NO: 1017009 - RNA, 20 nt, Mycobacterium avium subsp. paratuberculosis
cggggcgccgcugcgggcca

SEQ ID NO: 1017010 - RNA, 12 nt, Mycobacterium avium subsp. paratuberculosis
cggggcgcgcug

SEQ ID NO: 1017011 - RNA, 20 nt, Mycobacterium avium subsp. paratuberculosis
cggggcgcgcugggcuaacg

SEQ ID NO: 1017012 - RNA, 14 nt, Mycobacterium avium subsp. paratuberculosis
cggggcgcggaccg

SEQ ID NO: 1017013 - RNA, 16 nt, Mycobacterium avium subsp. paratuberculosis
cgggggcggugcagcc

SEQ ID NO: 1017014 - RNA, 18 nt, Mycobacterium avium subsp. paratuberculosis
cgggggcggugcagccgg

SEQ ID NO: 1017015 - RNA, 18 nt, Mycobacterium avium subsp. paratuberculosis
cggggcgucgaugcguga

SEQ ID NO: 1017016 - RNA, 22 nt, Mycobacterium avium subsp. paratuberculosis
cggggcggccgccgggccggcg

SEQ ID NO: 1017017 - RNA, 17 nt, Mycobacterium avium subsp. paratuberculosis
cgggggcgcgggcggca

SEQ ID NO: 1017018 - RNA, 21 nt, Mycobacterium avium subsp. paratuberculosis
cggggguucguugcgccgcca

SEQ ID NO: 1017019 - RNA, 22 nt, Mycobacterium avium subsp. paratuberculosis
cggggguuucgugugcucagcu

SEQ ID NO: 1017020 - RNA, 18 nt, Mycobacterium avium subsp. paratuberculosis
cggggguaaaccgccagc

SEQ ID NO: 1017021 - RNA, 13 nt, Mycobacterium avium subsp. paratuberculosis
cggggguccaggg

SEQ ID NO: 1017022 - RNA, 14 nt, Mycobacterium avium subsp. paratuberculosis
cgggggucggagca

SEQ ID NO: 1017023 - RNA, 16 nt, Mycobacterium avium subsp. paratuberculosis
cgggggugccgaccgc

SEQ ID NO: 1017024 - RNA, 15 nt, Mycobacterium avium subsp. paratuberculosis
cggggugggcugcau

SEQ ID NO: 1017025 - RNA, 21 nt, Mycobacterium avium subsp. paratuberculosis
cgggguguaggcgucggcgga

SEQ ID NO: 1017026 - RNA, 15 nt, Mycobacterium avium subsp. paratuberculosis
cggggugguggaagg

SEQ ID NO: 1017027 - RNA, 20 nt, Mycobacterium avium subsp. paratuberculosis
cgggguggcgccggccagca

SEQ ID NO: 1017028 - RNA, 17 nt, Mycobacterium avium subsp. paratuberculosis
cggguagcccgucgacg

SEQ ID NO: 1017029 - RNA, 18 nt, Mycobacterium avium subsp. paratuberculosis
cggguagaaccagcccgg

SEQ ID NO: 1017030 - RNA, 19 nt, Mycobacterium avium subsp. paratuberculosis
cggguagaaccagcccggc

SEQ ID NO: 1017031 - RNA, 20 nt, Mycobacterium avium subsp. paratuberculosis
cggguagacguucuccccgc

SEQ ID NO: 1017032 - RNA, 21 nt, Mycobacterium avium subsp. paratuberculosis
cggguagacguucuccccgcc

SEQ ID NO: 1017033 - RNA, 21 nt, Mycobacterium avium subsp. paratuberculosis
cggguagggcagccacaucug

SEQ ID NO: 1017034 - RNA, 16 nt, Mycobacterium avium subsp. paratuberculosis
cggguaggugcccggg

SEQ ID NO: 1017035 - RNA, 16 nt, Mycobacterium avium subsp. paratuberculosis
cggguaggcgucgcgc

SEQ ID NO: 1017036 - RNA, 19 nt, Mycobacterium avium subsp. paratuberculosis
cgggucaauugccacagcc

SEQ ID NO: 1017037 - RNA, 17 nt, Mycobacterium avium subsp. paratuberculosis
cggguccgaccagcacc

SEQ ID NO: 1017038 - RNA, 18 nt, Mycobacterium avium subsp. paratuberculosis
cggguccgaccagcaccc

SEQ ID NO: 1017039 - RNA, 19 nt, Mycobacterium avium subsp. paratuberculosis
cggguccgcacccgggccc

SEQ ID NO: 1017040 - RNA, 17 nt, Mycobacterium avium subsp. paratuberculosis
cggggucggccgagguc

SEQ ID NO: 1017041 - RNA, 14 nt, Mycobacterium avium subsp. paratuberculosis
cggggucggcgccc

SEQ ID NO: 1017042 - RNA, 15 nt, Mycobacterium avium subsp. paratuberculosis
cggggucggacagag

SEQ ID NO: 1017043 - RNA, 22 nt, Mycobacterium avium subsp. paratuberculosis
cggggucgaaguccugcgccgc

SEQ ID NO: 1017044 - RNA, 22 nt, Mycobacterium avium subsp. paratuberculosis
cgggguccaccggccgauggcc

SEQ ID NO: 1017045 - RNA, 13 nt, Mycobacterium avium subsp. paratuberculosis
cgggguccaggcc

SEQ ID NO: 1017046 - RNA, 19 nt, Mycobacterium avium subsp. paratuberculosis
cggggucccaauccucgcc

SEQ ID NO: 1017047 - RNA, 24 nt, Mycobacterium avium subsp. paratuberculosis
cgggguccgcaacgccggcgugca

SEQ ID NO: 1017048 - RNA, 17 nt, Mycobacterium avium subsp. paratuberculosis
cggggucaagcggcaga

SEQ ID NO: 1017049 - RNA, 20 nt, Mycobacterium avium subsp. paratuberculosis
cggggucaagcggcagaccg

SEQ ID NO: 1017050 - RNA, 17 nt, Mycobacterium avium subsp. paratuberculosis
cgggguagccggcccgc

SEQ ID NO: 1017051 - RNA, 19 nt, Mycobacterium avium subsp. paratuberculosis
cgggguaguucagcgcgcg

SEQ ID NO: 1017052 - RNA, 24 nt, Mycobacterium avium subsp. paratuberculosis
cgggguaguucagcgcgcgggagc

SEQ ID NO: 1017053 - RNA, 14 nt, Mycobacterium avium subsp. paratuberculosis
cggggugcagcacc

SEQ ID NO: 1017054 - RNA, 18 nt, Mycobacterium avium subsp. paratuberculosis
cgggguggccggccagca

SEQ ID NO: 1017055 - RNA, 22 nt, Mycobacterium avium subsp. paratuberculosis
cggggugcucgaucggcgcgcc

SEQ ID NO: 1017056 - RNA, 15 nt, Mycobacterium avium subsp. paratuberculosis
cggggugcccaccac

SEQ ID NO: 1017057 - RNA, 19 nt, Mycobacterium avium subsp. paratuberculosis
cggggugaugccggcggua

SEQ ID NO: 1017058 - RNA, 13 nt, Mycobacterium avium subsp. paratuberculosis
cggggugagcacc

SEQ ID NO: 1017059 - RNA, 19 nt, Mycobacterium avium subsp. paratuberculosis
cggggucgggccggacagc

SEQ ID NO: 1017060 - RNA, 17 nt, Mycobacterium avium subsp. paratuberculosis
cggggucgucgacggcc

SEQ ID NO: 1017061 - RNA, 19 nt, Mycobacterium avium subsp. paratuberculosis
cggggucguugcacaccac

SEQ ID NO: 1017062 - RNA, 19 nt, Mycobacterium avium subsp. paratuberculosis
cggggucucaaucuucucc

SEQ ID NO: 1017063 - RNA, 19 nt, Mycobacterium avium subsp. paratuberculosis
cgggccauguccccgacca

SEQ ID NO: 1017064 - RNA, 13 nt, Mycobacterium avium subsp. paratuberculosis
cgggcccaccgcc

SEQ ID NO: 1017065 - RNA, 23 nt, Mycobacterium avium subsp. paratuberculosis
cgggcccaccgcgcgcugcagca

SEQ ID NO: 1017066 - RNA, 17 nt, Mycobacterium avium subsp. paratuberculosis
cgggcccagcagauagc

SEQ ID NO: 1017067 - RNA, 14 nt, Mycobacterium avium subsp. paratuberculosis
cgggcccagcagcc

SEQ ID NO: 1017068 - RNA, 15 nt, Mycobacterium avium subsp. paratuberculosis
cgggcccagcagccu

SEQ ID NO: 1017069 - RNA, 20 nt, Mycobacterium avium subsp. paratuberculosis
cgggcccagcagccugcccc

SEQ ID NO: 1017070 - RNA, 20 nt, Mycobacterium avium subsp. paratuberculosis
cgggcccagcucggugcgca

SEQ ID NO: 1017071 - RNA, 23 nt, Mycobacterium avium subsp. paratuberculosis
cgggcccgagguccucgcgcaac

SEQ ID NO: 1017072 - RNA, 12 nt, Mycobacterium avium subsp. paratuberculosis
cgggcccgcagc

SEQ ID NO: 1017073 - RNA, 14 nt, Mycobacterium avium subsp. paratuberculosis
cgggccgaacugcc

SEQ ID NO: 1017074 - RNA, 17 nt, Mycobacterium avium subsp. paratuberculosis
cgggccgaaggcggcgc

SEQ ID NO: 1017075 - RNA, 22 nt, Mycobacterium avium subsp. paratuberculosis
cgggccgaaggcggcgccggcc

SEQ ID NO: 1017076 - RNA, 13 nt, Mycobacterium avium subsp. paratuberculosis
cgggcccggcgau

SEQ ID NO: 1017077 - RNA, 20 nt, Mycobacterium avium subsp. paratuberculosis
cgggcccgggcugcccgggc

SEQ ID NO: 1017078 - RNA, 17 nt, Mycobacterium avium subsp. paratuberculosis
cgggcccgucgccggcg

SEQ ID NO: 1017079 - RNA, 16 nt, Mycobacterium avium subsp. paratuberculosis
cgggccgacagcacgc

SEQ ID NO: 1017080 - RNA, 17 nt, Mycobacterium avium subsp. paratuberculosis
cgggccgacagcacgcc

SEQ ID NO: 1017081 - RNA, 15 nt, Mycobacterium avium subsp. paratuberculosis
cgggcccgcgcggcg

SEQ ID NO: 1017082 - RNA, 21 nt, Mycobacterium avium subsp. paratuberculosis
cgggcccgcucaccugcggcc

SEQ ID NO: 1017083 - RNA, 15 nt, Mycobacterium avium subsp. paratuberculosis
cgggcccgcugcagc

SEQ ID NO: 1017084 - RNA, 14 nt, Mycobacterium avium subsp. paratuberculosis
cgggcccgcgccgc

SEQ ID NO: 1017085 - RNA, 17 nt, Mycobacterium avium subsp. paratuberculosis
cgggcccgcgccgcguc

SEQ ID NO: 1017086 - RNA, 21 nt, Mycobacterium avium subsp. paratuberculosis
cgggcaggcucagguaggcgc

SEQ ID NO: 1017087 - RNA, 24 nt, Mycobacterium avium subsp. paratuberculosis
cgggcacguccagcccgcgccagc

SEQ ID NO: 1017088 - RNA, 22 nt, Mycobacterium avium subsp. paratuberculosis
cgggcaguuccuugcgcagcac

SEQ ID NO: 1017089 - RNA, 17 nt, Mycobacterium avium subsp. paratuberculosis
cgggcaguugccggcca

SEQ ID NO: 1017090 - RNA, 19 nt, Mycobacterium avium subsp. paratuberculosis
cgggccaggcgcgcguagc

SEQ ID NO: 1017091 - RNA, 17 nt, Mycobacterium avium subsp. paratuberculosis
cgggccaggucccaggc

SEQ ID NO: 1017092 - RNA, 20 nt, Mycobacterium avium subsp. paratuberculosis
cgggccagcucgaaccugga

SEQ ID NO: 1017093 - RNA, 13 nt, Mycobacterium avium subsp. paratuberculosis
cgggccaggaccg

SEQ ID NO: 1017094 - RNA, 22 nt, Mycobacterium avium subsp. paratuberculosis
cgggccaggauguucaccccgg

SEQ ID NO: 1017095 - RNA, 23 nt, Mycobacterium avium subsp. paratuberculosis
cgggccaggauguucaccccggc

SEQ ID NO: 1017096 - RNA, 14 nt, Mycobacterium avium subsp. paratuberculosis
cgggccagccaggu

SEQ ID NO: 1017097 - RNA, 15 nt, Mycobacterium avium subsp. paratuberculosis
cgggccagccggccc

SEQ ID NO: 1017098 - RNA, 21 nt, Mycobacterium avium subsp. paratuberculosis
cgggccagcguuuccagcgcc

SEQ ID NO: 1017099 - RNA, 15 nt, Mycobacterium avium subsp. paratuberculosis
cgggcauccgcccgu

SEQ ID NO: 1017100 - RNA, 18 nt, Mycobacterium avium subsp. paratuberculosis
cgggcauccggcucagaa

SEQ ID NO: 1017101 - RNA, 15 nt, Mycobacterium avium subsp. paratuberculosis
cgggaagcccaccgc

SEQ ID NO: 1017102 - RNA, 17 nt, Mycobacterium avium subsp. paratuberculosis
cgggaagccgcagcagg

SEQ ID NO: 1017103 - RNA, 18 nt, Mycobacterium avium subsp. paratuberculosis
cgggaaucccacccgcaa

SEQ ID NO: 1017104 - RNA, 14 nt, Mycobacterium avium subsp. paratuberculosis
cgggcacgccgccg

SEQ ID NO: 1017105 - RNA, 21 nt, Mycobacterium avium subsp. paratuberculosis
cgggcagcuuccgccucggcg

SEQ ID NO: 1017106 - RNA, 21 nt, Mycobacterium avium subsp. paratuberculosis
cgggcaccucggcgucggcgc

SEQ ID NO: 1017107 - RNA, 16 nt, Mycobacterium avium subsp. paratuberculosis
cgggaauggccgcgcc

SEQ ID NO: 1017108 - RNA, 23 nt, Mycobacterium avium subsp. paratuberculosis
cgggcacaccgucguccacgccc

SEQ ID NO: 1017109 - RNA, 18 nt, Mycobacterium avium subsp. paratuberculosis
cgggcacagccagcgccc

SEQ ID NO: 1017110 - RNA, 15 nt, Mycobacterium avium subsp. paratuberculosis
cgggcaccaccaccg

SEQ ID NO: 1017111 - RNA, 13 nt, Mycobacterium avium subsp. paratuberculosis
cgggcaccacggc

SEQ ID NO: 1017112 - RNA, 15 nt, Mycobacterium avium subsp. paratuberculosis
cgggcaccagcaccg

SEQ ID NO: 1017113 - RNA, 22 nt, Mycobacterium avium subsp. paratuberculosis
cgggcaccaguaggucacccgg

SEQ ID NO: 1017114 - RNA, 20 nt, Mycobacterium avium subsp. paratuberculosis
cgggcaccccaucggccagg

SEQ ID NO: 1017115 - RNA, 14 nt, Mycobacterium avium subsp. paratuberculosis
cgggcacccgggcg

SEQ ID NO: 1017116 - RNA, 16 nt, Mycobacterium avium subsp. paratuberculosis
cgggcacccgggcgac

SEQ ID NO: 1017117 - RNA, 15 nt, Mycobacterium avium subsp. paratuberculosis
cgggcaccgacauca

SEQ ID NO: 1017118 - RNA, 16 nt, Mycobacterium avium subsp. paratuberculosis
cgggcaccgacaucag

SEQ ID NO: 1017119 - RNA, 15 nt, Mycobacterium avium subsp. paratuberculosis
cgggcaccgacgagg

SEQ ID NO: 1017120 - RNA, 17 nt, Mycobacterium avium subsp. paratuberculosis
cgggccuuggccaacgc

SEQ ID NO: 1017121 - RNA, 19 nt, Mycobacterium avium subsp. paratuberculosis
cgggcgaaaucgcgggccu

SEQ ID NO: 1017122 - RNA, 20 nt, Mycobacterium avium subsp. paratuberculosis
cgggcgaaccacgggucgcu

SEQ ID NO: 1017123 - RNA, 13 nt, Mycobacterium avium subsp. paratuberculosis
cgggcgaacgacc

SEQ ID NO: 1017124 - RNA, 16 nt, Mycobacterium avium subsp. paratuberculosis
cgggcgaaguagccgg

SEQ ID NO: 1017125 - RNA, 13 nt, Mycobacterium avium subsp. paratuberculosis
cgggccugggcaa

SEQ ID NO: 1017126 - RNA, 13 nt, Mycobacterium avium subsp. paratuberculosis
cgggccugcagca

SEQ ID NO: 1017127 - RNA, 21 nt, Mycobacterium avium subsp. paratuberculosis
cgggccugcggcgcggccacc

SEQ ID NO: 1017128 - RNA, 22 nt, Mycobacterium avium subsp. paratuberculosis
cgggccugcucgucggggcagc

SEQ ID NO: 1017129 - RNA, 16 nt, Mycobacterium avium subsp. paratuberculosis
cgggcgacugcgugcu

SEQ ID NO: 1017130 - RNA, 20 nt, Mycobacterium avium subsp. paratuberculosis
cgggcgacuucuucgccggc

SEQ ID NO: 1017131 - RNA, 20 nt, Mycobacterium avium subsp. paratuberculosis
cgggcgaccccggccaggau

SEQ ID NO: 1017132 - RNA, 18 nt, Mycobacterium avium subsp. paratuberculosis
cgggcgaccugcgggccc

SEQ ID NO: 1017133 - RNA, 23 nt, Mycobacterium avium subsp. paratuberculosis
cgggcgaccugcgggcccaccgc

SEQ ID NO: 1017134 - RNA, 13 nt, Mycobacterium avium subsp. paratuberculosis
cgggcgaccuggu

SEQ ID NO: 1017135 - RNA, 20 nt, Mycobacterium avium subsp. paratuberculosis
cgggcgaccuggugcucgau

SEQ ID NO: 1017136 - RNA, 14 nt, Mycobacterium avium subsp. paratuberculosis
cgggcgauccgcag

SEQ ID NO: 1017137 - RNA, 21 nt, Mycobacterium avium subsp. paratuberculosis
cgggcgaucucgauggccacg

SEQ ID NO: 1017138 - RNA, 18 nt, Mycobacterium avium subsp. paratuberculosis
cgggcgcagcucgucgug

SEQ ID NO: 1017139 - RNA, 17 nt, Mycobacterium avium subsp. paratuberculosis
cgggcgcaccgcgcgcc

SEQ ID NO: 1017140 - RNA, 14 nt, Mycobacterium avium subsp. paratuberculosis
cgggcgaucagccc

SEQ ID NO: 1017141 - RNA, 20 nt, Mycobacterium avium subsp. paratuberculosis
cgggccgagcgcgccgccgc

SEQ ID NO: 1017142 - RNA, 15 nt, Mycobacterium avium subsp. paratuberculosis
cgggccgacccggcc

SEQ ID NO: 1017143 - RNA, 15 nt, Mycobacterium avium subsp. paratuberculosis
cgggccgaccuggcg

SEQ ID NO: 1017144 - RNA, 13 nt, Mycobacterium avium subsp. paratuberculosis
cgggccgcagcac

SEQ ID NO: 1017145 - RNA, 18 nt, Mycobacterium avium subsp. paratuberculosis
cgggccgcagcaccaccu

SEQ ID NO: 1017146 - RNA, 15 nt, Mycobacterium avium subsp. paratuberculosis
cgggccgcacccccu

SEQ ID NO: 1017147 - RNA, 20 nt, Mycobacterium avium subsp. paratuberculosis
cgggccgcacccccuccaca

SEQ ID NO: 1017148 - RNA, 18 nt, Mycobacterium avium subsp. paratuberculosis
cgggccgcauccgcgagc

SEQ ID NO: 1017149 - RNA, 15 nt, Mycobacterium avium subsp. paratuberculosis
cgggccgccacggcg

SEQ ID NO: 1017150 - RNA, 12 nt, Mycobacterium avium subsp. paratuberculosis
cgggccgccauc

SEQ ID NO: 1017151 - RNA, 15 nt, Mycobacterium avium subsp. paratuberculosis
cgggccgcgucggcc

SEQ ID NO: 1017152 - RNA, 14 nt, Mycobacterium avium subsp. paratuberculosis
cgggccgccgcggc

SEQ ID NO: 1017153 - RNA, 15 nt, Mycobacterium avium subsp. paratuberculosis
cgggccgccgggugg

SEQ ID NO: 1017154 - RNA, 11 nt, Mycobacterium avium subsp. paratuberculosis
cgggccgccuc

SEQ ID NO: 1017155 - RNA, 22 nt, Mycobacterium avium subsp. paratuberculosis
cgggccgccgacgucgugggcg

SEQ ID NO: 1017156 - RNA, 20 nt, Mycobacterium avium subsp. paratuberculosis
cgggccgccgaugcgcccgc

SEQ ID NO: 1017157 - RNA, 21 nt, Mycobacterium avium subsp. paratuberculosis
cgggccguaucggccccggcc

SEQ ID NO: 1017158 - RNA, 17 nt, Mycobacterium avium subsp. paratuberculosis
cgggccguccaucccga

SEQ ID NO: 1017159 - RNA, 14 nt, Mycobacterium avium subsp. paratuberculosis
cgggccggucgguc

SEQ ID NO: 1017160 - RNA, 18 nt, Mycobacterium avium subsp. paratuberculosis
cgggccggcggggugggc

SEQ ID NO: 1017161 - RNA, 18 nt, Mycobacterium avium subsp. paratuberculosis
cgggccggacagcggccc

SEQ ID NO: 1017162 - RNA, 13 nt, Mycobacterium avium subsp. paratuberculosis
cgggccggcagcc

SEQ ID NO: 1017163 - RNA, 15 nt, Mycobacterium avium subsp. paratuberculosis
cgggccggcagccgg

SEQ ID NO: 1017164 - RNA, 16 nt, Mycobacterium avium subsp. paratuberculosis
cgggccucgccgcuuc

SEQ ID NO: 1017165 - RNA, 18 nt, Mycobacterium avium subsp. paratuberculosis
cgggccuaggaccccggc

SEQ ID NO: 1017166 - RNA, 13 nt, Mycobacterium avium subsp. paratuberculosis
cgggccguucagc

SEQ ID NO: 1017167 - RNA, 15 nt, Mycobacterium avium subsp. paratuberculosis
cgggccguggcaccg

SEQ ID NO: 1017168 - RNA, 22 nt, Mycobacterium avium subsp. paratuberculosis
cgggccguggcaccgggugggc

SEQ ID NO: 1017169 - RNA, 20 nt, Mycobacterium avium subsp. paratuberculosis
cgggccguccgggugcgggc

SEQ ID NO: 1017170 - RNA, 15 nt, Mycobacterium avium subsp. paratuberculosis
cggcuuccgcggacg

SEQ ID NO: 1017171 - RNA, 15 nt, Mycobacterium avium subsp. paratuberculosis
cggcuuccuccucgg

SEQ ID NO: 1017172 - RNA, 21 nt, Mycobacterium avium subsp. paratuberculosis
cggcuucauaugacgccggcc

SEQ ID NO: 1017173 - RNA, 22 nt, Mycobacterium avium subsp. paratuberculosis
cggcuguggcgcacagaucguc

SEQ ID NO: 1017174 - RNA, 18 nt, Mycobacterium avium subsp. paratuberculosis
cggcuucgcugcgccggc

SEQ ID NO: 1017175 - RNA, 17 nt, Mycobacterium avium subsp. paratuberculosis
cggcuucggccaagggg

SEQ ID NO: 1017176 - RNA, 13 nt, Mycobacterium avium subsp. paratuberculosis
cggcugcccggcc

SEQ ID NO: 1017177 - RNA, 19 nt, Mycobacterium avium subsp. paratuberculosis
cggcugcccggcccgccgc

SEQ ID NO: 1017178 - RNA, 23 nt, Mycobacterium avium subsp. paratuberculosis
cggcugcccggcccgccgcugca

SEQ ID NO: 1017179 - RNA, 21 nt, Mycobacterium avium subsp. paratuberculosis
cggcugcgcacguagcccagc

SEQ ID NO: 1017180 - RNA, 21 nt, Mycobacterium avium subsp. paratuberculosis
cggcucgccggcgucuugauc

SEQ ID NO: 1017181 - RNA, 13 nt, Mycobacterium avium subsp. paratuberculosis
cggcucgccgggc

SEQ ID NO: 1017182 - RNA, 17 nt, Mycobacterium avium subsp. paratuberculosis
cggcuggcgugcggcgc

SEQ ID NO: 1017183 - RNA, 14 nt, Mycobacterium avium subsp. paratuberculosis
cggcugggccgcgg

SEQ ID NO: 1017184 - RNA, 20 nt, Mycobacterium avium subsp. paratuberculosis
cggcugggccgcggcgccgu

SEQ ID NO: 1017185 - RNA, 20 nt, Mycobacterium avium subsp. paratuberculosis
cggcuggccgcacaccugca

SEQ ID NO: 1017186 - RNA, 22 nt, Mycobacterium avium subsp. paratuberculosis
cggcuggccgcacaccugcauc

SEQ ID NO: 1017187 - RNA, 13 nt, Mycobacterium avium subsp. paratuberculosis
cggcuggccgcgg

SEQ ID NO: 1017188 - RNA, 16 nt, Mycobacterium avium subsp. paratuberculosis
cggcuggccgcggcga

SEQ ID NO: 1017189 - RNA, 15 nt, Mycobacterium avium subsp. paratuberculosis
cggcuggucggcggg

SEQ ID NO: 1017190 - RNA, 17 nt, Mycobacterium avium subsp. paratuberculosis
cggcuguagcacccggc

SEQ ID NO: 1017191 - RNA, 18 nt, Mycobacterium avium subsp. paratuberculosis
cggcuguagcacccggcc

SEQ ID NO: 1017192 - RNA, 22 nt, Mycobacterium avium subsp. paratuberculosis
cggcuguagcacccggccggcg

SEQ ID NO: 1017193 - RNA, 15 nt, Mycobacterium avium subsp. paratuberculosis
cggcuggugcagcag

SEQ ID NO: 1017194 - RNA, 17 nt, Mycobacterium avium subsp. paratuberculosis
cggcguacucgcacagc

SEQ ID NO: 1017195 - RNA, 23 nt, Mycobacterium avium subsp. paratuberculosis
cggcguacucgcacagccggcgc

SEQ ID NO: 1017196 - RNA, 23 nt, Mycobacterium avium subsp. paratuberculosis
cggcguacugcgcgaccaaacgc

SEQ ID NO: 1017197 - RNA, 17 nt, Mycobacterium avium subsp. paratuberculosis
cggcguacugcgcgagc

SEQ ID NO: 1017198 - RNA, 13 nt, Mycobacterium avium subsp. paratuberculosis
cggcguacccgcc

SEQ ID NO: 1017199 - RNA, 13 nt, Mycobacterium avium subsp. paratuberculosis
cggcguacagccc

SEQ ID NO: 1017200 - RNA, 16 nt, Mycobacterium avium subsp. paratuberculosis
cggcguagggcagccc

SEQ ID NO: 1017201 - RNA, 23 nt, Mycobacterium avium subsp. paratuberculosis
cggcguaggugggcagcgcggcc

SEQ ID NO: 1017202 - RNA, 24 nt, Mycobacterium avium subsp. paratuberculosis
cggcguaggugggcagcgcggcca

SEQ ID NO: 1017203 - RNA, 15 nt, Mycobacterium avium subsp. paratuberculosis
cggcgugcccgccga

SEQ ID NO: 1017204 - RNA, 19 nt, Mycobacterium avium subsp. paratuberculosis
cggcgugcacaggccgccg

SEQ ID NO: 1017205 - RNA, 17 nt, Mycobacterium avium subsp. paratuberculosis
cggcgugcaccgcccgc

SEQ ID NO: 1017206 - RNA, 15 nt, Mycobacterium avium subsp. paratuberculosis
cggcguagccgccgg

SEQ ID NO: 1017207 - RNA, 19 nt, Mycobacterium avium subsp. paratuberculosis
cggcgugccaccgcugggc

SEQ ID NO: 1017208 - RNA, 23 nt, Mycobacterium avium subsp. paratuberculosis
cggcgugccagggcagcgcgacc

SEQ ID NO: 1017209 - RNA, 19 nt, Mycobacterium avium subsp. paratuberculosis
cggcgugcucgucgcggag

SEQ ID NO: 1017210 - RNA, 15 nt, Mycobacterium avium subsp. paratuberculosis
cggcgugcugcgcag

SEQ ID NO: 1017211 - RNA, 16 nt, Mycobacterium avium subsp. paratuberculosis
cggcgugcugcgcagc

SEQ ID NO: 1017212 - RNA, 18 nt, Mycobacterium avium subsp. paratuberculosis
cggcgugcugcgcagcag

SEQ ID NO: 1017213 - RNA, 23 nt, Mycobacterium avium subsp. paratuberculosis
cggcgugcugcgcagcagcgcca

SEQ ID NO: 1017214 - RNA, 17 nt, Mycobacterium avium subsp. paratuberculosis
cggcgugcugggccacg

SEQ ID NO: 1017215 - RNA, 14 nt, Mycobacterium avium subsp. paratuberculosis
cggcguggaacacg

SEQ ID NO: 1017216 - RNA, 20 nt, Mycobacterium avium subsp. paratuberculosis
cggcguggaacacgcccagc

SEQ ID NO: 1017217 - RNA, 21 nt, Mycobacterium avium subsp. paratuberculosis
cggcguggaacacgcccagcg

SEQ ID NO: 1017218 - RNA, 23 nt, Mycobacterium avium subsp. paratuberculosis
cggcguggaacacgcccagcgcc

SEQ ID NO: 1017219 - RNA, 13 nt, Mycobacterium avium subsp. paratuberculosis
cggcguggcaggc

SEQ ID NO: 1017220 - RNA, 22 nt, Mycobacterium avium subsp. paratuberculosis
cggcguguaguacugcucgacg

SEQ ID NO: 1017221 - RNA, 16 nt, Mycobacterium avium subsp. paratuberculosis
cggcgugucggcgcca

SEQ ID NO: 1017222 - RNA, 19 nt, Mycobacterium avium subsp. paratuberculosis
cggcgugucggcgccaccg

SEQ ID NO: 1017223 - RNA, 14 nt, Mycobacterium avium subsp. paratuberculosis
cggcgugucgggug

SEQ ID NO: 1017224 - RNA, 15 nt, Mycobacterium avium subsp. paratuberculosis
cggcgugucgggugc

SEQ ID NO: 1017225 - RNA, 15 nt, Mycobacterium avium subsp. paratuberculosis
cggcguggccguccg

SEQ ID NO: 1017226 - RNA, 18 nt, Mycobacterium avium subsp. paratuberculosis
cggcguucagcggcaccg

SEQ ID NO: 1017227 - RNA, 18 nt, Mycobacterium avium subsp. paratuberculosis
cggcuaagccggcgucgg

SEQ ID NO: 1017228 - RNA, 22 nt, Mycobacterium avium subsp. paratuberculosis
cggcucaaaccguugaccacca

SEQ ID NO: 1017229 - RNA, 18 nt, Mycobacterium avium subsp. paratuberculosis
cggcucacagcgcggcgg

SEQ ID NO: 1017230 - RNA, 15 nt, Mycobacterium avium subsp. paratuberculosis
cggcucacaugggcg

SEQ ID NO: 1017231 - RNA, 23 nt, Mycobacterium avium subsp. paratuberculosis
cggcuacucggacgccggcagcc

SEQ ID NO: 1017232 - RNA, 17 nt, Mycobacterium avium subsp. paratuberculosis
cggcuccggccgcgccg

SEQ ID NO: 1017233 - RNA, 18 nt, Mycobacterium avium subsp. paratuberculosis
cggcuccggccgcgccgg

SEQ ID NO: 1017234 - RNA, 21 nt, Mycobacterium avium subsp. paratuberculosis
cggcuccggccgcgccggccu

SEQ ID NO: 1017235 - RNA, 16 nt, Mycobacterium avium subsp. paratuberculosis
cggcucagcgcgacgu

SEQ ID NO: 1017236 - RNA, 14 nt, Mycobacterium avium subsp. paratuberculosis
cggcucgccaccuc

SEQ ID NO: 1017237 - RNA, 20 nt, Mycobacterium avium subsp. paratuberculosis
cggcucgauggacgccagca

SEQ ID NO: 1017238 - RNA, 22 nt, Mycobacterium avium subsp. paratuberculosis
cggcuccugccguucggccagc

SEQ ID NO: 1017239 - RNA, 18 nt, Mycobacterium avium subsp. paratuberculosis
cggcucgaaaugccuugg

SEQ ID NO: 1017240 - RNA, 22 nt, Mycobacterium avium subsp. paratuberculosis
cggcucgaaaugccuuggcggc

SEQ ID NO: 1017241 - RNA, 22 nt, Mycobacterium avium subsp. paratuberculosis
cggcgguuucggugccggccca

SEQ ID NO: 1017242 - RNA, 23 nt, Mycobacterium avium subsp. paratuberculosis
cggcgguugauacucgggcaacg

SEQ ID NO: 1017243 - RNA, 12 nt, Mycobacterium avium subsp. paratuberculosis
cggcgguuuugu

SEQ ID NO: 1017244 - RNA, 19 nt, Mycobacterium avium subsp. paratuberculosis
cggcgguugcucgucggcc

SEQ ID NO: 1017245 - RNA, 13 nt, Mycobacterium avium subsp. paratuberculosis
cggcggucugucg

SEQ ID NO: 1017246 - RNA, 16 nt, Mycobacterium avium subsp. paratuberculosis
cggcggucugucgcgc

SEQ ID NO: 1017247 - RNA, 24 nt, Mycobacterium avium subsp. paratuberculosis
cggcggucuucuuggcgggcgacu

SEQ ID NO: 1017248 - RNA, 18 nt, Mycobacterium avium subsp. paratuberculosis
cggcggucuuggcggcca

SEQ ID NO: 1017249 - RNA, 15 nt, Mycobacterium avium subsp. paratuberculosis
cggcggucgcugcag

SEQ ID NO: 1017250 - RNA, 16 nt, Mycobacterium avium subsp. paratuberculosis
cggcggucgcugcagc

SEQ ID NO: 1017251 - RNA, 23 nt, Mycobacterium avium subsp. paratuberculosis
cggcggucgcugcagcggcggcc

SEQ ID NO: 1017252 - RNA, 22 nt, Mycobacterium avium subsp. paratuberculosis
cggcggucgccagcgccacgcu

SEQ ID NO: 1017253 - RNA, 21 nt, Mycobacterium avium subsp. paratuberculosis
cggcgggcgccggucggcgga

SEQ ID NO: 1017254 - RNA, 12 nt, Mycobacterium avium subsp. paratuberculosis
cggcggucgcgc

SEQ ID NO: 1017255 - RNA, 19 nt, Mycobacterium avium subsp. paratuberculosis
cggcggucccgugcgccgc

SEQ ID NO: 1017256 - RNA, 22 nt, Mycobacterium avium subsp. paratuberculosis
cggcggucagguucgccacgau

SEQ ID NO: 1017257 - RNA, 13 nt, Mycobacterium avium subsp. paratuberculosis
cggcggucaacac

SEQ ID NO: 1017258 - RNA, 20 nt, Mycobacterium avium subsp. paratuberculosis
cggcgguaugcccgggccgu

SEQ ID NO: 1017259 - RNA, 23 nt, Mycobacterium avium subsp. paratuberculosis
cggcgguauucgucaccccacca

SEQ ID NO: 1017260 - RNA, 23 nt, Mycobacterium avium subsp. paratuberculosis
cggcgggaacucgaugcggcagc

SEQ ID NO: 1017261 - RNA, 13 nt, Mycobacterium avium subsp. paratuberculosis
cggcgggacccgc

SEQ ID NO: 1017262 - RNA, 18 nt, Mycobacterium avium subsp. paratuberculosis
cggcgggagcuaggcggc

SEQ ID NO: 1017263 - RNA, 12 nt, Mycobacterium avium subsp. paratuberculosis
cggcgggcaccu

SEQ ID NO: 1017264 - RNA, 19 nt, Mycobacterium avium subsp. paratuberculosis
cggcgggccagcucgucga

SEQ ID NO: 1017265 - RNA, 13 nt, Mycobacterium avium subsp. paratuberculosis
cggcgggccaggg

SEQ ID NO: 1017266 - RNA, 18 nt, Mycobacterium avium subsp. paratuberculosis
cggcgggccagucgccgc

SEQ ID NO: 1017267 - RNA, 15 nt, Mycobacterium avium subsp. paratuberculosis
cggcgggcccagcag

SEQ ID NO: 1017268 - RNA, 21 nt, Mycobacterium avium subsp. paratuberculosis
cggcgggcccgucgccggcgc

SEQ ID NO: 1017269 - RNA, 24 nt, Mycobacterium avium subsp. paratuberculosis
cggcgggcccgucgccggcgcgca

SEQ ID NO: 1017270 - RNA, 12 nt, Mycobacterium avium subsp. paratuberculosis
cggcgggccgca

SEQ ID NO: 1017271 - RNA, 19 nt, Mycobacterium avium subsp. paratuberculosis
cggcgggccgcccggcgcg

SEQ ID NO: 1017272 - RNA, 20 nt, Mycobacterium avium subsp. paratuberculosis
cggcgggccgcccggcgcgc

SEQ ID NO: 1017273 - RNA, 15 nt, Mycobacterium avium subsp. paratuberculosis
cggcgggcggcggcg

SEQ ID NO: 1017274 - RNA, 13 nt, Mycobacterium avium subsp. paratuberculosis
cggcgggcggccg

SEQ ID NO: 1017275 - RNA, 12 nt, Mycobacterium avium subsp. paratuberculosis
cggcgggcggcg

SEQ ID NO: 1017276 - RNA, 14 nt, Mycobacterium avium subsp. paratuberculosis
cggcgggcgcgcgc

SEQ ID NO: 1017277 - RNA, 20 nt, Mycobacterium avium subsp. paratuberculosis
cggcgggcgcgcgccucgcg

SEQ ID NO: 1017278 - RNA, 20 nt, Mycobacterium avium subsp. paratuberculosis
cggcgggcgaaaucgcgggc

SEQ ID NO: 1017279 - RNA, 15 nt, Mycobacterium avium subsp. paratuberculosis
cggcggcgcgccggc

SEQ ID NO: 1017280 - RNA, 14 nt, Mycobacterium avium subsp. paratuberculosis
cggcggcggcaccg

SEQ ID NO: 1017281 - RNA, 12 nt, Mycobacterium avium subsp. paratuberculosis
cggcggcggccc

SEQ ID NO: 1017282 - RNA, 13 nt, Mycobacterium avium subsp. paratuberculosis
cggcggcggccgc

SEQ ID NO: 1017283 - RNA, 13 nt, Mycobacterium avium subsp. paratuberculosis
cggcggcggcgcg

SEQ ID NO: 1017284 - RNA, 16 nt, Mycobacterium avium subsp. paratuberculosis
cggcggcggcgcgccg

SEQ ID NO: 1017285 - RNA, 12 nt, Mycobacterium avium subsp. paratuberculosis
cggcggcggccu

SEQ ID NO: 1017286 - RNA, 15 nt, Mycobacterium avium subsp. paratuberculosis
cggcggcggugccgc

SEQ ID NO: 1017287 - RNA, 17 nt, Mycobacterium avium subsp. paratuberculosis
cggcggcgguccgcccg

SEQ ID NO: 1017288 - RNA, 20 nt, Mycobacterium avium subsp. paratuberculosis
cggcggcguauucccggggg

SEQ ID NO: 1017289 - RNA, 22 nt, Mycobacterium avium subsp. paratuberculosis
cggcggcugaaccaccgcgccc

SEQ ID NO: 1017290 - RNA, 15 nt, Mycobacterium avium subsp. paratuberculosis
cggcggcugugaucg

SEQ ID NO: 1017291 - RNA, 22 nt, Mycobacterium avium subsp. paratuberculosis
cggcggcucagcaacccgccga

SEQ ID NO: 1017292 - RNA, 14 nt, Mycobacterium avium subsp. paratuberculosis
cggcggcucagggg

SEQ ID NO: 1017293 - RNA, 14 nt, Mycobacterium avium subsp. paratuberculosis
cggcggcgugccgc

SEQ ID NO: 1017294 - RNA, 15 nt, Mycobacterium avium subsp. paratuberculosis
cggcggcgucggcgu

SEQ ID NO: 1017295 - RNA, 15 nt, Mycobacterium avium subsp. paratuberculosis
cggcggcgugcaccg

SEQ ID NO: 1017296 - RNA, 15 nt, Mycobacterium avium subsp. paratuberculosis
cggcggccugcucca

SEQ ID NO: 1017297 - RNA, 17 nt, Mycobacterium avium subsp. paratuberculosis
cggcggcgaagccggcc

SEQ ID NO: 1017298 - RNA, 23 nt, Mycobacterium avium subsp. paratuberculosis
cggcggcgacgucgacggcagcg

SEQ ID NO: 1017299 - RNA, 22 nt, Mycobacterium avium subsp. paratuberculosis
cggcggcgacgugccggcggca

SEQ ID NO: 1017300 - RNA, 18 nt, Mycobacterium avium subsp. paratuberculosis
cggcggccugcggcggca

SEQ ID NO: 1017301 - RNA, 17 nt, Mycobacterium avium subsp. paratuberculosis
cggcggccggcgccgac

SEQ ID NO: 1017302 - RNA, 15 nt, Mycobacterium avium subsp. paratuberculosis
cggcggccggcggca

SEQ ID NO: 1017303 - RNA, 12 nt, Mycobacterium avium subsp. paratuberculosis
cggcggccgggg

SEQ ID NO: 1017304 - RNA, 13 nt, Mycobacterium avium subsp. paratuberculosis
cggcggccgucgg

SEQ ID NO: 1017305 - RNA, 22 nt, Mycobacterium avium subsp. paratuberculosis
cggcggcgccaugaacggcggg

SEQ ID NO: 1017306 - RNA, 15 nt, Mycobacterium avium subsp. paratuberculosis
cggcggcgcccagga

SEQ ID NO: 1017307 - RNA, 24 nt, Mycobacterium avium subsp. paratuberculosis
cggcggcgaguucggcggcccgcu

SEQ ID NO: 1017308 - RNA, 16 nt, Mycobacterium avium subsp. paratuberculosis
cggcggcgauccggcc

SEQ ID NO: 1017309 - RNA, 13 nt, Mycobacterium avium subsp. paratuberculosis
cggcggcgccggg

SEQ ID NO: 1017310 - RNA, 13 nt, Mycobacterium avium subsp. paratuberculosis
cggcggcgcgcac

SEQ ID NO: 1017311 - RNA, 13 nt, Mycobacterium avium subsp. paratuberculosis
cggcggcgcgcug

SEQ ID NO: 1017312 - RNA, 14 nt, Mycobacterium avium subsp. paratuberculosis
cggcggcgcgcugc

SEQ ID NO: 1017313 - RNA, 15 nt, Mycobacterium avium subsp. paratuberculosis
cggcggcgcggcagg

SEQ ID NO: 1017314 - RNA, 15 nt, Mycobacterium avium subsp. paratuberculosis
cggcggcgcggccca

SEQ ID NO: 1017315 - RNA, 17 nt, Mycobacterium avium subsp. paratuberculosis
cggcggcgcggcccagg

SEQ ID NO: 1017316 - RNA, 13 nt, Mycobacterium avium subsp. paratuberculosis
cggcggcgcgggc

SEQ ID NO: 1017317 - RNA, 15 nt, Mycobacterium avium subsp. paratuberculosis
cggcggcgcgggcgc

SEQ ID NO: 1017318 - RNA, 17 nt, Mycobacterium avium subsp. paratuberculosis
cggcggcgcgggcgccc

SEQ ID NO: 1017319 - RNA, 16 nt, Mycobacterium avium subsp. paratuberculosis
cggcggcgcgggcggc

SEQ ID NO: 1017320 - RNA, 17 nt, Mycobacterium avium subsp. paratuberculosis
cggcggcgcgggcggcg

SEQ ID NO: 1017321 - RNA, 16 nt, Mycobacterium avium subsp. paratuberculosis
cggcgcucgcgggugc

SEQ ID NO: 1017322 - RNA, 19 nt, Mycobacterium avium subsp. paratuberculosis
cggcgcucgccgcgcggcc

SEQ ID NO: 1017323 - RNA, 13 nt, Mycobacterium avium subsp. paratuberculosis
cggcgcugcagca

SEQ ID NO: 1017324 - RNA, 21 nt, Mycobacterium avium subsp. paratuberculosis
cggcgcugcccgccgcggugc

SEQ ID NO: 1017325 - RNA, 18 nt, Mycobacterium avium subsp. paratuberculosis
cggcggacucggcgaagu

SEQ ID NO: 1017326 - RNA, 13 nt, Mycobacterium avium subsp. paratuberculosis
cggcggacagccc

SEQ ID NO: 1017327 - RNA, 21 nt, Mycobacterium avium subsp. paratuberculosis
cggcggacagccccgagccgc

SEQ ID NO: 1017328 - RNA, 17 nt, Mycobacterium avium subsp. paratuberculosis
cggcggacccagcuccu

SEQ ID NO: 1017329 - RNA, 21 nt, Mycobacterium avium subsp. paratuberculosis
cggcggacccggaggcggcgg

SEQ ID NO: 1017330 - RNA, 14 nt, Mycobacterium avium subsp. paratuberculosis
cggcggaccggcgg

SEQ ID NO: 1017331 - RNA, 20 nt, Mycobacterium avium subsp. paratuberculosis
cggcggaccggcggccgcca

SEQ ID NO: 1017332 - RNA, 15 nt, Mycobacterium avium subsp. paratuberculosis
cggcggacgcggcca

SEQ ID NO: 1017333 - RNA, 17 nt, Mycobacterium avium subsp. paratuberculosis
cggcggauccagguggg

SEQ ID NO: 1017334 - RNA, 20 nt, Mycobacterium avium subsp. paratuberculosis
cggcggaggccugcgcggcc

SEQ ID NO: 1017335 - RNA, 22 nt, Mycobacterium avium subsp. paratuberculosis
cggcggaggccugcgcggccgc

SEQ ID NO: 1017336 - RNA, 15 nt, Mycobacterium avium subsp. paratuberculosis
cggcggagggguacu

SEQ ID NO: 1017337 - RNA, 17 nt, Mycobacterium avium subsp. paratuberculosis
cggcggauauagccgac

SEQ ID NO: 1017338 - RNA, 22 nt, Mycobacterium avium subsp. paratuberculosis
cggcggauucucgcucugccgg

SEQ ID NO: 1017339 - RNA, 13 nt, Mycobacterium avium subsp. paratuberculosis
cggcggccaccgc

SEQ ID NO: 1017340 - RNA, 16 nt, Mycobacterium avium subsp. paratuberculosis
cggcggccaccagccg

SEQ ID NO: 1017341 - RNA, 21 nt, Mycobacterium avium subsp. paratuberculosis
cggcggccaccagccggccgg

SEQ ID NO: 1017342 - RNA, 14 nt, Mycobacterium avium subsp. paratuberculosis
cggcggccaccaug

SEQ ID NO: 1017343 - RNA, 16 nt, Mycobacterium avium subsp. paratuberculosis
cggcggccggccagca

SEQ ID NO: 1017344 - RNA, 21 nt, Mycobacterium avium subsp. paratuberculosis
cggcggccggccagcagccgg

SEQ ID NO: 1017345 - RNA, 13 nt, Mycobacterium avium subsp. paratuberculosis
cggcggccggccg

SEQ ID NO: 1017346 - RNA, 14 nt, Mycobacterium avium subsp. paratuberculosis
cggcggccggccgc

SEQ ID NO: 1017347 - RNA, 18 nt, Mycobacterium avium subsp. paratuberculosis
cggcggccggccgcgcgc

SEQ ID NO: 1017348 - RNA, 12 nt, Mycobacterium avium subsp. paratuberculosis
cggcggccgccc

SEQ ID NO: 1017349 - RNA, 18 nt, Mycobacterium avium subsp. paratuberculosis
cggcggccaccucgccgc

SEQ ID NO: 1017350 - RNA, 22 nt, Mycobacterium avium subsp. paratuberculosis
cggcggccccgguagccagcac

SEQ ID NO: 1017351 - RNA, 18 nt, Mycobacterium avium subsp. paratuberculosis
cggcggcccgccgcgccc

SEQ ID NO: 1017352 - RNA, 23 nt, Mycobacterium avium subsp. paratuberculosis
cggcggcccgucgccaccacggc

SEQ ID NO: 1017353 - RNA, 22 nt, Mycobacterium avium subsp. paratuberculosis
cggcggcccuucucggacgccc

SEQ ID NO: 1017354 - RNA, 17 nt, Mycobacterium avium subsp. paratuberculosis
cggcggccgacagggug

SEQ ID NO: 1017355 - RNA, 15 nt, Mycobacterium avium subsp. paratuberculosis
cggcggccgacgcgc

SEQ ID NO: 1017356 - RNA, 23 nt, Mycobacterium avium subsp. paratuberculosis
cggcggccgagcgcaccgcggag

SEQ ID NO: 1017357 - RNA, 14 nt, Mycobacterium avium subsp. paratuberculosis
cggcggccgcagcg

SEQ ID NO: 1017358 - RNA, 20 nt, Mycobacterium avium subsp. paratuberculosis
cggcgcgugcgccgcggcgg

SEQ ID NO: 1017359 - RNA, 21 nt, Mycobacterium avium subsp. paratuberculosis
cggcgcgugcgccgcggcggc

SEQ ID NO: 1017360 - RNA, 14 nt, Mycobacterium avium subsp. paratuberculosis
cggcgcggcgcagc

SEQ ID NO: 1017361 - RNA, 15 nt, Mycobacterium avium subsp. paratuberculosis
cggcgcucaccgcga

SEQ ID NO: 1017362 - RNA, 17 nt, Mycobacterium avium subsp. paratuberculosis
cggcgcucaccggcgug

SEQ ID NO: 1017363 - RNA, 13 nt, Mycobacterium avium subsp. paratuberculosis
cggcgcuccagcg

SEQ ID NO: 1017364 - RNA, 15 nt, Mycobacterium avium subsp. paratuberculosis
cggcgcuccagcggg

SEQ ID NO: 1017365 - RNA, 23 nt, Mycobacterium avium subsp. paratuberculosis
cggcgcggccggugcgcgucagc

SEQ ID NO: 1017366 - RNA, 10 nt, Mycobacterium avium subsp. paratuberculosis
cggcgcggcc

SEQ ID NO: 1017367 - RNA, 17 nt, Mycobacterium avium subsp. paratuberculosis
cggcgcggccgcccagc

SEQ ID NO: 1017368 - RNA, 17 nt, Mycobacterium avium subsp. paratuberculosis
cggcgcggcccggcccg

SEQ ID NO: 1017369 - RNA, 20 nt, Mycobacterium avium subsp. paratuberculosis
cggcgcggaucucgcgcagg

SEQ ID NO: 1017370 - RNA, 23 nt, Mycobacterium avium subsp. paratuberculosis
cggcgcggaugacgugcaccacc

SEQ ID NO: 1017371 - RNA, 16 nt, Mycobacterium avium subsp. paratuberculosis
cggcgcggcagggcca

SEQ ID NO: 1017372 - RNA, 12 nt, Mycobacterium avium subsp. paratuberculosis
cggcgcggacgg

SEQ ID NO: 1017373 - RNA, 18 nt, Mycobacterium avium subsp. paratuberculosis
cggccuugaccaggaugu

SEQ ID NO: 1017374 - RNA, 21 nt, Mycobacterium avium subsp. paratuberculosis
cggccuugcgagccggagccu

SEQ ID NO: 1017375 - RNA, 20 nt, Mycobacterium avium subsp. paratuberculosis
cggcgcgcugaagcgcgacc

SEQ ID NO: 1017376 - RNA, 17 nt, Mycobacterium avium subsp. paratuberculosis
cggcgcgcugcaggccc

SEQ ID NO: 1017377 - RNA, 20 nt, Mycobacterium avium subsp. paratuberculosis
cggcgcgcugcaggcccggg

SEQ ID NO: 1017378 - RNA, 19 nt, Mycobacterium avium subsp. paratuberculosis
cggccuucagugaaccccg

SEQ ID NO: 1017379 - RNA, 21 nt, Mycobacterium avium subsp. paratuberculosis
cggccuucuuggccggagccu

SEQ ID NO: 1017380 - RNA, 22 nt, Mycobacterium avium subsp. paratuberculosis
cggccuucaccagggugccccg

SEQ ID NO: 1017381 - RNA, 18 nt, Mycobacterium avium subsp. paratuberculosis
cggccugguacagcaccg

SEQ ID NO: 1017382 - RNA, 20 nt, Mycobacterium avium subsp. paratuberculosis
cggccugucaacgagacacc

SEQ ID NO: 1017383 - RNA, 18 nt, Mycobacterium avium subsp. paratuberculosis
cgucacgucgacggccgc

SEQ ID NO: 1017384 - RNA, 16 nt, Mycobacterium avium subsp. paratuberculosis
cgucacgucggccugc

SEQ ID NO: 1017385 - RNA, 14 nt, Mycobacterium avium subsp. paratuberculosis
cgucacgggccagg

SEQ ID NO: 1017386 - RNA, 21 nt, Mycobacterium avium subsp. paratuberculosis
cgucacugucggcgcggacgu

SEQ ID NO: 1017387 - RNA, 21 nt, Mycobacterium avium subsp. paratuberculosis
cgucacguagcgcggccgccc

SEQ ID NO: 1017388 - RNA, 18 nt, Mycobacterium avium subsp. paratuberculosis
cgucacgccgcgcccguc

SEQ ID NO: 1017389 - RNA, 17 nt, Mycobacterium avium subsp. paratuberculosis
cgucacgcugcgcgccg

SEQ ID NO: 1017390 - RNA, 14 nt, Mycobacterium avium subsp. paratuberculosis
cgucacgccagcgu

SEQ ID NO: 1017391 - RNA, 22 nt, Mycobacterium avium subsp. paratuberculosis
cgucacgccagcgugacgccgg

SEQ ID NO: 1017392 - RNA, 18 nt, Mycobacterium avium subsp. paratuberculosis
cgucaccuucacccccac

SEQ ID NO: 1017393 - RNA, 14 nt, Mycobacterium avium subsp. paratuberculosis
cgucaccguggcgg

SEQ ID NO: 1017394 - RNA, 18 nt, Mycobacterium avium subsp. paratuberculosis
cgucaccccaccgagcag

SEQ ID NO: 1017395 - RNA, 20 nt, Mycobacterium avium subsp. paratuberculosis
cgucaccgccaggaccaccc

SEQ ID NO: 1017396 - RNA, 21 nt, Mycobacterium avium subsp. paratuberculosis
cgucacaccgcggccagcgcg

SEQ ID NO: 1017397 - RNA, 17 nt, Mycobacterium avium subsp. paratuberculosis
cgucaccaaugcgccgg

SEQ ID NO: 1017398 - RNA, 18 nt, Mycobacterium avium subsp. paratuberculosis
cgucaccaaugcgccggc

SEQ ID NO: 1017399 - RNA, 15 nt, Mycobacterium avium subsp. paratuberculosis
cgucaacgccccggu

SEQ ID NO: 1017400 - RNA, 22 nt, Mycobacterium avium subsp. paratuberculosis
cgucaucaucaccgggauggug

SEQ ID NO: 1017401 - RNA, 19 nt, Mycobacterium avium subsp. paratuberculosis
cgucaggucaccgagcggg

SEQ ID NO: 1017402 - RNA, 14 nt, Mycobacterium avium subsp. paratuberculosis
cgucaggucgaccg

SEQ ID NO: 1017403 - RNA, 20 nt, Mycobacterium avium subsp. paratuberculosis
cgucaugccuuggccguagg

SEQ ID NO: 1017404 - RNA, 17 nt, Mycobacterium avium subsp. paratuberculosis
cgucaucgucuccgcug

SEQ ID NO: 1017405 - RNA, 22 nt, Mycobacterium avium subsp. paratuberculosis
cgucauccggcugcccugggag

SEQ ID NO: 1017406 - RNA, 22 nt, Mycobacterium avium subsp. paratuberculosis
cgucaucgcggcgaacaacgcc

SEQ ID NO: 1017407 - RNA, 19 nt, Mycobacterium avium subsp. paratuberculosis
cgucagaaccggggccagc

SEQ ID NO: 1017408 - RNA, 13 nt, Mycobacterium avium subsp. paratuberculosis
cgucagcaccgcg

SEQ ID NO: 1017409 - RNA, 18 nt, Mycobacterium avium subsp. paratuberculosis
cgucagcccgcgucgcgc

SEQ ID NO: 1017410 - RNA, 19 nt, Mycobacterium avium subsp. paratuberculosis
cgucagccagguguagacc

SEQ ID NO: 1017411 - RNA, 18 nt, Mycobacterium avium subsp. paratuberculosis
cgucagcaccgugggccc

SEQ ID NO: 1017412 - RNA, 16 nt, Mycobacterium avium subsp. paratuberculosis
cgucagcgucagcacg

SEQ ID NO: 1017413 - RNA, 18 nt, Mycobacterium avium subsp. paratuberculosis
cgucagcgcgggccagca

SEQ ID NO: 1017414 - RNA, 17 nt, Mycobacterium avium subsp. paratuberculosis
cgucaggagugcucggc

SEQ ID NO: 1017415 - RNA, 23 nt, Mycobacterium avium subsp. paratuberculosis
cgucagcucccccgacaccgcca

SEQ ID NO: 1017416 - RNA, 22 nt, Mycobacterium avium subsp. paratuberculosis
cgucaggccggucagcgacgag

SEQ ID NO: 1017417 - RNA, 22 nt, Mycobacterium avium subsp. paratuberculosis
cgucaggccguagcggcucgcc

SEQ ID NO: 1017418 - RNA, 17 nt, Mycobacterium avium subsp. paratuberculosis
cguauccggccagccgg

SEQ ID NO: 1017419 - RNA, 17 nt, Mycobacterium avium subsp. paratuberculosis
cguauugcacggcggcg

SEQ ID NO: 1017420 - RNA, 14 nt, Mycobacterium avium subsp. paratuberculosis
cguauuguccuguc

SEQ ID NO: 1017421 - RNA, 12 nt, Mycobacterium avium subsp. paratuberculosis
cguaucccugcc

SEQ ID NO: 1017422 - RNA, 15 nt, Mycobacterium avium subsp. paratuberculosis
cguaguugcgcgccg

SEQ ID NO: 1017423 - RNA, 18 nt, Mycobacterium avium subsp. paratuberculosis
cguagugcagccgcccgu

SEQ ID NO: 1017424 - RNA, 17 nt, Mycobacterium avium subsp. paratuberculosis
cguagucggcccgccgg

SEQ ID NO: 1017425 - RNA, 16 nt, Mycobacterium avium subsp. paratuberculosis
cguagucggcgcagcg

SEQ ID NO: 1017426 - RNA, 18 nt, Mycobacterium avium subsp. paratuberculosis
cguagucggcgcagcgca

SEQ ID NO: 1017427 - RNA, 14 nt, Mycobacterium avium subsp. paratuberculosis
cguagucggcggcg

SEQ ID NO: 1017428 - RNA, 19 nt, Mycobacterium avium subsp. paratuberculosis
cguaggugagcaacgccag

SEQ ID NO: 1017429 - RNA, 16 nt, Mycobacterium avium subsp. paratuberculosis
cguaggugcacagccc

SEQ ID NO: 1017430 - RNA, 17 nt, Mycobacterium avium subsp. paratuberculosis
cguagguggccagcacg

SEQ ID NO: 1017431 - RNA, 18 nt, Mycobacterium avium subsp. paratuberculosis
cguaacgccacggcggcc

SEQ ID NO: 1017432 - RNA, 18 nt, Mycobacterium avium subsp. paratuberculosis
cguagagcgcgaagcccu

SEQ ID NO: 1017433 - RNA, 15 nt, Mycobacterium avium subsp. paratuberculosis
cguagaccucuuggg

SEQ ID NO: 1017434 - RNA, 13 nt, Mycobacterium avium subsp. paratuberculosis
cguagcccgccga

SEQ ID NO: 1017435 - RNA, 23 nt, Mycobacterium avium subsp. paratuberculosis
cguagcccaccucgagcacgccc

SEQ ID NO: 1017436 - RNA, 14 nt, Mycobacterium avium subsp. paratuberculosis
cguagcccagcgcg

SEQ ID NO: 1017437 - RNA, 22 nt, Mycobacterium avium subsp. paratuberculosis
cguagcuggugcgcagcccgcc

SEQ ID NO: 1017438 - RNA, 14 nt, Mycobacterium avium subsp. paratuberculosis
cguagcucagcgga

SEQ ID NO: 1017439 - RNA, 21 nt, Mycobacterium avium subsp. paratuberculosis
cguagcgggucagcuccaccu

SEQ ID NO: 1017440 - RNA, 19 nt, Mycobacterium avium subsp. paratuberculosis
cguagcggucgccccagaa

SEQ ID NO: 1017441 - RNA, 23 nt, Mycobacterium avium subsp. paratuberculosis
cguagcggacgacggccagcuga

SEQ ID NO: 1017442 - RNA, 14 nt, Mycobacterium avium subsp. paratuberculosis
cguagcggcccagg

SEQ ID NO: 1017443 - RNA, 21 nt, Mycobacterium avium subsp. paratuberculosis
cguagcggcgccaccggcugg

SEQ ID NO: 1017444 - RNA, 17 nt, Mycobacterium avium subsp. paratuberculosis
cguagcgcagcuccagg

SEQ ID NO: 1017445 - RNA, 12 nt, Mycobacterium avium subsp. paratuberculosis
cguagcgccggc

SEQ ID NO: 1017446 - RNA, 18 nt, Mycobacterium avium subsp. paratuberculosis
cguagcgaggugugagga

SEQ ID NO: 1017447 - RNA, 21 nt, Mycobacterium avium subsp. paratuberculosis
cguaggacaggaacgggccgg

SEQ ID NO: 1017448 - RNA, 23 nt, Mycobacterium avium subsp. paratuberculosis
cguaggacaggaacgggccggcg

SEQ ID NO: 1017449 - RNA, 14 nt, Mycobacterium avium subsp. paratuberculosis
cguaggaguagcag

SEQ ID NO: 1017450 - RNA, 22 nt, Mycobacterium avium subsp. paratuberculosis
cguaggccaggaccgggacgac

SEQ ID NO: 1017451 - RNA, 15 nt, Mycobacterium avium subsp. paratuberculosis
cguaggcgaggaccg

SEQ ID NO: 1017452 - RNA, 22 nt, Mycobacterium avium subsp. paratuberculosis
cguaggcgaucagcgcgcacag

SEQ ID NO: 1017453 - RNA, 18 nt, Mycobacterium avium subsp. paratuberculosis
cguaggcggccagcagca

SEQ ID NO: 1017454 - RNA, 19 nt, Mycobacterium avium subsp. paratuberculosis
cguaggcggccagcagcac

SEQ ID NO: 1017455 - RNA, 13 nt, Mycobacterium avium subsp. paratuberculosis
cguaggggcccgg

SEQ ID NO: 1017456 - RNA, 22 nt, Mycobacterium avium subsp. paratuberculosis
cggucgccacucgggcggccgc

SEQ ID NO: 1017457 - RNA, 17 nt, Mycobacterium avium subsp. paratuberculosis
cggucgccagcaccgug

SEQ ID NO: 1017458 - RNA, 16 nt, Mycobacterium avium subsp. paratuberculosis
cggucgcccccucggc

SEQ ID NO: 1017459 - RNA, 16 nt, Mycobacterium avium subsp. paratuberculosis
cggucgccccggccgc

SEQ ID NO: 1017460 - RNA, 20 nt, Mycobacterium avium subsp. paratuberculosis
cggucgccgacucgcaggug

SEQ ID NO: 1017461 - RNA, 20 nt, Mycobacterium avium subsp. paratuberculosis
cggucgccgcgccgccggug

SEQ ID NO: 1017462 - RNA, 16 nt, Mycobacterium avium subsp. paratuberculosis
cggucgcaggccgccc

SEQ ID NO: 1017463 - RNA, 19 nt, Mycobacterium avium subsp. paratuberculosis
cggucgcaggccgcccggc

SEQ ID NO: 1017464 - RNA, 17 nt, Mycobacterium avium subsp. paratuberculosis
cggucgaccagcuccug

SEQ ID NO: 1017465 - RNA, 20 nt, Mycobacterium avium subsp. paratuberculosis
cggucgaggucggccagcag

SEQ ID NO: 1017466 - RNA, 14 nt, Mycobacterium avium subsp. paratuberculosis
cggucgaugacgcc

SEQ ID NO: 1017467 - RNA, 14 nt, Mycobacterium avium subsp. paratuberculosis
cggucggcaggaaa

SEQ ID NO: 1017468 - RNA, 14 nt, Mycobacterium avium subsp. paratuberculosis
cggucgccugcuuc

SEQ ID NO: 1017469 - RNA, 16 nt, Mycobacterium avium subsp. paratuberculosis
cggucgcgcagccgcc

SEQ ID NO: 1017470 - RNA, 21 nt, Mycobacterium avium subsp. paratuberculosis
cggucgcgcagccgggcggcg

SEQ ID NO: 1017471 - RNA, 22 nt, Mycobacterium avium subsp. paratuberculosis
cggucgcggaaccggccggggc

SEQ ID NO: 1017472 - RNA, 16 nt, Mycobacterium avium subsp. paratuberculosis
cggucgcggcgccggu

SEQ ID NO: 1017473 - RNA, 17 nt, Mycobacterium avium subsp. paratuberculosis
cggucgcggugcccagc

SEQ ID NO: 1017474 - RNA, 18 nt, Mycobacterium avium subsp. paratuberculosis
cggucgcggugcccagcc

SEQ ID NO: 1017475 - RNA, 18 nt, Mycobacterium avium subsp. paratuberculosis
cggucgcgugaccggcgg

SEQ ID NO: 1017476 - RNA, 15 nt, Mycobacterium avium subsp. paratuberculosis
cggucggcgcccggc

SEQ ID NO: 1017477 - RNA, 17 nt, Mycobacterium avium subsp. paratuberculosis
cggucggcgcccggccc

SEQ ID NO: 1017478 - RNA, 18 nt, Mycobacterium avium subsp. paratuberculosis
cggucggcccgcuccccg

SEQ ID NO: 1017479 - RNA, 19 nt, Mycobacterium avium subsp. paratuberculosis
cggucggaguccagcacgc

SEQ ID NO: 1017480 - RNA, 14 nt, Mycobacterium avium subsp. paratuberculosis
cggucggcgucgcu

SEQ ID NO: 1017481 - RNA, 20 nt, Mycobacterium avium subsp. paratuberculosis
cggucggcgucguacagcag

SEQ ID NO: 1017482 - RNA, 19 nt, Mycobacterium avium subsp. paratuberculosis
cggugacggcgucggcgau

SEQ ID NO: 1017483 - RNA, 21 nt, Mycobacterium avium subsp. paratuberculosis
cggugacguuccagccgugcu

SEQ ID NO: 1017484 - RNA, 19 nt, Mycobacterium avium subsp. paratuberculosis
cggugaccuugcgggcggu

SEQ ID NO: 1017485 - RNA, 22 nt, Mycobacterium avium subsp. paratuberculosis
cggugauggucaccgugucggc

SEQ ID NO: 1017486 - RNA, 14 nt, Mycobacterium avium subsp. paratuberculosis
cggugauguugucc

SEQ ID NO: 1017487 - RNA, 24 nt, Mycobacterium avium subsp. paratuberculosis
cggugaugcgcgccgacgaccagu

SEQ ID NO: 1017488 - RNA, 20 nt, Mycobacterium avium subsp. paratuberculosis
cggugaugacguagucgucc

SEQ ID NO: 1017489 - RNA, 15 nt, Mycobacterium avium subsp. paratuberculosis
cggugaucugcacca

SEQ ID NO: 1017490 - RNA, 17 nt, Mycobacterium avium subsp. paratuberculosis
cggugaucugcaccagc

SEQ ID NO: 1017491 - RNA, 13 nt, Mycobacterium avium subsp. paratuberculosis
cggugaccugcag

SEQ ID NO: 1017492 - RNA, 14 nt, Mycobacterium avium subsp. paratuberculosis
cggugaccgccgcc

SEQ ID NO: 1017493 - RNA, 14 nt, Mycobacterium avium subsp. paratuberculosis
cggugaccgccucg

SEQ ID NO: 1017494 - RNA, 15 nt, Mycobacterium avium subsp. paratuberculosis
cggugaccgcgccgc

SEQ ID NO: 1017495 - RNA, 20 nt, Mycobacterium avium subsp. paratuberculosis
cggugaccggaucggccagc

SEQ ID NO: 1017496 - RNA, 16 nt, Mycobacterium avium subsp. paratuberculosis
cggugaccggcgcgcc

SEQ ID NO: 1017497 - RNA, 23 nt, Mycobacterium avium subsp. paratuberculosis
cggugaccgucgccgaccagccg

SEQ ID NO: 1017498 - RNA, 22 nt, Mycobacterium avium subsp. paratuberculosis
cggucucgaccgcggcgccgau

SEQ ID NO: 1017499 - RNA, 20 nt, Mycobacterium avium subsp. paratuberculosis
cggucguuucggccggcccc

SEQ ID NO: 1017500 - RNA, 18 nt, Mycobacterium avium subsp. paratuberculosis
cggucgggugcgcucacc

SEQ ID NO: 1017501 - RNA, 22 nt, Mycobacterium avium subsp. paratuberculosis
cggucguagucggcccgccggg

SEQ ID NO: 1017502 - RNA, 15 nt, Mycobacterium avium subsp. paratuberculosis
cggucguuggccucc

SEQ ID NO: 1017503 - RNA, 19 nt, Mycobacterium avium subsp. paratuberculosis
cggucauaggccgcgcaga

SEQ ID NO: 1017504 - RNA, 15 nt, Mycobacterium avium subsp. paratuberculosis
cggucaggccggcgc

SEQ ID NO: 1017505 - RNA, 18 nt, Mycobacterium avium subsp. paratuberculosis
cggucaggcgcagccagc

SEQ ID NO: 1017506 - RNA, 17 nt, Mycobacterium avium subsp. paratuberculosis
cggucacggccgccagc

SEQ ID NO: 1017507 - RNA, 17 nt, Mycobacterium avium subsp. paratuberculosis
cggucacguagcucagc

SEQ ID NO: 1017508 - RNA, 19 nt, Mycobacterium avium subsp. paratuberculosis
cggucagcucgcgcccggc

SEQ ID NO: 1017509 - RNA, 23 nt, Mycobacterium avium subsp. paratuberculosis
cggucagcucgcgcccggccagg

SEQ ID NO: 1017510 - RNA, 13 nt, Mycobacterium avium subsp. paratuberculosis
cggucagcuggug

SEQ ID NO: 1017511 - RNA, 17 nt, Mycobacterium avium subsp. paratuberculosis
cggucacgcugaucgac

SEQ ID NO: 1017512 - RNA, 14 nt, Mycobacterium avium subsp. paratuberculosis
cggucacgcuggcg

SEQ ID NO: 1017513 - RNA, 24 nt, Mycobacterium avium subsp. paratuberculosis
cggucaccggugucacgcuggcgu

SEQ ID NO: 1017514 - RNA, 14 nt, Mycobacterium avium subsp. paratuberculosis
cggucaccagcggc

SEQ ID NO: 1017515 - RNA, 13 nt, Mycobacterium avium subsp. paratuberculosis
cggucaccccggc

SEQ ID NO: 1017516 - RNA, 15 nt, Mycobacterium avium subsp. paratuberculosis
cggucaccgagcggc

SEQ ID NO: 1017517 - RNA, 20 nt, Mycobacterium avium subsp. paratuberculosis
cggucaagccggccagcagc

SEQ ID NO: 1017518 - RNA, 22 nt, Mycobacterium avium subsp. paratuberculosis
cgggucgcgcggcuacagcaac

SEQ ID NO: 1017519 - RNA, 15 nt, Mycobacterium avium subsp. paratuberculosis
cgggucgcggugggc

SEQ ID NO: 1017520 - RNA, 18 nt, Mycobacterium avium subsp. paratuberculosis
cgggucgcaggcagcagc

SEQ ID NO: 1017521 - RNA, 20 nt, Mycobacterium avium subsp. paratuberculosis
cgggucgcaggcagcagcac

SEQ ID NO: 1017522 - RNA, 21 nt, Mycobacterium avium subsp. paratuberculosis
cgggucgcaggcagcagcacc

SEQ ID NO: 1017523 - RNA, 15 nt, Mycobacterium avium subsp. paratuberculosis
cgggucgagcgcgcc

SEQ ID NO: 1017524 - RNA, 13 nt, Mycobacterium avium subsp. paratuberculosis
cgggucgagcggc

SEQ ID NO: 1017525 - RNA, 16 nt, Mycobacterium avium subsp. paratuberculosis
cgggucgagcagcagc

SEQ ID NO: 1017526 - RNA, 18 nt, Mycobacterium avium subsp. paratuberculosis
cgggucgaucucggcgca

SEQ ID NO: 1017527 - RNA, 21 nt, Mycobacterium avium subsp. paratuberculosis
cggguccuggcccccgcccca

SEQ ID NO: 1017528 - RNA, 19 nt, Mycobacterium avium subsp. paratuberculosis
cggguccuugccggcggcg

SEQ ID NO: 1017529 - RNA, 15 nt, Mycobacterium avium subsp. paratuberculosis
cgggucgaccgccuc

SEQ ID NO: 1017530 - RNA, 20 nt, Mycobacterium avium subsp. paratuberculosis
cgggucacgugcacccacgc

SEQ ID NO: 1017531 - RNA, 15 nt, Mycobacterium avium subsp. paratuberculosis
cgguccccgcgcccg

SEQ ID NO: 1017532 - RNA, 14 nt, Mycobacterium avium subsp. paratuberculosis
cgguccgcccagac

SEQ ID NO: 1017533 - RNA, 15 nt, Mycobacterium avium subsp. paratuberculosis
cgguccgccgccggc

SEQ ID NO: 1017534 - RNA, 14 nt, Mycobacterium avium subsp. paratuberculosis
cggucccgccggug

SEQ ID NO: 1017535 - RNA, 22 nt, Mycobacterium avium subsp. paratuberculosis
cggucccgccggugaucucccg

SEQ ID NO: 1017536 - RNA, 19 nt, Mycobacterium avium subsp. paratuberculosis
cggucccggcggacccgga

SEQ ID NO: 1017537 - RNA, 19 nt, Mycobacterium avium subsp. paratuberculosis
cggucccggcgggggcggc

SEQ ID NO: 1017538 - RNA, 15 nt, Mycobacterium avium subsp. paratuberculosis
cggucccguugaucu

SEQ ID NO: 1017539 - RNA, 18 nt, Mycobacterium avium subsp. paratuberculosis
cgguccuucucgcacagc

SEQ ID NO: 1017540 - RNA, 22 nt, Mycobacterium avium subsp. paratuberculosis
cgguccuucucgcacagcacca

SEQ ID NO: 1017541 - RNA, 23 nt, Mycobacterium avium subsp. paratuberculosis
cgguccuugagguagucgcgcag

SEQ ID NO: 1017542 - RNA, 21 nt, Mycobacterium avium subsp. paratuberculosis
cgguccugggccuccggcggc

SEQ ID NO: 1017543 - RNA, 18 nt, Mycobacterium avium subsp. paratuberculosis
cgguccgcugugcggccc

SEQ ID NO: 1017544 - RNA, 21 nt, Mycobacterium avium subsp. paratuberculosis
cgguccgcugugcggcccggc

SEQ ID NO: 1017545 - RNA, 19 nt, Mycobacterium avium subsp. paratuberculosis
cgguccggcggcaccaccc

SEQ ID NO: 1017546 - RNA, 16 nt, Mycobacterium avium subsp. paratuberculosis
cgguccgaccagcggc

SEQ ID NO: 1017547 - RNA, 18 nt, Mycobacterium avium subsp. paratuberculosis
cgguccgugcacggccaa

SEQ ID NO: 1017548 - RNA, 18 nt, Mycobacterium avium subsp. paratuberculosis
cgguccuccccgcuggcg

SEQ ID NO: 1017549 - RNA, 21 nt, Mycobacterium avium subsp. paratuberculosis
cgguccaggauccgcaccggg

SEQ ID NO: 1017550 - RNA, 23 nt, Mycobacterium avium subsp. paratuberculosis
cgguccagcguuuccuggugcac

SEQ ID NO: 1017551 - RNA, 20 nt, Mycobacterium avium subsp. paratuberculosis
cgguccagguggccaugggg

SEQ ID NO: 1017552 - RNA, 13 nt, Mycobacterium avium subsp. paratuberculosis
cgguccagguggg

SEQ ID NO: 1017553 - RNA, 13 nt, Mycobacterium avium subsp. paratuberculosis
cgguccaccacca

SEQ ID NO: 1017554 - RNA, 22 nt, Mycobacterium avium subsp. paratuberculosis
cgguccaccaccacacccgcgg

SEQ ID NO: 1017555 - RNA, 22 nt, Mycobacterium avium subsp. paratuberculosis
cgguccaacgggcucagcacca

SEQ ID NO: 1017556 - RNA, 18 nt, Mycobacterium avium subsp. paratuberculosis
cgguccacuuccgcgcag

SEQ ID NO: 1017557 - RNA, 23 nt, Mycobacterium avium subsp. paratuberculosis
cggucaugccgagccgcuuggug

SEQ ID NO: 1017558 - RNA, 18 nt, Mycobacterium avium subsp. paratuberculosis
cggucauccgggccacca

SEQ ID NO: 1017559 - RNA, 15 nt, Mycobacterium avium subsp. paratuberculosis
cggugggacggcggg

SEQ ID NO: 1017560 - RNA, 16 nt, Mycobacterium avium subsp. paratuberculosis
cggugggcaccagcag

SEQ ID NO: 1017561 - RNA, 18 nt, Mycobacterium avium subsp. paratuberculosis
cggugggcccgccgucga

SEQ ID NO: 1017562 - RNA, 13 nt, Mycobacterium avium subsp. paratuberculosis
cggugggccgcac

SEQ ID NO: 1017563 - RNA, 22 nt, Mycobacterium avium subsp. paratuberculosis
cggugggccgcaccuggcagca

SEQ ID NO: 1017564 - RNA, 21 nt, Mycobacterium avium subsp. paratuberculosis
cggugggccgccgcggcggca

SEQ ID NO: 1017565 - RNA, 12 nt, Mycobacterium avium subsp. paratuberculosis
cgguggcagccc

SEQ ID NO: 1017566 - RNA, 19 nt, Mycobacterium avium subsp. paratuberculosis
cgguggccgcgaagauguc

SEQ ID NO: 1017567 - RNA, 12 nt, Mycobacterium avium subsp. paratuberculosis
cgguggccaccu

SEQ ID NO: 1017568 - RNA, 14 nt, Mycobacterium avium subsp. paratuberculosis
cgguggccagcagg

SEQ ID NO: 1017569 - RNA, 17 nt, Mycobacterium avium subsp. paratuberculosis
cgguggccagcaggguc

SEQ ID NO: 1017570 - RNA, 15 nt, Mycobacterium avium subsp. paratuberculosis
cgguggcccccacca

SEQ ID NO: 1017571 - RNA, 17 nt, Mycobacterium avium subsp. paratuberculosis
cgguggccccgggccgc

SEQ ID NO: 1017572 - RNA, 18 nt, Mycobacterium avium subsp. paratuberculosis
cgguggccccgggccgca

SEQ ID NO: 1017573 - RNA, 13 nt, Mycobacterium avium subsp. paratuberculosis
cgguggcccggua

SEQ ID NO: 1017574 - RNA, 18 nt, Mycobacterium avium subsp. paratuberculosis
cgguggcccgguacagcg

SEQ ID NO: 1017575 - RNA, 20 nt, Mycobacterium avium subsp. paratuberculosis
cgguggcaccccgcgccggg

SEQ ID NO: 1017576 - RNA, 12 nt, Mycobacterium avium subsp. paratuberculosis
cgguggccacca

SEQ ID NO: 1017577 - RNA, 15 nt, Mycobacterium avium subsp. paratuberculosis
cgguggccaccaccg

SEQ ID NO: 1017578 - RNA, 18 nt, Mycobacterium avium subsp. paratuberculosis
cggugccgagcccgccgg

SEQ ID NO: 1017579 - RNA, 21 nt, Mycobacterium avium subsp. paratuberculosis
cggugccgaguucgaccucgg

SEQ ID NO: 1017580 - RNA, 17 nt, Mycobacterium avium subsp. paratuberculosis
cgguggacgccgcgcac

SEQ ID NO: 1017581 - RNA, 20 nt, Mycobacterium avium subsp. paratuberculosis
cgguggacgccgcgcacgac

SEQ ID NO: 1017582 - RNA, 15 nt, Mycobacterium avium subsp. paratuberculosis
cgguggacuccagca

SEQ ID NO: 1017583 - RNA, 15 nt, Mycobacterium avium subsp. paratuberculosis
cgguggagcgcggca

SEQ ID NO: 1017584 - RNA, 20 nt, Mycobacterium avium subsp. paratuberculosis
cgguggauauuucgcggccg

SEQ ID NO: 1017585 - RNA, 17 nt, Mycobacterium avium subsp. paratuberculosis
cggugcccgccgcgacc

SEQ ID NO: 1017586 - RNA, 16 nt, Mycobacterium avium subsp. paratuberculosis
cggugcccggggucca

SEQ ID NO: 1017587 - RNA, 20 nt, Mycobacterium avium subsp. paratuberculosis
cggugcccgggguccaccgg

SEQ ID NO: 1017588 - RNA, 16 nt, Mycobacterium avium subsp. paratuberculosis
cggugcccagccgcag

SEQ ID NO: 1017589 - RNA, 22 nt, Mycobacterium avium subsp. paratuberculosis
cggugccgaagcgccacggggc

SEQ ID NO: 1017590 - RNA, 15 nt, Mycobacterium avium subsp. paratuberculosis
cggugccacggucag

SEQ ID NO: 1017591 - RNA, 21 nt, Mycobacterium avium subsp. paratuberculosis
cggugcaccgcggcgcgcauc

SEQ ID NO: 1017592 - RNA, 15 nt, Mycobacterium avium subsp. paratuberculosis
cggugcaccaggacg

SEQ ID NO: 1017593 - RNA, 20 nt, Mycobacterium avium subsp. paratuberculosis
cggugcaccaggacgcgacc

SEQ ID NO: 1017594 - RNA, 20 nt, Mycobacterium avium subsp. paratuberculosis
cggugcacacgccgaggcgg

SEQ ID NO: 1017595 - RNA, 17 nt, Mycobacterium avium subsp. paratuberculosis
cggugugcgggucggug

SEQ ID NO: 1017596 - RNA, 15 nt, Mycobacterium avium subsp. paratuberculosis
cggugugcagccacc

SEQ ID NO: 1017597 - RNA, 19 nt, Mycobacterium avium subsp. paratuberculosis
cggugucaccgacgccagc

SEQ ID NO: 1017598 - RNA, 18 nt, Mycobacterium avium subsp. paratuberculosis
cggugucauaccagccgu

SEQ ID NO: 1017599 - RNA, 22 nt, Mycobacterium avium subsp. paratuberculosis
cggugguccgcgcgaccaucag

SEQ ID NO: 1017600 - RNA, 14 nt, Mycobacterium avium subsp. paratuberculosis
cggugucgcccagc

SEQ ID NO: 1017601 - RNA, 16 nt, Mycobacterium avium subsp. paratuberculosis
cggugucgagaugacc

SEQ ID NO: 1017602 - RNA, 17 nt, Mycobacterium avium subsp. paratuberculosis
cggugucgagggccauc

SEQ ID NO: 1017603 - RNA, 15 nt, Mycobacterium avium subsp. paratuberculosis
cggugggcggcgccc

SEQ ID NO: 1017604 - RNA, 22 nt, Mycobacterium avium subsp. paratuberculosis
cggugggcucggccaucccggu

SEQ ID NO: 1017605 - RNA, 16 nt, Mycobacterium avium subsp. paratuberculosis
cgguggggcuggccgc

SEQ ID NO: 1017606 - RNA, 19 nt, Mycobacterium avium subsp. paratuberculosis
cgguggguccgccgggcgc

SEQ ID NO: 1017607 - RNA, 14 nt, Mycobacterium avium subsp. paratuberculosis
cgguuugcccggcg

SEQ ID NO: 1017608 - RNA, 17 nt, Mycobacterium avium subsp. paratuberculosis
cgguuugcgccggcucc

SEQ ID NO: 1017609 - RNA, 21 nt, Mycobacterium avium subsp. paratuberculosis
cgguuugcgccggcuccaccg

SEQ ID NO: 1017610 - RNA, 14 nt, Mycobacterium avium subsp. paratuberculosis
cguaaccggugaca

SEQ ID NO: 1017611 - RNA, 18 nt, Mycobacterium avium subsp. paratuberculosis
cgguuguucaugaacauc

SEQ ID NO: 1017612 - RNA, 18 nt, Mycobacterium avium subsp. paratuberculosis
cgguuucaccgugcgcgc

SEQ ID NO: 1017613 - RNA, 13 nt, Mycobacterium avium subsp. paratuberculosis
cgguuuccaggac

SEQ ID NO: 1017614 - RNA, 14 nt, Mycobacterium avium subsp. paratuberculosis
cgguugcggcagca

SEQ ID NO: 1017615 - RNA, 20 nt, Mycobacterium avium subsp. paratuberculosis
cgguugccuuuccgcgcggc

SEQ ID NO: 1017616 - RNA, 14 nt, Mycobacterium avium subsp. paratuberculosis
cgguuggcggccgg

SEQ ID NO: 1017617 - RNA, 18 nt, Mycobacterium avium subsp. paratuberculosis
cgcgcccgagucacccgg

SEQ ID NO: 1017618 - RNA, 22 nt, Mycobacterium avium subsp. paratuberculosis
cgcgcccgauggaggugccgcg

SEQ ID NO: 1017619 - RNA, 19 nt, Mycobacterium avium subsp. paratuberculosis
cgcgcccuaacgugcccgg

SEQ ID NO: 1017620 - RNA, 21 nt, Mycobacterium avium subsp. paratuberculosis
cgcgcccuaacgugcccggcc

SEQ ID NO: 1017621 - RNA, 13 nt, Mycobacterium avium subsp. paratuberculosis
cgcgcccggcggg

SEQ ID NO: 1017622 - RNA, 14 nt, Mycobacterium avium subsp. paratuberculosis
cgcgcccaggcccg

SEQ ID NO: 1017623 - RNA, 13 nt, Mycobacterium avium subsp. paratuberculosis
cgcgcccacccga

SEQ ID NO: 1017624 - RNA, 13 nt, Mycobacterium avium subsp. paratuberculosis
cgcgcccacccgc

SEQ ID NO: 1017625 - RNA, 14 nt, Mycobacterium avium subsp. paratuberculosis
cgcgcccaccugga

SEQ ID NO: 1017626 - RNA, 11 nt, Mycobacterium avium subsp. paratuberculosis
cgcgcccaggg

SEQ ID NO: 1017627 - RNA, 16 nt, Mycobacterium avium subsp. paratuberculosis
cgcgcccaggggagcg

SEQ ID NO: 1017628 - RNA, 13 nt, Mycobacterium avium subsp. paratuberculosis
cgcgccccgagca

SEQ ID NO: 1017629 - RNA, 15 nt, Mycobacterium avium subsp. paratuberculosis
cgcgccccgagcagc

SEQ ID NO: 1017630 - RNA, 13 nt, Mycobacterium avium subsp. paratuberculosis
cgcgccccgccgg

SEQ ID NO: 1017631 - RNA, 14 nt, Mycobacterium avium subsp. paratuberculosis
cgcgccccggcccg

SEQ ID NO: 1017632 - RNA, 16 nt, Mycobacterium avium subsp. paratuberculosis
cgcgccccggcccggc

SEQ ID NO: 1017633 - RNA, 15 nt, Mycobacterium avium subsp. paratuberculosis
cgcgccccggcgcgc

SEQ ID NO: 1017634 - RNA, 12 nt, Mycobacterium avium subsp. paratuberculosis
cgcgccgccagc

SEQ ID NO: 1017635 - RNA, 14 nt, Mycobacterium avium subsp. paratuberculosis
cgcgccgcccagcg

SEQ ID NO: 1017636 - RNA, 17 nt, Mycobacterium avium subsp. paratuberculosis
cgcgccgcccagcggcc

SEQ ID NO: 1017637 - RNA, 18 nt, Mycobacterium avium subsp. paratuberculosis
cgcgccgcccagcggccc

SEQ ID NO: 1017638 - RNA, 15 nt, Mycobacterium avium subsp. paratuberculosis
cgcgccgccgccagc

SEQ ID NO: 1017639 - RNA, 19 nt, Mycobacterium avium subsp. paratuberculosis
cgcgccgccgccagccagc

SEQ ID NO: 1017640 - RNA, 15 nt, Mycobacterium avium subsp. paratuberculosis
cgcgccgccgaugug

SEQ ID NO: 1017641 - RNA, 14 nt, Mycobacterium avium subsp. paratuberculosis
cgcgccgcccggag

SEQ ID NO: 1017642 - RNA, 14 nt, Mycobacterium avium subsp. paratuberculosis
cgcgccgcccggcg

SEQ ID NO: 1017643 - RNA, 13 nt, Mycobacterium avium subsp. paratuberculosis
cgcgccgcggcca

SEQ ID NO: 1017644 - RNA, 18 nt, Mycobacterium avium subsp. paratuberculosis
cgcgccgcggccagcgcc

SEQ ID NO: 1017645 - RNA, 16 nt, Mycobacterium avium subsp. paratuberculosis
cgcgccgcgccgccuu

SEQ ID NO: 1017646 - RNA, 15 nt, Mycobacterium avium subsp. paratuberculosis
cgcgccgcgccgccu

SEQ ID NO: 1017647 - RNA, 14 nt, Mycobacterium avium subsp. paratuberculosis
cgcgccgccacccc

SEQ ID NO: 1017648 - RNA, 16 nt, Mycobacterium avium subsp. paratuberculosis
cgcgccgccgcccugg

SEQ ID NO: 1017649 - RNA, 23 nt, Mycobacterium avium subsp. paratuberculosis
cgcgccgcacagccggcggcggc

SEQ ID NO: 1017650 - RNA, 13 nt, Mycobacterium avium subsp. paratuberculosis
cgcgccgcaccuc

SEQ ID NO: 1017651 - RNA, 15 nt, Mycobacterium avium subsp. paratuberculosis
cgcgccgcagcgcgc

SEQ ID NO: 1017652 - RNA, 15 nt, Mycobacterium avium subsp. paratuberculosis
cgcgccgaucacgaa

SEQ ID NO: 1017653 - RNA, 17 nt, Mycobacterium avium subsp. paratuberculosis
cgcgccgaugccgcgcu

SEQ ID NO: 1017654 - RNA, 14 nt, Mycobacterium avium subsp. paratuberculosis
cgcgccgaggcgcu

SEQ ID NO: 1017655 - RNA, 16 nt, Mycobacterium avium subsp. paratuberculosis
cgcgccgagcagcugg

SEQ ID NO: 1017656 - RNA, 23 nt, Mycobacterium avium subsp. paratuberculosis
cgcgccgagcagcugggacagcg

SEQ ID NO: 1017657 - RNA, 20 nt, Mycobacterium avium subsp. paratuberculosis
cgcgcccggaaagcgcgggc

SEQ ID NO: 1017658 - RNA, 23 nt, Mycobacterium avium subsp. paratuberculosis
cgcgcccggaaagcgcgggcagc

SEQ ID NO: 1017659 - RNA, 12 nt, Mycobacterium avium subsp. paratuberculosis
cgcgcccggcga

SEQ ID NO: 1017660 - RNA, 16 nt, Mycobacterium avium subsp. paratuberculosis
cgcgccgacagaugcg

SEQ ID NO: 1017661 - RNA, 21 nt, Mycobacterium avium subsp. paratuberculosis
cgcgccgaccacggccccagc

SEQ ID NO: 1017662 - RNA, 22 nt, Mycobacterium avium subsp. paratuberculosis
cgcgccgacccgcccgccgggc

SEQ ID NO: 1017663 - RNA, 16 nt, Mycobacterium avium subsp. paratuberculosis
cgcgccgaccgcgagc

SEQ ID NO: 1017664 - RNA, 12 nt, Mycobacterium avium subsp. paratuberculosis
cgcgccgaccuc

SEQ ID NO: 1017665 - RNA, 11 nt, Mycobacterium avium subsp. paratuberculosis
cgcgcacccgc

SEQ ID NO: 1017666 - RNA, 15 nt, Mycobacterium avium subsp. paratuberculosis
cgcgcaccgcggcgg

SEQ ID NO: 1017667 - RNA, 21 nt, Mycobacterium avium subsp. paratuberculosis
cgcgcaccgggaccagcgcgg

SEQ ID NO: 1017668 - RNA, 16 nt, Mycobacterium avium subsp. paratuberculosis
cgcgcaccuucccggc

SEQ ID NO: 1017669 - RNA, 15 nt, Mycobacterium avium subsp. paratuberculosis
cgcgcacggcgcgca

SEQ ID NO: 1017670 - RNA, 20 nt, Mycobacterium avium subsp. paratuberculosis
cgcgcacgcuggccggcagc

SEQ ID NO: 1017671 - RNA, 23 nt, Mycobacterium avium subsp. paratuberculosis
cgcgcacgccaucgccucggcca

SEQ ID NO: 1017672 - RNA, 15 nt, Mycobacterium avium subsp. paratuberculosis
cgcgcagauggugac

SEQ ID NO: 1017673 - RNA, 14 nt, Mycobacterium avium subsp. paratuberculosis
cgcgcagcaccagc

SEQ ID NO: 1017674 - RNA, 12 nt, Mycobacterium avium subsp. paratuberculosis
cgcgcagcaccg

SEQ ID NO: 1017675 - RNA, 15 nt, Mycobacterium avium subsp. paratuberculosis
cgcgcagcacggaac

SEQ ID NO: 1017676 - RNA, 15 nt, Mycobacterium avium subsp. paratuberculosis
cgcgcagaucgccag

SEQ ID NO: 1017677 - RNA, 22 nt, Mycobacterium avium subsp. paratuberculosis
cgcgcagaacaccaccgccagg

SEQ ID NO: 1017678 - RNA, 16 nt, Mycobacterium avium subsp. paratuberculosis
cgcgcaggcggcgacg

SEQ ID NO: 1017679 - RNA, 15 nt, Mycobacterium avium subsp. paratuberculosis
cgcgcaggcgcacca

SEQ ID NO: 1017680 - RNA, 17 nt, Mycobacterium avium subsp. paratuberculosis
cgcgcaggcgcgcggcc

SEQ ID NO: 1017681 - RNA, 17 nt, Mycobacterium avium subsp. paratuberculosis
cgcgcagcucgcgcagc

SEQ ID NO: 1017682 - RNA, 18 nt, Mycobacterium avium subsp. paratuberculosis
cgcgcaggaacagcgacc

SEQ ID NO: 1017683 - RNA, 21 nt, Mycobacterium avium subsp. paratuberculosis
cgcgcaggccccggcgcgcgu

SEQ ID NO: 1017684 - RNA, 15 nt, Mycobacterium avium subsp. paratuberculosis
cgcgcaggccccggg

SEQ ID NO: 1017685 - RNA, 15 nt, Mycobacterium avium subsp. paratuberculosis
cgcgcaggccgccga

SEQ ID NO: 1017686 - RNA, 17 nt, Mycobacterium avium subsp. paratuberculosis
cgcgcagcccagccagc

SEQ ID NO: 1017687 - RNA, 19 nt, Mycobacterium avium subsp. paratuberculosis
cgcgcagcccagccagcga

SEQ ID NO: 1017688 - RNA, 16 nt, Mycobacterium avium subsp. paratuberculosis
cgcgcagcccccggac

SEQ ID NO: 1017689 - RNA, 15 nt, Mycobacterium avium subsp. paratuberculosis
cgcgcagccgggcgg

SEQ ID NO: 1017690 - RNA, 20 nt, Mycobacterium avium subsp. paratuberculosis
cgcgcagcgucuugcccagc

SEQ ID NO: 1017691 - RNA, 21 nt, Mycobacterium avium subsp. paratuberculosis
cgcgcagcgucuugcccagcg

SEQ ID NO: 1017692 - RNA, 16 nt, Mycobacterium avium subsp. paratuberculosis
cgcgcagccagaccuc

SEQ ID NO: 1017693 - RNA, 15 nt, Mycobacterium avium subsp. paratuberculosis
cgcgcagccaccgcc

SEQ ID NO: 1017694 - RNA, 18 nt, Mycobacterium avium subsp. paratuberculosis
cgcgcagccaccgcccga

SEQ ID NO: 1017695 - RNA, 19 nt, Mycobacterium avium subsp. paratuberculosis
cgcgccacgacauccccgc

SEQ ID NO: 1017696 - RNA, 16 nt, Mycobacterium avium subsp. paratuberculosis
cgcgccagacguccag

SEQ ID NO: 1017697 - RNA, 20 nt, Mycobacterium avium subsp. paratuberculosis
cgcgccagacguccagcgcc

SEQ ID NO: 1017698 - RNA, 14 nt, Mycobacterium avium subsp. paratuberculosis
cgcgccagcagcgc

SEQ ID NO: 1017699 - RNA, 16 nt, Mycobacterium avium subsp. paratuberculosis
cgcgccagcagcgcgc

SEQ ID NO: 1017700 - RNA, 19 nt, Mycobacterium avium subsp. paratuberculosis
cgcgccagcagcgcgccgc

SEQ ID NO: 1017701 - RNA, 12 nt, Mycobacterium avium subsp. paratuberculosis
cgcgccagcagc

SEQ ID NO: 1017702 - RNA, 13 nt, Mycobacterium avium subsp. paratuberculosis
cgcgccagcagcg

SEQ ID NO: 1017703 - RNA, 17 nt, Mycobacterium avium subsp. paratuberculosis
cgcgcauucaccagcug

SEQ ID NO: 1017704 - RNA, 16 nt, Mycobacterium avium subsp. paratuberculosis
cgcgcaucgccucggc

SEQ ID NO: 1017705 - RNA, 14 nt, Mycobacterium avium subsp. paratuberculosis
cgcgcaucgcgggc

SEQ ID NO: 1017706 - RNA, 19 nt, Mycobacterium avium subsp. paratuberculosis
cgcgcaucaucgcccagcg

SEQ ID NO: 1017707 - RNA, 17 nt, Mycobacterium avium subsp. paratuberculosis
cgcgcaggugaugcggc

SEQ ID NO: 1017708 - RNA, 20 nt, Mycobacterium avium subsp. paratuberculosis
cgcgcagucggcgucgcggc

SEQ ID NO: 1017709 - RNA, 18 nt, Mycobacterium avium subsp. paratuberculosis
cgcgcaguugcgcggcgg

SEQ ID NO: 1017710 - RNA, 13 nt, Mycobacterium avium subsp. paratuberculosis
cgcgcaucagcac

SEQ ID NO: 1017711 - RNA, 13 nt, Mycobacterium avium subsp. paratuberculosis
cgcgcaucagcgg

SEQ ID NO: 1017712 - RNA, 14 nt, Mycobacterium avium subsp. paratuberculosis
cgcgcaucaggggc

SEQ ID NO: 1017713 - RNA, 16 nt, Mycobacterium avium subsp. paratuberculosis
cgcgcaucaucgccca

SEQ ID NO: 1017714 - RNA, 16 nt, Mycobacterium avium subsp. paratuberculosis
cgcgacaccggacugc

SEQ ID NO: 1017715 - RNA, 14 nt, Mycobacterium avium subsp. paratuberculosis
cgcgacagccgccc

SEQ ID NO: 1017716 - RNA, 21 nt, Mycobacterium avium subsp. paratuberculosis
cgcgacagccgcccggcgccc

SEQ ID NO: 1017717 - RNA, 23 nt, Mycobacterium avium subsp. paratuberculosis
cgcgacacgucgacacgccggcc

SEQ ID NO: 1017718 - RNA, 18 nt, Mycobacterium avium subsp. paratuberculosis
cgcgacacgugcaucugc

SEQ ID NO: 1017719 - RNA, 18 nt, Mycobacterium avium subsp. paratuberculosis
cgcgaccagcggcagcag

SEQ ID NO: 1017720 - RNA, 20 nt, Mycobacterium avium subsp. paratuberculosis
cgcgaccagcggcagcagca

SEQ ID NO: 1017721 - RNA, 13 nt, Mycobacterium avium subsp. paratuberculosis
cgcgaccacagcg

SEQ ID NO: 1017722 - RNA, 13 nt, Mycobacterium avium subsp. paratuberculosis
cgcgaccaucagc

SEQ ID NO: 1017723 - RNA, 15 nt, Mycobacterium avium subsp. paratuberculosis
cgcgaccaugcccgg

SEQ ID NO: 1017724 - RNA, 17 nt, Mycobacterium avium subsp. paratuberculosis
cgcgacccaggccgccg

SEQ ID NO: 1017725 - RNA, 18 nt, Mycobacterium avium subsp. paratuberculosis
cgcgacccaggccgccgc

SEQ ID NO: 1017726 - RNA, 20 nt, Mycobacterium avium subsp. paratuberculosis
cgcgacccaggccgccgcca

SEQ ID NO: 1017727 - RNA, 21 nt, Mycobacterium avium subsp. paratuberculosis
cgcgaccccggaccgcggaac

SEQ ID NO: 1017728 - RNA, 13 nt, Mycobacterium avium subsp. paratuberculosis
cgcgaccaggccc

SEQ ID NO: 1017729 - RNA, 14 nt, Mycobacterium avium subsp. paratuberculosis
cgcgaccaggccca

SEQ ID NO: 1017730 - RNA, 17 nt, Mycobacterium avium subsp. paratuberculosis
cgcgaccaggcccagcg

SEQ ID NO: 1017731 - RNA, 22 nt, Mycobacterium avium subsp. paratuberculosis
cgcgacccggccgagcgcgccg

SEQ ID NO: 1017732 - RNA, 17 nt, Mycobacterium avium subsp. paratuberculosis
cgcgacccgggccgcca

SEQ ID NO: 1017733 - RNA, 14 nt, Mycobacterium avium subsp. paratuberculosis
cgcgaccgcagcag

SEQ ID NO: 1017734 - RNA, 11 nt, Mycobacterium avium subsp. paratuberculosis
cgcgaccucgg

SEQ ID NO: 1017735 - RNA, 14 nt, Mycobacterium avium subsp. paratuberculosis
cgcgaccggcccga

SEQ ID NO: 1017736 - RNA, 16 nt, Mycobacterium avium subsp. paratuberculosis
cgcgaccgucagcagg

SEQ ID NO: 1017737 - RNA, 13 nt, Mycobacterium avium subsp. paratuberculosis
cgcgacgccgccg

SEQ ID NO: 1017738 - RNA, 23 nt, Mycobacterium avium subsp. paratuberculosis
cgcgacgccguagaucacgccgg

SEQ ID NO: 1017739 - RNA, 19 nt, Mycobacterium avium subsp. paratuberculosis
cgcgacuuucaaguccucc

SEQ ID NO: 1017740 - RNA, 20 nt, Mycobacterium avium subsp. paratuberculosis
cgcgacguccaucgggaccg

SEQ ID NO: 1017741 - RNA, 17 nt, Mycobacterium avium subsp. paratuberculosis
cgcgacggcgcccgccc

SEQ ID NO: 1017742 - RNA, 18 nt, Mycobacterium avium subsp. paratuberculosis
cgcgacggcgcccgcccc

SEQ ID NO: 1017743 - RNA, 17 nt, Mycobacterium avium subsp. paratuberculosis
cgcgacggaccagugca

SEQ ID NO: 1017744 - RNA, 20 nt, Mycobacterium avium subsp. paratuberculosis
cgcgacggaccagugcaggu

SEQ ID NO: 1017745 - RNA, 14 nt, Mycobacterium avium subsp. paratuberculosis
cgcgacggccgccg

SEQ ID NO: 1017746 - RNA, 16 nt, Mycobacterium avium subsp. paratuberculosis
cgcgacggccggggcc

SEQ ID NO: 1017747 - RNA, 20 nt, Mycobacterium avium subsp. paratuberculosis
cgcgacgcgcucggcgaccg

SEQ ID NO: 1017748 - RNA, 17 nt, Mycobacterium avium subsp. paratuberculosis
cgcgacgccgacgccca

SEQ ID NO: 1017749 - RNA, 17 nt, Mycobacterium avium subsp. paratuberculosis
cgcgacgcugagcgcca

SEQ ID NO: 1017750 - RNA, 13 nt, Mycobacterium avium subsp. paratuberculosis
cgcgagcgcagcg

SEQ ID NO: 1017751 - RNA, 13 nt, Mycobacterium avium subsp. paratuberculosis
cgcgaggucgacg

SEQ ID NO: 1017752 - RNA, 17 nt, Mycobacterium avium subsp. paratuberculosis
cgcgaggaaucgcggca

SEQ ID NO: 1017753 - RNA, 13 nt, Mycobacterium avium subsp. paratuberculosis
cgcgaggccgcca

SEQ ID NO: 1017754 - RNA, 12 nt, Mycobacterium avium subsp. paratuberculosis
cgcgagccgccc

SEQ ID NO: 1017755 - RNA, 13 nt, Mycobacterium avium subsp. paratuberculosis
cgcgagcccgcaa

SEQ ID NO: 1017756 - RNA, 16 nt, Mycobacterium avium subsp. paratuberculosis
cgcgagaucagcgcca

SEQ ID NO: 1017757 - RNA, 17 nt, Mycobacterium avium subsp. paratuberculosis
cgcgagcagggcgggca

SEQ ID NO: 1017758 - RNA, 15 nt, Mycobacterium avium subsp. paratuberculosis
cgcgagacgagccgc

SEQ ID NO: 1017759 - RNA, 15 nt, Mycobacterium avium subsp. paratuberculosis
cgcgagaagcgcgca

SEQ ID NO: 1017760 - RNA, 14 nt, Mycobacterium avium subsp. paratuberculosis
cgcgaugcccaagc

SEQ ID NO: 1017761 - RNA, 17 nt, Mycobacterium avium subsp. paratuberculosis
cgcgaugcccgccggcc

SEQ ID NO: 1017762 - RNA, 17 nt, Mycobacterium avium subsp. paratuberculosis
cgcgaugaucacaccca

SEQ ID NO: 1017763 - RNA, 21 nt, Mycobacterium avium subsp. paratuberculosis
cgcgaugaucagcucgcgcau

SEQ ID NO: 1017764 - RNA, 17 nt, Mycobacterium avium subsp. paratuberculosis
cgcgaugaugagcaagu

SEQ ID NO: 1017765 - RNA, 22 nt, Mycobacterium avium subsp. paratuberculosis
cgcgaucgacagcuccaacagc

SEQ ID NO: 1017766 - RNA, 15 nt, Mycobacterium avium subsp. paratuberculosis
cgcgauccgggcgcc

SEQ ID NO: 1017767 - RNA, 15 nt, Mycobacterium avium subsp. paratuberculosis
cgcgauccggggggc

SEQ ID NO: 1017768 - RNA, 15 nt, Mycobacterium avium subsp. paratuberculosis
cgcgaucgccagcgc

SEQ ID NO: 1017769 - RNA, 18 nt, Mycobacterium avium subsp. paratuberculosis
cgcgaucggccgcugccc

SEQ ID NO: 1017770 - RNA, 15 nt, Mycobacterium avium subsp. paratuberculosis
cgcgaucggcgagcc

SEQ ID NO: 1017771 - RNA, 14 nt, Mycobacterium avium subsp. paratuberculosis
cgcgaucggcgcca

SEQ ID NO: 1017772 - RNA, 20 nt, Mycobacterium avium subsp. paratuberculosis
cgcgaucggcgccacgacca

SEQ ID NO: 1017773 - RNA, 22 nt, Mycobacterium avium subsp. paratuberculosis
cgcgaucggauggugcccaccg

SEQ ID NO: 1017774 - RNA, 17 nt, Mycobacterium avium subsp. paratuberculosis
cgcgaucacaccaccac

SEQ ID NO: 1017775 - RNA, 20 nt, Mycobacterium avium subsp. paratuberculosis
cgcgaucagccccagggugc

SEQ ID NO: 1017776 - RNA, 23 nt, Mycobacterium avium subsp. paratuberculosis
cgcgaucaggccggccaccaggu

SEQ ID NO: 1017777 - RNA, 20 nt, Mycobacterium avium subsp. paratuberculosis
cgcgaucagggcccacagca

SEQ ID NO: 1017778 - RNA, 23 nt, Mycobacterium avium subsp. paratuberculosis
cgcgaucagggccgcggccgccg

SEQ ID NO: 1017779 - RNA, 18 nt, Mycobacterium avium subsp. paratuberculosis
cgcgaguaggcgaagagc

SEQ ID NO: 1017780 - RNA, 17 nt, Mycobacterium avium subsp. paratuberculosis
cgcgauggacagcagcc

SEQ ID NO: 1017781 - RNA, 17 nt, Mycobacterium avium subsp. paratuberculosis
cgcgauggcggcgcgcu

SEQ ID NO: 1017782 - RNA, 23 nt, Mycobacterium avium subsp. paratuberculosis
cgcgcaccauccgcgacgccagc

SEQ ID NO: 1017783 - RNA, 17 nt, Mycobacterium avium subsp. paratuberculosis
cgcgcaccgccaccgcc

SEQ ID NO: 1017784 - RNA, 18 nt, Mycobacterium avium subsp. paratuberculosis
cgcgcaccgccccgcccu

SEQ ID NO: 1017785 - RNA, 20 nt, Mycobacterium avium subsp. paratuberculosis
cgcgcacccccuucuccacg

SEQ ID NO: 1017786 - RNA, 15 nt, Mycobacterium avium subsp. paratuberculosis
cgcgcaccccggcau

SEQ ID NO: 1017787 - RNA, 23 nt, Mycobacterium avium subsp. paratuberculosis
cgcgcaccagggccgcgagcgcu

SEQ ID NO: 1017788 - RNA, 14 nt, Mycobacterium avium subsp. paratuberculosis
cgcgcaccaggccg

SEQ ID NO: 1017789 - RNA, 21 nt, Mycobacterium avium subsp. paratuberculosis
cgcgcaccagcucgaggccgc

SEQ ID NO: 1017790 - RNA, 19 nt, Mycobacterium avium subsp. paratuberculosis
cgcgcaauacccgaccagc

SEQ ID NO: 1017791 - RNA, 21 nt, Mycobacterium avium subsp. paratuberculosis
cgcgcaauacccgaccagcac

SEQ ID NO: 1017792 - RNA, 18 nt, Mycobacterium avium subsp. paratuberculosis
cgcgcaauccugcccggu

SEQ ID NO: 1017793 - RNA, 20 nt, Mycobacterium avium subsp. paratuberculosis
cgcgcaacucguccaccagc

SEQ ID NO: 1017794 - RNA, 21 nt, Mycobacterium avium subsp. paratuberculosis
cgcgcaacgauucacccagcg

SEQ ID NO: 1017795 - RNA, 16 nt, Mycobacterium avium subsp. paratuberculosis
cgcgcaaccgggccgc

SEQ ID NO: 1017796 - RNA, 22 nt, Mycobacterium avium subsp. paratuberculosis
cgccucagcagcugcuggcgug

SEQ ID NO: 1017797 - RNA, 18 nt, Mycobacterium avium subsp. paratuberculosis
cgccucacgcagggccaa

SEQ ID NO: 1017798 - RNA, 22 nt, Mycobacterium avium subsp. paratuberculosis
cgccucacgcagggccaagaca

SEQ ID NO: 1017799 - RNA, 23 nt, Mycobacterium avium subsp. paratuberculosis
cgccuaccggguggccagcacca

SEQ ID NO: 1017800 - RNA, 18 nt, Mycobacterium avium subsp. paratuberculosis
cgccguugcggcccacgg

SEQ ID NO: 1017801 - RNA, 17 nt, Mycobacterium avium subsp. paratuberculosis
cgccguuguaguagacc

SEQ ID NO: 1017802 - RNA, 16 nt, Mycobacterium avium subsp. paratuberculosis
cgccguucucgcgcag

SEQ ID NO: 1017803 - RNA, 21 nt, Mycobacterium avium subsp. paratuberculosis
cgccguucucgcgcaggucac

SEQ ID NO: 1017804 - RNA, 22 nt, Mycobacterium avium subsp. paratuberculosis
cgccguugauugcgcccgccga

SEQ ID NO: 1017805 - RNA, 14 nt, Mycobacterium avium subsp. paratuberculosis
cgccgucgcgccag

SEQ ID NO: 1017806 - RNA, 17 nt, Mycobacterium avium subsp. paratuberculosis
cgccgucggccagcagc

SEQ ID NO: 1017807 - RNA, 17 nt, Mycobacterium avium subsp. paratuberculosis
cgccgucgauggcgcgg

SEQ ID NO: 1017808 - RNA, 20 nt, Mycobacterium avium subsp. paratuberculosis
cgccgucgauggcgcggccc

SEQ ID NO: 1017809 - RNA, 20 nt, Mycobacterium avium subsp. paratuberculosis
cgccgucgccaccaccgcgc

SEQ ID NO: 1017810 - RNA, 15 nt, Mycobacterium avium subsp. paratuberculosis
cgccgucgccaccga

SEQ ID NO: 1017811 - RNA, 16 nt, Mycobacterium avium subsp. paratuberculosis
cgccgucgaugacgcg

SEQ ID NO: 1017812 - RNA, 18 nt, Mycobacterium avium subsp. paratuberculosis
cgccgucgacccguuccc

SEQ ID NO: 1017813 - RNA, 20 nt, Mycobacterium avium subsp. paratuberculosis
cgccguccuuggccgccagc

SEQ ID NO: 1017814 - RNA, 21 nt, Mycobacterium avium subsp. paratuberculosis
cgccguccuuggccgccagca

SEQ ID NO: 1017815 - RNA, 18 nt, Mycobacterium avium subsp. paratuberculosis
cgccgucguagccgcggg

SEQ ID NO: 1017816 - RNA, 16 nt, Mycobacterium avium subsp. paratuberculosis
cgccgucgucagccgg

SEQ ID NO: 1017817 - RNA, 19 nt, Mycobacterium avium subsp. paratuberculosis
cgccgucggggucgcgccg

SEQ ID NO: 1017818 - RNA, 12 nt, Mycobacterium avium subsp. paratuberculosis
cgccgucggggc

SEQ ID NO: 1017819 - RNA, 20 nt, Mycobacterium avium subsp. paratuberculosis
cgccgugagauccagcagcc

SEQ ID NO: 1017820 - RNA, 13 nt, Mycobacterium avium subsp. paratuberculosis
cgccgucucagga

SEQ ID NO: 1017821 - RNA, 18 nt, Mycobacterium avium subsp. paratuberculosis
cgccgucugguccaccgg

SEQ ID NO: 1017822 - RNA, 14 nt, Mycobacterium avium subsp. paratuberculosis
cgccguggucaacg

SEQ ID NO: 1017823 - RNA, 14 nt, Mycobacterium avium subsp. paratuberculosis
cgccguggcggccc

SEQ ID NO: 1017824 - RNA, 18 nt, Mycobacterium avium subsp. paratuberculosis
cgccguggcggcccgacc

SEQ ID NO: 1017825 - RNA, 15 nt, Mycobacterium avium subsp. paratuberculosis
cgccguggcggcggg

SEQ ID NO: 1017826 - RNA, 21 nt, Mycobacterium avium subsp. paratuberculosis
cgccguggcguuacacccgcg

SEQ ID NO: 1017827 - RNA, 22 nt, Mycobacterium avium subsp. paratuberculosis
cgccguggcguuacacccgcgg

SEQ ID NO: 1017828 - RNA, 15 nt, Mycobacterium avium subsp. paratuberculosis
cgccguguuccaggu

SEQ ID NO: 1017829 - RNA, 12 nt, Mycobacterium avium subsp. paratuberculosis
cgccgugcugcc

SEQ ID NO: 1017830 - RNA, 19 nt, Mycobacterium avium subsp. paratuberculosis
cgccguggaagauguugcc

SEQ ID NO: 1017831 - RNA, 13 nt, Mycobacterium avium subsp. paratuberculosis
cgccguggcaggg

SEQ ID NO: 1017832 - RNA, 16 nt, Mycobacterium avium subsp. paratuberculosis
cgccguggcagggcca

SEQ ID NO: 1017833 - RNA, 23 nt, Mycobacterium avium subsp. paratuberculosis
cgccguggcagggccagcagccc

SEQ ID NO: 1017834 - RNA, 15 nt, Mycobacterium avium subsp. paratuberculosis
cgccguggcccgccc

SEQ ID NO: 1017835 - RNA, 18 nt, Mycobacterium avium subsp. paratuberculosis
cgccgugccgcgcggcga

SEQ ID NO: 1017836 - RNA, 14 nt, Mycobacterium avium subsp. paratuberculosis
cgccgugccggacc

SEQ ID NO: 1017837 - RNA, 18 nt, Mycobacterium avium subsp. paratuberculosis
cgccgugccggaccgcgc

SEQ ID NO: 1017838 - RNA, 12 nt, Mycobacterium avium subsp. paratuberculosis
cgccgugcagca

SEQ ID NO: 1017839 - RNA, 15 nt, Mycobacterium avium subsp. paratuberculosis
cgccgugcagcaccu

SEQ ID NO: 1017840 - RNA, 14 nt, Mycobacterium avium subsp. paratuberculosis
cgccugagcccgcc

SEQ ID NO: 1017841 - RNA, 21 nt, Mycobacterium avium subsp. paratuberculosis
cgccucguugagcacaaagcc

SEQ ID NO: 1017842 - RNA, 17 nt, Mycobacterium avium subsp. paratuberculosis
cgccucguuggccagcu

SEQ ID NO: 1017843 - RNA, 20 nt, Mycobacterium avium subsp. paratuberculosis
cgccucgucgaccgcggccu

SEQ ID NO: 1017844 - RNA, 15 nt, Mycobacterium avium subsp. paratuberculosis
cgccucgucgagcag

SEQ ID NO: 1017845 - RNA, 24 nt, Mycobacterium avium subsp. paratuberculosis
cgccucgguggucgacgagcccgc

SEQ ID NO: 1017846 - RNA, 17 nt, Mycobacterium avium subsp. paratuberculosis
cgccucgggccggcagc

SEQ ID NO: 1017847 - RNA, 22 nt, Mycobacterium avium subsp. paratuberculosis
cgccucgggccggcagccggcc

SEQ ID NO: 1017848 - RNA, 23 nt, Mycobacterium avium subsp. paratuberculosis
cgccucgggccggcagccggcca

SEQ ID NO: 1017849 - RNA, 18 nt, Mycobacterium avium subsp. paratuberculosis
cgccucggggaucgccag

SEQ ID NO: 1017850 - RNA, 16 nt, Mycobacterium avium subsp. paratuberculosis
cgccucggcggccccu

SEQ ID NO: 1017851 - RNA, 18 nt, Mycobacterium avium subsp. paratuberculosis
cgccucggcggccgcccg

SEQ ID NO: 1017852 - RNA, 19 nt, Mycobacterium avium subsp. paratuberculosis
cgccucggcggccgcccgg

SEQ ID NO: 1017853 - RNA, 16 nt, Mycobacterium avium subsp. paratuberculosis
cgccucggcgggccgc

SEQ ID NO: 1017854 - RNA, 18 nt, Mycobacterium avium subsp. paratuberculosis
cgccucggcgggccgccc

SEQ ID NO: 1017855 - RNA, 20 nt, Mycobacterium avium subsp. paratuberculosis
cgccucggcgggccgcccgg

SEQ ID NO: 1017856 - RNA, 20 nt, Mycobacterium avium subsp. paratuberculosis
cgccucggaggccaccgcgc

SEQ ID NO: 1017857 - RNA, 22 nt, Mycobacterium avium subsp. paratuberculosis
cgccucggaggccaccgcgccg

SEQ ID NO: 1017858 - RNA, 24 nt, Mycobacterium avium subsp. paratuberculosis
cgccucggaggccaccgcgccguc

SEQ ID NO: 1017859 - RNA, 23 nt, Mycobacterium avium subsp. paratuberculosis
cgccucggaucccggggcgcgcu

SEQ ID NO: 1017860 - RNA, 17 nt, Mycobacterium avium subsp. paratuberculosis
cgccucggccgcggucu

SEQ ID NO: 1017861 - RNA, 20 nt, Mycobacterium avium subsp. paratuberculosis
cgccucggcgaucggccgcu

SEQ ID NO: 1017862 - RNA, 13 nt, Mycobacterium avium subsp. paratuberculosis
cgccucggcgccu

SEQ ID NO: 1017863 - RNA, 16 nt, Mycobacterium avium subsp. paratuberculosis
cgccucccccacccgc

SEQ ID NO: 1017864 - RNA, 21 nt, Mycobacterium avium subsp. paratuberculosis
cgccucccccacccgcacggu

SEQ ID NO: 1017865 - RNA, 14 nt, Mycobacterium avium subsp. paratuberculosis
cgccucaccccagc

SEQ ID NO: 1017866 - RNA, 18 nt, Mycobacterium avium subsp. paratuberculosis
cgccucaggcgagcaccc

SEQ ID NO: 1017867 - RNA, 21 nt, Mycobacterium avium subsp. paratuberculosis
cgccucaggcgagcacccgga

SEQ ID NO: 1017868 - RNA, 23 nt, Mycobacterium avium subsp. paratuberculosis
cgccuccacauacgcggcggccu

SEQ ID NO: 1017869 - RNA, 19 nt, Mycobacterium avium subsp. paratuberculosis
cgccuccgguuugcgccgg

SEQ ID NO: 1017870 - RNA, 20 nt, Mycobacterium avium subsp. paratuberculosis
cgccuccgguuugcgccggc

SEQ ID NO: 1017871 - RNA, 24 nt, Mycobacterium avium subsp. paratuberculosis
cgccuccgaauccagcgcgccgcu

SEQ ID NO: 1017872 - RNA, 22 nt, Mycobacterium avium subsp. paratuberculosis
cgccuccgucagcgccgcccgc

SEQ ID NO: 1017873 - RNA, 14 nt, Mycobacterium avium subsp. paratuberculosis
cgccuccgccgccc

SEQ ID NO: 1017874 - RNA, 15 nt, Mycobacterium avium subsp. paratuberculosis
cgccuccgccgcccc

SEQ ID NO: 1017875 - RNA, 19 nt, Mycobacterium avium subsp. paratuberculosis
cgccuccauucgggccagc

SEQ ID NO: 1017876 - RNA, 23 nt, Mycobacterium avium subsp. paratuberculosis
cgccucccgcagcgccagcgcgc

SEQ ID NO: 1017877 - RNA, 22 nt, Mycobacterium avium subsp. paratuberculosis
cgccuccgacagccgcaccggc

SEQ ID NO: 1017878 - RNA, 14 nt, Mycobacterium avium subsp. paratuberculosis
cgccuccgaccagc

SEQ ID NO: 1017879 - RNA, 14 nt, Mycobacterium avium subsp. paratuberculosis
cgccuccgagaugg

SEQ ID NO: 1017880 - RNA, 19 nt, Mycobacterium avium subsp. paratuberculosis
cgccucgcgcagcgcgucg

SEQ ID NO: 1017881 - RNA, 17 nt, Mycobacterium avium subsp. paratuberculosis
cgccucgccggucaccu

SEQ ID NO: 1017882 - RNA, 23 nt, Mycobacterium avium subsp. paratuberculosis
cgccucgaucagagcgggccgac

SEQ ID NO: 1017883 - RNA, 23 nt, Mycobacterium avium subsp. paratuberculosis
cgccucgaucugguucaccgcca

SEQ ID NO: 1017884 - RNA, 19 nt, Mycobacterium avium subsp. paratuberculosis
cgccucgagcaacggccgc

SEQ ID NO: 1017885 - RNA, 22 nt, Mycobacterium avium subsp. paratuberculosis
cgccucgagcaacggccgcagc

SEQ ID NO: 1017886 - RNA, 22 nt, Mycobacterium avium subsp. paratuberculosis
cgccucgagcaccacggcccgc

SEQ ID NO: 1017887 - RNA, 16 nt, Mycobacterium avium subsp. paratuberculosis
cgccucgaccagcacc

SEQ ID NO: 1017888 - RNA, 13 nt, Mycobacterium avium subsp. paratuberculosis
cgccucgaccagg

SEQ ID NO: 1017889 - RNA, 18 nt, Mycobacterium avium subsp. paratuberculosis
cgccucgaagucgccggc

SEQ ID NO: 1017890 - RNA, 23 nt, Mycobacterium avium subsp. paratuberculosis
cgccucgaagucgccggccucca

SEQ ID NO: 1017891 - RNA, 13 nt, Mycobacterium avium subsp. paratuberculosis
cgccugcgccgcc

SEQ ID NO: 1017892 - RNA, 14 nt, Mycobacterium avium subsp. paratuberculosis
cgccugcgccgccg

SEQ ID NO: 1017893 - RNA, 14 nt, Mycobacterium avium subsp. paratuberculosis
cgccugcgcggcgg

SEQ ID NO: 1017894 - RNA, 14 nt, Mycobacterium avium subsp. paratuberculosis
cgccugcuucugga

SEQ ID NO: 1017895 - RNA, 15 nt, Mycobacterium avium subsp. paratuberculosis
cgccugcuucuggau

SEQ ID NO: 1017896 - RNA, 18 nt, Mycobacterium avium subsp. paratuberculosis
cgccugggucucgggauc

SEQ ID NO: 1017897 - RNA, 23 nt, Mycobacterium avium subsp. paratuberculosis
cgccugggcguacagcggcgcca

SEQ ID NO: 1017898 - RNA, 15 nt, Mycobacterium avium subsp. paratuberculosis
cgccuggcgcagggc

SEQ ID NO: 1017899 - RNA, 24 nt, Mycobacterium avium subsp. paratuberculosis
cgccuggcggaaggccgcgcgggc

SEQ ID NO: 1017900 - RNA, 19 nt, Mycobacterium avium subsp. paratuberculosis
cgccuucacgaccggcagc

SEQ ID NO: 1017901 - RNA, 18 nt, Mycobacterium avium subsp. paratuberculosis
cgcgaagguggcacgcca

SEQ ID NO: 1017902 - RNA, 16 nt, Mycobacterium avium subsp. paratuberculosis
cgcgaagucgccgccc

SEQ ID NO: 1017903 - RNA, 19 nt, Mycobacterium avium subsp. paratuberculosis
cgcgaacuucaggcccuca

SEQ ID NO: 1017904 - RNA, 19 nt, Mycobacterium avium subsp. paratuberculosis
cgcgaagcccucgaagcag

SEQ ID NO: 1017905 - RNA, 19 nt, Mycobacterium avium subsp. paratuberculosis
cgcgaacucgucgacgccc

SEQ ID NO: 1017906 - RNA, 18 nt, Mycobacterium avium subsp. paratuberculosis
cgcgaagaacgacgccac

SEQ ID NO: 1017907 - RNA, 20 nt, Mycobacterium avium subsp. paratuberculosis
cgcgaagaacgacgccaccg

SEQ ID NO: 1017908 - RNA, 19 nt, Mycobacterium avium subsp. paratuberculosis
cgcgaacgacgaccucccc

SEQ ID NO: 1017909 - RNA, 16 nt, Mycobacterium avium subsp. paratuberculosis
cgcgaaagcagcaacg

SEQ ID NO: 1017910 - RNA, 14 nt, Mycobacterium avium subsp. paratuberculosis
cgcgaacagcgccg

SEQ ID NO: 1017911 - RNA, 16 nt, Mycobacterium avium subsp. paratuberculosis
cgcgaacagcgcggcc

SEQ ID NO: 1017912 - RNA, 20 nt, Mycobacterium avium subsp. paratuberculosis
cgcgaacagcgcggccacca

SEQ ID NO: 1017913 - RNA, 22 nt, Mycobacterium avium subsp. paratuberculosis
cgcgaacagguccuugcccagc

SEQ ID NO: 1017914 - RNA, 15 nt, Mycobacterium avium subsp. paratuberculosis
cgcgaaaaccagcac

SEQ ID NO: 1017915 - RNA, 17 nt, Mycobacterium avium subsp. paratuberculosis
cgcgaaaaccagcaccg

SEQ ID NO: 1017916 - RNA, 15 nt, Mycobacterium avium subsp. paratuberculosis
cgcgaaacccccggg

SEQ ID NO: 1017917 - RNA, 16 nt, Mycobacterium avium subsp. paratuberculosis
cgccuucggcgccagc

SEQ ID NO: 1017918 - RNA, 18 nt, Mycobacterium avium subsp. paratuberculosis
cgccuucggcgccagccc

SEQ ID NO: 1017919 - RNA, 20 nt, Mycobacterium avium subsp. paratuberculosis
cgccuucggcgccagcccgc

SEQ ID NO: 1017920 - RNA, 18 nt, Mycobacterium avium subsp. paratuberculosis
cgccuucuugcgcggcgc

SEQ ID NO: 1017921 - RNA, 20 nt, Mycobacterium avium subsp. paratuberculosis
cgccuucuugcugcccgcgg

SEQ ID NO: 1017922 - RNA, 23 nt, Mycobacterium avium subsp. paratuberculosis
cgccuucuugcugcccgcggccg

SEQ ID NO: 1017923 - RNA, 13 nt, Mycobacterium avium subsp. paratuberculosis
cgccuucgacggc

SEQ ID NO: 1017924 - RNA, 18 nt, Mycobacterium avium subsp. paratuberculosis
cgccuucgacggccggcc

SEQ ID NO: 1017925 - RNA, 17 nt, Mycobacterium avium subsp. paratuberculosis
cgccuuuugcacccgcc

SEQ ID NO: 1017926 - RNA, 15 nt, Mycobacterium avium subsp. paratuberculosis
cgccuugggccaucc

SEQ ID NO: 1017927 - RNA, 22 nt, Mycobacterium avium subsp. paratuberculosis
cgccuugaucuuggccugggcc

SEQ ID NO: 1017928 - RNA, 17 nt, Mycobacterium avium subsp. paratuberculosis
cgccuugcacacggccu

SEQ ID NO: 1017929 - RNA, 22 nt, Mycobacterium avium subsp. paratuberculosis
cgccguacagcugguccggccg

SEQ ID NO: 1017930 - RNA, 16 nt, Mycobacterium avium subsp. paratuberculosis
cgccgguuuccaggac

SEQ ID NO: 1017931 - RNA, 15 nt, Mycobacterium avium subsp. paratuberculosis
cgccggugugcagcc

SEQ ID NO: 1017932 - RNA, 20 nt, Mycobacterium avium subsp. paratuberculosis
cgccggugugcagccacccg

SEQ ID NO: 1017933 - RNA, 19 nt, Mycobacterium avium subsp. paratuberculosis
cgccgguugaucacccggg

SEQ ID NO: 1017934 - RNA, 15 nt, Mycobacterium avium subsp. paratuberculosis
cgccgguggccgccg

SEQ ID NO: 1017935 - RNA, 17 nt, Mycobacterium avium subsp. paratuberculosis
cgccgguggcggcgaca

SEQ ID NO: 1017936 - RNA, 13 nt, Mycobacterium avium subsp. paratuberculosis
cgccggugcgggc

SEQ ID NO: 1017937 - RNA, 19 nt, Mycobacterium avium subsp. paratuberculosis
cgccggugcgggcuggagu

SEQ ID NO: 1017938 - RNA, 22 nt, Mycobacterium avium subsp. paratuberculosis
cgccgguggacaggugcaucca

SEQ ID NO: 1017939 - RNA, 16 nt, Mycobacterium avium subsp. paratuberculosis
cgccggugcggccgcg

SEQ ID NO: 1017940 - RNA, 23 nt, Mycobacterium avium subsp. paratuberculosis
cgccggugccguugaucagggcg

SEQ ID NO: 1017941 - RNA, 13 nt, Mycobacterium avium subsp. paratuberculosis
cgccggugcgcag

SEQ ID NO: 1017942 - RNA, 21 nt, Mycobacterium avium subsp. paratuberculosis
cgccgucaucaccgccgaggg

SEQ ID NO: 1017943 - RNA, 21 nt, Mycobacterium avium subsp. paratuberculosis
cgccgucacugcacgcacggc

SEQ ID NO: 1017944 - RNA, 13 nt, Mycobacterium avium subsp. paratuberculosis
cgccguccggggc

SEQ ID NO: 1017945 - RNA, 15 nt, Mycobacterium avium subsp. paratuberculosis
cgccguccggggccg

SEQ ID NO: 1017946 - RNA, 18 nt, Mycobacterium avium subsp. paratuberculosis
cgccguccccgcgcggcu

SEQ ID NO: 1017947 - RNA, 16 nt, Mycobacterium avium subsp. paratuberculosis
cgccgucccggacgcu

SEQ ID NO: 1017948 - RNA, 19 nt, Mycobacterium avium subsp. paratuberculosis
cgccgucccguccgacggc

SEQ ID NO: 1017949 - RNA, 19 nt, Mycobacterium avium subsp. paratuberculosis
cgccguagcgccggcaaca

SEQ ID NO: 1017950 - RNA, 18 nt, Mycobacterium avium subsp. paratuberculosis
cgccguacgcgccggcca

SEQ ID NO: 1017951 - RNA, 14 nt, Mycobacterium avium subsp. paratuberculosis
cgccguaggccgcg

SEQ ID NO: 1017952 - RNA, 16 nt, Mycobacterium avium subsp. paratuberculosis
cgccgucaccgccagg

SEQ ID NO: 1017953 - RNA, 20 nt, Mycobacterium avium subsp. paratuberculosis
cgccgucaccggcugcccga

SEQ ID NO: 1017954 - RNA, 19 nt, Mycobacterium avium subsp. paratuberculosis
cgccggucccgcggcggcg

SEQ ID NO: 1017955 - RNA, 18 nt, Mycobacterium avium subsp. paratuberculosis
cgccggugaaaccggcgc

SEQ ID NO: 1017956 - RNA, 20 nt, Mycobacterium avium subsp. paratuberculosis
cgccggugaaaccggcgccg

SEQ ID NO: 1017957 - RNA, 18 nt, Mycobacterium avium subsp. paratuberculosis
cgccggucagcggcaaca

SEQ ID NO: 1017958 - RNA, 15 nt, Mycobacterium avium subsp. paratuberculosis
cgccggugaccgcgc

SEQ ID NO: 1017959 - RNA, 17 nt, Mycobacterium avium subsp. paratuberculosis
cgccggugaccugcagc

SEQ ID NO: 1017960 - RNA, 22 nt, Mycobacterium avium subsp. paratuberculosis
cgccggugaccugcagcgccuu

SEQ ID NO: 1017961 - RNA, 15 nt, Mycobacterium avium subsp. paratuberculosis
cgccggucguggggc

SEQ ID NO: 1017962 - RNA, 19 nt, Mycobacterium avium subsp. paratuberculosis
cgccggugaucucccgugc

SEQ ID NO: 1017963 - RNA, 16 nt, Mycobacterium avium subsp. paratuberculosis
cgccggugccagcaac

SEQ ID NO: 1017964 - RNA, 21 nt, Mycobacterium avium subsp. paratuberculosis
cgccggugccgcagccguccc

SEQ ID NO: 1017965 - RNA, 15 nt, Mycobacterium avium subsp. paratuberculosis
cgccgguaaugggcg

SEQ ID NO: 1017966 - RNA, 15 nt, Mycobacterium avium subsp. paratuberculosis
cgccgguaccgccgg

SEQ ID NO: 1017967 - RNA, 16 nt, Mycobacterium avium subsp. paratuberculosis
cgccgguaccgccggc

SEQ ID NO: 1017968 - RNA, 22 nt, Mycobacterium avium subsp. paratuberculosis
cgccgguaggcggccagcgccc

SEQ ID NO: 1017969 - RNA, 18 nt, Mycobacterium avium subsp. paratuberculosis
cgccgguaucgagcacca

SEQ ID NO: 1017970 - RNA, 17 nt, Mycobacterium avium subsp. paratuberculosis
cgccgggucgacgccga

SEQ ID NO: 1017971 - RNA, 15 nt, Mycobacterium avium subsp. paratuberculosis
cgccggggucgcgcg

SEQ ID NO: 1017972 - RNA, 17 nt, Mycobacterium avium subsp. paratuberculosis
cgccggggucgcgcgcg

SEQ ID NO: 1017973 - RNA, 22 nt, Mycobacterium avium subsp. paratuberculosis
cgccggggcucauacggcggcu

SEQ ID NO: 1017974 - RNA, 21 nt, Mycobacterium avium subsp. paratuberculosis
cgccggggcggauccccgcgc

SEQ ID NO: 1017975 - RNA, 20 nt, Mycobacterium avium subsp. paratuberculosis
cgccggggcgggcggcggcu

SEQ ID NO: 1017976 - RNA, 16 nt, Mycobacterium avium subsp. paratuberculosis
cgccggggcgggcagc

SEQ ID NO: 1017977 - RNA, 20 nt, Mycobacterium avium subsp. paratuberculosis
cgccggggacccgcaccgga

SEQ ID NO: 1017978 - RNA, 13 nt, Mycobacterium avium subsp. paratuberculosis
cgccggggcccuc

SEQ ID NO: 1017979 - RNA, 21 nt, Mycobacterium avium subsp. paratuberculosis
cgccggggcccucgcucaacc

SEQ ID NO: 1017980 - RNA, 13 nt, Mycobacterium avium subsp. paratuberculosis
cgccgggcugacc

SEQ ID NO: 1017981 - RNA, 16 nt, Mycobacterium avium subsp. paratuberculosis
cgccgggcgggccgca

SEQ ID NO: 1017982 - RNA, 14 nt, Mycobacterium avium subsp. paratuberculosis
cgccgggcgggcgc

SEQ ID NO: 1017983 - RNA, 15 nt, Mycobacterium avium subsp. paratuberculosis
cgccgggcgggcgca

SEQ ID NO: 1017984 - RNA, 17 nt, Mycobacterium avium subsp. paratuberculosis
cgccgggcgucacucug

SEQ ID NO: 1017985 - RNA, 17 nt, Mycobacterium avium subsp. paratuberculosis
cgccgggcgcccgagcc

SEQ ID NO: 1017986 - RNA, 19 nt, Mycobacterium avium subsp. paratuberculosis
cgccgggcgcccgagccgc

SEQ ID NO: 1017987 - RNA, 16 nt, Mycobacterium avium subsp. paratuberculosis
cgccgggcggcagcac

SEQ ID NO: 1017988 - RNA, 13 nt, Mycobacterium avium subsp. paratuberculosis
cgccgggcggccc

SEQ ID NO: 1017989 - RNA, 15 nt, Mycobacterium avium subsp. paratuberculosis
cgccgggccggccgg

SEQ ID NO: 1017990 - RNA, 23 nt, Mycobacterium avium subsp. paratuberculosis
cgccgggccaggugugcccgccc

SEQ ID NO: 1017991 - RNA, 15 nt, Mycobacterium avium subsp. paratuberculosis
cgccgggcagcccgg

SEQ ID NO: 1017992 - RNA, 17 nt, Mycobacterium avium subsp. paratuberculosis
cgccgggcauccgcccg

SEQ ID NO: 1017993 - RNA, 13 nt, Mycobacterium avium subsp. paratuberculosis
cgccgggcacccg

SEQ ID NO: 1017994 - RNA, 18 nt, Mycobacterium avium subsp. paratuberculosis
cgccgggcagcccgccgc

SEQ ID NO: 1017995 - RNA, 15 nt, Mycobacterium avium subsp. paratuberculosis
cgccgggaucggcag

SEQ ID NO: 1017996 - RNA, 16 nt, Mycobacterium avium subsp. paratuberculosis
cgccgggaucggcggg

SEQ ID NO: 1017997 - RNA, 23 nt, Mycobacterium avium subsp. paratuberculosis
cgccggcuuucgaagagccggcg

SEQ ID NO: 1017998 - RNA, 19 nt, Mycobacterium avium subsp. paratuberculosis
cgccgggcaacagcgcgcc

SEQ ID NO: 1017999 - RNA, 22 nt, Mycobacterium avium subsp. paratuberculosis
cgccgggcaacagcgcgccggc

SEQ ID NO: 1018000 - RNA, 17 nt, Mycobacterium avium subsp. paratuberculosis
cgccggcuccaccgcgc

SEQ ID NO: 1018001 - RNA, 16 nt, Mycobacterium avium subsp. paratuberculosis
cgccggcucagcggca

SEQ ID NO: 1018002 - RNA, 16 nt, Mycobacterium avium subsp. paratuberculosis
cgccggcuaccggcgc

SEQ ID NO: 1018003 - RNA, 17 nt, Mycobacterium avium subsp. paratuberculosis
cgccggcuaccggcgcu

SEQ ID NO: 1018004 - RNA, 20 nt, Mycobacterium avium subsp. paratuberculosis
cgccggcgugcacaggccgc

SEQ ID NO: 1018005 - RNA, 16 nt, Mycobacterium avium subsp. paratuberculosis
cgccggcgucgccgcu

SEQ ID NO: 1018006 - RNA, 22 nt, Mycobacterium avium subsp. paratuberculosis
cgccggcgucgccgcucuucga

SEQ ID NO: 1018007 - RNA, 18 nt, Mycobacterium avium subsp. paratuberculosis
cgccggcgguaugcccgg

SEQ ID NO: 1018008 - RNA, 20 nt, Mycobacterium avium subsp. paratuberculosis
cgccggcguccagcgccgcc

SEQ ID NO: 1018009 - RNA, 22 nt, Mycobacterium avium subsp. paratuberculosis
cgccggcgggugagccggucga

SEQ ID NO: 1018010 - RNA, 17 nt, Mycobacterium avium subsp. paratuberculosis
cgccggcgcggccagcu

SEQ ID NO: 1018011 - RNA, 21 nt, Mycobacterium avium subsp. paratuberculosis
cgccggcggcgcccgcggccu

SEQ ID NO: 1018012 - RNA, 14 nt, Mycobacterium avium subsp. paratuberculosis
cgccggcggccgcc

SEQ ID NO: 1018013 - RNA, 15 nt, Mycobacterium avium subsp. paratuberculosis
cgccggcggccgcca

SEQ ID NO: 1018014 - RNA, 16 nt, Mycobacterium avium subsp. paratuberculosis
cgccggcggccgccac

SEQ ID NO: 1018015 - RNA, 13 nt, Mycobacterium avium subsp. paratuberculosis
cgccggcggccga

SEQ ID NO: 1018016 - RNA, 19 nt, Mycobacterium avium subsp. paratuberculosis
cgccggcgcuggcgcgccg

SEQ ID NO: 1018017 - RNA, 14 nt, Mycobacterium avium subsp. paratuberculosis
cgccggcgcgggca

SEQ ID NO: 1018018 - RNA, 20 nt, Mycobacterium avium subsp. paratuberculosis
cgccggcgcgggggcggccu

SEQ ID NO: 1018019 - RNA, 19 nt, Mycobacterium avium subsp. paratuberculosis
cgccggcgcguccggaggu

SEQ ID NO: 1018020 - RNA, 23 nt, Mycobacterium avium subsp. paratuberculosis
cgccggcgcgcugaagcgcgacc

SEQ ID NO: 1018021 - RNA, 13 nt, Mycobacterium avium subsp. paratuberculosis
cgccggcgcgcag

SEQ ID NO: 1018022 - RNA, 18 nt, Mycobacterium avium subsp. paratuberculosis
cgccggcgccgggcgggc

SEQ ID NO: 1018023 - RNA, 16 nt, Mycobacterium avium subsp. paratuberculosis
cgccggcgccggaggg

SEQ ID NO: 1018024 - RNA, 21 nt, Mycobacterium avium subsp. paratuberculosis
cgccggcgcccugcgcgcccu

SEQ ID NO: 1018025 - RNA, 18 nt, Mycobacterium avium subsp. paratuberculosis
cgccggcgaugcgcgccu

SEQ ID NO: 1018026 - RNA, 15 nt, Mycobacterium avium subsp. paratuberculosis
cgccggcgaucucca

SEQ ID NO: 1018027 - RNA, 17 nt, Mycobacterium avium subsp. paratuberculosis
cgccggcgaucuccacc

SEQ ID NO: 1018028 - RNA, 22 nt, Mycobacterium avium subsp. paratuberculosis
cgccggcgaucucgucgcgcag

SEQ ID NO: 1018029 - RNA, 18 nt, Mycobacterium avium subsp. paratuberculosis
cgccggccuuggcccgcg

SEQ ID NO: 1018030 - RNA, 14 nt, Mycobacterium avium subsp. paratuberculosis
cgccggccgcgcgu

SEQ ID NO: 1018031 - RNA, 18 nt, Mycobacterium avium subsp. paratuberculosis
cgccggccgcggcgugca

SEQ ID NO: 1018032 - RNA, 13 nt, Mycobacterium avium subsp. paratuberculosis
cgccggccgcggg

SEQ ID NO: 1018033 - RNA, 17 nt, Mycobacterium avium subsp. paratuberculosis
cgccggccgcgggcgau

SEQ ID NO: 1018034 - RNA, 18 nt, Mycobacterium avium subsp. paratuberculosis
cgccggccgccagcgccc

SEQ ID NO: 1018035 - RNA, 13 nt, Mycobacterium avium subsp. paratuberculosis
cgccggccgccgc

SEQ ID NO: 1018036 - RNA, 13 nt, Mycobacterium avium subsp. paratuberculosis
cgccggccggcac

SEQ ID NO: 1018037 - RNA, 14 nt, Mycobacterium avium subsp. paratuberculosis
cgccggccggcgcg

SEQ ID NO: 1018038 - RNA, 16 nt, Mycobacterium avium subsp. paratuberculosis
cgccggccggcgguca

SEQ ID NO: 1018039 - RNA, 22 nt, Mycobacterium avium subsp. paratuberculosis
cgccggccgggcgggggcuguc

SEQ ID NO: 1018040 - RNA, 17 nt, Mycobacterium avium subsp. paratuberculosis
cgccggcccgcggcgga

SEQ ID NO: 1018041 - RNA, 12 nt, Mycobacterium avium subsp. paratuberculosis
cgccggcccagg

SEQ ID NO: 1018042 - RNA, 15 nt, Mycobacterium avium subsp. paratuberculosis
cgccggccccggcga

SEQ ID NO: 1018043 - RNA, 13 nt, Mycobacterium avium subsp. paratuberculosis
cgccggccgccag

SEQ ID NO: 1018044 - RNA, 14 nt, Mycobacterium avium subsp. paratuberculosis
cgccggccgccagc

SEQ ID NO: 1018045 - RNA, 23 nt, Mycobacterium avium subsp. paratuberculosis
cgccggauuacucgccggcggcg

SEQ ID NO: 1018046 - RNA, 23 nt, Mycobacterium avium subsp. paratuberculosis
cgccggaucgagcacccggcggg

SEQ ID NO: 1018047 - RNA, 20 nt, Mycobacterium avium subsp. paratuberculosis
cgccggaguucagccugaug

SEQ ID NO: 1018048 - RNA, 15 nt, Mycobacterium avium subsp. paratuberculosis
cgccggacaccuugg

SEQ ID NO: 1018049 - RNA, 13 nt, Mycobacterium avium subsp. paratuberculosis
cgccggagcgccc

SEQ ID NO: 1018050 - RNA, 15 nt, Mycobacterium avium subsp. paratuberculosis
cgccggagcgcccca

SEQ ID NO: 1018051 - RNA, 18 nt, Mycobacterium avium subsp. paratuberculosis
cgccggaggccagcucga

SEQ ID NO: 1018052 - RNA, 21 nt, Mycobacterium avium subsp. paratuberculosis
cgccggaggcgaucagguggg

SEQ ID NO: 1018053 - RNA, 19 nt, Mycobacterium avium subsp. paratuberculosis
cgccggccagcuccgccac

SEQ ID NO: 1018054 - RNA, 14 nt, Mycobacterium avium subsp. paratuberculosis
cgccggccaggaug

SEQ ID NO: 1018055 - RNA, 12 nt, Mycobacterium avium subsp. paratuberculosis
cgccggccagcg

SEQ ID NO: 1018056 - RNA, 14 nt, Mycobacterium avium subsp. paratuberculosis
cgccggccagcggc

SEQ ID NO: 1018057 - RNA, 18 nt, Mycobacterium avium subsp. paratuberculosis
cgccggccaccagggucu

SEQ ID NO: 1018058 - RNA, 17 nt, Mycobacterium avium subsp. paratuberculosis
cgccggccagcaccacg

SEQ ID NO: 1018059 - RNA, 15 nt, Mycobacterium avium subsp. paratuberculosis
cgccggccagcagca

SEQ ID NO: 1018060 - RNA, 14 nt, Mycobacterium avium subsp. paratuberculosis
cgccggccaccagg

SEQ ID NO: 1018061 - RNA, 20 nt, Mycobacterium avium subsp. paratuberculosis
cgccggcaucgaccgcccgc

SEQ ID NO: 1018062 - RNA, 21 nt, Mycobacterium avium subsp. paratuberculosis
cgccggcaucgaccgcccgcu

SEQ ID NO: 1018063 - RNA, 19 nt, Mycobacterium avium subsp. paratuberculosis
cgccggcagcaaccggcgg

SEQ ID NO: 1018064 - RNA, 14 nt, Mycobacterium avium subsp. paratuberculosis
cgccggcagccgcu

SEQ ID NO: 1018065 - RNA, 16 nt, Mycobacterium avium subsp. paratuberculosis
cgccggcagcggccgc

SEQ ID NO: 1018066 - RNA, 17 nt, Mycobacterium avium subsp. paratuberculosis
cgccggcagcggcugcu

SEQ ID NO: 1018067 - RNA, 15 nt, Mycobacterium avium subsp. paratuberculosis
cgccggcaccagcag

SEQ ID NO: 1018068 - RNA, 14 nt, Mycobacterium avium subsp. paratuberculosis
cgccgcuggugaac

SEQ ID NO: 1018069 - RNA, 21 nt, Mycobacterium avium subsp. paratuberculosis
cgccggacagcgggccgaccc

SEQ ID NO: 1018070 - RNA, 15 nt, Mycobacterium avium subsp. paratuberculosis
cgccggacagcuggc

SEQ ID NO: 1018071 - RNA, 17 nt, Mycobacterium avium subsp. paratuberculosis
cgccggaauggcaaggc

SEQ ID NO: 1018072 - RNA, 23 nt, Mycobacterium avium subsp. paratuberculosis
cgccggaauggcaaggccagcaa

SEQ ID NO: 1018073 - RNA, 21 nt, Mycobacterium avium subsp. paratuberculosis
cgccggaccccacagcgcgcc

SEQ ID NO: 1018074 - RNA, 16 nt, Mycobacterium avium subsp. paratuberculosis
cgccgcucggccagca

SEQ ID NO: 1018075 - RNA, 17 nt, Mycobacterium avium subsp. paratuberculosis
cgccgcucggccagcgc

SEQ ID NO: 1018076 - RNA, 22 nt, Mycobacterium avium subsp. paratuberculosis
cgccgcugcgcgcgcgaucggu

SEQ ID NO: 1018077 - RNA, 19 nt, Mycobacterium avium subsp. paratuberculosis
cgccgcucguaacgccacg

SEQ ID NO: 1018078 - RNA, 21 nt, Mycobacterium avium subsp. paratuberculosis
cgccgcucguaacgccacggc

SEQ ID NO: 1018079 - RNA, 18 nt, Mycobacterium avium subsp. paratuberculosis
cgccgcuagucgcccagc

SEQ ID NO: 1018080 - RNA, 16 nt, Mycobacterium avium subsp. paratuberculosis
cgccgcucaccgccga

SEQ ID NO: 1018081 - RNA, 22 nt, Mycobacterium avium subsp. paratuberculosis
cgccgcgcuugacggccgggcc

SEQ ID NO: 1018082 - RNA, 23 nt, Mycobacterium avium subsp. paratuberculosis
cgccgcgcuugacggccgggccc

SEQ ID NO: 1018083 - RNA, 22 nt, Mycobacterium avium subsp. paratuberculosis
cgccgcgcuugcgaccgccgcu

SEQ ID NO: 1018084 - RNA, 15 nt, Mycobacterium avium subsp. paratuberculosis
cgccgcgcgcggcca

SEQ ID NO: 1018085 - RNA, 15 nt, Mycobacterium avium subsp. paratuberculosis
cgccgcgcggcccgc

SEQ ID NO: 1018086 - RNA, 13 nt, Mycobacterium avium subsp. paratuberculosis
cgccgcgcggccg

SEQ ID NO: 1018087 - RNA, 21 nt, Mycobacterium avium subsp. paratuberculosis
cgccgcgcggccgggcucccg

SEQ ID NO: 1018088 - RNA, 14 nt, Mycobacterium avium subsp. paratuberculosis
cgccgcgcgccagc

SEQ ID NO: 1018089 - RNA, 17 nt, Mycobacterium avium subsp. paratuberculosis
cgccgcgccgggcgccc

SEQ ID NO: 1018090 - RNA, 12 nt, Mycobacterium avium subsp. paratuberculosis
cgccgcggcgcc

SEQ ID NO: 1018091 - RNA, 13 nt, Mycobacterium avium subsp. paratuberculosis
cgccgcggcaccu

SEQ ID NO: 1018092 - RNA, 14 nt, Mycobacterium avium subsp. paratuberculosis
cgccgcggccgccu

SEQ ID NO: 1018093 - RNA, 13 nt, Mycobacterium avium subsp. paratuberculosis
cgccgcggccgcg

SEQ ID NO: 1018094 - RNA, 15 nt, Mycobacterium avium subsp. paratuberculosis
cgccgcggccacgcu

SEQ ID NO: 1018095 - RNA, 15 nt, Mycobacterium avium subsp. paratuberculosis
cgccgcgcuggccga

SEQ ID NO: 1018096 - RNA, 15 nt, Mycobacterium avium subsp. paratuberculosis
cgccgcggaagcccc

SEQ ID NO: 1018097 - RNA, 16 nt, Mycobacterium avium subsp. paratuberculosis
cgccgcggaccccagc

SEQ ID NO: 1018098 - RNA, 18 nt, Mycobacterium avium subsp. paratuberculosis
cgccgcgcucgcaccagc

SEQ ID NO: 1018099 - RNA, 22 nt, Mycobacterium avium subsp. paratuberculosis
cgccgcggaucuucuccgccac

SEQ ID NO: 1018100 - RNA, 15 nt, Mycobacterium avium subsp. paratuberculosis
cgccgcguggccucc

SEQ ID NO: 1018101 - RNA, 18 nt, Mycobacterium avium subsp. paratuberculosis
cgccgcguucacccgcgc

SEQ ID NO: 1018102 - RNA, 20 nt, Mycobacterium avium subsp. paratuberculosis
cgccgcguucacccgcgccc

SEQ ID NO: 1018103 - RNA, 21 nt, Mycobacterium avium subsp. paratuberculosis
cgccgcguucggcggcgcgcu

SEQ ID NO: 1018104 - RNA, 18 nt, Mycobacterium avium subsp. paratuberculosis
cgccgcgucgacgccgcu

SEQ ID NO: 1018105 - RNA, 20 nt, Mycobacterium avium subsp. paratuberculosis
cgccgcgggugacgaucugg

SEQ ID NO: 1018106 - RNA, 13 nt, Mycobacterium avium subsp. paratuberculosis
cgccgcggucgcu

SEQ ID NO: 1018107 - RNA, 17 nt, Mycobacterium avium subsp. paratuberculosis
cgccgcggucgcugacc

SEQ ID NO: 1018108 - RNA, 14 nt, Mycobacterium avium subsp. paratuberculosis
cgccgcggugcgcc

SEQ ID NO: 1018109 - RNA, 15 nt, Mycobacterium avium subsp. paratuberculosis
cgccgcggugcgcca

SEQ ID NO: 1018110 - RNA, 22 nt, Mycobacterium avium subsp. paratuberculosis
cgccgcggugcgccacgcccgc

SEQ ID NO: 1018111 - RNA, 21 nt, Mycobacterium avium subsp. paratuberculosis
cgccgcgggcucccgcucgcc

SEQ ID NO: 1018112 - RNA, 13 nt, Mycobacterium avium subsp. paratuberculosis
cgccgcggcgccg

SEQ ID NO: 1018113 - RNA, 14 nt, Mycobacterium avium subsp. paratuberculosis
cgccgcguacagca

SEQ ID NO: 1018114 - RNA, 16 nt, Mycobacterium avium subsp. paratuberculosis
cgccgcguacagcagc

SEQ ID NO: 1018115 - RNA, 15 nt, Mycobacterium avium subsp. paratuberculosis
cgccgcguaccagcg

SEQ ID NO: 1018116 - RNA, 16 nt, Mycobacterium avium subsp. paratuberculosis
cgccgcguaccagcgc

SEQ ID NO: 1018117 - RNA, 18 nt, Mycobacterium avium subsp. paratuberculosis
cgccgcggcuccagcagc

SEQ ID NO: 1018118 - RNA, 18 nt, Mycobacterium avium subsp. paratuberculosis
cgccgcggcgguggccug

SEQ ID NO: 1018119 - RNA, 19 nt, Mycobacterium avium subsp. paratuberculosis
cgccgcggcgguggccugc

SEQ ID NO: 1018120 - RNA, 21 nt, Mycobacterium avium subsp. paratuberculosis
cgccgcggcgguggccugccc

SEQ ID NO: 1018121 - RNA, 24 nt, Mycobacterium avium subsp. paratuberculosis
cgccgcggcgaaaacgccugcgcc

SEQ ID NO: 1018122 - RNA, 16 nt, Mycobacterium avium subsp. paratuberculosis
cgccgcggcgcccggc

SEQ ID NO: 1018123 - RNA, 12 nt, Mycobacterium avium subsp. paratuberculosis
cgccgcggcgcu

SEQ ID NO: 1018124 - RNA, 22 nt, Mycobacterium avium subsp. paratuberculosis
cgccgcggcgcuugaccucgcc

SEQ ID NO: 1018125 - RNA, 11 nt, Mycobacterium avium subsp. paratuberculosis
cgccgcggcgg

SEQ ID NO: 1018126 - RNA, 21 nt, Mycobacterium avium subsp. paratuberculosis
cgccgcggcggcaaguccggg

SEQ ID NO: 1018127 - RNA, 13 nt, Mycobacterium avium subsp. paratuberculosis
cgccgcggcggcc

SEQ ID NO: 1018128 - RNA, 14 nt, Mycobacterium avium subsp. paratuberculosis
cgccgcggcggccu

SEQ ID NO: 1018129 - RNA, 15 nt, Mycobacterium avium subsp. paratuberculosis
cgccgcggcggccug

SEQ ID NO: 1018130 - RNA, 18 nt, Mycobacterium avium subsp. paratuberculosis
cgccgcgaucucggcgga

SEQ ID NO: 1018131 - RNA, 15 nt, Mycobacterium avium subsp. paratuberculosis
cgccgcgagccgccc

SEQ ID NO: 1018132 - RNA, 19 nt, Mycobacterium avium subsp. paratuberculosis
cgccgcgagccgcccaggc

SEQ ID NO: 1018133 - RNA, 18 nt, Mycobacterium avium subsp. paratuberculosis
cgccgcgacggccgccga

SEQ ID NO: 1018134 - RNA, 14 nt, Mycobacterium avium subsp. paratuberculosis
cgccgcgcagccag

SEQ ID NO: 1018135 - RNA, 20 nt, Mycobacterium avium subsp. paratuberculosis
cgccgcgcaccccgaaccgc

SEQ ID NO: 1018136 - RNA, 14 nt, Mycobacterium avium subsp. paratuberculosis
cgccgcgcacccgg

SEQ ID NO: 1018137 - RNA, 15 nt, Mycobacterium avium subsp. paratuberculosis
cgccgcgcacccggc

SEQ ID NO: 1018138 - RNA, 13 nt, Mycobacterium avium subsp. paratuberculosis
cgccgcgcccggc

SEQ ID NO: 1018139 - RNA, 15 nt, Mycobacterium avium subsp. paratuberculosis
cgccgcgcccagcac

SEQ ID NO: 1018140 - RNA, 20 nt, Mycobacterium avium subsp. paratuberculosis
cgccgcgccccggcgcgccu

SEQ ID NO: 1018141 - RNA, 15 nt, Mycobacterium avium subsp. paratuberculosis
cgccgcgcccgccgg

SEQ ID NO: 1018142 - RNA, 14 nt, Mycobacterium avium subsp. paratuberculosis
cgccgcgccagcac

SEQ ID NO: 1018143 - RNA, 16 nt, Mycobacterium avium subsp. paratuberculosis
cgccgcgccagcaccu

SEQ ID NO: 1018144 - RNA, 16 nt, Mycobacterium avium subsp. paratuberculosis
cgccgccguucgccgg

SEQ ID NO: 1018145 - RNA, 22 nt, Mycobacterium avium subsp. paratuberculosis
cgccgcgaacucaggcgcgcac

SEQ ID NO: 1018146 - RNA, 15 nt, Mycobacterium avium subsp. paratuberculosis
cgccgcgaccacagc

SEQ ID NO: 1018147 - RNA, 12 nt, Mycobacterium avium subsp. paratuberculosis
cgccgccugagc

SEQ ID NO: 1018148 - RNA, 18 nt, Mycobacterium avium subsp. paratuberculosis
cgccgccuucuugcgcgg

SEQ ID NO: 1018149 - RNA, 15 nt, Mycobacterium avium subsp. paratuberculosis
cgcccuuccagcacc

SEQ ID NO: 1018150 - RNA, 18 nt, Mycobacterium avium subsp. paratuberculosis
cgcccuugcucgcggcgu

SEQ ID NO: 1018151 - RNA, 23 nt, Mycobacterium avium subsp. paratuberculosis
cgcccuugaucgucuugccgaag

SEQ ID NO: 1018152 - RNA, 22 nt, Mycobacterium avium subsp. paratuberculosis
cgcccuucuucgcgggugccuu

SEQ ID NO: 1018153 - RNA, 15 nt, Mycobacterium avium subsp. paratuberculosis
cgcccugguugaucc

SEQ ID NO: 1018154 - RNA, 17 nt, Mycobacterium avium subsp. paratuberculosis
cgcccuucggcgcccgc

SEQ ID NO: 1018155 - RNA, 22 nt, Mycobacterium avium subsp. paratuberculosis
cgcccugcgaauacccgcccag

SEQ ID NO: 1018156 - RNA, 23 nt, Mycobacterium avium subsp. paratuberculosis
cgcccugcgaauacccgcccagc

SEQ ID NO: 1018157 - RNA, 16 nt, Mycobacterium avium subsp. paratuberculosis
cgcccugcgagcccgg

SEQ ID NO: 1018158 - RNA, 18 nt, Mycobacterium avium subsp. paratuberculosis
cgcccugcgcgcccugcu

SEQ ID NO: 1018159 - RNA, 22 nt, Mycobacterium avium subsp. paratuberculosis
cgcccugcacccagccgugccc

SEQ ID NO: 1018160 - RNA, 14 nt, Mycobacterium avium subsp. paratuberculosis
cgcccugccacagc

SEQ ID NO: 1018161 - RNA, 15 nt, Mycobacterium avium subsp. paratuberculosis
cgcccugccacagcg

SEQ ID NO: 1018162 - RNA, 22 nt, Mycobacterium avium subsp. paratuberculosis
cgcccuggauauccagccuugc

SEQ ID NO: 1018163 - RNA, 14 nt, Mycobacterium avium subsp. paratuberculosis
cgcccugcugggag

SEQ ID NO: 1018164 - RNA, 21 nt, Mycobacterium avium subsp. paratuberculosis
cgcccugcuugaacagcaccc

SEQ ID NO: 1018165 - RNA, 18 nt, Mycobacterium avium subsp. paratuberculosis
cgcccuaacgugcccggc

SEQ ID NO: 1018166 - RNA, 20 nt, Mycobacterium avium subsp. paratuberculosis
cgcccuaacgugcccggccc

SEQ ID NO: 1018167 - RNA, 13 nt, Mycobacterium avium subsp. paratuberculosis
cgcccuccccggc

SEQ ID NO: 1018168 - RNA, 16 nt, Mycobacterium avium subsp. paratuberculosis
cgcccucgcgcagggc

SEQ ID NO: 1018169 - RNA, 17 nt, Mycobacterium avium subsp. paratuberculosis
cgcccucgcgcagggcc

SEQ ID NO: 1018170 - RNA, 20 nt, Mycobacterium avium subsp. paratuberculosis
cgcccucgcgcagggccagc

SEQ ID NO: 1018171 - RNA, 21 nt, Mycobacterium avium subsp. paratuberculosis
cgcccucggcuuccgagccgg

SEQ ID NO: 1018172 - RNA, 11 nt, Mycobacterium avium subsp. paratuberculosis
cgcccuccugg

SEQ ID NO: 1018173 - RNA, 20 nt, Mycobacterium avium subsp. paratuberculosis
cgcccucgccggcggcgccc

SEQ ID NO: 1018174 - RNA, 19 nt, Mycobacterium avium subsp. paratuberculosis
cgcccguucgagcgccgga

SEQ ID NO: 1018175 - RNA, 13 nt, Mycobacterium avium subsp. paratuberculosis
cgcccgucggggc

SEQ ID NO: 1018176 - RNA, 18 nt, Mycobacterium avium subsp. paratuberculosis
cgcccgucggggcccggc

SEQ ID NO: 1018177 - RNA, 16 nt, Mycobacterium avium subsp. paratuberculosis
cgcccggugcgccagc

SEQ ID NO: 1018178 - RNA, 18 nt, Mycobacterium avium subsp. paratuberculosis
cgcccggugcgccagcgu

SEQ ID NO: 1018179 - RNA, 19 nt, Mycobacterium avium subsp. paratuberculosis
cgcccgguaggccgccgcg

SEQ ID NO: 1018180 - RNA, 16 nt, Mycobacterium avium subsp. paratuberculosis
cgcccggucacccgug

SEQ ID NO: 1018181 - RNA, 22 nt, Mycobacterium avium subsp. paratuberculosis
cgcccggucaggaacccggccc

SEQ ID NO: 1018182 - RNA, 20 nt, Mycobacterium avium subsp. paratuberculosis
cgcccggucgaggucggcca

SEQ ID NO: 1018183 - RNA, 22 nt, Mycobacterium avium subsp. paratuberculosis
cgcccggggugaugccggcggu

SEQ ID NO: 1018184 - RNA, 18 nt, Mycobacterium avium subsp. paratuberculosis
cgcccguagaugcggccc

SEQ ID NO: 1018185 - RNA, 24 nt, Mycobacterium avium subsp. paratuberculosis
cgcccgucgagcgucacgccgcgc

SEQ ID NO: 1018186 - RNA, 13 nt, Mycobacterium avium subsp. paratuberculosis
cgcccgucgccuc

SEQ ID NO: 1018187 - RNA, 13 nt, Mycobacterium avium subsp. paratuberculosis
cgcccgucccgcc

SEQ ID NO: 1018188 - RNA, 18 nt, Mycobacterium avium subsp. paratuberculosis
cgcccguccgggccggcc

SEQ ID NO: 1018189 - RNA, 16 nt, Mycobacterium avium subsp. paratuberculosis
cgccgaaccgggcgcg

SEQ ID NO: 1018190 - RNA, 22 nt, Mycobacterium avium subsp. paratuberculosis
cgccgaacgucgagcgcggccc

SEQ ID NO: 1018191 - RNA, 19 nt, Mycobacterium avium subsp. paratuberculosis
cgccgaacgugcgcggcgc

SEQ ID NO: 1018192 - RNA, 21 nt, Mycobacterium avium subsp. paratuberculosis
cgccgaaaaacgcgacggccc

SEQ ID NO: 1018193 - RNA, 20 nt, Mycobacterium avium subsp. paratuberculosis
cgccgaaccagaucggcggg

SEQ ID NO: 1018194 - RNA, 16 nt, Mycobacterium avium subsp. paratuberculosis
cgccgaacagcagcgc

SEQ ID NO: 1018195 - RNA, 15 nt, Mycobacterium avium subsp. paratuberculosis
cgccgaacagccggg

SEQ ID NO: 1018196 - RNA, 21 nt, Mycobacterium avium subsp. paratuberculosis
cgccgaacaccugcggcggca

SEQ ID NO: 1018197 - RNA, 15 nt, Mycobacterium avium subsp. paratuberculosis
cgccgaauccggcgg

SEQ ID NO: 1018198 - RNA, 17 nt, Mycobacterium avium subsp. paratuberculosis
cgccgaauccgggcaug

SEQ ID NO: 1018199 - RNA, 18 nt, Mycobacterium avium subsp. paratuberculosis
cgccgaaguuccagccga

SEQ ID NO: 1018200 - RNA, 21 nt, Mycobacterium avium subsp. paratuberculosis
cgccgacaccagcgcgcacgc

SEQ ID NO: 1018201 - RNA, 14 nt, Mycobacterium avium subsp. paratuberculosis
cgccgacaccaggg

SEQ ID NO: 1018202 - RNA, 13 nt, Mycobacterium avium subsp. paratuberculosis
cgccgacagcagc

SEQ ID NO: 1018203 - RNA, 19 nt, Mycobacterium avium subsp. paratuberculosis
cgccgacagcugagcagcc

SEQ ID NO: 1018204 - RNA, 20 nt, Mycobacterium avium subsp. paratuberculosis
cgccgacaucucccggucga

SEQ ID NO: 1018205 - RNA, 20 nt, Mycobacterium avium subsp. paratuberculosis
cgccgaccaccuugcgcagc

SEQ ID NO: 1018206 - RNA, 23 nt, Mycobacterium avium subsp. paratuberculosis
cgccgaccaccuugcgcagcagc

SEQ ID NO: 1018207 - RNA, 19 nt, Mycobacterium avium subsp. paratuberculosis
cgccgaccacggccccagc

SEQ ID NO: 1018208 - RNA, 14 nt, Mycobacterium avium subsp. paratuberculosis
cgccgaccagcagg

SEQ ID NO: 1018209 - RNA, 14 nt, Mycobacterium avium subsp. paratuberculosis
cgccgaccagccga

SEQ ID NO: 1018210 - RNA, 18 nt, Mycobacterium avium subsp. paratuberculosis
cgccgacccgcccgccgg

SEQ ID NO: 1018211 - RNA, 12 nt, Mycobacterium avium subsp. paratuberculosis
cgccgagcagcu

SEQ ID NO: 1018212 - RNA, 14 nt, Mycobacterium avium subsp. paratuberculosis
cgccgagcagcuca

SEQ ID NO: 1018213 - RNA, 23 nt, Mycobacterium avium subsp. paratuberculosis
cgccgagcacgaacgcggccgcc

SEQ ID NO: 1018214 - RNA, 17 nt, Mycobacterium avium subsp. paratuberculosis
cgccgagcagccggucc

SEQ ID NO: 1018215 - RNA, 16 nt, Mycobacterium avium subsp. paratuberculosis
cgccgagccgcaccgc

SEQ ID NO: 1018216 - RNA, 14 nt, Mycobacterium avium subsp. paratuberculosis
cgccgagccgcggg

SEQ ID NO: 1018217 - RNA, 15 nt, Mycobacterium avium subsp. paratuberculosis
cgccgagccgcucca

SEQ ID NO: 1018218 - RNA, 17 nt, Mycobacterium avium subsp. paratuberculosis
cgccgagccggcacggc

SEQ ID NO: 1018219 - RNA, 22 nt, Mycobacterium avium subsp. paratuberculosis
cgccgagccgucgucgcugcag

SEQ ID NO: 1018220 - RNA, 19 nt, Mycobacterium avium subsp. paratuberculosis
cgccgacuagcgcggcggc

SEQ ID NO: 1018221 - RNA, 18 nt, Mycobacterium avium subsp. paratuberculosis
cgccgagcaacagcccga

SEQ ID NO: 1018222 - RNA, 21 nt, Mycobacterium avium subsp. paratuberculosis
cgccgagagcucuugcgcccc

SEQ ID NO: 1018223 - RNA, 20 nt, Mycobacterium avium subsp. paratuberculosis
cgccgacuugaucgcggcgu

SEQ ID NO: 1018224 - RNA, 20 nt, Mycobacterium avium subsp. paratuberculosis
cgccgacgaugcugucgcgg

SEQ ID NO: 1018225 - RNA, 15 nt, Mycobacterium avium subsp. paratuberculosis
cgccgacgccagcac

SEQ ID NO: 1018226 - RNA, 16 nt, Mycobacterium avium subsp. paratuberculosis
cgccgacgccagcacg

SEQ ID NO: 1018227 - RNA, 14 nt, Mycobacterium avium subsp. paratuberculosis
cgccgacgcccaca

SEQ ID NO: 1018228 - RNA, 16 nt, Mycobacterium avium subsp. paratuberculosis
cgccgacgcccacagc

SEQ ID NO: 1018229 - RNA, 20 nt, Mycobacterium avium subsp. paratuberculosis
cgccgacgcccacagcgcca

SEQ ID NO: 1018230 - RNA, 19 nt, Mycobacterium avium subsp. paratuberculosis
cgccgacgacgucgcgcag

SEQ ID NO: 1018231 - RNA, 19 nt, Mycobacterium avium subsp. paratuberculosis
cgccgacgaucccggcgag

SEQ ID NO: 1018232 - RNA, 18 nt, Mycobacterium avium subsp. paratuberculosis
cgccgacgauccgcgccg

SEQ ID NO: 1018233 - RNA, 19 nt, Mycobacterium avium subsp. paratuberculosis
cgccgacgauccgcgccgc

SEQ ID NO: 1018234 - RNA, 20 nt, Mycobacterium avium subsp. paratuberculosis
cgccgacggcugcccggccc

SEQ ID NO: 1018235 - RNA, 13 nt, Mycobacterium avium subsp. paratuberculosis
cgccgacggccgc

SEQ ID NO: 1018236 - RNA, 18 nt, Mycobacterium avium subsp. paratuberculosis
cgccgacggccgcgccgu

SEQ ID NO: 1018237 - RNA, 17 nt, Mycobacterium avium subsp. paratuberculosis
cgccgacggccagcagg

SEQ ID NO: 1018238 - RNA, 17 nt, Mycobacterium avium subsp. paratuberculosis
cgccgacggagacgacc

SEQ ID NO: 1018239 - RNA, 17 nt, Mycobacterium avium subsp. paratuberculosis
cgccgaccgguccgccg

SEQ ID NO: 1018240 - RNA, 19 nt, Mycobacterium avium subsp. paratuberculosis
cgccgaccgguccgccgcc

SEQ ID NO: 1018241 - RNA, 15 nt, Mycobacterium avium subsp. paratuberculosis
cgccgaccgcccgcu

SEQ ID NO: 1018242 - RNA, 13 nt, Mycobacterium avium subsp. paratuberculosis
cgccgccgccagc

SEQ ID NO: 1018243 - RNA, 16 nt, Mycobacterium avium subsp. paratuberculosis
cgccgccgacuccccg

SEQ ID NO: 1018244 - RNA, 22 nt, Mycobacterium avium subsp. paratuberculosis
cgccgccgaugcugauccgcag

SEQ ID NO: 1018245 - RNA, 15 nt, Mycobacterium avium subsp. paratuberculosis
cgccgccgcaccggc

SEQ ID NO: 1018246 - RNA, 16 nt, Mycobacterium avium subsp. paratuberculosis
cgccgccgcaccggcc

SEQ ID NO: 1018247 - RNA, 19 nt, Mycobacterium avium subsp. paratuberculosis
cgccgccgcaccggccggc

SEQ ID NO: 1018248 - RNA, 14 nt, Mycobacterium avium subsp. paratuberculosis
cgccgccgcggccg

SEQ ID NO: 1018249 - RNA, 15 nt, Mycobacterium avium subsp. paratuberculosis
cgccgccgcggccgc

SEQ ID NO: 1018250 - RNA, 12 nt, Mycobacterium avium subsp. paratuberculosis
cgccgccgcggg

SEQ ID NO: 1018251 - RNA, 21 nt, Mycobacterium avium subsp. paratuberculosis
cgccgccguguaggccgcgcu

SEQ ID NO: 1018252 - RNA, 23 nt, Mycobacterium avium subsp. paratuberculosis
cgccgccguguaggccgcgcugg

SEQ ID NO: 1018253 - RNA, 14 nt, Mycobacterium avium subsp. paratuberculosis
cgccgccggggcgc

SEQ ID NO: 1018254 - RNA, 19 nt, Mycobacterium avium subsp. paratuberculosis
cgccgccggggcgggcagc

SEQ ID NO: 1018255 - RNA, 23 nt, Mycobacterium avium subsp. paratuberculosis
cgccgccgggccuguccagccgg

SEQ ID NO: 1018256 - RNA, 15 nt, Mycobacterium avium subsp. paratuberculosis
cgccgccgggaacag

SEQ ID NO: 1018257 - RNA, 13 nt, Mycobacterium avium subsp. paratuberculosis
cgccgccggcgcu

SEQ ID NO: 1018258 - RNA, 15 nt, Mycobacterium avium subsp. paratuberculosis
cgccgccggcuagac

SEQ ID NO: 1018259 - RNA, 22 nt, Mycobacterium avium subsp. paratuberculosis
cgccgccggcuagacgcgcagc

SEQ ID NO: 1018260 - RNA, 16 nt, Mycobacterium avium subsp. paratuberculosis
cgccgccacgcggcgc

SEQ ID NO: 1018261 - RNA, 18 nt, Mycobacterium avium subsp. paratuberculosis
cgccgccacgcggcgcgc

SEQ ID NO: 1018262 - RNA, 19 nt, Mycobacterium avium subsp. paratuberculosis
cgccgccaccgucgccggc

SEQ ID NO: 1018263 - RNA, 23 nt, Mycobacterium avium subsp. paratuberculosis
cgccgccagcaaccccgcggugc

SEQ ID NO: 1018264 - RNA, 13 nt, Mycobacterium avium subsp. paratuberculosis
cgccgccagcagc

SEQ ID NO: 1018265 - RNA, 14 nt, Mycobacterium avium subsp. paratuberculosis
cgccgccagcagca

SEQ ID NO: 1018266 - RNA, 13 nt, Mycobacterium avium subsp. paratuberculosis
cgccgccagccag

SEQ ID NO: 1018267 - RNA, 14 nt, Mycobacterium avium subsp. paratuberculosis
cgccgccagcgcgg

SEQ ID NO: 1018268 - RNA, 17 nt, Mycobacterium avium subsp. paratuberculosis
cgccgccagcgcggggu

SEQ ID NO: 1018269 - RNA, 16 nt, Mycobacterium avium subsp. paratuberculosis
cgccgccagccgcagc

SEQ ID NO: 1018270 - RNA, 18 nt, Mycobacterium avium subsp. paratuberculosis
cgccgccaucuccuccgg

SEQ ID NO: 1018271 - RNA, 20 nt, Mycobacterium avium subsp. paratuberculosis
cgccgccaucuccuccgggc

SEQ ID NO: 1018272 - RNA, 17 nt, Mycobacterium avium subsp. paratuberculosis
cgccgccauccgcgccg

SEQ ID NO: 1018273 - RNA, 22 nt, Mycobacterium avium subsp. paratuberculosis
cgccgccaucgccucgucccuc

SEQ ID NO: 1018274 - RNA, 20 nt, Mycobacterium avium subsp. paratuberculosis
cgccgcccccgauagccccg

SEQ ID NO: 1018275 - RNA, 15 nt, Mycobacterium avium subsp. paratuberculosis
cgccgcccccgccgc

SEQ ID NO: 1018276 - RNA, 15 nt, Mycobacterium avium subsp. paratuberculosis
cgccgcccgcgcggc

SEQ ID NO: 1018277 - RNA, 23 nt, Mycobacterium avium subsp. paratuberculosis
cgccgccccgaguuccagcuccg

SEQ ID NO: 1018278 - RNA, 13 nt, Mycobacterium avium subsp. paratuberculosis
cgccgcccaccag

SEQ ID NO: 1018279 - RNA, 14 nt, Mycobacterium avium subsp. paratuberculosis
cgccgcccaccagc

SEQ ID NO: 1018280 - RNA, 19 nt, Mycobacterium avium subsp. paratuberculosis
cgccgcccaggccccggcc

SEQ ID NO: 1018281 - RNA, 21 nt, Mycobacterium avium subsp. paratuberculosis
cgccgcccaggccccggccga

SEQ ID NO: 1018282 - RNA, 17 nt, Mycobacterium avium subsp. paratuberculosis
cgccgcccaucggcagc

SEQ ID NO: 1018283 - RNA, 17 nt, Mycobacterium avium subsp. paratuberculosis
cgccgccgaaccccagc

SEQ ID NO: 1018284 - RNA, 23 nt, Mycobacterium avium subsp. paratuberculosis
cgccgccgaaccccagcuccggg

SEQ ID NO: 1018285 - RNA, 14 nt, Mycobacterium avium subsp. paratuberculosis
cgccgcccgggccc

SEQ ID NO: 1018286 - RNA, 14 nt, Mycobacterium avium subsp. paratuberculosis
cgccgcccgucagc

SEQ ID NO: 1018287 - RNA, 13 nt, Mycobacterium avium subsp. paratuberculosis
cgccgcccggcga

SEQ ID NO: 1018288 - RNA, 17 nt, Mycobacterium avium subsp. paratuberculosis
cgccgcauaccgcccgc

SEQ ID NO: 1018289 - RNA, 22 nt, Mycobacterium avium subsp. paratuberculosis
cgccgcauaccgcccgcgcugg

SEQ ID NO: 1018290 - RNA, 21 nt, Mycobacterium avium subsp. paratuberculosis
cgccgcauuccucggccagcu

SEQ ID NO: 1018291 - RNA, 19 nt, Mycobacterium avium subsp. paratuberculosis
cgccgcauuggugccggcc

SEQ ID NO: 1018292 - RNA, 12 nt, Mycobacterium avium subsp. paratuberculosis
cgccgccaccgg

SEQ ID NO: 1018293 - RNA, 16 nt, Mycobacterium avium subsp. paratuberculosis
cgccgccaccccaggc

SEQ ID NO: 1018294 - RNA, 24 nt, Mycobacterium avium subsp. paratuberculosis
cgccgccaaccaggucgcggcgcu

SEQ ID NO: 1018295 - RNA, 13 nt, Mycobacterium avium subsp. paratuberculosis
cgccgccaccacg

SEQ ID NO: 1018296 - RNA, 15 nt, Mycobacterium avium subsp. paratuberculosis
cgccgccaccacggc

SEQ ID NO: 1018297 - RNA, 17 nt, Mycobacterium avium subsp. paratuberculosis
cgccgcaacagccggcc

SEQ ID NO: 1018298 - RNA, 19 nt, Mycobacterium avium subsp. paratuberculosis
cgccgcaacagccggcccg

SEQ ID NO: 1018299 - RNA, 17 nt, Mycobacterium avium subsp. paratuberculosis
cgccgauucaaccccgc

SEQ ID NO: 1018300 - RNA, 18 nt, Mycobacterium avium subsp. paratuberculosis
cgccgauuccggccggcc

SEQ ID NO: 1018301 - RNA, 14 nt, Mycobacterium avium subsp. paratuberculosis
cgccgcacacuucc

SEQ ID NO: 1018302 - RNA, 21 nt, Mycobacterium avium subsp. paratuberculosis
cgccgcaacuugcccgacggc

SEQ ID NO: 1018303 - RNA, 16 nt, Mycobacterium avium subsp. paratuberculosis
cgccgcacccagcggg

SEQ ID NO: 1018304 - RNA, 15 nt, Mycobacterium avium subsp. paratuberculosis
cgccgcaccggccgg

SEQ ID NO: 1018305 - RNA, 22 nt, Mycobacterium avium subsp. paratuberculosis
cgccgcaccggccggccccggg

SEQ ID NO: 1018306 - RNA, 21 nt, Mycobacterium avium subsp. paratuberculosis
cgccgcaccucgccggccgcc

SEQ ID NO: 1018307 - RNA, 17 nt, Mycobacterium avium subsp. paratuberculosis
cgccgcacgcccacagc

SEQ ID NO: 1018308 - RNA, 16 nt, Mycobacterium avium subsp. paratuberculosis
cgccgcagcggcgccg

SEQ ID NO: 1018309 - RNA, 15 nt, Mycobacterium avium subsp. paratuberculosis
cgccgcagcccgcca

SEQ ID NO: 1018310 - RNA, 16 nt, Mycobacterium avium subsp. paratuberculosis
cgccgagguggccgcc

SEQ ID NO: 1018311 - RNA, 17 nt, Mycobacterium avium subsp. paratuberculosis
cgccgagguggccgcca

SEQ ID NO: 1018312 - RNA, 19 nt, Mycobacterium avium subsp. paratuberculosis
cgccgagguggccgccagc

SEQ ID NO: 1018313 - RNA, 17 nt, Mycobacterium avium subsp. paratuberculosis
cgccgagucgcgccgcg

SEQ ID NO: 1018314 - RNA, 17 nt, Mycobacterium avium subsp. paratuberculosis
cgccgaggugcaacacu

SEQ ID NO: 1018315 - RNA, 17 nt, Mycobacterium avium subsp. paratuberculosis
cgccgagggugccggcc

SEQ ID NO: 1018316 - RNA, 15 nt, Mycobacterium avium subsp. paratuberculosis
cgccgagguccucga

SEQ ID NO: 1018317 - RNA, 17 nt, Mycobacterium avium subsp. paratuberculosis
cgccgagggccagcagc

SEQ ID NO: 1018318 - RNA, 16 nt, Mycobacterium avium subsp. paratuberculosis
cgccgagggcggcggc

SEQ ID NO: 1018319 - RNA, 23 nt, Mycobacterium avium subsp. paratuberculosis
cgccgaggcgugccgcugggagc

SEQ ID NO: 1018320 - RNA, 23 nt, Mycobacterium avium subsp. paratuberculosis
cgccgaggaucuugaucgcgaag

SEQ ID NO: 1018321 - RNA, 22 nt, Mycobacterium avium subsp. paratuberculosis
cgccgaggcgaugccgugcugg

SEQ ID NO: 1018322 - RNA, 15 nt, Mycobacterium avium subsp. paratuberculosis
cgccgaggaggccgc

SEQ ID NO: 1018323 - RNA, 18 nt, Mycobacterium avium subsp. paratuberculosis
cgccgaggaggccgcggc

SEQ ID NO: 1018324 - RNA, 20 nt, Mycobacterium avium subsp. paratuberculosis
cgccgaggaggccgcggcga

SEQ ID NO: 1018325 - RNA, 20 nt, Mycobacterium avium subsp. paratuberculosis
cgccgagcucggccaccagc

SEQ ID NO: 1018326 - RNA, 22 nt, Mycobacterium avium subsp. paratuberculosis
cgccgagcucggccaccagcgc

SEQ ID NO: 1018327 - RNA, 16 nt, Mycobacterium avium subsp. paratuberculosis
cgccgauccagccguc

SEQ ID NO: 1018328 - RNA, 16 nt, Mycobacterium avium subsp. paratuberculosis
cgccgaucuggcgcag

SEQ ID NO: 1018329 - RNA, 17 nt, Mycobacterium avium subsp. paratuberculosis
cgccgauccggcgccgc

SEQ ID NO: 1018330 - RNA, 13 nt, Mycobacterium avium subsp. paratuberculosis
cgccgaucgcgcg

SEQ ID NO: 1018331 - RNA, 15 nt, Mycobacterium avium subsp. paratuberculosis
cgccgaucgcgcgca

SEQ ID NO: 1018332 - RNA, 19 nt, Mycobacterium avium subsp. paratuberculosis
cgccgaucucgaccagcgc

SEQ ID NO: 1018333 - RNA, 19 nt, Mycobacterium avium subsp. paratuberculosis
cgccgaugucggccggucc

SEQ ID NO: 1018334 - RNA, 12 nt, Mycobacterium avium subsp. paratuberculosis
cgccgaugcuga

SEQ ID NO: 1018335 - RNA, 15 nt, Mycobacterium avium subsp. paratuberculosis
cgccgaugccgcgcu

SEQ ID NO: 1018336 - RNA, 16 nt, Mycobacterium avium subsp. paratuberculosis
cgccgaugcgcccgcu

SEQ ID NO: 1018337 - RNA, 16 nt, Mycobacterium avium subsp. paratuberculosis
cgccgaugcccgcccc

SEQ ID NO: 1018338 - RNA, 13 nt, Mycobacterium avium subsp. paratuberculosis
cgccgaugcagca

SEQ ID NO: 1018339 - RNA, 19 nt, Mycobacterium avium subsp. paratuberculosis
cgccgaugcauuggugcac

SEQ ID NO: 1018340 - RNA, 15 nt, Mycobacterium avium subsp. paratuberculosis
cgccgaugacggcgc

SEQ ID NO: 1018341 - RNA, 14 nt, Mycobacterium avium subsp. paratuberculosis
cgccaggaucugcu

SEQ ID NO: 1018342 - RNA, 19 nt, Mycobacterium avium subsp. paratuberculosis
cgccaggaauaacgccggc

SEQ ID NO: 1018343 - RNA, 21 nt, Mycobacterium avium subsp. paratuberculosis
cgccaggaauaacgccggccc

SEQ ID NO: 1018344 - RNA, 23 nt, Mycobacterium avium subsp. paratuberculosis
cgccaggaccacccacucccagc

SEQ ID NO: 1018345 - RNA, 14 nt, Mycobacterium avium subsp. paratuberculosis
cgccaggaccagcg

SEQ ID NO: 1018346 - RNA, 16 nt, Mycobacterium avium subsp. paratuberculosis
cgccaggaccagcggg

SEQ ID NO: 1018347 - RNA, 18 nt, Mycobacterium avium subsp. paratuberculosis
cgccaggaccagcggguc

SEQ ID NO: 1018348 - RNA, 21 nt, Mycobacterium avium subsp. paratuberculosis
cgccaggaaccacaccccggc

SEQ ID NO: 1018349 - RNA, 22 nt, Mycobacterium avium subsp. paratuberculosis
cgccagcuggguggucaccagc

SEQ ID NO: 1018350 - RNA, 16 nt, Mycobacterium avium subsp. paratuberculosis
cgccagcugggcagcc

SEQ ID NO: 1018351 - RNA, 20 nt, Mycobacterium avium subsp. paratuberculosis
cgccagcugggcagccagau

SEQ ID NO: 1018352 - RNA, 19 nt, Mycobacterium avium subsp. paratuberculosis
cgccagcguggccagcacc

SEQ ID NO: 1018353 - RNA, 16 nt, Mycobacterium avium subsp. paratuberculosis
cgccagcguggcgaac

SEQ ID NO: 1018354 - RNA, 14 nt, Mycobacterium avium subsp. paratuberculosis
cgccaggccaccgc

SEQ ID NO: 1018355 - RNA, 12 nt, Mycobacterium avium subsp. paratuberculosis
cgccaggcaggc

SEQ ID NO: 1018356 - RNA, 13 nt, Mycobacterium avium subsp. paratuberculosis
cgccagcgccccc

SEQ ID NO: 1018357 - RNA, 16 nt, Mycobacterium avium subsp. paratuberculosis
cgccagcgcccccagc

SEQ ID NO: 1018358 - RNA, 13 nt, Mycobacterium avium subsp. paratuberculosis
cgccagcgcccga

SEQ ID NO: 1018359 - RNA, 14 nt, Mycobacterium avium subsp. paratuberculosis
cgccagcgcggcga

SEQ ID NO: 1018360 - RNA, 14 nt, Mycobacterium avium subsp. paratuberculosis
cgccagcgcggcgg

SEQ ID NO: 1018361 - RNA, 16 nt, Mycobacterium avium subsp. paratuberculosis
cgccagcgcggcggcg

SEQ ID NO: 1018362 - RNA, 18 nt, Mycobacterium avium subsp. paratuberculosis
cgccagcgcggcggcgcc

SEQ ID NO: 1018363 - RNA, 21 nt, Mycobacterium avium subsp. paratuberculosis
cgccagcgcggcggcgccguc

SEQ ID NO: 1018364 - RNA, 14 nt, Mycobacterium avium subsp. paratuberculosis
cgccagcgcggggu

SEQ ID NO: 1018365 - RNA, 13 nt, Mycobacterium avium subsp. paratuberculosis
cgccagcgcgccg

SEQ ID NO: 1018366 - RNA, 18 nt, Mycobacterium avium subsp. paratuberculosis
cgccagcgcgcccgccau

SEQ ID NO: 1018367 - RNA, 18 nt, Mycobacterium avium subsp. paratuberculosis
cgccagcgcgacccgcuc

SEQ ID NO: 1018368 - RNA, 17 nt, Mycobacterium avium subsp. paratuberculosis
cgccagcgcgcagaaca

SEQ ID NO: 1018369 - RNA, 13 nt, Mycobacterium avium subsp. paratuberculosis
cgccagcgccggc

SEQ ID NO: 1018370 - RNA, 15 nt, Mycobacterium avium subsp. paratuberculosis
cgccagcgccggcag

SEQ ID NO: 1018371 - RNA, 16 nt, Mycobacterium avium subsp. paratuberculosis
cgccagcgccggcagc

SEQ ID NO: 1018372 - RNA, 17 nt, Mycobacterium avium subsp. paratuberculosis
cgccagcggcagcgcca

SEQ ID NO: 1018373 - RNA, 19 nt, Mycobacterium avium subsp. paratuberculosis
cgccagcggcagcgccagc

SEQ ID NO: 1018374 - RNA, 14 nt, Mycobacterium avium subsp. paratuberculosis
cgccagcggcagcg

SEQ ID NO: 1018375 - RNA, 14 nt, Mycobacterium avium subsp. paratuberculosis
cgccagcgggccgu

SEQ ID NO: 1018376 - RNA, 14 nt, Mycobacterium avium subsp. paratuberculosis
cgccagcgggccga

SEQ ID NO: 1018377 - RNA, 15 nt, Mycobacterium avium subsp. paratuberculosis
cgccagcgggccgac

SEQ ID NO: 1018378 - RNA, 17 nt, Mycobacterium avium subsp. paratuberculosis
cgccagcgggccgaccu

SEQ ID NO: 1018379 - RNA, 21 nt, Mycobacterium avium subsp. paratuberculosis
cgccaguugcacuuucggcag

SEQ ID NO: 1018380 - RNA, 14 nt, Mycobacterium avium subsp. paratuberculosis
cgccaguucccggc

SEQ ID NO: 1018381 - RNA, 14 nt, Mycobacterium avium subsp. paratuberculosis
cgccaucaccagcg

SEQ ID NO: 1018382 - RNA, 20 nt, Mycobacterium avium subsp. paratuberculosis
cgccagguuggcggcggccc

SEQ ID NO: 1018383 - RNA, 17 nt, Mycobacterium avium subsp. paratuberculosis
cgccagucugagcccgg

SEQ ID NO: 1018384 - RNA, 14 nt, Mycobacterium avium subsp. paratuberculosis
cgccaggucggggc

SEQ ID NO: 1018385 - RNA, 22 nt, Mycobacterium avium subsp. paratuberculosis
cgccagggucucgggcagcagc

SEQ ID NO: 1018386 - RNA, 23 nt, Mycobacterium avium subsp. paratuberculosis
cgccagggucucgggcagcagca

SEQ ID NO: 1018387 - RNA, 14 nt, Mycobacterium avium subsp. paratuberculosis
cgccagggcgcggc

SEQ ID NO: 1018388 - RNA, 15 nt, Mycobacterium avium subsp. paratuberculosis
cgccagggccccguu

SEQ ID NO: 1018389 - RNA, 16 nt, Mycobacterium avium subsp. paratuberculosis
cgccacagcgccucgc

SEQ ID NO: 1018390 - RNA, 13 nt, Mycobacterium avium subsp. paratuberculosis
cgccacagccggg

SEQ ID NO: 1018391 - RNA, 11 nt, Mycobacterium avium subsp. paratuberculosis
cgccacagcag

SEQ ID NO: 1018392 - RNA, 19 nt, Mycobacterium avium subsp. paratuberculosis
cgccacagcagcaccagcg

SEQ ID NO: 1018393 - RNA, 12 nt, Mycobacterium avium subsp. paratuberculosis
cgcauaccagcg

SEQ ID NO: 1018394 - RNA, 15 nt, Mycobacterium avium subsp. paratuberculosis
cgcauaccgcccgcg

SEQ ID NO: 1018395 - RNA, 15 nt, Mycobacterium avium subsp. paratuberculosis
cgccaccccaggcga

SEQ ID NO: 1018396 - RNA, 13 nt, Mycobacterium avium subsp. paratuberculosis
cgccaccaggccg

SEQ ID NO: 1018397 - RNA, 15 nt, Mycobacterium avium subsp. paratuberculosis
cgccaccagcuccuc

SEQ ID NO: 1018398 - RNA, 23 nt, Mycobacterium avium subsp. paratuberculosis
cgccaccagccacaccgccgcgg

SEQ ID NO: 1018399 - RNA, 17 nt, Mycobacterium avium subsp. paratuberculosis
cgccaccagcgcacaca

SEQ ID NO: 1018400 - RNA, 14 nt, Mycobacterium avium subsp. paratuberculosis
cgccaccaccagcg

SEQ ID NO: 1018401 - RNA, 16 nt, Mycobacterium avium subsp. paratuberculosis
cgccaccaccuccucg

SEQ ID NO: 1018402 - RNA, 13 nt, Mycobacterium avium subsp. paratuberculosis
cgccaccaccgcg

SEQ ID NO: 1018403 - RNA, 20 nt, Mycobacterium avium subsp. paratuberculosis
cgccaccagcaggcccaacg

SEQ ID NO: 1018404 - RNA, 18 nt, Mycobacterium avium subsp. paratuberculosis
cgccaccggccgguccgc

SEQ ID NO: 1018405 - RNA, 20 nt, Mycobacterium avium subsp. paratuberculosis
cgccaccggccgguccgccc

SEQ ID NO: 1018406 - RNA, 13 nt, Mycobacterium avium subsp. paratuberculosis
cgccaccucggag

SEQ ID NO: 1018407 - RNA, 14 nt, Mycobacterium avium subsp. paratuberculosis
cgccaccuccuccg

SEQ ID NO: 1018408 - RNA, 15 nt, Mycobacterium avium subsp. paratuberculosis
cgccaccuccuccgg

SEQ ID NO: 1018409 - RNA, 18 nt, Mycobacterium avium subsp. paratuberculosis
cgccaccuccuccggucc

SEQ ID NO: 1018410 - RNA, 17 nt, Mycobacterium avium subsp. paratuberculosis
cgccacggggcgccgcu

SEQ ID NO: 1018411 - RNA, 18 nt, Mycobacterium avium subsp. paratuberculosis
cgccacggggcgccgcug

SEQ ID NO: 1018412 - RNA, 19 nt, Mycobacterium avium subsp. paratuberculosis
cgccacggggcgccgcugc

SEQ ID NO: 1018413 - RNA, 19 nt, Mycobacterium avium subsp. paratuberculosis
cgccacgacguacccccgc

SEQ ID NO: 1018414 - RNA, 13 nt, Mycobacterium avium subsp. paratuberculosis
cgccacgaccagc

SEQ ID NO: 1018415 - RNA, 16 nt, Mycobacterium avium subsp. paratuberculosis
cgccacgaccagcggc

SEQ ID NO: 1018416 - RNA, 13 nt, Mycobacterium avium subsp. paratuberculosis
cgccaccuucacc

SEQ ID NO: 1018417 - RNA, 18 nt, Mycobacterium avium subsp. paratuberculosis
cgccacgaucaccaccac

SEQ ID NO: 1018418 - RNA, 13 nt, Mycobacterium avium subsp. paratuberculosis
cgccacgaucugg

SEQ ID NO: 1018419 - RNA, 17 nt, Mycobacterium avium subsp. paratuberculosis
cgccacgaugcugauac

SEQ ID NO: 1018420 - RNA, 20 nt, Mycobacterium avium subsp. paratuberculosis
cgccacgcacaccgcgcgca

SEQ ID NO: 1018421 - RNA, 15 nt, Mycobacterium avium subsp. paratuberculosis
cgccacggcgacgac

SEQ ID NO: 1018422 - RNA, 13 nt, Mycobacterium avium subsp. paratuberculosis
cgccacggcgcca

SEQ ID NO: 1018423 - RNA, 19 nt, Mycobacterium avium subsp. paratuberculosis
cgccacucgggcggccgcg

SEQ ID NO: 1018424 - RNA, 17 nt, Mycobacterium avium subsp. paratuberculosis
cgccacucauguucagg

SEQ ID NO: 1018425 - RNA, 16 nt, Mycobacterium avium subsp. paratuberculosis
cgccacgugcggcugc

SEQ ID NO: 1018426 - RNA, 14 nt, Mycobacterium avium subsp. paratuberculosis
cgccagcaccgacg

SEQ ID NO: 1018427 - RNA, 16 nt, Mycobacterium avium subsp. paratuberculosis
cgccagcaccgccacc

SEQ ID NO: 1018428 - RNA, 19 nt, Mycobacterium avium subsp. paratuberculosis
cgccagcaccgccaccggc

SEQ ID NO: 1018429 - RNA, 20 nt, Mycobacterium avium subsp. paratuberculosis
cgccagcaccgccugggucu

SEQ ID NO: 1018430 - RNA, 13 nt, Mycobacterium avium subsp. paratuberculosis
cgccagcaccgcg

SEQ ID NO: 1018431 - RNA, 15 nt, Mycobacterium avium subsp. paratuberculosis
cgccagcaccgcggg

SEQ ID NO: 1018432 - RNA, 18 nt, Mycobacterium avium subsp. paratuberculosis
cgccagcaccgcgggggc

SEQ ID NO: 1018433 - RNA, 22 nt, Mycobacterium avium subsp. paratuberculosis
cgccagcaccgcgggggcggcc

SEQ ID NO: 1018434 - RNA, 16 nt, Mycobacterium avium subsp. paratuberculosis
cgccagcagcgccgcu

SEQ ID NO: 1018435 - RNA, 19 nt, Mycobacterium avium subsp. paratuberculosis
cgccagcagaugccgccca

SEQ ID NO: 1018436 - RNA, 14 nt, Mycobacterium avium subsp. paratuberculosis
cgccagcagcaacg

SEQ ID NO: 1018437 - RNA, 20 nt, Mycobacterium avium subsp. paratuberculosis
cgccagcagcagcgcggcau

SEQ ID NO: 1018438 - RNA, 16 nt, Mycobacterium avium subsp. paratuberculosis
cgccagcacggccacc

SEQ ID NO: 1018439 - RNA, 23 nt, Mycobacterium avium subsp. paratuberculosis
cgccagcacgguguugcgcaccc

SEQ ID NO: 1018440 - RNA, 14 nt, Mycobacterium avium subsp. paratuberculosis
cgccagcacguggc

SEQ ID NO: 1018441 - RNA, 16 nt, Mycobacterium avium subsp. paratuberculosis
cgccagcaccggcgcg

SEQ ID NO: 1018442 - RNA, 20 nt, Mycobacterium avium subsp. paratuberculosis
cgccagcaccgugcugaucc

SEQ ID NO: 1018443 - RNA, 20 nt, Mycobacterium avium subsp. paratuberculosis
cgccagcaccuucgggccga

SEQ ID NO: 1018444 - RNA, 21 nt, Mycobacterium avium subsp. paratuberculosis
cgccagcaccucgcggcagcc

SEQ ID NO: 1018445 - RNA, 18 nt, Mycobacterium avium subsp. paratuberculosis
cgccagcaguguccaguc

SEQ ID NO: 1018446 - RNA, 12 nt, Mycobacterium avium subsp. paratuberculosis
cgccagcagccg

SEQ ID NO: 1018447 - RNA, 24 nt, Mycobacterium avium subsp. paratuberculosis
cgccagccagccggugcggucggc

SEQ ID NO: 1018448 - RNA, 18 nt, Mycobacterium avium subsp. paratuberculosis
cgccagccccaccggcca

SEQ ID NO: 1018449 - RNA, 20 nt, Mycobacterium avium subsp. paratuberculosis
cgccagccccaccggccacu

SEQ ID NO: 1018450 - RNA, 14 nt, Mycobacterium avium subsp. paratuberculosis
cgccagccagaaca

SEQ ID NO: 1018451 - RNA, 13 nt, Mycobacterium avium subsp. paratuberculosis
cgccagccaccac

SEQ ID NO: 1018452 - RNA, 21 nt, Mycobacterium avium subsp. paratuberculosis
cgccagccgguacggaucgcc

SEQ ID NO: 1018453 - RNA, 17 nt, Mycobacterium avium subsp. paratuberculosis
cgccagccguccugguc

SEQ ID NO: 1018454 - RNA, 16 nt, Mycobacterium avium subsp. paratuberculosis
cgccagccgucgccgc

SEQ ID NO: 1018455 - RNA, 14 nt, Mycobacterium avium subsp. paratuberculosis
cgccagccgccggc

SEQ ID NO: 1018456 - RNA, 21 nt, Mycobacterium avium subsp. paratuberculosis
cgccagcccgaaaguccccgg

SEQ ID NO: 1018457 - RNA, 14 nt, Mycobacterium avium subsp. paratuberculosis
cgccagcccgccga

SEQ ID NO: 1018458 - RNA, 12 nt, Mycobacterium avium subsp. paratuberculosis
cgccagcccgcc

SEQ ID NO: 1018459 - RNA, 14 nt, Mycobacterium avium subsp. paratuberculosis
cgccagcccgccca

SEQ ID NO: 1018460 - RNA, 16 nt, Mycobacterium avium subsp. paratuberculosis
cgccagcccgcccagc

SEQ ID NO: 1018461 - RNA, 22 nt, Mycobacterium avium subsp. paratuberculosis
cgcccccgauagccccgccagg

SEQ ID NO: 1018462 - RNA, 23 nt, Mycobacterium avium subsp. paratuberculosis
cgcccccgauagccccgccaggc

SEQ ID NO: 1018463 - RNA, 17 nt, Mycobacterium avium subsp. paratuberculosis
cgccccagccccucgcc

SEQ ID NO: 1018464 - RNA, 14 nt, Mycobacterium avium subsp. paratuberculosis
cgccccaggcgccc

SEQ ID NO: 1018465 - RNA, 22 nt, Mycobacterium avium subsp. paratuberculosis
cgccccgacgugcagcgccagc

SEQ ID NO: 1018466 - RNA, 15 nt, Mycobacterium avium subsp. paratuberculosis
cgccccgagcagcgg

SEQ ID NO: 1018467 - RNA, 22 nt, Mycobacterium avium subsp. paratuberculosis
cgccccgcaaccguucaacggc

SEQ ID NO: 1018468 - RNA, 16 nt, Mycobacterium avium subsp. paratuberculosis
cgcccccucggccggu

SEQ ID NO: 1018469 - RNA, 18 nt, Mycobacterium avium subsp. paratuberculosis
cgcccccucggccggucc

SEQ ID NO: 1018470 - RNA, 20 nt, Mycobacterium avium subsp. paratuberculosis
cgcccccucggccgguccga

SEQ ID NO: 1018471 - RNA, 14 nt, Mycobacterium avium subsp. paratuberculosis
cgcccccgcggcgg

SEQ ID NO: 1018472 - RNA, 22 nt, Mycobacterium avium subsp. paratuberculosis
cgccccagcacgaucccgccgc

SEQ ID NO: 1018473 - RNA, 18 nt, Mycobacterium avium subsp. paratuberculosis
cgccccacggcgcgugcu

SEQ ID NO: 1018474 - RNA, 16 nt, Mycobacterium avium subsp. paratuberculosis
cgccccggaguagacc

SEQ ID NO: 1018475 - RNA, 17 nt, Mycobacterium avium subsp. paratuberculosis
cgccccgcugccggacc

SEQ ID NO: 1018476 - RNA, 16 nt, Mycobacterium avium subsp. paratuberculosis
cgccccggcccggcga

SEQ ID NO: 1018477 - RNA, 14 nt, Mycobacterium avium subsp. paratuberculosis
cgccccggccgcgg

SEQ ID NO: 1018478 - RNA, 15 nt, Mycobacterium avium subsp. paratuberculosis
cgccccggccgcggu

SEQ ID NO: 1018479 - RNA, 12 nt, Mycobacterium avium subsp. paratuberculosis
cgccccggccgu

SEQ ID NO: 1018480 - RNA, 13 nt, Mycobacterium avium subsp. paratuberculosis
cgccccgcgccuc

SEQ ID NO: 1018481 - RNA, 21 nt, Mycobacterium avium subsp. paratuberculosis
cgccccgaucggauccgccug

SEQ ID NO: 1018482 - RNA, 12 nt, Mycobacterium avium subsp. paratuberculosis
cgccccgcccgg

SEQ ID NO: 1018483 - RNA, 17 nt, Mycobacterium avium subsp. paratuberculosis
cgccccgcccggcggcc

SEQ ID NO: 1018484 - RNA, 17 nt, Mycobacterium avium subsp. paratuberculosis
cgccccggucaccccgg

SEQ ID NO: 1018485 - RNA, 20 nt, Mycobacterium avium subsp. paratuberculosis
cgccccggucaccccggcca

SEQ ID NO: 1018486 - RNA, 14 nt, Mycobacterium avium subsp. paratuberculosis
cgccccgguccggc

SEQ ID NO: 1018487 - RNA, 17 nt, Mycobacterium avium subsp. paratuberculosis
cgccccgguccggcuga

SEQ ID NO: 1018488 - RNA, 21 nt, Mycobacterium avium subsp. paratuberculosis
cgccccggcggccacgcaggc

SEQ ID NO: 1018489 - RNA, 19 nt, Mycobacterium avium subsp. paratuberculosis
cgccccggcgggcggccga

SEQ ID NO: 1018490 - RNA, 15 nt, Mycobacterium avium subsp. paratuberculosis
cgccccggcgggucu

SEQ ID NO: 1018491 - RNA, 23 nt, Mycobacterium avium subsp. paratuberculosis
cgccccggcgccgucguucucca

SEQ ID NO: 1018492 - RNA, 15 nt, Mycobacterium avium subsp. paratuberculosis
cgccccggcgcgccu

SEQ ID NO: 1018493 - RNA, 21 nt, Mycobacterium avium subsp. paratuberculosis
cgccccggcgcgccugcgcgg

SEQ ID NO: 1018494 - RNA, 18 nt, Mycobacterium avium subsp. paratuberculosis
cgcccgacauccaggacc

SEQ ID NO: 1018495 - RNA, 13 nt, Mycobacterium avium subsp. paratuberculosis
cgccccuccaggc

SEQ ID NO: 1018496 - RNA, 16 nt, Mycobacterium avium subsp. paratuberculosis
cgcccgacgccggacc

SEQ ID NO: 1018497 - RNA, 22 nt, Mycobacterium avium subsp. paratuberculosis
cgcccgagcgucauuccgccgc

SEQ ID NO: 1018498 - RNA, 18 nt, Mycobacterium avium subsp. paratuberculosis
cgcccgacggucgccacc

SEQ ID NO: 1018499 - RNA, 21 nt, Mycobacterium avium subsp. paratuberculosis
cgcccgaucaucucaccgacg

SEQ ID NO: 1018500 - RNA, 16 nt, Mycobacterium avium subsp. paratuberculosis
cgcccgaucccgggcc

SEQ ID NO: 1018501 - RNA, 21 nt, Mycobacterium avium subsp. paratuberculosis
cgcccgcugaccgccgcgcuc

SEQ ID NO: 1018502 - RNA, 17 nt, Mycobacterium avium subsp. paratuberculosis
cgcccgcguugcggcgc

SEQ ID NO: 1018503 - RNA, 16 nt, Mycobacterium avium subsp. paratuberculosis
cgcccgcuccggcgga

SEQ ID NO: 1018504 - RNA, 19 nt, Mycobacterium avium subsp. paratuberculosis
cgcccgcucgacggccggu

SEQ ID NO: 1018505 - RNA, 20 nt, Mycobacterium avium subsp. paratuberculosis
cgcccggcccggcgcggccg

SEQ ID NO: 1018506 - RNA, 14 nt, Mycobacterium avium subsp. paratuberculosis
cgcccggccggccc

SEQ ID NO: 1018507 - RNA, 15 nt, Mycobacterium avium subsp. paratuberculosis
cgcccggcaacacgu

SEQ ID NO: 1018508 - RNA, 16 nt, Mycobacterium avium subsp. paratuberculosis
cgcccggcccagccgc

SEQ ID NO: 1018509 - RNA, 22 nt, Mycobacterium avium subsp. paratuberculosis
cgcccggaccaggguggcccca

SEQ ID NO: 1018510 - RNA, 18 nt, Mycobacterium avium subsp. paratuberculosis
cgcccggacccgcucgcc

SEQ ID NO: 1018511 - RNA, 23 nt, Mycobacterium avium subsp. paratuberculosis
cgcccggaccggcucguagcugg

SEQ ID NO: 1018512 - RNA, 14 nt, Mycobacterium avium subsp. paratuberculosis
cgcccggagaacuc

SEQ ID NO: 1018513 - RNA, 18 nt, Mycobacterium avium subsp. paratuberculosis
cgcccggaucagcugacc

SEQ ID NO: 1018514 - RNA, 13 nt, Mycobacterium avium subsp. paratuberculosis
cgcccggccagcc

SEQ ID NO: 1018515 - RNA, 20 nt, Mycobacterium avium subsp. paratuberculosis
cgcccggccagccggccgcu

SEQ ID NO: 1018516 - RNA, 22 nt, Mycobacterium avium subsp. paratuberculosis
cgcccggcggcgcugccccagc

SEQ ID NO: 1018517 - RNA, 13 nt, Mycobacterium avium subsp. paratuberculosis
cgcccggcgcggc

SEQ ID NO: 1018518 - RNA, 14 nt, Mycobacterium avium subsp. paratuberculosis
cgcccggcgcggca

SEQ ID NO: 1018519 - RNA, 14 nt, Mycobacterium avium subsp. paratuberculosis
cgcccggcgccggc

SEQ ID NO: 1018520 - RNA, 16 nt, Mycobacterium avium subsp. paratuberculosis
cgcccggcgccggccc

SEQ ID NO: 1018521 - RNA, 16 nt, Mycobacterium avium subsp. paratuberculosis
cgcccggcgccggcgg

SEQ ID NO: 1018522 - RNA, 23 nt, Mycobacterium avium subsp. paratuberculosis
cgcccggcgccggcggccacgcu

SEQ ID NO: 1018523 - RNA, 13 nt, Mycobacterium avium subsp. paratuberculosis
cgcccggcgccga

SEQ ID NO: 1018524 - RNA, 14 nt, Mycobacterium avium subsp. paratuberculosis
cgcccggcgccgau

SEQ ID NO: 1018525 - RNA, 16 nt, Mycobacterium avium subsp. paratuberculosis
cgcccggcgcgccgca

SEQ ID NO: 1018526 - RNA, 20 nt, Mycobacterium avium subsp. paratuberculosis
cgcccggcgacgcggcggga

SEQ ID NO: 1018527 - RNA, 18 nt, Mycobacterium avium subsp. paratuberculosis
cgcccggcgcccggccgg

SEQ ID NO: 1018528 - RNA, 18 nt, Mycobacterium avium subsp. paratuberculosis
cgcccggcgcccggcgcg

SEQ ID NO: 1018529 - RNA, 17 nt, Mycobacterium avium subsp. paratuberculosis
cgcccggguagggcagc

SEQ ID NO: 1018530 - RNA, 17 nt, Mycobacterium avium subsp. paratuberculosis
cgcccgggugcaggccc

SEQ ID NO: 1018531 - RNA, 16 nt, Mycobacterium avium subsp. paratuberculosis
cgcccgggcggcccgc

SEQ ID NO: 1018532 - RNA, 18 nt, Mycobacterium avium subsp. paratuberculosis
cgcccgggcggcccgcau

SEQ ID NO: 1018533 - RNA, 19 nt, Mycobacterium avium subsp. paratuberculosis
cgcccgggcguucccgcgc

SEQ ID NO: 1018534 - RNA, 22 nt, Mycobacterium avium subsp. paratuberculosis
cgcccgggcguucccgcgcgcg

SEQ ID NO: 1018535 - RNA, 20 nt, Mycobacterium avium subsp. paratuberculosis
cgcccgggcuaucgcccggc

SEQ ID NO: 1018536 - RNA, 17 nt, Mycobacterium avium subsp. paratuberculosis
cgcccggggcgcggacc

SEQ ID NO: 1018537 - RNA, 13 nt, Mycobacterium avium subsp. paratuberculosis
cgcccggggcggc

SEQ ID NO: 1018538 - RNA, 12 nt, Mycobacterium avium subsp. paratuberculosis
cgcccgggcggc

SEQ ID NO: 1018539 - RNA, 19 nt, Mycobacterium avium subsp. paratuberculosis
cgcccggcuucgccgccgc

SEQ ID NO: 1018540 - RNA, 16 nt, Mycobacterium avium subsp. paratuberculosis
cgcccggcggccacca

SEQ ID NO: 1018541 - RNA, 19 nt, Mycobacterium avium subsp. paratuberculosis
cgcccggcugcgccgcgcu

SEQ ID NO: 1018542 - RNA, 13 nt, Mycobacterium avium subsp. paratuberculosis
cgcccgcaccacg

SEQ ID NO: 1018543 - RNA, 16 nt, Mycobacterium avium subsp. paratuberculosis
cgcccgcaccacgacc

SEQ ID NO: 1018544 - RNA, 13 nt, Mycobacterium avium subsp. paratuberculosis
cgcccgauggagg

SEQ ID NO: 1018545 - RNA, 16 nt, Mycobacterium avium subsp. paratuberculosis
cgcccgauuccccggc

SEQ ID NO: 1018546 - RNA, 18 nt, Mycobacterium avium subsp. paratuberculosis
cgcccgcaggccgcgagc

SEQ ID NO: 1018547 - RNA, 15 nt, Mycobacterium avium subsp. paratuberculosis
cgcccgcaccugcgc

SEQ ID NO: 1018548 - RNA, 15 nt, Mycobacterium avium subsp. paratuberculosis
cgcccgcaguucggc

SEQ ID NO: 1018549 - RNA, 19 nt, Mycobacterium avium subsp. paratuberculosis
cgcccgcaguucggccgcc

SEQ ID NO: 1018550 - RNA, 14 nt, Mycobacterium avium subsp. paratuberculosis
cgcccgccaucugg

SEQ ID NO: 1018551 - RNA, 13 nt, Mycobacterium avium subsp. paratuberculosis
cgcccgcccaggc

SEQ ID NO: 1018552 - RNA, 16 nt, Mycobacterium avium subsp. paratuberculosis
cgcccgcccggcacga

SEQ ID NO: 1018553 - RNA, 13 nt, Mycobacterium avium subsp. paratuberculosis
cgcccgccgccac

SEQ ID NO: 1018554 - RNA, 14 nt, Mycobacterium avium subsp. paratuberculosis
cgcccgccgcgagc

SEQ ID NO: 1018555 - RNA, 23 nt, Mycobacterium avium subsp. paratuberculosis
cgcccgccgcguacaccggcuga

SEQ ID NO: 1018556 - RNA, 19 nt, Mycobacterium avium subsp. paratuberculosis
cgcccgccgggcacccggg

SEQ ID NO: 1018557 - RNA, 13 nt, Mycobacterium avium subsp. paratuberculosis
cgcccgcgccacc

SEQ ID NO: 1018558 - RNA, 15 nt, Mycobacterium avium subsp. paratuberculosis
cgcccgcgccacccc

SEQ ID NO: 1018559 - RNA, 16 nt, Mycobacterium avium subsp. paratuberculosis
cgcccgcgccaccccg

SEQ ID NO: 1018560 - RNA, 17 nt, Mycobacterium avium subsp. paratuberculosis
cgcccgcgucguggccc

SEQ ID NO: 1018561 - RNA, 23 nt, Mycobacterium avium subsp. paratuberculosis
cgcccgcgguggaacccagcacc

SEQ ID NO: 1018562 - RNA, 14 nt, Mycobacterium avium subsp. paratuberculosis
cgcccgcggccucc

SEQ ID NO: 1018563 - RNA, 17 nt, Mycobacterium avium subsp. paratuberculosis
cgcccgcggccuccagc

SEQ ID NO: 1018564 - RNA, 20 nt, Mycobacterium avium subsp. paratuberculosis
cgcccgcggccuccagccgc

SEQ ID NO: 1018565 - RNA, 22 nt, Mycobacterium avium subsp. paratuberculosis
cgcccgcggccuccagccgcuc

SEQ ID NO: 1018566 - RNA, 14 nt, Mycobacterium avium subsp. paratuberculosis
cgcccgcgcgggcu

SEQ ID NO: 1018567 - RNA, 13 nt, Mycobacterium avium subsp. paratuberculosis
cgcccgcgcggcg

SEQ ID NO: 1018568 - RNA, 14 nt, Mycobacterium avium subsp. paratuberculosis
cgccaucgccucgg

SEQ ID NO: 1018569 - RNA, 14 nt, Mycobacterium avium subsp. paratuberculosis
cgccaucgcggcgu

SEQ ID NO: 1018570 - RNA, 18 nt, Mycobacterium avium subsp. paratuberculosis
cgccaucgcaccgcgagc

SEQ ID NO: 1018571 - RNA, 14 nt, Mycobacterium avium subsp. paratuberculosis
cgccaucuccuccg

SEQ ID NO: 1018572 - RNA, 17 nt, Mycobacterium avium subsp. paratuberculosis
cgccaucagcagcgccu

SEQ ID NO: 1018573 - RNA, 23 nt, Mycobacterium avium subsp. paratuberculosis
cgccauugucggaucgcuugacc

SEQ ID NO: 1018574 - RNA, 13 nt, Mycobacterium avium subsp. paratuberculosis
cgcccacagcaac

SEQ ID NO: 1018575 - RNA, 22 nt, Mycobacterium avium subsp. paratuberculosis
cgcccacaccgacaccggccgg

SEQ ID NO: 1018576 - RNA, 14 nt, Mycobacterium avium subsp. paratuberculosis
cgccaugcgccgcg

SEQ ID NO: 1018577 - RNA, 20 nt, Mycobacterium avium subsp. paratuberculosis
cgccaugcuggcacuccuug

SEQ ID NO: 1018578 - RNA, 14 nt, Mycobacterium avium subsp. paratuberculosis
cgccaugccgccga

SEQ ID NO: 1018579 - RNA, 16 nt, Mycobacterium avium subsp. paratuberculosis
cgccaugugccggcgc

SEQ ID NO: 1018580 - RNA, 20 nt, Mycobacterium avium subsp. paratuberculosis
cgccauggcggcauccccag

SEQ ID NO: 1018581 - RNA, 21 nt, Mycobacterium avium subsp. paratuberculosis
cgccauguccggcaggcucag

SEQ ID NO: 1018582 - RNA, 17 nt, Mycobacterium avium subsp. paratuberculosis
cgcccaucaccgcaccg

SEQ ID NO: 1018583 - RNA, 13 nt, Mycobacterium avium subsp. paratuberculosis
cgcccaucagcag

SEQ ID NO: 1018584 - RNA, 15 nt, Mycobacterium avium subsp. paratuberculosis
cgcccaucgcggccg

SEQ ID NO: 1018585 - RNA, 18 nt, Mycobacterium avium subsp. paratuberculosis
cgcccaucgcggccgccc

SEQ ID NO: 1018586 - RNA, 19 nt, Mycobacterium avium subsp. paratuberculosis
cgcccaugcacgaucuccc

SEQ ID NO: 1018587 - RNA, 15 nt, Mycobacterium avium subsp. paratuberculosis
cgcccaugcccaugu

SEQ ID NO: 1018588 - RNA, 17 nt, Mycobacterium avium subsp. paratuberculosis
cgcccagugcgcgccgu

SEQ ID NO: 1018589 - RNA, 17 nt, Mycobacterium avium subsp. paratuberculosis
cgcccagguccaccagg

SEQ ID NO: 1018590 - RNA, 16 nt, Mycobacterium avium subsp. paratuberculosis
cgcccagcgccgcggc

SEQ ID NO: 1018591 - RNA, 23 nt, Mycobacterium avium subsp. paratuberculosis
cgcccagcguggucacccgcagc

SEQ ID NO: 1018592 - RNA, 23 nt, Mycobacterium avium subsp. paratuberculosis
cgcccagcugcacccaccggccc

SEQ ID NO: 1018593 - RNA, 16 nt, Mycobacterium avium subsp. paratuberculosis
cgcccagcgcagcgcc

SEQ ID NO: 1018594 - RNA, 17 nt, Mycobacterium avium subsp. paratuberculosis
cgcccagcgcagcgccu

SEQ ID NO: 1018595 - RNA, 18 nt, Mycobacterium avium subsp. paratuberculosis
cgcccagcgcagcgccuc

SEQ ID NO: 1018596 - RNA, 21 nt, Mycobacterium avium subsp. paratuberculosis
cgcccagcgcagcgccucggc

SEQ ID NO: 1018597 - RNA, 15 nt, Mycobacterium avium subsp. paratuberculosis
cgcccagcgcggcgg

SEQ ID NO: 1018598 - RNA, 16 nt, Mycobacterium avium subsp. paratuberculosis
cgcccagcgcggcggc

SEQ ID NO: 1018599 - RNA, 17 nt, Mycobacterium avium subsp. paratuberculosis
cgcccagcgcggcggcc

SEQ ID NO: 1018600 - RNA, 22 nt, Mycobacterium avium subsp. paratuberculosis
cgcccagcgcggcggccaccuc

SEQ ID NO: 1018601 - RNA, 13 nt, Mycobacterium avium subsp. paratuberculosis
cgcccagcggcac

SEQ ID NO: 1018602 - RNA, 17 nt, Mycobacterium avium subsp. paratuberculosis
cgcccagcggccccggc

SEQ ID NO: 1018603 - RNA, 16 nt, Mycobacterium avium subsp. paratuberculosis
cgcccaggggagcggc

SEQ ID NO: 1018604 - RNA, 11 nt, Mycobacterium avium subsp. paratuberculosis
cgcccaggcuc

SEQ ID NO: 1018605 - RNA, 18 nt, Mycobacterium avium subsp. paratuberculosis
cgcccagggcgugcgcgg

SEQ ID NO: 1018606 - RNA, 16 nt, Mycobacterium avium subsp. paratuberculosis
cgcccaggccgccagc

SEQ ID NO: 1018607 - RNA, 21 nt, Mycobacterium avium subsp. paratuberculosis
cgcccaggaacgcgccggcgc

SEQ ID NO: 1018608 - RNA, 15 nt, Mycobacterium avium subsp. paratuberculosis
cgcccaggaacuggu

SEQ ID NO: 1018609 - RNA, 21 nt, Mycobacterium avium subsp. paratuberculosis
cgcccagcagcgggcccgggc

SEQ ID NO: 1018610 - RNA, 23 nt, Mycobacterium avium subsp. paratuberculosis
cgcccagcagcugcgcgucgaag

SEQ ID NO: 1018611 - RNA, 17 nt, Mycobacterium avium subsp. paratuberculosis
cgcccagaucggccagc

SEQ ID NO: 1018612 - RNA, 12 nt, Mycobacterium avium subsp. paratuberculosis
cgcccagauguu

SEQ ID NO: 1018613 - RNA, 20 nt, Mycobacterium avium subsp. paratuberculosis
cgcccagcaaacccagcacc

SEQ ID NO: 1018614 - RNA, 14 nt, Mycobacterium avium subsp. paratuberculosis
cgcccagcacccgg

SEQ ID NO: 1018615 - RNA, 15 nt, Mycobacterium avium subsp. paratuberculosis
cgcccagcacccggu

SEQ ID NO: 1018616 - RNA, 20 nt, Mycobacterium avium subsp. paratuberculosis
cgcccagcaccgucugcgcc

SEQ ID NO: 1018617 - RNA, 21 nt, Mycobacterium avium subsp. paratuberculosis
cgcccagcgagcugccggcgg

SEQ ID NO: 1018618 - RNA, 14 nt, Mycobacterium avium subsp. paratuberculosis
cgcccagccccagc

SEQ ID NO: 1018619 - RNA, 12 nt, Mycobacterium avium subsp. paratuberculosis
cgcccagccgag

SEQ ID NO: 1018620 - RNA, 17 nt, Mycobacterium avium subsp. paratuberculosis
cgcccagccgagccggg

SEQ ID NO: 1018621 - RNA, 13 nt, Mycobacterium avium subsp. paratuberculosis
cgcccagcccgag

SEQ ID NO: 1018622 - RNA, 20 nt, Mycobacterium avium subsp. paratuberculosis
cgcccagcccgagcaccagc

SEQ ID NO: 1018623 - RNA, 13 nt, Mycobacterium avium subsp. paratuberculosis
cgcccagcccgcg

SEQ ID NO: 1018624 - RNA, 19 nt, Mycobacterium avium subsp. paratuberculosis
cgcccagcccgcgggcggc

SEQ ID NO: 1018625 - RNA, 22 nt, Mycobacterium avium subsp. paratuberculosis
cgcccagacgcgggcgcccagc

SEQ ID NO: 1018626 - RNA, 23 nt, Mycobacterium avium subsp. paratuberculosis
cgcccagacgcgggcgcccagca

SEQ ID NO: 1018627 - RNA, 20 nt, Mycobacterium avium subsp. paratuberculosis
cgcccacugguaaccgcccg

SEQ ID NO: 1018628 - RNA, 21 nt, Mycobacterium avium subsp. paratuberculosis
cgcccacugguaaccgcccga

SEQ ID NO: 1018629 - RNA, 18 nt, Mycobacterium avium subsp. paratuberculosis
cgcccagaacgacgcgcu

SEQ ID NO: 1018630 - RNA, 19 nt, Mycobacterium avium subsp. paratuberculosis
cgcccagaacgacgcgcuc

SEQ ID NO: 1018631 - RNA, 18 nt, Mycobacterium avium subsp. paratuberculosis
cgcccagaacugggccgc

SEQ ID NO: 1018632 - RNA, 16 nt, Mycobacterium avium subsp. paratuberculosis
cgcccagaagccccgg

SEQ ID NO: 1018633 - RNA, 17 nt, Mycobacterium avium subsp. paratuberculosis
cgcccagaagccccggu

SEQ ID NO: 1018634 - RNA, 21 nt, Mycobacterium avium subsp. paratuberculosis
cgcccaccugguucucccguc

SEQ ID NO: 1018635 - RNA, 22 nt, Mycobacterium avium subsp. paratuberculosis
cgcccaccugguuggcccgcac

SEQ ID NO: 1018636 - RNA, 23 nt, Mycobacterium avium subsp. paratuberculosis
cgcccaccugguuggcccgcacc

SEQ ID NO: 1018637 - RNA, 15 nt, Mycobacterium avium subsp. paratuberculosis
cgcccaccgcggcgc

SEQ ID NO: 1018638 - RNA, 20 nt, Mycobacterium avium subsp. paratuberculosis
cgcccacccgccagcccgcg

SEQ ID NO: 1018639 - RNA, 13 nt, Mycobacterium avium subsp. paratuberculosis
cgcccacccgcgc

SEQ ID NO: 1018640 - RNA, 15 nt, Mycobacterium avium subsp. paratuberculosis
cgcccacccgcgcac

SEQ ID NO: 1018641 - RNA, 17 nt, Mycobacterium avium subsp. paratuberculosis
cgcccacccgcgccggc

SEQ ID NO: 1018642 - RNA, 14 nt, Mycobacterium avium subsp. paratuberculosis
cgcccaccgacgcg

SEQ ID NO: 1018643 - RNA, 15 nt, Mycobacterium avium subsp. paratuberculosis
cgcccaccacgaacg

SEQ ID NO: 1018644 - RNA, 11 nt, Mycobacterium avium subsp. paratuberculosis
ccuucaucacc

SEQ ID NO: 1018645 - RNA, 14 nt, Mycobacterium avium subsp. paratuberculosis
ccuucaucaccgcc

SEQ ID NO: 1018646 - RNA, 15 nt, Mycobacterium avium subsp. paratuberculosis
ccuucaucagcaccg

SEQ ID NO: 1018647 - RNA, 20 nt, Mycobacterium avium subsp. paratuberculosis
cgaucgacagcuccaacagc

SEQ ID NO: 1018648 - RNA, 16 nt, Mycobacterium avium subsp. paratuberculosis
cgaucgccgacgccag

SEQ ID NO: 1018649 - RNA, 17 nt, Mycobacterium avium subsp. paratuberculosis
cgaucgccgacgccagc

SEQ ID NO: 1018650 - RNA, 22 nt, Mycobacterium avium subsp. paratuberculosis
cgaucgccgagucgaucgccag

SEQ ID NO: 1018651 - RNA, 18 nt, Mycobacterium avium subsp. paratuberculosis
cgaucgccagcgcgcaga

SEQ ID NO: 1018652 - RNA, 22 nt, Mycobacterium avium subsp. paratuberculosis
cgaucgccagcgcgcagaacac

SEQ ID NO: 1018653 - RNA, 15 nt, Mycobacterium avium subsp. paratuberculosis
cgaucgccggggauc

SEQ ID NO: 1018654 - RNA, 23 nt, Mycobacterium avium subsp. paratuberculosis
cgaucgccuccgucagcgccgcc

SEQ ID NO: 1018655 - RNA, 15 nt, Mycobacterium avium subsp. paratuberculosis
cgaucgcgacggccg

SEQ ID NO: 1018656 - RNA, 15 nt, Mycobacterium avium subsp. paratuberculosis
cgaucgcgagggccg

SEQ ID NO: 1018657 - RNA, 18 nt, Mycobacterium avium subsp. paratuberculosis
cgauccgggcgccggccg

SEQ ID NO: 1018658 - RNA, 16 nt, Mycobacterium avium subsp. paratuberculosis
cgauccgguccagccc

SEQ ID NO: 1018659 - RNA, 21 nt, Mycobacterium avium subsp. paratuberculosis
cgauccccgcagcucccccgg

SEQ ID NO: 1018660 - RNA, 22 nt, Mycobacterium avium subsp. paratuberculosis
cgauccccgcagcucccccggc

SEQ ID NO: 1018661 - RNA, 12 nt, Mycobacterium avium subsp. paratuberculosis
cgaucccgccgc

SEQ ID NO: 1018662 - RNA, 14 nt, Mycobacterium avium subsp. paratuberculosis
cgaucccggccagc

SEQ ID NO: 1018663 - RNA, 15 nt, Mycobacterium avium subsp. paratuberculosis
cgaucccggccagca

SEQ ID NO: 1018664 - RNA, 15 nt, Mycobacterium avium subsp. paratuberculosis
cgauccgcgcggcca

SEQ ID NO: 1018665 - RNA, 21 nt, Mycobacterium avium subsp. paratuberculosis
cgauccgcgcggccaccagcg

SEQ ID NO: 1018666 - RNA, 15 nt, Mycobacterium avium subsp. paratuberculosis
cgauccgcgcggcga

SEQ ID NO: 1018667 - RNA, 18 nt, Mycobacterium avium subsp. paratuberculosis
cgauccgcgggccggcac

SEQ ID NO: 1018668 - RNA, 21 nt, Mycobacterium avium subsp. paratuberculosis
cgaucagggcccacagcagcc

SEQ ID NO: 1018669 - RNA, 15 nt, Mycobacterium avium subsp. paratuberculosis
cgaucaggcgcagcc

SEQ ID NO: 1018670 - RNA, 24 nt, Mycobacterium avium subsp. paratuberculosis
cgaucaggcgcagcccgagcggca

SEQ ID NO: 1018671 - RNA, 14 nt, Mycobacterium avium subsp. paratuberculosis
cgaucaggcuggac

SEQ ID NO: 1018672 - RNA, 12 nt, Mycobacterium avium subsp. paratuberculosis
cgaucagggucc

SEQ ID NO: 1018673 - RNA, 15 nt, Mycobacterium avium subsp. paratuberculosis
cgaucaggguccagg

SEQ ID NO: 1018674 - RNA, 19 nt, Mycobacterium avium subsp. paratuberculosis
cgaucauguagcgcuggua

SEQ ID NO: 1018675 - RNA, 15 nt, Mycobacterium avium subsp. paratuberculosis
cgaucauuccgccga

SEQ ID NO: 1018676 - RNA, 14 nt, Mycobacterium avium subsp. paratuberculosis
cgaucagcaccgcc

SEQ ID NO: 1018677 - RNA, 12 nt, Mycobacterium avium subsp. paratuberculosis
cgaucagcagca

SEQ ID NO: 1018678 - RNA, 15 nt, Mycobacterium avium subsp. paratuberculosis
cgaucagcagcaccu

SEQ ID NO: 1018679 - RNA, 19 nt, Mycobacterium avium subsp. paratuberculosis
cgaucagcucguggcgggc

SEQ ID NO: 1018680 - RNA, 15 nt, Mycobacterium avium subsp. paratuberculosis
cgaucagcccgccca

SEQ ID NO: 1018681 - RNA, 10 nt, Mycobacterium avium subsp. paratuberculosis
cgaucagccg

SEQ ID NO: 1018682 - RNA, 17 nt, Mycobacterium avium subsp. paratuberculosis
cgaucagcgacucgacc

SEQ ID NO: 1018683 - RNA, 15 nt, Mycobacterium avium subsp. paratuberculosis
cgaucagcggcgggc

SEQ ID NO: 1018684 - RNA, 15 nt, Mycobacterium avium subsp. paratuberculosis
cgaugauccuggccu

SEQ ID NO: 1018685 - RNA, 22 nt, Mycobacterium avium subsp. paratuberculosis
cgaugaugaaaccggccagcag

SEQ ID NO: 1018686 - RNA, 19 nt, Mycobacterium avium subsp. paratuberculosis
cgaugaugucgcccggcgg

SEQ ID NO: 1018687 - RNA, 16 nt, Mycobacterium avium subsp. paratuberculosis
cgaugcagaucaccac

SEQ ID NO: 1018688 - RNA, 13 nt, Mycobacterium avium subsp. paratuberculosis
cgaugcagggccg

SEQ ID NO: 1018689 - RNA, 18 nt, Mycobacterium avium subsp. paratuberculosis
cgaugccagacgcucuug

SEQ ID NO: 1018690 - RNA, 21 nt, Mycobacterium avium subsp. paratuberculosis
cgaugccagcgcaccgggccc

SEQ ID NO: 1018691 - RNA, 16 nt, Mycobacterium avium subsp. paratuberculosis
cgaugcgcgccagcag

SEQ ID NO: 1018692 - RNA, 17 nt, Mycobacterium avium subsp. paratuberculosis
cgaugcgcgccagcagc

SEQ ID NO: 1018693 - RNA, 14 nt, Mycobacterium avium subsp. paratuberculosis
cgaugcccagcccc

SEQ ID NO: 1018694 - RNA, 13 nt, Mycobacterium avium subsp. paratuberculosis
cgaugcgcugugc

SEQ ID NO: 1018695 - RNA, 14 nt, Mycobacterium avium subsp. paratuberculosis
cgaugcgcgguaac

SEQ ID NO: 1018696 - RNA, 15 nt, Mycobacterium avium subsp. paratuberculosis
cgaugcgcuccagca

SEQ ID NO: 1018697 - RNA, 16 nt, Mycobacterium avium subsp. paratuberculosis
cgaugcgcuccagcag

SEQ ID NO: 1018698 - RNA, 17 nt, Mycobacterium avium subsp. paratuberculosis
cgaugcgcuccagcagg

SEQ ID NO: 1018699 - RNA, 22 nt, Mycobacterium avium subsp. paratuberculosis
cgaugcgcuccagcaggcuggc

SEQ ID NO: 1018700 - RNA, 22 nt, Mycobacterium avium subsp. paratuberculosis
cgauguagagcgggauccccac

SEQ ID NO: 1018701 - RNA, 15 nt, Mycobacterium avium subsp. paratuberculosis
cgauguaggacaggu

SEQ ID NO: 1018702 - RNA, 22 nt, Mycobacterium avium subsp. paratuberculosis
cgauguaggacgccgcaccgca

SEQ ID NO: 1018703 - RNA, 18 nt, Mycobacterium avium subsp. paratuberculosis
cgauggccuucuggaagc

SEQ ID NO: 1018704 - RNA, 13 nt, Mycobacterium avium subsp. paratuberculosis
cgauggcgcggcc

SEQ ID NO: 1018705 - RNA, 16 nt, Mycobacterium avium subsp. paratuberculosis
cgauggcccaggccgc

SEQ ID NO: 1018706 - RNA, 14 nt, Mycobacterium avium subsp. paratuberculosis
cgauggcgcuggcc

SEQ ID NO: 1018707 - RNA, 19 nt, Mycobacterium avium subsp. paratuberculosis
cgaugguguagccgugccc

SEQ ID NO: 1018708 - RNA, 21 nt, Mycobacterium avium subsp. paratuberculosis
cgaugguguagccgugcccca

SEQ ID NO: 1018709 - RNA, 17 nt, Mycobacterium avium subsp. paratuberculosis
cgaugcggugccgggcc

SEQ ID NO: 1018710 - RNA, 17 nt, Mycobacterium avium subsp. paratuberculosis
cgaugcggugccgggug

SEQ ID NO: 1018711 - RNA, 12 nt, Mycobacterium avium subsp. paratuberculosis
cgaugcgggcca

SEQ ID NO: 1018712 - RNA, 15 nt, Mycobacterium avium subsp. paratuberculosis
cgaugcggggccggc

SEQ ID NO: 1018713 - RNA, 21 nt, Mycobacterium avium subsp. paratuberculosis
cgaugcggguguugcgcagcg

SEQ ID NO: 1018714 - RNA, 15 nt, Mycobacterium avium subsp. paratuberculosis
cgauggcccgcucgg

SEQ ID NO: 1018715 - RNA, 14 nt, Mycobacterium avium subsp. paratuberculosis
cgauggccaucguc

SEQ ID NO: 1018716 - RNA, 15 nt, Mycobacterium avium subsp. paratuberculosis
cgauggccucgucga

SEQ ID NO: 1018717 - RNA, 16 nt, Mycobacterium avium subsp. paratuberculosis
cgauggcccgggccac

SEQ ID NO: 1018718 - RNA, 13 nt, Mycobacterium avium subsp. paratuberculosis
cgauggccaccgg

SEQ ID NO: 1018719 - RNA, 15 nt, Mycobacterium avium subsp. paratuberculosis
cgaucgucaggucuu

SEQ ID NO: 1018720 - RNA, 16 nt, Mycobacterium avium subsp. paratuberculosis
cgaucgucgaccacca

SEQ ID NO: 1018721 - RNA, 18 nt, Mycobacterium avium subsp. paratuberculosis
cgaucgguguccagccgc

SEQ ID NO: 1018722 - RNA, 16 nt, Mycobacterium avium subsp. paratuberculosis
cgaucgggaacagccc

SEQ ID NO: 1018723 - RNA, 17 nt, Mycobacterium avium subsp. paratuberculosis
cgaucggggcgcagccc

SEQ ID NO: 1018724 - RNA, 20 nt, Mycobacterium avium subsp. paratuberculosis
cgaucggggcgcagcccggc

SEQ ID NO: 1018725 - RNA, 14 nt, Mycobacterium avium subsp. paratuberculosis
cgaucggcuccagc

SEQ ID NO: 1018726 - RNA, 14 nt, Mycobacterium avium subsp. paratuberculosis
cgaucggcucgagc

SEQ ID NO: 1018727 - RNA, 14 nt, Mycobacterium avium subsp. paratuberculosis
cgaucggcgcggcg

SEQ ID NO: 1018728 - RNA, 15 nt, Mycobacterium avium subsp. paratuberculosis
cgaucggcgcggcga

SEQ ID NO: 1018729 - RNA, 18 nt, Mycobacterium avium subsp. paratuberculosis
cgaucgcguucugcacca

SEQ ID NO: 1018730 - RNA, 12 nt, Mycobacterium avium subsp. paratuberculosis
cgaucgcggcca

SEQ ID NO: 1018731 - RNA, 15 nt, Mycobacterium avium subsp. paratuberculosis
cgaucgcgccggccg

SEQ ID NO: 1018732 - RNA, 20 nt, Mycobacterium avium subsp. paratuberculosis
cgaucucgccgaaggccggg

SEQ ID NO: 1018733 - RNA, 18 nt, Mycobacterium avium subsp. paratuberculosis
cgaucucgauggccacgc

SEQ ID NO: 1018734 - RNA, 15 nt, Mycobacterium avium subsp. paratuberculosis
cgaucugggccagga

SEQ ID NO: 1018735 - RNA, 22 nt, Mycobacterium avium subsp. paratuberculosis
cgaucugcgucauggagaucac

SEQ ID NO: 1018736 - RNA, 22 nt, Mycobacterium avium subsp. paratuberculosis
cgaugaacgggauggagccgcc

SEQ ID NO: 1018737 - RNA, 17 nt, Mycobacterium avium subsp. paratuberculosis
cgaugaauccgcgcagc

SEQ ID NO: 1018738 - RNA, 20 nt, Mycobacterium avium subsp. paratuberculosis
cgaugaauccgcgcagcagc

SEQ ID NO: 1018739 - RNA, 21 nt, Mycobacterium avium subsp. paratuberculosis
cgaugaccacccucagggagc

SEQ ID NO: 1018740 - RNA, 14 nt, Mycobacterium avium subsp. paratuberculosis
cgaugaccagcgcg

SEQ ID NO: 1018741 - RNA, 14 nt, Mycobacterium avium subsp. paratuberculosis
cgaugaccggcccg

SEQ ID NO: 1018742 - RNA, 18 nt, Mycobacterium avium subsp. paratuberculosis
cgaugacccaccagccga

SEQ ID NO: 1018743 - RNA, 15 nt, Mycobacterium avium subsp. paratuberculosis
cgaugaccgcggcgg

SEQ ID NO: 1018744 - RNA, 16 nt, Mycobacterium avium subsp. paratuberculosis
cgaugaccucgcacag

SEQ ID NO: 1018745 - RNA, 15 nt, Mycobacterium avium subsp. paratuberculosis
cgaugacguccacca

SEQ ID NO: 1018746 - RNA, 17 nt, Mycobacterium avium subsp. paratuberculosis
cgaugacguccaccagg

SEQ ID NO: 1018747 - RNA, 16 nt, Mycobacterium avium subsp. paratuberculosis
cgauuacgaccaguuc

SEQ ID NO: 1018748 - RNA, 23 nt, Mycobacterium avium subsp. paratuberculosis
cgcaaagacauucggggccacca

SEQ ID NO: 1018749 - RNA, 15 nt, Mycobacterium avium subsp. paratuberculosis
cgcaacaccagcacg

SEQ ID NO: 1018750 - RNA, 22 nt, Mycobacterium avium subsp. paratuberculosis
cgcaacgugcgccggccuaccu

SEQ ID NO: 1018751 - RNA, 14 nt, Mycobacterium avium subsp. paratuberculosis
cgcaacgcggcggu

SEQ ID NO: 1018752 - RNA, 20 nt, Mycobacterium avium subsp. paratuberculosis
cgcaacgggccgcagccgcg

SEQ ID NO: 1018753 - RNA, 17 nt, Mycobacterium avium subsp. paratuberculosis
cgcacaccagcacggcg

SEQ ID NO: 1018754 - RNA, 13 nt, Mycobacterium avium subsp. paratuberculosis
cgcacaccaccac

SEQ ID NO: 1018755 - RNA, 16 nt, Mycobacterium avium subsp. paratuberculosis
cgcaaguagcgcucca

SEQ ID NO: 1018756 - RNA, 24 nt, Mycobacterium avium subsp. paratuberculosis
cgcaaggugauucgcgcggcgccc

SEQ ID NO: 1018757 - RNA, 15 nt, Mycobacterium avium subsp. paratuberculosis
cgcaccuucccggcc

SEQ ID NO: 1018758 - RNA, 17 nt, Mycobacterium avium subsp. paratuberculosis
cgcaccuggucggucag

SEQ ID NO: 1018759 - RNA, 13 nt, Mycobacterium avium subsp. paratuberculosis
cgcacgaaaccgc

SEQ ID NO: 1018760 - RNA, 22 nt, Mycobacterium avium subsp. paratuberculosis
cgcaccuggcagcauccgccga

SEQ ID NO: 1018761 - RNA, 19 nt, Mycobacterium avium subsp. paratuberculosis
cgcaccuggcgcagcaccg

SEQ ID NO: 1018762 - RNA, 18 nt, Mycobacterium avium subsp. paratuberculosis
cgcaccugcggccccugc

SEQ ID NO: 1018763 - RNA, 13 nt, Mycobacterium avium subsp. paratuberculosis
cgcacccuugacu

SEQ ID NO: 1018764 - RNA, 15 nt, Mycobacterium avium subsp. paratuberculosis
cgcaccucgcccggc

SEQ ID NO: 1018765 - RNA, 15 nt, Mycobacterium avium subsp. paratuberculosis
cgcaccucgccggcc

SEQ ID NO: 1018766 - RNA, 19 nt, Mycobacterium avium subsp. paratuberculosis
cgcaccucgcucagcccgg

SEQ ID NO: 1018767 - RNA, 18 nt, Mycobacterium avium subsp. paratuberculosis
cgcaccucggggcguggc

SEQ ID NO: 1018768 - RNA, 18 nt, Mycobacterium avium subsp. paratuberculosis
cgcaccugaaccgcgcac

SEQ ID NO: 1018769 - RNA, 14 nt, Mycobacterium avium subsp. paratuberculosis
cgcacgccggcggg

SEQ ID NO: 1018770 - RNA, 17 nt, Mycobacterium avium subsp. paratuberculosis
cgcacgccggcgggggu

SEQ ID NO: 1018771 - RNA, 15 nt, Mycobacterium avium subsp. paratuberculosis
cgcacaccgcggcgg

SEQ ID NO: 1018772 - RNA, 19 nt, Mycobacterium avium subsp. paratuberculosis
cgcacagauacgcgacgaa

SEQ ID NO: 1018773 - RNA, 23 nt, Mycobacterium avium subsp. paratuberculosis
cgcacagauacgcgacgaaccgc

SEQ ID NO: 1018774 - RNA, 12 nt, Mycobacterium avium subsp. paratuberculosis
cgcacagcacca

SEQ ID NO: 1018775 - RNA, 22 nt, Mycobacterium avium subsp. paratuberculosis
cgcacagcguuauccaccaggu

SEQ ID NO: 1018776 - RNA, 21 nt, Mycobacterium avium subsp. paratuberculosis
cgcacagcuaggucguggcgc

SEQ ID NO: 1018777 - RNA, 12 nt, Mycobacterium avium subsp. paratuberculosis
cgcacagcgcca

SEQ ID NO: 1018778 - RNA, 13 nt, Mycobacterium avium subsp. paratuberculosis
cgcaccagcaccc

SEQ ID NO: 1018779 - RNA, 19 nt, Mycobacterium avium subsp. paratuberculosis
cgcaccagcaccccgccgc

SEQ ID NO: 1018780 - RNA, 22 nt, Mycobacterium avium subsp. paratuberculosis
cgcaccacgucggguucgccgg

SEQ ID NO: 1018781 - RNA, 23 nt, Mycobacterium avium subsp. paratuberculosis
cgcaccaggccgacgcuggccga

SEQ ID NO: 1018782 - RNA, 14 nt, Mycobacterium avium subsp. paratuberculosis
cgcaccagggccgc

SEQ ID NO: 1018783 - RNA, 17 nt, Mycobacterium avium subsp. paratuberculosis
cgcaccagggccgcgag

SEQ ID NO: 1018784 - RNA, 20 nt, Mycobacterium avium subsp. paratuberculosis
cgcaccagggccugcagcac

SEQ ID NO: 1018785 - RNA, 11 nt, Mycobacterium avium subsp. paratuberculosis
cgcaccaucac

SEQ ID NO: 1018786 - RNA, 21 nt, Mycobacterium avium subsp. paratuberculosis
cgcaccauccgcgacgccagc

SEQ ID NO: 1018787 - RNA, 15 nt, Mycobacterium avium subsp. paratuberculosis
cgcacccccggggcc

SEQ ID NO: 1018788 - RNA, 20 nt, Mycobacterium avium subsp. paratuberculosis
cgcacccccuccacacggca

SEQ ID NO: 1018789 - RNA, 21 nt, Mycobacterium avium subsp. paratuberculosis
cgcacccccuccacacggcag

SEQ ID NO: 1018790 - RNA, 13 nt, Mycobacterium avium subsp. paratuberculosis
cgcaccccgucca

SEQ ID NO: 1018791 - RNA, 14 nt, Mycobacterium avium subsp. paratuberculosis
cgcacccguaacac

SEQ ID NO: 1018792 - RNA, 13 nt, Mycobacterium avium subsp. paratuberculosis
cgcagaacaccac

SEQ ID NO: 1018793 - RNA, 15 nt, Mycobacterium avium subsp. paratuberculosis
cgcagaacaccagcg

SEQ ID NO: 1018794 - RNA, 22 nt, Mycobacterium avium subsp. paratuberculosis
cgcagaaaaaggccgccgcugg

SEQ ID NO: 1018795 - RNA, 19 nt, Mycobacterium avium subsp. paratuberculosis
cgcagcaucacgucggcga

SEQ ID NO: 1018796 - RNA, 22 nt, Mycobacterium avium subsp. paratuberculosis
cgcagcagguaaaccagcagcg

SEQ ID NO: 1018797 - RNA, 19 nt, Mycobacterium avium subsp. paratuberculosis
cgcagcaggugcgccagau

SEQ ID NO: 1018798 - RNA, 15 nt, Mycobacterium avium subsp. paratuberculosis
cgcagcaggcggacg

SEQ ID NO: 1018799 - RNA, 13 nt, Mycobacterium avium subsp. paratuberculosis
cgcagcagcugca

SEQ ID NO: 1018800 - RNA, 19 nt, Mycobacterium avium subsp. paratuberculosis
cgcagcagcguuccgucgg

SEQ ID NO: 1018801 - RNA, 18 nt, Mycobacterium avium subsp. paratuberculosis
cgcagcagcgccagcagc

SEQ ID NO: 1018802 - RNA, 20 nt, Mycobacterium avium subsp. paratuberculosis
cgcagcagccgcgccaccgc

SEQ ID NO: 1018803 - RNA, 23 nt, Mycobacterium avium subsp. paratuberculosis
cgcagcagcgaggccucgccgcu

SEQ ID NO: 1018804 - RNA, 12 nt, Mycobacterium avium subsp. paratuberculosis
cgcacugcuucg

SEQ ID NO: 1018805 - RNA, 22 nt, Mycobacterium avium subsp. paratuberculosis
cgcagcaucuccgagucggcgu

SEQ ID NO: 1018806 - RNA, 18 nt, Mycobacterium avium subsp. paratuberculosis
cgcagccacgagcccagc

SEQ ID NO: 1018807 - RNA, 19 nt, Mycobacterium avium subsp. paratuberculosis
cgcagccacgagcccagcc

SEQ ID NO: 1018808 - RNA, 14 nt, Mycobacterium avium subsp. paratuberculosis
cgcagccagcgcag

SEQ ID NO: 1018809 - RNA, 15 nt, Mycobacterium avium subsp. paratuberculosis
cgcagcccagccagc

SEQ ID NO: 1018810 - RNA, 16 nt, Mycobacterium avium subsp. paratuberculosis
cgcagcccagccagcg

SEQ ID NO: 1018811 - RNA, 22 nt, Mycobacterium avium subsp. paratuberculosis
cgcagcccaggcccagcagcac

SEQ ID NO: 1018812 - RNA, 22 nt, Mycobacterium avium subsp. paratuberculosis
cgcagccuucuucgccggggcc

SEQ ID NO: 1018813 - RNA, 16 nt, Mycobacterium avium subsp. paratuberculosis
cgcagcgaacgcggcu

SEQ ID NO: 1018814 - RNA, 17 nt, Mycobacterium avium subsp. paratuberculosis
cgcagccgggcggcgcu

SEQ ID NO: 1018815 - RNA, 16 nt, Mycobacterium avium subsp. paratuberculosis
cgcagccgcugcagcg

SEQ ID NO: 1018816 - RNA, 22 nt, Mycobacterium avium subsp. paratuberculosis
cgcagccgcugcagcgccgccc

SEQ ID NO: 1018817 - RNA, 14 nt, Mycobacterium avium subsp. paratuberculosis
cgcagccgcugccg

SEQ ID NO: 1018818 - RNA, 15 nt, Mycobacterium avium subsp. paratuberculosis
cgcagccgcuggccg

SEQ ID NO: 1018819 - RNA, 16 nt, Mycobacterium avium subsp. paratuberculosis
cgcagccggccaccgc

SEQ ID NO: 1018820 - RNA, 19 nt, Mycobacterium avium subsp. paratuberculosis
cgcagccggccaccgcccc

SEQ ID NO: 1018821 - RNA, 22 nt, Mycobacterium avium subsp. paratuberculosis
cgcagccggccaccgccccagc

SEQ ID NO: 1018822 - RNA, 13 nt, Mycobacterium avium subsp. paratuberculosis
cgcagccgcgccc

SEQ ID NO: 1018823 - RNA, 15 nt, Mycobacterium avium subsp. paratuberculosis
cgcagccgcgcggcc

SEQ ID NO: 1018824 - RNA, 16 nt, Mycobacterium avium subsp. paratuberculosis
cgcagccgcgcggccg

SEQ ID NO: 1018825 - RNA, 12 nt, Mycobacterium avium subsp. paratuberculosis
cgcaggcggcca

SEQ ID NO: 1018826 - RNA, 17 nt, Mycobacterium avium subsp. paratuberculosis
cgcaggcggccagcacc

SEQ ID NO: 1018827 - RNA, 19 nt, Mycobacterium avium subsp. paratuberculosis
cgcaggcggcgcgcagccg

SEQ ID NO: 1018828 - RNA, 22 nt, Mycobacterium avium subsp. paratuberculosis
cgcaggcggcgcgcagccggcc

SEQ ID NO: 1018829 - RNA, 19 nt, Mycobacterium avium subsp. paratuberculosis
cgcaggcguggcccagccg

SEQ ID NO: 1018830 - RNA, 15 nt, Mycobacterium avium subsp. paratuberculosis
cgcaggcguccuuga

SEQ ID NO: 1018831 - RNA, 15 nt, Mycobacterium avium subsp. paratuberculosis
cgcaggugcgccgcu

SEQ ID NO: 1018832 - RNA, 16 nt, Mycobacterium avium subsp. paratuberculosis
cgcaggugcgccgcuc

SEQ ID NO: 1018833 - RNA, 17 nt, Mycobacterium avium subsp. paratuberculosis
cgcaggugcgccgcucg

SEQ ID NO: 1018834 - RNA, 13 nt, Mycobacterium avium subsp. paratuberculosis
cgcaggugguggg

SEQ ID NO: 1018835 - RNA, 15 nt, Mycobacterium avium subsp. paratuberculosis
cgcaggugcagcucc

SEQ ID NO: 1018836 - RNA, 23 nt, Mycobacterium avium subsp. paratuberculosis
cgcaguugcgcggcgggcgagcc

SEQ ID NO: 1018837 - RNA, 19 nt, Mycobacterium avium subsp. paratuberculosis
cgcaguccagggugguggu

SEQ ID NO: 1018838 - RNA, 19 nt, Mycobacterium avium subsp. paratuberculosis
cgcagcgggauuggcgcca

SEQ ID NO: 1018839 - RNA, 18 nt, Mycobacterium avium subsp. paratuberculosis
cgcagcuucugcagcucg

SEQ ID NO: 1018840 - RNA, 16 nt, Mycobacterium avium subsp. paratuberculosis
cgcaggaaaggaaggc

SEQ ID NO: 1018841 - RNA, 23 nt, Mycobacterium avium subsp. paratuberculosis
cgcaggaacuccagcagcuguug

SEQ ID NO: 1018842 - RNA, 19 nt, Mycobacterium avium subsp. paratuberculosis
cgcagcggggaggcccagc

SEQ ID NO: 1018843 - RNA, 20 nt, Mycobacterium avium subsp. paratuberculosis
cgcagcggggaggcccagcc

SEQ ID NO: 1018844 - RNA, 21 nt, Mycobacterium avium subsp. paratuberculosis
cgcagcggggaggcccagccc

SEQ ID NO: 1018845 - RNA, 13 nt, Mycobacterium avium subsp. paratuberculosis
cgcagcggggcgc

SEQ ID NO: 1018846 - RNA, 16 nt, Mycobacterium avium subsp. paratuberculosis
cgcagcggggcgcgca

SEQ ID NO: 1018847 - RNA, 14 nt, Mycobacterium avium subsp. paratuberculosis
cgcagcggggcgcu

SEQ ID NO: 1018848 - RNA, 22 nt, Mycobacterium avium subsp. paratuberculosis
cgcagcggggcgcuguccuggu

SEQ ID NO: 1018849 - RNA, 17 nt, Mycobacterium avium subsp. paratuberculosis
cgcagcuguucgggcag

SEQ ID NO: 1018850 - RNA, 13 nt, Mycobacterium avium subsp. paratuberculosis
cgcagcggcggcu

SEQ ID NO: 1018851 - RNA, 20 nt, Mycobacterium avium subsp. paratuberculosis
cgcagcggcgccgcagcucg

SEQ ID NO: 1018852 - RNA, 13 nt, Mycobacterium avium subsp. paratuberculosis
cgcagcggcaggu

SEQ ID NO: 1018853 - RNA, 13 nt, Mycobacterium avium subsp. paratuberculosis
cgcagcgcggcgg

SEQ ID NO: 1018854 - RNA, 20 nt, Mycobacterium avium subsp. paratuberculosis
cgcagcgcgucgcgcccggc

SEQ ID NO: 1018855 - RNA, 14 nt, Mycobacterium avium subsp. paratuberculosis
cgcagcgcgacgaa

SEQ ID NO: 1018856 - RNA, 22 nt, Mycobacterium avium subsp. paratuberculosis
cgcagcgcgcgcucggucagca

SEQ ID NO: 1018857 - RNA, 15 nt, Mycobacterium avium subsp. paratuberculosis
cgcagcgcgcggcgc

SEQ ID NO: 1018858 - RNA, 15 nt, Mycobacterium avium subsp. paratuberculosis
cgcagcgcgcgggug

SEQ ID NO: 1018859 - RNA, 15 nt, Mycobacterium avium subsp. paratuberculosis
cgcagcgccaggcag

SEQ ID NO: 1018860 - RNA, 18 nt, Mycobacterium avium subsp. paratuberculosis
cgcagcgccucggcggcc

SEQ ID NO: 1018861 - RNA, 19 nt, Mycobacterium avium subsp. paratuberculosis
cgcagcgccucggcggccc

SEQ ID NO: 1018862 - RNA, 21 nt, Mycobacterium avium subsp. paratuberculosis
cgcagcgccucggcguggcag

SEQ ID NO: 1018863 - RNA, 14 nt, Mycobacterium avium subsp. paratuberculosis
cgcagcgcccaggc

SEQ ID NO: 1018864 - RNA, 16 nt, Mycobacterium avium subsp. paratuberculosis
cgcagcgcccggcagc

SEQ ID NO: 1018865 - RNA, 20 nt, Mycobacterium avium subsp. paratuberculosis
cgcagcgaagcgaggcgcca

SEQ ID NO: 1018866 - RNA, 22 nt, Mycobacterium avium subsp. paratuberculosis
cgcagcgacaaucggcucgccu

SEQ ID NO: 1018867 - RNA, 15 nt, Mycobacterium avium subsp. paratuberculosis
cgcagcgaccgcgga

SEQ ID NO: 1018868 - RNA, 17 nt, Mycobacterium avium subsp. paratuberculosis
cgcagcgaucggcggcu

SEQ ID NO: 1018869 - RNA, 16 nt, Mycobacterium avium subsp. paratuberculosis
cgcagcgacuccuggu

SEQ ID NO: 1018870 - RNA, 14 nt, Mycobacterium avium subsp. paratuberculosis
cuuccagcaccggc

SEQ ID NO: 1018871 - RNA, 18 nt, Mycobacterium avium subsp. paratuberculosis
cuuccagcaccggcuggu

SEQ ID NO: 1018872 - RNA, 17 nt, Mycobacterium avium subsp. paratuberculosis
cuuccugggacagccgg

SEQ ID NO: 1018873 - RNA, 12 nt, Mycobacterium avium subsp. paratuberculosis
cuucccggccgc

SEQ ID NO: 1018874 - RNA, 15 nt, Mycobacterium avium subsp. paratuberculosis
cuucccggccgccaa

SEQ ID NO: 1018875 - RNA, 13 nt, Mycobacterium avium subsp. paratuberculosis
cuuccccggcggc

SEQ ID NO: 1018876 - RNA, 15 nt, Mycobacterium avium subsp. paratuberculosis
cuucguacggcccgg

SEQ ID NO: 1018877 - RNA, 14 nt, Mycobacterium avium subsp. paratuberculosis
cuucuacggcgggc

SEQ ID NO: 1018878 - RNA, 17 nt, Mycobacterium avium subsp. paratuberculosis
cuucgaacaucuugauc

SEQ ID NO: 1018879 - RNA, 15 nt, Mycobacterium avium subsp. paratuberculosis
cuucgacccgguggc

SEQ ID NO: 1018880 - RNA, 14 nt, Mycobacterium avium subsp. paratuberculosis
cuucgacggcagcg

SEQ ID NO: 1018881 - RNA, 16 nt, Mycobacterium avium subsp. paratuberculosis
cuucgaacgcccgcac

SEQ ID NO: 1018882 - RNA, 15 nt, Mycobacterium avium subsp. paratuberculosis
cuucgcugcgccggc

SEQ ID NO: 1018883 - RNA, 14 nt, Mycobacterium avium subsp. paratuberculosis
cuucggagguacuc

SEQ ID NO: 1018884 - RNA, 14 nt, Mycobacterium avium subsp. paratuberculosis
cuucggccagcgcg

SEQ ID NO: 1018885 - RNA, 21 nt, Mycobacterium avium subsp. paratuberculosis
cuucggcgccaaccuguuugg

SEQ ID NO: 1018886 - RNA, 15 nt, Mycobacterium avium subsp. paratuberculosis
cuucggcgcccgcuc

SEQ ID NO: 1018887 - RNA, 22 nt, Mycobacterium avium subsp. paratuberculosis
cuucggcgcccgcuccggcgga

SEQ ID NO: 1018888 - RNA, 18 nt, Mycobacterium avium subsp. paratuberculosis
cuucggcgucacucuggc

SEQ ID NO: 1018889 - RNA, 17 nt, Mycobacterium avium subsp. paratuberculosis
cuucggcgugucgggug

SEQ ID NO: 1018890 - RNA, 16 nt, Mycobacterium avium subsp. paratuberculosis
cuucggcucggcgaca

SEQ ID NO: 1018891 - RNA, 13 nt, Mycobacterium avium subsp. paratuberculosis
cuucggggccgcc

SEQ ID NO: 1018892 - RNA, 22 nt, Mycobacterium avium subsp. paratuberculosis
cuucgggguggucaccggcaag

SEQ ID NO: 1018893 - RNA, 18 nt, Mycobacterium avium subsp. paratuberculosis
cuucaccgaccagcuguu

SEQ ID NO: 1018894 - RNA, 22 nt, Mycobacterium avium subsp. paratuberculosis
cuucacgaagugcccggcgccg

SEQ ID NO: 1018895 - RNA, 21 nt, Mycobacterium avium subsp. paratuberculosis
cuucaacuugcgcgacgccgu

SEQ ID NO: 1018896 - RNA, 23 nt, Mycobacterium avium subsp. paratuberculosis
cuuaacuucacgcucggcgagca

SEQ ID NO: 1018897 - RNA, 14 nt, Mycobacterium avium subsp. paratuberculosis
cuguucgcgccggu

SEQ ID NO: 1018898 - RNA, 14 nt, Mycobacterium avium subsp. paratuberculosis
cuuaccgaccucga

SEQ ID NO: 1018899 - RNA, 21 nt, Mycobacterium avium subsp. paratuberculosis
cuuaccggccggccgccugga

SEQ ID NO: 1018900 - RNA, 15 nt, Mycobacterium avium subsp. paratuberculosis
cuuagccccucccac

SEQ ID NO: 1018901 - RNA, 21 nt, Mycobacterium avium subsp. paratuberculosis
cuuagccccucccaccacggc

SEQ ID NO: 1018902 - RNA, 19 nt, Mycobacterium avium subsp. paratuberculosis
cuuagcccggccgcggccc

SEQ ID NO: 1018903 - RNA, 23 nt, Mycobacterium avium subsp. paratuberculosis
cuuagcggggugagcuaugcuga

SEQ ID NO: 1018904 - RNA, 14 nt, Mycobacterium avium subsp. paratuberculosis
cuuugaucagcucg

SEQ ID NO: 1018905 - RNA, 18 nt, Mycobacterium avium subsp. paratuberculosis
cuuugccuuagcccggcc

SEQ ID NO: 1018906 - RNA, 18 nt, Mycobacterium avium subsp. paratuberculosis
cuuugccguuccagccgg

SEQ ID NO: 1018907 - RNA, 20 nt, Mycobacterium avium subsp. paratuberculosis
cuuucguucgaugucggcca

SEQ ID NO: 1018908 - RNA, 22 nt, Mycobacterium avium subsp. paratuberculosis
cuuucgucgaccgucacgcugg

SEQ ID NO: 1018909 - RNA, 14 nt, Mycobacterium avium subsp. paratuberculosis
cuuucgucgcuugg

SEQ ID NO: 1018910 - RNA, 18 nt, Mycobacterium avium subsp. paratuberculosis
cuuugaaccuggccacca

SEQ ID NO: 1018911 - RNA, 22 nt, Mycobacterium avium subsp. paratuberculosis
cuuugagcauuggcgauggccu

SEQ ID NO: 1018912 - RNA, 21 nt, Mycobacterium avium subsp. paratuberculosis
cuuuauucggcuucguaacac

SEQ ID NO: 1018913 - RNA, 16 nt, Mycobacterium avium subsp. paratuberculosis
cuuuagaaggccgccu

SEQ ID NO: 1018914 - RNA, 18 nt, Mycobacterium avium subsp. paratuberculosis
cuuguccuuguuggccuc

SEQ ID NO: 1018915 - RNA, 17 nt, Mycobacterium avium subsp. paratuberculosis
cuugucgcugaccaccg

SEQ ID NO: 1018916 - RNA, 17 nt, Mycobacterium avium subsp. paratuberculosis
cuugucgcagacccucg

SEQ ID NO: 1018917 - RNA, 18 nt, Mycobacterium avium subsp. paratuberculosis
cuugucggcgcccaggau

SEQ ID NO: 1018918 - RNA, 19 nt, Mycobacterium avium subsp. paratuberculosis
cuugucggcguggccgucc

SEQ ID NO: 1018919 - RNA, 12 nt, Mycobacterium avium subsp. paratuberculosis
cuugcgcagcag

SEQ ID NO: 1018920 - RNA, 16 nt, Mycobacterium avium subsp. paratuberculosis
cuugcugcggaaccca

SEQ ID NO: 1018921 - RNA, 15 nt, Mycobacterium avium subsp. paratuberculosis
cuugcgaccgccgcu

SEQ ID NO: 1018922 - RNA, 15 nt, Mycobacterium avium subsp. paratuberculosis
cuugccgaucgccgc

SEQ ID NO: 1018923 - RNA, 17 nt, Mycobacterium avium subsp. paratuberculosis
cuugccgaucagcuggc

SEQ ID NO: 1018924 - RNA, 14 nt, Mycobacterium avium subsp. paratuberculosis
cuugccgcgacccg

SEQ ID NO: 1018925 - RNA, 14 nt, Mycobacterium avium subsp. paratuberculosis
cuuggcacgggccc

SEQ ID NO: 1018926 - RNA, 19 nt, Mycobacterium avium subsp. paratuberculosis
cuuggccagcucggcggcc

SEQ ID NO: 1018927 - RNA, 13 nt, Mycobacterium avium subsp. paratuberculosis
cuuggcgcgccgc

SEQ ID NO: 1018928 - RNA, 17 nt, Mycobacterium avium subsp. paratuberculosis
cuuggccggagccuugg

SEQ ID NO: 1018929 - RNA, 16 nt, Mycobacterium avium subsp. paratuberculosis
cuuggucacaaagccc

SEQ ID NO: 1018930 - RNA, 18 nt, Mycobacterium avium subsp. paratuberculosis
cuuggucacaaagcccgg

SEQ ID NO: 1018931 - RNA, 17 nt, Mycobacterium avium subsp. paratuberculosis
cuuggucaccugacgcu

SEQ ID NO: 1018932 - RNA, 15 nt, Mycobacterium avium subsp. paratuberculosis
cuuggucagcccgcg

SEQ ID NO: 1018933 - RNA, 13 nt, Mycobacterium avium subsp. paratuberculosis
cuuggucuccggc

SEQ ID NO: 1018934 - RNA, 15 nt, Mycobacterium avium subsp. paratuberculosis
cuuggucuccggccc

SEQ ID NO: 1018935 - RNA, 15 nt, Mycobacterium avium subsp. paratuberculosis
cuuggucgcggccuu

SEQ ID NO: 1018936 - RNA, 18 nt, Mycobacterium avium subsp. paratuberculosis
cuuggucgcggccuucuu

SEQ ID NO: 1018937 - RNA, 23 nt, Mycobacterium avium subsp. paratuberculosis
cuuggucgcggccuucuuggccg

SEQ ID NO: 1018938 - RNA, 19 nt, Mycobacterium avium subsp. paratuberculosis
cuuggugaugggcagcgcc

SEQ ID NO: 1018939 - RNA, 19 nt, Mycobacterium avium subsp. paratuberculosis
cuuggugauuucgcgcacc

SEQ ID NO: 1018940 - RNA, 19 nt, Mycobacterium avium subsp. paratuberculosis
cuuggugcgagccaccucg

SEQ ID NO: 1018941 - RNA, 15 nt, Mycobacterium avium subsp. paratuberculosis
cuugggacuggaugg

SEQ ID NO: 1018942 - RNA, 14 nt, Mycobacterium avium subsp. paratuberculosis
cuuggcguccaugu

SEQ ID NO: 1018943 - RNA, 13 nt, Mycobacterium avium subsp. paratuberculosis
cuuggcgggcgcc

SEQ ID NO: 1018944 - RNA, 17 nt, Mycobacterium avium subsp. paratuberculosis
cuuggcgggcgccuucu

SEQ ID NO: 1018945 - RNA, 24 nt, Mycobacterium avium subsp. paratuberculosis
cuuggcggccaccaucuccgcggc

SEQ ID NO: 1018946 - RNA, 12 nt, Mycobacterium avium subsp. paratuberculosis
cuuggcggccug

SEQ ID NO: 1018947 - RNA, 14 nt, Mycobacterium avium subsp. paratuberculosis
cuuggcggccugcu

SEQ ID NO: 1018948 - RNA, 19 nt, Mycobacterium avium subsp. paratuberculosis
cuuggcggcggccuucuug

SEQ ID NO: 1018949 - RNA, 23 nt, Mycobacterium avium subsp. paratuberculosis
cuuggcggcggccuucuuggccg

SEQ ID NO: 1018950 - RNA, 20 nt, Mycobacterium avium subsp. paratuberculosis
cuuggcggcgcacuccauca

SEQ ID NO: 1018951 - RNA, 12 nt, Mycobacterium avium subsp. paratuberculosis
cuuggcgggcgc

SEQ ID NO: 1018952 - RNA, 13 nt, Mycobacterium avium subsp. paratuberculosis
cuuggggcugacc

SEQ ID NO: 1018953 - RNA, 22 nt, Mycobacterium avium subsp. paratuberculosis
cuugguagaugcguuccaggug

SEQ ID NO: 1018954 - RNA, 22 nt, Mycobacterium avium subsp. paratuberculosis
cuugggcgaaucugucgauggc

SEQ ID NO: 1018955 - RNA, 18 nt, Mycobacterium avium subsp. paratuberculosis
cuugggccggugcagcac

SEQ ID NO: 1018956 - RNA, 19 nt, Mycobacterium avium subsp. paratuberculosis
cuugccgacgugaugcacc

SEQ ID NO: 1018957 - RNA, 20 nt, Mycobacterium avium subsp. paratuberculosis
cuugccgaaguccuugaccc

SEQ ID NO: 1018958 - RNA, 19 nt, Mycobacterium avium subsp. paratuberculosis
cuugaucuuggccugggcc

SEQ ID NO: 1018959 - RNA, 17 nt, Mycobacterium avium subsp. paratuberculosis
cuugagcaagcaguccc

SEQ ID NO: 1018960 - RNA, 17 nt, Mycobacterium avium subsp. paratuberculosis
cuugaucucgaccuucu

SEQ ID NO: 1018961 - RNA, 16 nt, Mycobacterium avium subsp. paratuberculosis
cuugacgucggucagc

SEQ ID NO: 1018962 - RNA, 17 nt, Mycobacterium avium subsp. paratuberculosis
cuugaacucggccaggg

SEQ ID NO: 1018963 - RNA, 14 nt, Mycobacterium avium subsp. paratuberculosis
cuugaagaaccggg

SEQ ID NO: 1018964 - RNA, 20 nt, Mycobacterium avium subsp. paratuberculosis
cuugaacgcguacagcgccc

SEQ ID NO: 1018965 - RNA, 14 nt, Mycobacterium avium subsp. paratuberculosis
cuugaccacccggu

SEQ ID NO: 1018966 - RNA, 17 nt, Mycobacterium avium subsp. paratuberculosis
cuugaccaccuuggccg

SEQ ID NO: 1018967 - RNA, 16 nt, Mycobacterium avium subsp. paratuberculosis
cuugaccagcaacacc

SEQ ID NO: 1018968 - RNA, 14 nt, Mycobacterium avium subsp. paratuberculosis
cuugaccagcagcu

SEQ ID NO: 1018969 - RNA, 12 nt, Mycobacterium avium subsp. paratuberculosis
cuugaccaggau

SEQ ID NO: 1018970 - RNA, 14 nt, Mycobacterium avium subsp. paratuberculosis
cuugaccagcugcg

SEQ ID NO: 1018971 - RNA, 16 nt, Mycobacterium avium subsp. paratuberculosis
cuugaccgccugcuug

SEQ ID NO: 1018972 - RNA, 23 nt, Mycobacterium avium subsp. paratuberculosis
cuugacccgcaaggccgccagcc

SEQ ID NO: 1018973 - RNA, 16 nt, Mycobacterium avium subsp. paratuberculosis
cuugacccgcuccagc

SEQ ID NO: 1018974 - RNA, 18 nt, Mycobacterium avium subsp. paratuberculosis
cuugaccucgccgagcag

SEQ ID NO: 1018975 - RNA, 22 nt, Mycobacterium avium subsp. paratuberculosis
cuugaccggcucgccggcgcgc

SEQ ID NO: 1018976 - RNA, 17 nt, Mycobacterium avium subsp. paratuberculosis
cuugaccgggcuccagc

SEQ ID NO: 1018977 - RNA, 19 nt, Mycobacterium avium subsp. paratuberculosis
cuugacgaacgccaccacg

SEQ ID NO: 1018978 - RNA, 20 nt, Mycobacterium avium subsp. paratuberculosis
cuguuagccucgccagccgu

SEQ ID NO: 1018979 - RNA, 19 nt, Mycobacterium avium subsp. paratuberculosis
cuguuagggcgaccaccac

SEQ ID NO: 1018980 - RNA, 19 nt, Mycobacterium avium subsp. paratuberculosis
cuguggcgcacagaucguc

SEQ ID NO: 1018981 - RNA, 16 nt, Mycobacterium avium subsp. paratuberculosis
cuguggaagggccccg

SEQ ID NO: 1018982 - RNA, 16 nt, Mycobacterium avium subsp. paratuberculosis
cugugcugccugccgu

SEQ ID NO: 1018983 - RNA, 15 nt, Mycobacterium avium subsp. paratuberculosis
cuguggaugacgcag

SEQ ID NO: 1018984 - RNA, 22 nt, Mycobacterium avium subsp. paratuberculosis
cuguggaucgugucuggccccg

SEQ ID NO: 1018985 - RNA, 15 nt, Mycobacterium avium subsp. paratuberculosis
cuguggugacggccc

SEQ ID NO: 1018986 - RNA, 15 nt, Mycobacterium avium subsp. paratuberculosis
cugugcgccuugccg

SEQ ID NO: 1018987 - RNA, 18 nt, Mycobacterium avium subsp. paratuberculosis
cugugcgggugaggccag

SEQ ID NO: 1018988 - RNA, 22 nt, Mycobacterium avium subsp. paratuberculosis
cugugcgggugaggccaggcgu

SEQ ID NO: 1018989 - RNA, 21 nt, Mycobacterium avium subsp. paratuberculosis
cugugccgcggugcggcccgc

SEQ ID NO: 1018990 - RNA, 22 nt, Mycobacterium avium subsp. paratuberculosis
cugugcgaacuccggugauuga

SEQ ID NO: 1018991 - RNA, 22 nt, Mycobacterium avium subsp. paratuberculosis
cugugccggcgggucagcagcg

SEQ ID NO: 1018992 - RNA, 13 nt, Mycobacterium avium subsp. paratuberculosis
cugugaggcaccg

SEQ ID NO: 1018993 - RNA, 22 nt, Mycobacterium avium subsp. paratuberculosis
cugugaggcaccgaacgccagc

SEQ ID NO: 1018994 - RNA, 15 nt, Mycobacterium avium subsp. paratuberculosis
cugugaccacgguca

SEQ ID NO: 1018995 - RNA, 16 nt, Mycobacterium avium subsp. paratuberculosis
cugugaccacggucac

SEQ ID NO: 1018996 - RNA, 17 nt, Mycobacterium avium subsp. paratuberculosis
cuguccucccagcgccc

SEQ ID NO: 1018997 - RNA, 12 nt, Mycobacterium avium subsp. paratuberculosis
cuguccaggccg

SEQ ID NO: 1018998 - RNA, 12 nt, Mycobacterium avium subsp. paratuberculosis
cuguagggccac

SEQ ID NO: 1018999 - RNA, 14 nt, Mycobacterium avium subsp. paratuberculosis
cuguagggccacca

SEQ ID NO: 1019000 - RNA, 15 nt, Mycobacterium avium subsp. paratuberculosis
cuguagggccaccac

SEQ ID NO: 1019001 - RNA, 15 nt, Mycobacterium avium subsp. paratuberculosis
cuguagcucacggug

SEQ ID NO: 1019002 - RNA, 20 nt, Mycobacterium avium subsp. paratuberculosis
cuguagcucacggugucggc

SEQ ID NO: 1019003 - RNA, 17 nt, Mycobacterium avium subsp. paratuberculosis
cugguucaccgccacca

SEQ ID NO: 1019004 - RNA, 23 nt, Mycobacterium avium subsp. paratuberculosis
cugguucaccgccaccagcaggc

SEQ ID NO: 1019005 - RNA, 17 nt, Mycobacterium avium subsp. paratuberculosis
cugguuggucaauccgg

SEQ ID NO: 1019006 - RNA, 20 nt, Mycobacterium avium subsp. paratuberculosis
cugguuucggggguaaaccg

SEQ ID NO: 1019007 - RNA, 23 nt, Mycobacterium avium subsp. paratuberculosis
cugguugauccagcggcgcaccg

SEQ ID NO: 1019008 - RNA, 18 nt, Mycobacterium avium subsp. paratuberculosis
cugguugacgccgaugcg

SEQ ID NO: 1019009 - RNA, 15 nt, Mycobacterium avium subsp. paratuberculosis
cuggguugcucgccg

SEQ ID NO: 1019010 - RNA, 14 nt, Mycobacterium avium subsp. paratuberculosis
cuggugcggaugau

SEQ ID NO: 1019011 - RNA, 13 nt, Mycobacterium avium subsp. paratuberculosis
cuggugcgggcca

SEQ ID NO: 1019012 - RNA, 14 nt, Mycobacterium avium subsp. paratuberculosis
cugguggcccaggc

SEQ ID NO: 1019013 - RNA, 19 nt, Mycobacterium avium subsp. paratuberculosis
cugguggcccaggcagacc

SEQ ID NO: 1019014 - RNA, 20 nt, Mycobacterium avium subsp. paratuberculosis
cugguggccgacgugccggu

SEQ ID NO: 1019015 - RNA, 14 nt, Mycobacterium avium subsp. paratuberculosis
cuggugggcgggca

SEQ ID NO: 1019016 - RNA, 20 nt, Mycobacterium avium subsp. paratuberculosis
cugguggugaucggccaggc

SEQ ID NO: 1019017 - RNA, 11 nt, Mycobacterium avium subsp. paratuberculosis
cugggacagcc

SEQ ID NO: 1019018 - RNA, 23 nt, Mycobacterium avium subsp. paratuberculosis
cugggagaacucgaucugcagcc

SEQ ID NO: 1019019 - RNA, 23 nt, Mycobacterium avium subsp. paratuberculosis
cugggaucggugcgcggcgaagg

SEQ ID NO: 1019020 - RNA, 15 nt, Mycobacterium avium subsp. paratuberculosis
cugggagcggcccaa

SEQ ID NO: 1019021 - RNA, 20 nt, Mycobacterium avium subsp. paratuberculosis
cugggcaaaaacgcgcgauc

SEQ ID NO: 1019022 - RNA, 15 nt, Mycobacterium avium subsp. paratuberculosis
cugggcaauggccgc

SEQ ID NO: 1019023 - RNA, 13 nt, Mycobacterium avium subsp. paratuberculosis
cugggccaggauc

SEQ ID NO: 1019024 - RNA, 21 nt, Mycobacterium avium subsp. paratuberculosis
cugggcaucaucggcacgccg

SEQ ID NO: 1019025 - RNA, 23 nt, Mycobacterium avium subsp. paratuberculosis
cugggcaucaucggcacgccggg

SEQ ID NO: 1019026 - RNA, 16 nt, Mycobacterium avium subsp. paratuberculosis
cugggcagccgcgcgu

SEQ ID NO: 1019027 - RNA, 21 nt, Mycobacterium avium subsp. paratuberculosis
cugggcagccgcgcgugcagc

SEQ ID NO: 1019028 - RNA, 15 nt, Mycobacterium avium subsp. paratuberculosis
cugggcagccguccc

SEQ ID NO: 1019029 - RNA, 18 nt, Mycobacterium avium subsp. paratuberculosis
cugggcagccgucccugu

SEQ ID NO: 1019030 - RNA, 17 nt, Mycobacterium avium subsp. paratuberculosis
cuggggucggccagcga

SEQ ID NO: 1019031 - RNA, 17 nt, Mycobacterium avium subsp. paratuberculosis
cuggggugcccaccagc

SEQ ID NO: 1019032 - RNA, 19 nt, Mycobacterium avium subsp. paratuberculosis
cuggggugcccaccagcau

SEQ ID NO: 1019033 - RNA, 14 nt, Mycobacterium avium subsp. paratuberculosis
cugggcguacagcg

SEQ ID NO: 1019034 - RNA, 14 nt, Mycobacterium avium subsp. paratuberculosis
cugggcgucggcgc

SEQ ID NO: 1019035 - RNA, 15 nt, Mycobacterium avium subsp. paratuberculosis
cugggccccuccagc

SEQ ID NO: 1019036 - RNA, 13 nt, Mycobacterium avium subsp. paratuberculosis
cugggcgcgcacc

SEQ ID NO: 1019037 - RNA, 17 nt, Mycobacterium avium subsp. paratuberculosis
cugggcgcgcacccccu

SEQ ID NO: 1019038 - RNA, 22 nt, Mycobacterium avium subsp. paratuberculosis
cugggccgccgucgccaccacc

SEQ ID NO: 1019039 - RNA, 16 nt, Mycobacterium avium subsp. paratuberculosis
cugggccgccagccgg

SEQ ID NO: 1019040 - RNA, 13 nt, Mycobacterium avium subsp. paratuberculosis
cugggcggcggcg

SEQ ID NO: 1019041 - RNA, 17 nt, Mycobacterium avium subsp. paratuberculosis
cugggcgggcucgagcc

SEQ ID NO: 1019042 - RNA, 15 nt, Mycobacterium avium subsp. paratuberculosis
cugggcggcgcggcg

SEQ ID NO: 1019043 - RNA, 18 nt, Mycobacterium avium subsp. paratuberculosis
cuggcguucgccgaggaa

SEQ ID NO: 1019044 - RNA, 13 nt, Mycobacterium avium subsp. paratuberculosis
cuggcgcagcacc

SEQ ID NO: 1019045 - RNA, 20 nt, Mycobacterium avium subsp. paratuberculosis
cuggcgcaggcgcugggugu

SEQ ID NO: 1019046 - RNA, 17 nt, Mycobacterium avium subsp. paratuberculosis
cuggcguggcgccggcg

SEQ ID NO: 1019047 - RNA, 18 nt, Mycobacterium avium subsp. paratuberculosis
cuggcguggcgccggcgc

SEQ ID NO: 1019048 - RNA, 22 nt, Mycobacterium avium subsp. paratuberculosis
cuggcgugaaucuuggccagca

SEQ ID NO: 1019049 - RNA, 19 nt, Mycobacterium avium subsp. paratuberculosis
cuggcgugacgcucggcgc

SEQ ID NO: 1019050 - RNA, 22 nt, Mycobacterium avium subsp. paratuberculosis
cuggcgugacgcucggcgcguc

SEQ ID NO: 1019051 - RNA, 13 nt, Mycobacterium avium subsp. paratuberculosis
cuggcgcaucagc

SEQ ID NO: 1019052 - RNA, 13 nt, Mycobacterium avium subsp. paratuberculosis
cuggcugagcacc

SEQ ID NO: 1019053 - RNA, 15 nt, Mycobacterium avium subsp. paratuberculosis
cuggcugcggccccg

SEQ ID NO: 1019054 - RNA, 17 nt, Mycobacterium avium subsp. paratuberculosis
cuggcuggugauggcca

SEQ ID NO: 1019055 - RNA, 22 nt, Mycobacterium avium subsp. paratuberculosis
cugcuucgucgccgggcugggu

SEQ ID NO: 1019056 - RNA, 14 nt, Mycobacterium avium subsp. paratuberculosis
cugcuguuccucga

SEQ ID NO: 1019057 - RNA, 22 nt, Mycobacterium avium subsp. paratuberculosis
cugcuguuccucgaacaggcug

SEQ ID NO: 1019058 - RNA, 20 nt, Mycobacterium avium subsp. paratuberculosis
cuggaugucacgguccaggu

SEQ ID NO: 1019059 - RNA, 11 nt, Mycobacterium avium subsp. paratuberculosis
cuggaugaaca

SEQ ID NO: 1019060 - RNA, 13 nt, Mycobacterium avium subsp. paratuberculosis
cuggaugaacagc

SEQ ID NO: 1019061 - RNA, 14 nt, Mycobacterium avium subsp. paratuberculosis
cuggaugccguagg

SEQ ID NO: 1019062 - RNA, 15 nt, Mycobacterium avium subsp. paratuberculosis
cuggaugcccagggc

SEQ ID NO: 1019063 - RNA, 19 nt, Mycobacterium avium subsp. paratuberculosis
cuggcgaauccgggccucc

SEQ ID NO: 1019064 - RNA, 13 nt, Mycobacterium avium subsp. paratuberculosis
cuggcgcaccgcc

SEQ ID NO: 1019065 - RNA, 16 nt, Mycobacterium avium subsp. paratuberculosis
cuggccgucgcggcgc

SEQ ID NO: 1019066 - RNA, 18 nt, Mycobacterium avium subsp. paratuberculosis
cuggccggguuggcaucc

SEQ ID NO: 1019067 - RNA, 19 nt, Mycobacterium avium subsp. paratuberculosis
cuggccggguuggcaucca

SEQ ID NO: 1019068 - RNA, 22 nt, Mycobacterium avium subsp. paratuberculosis
cuggccgggcucgagggcggcg

SEQ ID NO: 1019069 - RNA, 17 nt, Mycobacterium avium subsp. paratuberculosis
cuggccggccaucuuca

SEQ ID NO: 1019070 - RNA, 13 nt, Mycobacterium avium subsp. paratuberculosis
cuggccggacggg

SEQ ID NO: 1019071 - RNA, 20 nt, Mycobacterium avium subsp. paratuberculosis
cuggccgcggccagcugccc

SEQ ID NO: 1019072 - RNA, 18 nt, Mycobacterium avium subsp. paratuberculosis
cuggccgcguuccaggac

SEQ ID NO: 1019073 - RNA, 13 nt, Mycobacterium avium subsp. paratuberculosis
cuggccgcgcagc

SEQ ID NO: 1019074 - RNA, 23 nt, Mycobacterium avium subsp. paratuberculosis
cuggccgauggucagcugccgca

SEQ ID NO: 1019075 - RNA, 14 nt, Mycobacterium avium subsp. paratuberculosis
cuggccgcacggug

SEQ ID NO: 1019076 - RNA, 19 nt, Mycobacterium avium subsp. paratuberculosis
cuggccgcacggugcagca

SEQ ID NO: 1019077 - RNA, 15 nt, Mycobacterium avium subsp. paratuberculosis
cuggcacggcugcuc

SEQ ID NO: 1019078 - RNA, 20 nt, Mycobacterium avium subsp. paratuberculosis
cuggcacuccuugcugucgg

SEQ ID NO: 1019079 - RNA, 22 nt, Mycobacterium avium subsp. paratuberculosis
cuggcaacguccucgaggguuu

SEQ ID NO: 1019080 - RNA, 21 nt, Mycobacterium avium subsp. paratuberculosis
cuggcagcauccgccgacgau

SEQ ID NO: 1019081 - RNA, 15 nt, Mycobacterium avium subsp. paratuberculosis
cuggccagcaccgcg

SEQ ID NO: 1019082 - RNA, 21 nt, Mycobacterium avium subsp. paratuberculosis
cuggcccuugaccgccugcuu

SEQ ID NO: 1019083 - RNA, 20 nt, Mycobacterium avium subsp. paratuberculosis
cuggccgaggccuccaggua

SEQ ID NO: 1019084 - RNA, 18 nt, Mycobacterium avium subsp. paratuberculosis
cuggccgaccgccgccau

SEQ ID NO: 1019085 - RNA, 19 nt, Mycobacterium avium subsp. paratuberculosis
cuggccgaccgccgccauc

SEQ ID NO: 1019086 - RNA, 15 nt, Mycobacterium avium subsp. paratuberculosis
cuggccgaagguggg

SEQ ID NO: 1019087 - RNA, 21 nt, Mycobacterium avium subsp. paratuberculosis
cuggccgaaggugggguugaa

SEQ ID NO: 1019088 - RNA, 22 nt, Mycobacterium avium subsp. paratuberculosis
cugcucgcuugccagccgggcc

SEQ ID NO: 1019089 - RNA, 22 nt, Mycobacterium avium subsp. paratuberculosis
cugcucggaggaaccgugcguc

SEQ ID NO: 1019090 - RNA, 20 nt, Mycobacterium avium subsp. paratuberculosis
cugcucgcgcugccgcgcgc

SEQ ID NO: 1019091 - RNA, 17 nt, Mycobacterium avium subsp. paratuberculosis
cugcucgcgauuggccu

SEQ ID NO: 1019092 - RNA, 15 nt, Mycobacterium avium subsp. paratuberculosis
cugcucgcgggccac

SEQ ID NO: 1019093 - RNA, 17 nt, Mycobacterium avium subsp. paratuberculosis
cugcucggcgucgcacg

SEQ ID NO: 1019094 - RNA, 13 nt, Mycobacterium avium subsp. paratuberculosis
cugcucggcgggc

SEQ ID NO: 1019095 - RNA, 14 nt, Mycobacterium avium subsp. paratuberculosis
cugcucguccuggc

SEQ ID NO: 1019096 - RNA, 15 nt, Mycobacterium avium subsp. paratuberculosis
cugcucguccuggcg

SEQ ID NO: 1019097 - RNA, 17 nt, Mycobacterium avium subsp. paratuberculosis
cugcucguccuggcgcu

SEQ ID NO: 1019098 - RNA, 15 nt, Mycobacterium avium subsp. paratuberculosis
cugcucgucggugac

SEQ ID NO: 1019099 - RNA, 20 nt, Mycobacterium avium subsp. paratuberculosis
cugcucuucgguggugugga

SEQ ID NO: 1019100 - RNA, 22 nt, Mycobacterium avium subsp. paratuberculosis
cugcucgugcaaaccggaccgc

SEQ ID NO: 1019101 - RNA, 14 nt, Mycobacterium avium subsp. paratuberculosis
cugcguccggcccg

SEQ ID NO: 1019102 - RNA, 14 nt, Mycobacterium avium subsp. paratuberculosis
cugcucccaggcgu

SEQ ID NO: 1019103 - RNA, 19 nt, Mycobacterium avium subsp. paratuberculosis
cugcuccgggggcaccgcc

SEQ ID NO: 1019104 - RNA, 12 nt, Mycobacterium avium subsp. paratuberculosis
cugcuccggggu

SEQ ID NO: 1019105 - RNA, 19 nt, Mycobacterium avium subsp. paratuberculosis
cugcucgaucucggccacc

SEQ ID NO: 1019106 - RNA, 13 nt, Mycobacterium avium subsp. paratuberculosis
cugcucgagggcc

SEQ ID NO: 1019107 - RNA, 17 nt, Mycobacterium avium subsp. paratuberculosis
cugcucgagggccucca

SEQ ID NO: 1019108 - RNA, 21 nt, Mycobacterium avium subsp. paratuberculosis
cugcugcgggugcggccagcg

SEQ ID NO: 1019109 - RNA, 20 nt, Mycobacterium avium subsp. paratuberculosis
cugcugcagcgcccgggcca

SEQ ID NO: 1019110 - RNA, 21 nt, Mycobacterium avium subsp. paratuberculosis
cugcugcagcgcccgggccag

SEQ ID NO: 1019111 - RNA, 17 nt, Mycobacterium avium subsp. paratuberculosis
cugcugcacgucgccgg

SEQ ID NO: 1019112 - RNA, 23 nt, Mycobacterium avium subsp. paratuberculosis
cugcuggaugugguugcuggcgu

SEQ ID NO: 1019113 - RNA, 14 nt, Mycobacterium avium subsp. paratuberculosis
cugcuggcgcugcc

SEQ ID NO: 1019114 - RNA, 20 nt, Mycobacterium avium subsp. paratuberculosis
cugcuggucuugccgugcag

SEQ ID NO: 1019115 - RNA, 22 nt, Mycobacterium avium subsp. paratuberculosis
cugcuggucuugccgugcagca

SEQ ID NO: 1019116 - RNA, 23 nt, Mycobacterium avium subsp. paratuberculosis
cugccuugcugacgccgcggugc

SEQ ID NO: 1019117 - RNA, 13 nt, Mycobacterium avium subsp. paratuberculosis
cugccgcgccccg

SEQ ID NO: 1019118 - RNA, 14 nt, Mycobacterium avium subsp. paratuberculosis
cugccgccgccgcu

SEQ ID NO: 1019119 - RNA, 14 nt, Mycobacterium avium subsp. paratuberculosis
cugcgagaucggca

SEQ ID NO: 1019120 - RNA, 14 nt, Mycobacterium avium subsp. paratuberculosis
cugcgagcacaccc

SEQ ID NO: 1019121 - RNA, 14 nt, Mycobacterium avium subsp. paratuberculosis
cugcgaggcgggca

SEQ ID NO: 1019122 - RNA, 19 nt, Mycobacterium avium subsp. paratuberculosis
cugcgaccacccggacgau

SEQ ID NO: 1019123 - RNA, 23 nt, Mycobacterium avium subsp. paratuberculosis
cugcgcacccgguccggcugguc

SEQ ID NO: 1019124 - RNA, 18 nt, Mycobacterium avium subsp. paratuberculosis
cugcgcaccgccagcacc

SEQ ID NO: 1019125 - RNA, 19 nt, Mycobacterium avium subsp. paratuberculosis
cugcgcaccgccagcaccg

SEQ ID NO: 1019126 - RNA, 13 nt, Mycobacterium avium subsp. paratuberculosis
cugcgccagcagc

SEQ ID NO: 1019127 - RNA, 23 nt, Mycobacterium avium subsp. paratuberculosis
cugcgccagccgucgccgcgccc

SEQ ID NO: 1019128 - RNA, 15 nt, Mycobacterium avium subsp. paratuberculosis
cugcgccggggccgc

SEQ ID NO: 1019129 - RNA, 21 nt, Mycobacterium avium subsp. paratuberculosis
cugcgccggcaacuggccgcc

SEQ ID NO: 1019130 - RNA, 19 nt, Mycobacterium avium subsp. paratuberculosis
cugcgccggcgcggccagc

SEQ ID NO: 1019131 - RNA, 23 nt, Mycobacterium avium subsp. paratuberculosis
cugcgccgcggugcgccacgccc

SEQ ID NO: 1019132 - RNA, 22 nt, Mycobacterium avium subsp. paratuberculosis
cugcgccggcgguaugcccggg

SEQ ID NO: 1019133 - RNA, 16 nt, Mycobacterium avium subsp. paratuberculosis
cugcgccagcuccagc

SEQ ID NO: 1019134 - RNA, 23 nt, Mycobacterium avium subsp. paratuberculosis
cugcgccagcuccagcagcccgg

SEQ ID NO: 1019135 - RNA, 21 nt, Mycobacterium avium subsp. paratuberculosis
cugcgccagcuggguggucac

SEQ ID NO: 1019136 - RNA, 20 nt, Mycobacterium avium subsp. paratuberculosis
cugcgccaggauccgcccgc

SEQ ID NO: 1019137 - RNA, 22 nt, Mycobacterium avium subsp. paratuberculosis
cugcgccguugauugcgcccgc

SEQ ID NO: 1019138 - RNA, 18 nt, Mycobacterium avium subsp. paratuberculosis
cugcggcagguaggcgcc

SEQ ID NO: 1019139 - RNA, 23 nt, Mycobacterium avium subsp. paratuberculosis
cugcggcaggucggccagcgccg

SEQ ID NO: 1019140 - RNA, 15 nt, Mycobacterium avium subsp. paratuberculosis
cugcggcgacaacgc

SEQ ID NO: 1019141 - RNA, 22 nt, Mycobacterium avium subsp. paratuberculosis
cugcggccgcgacugcacccga

SEQ ID NO: 1019142 - RNA, 15 nt, Mycobacterium avium subsp. paratuberculosis
cugcggcucggcgcu

SEQ ID NO: 1019143 - RNA, 20 nt, Mycobacterium avium subsp. paratuberculosis
cugcggcugggagagcaggu

SEQ ID NO: 1019144 - RNA, 17 nt, Mycobacterium avium subsp. paratuberculosis
cugcggcgcggccaccc

SEQ ID NO: 1019145 - RNA, 20 nt, Mycobacterium avium subsp. paratuberculosis
cugcggcgucgucuuggccu

SEQ ID NO: 1019146 - RNA, 13 nt, Mycobacterium avium subsp. paratuberculosis
cugcaccagggcg

SEQ ID NO: 1019147 - RNA, 13 nt, Mycobacterium avium subsp. paratuberculosis
cugcaccagcgcg

SEQ ID NO: 1019148 - RNA, 22 nt, Mycobacterium avium subsp. paratuberculosis
cugcaccagcgcggacaccagg

SEQ ID NO: 1019149 - RNA, 13 nt, Mycobacterium avium subsp. paratuberculosis
cugcaccagcggc

SEQ ID NO: 1019150 - RNA, 13 nt, Mycobacterium avium subsp. paratuberculosis
cugcaccagcucg

SEQ ID NO: 1019151 - RNA, 19 nt, Mycobacterium avium subsp. paratuberculosis
cugcacccaccggcgcagc

SEQ ID NO: 1019152 - RNA, 12 nt, Mycobacterium avium subsp. paratuberculosis
cugcacccagcc

SEQ ID NO: 1019153 - RNA, 16 nt, Mycobacterium avium subsp. paratuberculosis
cugcacccagccgugc

SEQ ID NO: 1019154 - RNA, 19 nt, Mycobacterium avium subsp. paratuberculosis
cugcacagcuucggcgccg

SEQ ID NO: 1019155 - RNA, 21 nt, Mycobacterium avium subsp. paratuberculosis
cugcagcagaugcgccucgau

SEQ ID NO: 1019156 - RNA, 11 nt, Mycobacterium avium subsp. paratuberculosis
cugcagcagcc

SEQ ID NO: 1019157 - RNA, 15 nt, Mycobacterium avium subsp. paratuberculosis
cugcagcagcccgau

SEQ ID NO: 1019158 - RNA, 22 nt, Mycobacterium avium subsp. paratuberculosis
cugcagcagcccgaucaccccc

SEQ ID NO: 1019159 - RNA, 12 nt, Mycobacterium avium subsp. paratuberculosis
cugcagcacgcc

SEQ ID NO: 1019160 - RNA, 14 nt, Mycobacterium avium subsp. paratuberculosis
cugcagcaccaggc

SEQ ID NO: 1019161 - RNA, 15 nt, Mycobacterium avium subsp. paratuberculosis
cugcagcaccaggcc

SEQ ID NO: 1019162 - RNA, 23 nt, Mycobacterium avium subsp. paratuberculosis
cugcagcaccaggcccucgccgc

SEQ ID NO: 1019163 - RNA, 21 nt, Mycobacterium avium subsp. paratuberculosis
cugcacgcaaaaaccaugcca

SEQ ID NO: 1019164 - RNA, 22 nt, Mycobacterium avium subsp. paratuberculosis
cugcacgaagucgaccgcggcu

SEQ ID NO: 1019165 - RNA, 17 nt, Mycobacterium avium subsp. paratuberculosis
cugcacgaaauaaccgc

SEQ ID NO: 1019166 - RNA, 16 nt, Mycobacterium avium subsp. paratuberculosis
cugcaccugcggcagg

SEQ ID NO: 1019167 - RNA, 16 nt, Mycobacterium avium subsp. paratuberculosis
cugcaccgggaugaca

SEQ ID NO: 1019168 - RNA, 23 nt, Mycobacterium avium subsp. paratuberculosis
cugcaccggguacaccggcucgc

SEQ ID NO: 1019169 - RNA, 19 nt, Mycobacterium avium subsp. paratuberculosis
cugcacccucugccacggc

SEQ ID NO: 1019170 - RNA, 15 nt, Mycobacterium avium subsp. paratuberculosis
cugcacccgcuccac

SEQ ID NO: 1019171 - RNA, 19 nt, Mycobacterium avium subsp. paratuberculosis
cugcacccgcuccaccgaa

SEQ ID NO: 1019172 - RNA, 16 nt, Mycobacterium avium subsp. paratuberculosis
cugcaccgacuccuug

SEQ ID NO: 1019173 - RNA, 13 nt, Mycobacterium avium subsp. paratuberculosis
cugccaaaguugg

SEQ ID NO: 1019174 - RNA, 14 nt, Mycobacterium avium subsp. paratuberculosis
cugcaugccgucga

SEQ ID NO: 1019175 - RNA, 16 nt, Mycobacterium avium subsp. paratuberculosis
cugcaucgccagcaca

SEQ ID NO: 1019176 - RNA, 13 nt, Mycobacterium avium subsp. paratuberculosis
cugcaucuccagc

SEQ ID NO: 1019177 - RNA, 14 nt, Mycobacterium avium subsp. paratuberculosis
cugcaucuccagcc

SEQ ID NO: 1019178 - RNA, 21 nt, Mycobacterium avium subsp. paratuberculosis
cugcaucucgacccgggccag

SEQ ID NO: 1019179 - RNA, 17 nt, Mycobacterium avium subsp. paratuberculosis
cugcagccggccggcgg

SEQ ID NO: 1019180 - RNA, 20 nt, Mycobacterium avium subsp. paratuberculosis
cugcagccggguggcccgcc

SEQ ID NO: 1019181 - RNA, 21 nt, Mycobacterium avium subsp. paratuberculosis
cugcagccggguggcccgccc

SEQ ID NO: 1019182 - RNA, 21 nt, Mycobacterium avium subsp. paratuberculosis
cugcagcgacggaucggccgc

SEQ ID NO: 1019183 - RNA, 20 nt, Mycobacterium avium subsp. paratuberculosis
cugcagcgacuggaccacca

SEQ ID NO: 1019184 - RNA, 15 nt, Mycobacterium avium subsp. paratuberculosis
cugcagcgagaccuc

SEQ ID NO: 1019185 - RNA, 14 nt, Mycobacterium avium subsp. paratuberculosis
cugcagcgcccggg

SEQ ID NO: 1019186 - RNA, 14 nt, Mycobacterium avium subsp. paratuberculosis
cugcagcugcucgu

SEQ ID NO: 1019187 - RNA, 22 nt, Mycobacterium avium subsp. paratuberculosis
cugcaggaacaaccgcagcggc

SEQ ID NO: 1019188 - RNA, 17 nt, Mycobacterium avium subsp. paratuberculosis
cugcagcgcgaggcgca

SEQ ID NO: 1019189 - RNA, 13 nt, Mycobacterium avium subsp. paratuberculosis
cugcccaccacca

SEQ ID NO: 1019190 - RNA, 18 nt, Mycobacterium avium subsp. paratuberculosis
cugcccaccaccaggggc

SEQ ID NO: 1019191 - RNA, 16 nt, Mycobacterium avium subsp. paratuberculosis
cugccacagcgacagg

SEQ ID NO: 1019192 - RNA, 12 nt, Mycobacterium avium subsp. paratuberculosis
cugccagcgccc

SEQ ID NO: 1019193 - RNA, 15 nt, Mycobacterium avium subsp. paratuberculosis
cugccagcgcccgcu

SEQ ID NO: 1019194 - RNA, 15 nt, Mycobacterium avium subsp. paratuberculosis
cugcccucuuccucg

SEQ ID NO: 1019195 - RNA, 13 nt, Mycobacterium avium subsp. paratuberculosis
cugcccugggagg

SEQ ID NO: 1019196 - RNA, 21 nt, Mycobacterium avium subsp. paratuberculosis
cugccgcaccccgugguagac

SEQ ID NO: 1019197 - RNA, 15 nt, Mycobacterium avium subsp. paratuberculosis
cugcccgucgggcgc

SEQ ID NO: 1019198 - RNA, 14 nt, Mycobacterium avium subsp. paratuberculosis
cugcccgcacuggu

SEQ ID NO: 1019199 - RNA, 14 nt, Mycobacterium avium subsp. paratuberculosis
cugcccgacccgca

SEQ ID NO: 1019200 - RNA, 19 nt, Mycobacterium avium subsp. paratuberculosis
cugcccgacccgcaccacc

SEQ ID NO: 1019201 - RNA, 17 nt, Mycobacterium avium subsp. paratuberculosis
cugcccgacccgccuac

SEQ ID NO: 1019202 - RNA, 16 nt, Mycobacterium avium subsp. paratuberculosis
cugcccgaccgcgccg

SEQ ID NO: 1019203 - RNA, 21 nt, Mycobacterium avium subsp. paratuberculosis
cugacuucggaggucagcagg

SEQ ID NO: 1019204 - RNA, 18 nt, Mycobacterium avium subsp. paratuberculosis
cugagcacccgcccggac

SEQ ID NO: 1019205 - RNA, 22 nt, Mycobacterium avium subsp. paratuberculosis
cugagcacccgcccggacgcgc

SEQ ID NO: 1019206 - RNA, 21 nt, Mycobacterium avium subsp. paratuberculosis
cugagcaauucggugacggcg

SEQ ID NO: 1019207 - RNA, 15 nt, Mycobacterium avium subsp. paratuberculosis
cugagcacggugggc

SEQ ID NO: 1019208 - RNA, 21 nt, Mycobacterium avium subsp. paratuberculosis
cugagcggguaaccgcagccg

SEQ ID NO: 1019209 - RNA, 19 nt, Mycobacterium avium subsp. paratuberculosis
cugagcgggucggccggcg

SEQ ID NO: 1019210 - RNA, 23 nt, Mycobacterium avium subsp. paratuberculosis
cugagcgggucggccggcggggc

SEQ ID NO: 1019211 - RNA, 13 nt, Mycobacterium avium subsp. paratuberculosis
cugagcggcagaa

SEQ ID NO: 1019212 - RNA, 19 nt, Mycobacterium avium subsp. paratuberculosis
cugagcggcagaaguugac

SEQ ID NO: 1019213 - RNA, 21 nt, Mycobacterium avium subsp. paratuberculosis
cugagcagcccgaccaccucc

SEQ ID NO: 1019214 - RNA, 17 nt, Mycobacterium avium subsp. paratuberculosis
cugagcccggcgacgaa

SEQ ID NO: 1019215 - RNA, 23 nt, Mycobacterium avium subsp. paratuberculosis
cugagcccggcgacgaagcagcu

SEQ ID NO: 1019216 - RNA, 14 nt, Mycobacterium avium subsp. paratuberculosis
cugacgucgaaggu

SEQ ID NO: 1019217 - RNA, 15 nt, Mycobacterium avium subsp. paratuberculosis
cugacgggccggcgg

SEQ ID NO: 1019218 - RNA, 16 nt, Mycobacterium avium subsp. paratuberculosis
cugacgggccggcggg

SEQ ID NO: 1019219 - RNA, 22 nt, Mycobacterium avium subsp. paratuberculosis
cugacgggccggcggggugggc

SEQ ID NO: 1019220 - RNA, 21 nt, Mycobacterium avium subsp. paratuberculosis
cugacgaacgcgccgcccacc

SEQ ID NO: 1019221 - RNA, 17 nt, Mycobacterium avium subsp. paratuberculosis
cugaccugugcgcccca

SEQ ID NO: 1019222 - RNA, 16 nt, Mycobacterium avium subsp. paratuberculosis
cugaccgucggccaga

SEQ ID NO: 1019223 - RNA, 17 nt, Mycobacterium avium subsp. paratuberculosis
cugaccucgccgcccuc

SEQ ID NO: 1019224 - RNA, 16 nt, Mycobacterium avium subsp. paratuberculosis
cugacgauggcgaccg

SEQ ID NO: 1019225 - RNA, 15 nt, Mycobacterium avium subsp. paratuberculosis
cugacgcaucaccac

SEQ ID NO: 1019226 - RNA, 22 nt, Mycobacterium avium subsp. paratuberculosis
cugacgccggucgcugcgauga

SEQ ID NO: 1019227 - RNA, 14 nt, Mycobacterium avium subsp. paratuberculosis
cugacgccgagcag

SEQ ID NO: 1019228 - RNA, 19 nt, Mycobacterium avium subsp. paratuberculosis
cugacgccgagcagcucag

SEQ ID NO: 1019229 - RNA, 20 nt, Mycobacterium avium subsp. paratuberculosis
cugacacccgacgaagccgc

SEQ ID NO: 1019230 - RNA, 14 nt, Mycobacterium avium subsp. paratuberculosis
cugacacagcaccg

SEQ ID NO: 1019231 - RNA, 15 nt, Mycobacterium avium subsp. paratuberculosis
cugaccacgcuccag

SEQ ID NO: 1019232 - RNA, 13 nt, Mycobacterium avium subsp. paratuberculosis
cugaccagcgccu

SEQ ID NO: 1019233 - RNA, 20 nt, Mycobacterium avium subsp. paratuberculosis
cugaccagcggcgcgccggg

SEQ ID NO: 1019234 - RNA, 18 nt, Mycobacterium avium subsp. paratuberculosis
cugaccaugacccacggg

SEQ ID NO: 1019235 - RNA, 14 nt, Mycobacterium avium subsp. paratuberculosis
cugaccaaggacaa

SEQ ID NO: 1019236 - RNA, 13 nt, Mycobacterium avium subsp. paratuberculosis
cugacccagcgcg

SEQ ID NO: 1019237 - RNA, 16 nt, Mycobacterium avium subsp. paratuberculosis
cugacccuucugggcg

SEQ ID NO: 1019238 - RNA, 17 nt, Mycobacterium avium subsp. paratuberculosis
cugacccgccgcaacag

SEQ ID NO: 1019239 - RNA, 22 nt, Mycobacterium avium subsp. paratuberculosis
cugaccggcggugccggccaga

SEQ ID NO: 1019240 - RNA, 23 nt, Mycobacterium avium subsp. paratuberculosis
cugaccgcgggugaggggcgcgc

SEQ ID NO: 1019241 - RNA, 12 nt, Mycobacterium avium subsp. paratuberculosis
cugaccgagcag

SEQ ID NO: 1019242 - RNA, 13 nt, Mycobacterium avium subsp. paratuberculosis
cugaccgcaggaa

SEQ ID NO: 1019243 - RNA, 18 nt, Mycobacterium avium subsp. paratuberculosis
cugaacugcucgaccagc

SEQ ID NO: 1019244 - RNA, 16 nt, Mycobacterium avium subsp. paratuberculosis
cugaacgucuugggcg

SEQ ID NO: 1019245 - RNA, 22 nt, Mycobacterium avium subsp. paratuberculosis
cugaacgccugccggcgccgga

SEQ ID NO: 1019246 - RNA, 15 nt, Mycobacterium avium subsp. paratuberculosis
cugaacgcggugggc

SEQ ID NO: 1019247 - RNA, 23 nt, Mycobacterium avium subsp. paratuberculosis
cugaacgccagcagccgcagcag

SEQ ID NO: 1019248 - RNA, 16 nt, Mycobacterium avium subsp. paratuberculosis
cugaacggccgcgcag

SEQ ID NO: 1019249 - RNA, 18 nt, Mycobacterium avium subsp. paratuberculosis
cugaagaucaacagccgc

SEQ ID NO: 1019250 - RNA, 15 nt, Mycobacterium avium subsp. paratuberculosis
cugaacaaccccacc

SEQ ID NO: 1019251 - RNA, 13 nt, Mycobacterium avium subsp. paratuberculosis
cugaacagcagca

SEQ ID NO: 1019252 - RNA, 13 nt, Mycobacterium avium subsp. paratuberculosis
cugaacagcccga

SEQ ID NO: 1019253 - RNA, 16 nt, Mycobacterium avium subsp. paratuberculosis
cugaacagcccgagca

SEQ ID NO: 1019254 - RNA, 18 nt, Mycobacterium avium subsp. paratuberculosis
cugaacagcgcgccgaac

SEQ ID NO: 1019255 - RNA, 16 nt, Mycobacterium avium subsp. paratuberculosis
cugaacacgaacccgg

SEQ ID NO: 1019256 - RNA, 15 nt, Mycobacterium avium subsp. paratuberculosis
cugaaagugacgggu

SEQ ID NO: 1019257 - RNA, 21 nt, Mycobacterium avium subsp. paratuberculosis
cugaaagccgaggcgcaacac

SEQ ID NO: 1019258 - RNA, 18 nt, Mycobacterium avium subsp. paratuberculosis
cucuugcgugcgggucgc

SEQ ID NO: 1019259 - RNA, 16 nt, Mycobacterium avium subsp. paratuberculosis
cucuugggacuggaug

SEQ ID NO: 1019260 - RNA, 19 nt, Mycobacterium avium subsp. paratuberculosis
cucuucucguucugcgugc

SEQ ID NO: 1019261 - RNA, 24 nt, Mycobacterium avium subsp. paratuberculosis
cucuucggugguguggaucuccag

SEQ ID NO: 1019262 - RNA, 14 nt, Mycobacterium avium subsp. paratuberculosis
cucuucgacccggu

SEQ ID NO: 1019263 - RNA, 17 nt, Mycobacterium avium subsp. paratuberculosis
cucuucgccggacagcc

SEQ ID NO: 1019264 - RNA, 20 nt, Mycobacterium avium subsp. paratuberculosis
cucuucgccggacagccggg

SEQ ID NO: 1019265 - RNA, 13 nt, Mycobacterium avium subsp. paratuberculosis
cucuucggcgccg

SEQ ID NO: 1019266 - RNA, 15 nt, Mycobacterium avium subsp. paratuberculosis
cucuucggcgccggc

SEQ ID NO: 1019267 - RNA, 16 nt, Mycobacterium avium subsp. paratuberculosis
cucuugaugcagcgcc

SEQ ID NO: 1019268 - RNA, 19 nt, Mycobacterium avium subsp. paratuberculosis
cucuucgaaagccacccgc

SEQ ID NO: 1019269 - RNA, 20 nt, Mycobacterium avium subsp. paratuberculosis
cucucagccggaacacaacg

SEQ ID NO: 1019270 - RNA, 13 nt, Mycobacterium avium subsp. paratuberculosis
cucucggcgccgu

SEQ ID NO: 1019271 - RNA, 20 nt, Mycobacterium avium subsp. paratuberculosis
cucucgggaaacgcgucgcu

SEQ ID NO: 1019272 - RNA, 22 nt, Mycobacterium avium subsp. paratuberculosis
cucucguugaugcugugcgcuu

SEQ ID NO: 1019273 - RNA, 16 nt, Mycobacterium avium subsp. paratuberculosis
cucugauuugaaauuc

SEQ ID NO: 1019274 - RNA, 13 nt, Mycobacterium avium subsp. paratuberculosis
cucugccgggccg

SEQ ID NO: 1019275 - RNA, 14 nt, Mycobacterium avium subsp. paratuberculosis
cucugccgggccgc

SEQ ID NO: 1019276 - RNA, 15 nt, Mycobacterium avium subsp. paratuberculosis
cucugccgggccgca

SEQ ID NO: 1019277 - RNA, 19 nt, Mycobacterium avium subsp. paratuberculosis
cucugccgggccgcaucca

SEQ ID NO: 1019278 - RNA, 20 nt, Mycobacterium avium subsp. paratuberculosis
cucuaacuguugucagccac

SEQ ID NO: 1019279 - RNA, 17 nt, Mycobacterium avium subsp. paratuberculosis
cucguugccggcggcca

SEQ ID NO: 1019280 - RNA, 22 nt, Mycobacterium avium subsp. paratuberculosis
cucguguccgaugacgagcagc

SEQ ID NO: 1019281 - RNA, 16 nt, Mycobacterium avium subsp. paratuberculosis
cucguggucccaggac

SEQ ID NO: 1019282 - RNA, 18 nt, Mycobacterium avium subsp. paratuberculosis
cucgugggaaugcggcug

SEQ ID NO: 1019283 - RNA, 17 nt, Mycobacterium avium subsp. paratuberculosis
cucguagaagcucagcu

SEQ ID NO: 1019284 - RNA, 16 nt, Mycobacterium avium subsp. paratuberculosis
cucgguguagagcacc

SEQ ID NO: 1019285 - RNA, 20 nt, Mycobacterium avium subsp. paratuberculosis
cucgguggcgguggccacgg

SEQ ID NO: 1019286 - RNA, 24 nt, Mycobacterium avium subsp. paratuberculosis
cucgguggucgacgagcccgcgcc

SEQ ID NO: 1019287 - RNA, 23 nt, Mycobacterium avium subsp. paratuberculosis
cucguagcccaccucgagcacgc

SEQ ID NO: 1019288 - RNA, 17 nt, Mycobacterium avium subsp. paratuberculosis
cucguagcuggugcgca

SEQ ID NO: 1019289 - RNA, 15 nt, Mycobacterium avium subsp. paratuberculosis
cucgguggacgccgc

SEQ ID NO: 1019290 - RNA, 16 nt, Mycobacterium avium subsp. paratuberculosis
cucgguggacgccgcg

SEQ ID NO: 1019291 - RNA, 15 nt, Mycobacterium avium subsp. paratuberculosis
cucggugcggaacac

SEQ ID NO: 1019292 - RNA, 23 nt, Mycobacterium avium subsp. paratuberculosis
cucggugcgcauggcgugcugau

SEQ ID NO: 1019293 - RNA, 14 nt, Mycobacterium avium subsp. paratuberculosis
cucggugccgguga

SEQ ID NO: 1019294 - RNA, 18 nt, Mycobacterium avium subsp. paratuberculosis
cucgucagcgcgggccag

SEQ ID NO: 1019295 - RNA, 18 nt, Mycobacterium avium subsp. paratuberculosis
cucgucgcgcagcuggga

SEQ ID NO: 1019296 - RNA, 18 nt, Mycobacterium avium subsp. paratuberculosis
cucguccaccagcucgau

SEQ ID NO: 1019297 - RNA, 15 nt, Mycobacterium avium subsp. paratuberculosis
cucgucgcggcugcc

SEQ ID NO: 1019298 - RNA, 14 nt, Mycobacterium avium subsp. paratuberculosis
cucgucggccagcg

SEQ ID NO: 1019299 - RNA, 21 nt, Mycobacterium avium subsp. paratuberculosis
cucgucggucaggaacgcgga

SEQ ID NO: 1019300 - RNA, 14 nt, Mycobacterium avium subsp. paratuberculosis
cucgucggcgagca

SEQ ID NO: 1019301 - RNA, 21 nt, Mycobacterium avium subsp. paratuberculosis
cucgucggcgcgggccagcag

SEQ ID NO: 1019302 - RNA, 13 nt, Mycobacterium avium subsp. paratuberculosis
cucgucggcggcg

SEQ ID NO: 1019303 - RNA, 16 nt, Mycobacterium avium subsp. paratuberculosis
cucgucgggcaccgcc

SEQ ID NO: 1019304 - RNA, 20 nt, Mycobacterium avium subsp. paratuberculosis
cucgucgggcgccagcccgc

SEQ ID NO: 1019305 - RNA, 21 nt, Mycobacterium avium subsp. paratuberculosis
cucgucgggcgccagcccgcc

SEQ ID NO: 1019306 - RNA, 20 nt, Mycobacterium avium subsp. paratuberculosis
cucgucggggaacuccugca

SEQ ID NO: 1019307 - RNA, 23 nt, Mycobacterium avium subsp. paratuberculosis
cucgucgggugucaggucggcga

SEQ ID NO: 1019308 - RNA, 16 nt, Mycobacterium avium subsp. paratuberculosis
cucgguacccccgccg

SEQ ID NO: 1019309 - RNA, 16 nt, Mycobacterium avium subsp. paratuberculosis
cucggucaagccggcc

SEQ ID NO: 1019310 - RNA, 15 nt, Mycobacterium avium subsp. paratuberculosis
cucggucaccagcgg

SEQ ID NO: 1019311 - RNA, 22 nt, Mycobacterium avium subsp. paratuberculosis
cucggugaugccgagcgccgcg

SEQ ID NO: 1019312 - RNA, 16 nt, Mycobacterium avium subsp. paratuberculosis
cucggugaugccggcc

SEQ ID NO: 1019313 - RNA, 21 nt, Mycobacterium avium subsp. paratuberculosis
cucggugaugccggccagccg

SEQ ID NO: 1019314 - RNA, 15 nt, Mycobacterium avium subsp. paratuberculosis
cucggugaucacccg

SEQ ID NO: 1019315 - RNA, 22 nt, Mycobacterium avium subsp. paratuberculosis
cucggugaucucaccggcggcg

SEQ ID NO: 1019316 - RNA, 14 nt, Mycobacterium avium subsp. paratuberculosis
cucggcggccgcca

SEQ ID NO: 1019317 - RNA, 18 nt, Mycobacterium avium subsp. paratuberculosis
cucgggcccgcgcaccgu

SEQ ID NO: 1019318 - RNA, 19 nt, Mycobacterium avium subsp. paratuberculosis
cucgggcgguggcgccggg

SEQ ID NO: 1019319 - RNA, 15 nt, Mycobacterium avium subsp. paratuberculosis
cucgggggugucgua

SEQ ID NO: 1019320 - RNA, 17 nt, Mycobacterium avium subsp. paratuberculosis
cucggggcugcgcggcu

SEQ ID NO: 1019321 - RNA, 13 nt, Mycobacterium avium subsp. paratuberculosis
cucgggggccgcu

SEQ ID NO: 1019322 - RNA, 14 nt, Mycobacterium avium subsp. paratuberculosis
cucgggggcgggca

SEQ ID NO: 1019323 - RNA, 18 nt, Mycobacterium avium subsp. paratuberculosis
cucgggguagccggcccg

SEQ ID NO: 1019324 - RNA, 16 nt, Mycobacterium avium subsp. paratuberculosis
cucgggugaguagucc

SEQ ID NO: 1019325 - RNA, 18 nt, Mycobacterium avium subsp. paratuberculosis
cucggguguaggcccgau

SEQ ID NO: 1019326 - RNA, 20 nt, Mycobacterium avium subsp. paratuberculosis
cucgggugucgccgagccgc

SEQ ID NO: 1019327 - RNA, 17 nt, Mycobacterium avium subsp. paratuberculosis
cucggcgaucggccgcu

SEQ ID NO: 1019328 - RNA, 18 nt, Mycobacterium avium subsp. paratuberculosis
cucggcgaucagcugccc

SEQ ID NO: 1019329 - RNA, 14 nt, Mycobacterium avium subsp. paratuberculosis
cucggcggcccgcc

SEQ ID NO: 1019330 - RNA, 20 nt, Mycobacterium avium subsp. paratuberculosis
cucggcgggaucggaccgca

SEQ ID NO: 1019331 - RNA, 19 nt, Mycobacterium avium subsp. paratuberculosis
cucggcgggccgcccggcg

SEQ ID NO: 1019332 - RNA, 12 nt, Mycobacterium avium subsp. paratuberculosis
cucggcggccgc

SEQ ID NO: 1019333 - RNA, 14 nt, Mycobacterium avium subsp. paratuberculosis
cucggcggccggga

SEQ ID NO: 1019334 - RNA, 16 nt, Mycobacterium avium subsp. paratuberculosis
cucggcggccugcuuc

SEQ ID NO: 1019335 - RNA, 17 nt, Mycobacterium avium subsp. paratuberculosis
cucggcggcgcccagga

SEQ ID NO: 1019336 - RNA, 20 nt, Mycobacterium avium subsp. paratuberculosis
cucggcggcgcgcaggcgcg

SEQ ID NO: 1019337 - RNA, 20 nt, Mycobacterium avium subsp. paratuberculosis
cucggcggcggcgcgccggc

SEQ ID NO: 1019338 - RNA, 17 nt, Mycobacterium avium subsp. paratuberculosis
cucggccaccaccucgc

SEQ ID NO: 1019339 - RNA, 23 nt, Mycobacterium avium subsp. paratuberculosis
cucggccaccagaugccgggcuc

SEQ ID NO: 1019340 - RNA, 20 nt, Mycobacterium avium subsp. paratuberculosis
cucggcauaacgcaaccggu

SEQ ID NO: 1019341 - RNA, 22 nt, Mycobacterium avium subsp. paratuberculosis
cucggccaaccgggcaggcacg

SEQ ID NO: 1019342 - RNA, 12 nt, Mycobacterium avium subsp. paratuberculosis
cucggccagcgc

SEQ ID NO: 1019343 - RNA, 17 nt, Mycobacterium avium subsp. paratuberculosis
cucggccagcgcgccgc

SEQ ID NO: 1019344 - RNA, 22 nt, Mycobacterium avium subsp. paratuberculosis
cucggccacgacgcgccacgcc

SEQ ID NO: 1019345 - RNA, 13 nt, Mycobacterium avium subsp. paratuberculosis
cucggccagcccc

SEQ ID NO: 1019346 - RNA, 18 nt, Mycobacterium avium subsp. paratuberculosis
cucggcgagcaccgugcc

SEQ ID NO: 1019347 - RNA, 19 nt, Mycobacterium avium subsp. paratuberculosis
cucggcgagcaccgugccg

SEQ ID NO: 1019348 - RNA, 20 nt, Mycobacterium avium subsp. paratuberculosis
cucggcgaagucaucaccgg

SEQ ID NO: 1019349 - RNA, 13 nt, Mycobacterium avium subsp. paratuberculosis
cucggcgagccgc

SEQ ID NO: 1019350 - RNA, 16 nt, Mycobacterium avium subsp. paratuberculosis
cucggcaccgugccgc

SEQ ID NO: 1019351 - RNA, 13 nt, Mycobacterium avium subsp. paratuberculosis
cucgcgcaccgcg

SEQ ID NO: 1019352 - RNA, 16 nt, Mycobacterium avium subsp. paratuberculosis
cucgcgaggccgccau

SEQ ID NO: 1019353 - RNA, 13 nt, Mycobacterium avium subsp. paratuberculosis
cucgccuccagca

SEQ ID NO: 1019354 - RNA, 19 nt, Mycobacterium avium subsp. paratuberculosis
cucgccuccagcagggaca

SEQ ID NO: 1019355 - RNA, 17 nt, Mycobacterium avium subsp. paratuberculosis
cucgccguugccggccc

SEQ ID NO: 1019356 - RNA, 14 nt, Mycobacterium avium subsp. paratuberculosis
cucgccgucggcca

SEQ ID NO: 1019357 - RNA, 16 nt, Mycobacterium avium subsp. paratuberculosis
cucgccgucggccagc

SEQ ID NO: 1019358 - RNA, 17 nt, Mycobacterium avium subsp. paratuberculosis
cucgccgucggccagca

SEQ ID NO: 1019359 - RNA, 13 nt, Mycobacterium avium subsp. paratuberculosis
cucgaccccgccc

SEQ ID NO: 1019360 - RNA, 23 nt, Mycobacterium avium subsp. paratuberculosis
cucgaagcugcgccacaacuggc

SEQ ID NO: 1019361 - RNA, 22 nt, Mycobacterium avium subsp. paratuberculosis
cucgaccuucgagccgccgccg

SEQ ID NO: 1019362 - RNA, 13 nt, Mycobacterium avium subsp. paratuberculosis
cucgaccuucuug

SEQ ID NO: 1019363 - RNA, 14 nt, Mycobacterium avium subsp. paratuberculosis
cucgaccuucuugu

SEQ ID NO: 1019364 - RNA, 22 nt, Mycobacterium avium subsp. paratuberculosis
cucgaccucggcggccagcgcg

SEQ ID NO: 1019365 - RNA, 14 nt, Mycobacterium avium subsp. paratuberculosis
cucgaccuggguca

SEQ ID NO: 1019366 - RNA, 19 nt, Mycobacterium avium subsp. paratuberculosis
cucgacgaugucgacgccc

SEQ ID NO: 1019367 - RNA, 16 nt, Mycobacterium avium subsp. paratuberculosis
cucgacgaacuccgcg

SEQ ID NO: 1019368 - RNA, 23 nt, Mycobacterium avium subsp. paratuberculosis
cucgacgaacuccgcgcgcggca

SEQ ID NO: 1019369 - RNA, 15 nt, Mycobacterium avium subsp. paratuberculosis
cucgaacggcccgga

SEQ ID NO: 1019370 - RNA, 22 nt, Mycobacterium avium subsp. paratuberculosis
cucgaagaaccgcaacaccagc

SEQ ID NO: 1019371 - RNA, 14 nt, Mycobacterium avium subsp. paratuberculosis
cucgaagggcgcca

SEQ ID NO: 1019372 - RNA, 16 nt, Mycobacterium avium subsp. paratuberculosis
cucgaaguagagccgc

SEQ ID NO: 1019373 - RNA, 15 nt, Mycobacterium avium subsp. paratuberculosis
cucgaagucgccggc

SEQ ID NO: 1019374 - RNA, 17 nt, Mycobacterium avium subsp. paratuberculosis
cucgaagcgcagcagcu

SEQ ID NO: 1019375 - RNA, 13 nt, Mycobacterium avium subsp. paratuberculosis
cucgaagaucucc

SEQ ID NO: 1019376 - RNA, 13 nt, Mycobacterium avium subsp. paratuberculosis
cucgaaccuggag

SEQ ID NO: 1019377 - RNA, 15 nt, Mycobacterium avium subsp. paratuberculosis
cucgaacaggcuggc

SEQ ID NO: 1019378 - RNA, 14 nt, Mycobacterium avium subsp. paratuberculosis
cucgaacacccggc

SEQ ID NO: 1019379 - RNA, 12 nt, Mycobacterium avium subsp. paratuberculosis
cucgaacaccgc

SEQ ID NO: 1019380 - RNA, 20 nt, Mycobacterium avium subsp. paratuberculosis
cucgaacacgccgucguggg

SEQ ID NO: 1019381 - RNA, 13 nt, Mycobacterium avium subsp. paratuberculosis
cucgaaacccagc

SEQ ID NO: 1019382 - RNA, 15 nt, Mycobacterium avium subsp. paratuberculosis
cuccuugacccggcc

SEQ ID NO: 1019383 - RNA, 17 nt, Mycobacterium avium subsp. paratuberculosis
cuccuguuggcccugcu

SEQ ID NO: 1019384 - RNA, 18 nt, Mycobacterium avium subsp. paratuberculosis
cuccuguuggcccugcuc

SEQ ID NO: 1019385 - RNA, 23 nt, Mycobacterium avium subsp. paratuberculosis
cuccuggugucguauuguccugu

SEQ ID NO: 1019386 - RNA, 13 nt, Mycobacterium avium subsp. paratuberculosis
cuccuggccccga

SEQ ID NO: 1019387 - RNA, 16 nt, Mycobacterium avium subsp. paratuberculosis
cucgcccagcgcggcg

SEQ ID NO: 1019388 - RNA, 12 nt, Mycobacterium avium subsp. paratuberculosis
cucgcagcgaca

SEQ ID NO: 1019389 - RNA, 22 nt, Mycobacterium avium subsp. paratuberculosis
cucgcccgggcuaucgcccggc

SEQ ID NO: 1019390 - RNA, 23 nt, Mycobacterium avium subsp. paratuberculosis
cucgcccgggugcugcggcucca

SEQ ID NO: 1019391 - RNA, 22 nt, Mycobacterium avium subsp. paratuberculosis
cucgccgaucucgaccagcgcc

SEQ ID NO: 1019392 - RNA, 19 nt, Mycobacterium avium subsp. paratuberculosis
cucgccgaucuggcgcagc

SEQ ID NO: 1019393 - RNA, 17 nt, Mycobacterium avium subsp. paratuberculosis
cucgccgaaccggggcc

SEQ ID NO: 1019394 - RNA, 13 nt, Mycobacterium avium subsp. paratuberculosis
cucgccgaccugu

SEQ ID NO: 1019395 - RNA, 23 nt, Mycobacterium avium subsp. paratuberculosis
cucgccgcgcucaacccgggccg

SEQ ID NO: 1019396 - RNA, 16 nt, Mycobacterium avium subsp. paratuberculosis
cucgccgcggccacgc

SEQ ID NO: 1019397 - RNA, 19 nt, Mycobacterium avium subsp. paratuberculosis
cucgccgcgguggugggcg

SEQ ID NO: 1019398 - RNA, 15 nt, Mycobacterium avium subsp. paratuberculosis
cucgccgcguacgcc

SEQ ID NO: 1019399 - RNA, 23 nt, Mycobacterium avium subsp. paratuberculosis
cucgccgcgcaucaucgcccagc

SEQ ID NO: 1019400 - RNA, 17 nt, Mycobacterium avium subsp. paratuberculosis
cucgccgcgccagcacc

SEQ ID NO: 1019401 - RNA, 14 nt, Mycobacterium avium subsp. paratuberculosis
cucgccgcgcggcc

SEQ ID NO: 1019402 - RNA, 18 nt, Mycobacterium avium subsp. paratuberculosis
cucgaugagcgagaugau

SEQ ID NO: 1019403 - RNA, 14 nt, Mycobacterium avium subsp. paratuberculosis
cucgaugcauucgu

SEQ ID NO: 1019404 - RNA, 23 nt, Mycobacterium avium subsp. paratuberculosis
cucgaugacccaccagccgagau

SEQ ID NO: 1019405 - RNA, 13 nt, Mycobacterium avium subsp. paratuberculosis
cucgaugaccucg

SEQ ID NO: 1019406 - RNA, 22 nt, Mycobacterium avium subsp. paratuberculosis
cucgaucuggcggacccgcucc

SEQ ID NO: 1019407 - RNA, 16 nt, Mycobacterium avium subsp. paratuberculosis
cucgaucugggccagg

SEQ ID NO: 1019408 - RNA, 17 nt, Mycobacterium avium subsp. paratuberculosis
cucgaucucggccaccg

SEQ ID NO: 1019409 - RNA, 23 nt, Mycobacterium avium subsp. paratuberculosis
cucgaucgcguucugcaccagcu

SEQ ID NO: 1019410 - RNA, 22 nt, Mycobacterium avium subsp. paratuberculosis
cucgaucggggaauccuggccg

SEQ ID NO: 1019411 - RNA, 22 nt, Mycobacterium avium subsp. paratuberculosis
cucgaugccgaccgacagccgc

SEQ ID NO: 1019412 - RNA, 14 nt, Mycobacterium avium subsp. paratuberculosis
cucgaugcgcgcca

SEQ ID NO: 1019413 - RNA, 19 nt, Mycobacterium avium subsp. paratuberculosis
cucgaugcgcgccagcagc

SEQ ID NO: 1019414 - RNA, 16 nt, Mycobacterium avium subsp. paratuberculosis
cucgcacagcaccagu

SEQ ID NO: 1019415 - RNA, 15 nt, Mycobacterium avium subsp. paratuberculosis
cucgagcaucacgaa

SEQ ID NO: 1019416 - RNA, 23 nt, Mycobacterium avium subsp. paratuberculosis
cucgagccauaaaccggccggcg

SEQ ID NO: 1019417 - RNA, 14 nt, Mycobacterium avium subsp. paratuberculosis
cucgagcucaccga

SEQ ID NO: 1019418 - RNA, 21 nt, Mycobacterium avium subsp. paratuberculosis
cucgagcucaccgacaagggc

SEQ ID NO: 1019419 - RNA, 13 nt, Mycobacterium avium subsp. paratuberculosis
cucgagcgcgcuc

SEQ ID NO: 1019420 - RNA, 18 nt, Mycobacterium avium subsp. paratuberculosis
cucgagcgugcccgcgcc

SEQ ID NO: 1019421 - RNA, 20 nt, Mycobacterium avium subsp. paratuberculosis
cucgagcgugcccgcgccca

SEQ ID NO: 1019422 - RNA, 23 nt, Mycobacterium avium subsp. paratuberculosis
cucgagcgugcccgcgcccaccu

SEQ ID NO: 1019423 - RNA, 23 nt, Mycobacterium avium subsp. paratuberculosis
cucgaucaucaccaccgccgccg

SEQ ID NO: 1019424 - RNA, 22 nt, Mycobacterium avium subsp. paratuberculosis
cucgaucgccgcgcccagcacg

SEQ ID NO: 1019425 - RNA, 15 nt, Mycobacterium avium subsp. paratuberculosis
cucgaucgacgacgc

SEQ ID NO: 1019426 - RNA, 18 nt, Mycobacterium avium subsp. paratuberculosis
cucgaucgacgacgccag

SEQ ID NO: 1019427 - RNA, 19 nt, Mycobacterium avium subsp. paratuberculosis
cucgaucgacgacgccagc

SEQ ID NO: 1019428 - RNA, 22 nt, Mycobacterium avium subsp. paratuberculosis
cucgaucgacgacgccagcugc

SEQ ID NO: 1019429 - RNA, 12 nt, Mycobacterium avium subsp. paratuberculosis
cucgaggccccg

SEQ ID NO: 1019430 - RNA, 24 nt, Mycobacterium avium subsp. paratuberculosis
cucgaggccccgcgugacggccgc

SEQ ID NO: 1019431 - RNA, 17 nt, Mycobacterium avium subsp. paratuberculosis
cucgaggaucgcggcca

SEQ ID NO: 1019432 - RNA, 15 nt, Mycobacterium avium subsp. paratuberculosis
cucgaggccgagguc

SEQ ID NO: 1019433 - RNA, 23 nt, Mycobacterium avium subsp. paratuberculosis
cucgagcuuccgccgagucgcgc

SEQ ID NO: 1019434 - RNA, 20 nt, Mycobacterium avium subsp. paratuberculosis
cuccucuucgcugccgccgc

SEQ ID NO: 1019435 - RNA, 22 nt, Mycobacterium avium subsp. paratuberculosis
cuccucuucgcugccgccgccg

SEQ ID NO: 1019436 - RNA, 17 nt, Mycobacterium avium subsp. paratuberculosis
cuccucgucggcuccgu

SEQ ID NO: 1019437 - RNA, 15 nt, Mycobacterium avium subsp. paratuberculosis
cuccuccucgcgccg

SEQ ID NO: 1019438 - RNA, 19 nt, Mycobacterium avium subsp. paratuberculosis
cuccuccucgcgccgccac

SEQ ID NO: 1019439 - RNA, 20 nt, Mycobacterium avium subsp. paratuberculosis
cuccucgguguacagcgcca

SEQ ID NO: 1019440 - RNA, 19 nt, Mycobacterium avium subsp. paratuberculosis
cuccuccaggaaacggccc

SEQ ID NO: 1019441 - RNA, 14 nt, Mycobacterium avium subsp. paratuberculosis
cuccuccggcccga

SEQ ID NO: 1019442 - RNA, 20 nt, Mycobacterium avium subsp. paratuberculosis
cuccuccggguccccgccgc

SEQ ID NO: 1019443 - RNA, 18 nt, Mycobacterium avium subsp. paratuberculosis
cuccucauaggcguacac

SEQ ID NO: 1019444 - RNA, 23 nt, Mycobacterium avium subsp. paratuberculosis
cuccucauaggcguacaccaggg

SEQ ID NO: 1019445 - RNA, 14 nt, Mycobacterium avium subsp. paratuberculosis
cuccugcggugggc

SEQ ID NO: 1019446 - RNA, 17 nt, Mycobacterium avium subsp. paratuberculosis
cuccugcuggcgcugcc

SEQ ID NO: 1019447 - RNA, 22 nt, Mycobacterium avium subsp. paratuberculosis
cuccuggaaggacgucaggccg

SEQ ID NO: 1019448 - RNA, 24 nt, Mycobacterium avium subsp. paratuberculosis
cuccgcguucgaccuccacgagcc

SEQ ID NO: 1019449 - RNA, 17 nt, Mycobacterium avium subsp. paratuberculosis
cuccgcggccgcgcgcc

SEQ ID NO: 1019450 - RNA, 20 nt, Mycobacterium avium subsp. paratuberculosis
cuccggagugacgucgcgcg

SEQ ID NO: 1019451 - RNA, 19 nt, Mycobacterium avium subsp. paratuberculosis
cuccgugcuggccggguug

SEQ ID NO: 1019452 - RNA, 14 nt, Mycobacterium avium subsp. paratuberculosis
cuccgucagcgccg

SEQ ID NO: 1019453 - RNA, 13 nt, Mycobacterium avium subsp. paratuberculosis
cuccgucggcgcu

SEQ ID NO: 1019454 - RNA, 14 nt, Mycobacterium avium subsp. paratuberculosis
cuccggucggcgcu

SEQ ID NO: 1019455 - RNA, 21 nt, Mycobacterium avium subsp. paratuberculosis
cuccgaucuccuggugucgua

SEQ ID NO: 1019456 - RNA, 18 nt, Mycobacterium avium subsp. paratuberculosis
cuccgacugugaauuccg

SEQ ID NO: 1019457 - RNA, 17 nt, Mycobacterium avium subsp. paratuberculosis
cuccgagccgguggagu

SEQ ID NO: 1019458 - RNA, 19 nt, Mycobacterium avium subsp. paratuberculosis
cuccgaggcguccuccucg

SEQ ID NO: 1019459 - RNA, 19 nt, Mycobacterium avium subsp. paratuberculosis
cuccgcgacaucggcgccg

SEQ ID NO: 1019460 - RNA, 19 nt, Mycobacterium avium subsp. paratuberculosis
cuccgcgauggccuccgac

SEQ ID NO: 1019461 - RNA, 14 nt, Mycobacterium avium subsp. paratuberculosis
cuccgcgcgcggcc

SEQ ID NO: 1019462 - RNA, 13 nt, Mycobacterium avium subsp. paratuberculosis
cuccgcgcugacc

SEQ ID NO: 1019463 - RNA, 23 nt, Mycobacterium avium subsp. paratuberculosis
cucccgugcgguccaccaauggc

SEQ ID NO: 1019464 - RNA, 15 nt, Mycobacterium avium subsp. paratuberculosis
cucccgguccacggu

SEQ ID NO: 1019465 - RNA, 16 nt, Mycobacterium avium subsp. paratuberculosis
cucccgggcggcgccg

SEQ ID NO: 1019466 - RNA, 23 nt, Mycobacterium avium subsp. paratuberculosis
cuccgacagccgcaccggcgccg

SEQ ID NO: 1019467 - RNA, 24 nt, Mycobacterium avium subsp. paratuberculosis
cuccgacagccgcaccggcgccgc

SEQ ID NO: 1019468 - RNA, 12 nt, Mycobacterium avium subsp. paratuberculosis
cuccgacuccag

SEQ ID NO: 1019469 - RNA, 16 nt, Mycobacterium avium subsp. paratuberculosis
cuccgacuccagcagc

SEQ ID NO: 1019470 - RNA, 13 nt, Mycobacterium avium subsp. paratuberculosis
cuccccguugcgg

SEQ ID NO: 1019471 - RNA, 18 nt, Mycobacterium avium subsp. paratuberculosis
cuccccgcggugccgcag

SEQ ID NO: 1019472 - RNA, 12 nt, Mycobacterium avium subsp. paratuberculosis
cuccccgcuggc

SEQ ID NO: 1019473 - RNA, 18 nt, Mycobacterium avium subsp. paratuberculosis
cuccccgcuggcgccggc

SEQ ID NO: 1019474 - RNA, 23 nt, Mycobacterium avium subsp. paratuberculosis
cuccccgcuggcgccggcgucca

SEQ ID NO: 1019475 - RNA, 19 nt, Mycobacterium avium subsp. paratuberculosis
cuccccggacagccacucc

SEQ ID NO: 1019476 - RNA, 13 nt, Mycobacterium avium subsp. paratuberculosis
cuccacccgcccc

SEQ ID NO: 1019477 - RNA, 15 nt, Mycobacterium avium subsp. paratuberculosis
cuccacccgccccuc

SEQ ID NO: 1019478 - RNA, 14 nt, Mycobacterium avium subsp. paratuberculosis
cuccaccgcccgga

SEQ ID NO: 1019479 - RNA, 13 nt, Mycobacterium avium subsp. paratuberculosis
cuccaccgcgccg

SEQ ID NO: 1019480 - RNA, 21 nt, Mycobacterium avium subsp. paratuberculosis
cuccaccagguucgcgcagcu

SEQ ID NO: 1019481 - RNA, 20 nt, Mycobacterium avium subsp. paratuberculosis
cuccaccaccggccgcgcgu

SEQ ID NO: 1019482 - RNA, 16 nt, Mycobacterium avium subsp. paratuberculosis
cuccaccaccuggccg

SEQ ID NO: 1019483 - RNA, 14 nt, Mycobacterium avium subsp. paratuberculosis
cuccaccaccaugu

SEQ ID NO: 1019484 - RNA, 12 nt, Mycobacterium avium subsp. paratuberculosis
cuccaccaccau

SEQ ID NO: 1019485 - RNA, 21 nt, Mycobacterium avium subsp. paratuberculosis
cuccaccagcggcgcgucgcu

SEQ ID NO: 1019486 - RNA, 16 nt, Mycobacterium avium subsp. paratuberculosis
cuccacccugccgacc

SEQ ID NO: 1019487 - RNA, 14 nt, Mycobacterium avium subsp. paratuberculosis
cuccaccgaaaagc

SEQ ID NO: 1019488 - RNA, 19 nt, Mycobacterium avium subsp. paratuberculosis
cucauaggcguacaccagg

SEQ ID NO: 1019489 - RNA, 13 nt, Mycobacterium avium subsp. paratuberculosis
cucauagccggcc

SEQ ID NO: 1019490 - RNA, 18 nt, Mycobacterium avium subsp. paratuberculosis
cucagugucguggcgaca

SEQ ID NO: 1019491 - RNA, 15 nt, Mycobacterium avium subsp. paratuberculosis
cucagcgggcggcca

SEQ ID NO: 1019492 - RNA, 19 nt, Mycobacterium avium subsp. paratuberculosis
cucagcgauugcggccgcc

SEQ ID NO: 1019493 - RNA, 12 nt, Mycobacterium avium subsp. paratuberculosis
cucagcgcggcc

SEQ ID NO: 1019494 - RNA, 16 nt, Mycobacterium avium subsp. paratuberculosis
cucagcgcggccacac

SEQ ID NO: 1019495 - RNA, 13 nt, Mycobacterium avium subsp. paratuberculosis
cucagcggcagcg

SEQ ID NO: 1019496 - RNA, 18 nt, Mycobacterium avium subsp. paratuberculosis
cucagcgcccaggaugac

SEQ ID NO: 1019497 - RNA, 18 nt, Mycobacterium avium subsp. paratuberculosis
cucagcgcccgcccggcc

SEQ ID NO: 1019498 - RNA, 16 nt, Mycobacterium avium subsp. paratuberculosis
cucaggcgagcacccg

SEQ ID NO: 1019499 - RNA, 13 nt, Mycobacterium avium subsp. paratuberculosis
cucaggggaucuc

SEQ ID NO: 1019500 - RNA, 22 nt, Mycobacterium avium subsp. paratuberculosis
cucagucggccaccgcgaucuc

SEQ ID NO: 1019501 - RNA, 19 nt, Mycobacterium avium subsp. paratuberculosis
cucaggcguccagcaccug

SEQ ID NO: 1019502 - RNA, 23 nt, Mycobacterium avium subsp. paratuberculosis
cucaggcguggguuccgccgucg

SEQ ID NO: 1019503 - RNA, 20 nt, Mycobacterium avium subsp. paratuberculosis
cuccaacccaaccugugcca

SEQ ID NO: 1019504 - RNA, 22 nt, Mycobacterium avium subsp. paratuberculosis
cuccaacagccgguccuuggcc

SEQ ID NO: 1019505 - RNA, 13 nt, Mycobacterium avium subsp. paratuberculosis
cucaucccgccga

SEQ ID NO: 1019506 - RNA, 21 nt, Mycobacterium avium subsp. paratuberculosis
cuauuggccgagccgggcggc

SEQ ID NO: 1019507 - RNA, 14 nt, Mycobacterium avium subsp. paratuberculosis
cucaacggccggcg

SEQ ID NO: 1019508 - RNA, 17 nt, Mycobacterium avium subsp. paratuberculosis
cucaacggccggcgccg

SEQ ID NO: 1019509 - RNA, 17 nt, Mycobacterium avium subsp. paratuberculosis
cucacguagucgaccgg

SEQ ID NO: 1019510 - RNA, 16 nt, Mycobacterium avium subsp. paratuberculosis
cucacggcgaauauuu

SEQ ID NO: 1019511 - RNA, 19 nt, Mycobacterium avium subsp. paratuberculosis
cucacgccucgucgagcag

SEQ ID NO: 1019512 - RNA, 17 nt, Mycobacterium avium subsp. paratuberculosis
cucacgacuccuggccg

SEQ ID NO: 1019513 - RNA, 17 nt, Mycobacterium avium subsp. paratuberculosis
cucaccgccgagccgcu

SEQ ID NO: 1019514 - RNA, 20 nt, Mycobacterium avium subsp. paratuberculosis
cucaccgccgagccgcucca

SEQ ID NO: 1019515 - RNA, 17 nt, Mycobacterium avium subsp. paratuberculosis
cucaccccagcgcgacc

SEQ ID NO: 1019516 - RNA, 13 nt, Mycobacterium avium subsp. paratuberculosis
cucacccggccca

SEQ ID NO: 1019517 - RNA, 22 nt, Mycobacterium avium subsp. paratuberculosis
cucacccggcccaccggcccgg

SEQ ID NO: 1019518 - RNA, 21 nt, Mycobacterium avium subsp. paratuberculosis
cucaccgaauuugaaaauguc

SEQ ID NO: 1019519 - RNA, 13 nt, Mycobacterium avium subsp. paratuberculosis
cucacacagccgc

SEQ ID NO: 1019520 - RNA, 11 nt, Mycobacterium avium subsp. paratuberculosis
cucacaccucg

SEQ ID NO: 1019521 - RNA, 20 nt, Mycobacterium avium subsp. paratuberculosis
cucacaaauccagcagcgcg

SEQ ID NO: 1019522 - RNA, 19 nt, Mycobacterium avium subsp. paratuberculosis
cuagggcccacgcucgacg

SEQ ID NO: 1019523 - RNA, 14 nt, Mycobacterium avium subsp. paratuberculosis
cuagucgcccagca

SEQ ID NO: 1019524 - RNA, 16 nt, Mycobacterium avium subsp. paratuberculosis
cuagucgcccagcagc

SEQ ID NO: 1019525 - RNA, 17 nt, Mycobacterium avium subsp. paratuberculosis
cuagucgcccagcagcc

SEQ ID NO: 1019526 - RNA, 14 nt, Mycobacterium avium subsp. paratuberculosis
cuagcgggccagga

SEQ ID NO: 1019527 - RNA, 15 nt, Mycobacterium avium subsp. paratuberculosis
cuagcgggccaggau

SEQ ID NO: 1019528 - RNA, 18 nt, Mycobacterium avium subsp. paratuberculosis
cuagcgggcgcgcagcca

SEQ ID NO: 1019529 - RNA, 18 nt, Mycobacterium avium subsp. paratuberculosis
cuaggcggccgggcggcc

SEQ ID NO: 1019530 - RNA, 21 nt, Mycobacterium avium subsp. paratuberculosis
cuagcgugccguccagcuccg

SEQ ID NO: 1019531 - RNA, 14 nt, Mycobacterium avium subsp. paratuberculosis
cuacuugcggccgc

SEQ ID NO: 1019532 - RNA, 16 nt, Mycobacterium avium subsp. paratuberculosis
cuacuucgucagcagc

SEQ ID NO: 1019533 - RNA, 14 nt, Mycobacterium avium subsp. paratuberculosis
cuacuuggccagcu

SEQ ID NO: 1019534 - RNA, 15 nt, Mycobacterium avium subsp. paratuberculosis
cuagacgcgcaccag

SEQ ID NO: 1019535 - RNA, 17 nt, Mycobacterium avium subsp. paratuberculosis
cuagacgcgcaccaggg

SEQ ID NO: 1019536 - RNA, 20 nt, Mycobacterium avium subsp. paratuberculosis
cuacccgccgacgccugcgc

SEQ ID NO: 1019537 - RNA, 21 nt, Mycobacterium avium subsp. paratuberculosis
cuacccgcgauggcacacagc

SEQ ID NO: 1019538 - RNA, 18 nt, Mycobacterium avium subsp. paratuberculosis
cuaccccgucgaaaccgu

SEQ ID NO: 1019539 - RNA, 23 nt, Mycobacterium avium subsp. paratuberculosis
cuaacgugcccggcccaggcaca

SEQ ID NO: 1019540 - RNA, 12 nt, Mycobacterium avium subsp. paratuberculosis
cuaccagcccca

SEQ ID NO: 1019541 - RNA, 14 nt, Mycobacterium avium subsp. paratuberculosis
cguuuuccagccgg

SEQ ID NO: 1019542 - RNA, 22 nt, Mycobacterium avium subsp. paratuberculosis
cguuucgugugguacagcgcca

SEQ ID NO: 1019543 - RNA, 15 nt, Mycobacterium avium subsp. paratuberculosis
cguugcgggccaggu

SEQ ID NO: 1019544 - RNA, 14 nt, Mycobacterium avium subsp. paratuberculosis
cguugcgggcggcg

SEQ ID NO: 1019545 - RNA, 16 nt, Mycobacterium avium subsp. paratuberculosis
cguugcggccguccag

SEQ ID NO: 1019546 - RNA, 15 nt, Mycobacterium avium subsp. paratuberculosis
cguugcggcgcagcg

SEQ ID NO: 1019547 - RNA, 15 nt, Mycobacterium avium subsp. paratuberculosis
cguuguccagcagcg

SEQ ID NO: 1019548 - RNA, 17 nt, Mycobacterium avium subsp. paratuberculosis
cguuguccagcagcgcc

SEQ ID NO: 1019549 - RNA, 13 nt, Mycobacterium avium subsp. paratuberculosis
cguuguccagcag

SEQ ID NO: 1019550 - RNA, 14 nt, Mycobacterium avium subsp. paratuberculosis
cguugugccaccgc

SEQ ID NO: 1019551 - RNA, 20 nt, Mycobacterium avium subsp. paratuberculosis
cguugucggcggucugagcc

SEQ ID NO: 1019552 - RNA, 16 nt, Mycobacterium avium subsp. paratuberculosis
cguugucguucucccc

SEQ ID NO: 1019553 - RNA, 14 nt, Mycobacterium avium subsp. paratuberculosis
cguugucgcggccc

SEQ ID NO: 1019554 - RNA, 15 nt, Mycobacterium avium subsp. paratuberculosis
cguugucgagcgagc

SEQ ID NO: 1019555 - RNA, 15 nt, Mycobacterium avium subsp. paratuberculosis
cguuccgaugaagaa

SEQ ID NO: 1019556 - RNA, 15 nt, Mycobacterium avium subsp. paratuberculosis
cguucggcggcgcgc

SEQ ID NO: 1019557 - RNA, 12 nt, Mycobacterium avium subsp. paratuberculosis
cguucgagcgcc

SEQ ID NO: 1019558 - RNA, 13 nt, Mycobacterium avium subsp. paratuberculosis
cgucauuccgccg

SEQ ID NO: 1019559 - RNA, 16 nt, Mycobacterium avium subsp. paratuberculosis
cgucaucgugugggcg

SEQ ID NO: 1019560 - RNA, 15 nt, Mycobacterium avium subsp. paratuberculosis
cgucauggccgucgg

SEQ ID NO: 1019561 - RNA, 22 nt, Mycobacterium avium subsp. paratuberculosis
cguccaccagaucgccccgcug

SEQ ID NO: 1019562 - RNA, 22 nt, Mycobacterium avium subsp. paratuberculosis
cguccaccggauggcgcccggc

SEQ ID NO: 1019563 - RNA, 21 nt, Mycobacterium avium subsp. paratuberculosis
cguugaccaacgccgccuccg

SEQ ID NO: 1019564 - RNA, 23 nt, Mycobacterium avium subsp. paratuberculosis
cguugaccaacgccgccuccgac

SEQ ID NO: 1019565 - RNA, 23 nt, Mycobacterium avium subsp. paratuberculosis
cguugaccaccagguaggcgacc

SEQ ID NO: 1019566 - RNA, 23 nt, Mycobacterium avium subsp. paratuberculosis
cguugaccgacgccuccacauac

SEQ ID NO: 1019567 - RNA, 17 nt, Mycobacterium avium subsp. paratuberculosis
cguucgguggccaccgc

SEQ ID NO: 1019568 - RNA, 15 nt, Mycobacterium avium subsp. paratuberculosis
cguugagcaggcugg

SEQ ID NO: 1019569 - RNA, 12 nt, Mycobacterium avium subsp. paratuberculosis
cguugagcacca

SEQ ID NO: 1019570 - RNA, 15 nt, Mycobacterium avium subsp. paratuberculosis
cguugagcacccgga

SEQ ID NO: 1019571 - RNA, 12 nt, Mycobacterium avium subsp. paratuberculosis
cguugagcaccg

SEQ ID NO: 1019572 - RNA, 14 nt, Mycobacterium avium subsp. paratuberculosis
cguugagcaccgcg

SEQ ID NO: 1019573 - RNA, 15 nt, Mycobacterium avium subsp. paratuberculosis
cguugagcacgcgga

SEQ ID NO: 1019574 - RNA, 15 nt, Mycobacterium avium subsp. paratuberculosis
cguugacgcccuccu

SEQ ID NO: 1019575 - RNA, 20 nt, Mycobacterium avium subsp. paratuberculosis
cguugagggcggggcagcag

SEQ ID NO: 1019576 - RNA, 16 nt, Mycobacterium avium subsp. paratuberculosis
cguugaggcggcggcg

SEQ ID NO: 1019577 - RNA, 23 nt, Mycobacterium avium subsp. paratuberculosis
cguugaugaagaccuggccggcc

SEQ ID NO: 1019578 - RNA, 19 nt, Mycobacterium avium subsp. paratuberculosis
cguugaugccgcccagcag

SEQ ID NO: 1019579 - RNA, 12 nt, Mycobacterium avium subsp. paratuberculosis
cguugcagcaca

SEQ ID NO: 1019580 - RNA, 15 nt, Mycobacterium avium subsp. paratuberculosis
cguugcagaacgcgc

SEQ ID NO: 1019581 - RNA, 14 nt, Mycobacterium avium subsp. paratuberculosis
cguugcagcgccgc

SEQ ID NO: 1019582 - RNA, 23 nt, Mycobacterium avium subsp. paratuberculosis
cguugcccaggaaguagccggcc

SEQ ID NO: 1019583 - RNA, 14 nt, Mycobacterium avium subsp. paratuberculosis
cguugcccgccagc

SEQ ID NO: 1019584 - RNA, 17 nt, Mycobacterium avium subsp. paratuberculosis
cguugccaggccgcgag

SEQ ID NO: 1019585 - RNA, 17 nt, Mycobacterium avium subsp. paratuberculosis
cguugcccgucgccucc

SEQ ID NO: 1019586 - RNA, 14 nt, Mycobacterium avium subsp. paratuberculosis
cguugcccugccug

SEQ ID NO: 1019587 - RNA, 23 nt, Mycobacterium avium subsp. paratuberculosis
cguugcgagucaucgccacccgc

SEQ ID NO: 1019588 - RNA, 13 nt, Mycobacterium avium subsp. paratuberculosis
cguugcgccccag

SEQ ID NO: 1019589 - RNA, 15 nt, Mycobacterium avium subsp. paratuberculosis
cguugcgcaucagcg

SEQ ID NO: 1019590 - RNA, 14 nt, Mycobacterium avium subsp. paratuberculosis
cguugcgcccggcc

SEQ ID NO: 1019591 - RNA, 20 nt, Mycobacterium avium subsp. paratuberculosis
cguugcgccgcaacggcgca

SEQ ID NO: 1019592 - RNA, 13 nt, Mycobacterium avium subsp. paratuberculosis
cguugcgccgcca

SEQ ID NO: 1019593 - RNA, 15 nt, Mycobacterium avium subsp. paratuberculosis
cguugcgccgccagg

SEQ ID NO: 1019594 - RNA, 15 nt, Mycobacterium avium subsp. paratuberculosis
cguugcgcggcggcc

SEQ ID NO: 1019595 - RNA, 15 nt, Mycobacterium avium subsp. paratuberculosis
cguugcgcggccgca

SEQ ID NO: 1019596 - RNA, 21 nt, Mycobacterium avium subsp. paratuberculosis
cguugcggaucgaacggcgga

SEQ ID NO: 1019597 - RNA, 14 nt, Mycobacterium avium subsp. paratuberculosis
cguugccgcgcgcc

SEQ ID NO: 1019598 - RNA, 17 nt, Mycobacterium avium subsp. paratuberculosis
cguugccggcccgcagc

SEQ ID NO: 1019599 - RNA, 16 nt, Mycobacterium avium subsp. paratuberculosis
cguugccggcggccag

SEQ ID NO: 1019600 - RNA, 14 nt, Mycobacterium avium subsp. paratuberculosis
cguugccggcggcg

SEQ ID NO: 1019601 - RNA, 16 nt, Mycobacterium avium subsp. paratuberculosis
aaaacgggguggaaua

SEQ ID NO: 1019602 - RNA, 13 nt, Mycobacterium avium subsp. paratuberculosis
aaaagugggucag

SEQ ID NO: 1019603 - RNA, 14 nt, Mycobacterium avium subsp. paratuberculosis
aaaauccagaacag

SEQ ID NO: 1019604 - RNA, 23 nt, Mycobacterium avium subsp. paratuberculosis
aaaaugcccagugucgcaaagac

SEQ ID NO: 1019605 - RNA, 21 nt, Mycobacterium avium subsp. paratuberculosis
aaaaagcguugcgccagcagg

SEQ ID NO: 1019606 - RNA, 20 nt, Mycobacterium avium subsp. paratuberculosis
aaaugcggaauagcgcucca

SEQ ID NO: 1019607 - RNA, 12 nt, Mycobacterium avium subsp. paratuberculosis
aaaugccuuggc

SEQ ID NO: 1019608 - RNA, 20 nt, Mycobacterium avium subsp. paratuberculosis
aaaugcccgcgccccggccu

SEQ ID NO: 1019609 - RNA, 23 nt, Mycobacterium avium subsp. paratuberculosis
aaauagcggcgcaccuggcgcag

SEQ ID NO: 1019610 - RNA, 18 nt, Mycobacterium avium subsp. paratuberculosis
aaaguccuucucgggcaa

SEQ ID NO: 1019611 - RNA, 13 nt, Mycobacterium avium subsp. paratuberculosis
aaauaaccgcgcg

SEQ ID NO: 1019612 - RNA, 23 nt, Mycobacterium avium subsp. paratuberculosis
aaaucagccgagccgggucaucc

SEQ ID NO: 1019613 - RNA, 15 nt, Mycobacterium avium subsp. paratuberculosis
aaaggccgccgcugg

SEQ ID NO: 1019614 - RNA, 16 nt, Mycobacterium avium subsp. paratuberculosis
aaagcguugccgcgcg

SEQ ID NO: 1019615 - RNA, 19 nt, Mycobacterium avium subsp. paratuberculosis
aaagcguugcgccagcagg

SEQ ID NO: 1019616 - RNA, 21 nt, Mycobacterium avium subsp. paratuberculosis
aaagccggucacgcugaucga

SEQ ID NO: 1019617 - RNA, 20 nt, Mycobacterium avium subsp. paratuberculosis
aaagccgaggcgcaacaccg

SEQ ID NO: 1019618 - RNA, 17 nt, Mycobacterium avium subsp. paratuberculosis
aaagcuguugaccacca

SEQ ID NO: 1019619 - RNA, 20 nt, Mycobacterium avium subsp. paratuberculosis
aaagcagcguucggucagca

SEQ ID NO: 1019620 - RNA, 21 nt, Mycobacterium avium subsp. paratuberculosis
aaagacgcacuaaucaacgaa

SEQ ID NO: 1019621 - RNA, 17 nt, Mycobacterium avium subsp. paratuberculosis
aaacuccgggggauugc

SEQ ID NO: 1019622 - RNA, 14 nt, Mycobacterium avium subsp. paratuberculosis
aaacuaacuucacg

SEQ ID NO: 1019623 - RNA, 23 nt, Mycobacterium avium subsp. paratuberculosis
aaacgcuucuccgccuucgaguu

SEQ ID NO: 1019624 - RNA, 23 nt, Mycobacterium avium subsp. paratuberculosis
aagcuucaagauaggagacagcc

SEQ ID NO: 1019625 - RNA, 13 nt, Mycobacterium avium subsp. paratuberculosis
aaggacuggccca

SEQ ID NO: 1019626 - RNA, 20 nt, Mycobacterium avium subsp. paratuberculosis
aagcugccguugcgccagcg

SEQ ID NO: 1019627 - RNA, 16 nt, Mycobacterium avium subsp. paratuberculosis
aagcugcgccacaacu

SEQ ID NO: 1019628 - RNA, 16 nt, Mycobacterium avium subsp. paratuberculosis
aagcguucguagaacc

SEQ ID NO: 1019629 - RNA, 16 nt, Mycobacterium avium subsp. paratuberculosis
aagcucgccaggaugu

SEQ ID NO: 1019630 - RNA, 14 nt, Mycobacterium avium subsp. paratuberculosis
aagccgcggacggc

SEQ ID NO: 1019631 - RNA, 17 nt, Mycobacterium avium subsp. paratuberculosis
aagccgacgucgaccag

SEQ ID NO: 1019632 - RNA, 13 nt, Mycobacterium avium subsp. paratuberculosis
aagcguacccagg

SEQ ID NO: 1019633 - RNA, 22 nt, Mycobacterium avium subsp. paratuberculosis
aaggcgaacgggcuggccaggc

SEQ ID NO: 1019634 - RNA, 23 nt, Mycobacterium avium subsp. paratuberculosis
aaggcgaauaaggggguagaugu

SEQ ID NO: 1019635 - RNA, 22 nt, Mycobacterium avium subsp. paratuberculosis
aaggcgcagaagcuaacgccag

SEQ ID NO: 1019636 - RNA, 19 nt, Mycobacterium avium subsp. paratuberculosis
aaggcguuggagccgacca

SEQ ID NO: 1019637 - RNA, 16 nt, Mycobacterium avium subsp. paratuberculosis
aaggugucgcacugcu

SEQ ID NO: 1019638 - RNA, 16 nt, Mycobacterium avium subsp. paratuberculosis
aaggugccguccgggu

SEQ ID NO: 1019639 - RNA, 16 nt, Mycobacterium avium subsp. paratuberculosis
aagcccaggcccggca

SEQ ID NO: 1019640 - RNA, 17 nt, Mycobacterium avium subsp. paratuberculosis
aagccccgguuccaacc

SEQ ID NO: 1019641 - RNA, 19 nt, Mycobacterium avium subsp. paratuberculosis
aagcccccaaugucacggc

SEQ ID NO: 1019642 - RNA, 13 nt, Mycobacterium avium subsp. paratuberculosis
aagccacggaguc

SEQ ID NO: 1019643 - RNA, 14 nt, Mycobacterium avium subsp. paratuberculosis
aagcagcucgcgua

SEQ ID NO: 1019644 - RNA, 14 nt, Mycobacterium avium subsp. paratuberculosis
aagcagccuucuug

SEQ ID NO: 1019645 - RNA, 17 nt, Mycobacterium avium subsp. paratuberculosis
aagcagagcagcgagau

SEQ ID NO: 1019646 - RNA, 20 nt, Mycobacterium avium subsp. paratuberculosis
aagcagaacgccaucaccag

SEQ ID NO: 1019647 - RNA, 23 nt, Mycobacterium avium subsp. paratuberculosis
aagcagaacgccaucaccagcgc

SEQ ID NO: 1019648 - RNA, 18 nt, Mycobacterium avium subsp. paratuberculosis
aagauggcgugccacagc

SEQ ID NO: 1019649 - RNA, 22 nt, Mycobacterium avium subsp. paratuberculosis
aagauggcgugccacagcauga

SEQ ID NO: 1019650 - RNA, 18 nt, Mycobacterium avium subsp. paratuberculosis
aagauguaucaggaucug

SEQ ID NO: 1019651 - RNA, 23 nt, Mycobacterium avium subsp. paratuberculosis
aagauguaucaggaucugcgcaa

SEQ ID NO: 1019652 - RNA, 19 nt, Mycobacterium avium subsp. paratuberculosis
aauacccgcccagcaccag

SEQ ID NO: 1019653 - RNA, 13 nt, Mycobacterium avium subsp. paratuberculosis
aauacccgaccag

SEQ ID NO: 1019654 - RNA, 13 nt, Mycobacterium avium subsp. paratuberculosis
aaguugcccaacu

SEQ ID NO: 1019655 - RNA, 23 nt, Mycobacterium avium subsp. paratuberculosis
aaguucggcaucccggagaacau

SEQ ID NO: 1019656 - RNA, 19 nt, Mycobacterium avium subsp. paratuberculosis
aaguucggcgggggcaggg

SEQ ID NO: 1019657 - RNA, 20 nt, Mycobacterium avium subsp. paratuberculosis
aaguucggcgggggcaggga

SEQ ID NO: 1019658 - RNA, 14 nt, Mycobacterium avium subsp. paratuberculosis
aagaagugggccau

SEQ ID NO: 1019659 - RNA, 14 nt, Mycobacterium avium subsp. paratuberculosis
aagaaguuucccca

SEQ ID NO: 1019660 - RNA, 19 nt, Mycobacterium avium subsp. paratuberculosis
aagaaggacaagccggaga

SEQ ID NO: 1019661 - RNA, 20 nt, Mycobacterium avium subsp. paratuberculosis
aagaagcgggccaaagagcu

SEQ ID NO: 1019662 - RNA, 18 nt, Mycobacterium avium subsp. paratuberculosis
aagaacgaaaagauguau

SEQ ID NO: 1019663 - RNA, 23 nt, Mycobacterium avium subsp. paratuberculosis
aagaacgaaaagauguaucagga

SEQ ID NO: 1019664 - RNA, 20 nt, Mycobacterium avium subsp. paratuberculosis
aacuucaccgucugcuggcc

SEQ ID NO: 1019665 - RNA, 17 nt, Mycobacterium avium subsp. paratuberculosis
aacugguccugcggcug

SEQ ID NO: 1019666 - RNA, 19 nt, Mycobacterium avium subsp. paratuberculosis
aacugguccugcggcuggu

SEQ ID NO: 1019667 - RNA, 21 nt, Mycobacterium avium subsp. paratuberculosis
aacugguccugcggcugguag

SEQ ID NO: 1019668 - RNA, 15 nt, Mycobacterium avium subsp. paratuberculosis
aacuuaacuucacgc

SEQ ID NO: 1019669 - RNA, 22 nt, Mycobacterium avium subsp. paratuberculosis
aacugauugcccuuggacaccu

SEQ ID NO: 1019670 - RNA, 15 nt, Mycobacterium avium subsp. paratuberculosis
aacugcaccagcggc

SEQ ID NO: 1019671 - RNA, 17 nt, Mycobacterium avium subsp. paratuberculosis
aacugcucgaccagcgc

SEQ ID NO: 1019672 - RNA, 19 nt, Mycobacterium avium subsp. paratuberculosis
aacugcagcgacuggcccu

SEQ ID NO: 1019673 - RNA, 15 nt, Mycobacterium avium subsp. paratuberculosis
aacugcaucgccagc

SEQ ID NO: 1019674 - RNA, 17 nt, Mycobacterium avium subsp. paratuberculosis
aacugcaucgccagcac

SEQ ID NO: 1019675 - RNA, 13 nt, Mycobacterium avium subsp. paratuberculosis
aacgugcccggcc

SEQ ID NO: 1019676 - RNA, 15 nt, Mycobacterium avium subsp. paratuberculosis
aacgucgcagcccgg

SEQ ID NO: 1019677 - RNA, 15 nt, Mycobacterium avium subsp. paratuberculosis
aacgucgauccccgc

SEQ ID NO: 1019678 - RNA, 14 nt, Mycobacterium avium subsp. paratuberculosis
aacgucaggcccag

SEQ ID NO: 1019679 - RNA, 18 nt, Mycobacterium avium subsp. paratuberculosis
aacuacuucgucagcagc

SEQ ID NO: 1019680 - RNA, 14 nt, Mycobacterium avium subsp. paratuberculosis
aacuagcuucacgu

SEQ ID NO: 1019681 - RNA, 22 nt, Mycobacterium avium subsp. paratuberculosis
aacuaccgacggcaccucucgg

SEQ ID NO: 1019682 - RNA, 14 nt, Mycobacterium avium subsp. paratuberculosis
aacuacgcacccga

SEQ ID NO: 1019683 - RNA, 14 nt, Mycobacterium avium subsp. paratuberculosis
aacuacgagcagca

SEQ ID NO: 1019684 - RNA, 20 nt, Mycobacterium avium subsp. paratuberculosis
aacuacgagcagcaagagca

SEQ ID NO: 1019685 - RNA, 22 nt, Mycobacterium avium subsp. paratuberculosis
aacggguugcgaaagcccaggc

SEQ ID NO: 1019686 - RNA, 22 nt, Mycobacterium avium subsp. paratuberculosis
aacggaauucagugaggccagc

SEQ ID NO: 1019687 - RNA, 14 nt, Mycobacterium avium subsp. paratuberculosis
aacgccucgggccg

SEQ ID NO: 1019688 - RNA, 19 nt, Mycobacterium avium subsp. paratuberculosis
aacgccucgggccggcagc

SEQ ID NO: 1019689 - RNA, 20 nt, Mycobacterium avium subsp. paratuberculosis
aacgccuccgaauccagcgc

SEQ ID NO: 1019690 - RNA, 18 nt, Mycobacterium avium subsp. paratuberculosis
aacgccggcgugcacagg

SEQ ID NO: 1019691 - RNA, 14 nt, Mycobacterium avium subsp. paratuberculosis
aacgcuuccagcac

SEQ ID NO: 1019692 - RNA, 14 nt, Mycobacterium avium subsp. paratuberculosis
aacgcugccaggcg

SEQ ID NO: 1019693 - RNA, 21 nt, Mycobacterium avium subsp. paratuberculosis
aacgcuggucgaacgccaccu

SEQ ID NO: 1019694 - RNA, 19 nt, Mycobacterium avium subsp. paratuberculosis
aacgauucacccagcgagc

SEQ ID NO: 1019695 - RNA, 23 nt, Mycobacterium avium subsp. paratuberculosis
aacgauuuccgguuccucggcgu

SEQ ID NO: 1019696 - RNA, 17 nt, Mycobacterium avium subsp. paratuberculosis
aacgaucggcuccagcg

SEQ ID NO: 1019697 - RNA, 18 nt, Mycobacterium avium subsp. paratuberculosis
aaccgcugcggcacacca

SEQ ID NO: 1019698 - RNA, 16 nt, Mycobacterium avium subsp. paratuberculosis
aaccgcugcugcucgg

SEQ ID NO: 1019699 - RNA, 17 nt, Mycobacterium avium subsp. paratuberculosis
aaccggaauggcagcag

SEQ ID NO: 1019700 - RNA, 19 nt, Mycobacterium avium subsp. paratuberculosis
aaccggaauggcagcagcc

SEQ ID NO: 1019701 - RNA, 16 nt, Mycobacterium avium subsp. paratuberculosis
aaccggaucuggcccu

SEQ ID NO: 1019702 - RNA, 14 nt, Mycobacterium avium subsp. paratuberculosis
aaccggccagcagc

SEQ ID NO: 1019703 - RNA, 15 nt, Mycobacterium avium subsp. paratuberculosis
aaccggccagcagca

SEQ ID NO: 1019704 - RNA, 14 nt, Mycobacterium avium subsp. paratuberculosis
aaccggccggggcg

SEQ ID NO: 1019705 - RNA, 12 nt, Mycobacterium avium subsp. paratuberculosis
aacgccacggcg

SEQ ID NO: 1019706 - RNA, 17 nt, Mycobacterium avium subsp. paratuberculosis
aacgccaucaccagcgc

SEQ ID NO: 1019707 - RNA, 13 nt, Mycobacterium avium subsp. paratuberculosis
aacgccagccaga

SEQ ID NO: 1019708 - RNA, 17 nt, Mycobacterium avium subsp. paratuberculosis
aacgccagccagaacac

SEQ ID NO: 1019709 - RNA, 12 nt, Mycobacterium avium subsp. paratuberculosis
aacgccagcagc

SEQ ID NO: 1019710 - RNA, 17 nt, Mycobacterium avium subsp. paratuberculosis
aacgccacguagcagca

SEQ ID NO: 1019711 - RNA, 18 nt, Mycobacterium avium subsp. paratuberculosis
aacgccacguagcagcag

SEQ ID NO: 1019712 - RNA, 18 nt, Mycobacterium avium subsp. paratuberculosis
aacgccagcgugagcuca

SEQ ID NO: 1019713 - RNA, 20 nt, Mycobacterium avium subsp. paratuberculosis
aacgccagcugggcagccag

SEQ ID NO: 1019714 - RNA, 21 nt, Mycobacterium avium subsp. paratuberculosis
aacgccagcugggcagccaga

SEQ ID NO: 1019715 - RNA, 18 nt, Mycobacterium avium subsp. paratuberculosis
aacgcccgcaacuccaca

SEQ ID NO: 1019716 - RNA, 21 nt, Mycobacterium avium subsp. paratuberculosis
aacgcccgcaacuccacaacc

SEQ ID NO: 1019717 - RNA, 11 nt, Mycobacterium avium subsp. paratuberculosis
aacgcccggcu

SEQ ID NO: 1019718 - RNA, 13 nt, Mycobacterium avium subsp. paratuberculosis
aacgcccggcuca

SEQ ID NO: 1019719 - RNA, 16 nt, Mycobacterium avium subsp. paratuberculosis
aaccacugauccguca

SEQ ID NO: 1019720 - RNA, 14 nt, Mycobacterium avium subsp. paratuberculosis
aaccacaccagcau

SEQ ID NO: 1019721 - RNA, 19 nt, Mycobacterium avium subsp. paratuberculosis
aacccgcugucaauccccg

SEQ ID NO: 1019722 - RNA, 19 nt, Mycobacterium avium subsp. paratuberculosis
aacccggcgugcuccagca

SEQ ID NO: 1019723 - RNA, 13 nt, Mycobacterium avium subsp. paratuberculosis
aaccgccagcagc

SEQ ID NO: 1019724 - RNA, 14 nt, Mycobacterium avium subsp. paratuberculosis
aaccgccagcagcg

SEQ ID NO: 1019725 - RNA, 19 nt, Mycobacterium avium subsp. paratuberculosis
aaccgauuucggccagccg

SEQ ID NO: 1019726 - RNA, 17 nt, Mycobacterium avium subsp. paratuberculosis
aaccgaucaccggcagc

SEQ ID NO: 1019727 - RNA, 18 nt, Mycobacterium avium subsp. paratuberculosis
aaccgcggcggcagcagc

SEQ ID NO: 1019728 - RNA, 19 nt, Mycobacterium avium subsp. paratuberculosis
aaccgcggcggcagcagcc

SEQ ID NO: 1019729 - RNA, 18 nt, Mycobacterium avium subsp. paratuberculosis
aaccgcguggcgcacagc

SEQ ID NO: 1019730 - RNA, 17 nt, Mycobacterium avium subsp. paratuberculosis
aaccgcccuuccagcac

SEQ ID NO: 1019731 - RNA, 23 nt, Mycobacterium avium subsp. paratuberculosis
aaccgcgcacucgaacggcccgg

SEQ ID NO: 1019732 - RNA, 11 nt, Mycobacterium avium subsp. paratuberculosis
aacccugggcg

SEQ ID NO: 1019733 - RNA, 18 nt, Mycobacterium avium subsp. paratuberculosis
aaccgaaucgagccgagg

SEQ ID NO: 1019734 - RNA, 21 nt, Mycobacterium avium subsp. paratuberculosis
aaccgaagggaaaggcagcag

SEQ ID NO: 1019735 - RNA, 22 nt, Mycobacterium avium subsp. paratuberculosis
aaccgaagggaaaggcagcagc

SEQ ID NO: 1019736 - RNA, 16 nt, Mycobacterium avium subsp. paratuberculosis
aacaucccggagccgu

SEQ ID NO: 1019737 - RNA, 18 nt, Mycobacterium avium subsp. paratuberculosis
aacagccgggccagcagc

SEQ ID NO: 1019738 - RNA, 22 nt, Mycobacterium avium subsp. paratuberculosis
aacagccgggccagcagcuuga

SEQ ID NO: 1019739 - RNA, 21 nt, Mycobacterium avium subsp. paratuberculosis
aacagcgacuccugacgcacc

SEQ ID NO: 1019740 - RNA, 21 nt, Mycobacterium avium subsp. paratuberculosis
aacagagcgggaucccgcagc

SEQ ID NO: 1019741 - RNA, 17 nt, Mycobacterium avium subsp. paratuberculosis
aacacuuuuaaggagca

SEQ ID NO: 1019742 - RNA, 10 nt, Mycobacterium avium subsp. paratuberculosis
aacagcagca

SEQ ID NO: 1019743 - RNA, 14 nt, Mycobacterium avium subsp. paratuberculosis
aacagcaccagcac

SEQ ID NO: 1019744 - RNA, 17 nt, Mycobacterium avium subsp. paratuberculosis
aacagcaccagcaccac

SEQ ID NO: 1019745 - RNA, 22 nt, Mycobacterium avium subsp. paratuberculosis
aacagcaggcccaggccgaugg

SEQ ID NO: 1019746 - RNA, 23 nt, Mycobacterium avium subsp. paratuberculosis
aacagcagcgaacccgccagggc

SEQ ID NO: 1019747 - RNA, 14 nt, Mycobacterium avium subsp. paratuberculosis
aacagcagcagcag

SEQ ID NO: 1019748 - RNA, 14 nt, Mycobacterium avium subsp. paratuberculosis
aacagcagcacccg

SEQ ID NO: 1019749 - RNA, 12 nt, Mycobacterium avium subsp. paratuberculosis
aacagcagcaga

SEQ ID NO: 1019750 - RNA, 20 nt, Mycobacterium avium subsp. paratuberculosis
aacagcagcagaaccagcac

SEQ ID NO: 1019751 - RNA, 17 nt, Mycobacterium avium subsp. paratuberculosis
aacacgucggccagcgc

SEQ ID NO: 1019752 - RNA, 15 nt, Mycobacterium avium subsp. paratuberculosis
aacacguccuggcgc

SEQ ID NO: 1019753 - RNA, 23 nt, Mycobacterium avium subsp. paratuberculosis
aacacguccuggcgccaguagug

SEQ ID NO: 1019754 - RNA, 13 nt, Mycobacterium avium subsp. paratuberculosis
aacaccuccucgg

SEQ ID NO: 1019755 - RNA, 21 nt, Mycobacterium avium subsp. paratuberculosis
aacaccuccucgguguacagc

SEQ ID NO: 1019756 - RNA, 20 nt, Mycobacterium avium subsp. paratuberculosis
aacaccucgccuccagcagg

SEQ ID NO: 1019757 - RNA, 15 nt, Mycobacterium avium subsp. paratuberculosis
aacaccucggugauc

SEQ ID NO: 1019758 - RNA, 17 nt, Mycobacterium avium subsp. paratuberculosis
aacacccccgcgcugcc

SEQ ID NO: 1019759 - RNA, 14 nt, Mycobacterium avium subsp. paratuberculosis
aacaccgccagcac

SEQ ID NO: 1019760 - RNA, 15 nt, Mycobacterium avium subsp. paratuberculosis
aacaccaccaggccg

SEQ ID NO: 1019761 - RNA, 17 nt, Mycobacterium avium subsp. paratuberculosis
aacaccaccgccaggua

SEQ ID NO: 1019762 - RNA, 18 nt, Mycobacterium avium subsp. paratuberculosis
aacaccagcgcauacaac

SEQ ID NO: 1019763 - RNA, 13 nt, Mycobacterium avium subsp. paratuberculosis
aacaccaucgcuu

SEQ ID NO: 1019764 - RNA, 16 nt, Mycobacterium avium subsp. paratuberculosis
aauccgcgcagcagcg

SEQ ID NO: 1019765 - RNA, 21 nt, Mycobacterium avium subsp. paratuberculosis
aauccggccccgcugccgucc

SEQ ID NO: 1019766 - RNA, 22 nt, Mycobacterium avium subsp. paratuberculosis
aaucuucgccuccgggaaggcg

SEQ ID NO: 1019767 - RNA, 20 nt, Mycobacterium avium subsp. paratuberculosis
aaucgcagacguagcaccag

SEQ ID NO: 1019768 - RNA, 15 nt, Mycobacterium avium subsp. paratuberculosis
aaucacgcaccgucc

SEQ ID NO: 1019769 - RNA, 10 nt, Mycobacterium avium subsp. paratuberculosis
aauuccagcg

SEQ ID NO: 1019770 - RNA, 13 nt, Mycobacterium avium subsp. paratuberculosis
aauuguggcggcc

SEQ ID NO: 1019771 - RNA, 23 nt, Mycobacterium avium subsp. paratuberculosis
aauugccuugcuccacacuggcu

SEQ ID NO: 1019772 - RNA, 23 nt, Mycobacterium avium subsp. paratuberculosis
aauugcuuuuugaccaccggcac

SEQ ID NO: 1019773 - RNA, 20 nt, Mycobacterium avium subsp. paratuberculosis
aauggauccgaucagcagca

SEQ ID NO: 1019774 - RNA, 19 nt, Mycobacterium avium subsp. paratuberculosis
acaaaagcgcccgauuccc

SEQ ID NO: 1019775 - RNA, 14 nt, Mycobacterium avium subsp. paratuberculosis
acaaagaucacagc

SEQ ID NO: 1019776 - RNA, 13 nt, Mycobacterium avium subsp. paratuberculosis
acaaagccggucu

SEQ ID NO: 1019777 - RNA, 15 nt, Mycobacterium avium subsp. paratuberculosis
acaacaccaccucuu

SEQ ID NO: 1019778 - RNA, 23 nt, Mycobacterium avium subsp. paratuberculosis
acaacacggggcuauccgggguc

SEQ ID NO: 1019779 - RNA, 14 nt, Mycobacterium avium subsp. paratuberculosis
acaccaacgacagc

SEQ ID NO: 1019780 - RNA, 18 nt, Mycobacterium avium subsp. paratuberculosis
acaccacgccgagcaccu

SEQ ID NO: 1019781 - RNA, 20 nt, Mycobacterium avium subsp. paratuberculosis
acaccaccacgugccccucc

SEQ ID NO: 1019782 - RNA, 22 nt, Mycobacterium avium subsp. paratuberculosis
acaccccgcgagucaccggcuc

SEQ ID NO: 1019783 - RNA, 17 nt, Mycobacterium avium subsp. paratuberculosis
acaccccggccaccagg

SEQ ID NO: 1019784 - RNA, 16 nt, Mycobacterium avium subsp. paratuberculosis
acaccgagccggcggc

SEQ ID NO: 1019785 - RNA, 16 nt, Mycobacterium avium subsp. paratuberculosis
acaccgagccggggcu

SEQ ID NO: 1019786 - RNA, 18 nt, Mycobacterium avium subsp. paratuberculosis
acaccgccccgccgcgcc

SEQ ID NO: 1019787 - RNA, 14 nt, Mycobacterium avium subsp. paratuberculosis
acaccgccagcacc

SEQ ID NO: 1019788 - RNA, 16 nt, Mycobacterium avium subsp. paratuberculosis
acaccgcggcggcguc

SEQ ID NO: 1019789 - RNA, 15 nt, Mycobacterium avium subsp. paratuberculosis
acacaugguccugca

SEQ ID NO: 1019790 - RNA, 12 nt, Mycobacterium avium subsp. paratuberculosis
acacgaucucgu

SEQ ID NO: 1019791 - RNA, 13 nt, Mycobacterium avium subsp. paratuberculosis
acacgaccgccug

SEQ ID NO: 1019792 - RNA, 15 nt, Mycobacterium avium subsp. paratuberculosis
acacgcccugcaggu

SEQ ID NO: 1019793 - RNA, 14 nt, Mycobacterium avium subsp. paratuberculosis
acacgccggcggcc

SEQ ID NO: 1019794 - RNA, 14 nt, Mycobacterium avium subsp. paratuberculosis
acacgcggacaggg

SEQ ID NO: 1019795 - RNA, 21 nt, Mycobacterium avium subsp. paratuberculosis
acacggcaggcggcccgcucg

SEQ ID NO: 1019796 - RNA, 18 nt, Mycobacterium avium subsp. paratuberculosis
acacgggccgcgccgagg

SEQ ID NO: 1019797 - RNA, 23 nt, Mycobacterium avium subsp. paratuberculosis
acacgggcggcagggccagcacc

SEQ ID NO: 1019798 - RNA, 19 nt, Mycobacterium avium subsp. paratuberculosis
acacggcucgggggccgcu

SEQ ID NO: 1019799 - RNA, 14 nt, Mycobacterium avium subsp. paratuberculosis
acacggcugcaccc

SEQ ID NO: 1019800 - RNA, 15 nt, Mycobacterium avium subsp. paratuberculosis
acaccgucgcccgcc

SEQ ID NO: 1019801 - RNA, 17 nt, Mycobacterium avium subsp. paratuberculosis
acaccgucgcgcaccca

SEQ ID NO: 1019802 - RNA, 14 nt, Mycobacterium avium subsp. paratuberculosis
acaccggcagcgcc

SEQ ID NO: 1019803 - RNA, 17 nt, Mycobacterium avium subsp. paratuberculosis
acaccgcguuggccgcc

SEQ ID NO: 1019804 - RNA, 18 nt, Mycobacterium avium subsp. paratuberculosis
acaccggggccagguacu

SEQ ID NO: 1019805 - RNA, 19 nt, Mycobacterium avium subsp. paratuberculosis
acaccgggcaccgacauca

SEQ ID NO: 1019806 - RNA, 19 nt, Mycobacterium avium subsp. paratuberculosis
acaccuucgcggucggcaa

SEQ ID NO: 1019807 - RNA, 22 nt, Mycobacterium avium subsp. paratuberculosis
acaccuuggcggccaccaucuc

SEQ ID NO: 1019808 - RNA, 22 nt, Mycobacterium avium subsp. paratuberculosis
acaccucgcuacgcgagcugcu

SEQ ID NO: 1019809 - RNA, 14 nt, Mycobacterium avium subsp. paratuberculosis
acaccugccgcaca

SEQ ID NO: 1019810 - RNA, 20 nt, Mycobacterium avium subsp. paratuberculosis
acaacgccagcgugagcuca

SEQ ID NO: 1019811 - RNA, 14 nt, Mycobacterium avium subsp. paratuberculosis
acaacgacagcacc

SEQ ID NO: 1019812 - RNA, 15 nt, Mycobacterium avium subsp. paratuberculosis
acaauccggucagcg

SEQ ID NO: 1019813 - RNA, 13 nt, Mycobacterium avium subsp. paratuberculosis
acacguagcgguc

SEQ ID NO: 1019814 - RNA, 18 nt, Mycobacterium avium subsp. paratuberculosis
acacguagcgguccagcg

SEQ ID NO: 1019815 - RNA, 17 nt, Mycobacterium avium subsp. paratuberculosis
acacgugcggauggccc

SEQ ID NO: 1019816 - RNA, 18 nt, Mycobacterium avium subsp. paratuberculosis
acacguccuggcgccagu

SEQ ID NO: 1019817 - RNA, 13 nt, Mycobacterium avium subsp. paratuberculosis
acagcagccgcac

SEQ ID NO: 1019818 - RNA, 20 nt, Mycobacterium avium subsp. paratuberculosis
acagcagccgcucacacagc

SEQ ID NO: 1019819 - RNA, 14 nt, Mycobacterium avium subsp. paratuberculosis
acagcagcgaaccc

SEQ ID NO: 1019820 - RNA, 16 nt, Mycobacterium avium subsp. paratuberculosis
acagcagcaccagcgc

SEQ ID NO: 1019821 - RNA, 20 nt, Mycobacterium avium subsp. paratuberculosis
acagcagcacccgggugauc

SEQ ID NO: 1019822 - RNA, 16 nt, Mycobacterium avium subsp. paratuberculosis
acagcagcaccggcac

SEQ ID NO: 1019823 - RNA, 16 nt, Mycobacterium avium subsp. paratuberculosis
acagcagcagcaccag

SEQ ID NO: 1019824 - RNA, 21 nt, Mycobacterium avium subsp. paratuberculosis
acagcagcagcaccaggcuga

SEQ ID NO: 1019825 - RNA, 18 nt, Mycobacterium avium subsp. paratuberculosis
acagcagcagcagcggca

SEQ ID NO: 1019826 - RNA, 9 nt, Mycobacterium avium subsp. paratuberculosis
acagcagcc

SEQ ID NO: 1019827 - RNA, 12 nt, Mycobacterium avium subsp. paratuberculosis
acagcaggcugu

SEQ ID NO: 1019828 - RNA, 12 nt, Mycobacterium avium subsp. paratuberculosis
acagcaggccca

SEQ ID NO: 1019829 - RNA, 14 nt, Mycobacterium avium subsp. paratuberculosis
acagcagggcaccg

SEQ ID NO: 1019830 - RNA, 20 nt, Mycobacterium avium subsp. paratuberculosis
acagcagguauuuggugacc

SEQ ID NO: 1019831 - RNA, 14 nt, Mycobacterium avium subsp. paratuberculosis
acagccgcagcagc

SEQ ID NO: 1019832 - RNA, 18 nt, Mycobacterium avium subsp. paratuberculosis
acagccagucgaagacca

SEQ ID NO: 1019833 - RNA, 23 nt, Mycobacterium avium subsp. paratuberculosis
acagcgaaagcgcuuggcggaga

SEQ ID NO: 1019834 - RNA, 14 nt, Mycobacterium avium subsp. paratuberculosis
acagccggcggcgg

SEQ ID NO: 1019835 - RNA, 18 nt, Mycobacterium avium subsp. paratuberculosis
acagccgggccagcagcu

SEQ ID NO: 1019836 - RNA, 17 nt, Mycobacterium avium subsp. paratuberculosis
acagccggggcagcugc

SEQ ID NO: 1019837 - RNA, 22 nt, Mycobacterium avium subsp. paratuberculosis
acagccgguccgaccgccacca

SEQ ID NO: 1019838 - RNA, 17 nt, Mycobacterium avium subsp. paratuberculosis
acagccgguccugggcc

SEQ ID NO: 1019839 - RNA, 14 nt, Mycobacterium avium subsp. paratuberculosis
acagcuccaacagc

SEQ ID NO: 1019840 - RNA, 19 nt, Mycobacterium avium subsp. paratuberculosis
acagcuccaacagccgguc

SEQ ID NO: 1019841 - RNA, 13 nt, Mycobacterium avium subsp. paratuberculosis
acagcucaccugc

SEQ ID NO: 1019842 - RNA, 16 nt, Mycobacterium avium subsp. paratuberculosis
acagcuaggccagcag

SEQ ID NO: 1019843 - RNA, 17 nt, Mycobacterium avium subsp. paratuberculosis
acagcuaggccagcagc

SEQ ID NO: 1019844 - RNA, 18 nt, Mycobacterium avium subsp. paratuberculosis
acagcuaggccagcagcg

SEQ ID NO: 1019845 - RNA, 14 nt, Mycobacterium avium subsp. paratuberculosis
acagcgccagcacg

SEQ ID NO: 1019846 - RNA, 23 nt, Mycobacterium avium subsp. paratuberculosis
acagcgccgacuuggugccaugc

SEQ ID NO: 1019847 - RNA, 16 nt, Mycobacterium avium subsp. paratuberculosis
acagcgacuccagcgc

SEQ ID NO: 1019848 - RNA, 14 nt, Mycobacterium avium subsp. paratuberculosis
acagcgacaaucuc

SEQ ID NO: 1019849 - RNA, 20 nt, Mycobacterium avium subsp. paratuberculosis
acagcgacccgaaccggauc

SEQ ID NO: 1019850 - RNA, 22 nt, Mycobacterium avium subsp. paratuberculosis
acagcuuucgggcggccugccg

SEQ ID NO: 1019851 - RNA, 18 nt, Mycobacterium avium subsp. paratuberculosis
acagcuugucccagugcu

SEQ ID NO: 1019852 - RNA, 14 nt, Mycobacterium avium subsp. paratuberculosis
acaggccggccgcu

SEQ ID NO: 1019853 - RNA, 15 nt, Mycobacterium avium subsp. paratuberculosis
acaggcuggccagcu

SEQ ID NO: 1019854 - RNA, 19 nt, Mycobacterium avium subsp. paratuberculosis
acaggcuggccagcucggc

SEQ ID NO: 1019855 - RNA, 23 nt, Mycobacterium avium subsp. paratuberculosis
acagguugggaaaacccggaacc

SEQ ID NO: 1019856 - RNA, 22 nt, Mycobacterium avium subsp. paratuberculosis
acagguagcaggcgcgcagcag

SEQ ID NO: 1019857 - RNA, 20 nt, Mycobacterium avium subsp. paratuberculosis
acagguagcgcaucagcucu

SEQ ID NO: 1019858 - RNA, 19 nt, Mycobacterium avium subsp. paratuberculosis
acagguccuugcccagcag

SEQ ID NO: 1019859 - RNA, 19 nt, Mycobacterium avium subsp. paratuberculosis
acagguucuuggcggccug

SEQ ID NO: 1019860 - RNA, 16 nt, Mycobacterium avium subsp. paratuberculosis
acagguggggcaccag

SEQ ID NO: 1019861 - RNA, 12 nt, Mycobacterium avium subsp. paratuberculosis
acaugcccggcg

SEQ ID NO: 1019862 - RNA, 16 nt, Mycobacterium avium subsp. paratuberculosis
acaugccgagcagcac

SEQ ID NO: 1019863 - RNA, 20 nt, Mycobacterium avium subsp. paratuberculosis
acaugccgaggcacagcagc

SEQ ID NO: 1019864 - RNA, 12 nt, Mycobacterium avium subsp. paratuberculosis
acaucuccagcg

SEQ ID NO: 1019865 - RNA, 22 nt, Mycobacterium avium subsp. paratuberculosis
acaucgucgcgcccaggaacgc

SEQ ID NO: 1019866 - RNA, 22 nt, Mycobacterium avium subsp. paratuberculosis
acaucguggcgacgacgccgau

SEQ ID NO: 1019867 - RNA, 20 nt, Mycobacterium avium subsp. paratuberculosis
acaucguggcgcaucaccuu

SEQ ID NO: 1019868 - RNA, 19 nt, Mycobacterium avium subsp. paratuberculosis
acaucacgguggccgccac

SEQ ID NO: 1019869 - RNA, 22 nt, Mycobacterium avium subsp. paratuberculosis
acauccgucacgcccgucccug

SEQ ID NO: 1019870 - RNA, 21 nt, Mycobacterium avium subsp. paratuberculosis
acauccgugagggaccuccag

SEQ ID NO: 1019871 - RNA, 13 nt, Mycobacterium avium subsp. paratuberculosis
acaucggugauca

SEQ ID NO: 1019872 - RNA, 12 nt, Mycobacterium avium subsp. paratuberculosis
acaucggcacac

SEQ ID NO: 1019873 - RNA, 20 nt, Mycobacterium avium subsp. paratuberculosis
accaacacccuugcgccgcu

SEQ ID NO: 1019874 - RNA, 12 nt, Mycobacterium avium subsp. paratuberculosis
accaacagcagc

SEQ ID NO: 1019875 - RNA, 13 nt, Mycobacterium avium subsp. paratuberculosis
accaacagcagcg

SEQ ID NO: 1019876 - RNA, 22 nt, Mycobacterium avium subsp. paratuberculosis
accaaauagccgucggcggccu

SEQ ID NO: 1019877 - RNA, 20 nt, Mycobacterium avium subsp. paratuberculosis
accaaacgcagcgucuucuu

SEQ ID NO: 1019878 - RNA, 21 nt, Mycobacterium avium subsp. paratuberculosis
acuuguggaaggcgccggcgc

SEQ ID NO: 1019879 - RNA, 12 nt, Mycobacterium avium subsp. paratuberculosis
acuugccgccgc

SEQ ID NO: 1019880 - RNA, 21 nt, Mycobacterium avium subsp. paratuberculosis
acuuguugacgaaaccgccau

SEQ ID NO: 1019881 - RNA, 16 nt, Mycobacterium avium subsp. paratuberculosis
acuuugccguuccagc

SEQ ID NO: 1019882 - RNA, 15 nt, Mycobacterium avium subsp. paratuberculosis
agaagugggccauca

SEQ ID NO: 1019883 - RNA, 17 nt, Mycobacterium avium subsp. paratuberculosis
agaaguggucgaucugc

SEQ ID NO: 1019884 - RNA, 21 nt, Mycobacterium avium subsp. paratuberculosis
agaaguccuuguggcccaggc

SEQ ID NO: 1019885 - RNA, 15 nt, Mycobacterium avium subsp. paratuberculosis
agaagucgcccgcgu

SEQ ID NO: 1019886 - RNA, 22 nt, Mycobacterium avium subsp. paratuberculosis
agaagucgcucagcgucuugga

SEQ ID NO: 1019887 - RNA, 15 nt, Mycobacterium avium subsp. paratuberculosis
agaaaugggccaggu

SEQ ID NO: 1019888 - RNA, 13 nt, Mycobacterium avium subsp. paratuberculosis
agaacgacuggcg

SEQ ID NO: 1019889 - RNA, 23 nt, Mycobacterium avium subsp. paratuberculosis
agaacauuucgucgaaguagggc

SEQ ID NO: 1019890 - RNA, 18 nt, Mycobacterium avium subsp. paratuberculosis
agaacuucuccgccggca

SEQ ID NO: 1019891 - RNA, 22 nt, Mycobacterium avium subsp. paratuberculosis
agaacgucaggcccagcgaggc

SEQ ID NO: 1019892 - RNA, 15 nt, Mycobacterium avium subsp. paratuberculosis
agaucacagcgcccu

SEQ ID NO: 1019893 - RNA, 17 nt, Mycobacterium avium subsp. paratuberculosis
agaucaacagccgcccc

SEQ ID NO: 1019894 - RNA, 18 nt, Mycobacterium avium subsp. paratuberculosis
agaguccgccgccgggcc

SEQ ID NO: 1019895 - RNA, 15 nt, Mycobacterium avium subsp. paratuberculosis
agaugggcgccgagu

SEQ ID NO: 1019896 - RNA, 21 nt, Mycobacterium avium subsp. paratuberculosis
agauggucgggacgucggcgc

SEQ ID NO: 1019897 - RNA, 16 nt, Mycobacterium avium subsp. paratuberculosis
agauggugaaggugcc

SEQ ID NO: 1019898 - RNA, 23 nt, Mycobacterium avium subsp. paratuberculosis
agauggugaaggugcccuccucg

SEQ ID NO: 1019899 - RNA, 16 nt, Mycobacterium avium subsp. paratuberculosis
agauggugaaguugcc

SEQ ID NO: 1019900 - RNA, 20 nt, Mycobacterium avium subsp. paratuberculosis
agaugcuguggaagggcccc

SEQ ID NO: 1019901 - RNA, 13 nt, Mycobacterium avium subsp. paratuberculosis
agaugcggcacca

SEQ ID NO: 1019902 - RNA, 22 nt, Mycobacterium avium subsp. paratuberculosis
agaugcggcaccagcccgccgu

SEQ ID NO: 1019903 - RNA, 20 nt, Mycobacterium avium subsp. paratuberculosis
agaugcggcccagcccggcc

SEQ ID NO: 1019904 - RNA, 19 nt, Mycobacterium avium subsp. paratuberculosis
agaugauugcgugcccggc

SEQ ID NO: 1019905 - RNA, 19 nt, Mycobacterium avium subsp. paratuberculosis
agaugauggccgcgccgcc

SEQ ID NO: 1019906 - RNA, 21 nt, Mycobacterium avium subsp. paratuberculosis
agaucccgccggcggccacga

SEQ ID NO: 1019907 - RNA, 14 nt, Mycobacterium avium subsp. paratuberculosis
agaucccgcuggcc

SEQ ID NO: 1019908 - RNA, 18 nt, Mycobacterium avium subsp. paratuberculosis
agaucccguaggucgccu

SEQ ID NO: 1019909 - RNA, 19 nt, Mycobacterium avium subsp. paratuberculosis
agaucccguaggucgccuc

SEQ ID NO: 1019910 - RNA, 13 nt, Mycobacterium avium subsp. paratuberculosis
agaucgaaaugac

SEQ ID NO: 1019911 - RNA, 17 nt, Mycobacterium avium subsp. paratuberculosis
agaucgagaucagggcg

SEQ ID NO: 1019912 - RNA, 18 nt, Mycobacterium avium subsp. paratuberculosis
agaucgcccgggcggcgg

SEQ ID NO: 1019913 - RNA, 16 nt, Mycobacterium avium subsp. paratuberculosis
agaucgucgggcaccu

SEQ ID NO: 1019914 - RNA, 17 nt, Mycobacterium avium subsp. paratuberculosis
agaucgucucggccagc

SEQ ID NO: 1019915 - RNA, 19 nt, Mycobacterium avium subsp. paratuberculosis
agaucgucuugaccgcccg

SEQ ID NO: 1019916 - RNA, 22 nt, Mycobacterium avium subsp. paratuberculosis
agaucggccagcgcggccgggc

SEQ ID NO: 1019917 - RNA, 14 nt, Mycobacterium avium subsp. paratuberculosis
agaucgggucccag

SEQ ID NO: 1019918 - RNA, 16 nt, Mycobacterium avium subsp. paratuberculosis
agaucuccaggcucga

SEQ ID NO: 1019919 - RNA, 22 nt, Mycobacterium avium subsp. paratuberculosis
agaucucgcgccgcgcauuguu

SEQ ID NO: 1019920 - RNA, 21 nt, Mycobacterium avium subsp. paratuberculosis
agaucucgucgaugggcucga

SEQ ID NO: 1019921 - RNA, 14 nt, Mycobacterium avium subsp. paratuberculosis
agagcggcaccagg

SEQ ID NO: 1019922 - RNA, 21 nt, Mycobacterium avium subsp. paratuberculosis
agagcggugacaucgccaccu

SEQ ID NO: 1019923 - RNA, 14 nt, Mycobacterium avium subsp. paratuberculosis
agacugccgagcau

SEQ ID NO: 1019924 - RNA, 21 nt, Mycobacterium avium subsp. paratuberculosis
agacugccgagcaucagcugc

SEQ ID NO: 1019925 - RNA, 22 nt, Mycobacterium avium subsp. paratuberculosis
agacugccgagcaucagcugcc

SEQ ID NO: 1019926 - RNA, 12 nt, Mycobacterium avium subsp. paratuberculosis
agacggcgaggu

SEQ ID NO: 1019927 - RNA, 15 nt, Mycobacterium avium subsp. paratuberculosis
agacucagcccggcc

SEQ ID NO: 1019928 - RNA, 15 nt, Mycobacterium avium subsp. paratuberculosis
agacgacccgagagc

SEQ ID NO: 1019929 - RNA, 15 nt, Mycobacterium avium subsp. paratuberculosis
agacgaugcccagcc

SEQ ID NO: 1019930 - RNA, 14 nt, Mycobacterium avium subsp. paratuberculosis
agacgcgcaccagg

SEQ ID NO: 1019931 - RNA, 19 nt, Mycobacterium avium subsp. paratuberculosis
agacgcgcaccgccaccgc

SEQ ID NO: 1019932 - RNA, 22 nt, Mycobacterium avium subsp. paratuberculosis
agacgcgcaccgccaccgcccg

SEQ ID NO: 1019933 - RNA, 14 nt, Mycobacterium avium subsp. paratuberculosis
agacgcgggccggc

SEQ ID NO: 1019934 - RNA, 13 nt, Mycobacterium avium subsp. paratuberculosis
agacgcgggcgcc

SEQ ID NO: 1019935 - RNA, 20 nt, Mycobacterium avium subsp. paratuberculosis
agacgcgggcgcccagcaaa

SEQ ID NO: 1019936 - RNA, 16 nt, Mycobacterium avium subsp. paratuberculosis
agacgcgaaagcaccc

SEQ ID NO: 1019937 - RNA, 20 nt, Mycobacterium avium subsp. paratuberculosis
agacccgcccggagaacucc

SEQ ID NO: 1019938 - RNA, 18 nt, Mycobacterium avium subsp. paratuberculosis
agacccggggguccaggg

SEQ ID NO: 1019939 - RNA, 19 nt, Mycobacterium avium subsp. paratuberculosis
agacccuggaugaucucga

SEQ ID NO: 1019940 - RNA, 21 nt, Mycobacterium avium subsp. paratuberculosis
agaccccggcguccaguagcc

SEQ ID NO: 1019941 - RNA, 16 nt, Mycobacterium avium subsp. paratuberculosis
agacccgaaacuggga

SEQ ID NO: 1019942 - RNA, 15 nt, Mycobacterium avium subsp. paratuberculosis
agaccgugugccagc

SEQ ID NO: 1019943 - RNA, 15 nt, Mycobacterium avium subsp. paratuberculosis
agaccggccggggcg

SEQ ID NO: 1019944 - RNA, 19 nt, Mycobacterium avium subsp. paratuberculosis
agaauucgccggggcacca

SEQ ID NO: 1019945 - RNA, 22 nt, Mycobacterium avium subsp. paratuberculosis
agcgcagcagguaaaccagcag

SEQ ID NO: 1019946 - RNA, 16 nt, Mycobacterium avium subsp. paratuberculosis
agcgcagcgccaggca

SEQ ID NO: 1019947 - RNA, 20 nt, Mycobacterium avium subsp. paratuberculosis
agcgcagcgccucggcggcc

SEQ ID NO: 1019948 - RNA, 21 nt, Mycobacterium avium subsp. paratuberculosis
agcgcagcgccucggcggccc

SEQ ID NO: 1019949 - RNA, 23 nt, Mycobacterium avium subsp. paratuberculosis
agcgcagcgccucggcggccccu

SEQ ID NO: 1019950 - RNA, 15 nt, Mycobacterium avium subsp. paratuberculosis
agcgcccccagcggg

SEQ ID NO: 1019951 - RNA, 17 nt, Mycobacterium avium subsp. paratuberculosis
agcgcccccgacaggcc

SEQ ID NO: 1019952 - RNA, 20 nt, Mycobacterium avium subsp. paratuberculosis
agcgccccgaaguucgacac

SEQ ID NO: 1019953 - RNA, 15 nt, Mycobacterium avium subsp. paratuberculosis
agcgcccaggaugac

SEQ ID NO: 1019954 - RNA, 13 nt, Mycobacterium avium subsp. paratuberculosis
agcgcccgcccgg

SEQ ID NO: 1019955 - RNA, 15 nt, Mycobacterium avium subsp. paratuberculosis
agcgcccgcccggcc

SEQ ID NO: 1019956 - RNA, 21 nt, Mycobacterium avium subsp. paratuberculosis
agcgcccgcccggcccggcgc

SEQ ID NO: 1019957 - RNA, 11 nt, Mycobacterium avium subsp. paratuberculosis
agcgcccgcgc

SEQ ID NO: 1019958 - RNA, 23 nt, Mycobacterium avium subsp. paratuberculosis
agcgcccgggcgcgugcacaccg

SEQ ID NO: 1019959 - RNA, 23 nt, Mycobacterium avium subsp. paratuberculosis
agcgccaccccccaguuucccgu

SEQ ID NO: 1019960 - RNA, 16 nt, Mycobacterium avium subsp. paratuberculosis
agcgccaccccgaacc

SEQ ID NO: 1019961 - RNA, 15 nt, Mycobacterium avium subsp. paratuberculosis
agcgccaccagcacc

SEQ ID NO: 1019962 - RNA, 17 nt, Mycobacterium avium subsp. paratuberculosis
agcgcauguaggacacc

SEQ ID NO: 1019963 - RNA, 21 nt, Mycobacterium avium subsp. paratuberculosis
agcgcagugcggacgccacaa

SEQ ID NO: 1019964 - RNA, 18 nt, Mycobacterium avium subsp. paratuberculosis
agcgcgcgggagcgcugg

SEQ ID NO: 1019965 - RNA, 16 nt, Mycobacterium avium subsp. paratuberculosis
agcgcgcgggcguccu

SEQ ID NO: 1019966 - RNA, 19 nt, Mycobacterium avium subsp. paratuberculosis
agcgcgcggugcgccagcg

SEQ ID NO: 1019967 - RNA, 20 nt, Mycobacterium avium subsp. paratuberculosis
agcgcgcgcucggucagcac

SEQ ID NO: 1019968 - RNA, 15 nt, Mycobacterium avium subsp. paratuberculosis
agcgcggacaccagg

SEQ ID NO: 1019969 - RNA, 16 nt, Mycobacterium avium subsp. paratuberculosis
agcgcgcugugcgcca

SEQ ID NO: 1019970 - RNA, 18 nt, Mycobacterium avium subsp. paratuberculosis
agcgcggcgggccagucg

SEQ ID NO: 1019971 - RNA, 14 nt, Mycobacterium avium subsp. paratuberculosis
agcgcgggccagca

SEQ ID NO: 1019972 - RNA, 19 nt, Mycobacterium avium subsp. paratuberculosis
agcgcggugugcggcggcu

SEQ ID NO: 1019973 - RNA, 17 nt, Mycobacterium avium subsp. paratuberculosis
agcgcggugagcagcau

SEQ ID NO: 1019974 - RNA, 21 nt, Mycobacterium avium subsp. paratuberculosis
agcgcggugcccagccaggcc

SEQ ID NO: 1019975 - RNA, 23 nt, Mycobacterium avium subsp. paratuberculosis
agcgcggugccggugauccacuc

SEQ ID NO: 1019976 - RNA, 17 nt, Mycobacterium avium subsp. paratuberculosis
agcgcgguggccagcag

SEQ ID NO: 1019977 - RNA, 18 nt, Mycobacterium avium subsp. paratuberculosis
agcgcgguggccagcagg

SEQ ID NO: 1019978 - RNA, 19 nt, Mycobacterium avium subsp. paratuberculosis
agcgcgucgaccagccgca

SEQ ID NO: 1019979 - RNA, 17 nt, Mycobacterium avium subsp. paratuberculosis
agcgcgucgacgcgguc

SEQ ID NO: 1019980 - RNA, 16 nt, Mycobacterium avium subsp. paratuberculosis
agcgcguccaggugcg

SEQ ID NO: 1019981 - RNA, 17 nt, Mycobacterium avium subsp. paratuberculosis
agcgcguccaggugcgc

SEQ ID NO: 1019982 - RNA, 12 nt, Mycobacterium avium subsp. paratuberculosis
agcgcuccacca

SEQ ID NO: 1019983 - RNA, 13 nt, Mycobacterium avium subsp. paratuberculosis
agcgccgcccgca

SEQ ID NO: 1019984 - RNA, 15 nt, Mycobacterium avium subsp. paratuberculosis
agcgccgcccgcacc

SEQ ID NO: 1019985 - RNA, 17 nt, Mycobacterium avium subsp. paratuberculosis
agcgccgcccguccagc

SEQ ID NO: 1019986 - RNA, 20 nt, Mycobacterium avium subsp. paratuberculosis
agcgccgcccguccagcgca

SEQ ID NO: 1019987 - RNA, 16 nt, Mycobacterium avium subsp. paratuberculosis
agcgccgcggcgcccu

SEQ ID NO: 1019988 - RNA, 16 nt, Mycobacterium avium subsp. paratuberculosis
agcgccggcagcaacc

SEQ ID NO: 1019989 - RNA, 13 nt, Mycobacterium avium subsp. paratuberculosis
agcgccggcacca

SEQ ID NO: 1019990 - RNA, 17 nt, Mycobacterium avium subsp. paratuberculosis
agcgccggcaccagcag

SEQ ID NO: 1019991 - RNA, 12 nt, Mycobacterium avium subsp. paratuberculosis
agcgccggggcg

SEQ ID NO: 1019992 - RNA, 15 nt, Mycobacterium avium subsp. paratuberculosis
agcgccguccgcacc

SEQ ID NO: 1019993 - RNA, 18 nt, Mycobacterium avium subsp. paratuberculosis
agcgccguccgcaccgcg

SEQ ID NO: 1019994 - RNA, 17 nt, Mycobacterium avium subsp. paratuberculosis
agcgcgacgaacagcac

SEQ ID NO: 1019995 - RNA, 18 nt, Mycobacterium avium subsp. paratuberculosis
agcgccgucaucaccgcc

SEQ ID NO: 1019996 - RNA, 16 nt, Mycobacterium avium subsp. paratuberculosis
agcgcgcacgcggaca

SEQ ID NO: 1019997 - RNA, 16 nt, Mycobacterium avium subsp. paratuberculosis
agcgcgacgggcaccc

SEQ ID NO: 1019998 - RNA, 18 nt, Mycobacterium avium subsp. paratuberculosis
agcgcgagguccuugcgg

SEQ ID NO: 1019999 - RNA, 23 nt, Mycobacterium avium subsp. paratuberculosis
agcgcgaucaacgggucgagcac

SEQ ID NO: 1020000 - RNA, 16 nt, Mycobacterium avium subsp. paratuberculosis
agcgcugucgcgggcc

SEQ ID NO: 1020001 - RNA, 12 nt, Mycobacterium avium subsp. paratuberculosis
agcgcuggguga

SEQ ID NO: 1020002 - RNA, 16 nt, Mycobacterium avium subsp. paratuberculosis
agcgcugguaguacac

SEQ ID NO: 1020003 - RNA, 16 nt, Mycobacterium avium subsp. paratuberculosis
agcgcuggccggccac

SEQ ID NO: 1020004 - RNA, 17 nt, Mycobacterium avium subsp. paratuberculosis
agcgcuggccggccacc

SEQ ID NO: 1020005 - RNA, 22 nt, Mycobacterium avium subsp. paratuberculosis
agcggaaugaacgcggccaggg

SEQ ID NO: 1020006 - RNA, 16 nt, Mycobacterium avium subsp. paratuberculosis
agcgcuuucgccgaau

SEQ ID NO: 1020007 - RNA, 19 nt, Mycobacterium avium subsp. paratuberculosis
agcggacccggucggccgc

SEQ ID NO: 1020008 - RNA, 17 nt, Mycobacterium avium subsp. paratuberculosis
agcggacgacggccagc

SEQ ID NO: 1020009 - RNA, 14 nt, Mycobacterium avium subsp. paratuberculosis
agcggauugaccag

SEQ ID NO: 1020010 - RNA, 15 nt, Mycobacterium avium subsp. paratuberculosis
agcggauugaccagc

SEQ ID NO: 1020011 - RNA, 17 nt, Mycobacterium avium subsp. paratuberculosis
agcggauugaccagcac

SEQ ID NO: 1020012 - RNA, 20 nt, Mycobacterium avium subsp. paratuberculosis
agcggcaccuuggugagcac

SEQ ID NO: 1020013 - RNA, 17 nt, Mycobacterium avium subsp. paratuberculosis
agcggcacgaucucgac

SEQ ID NO: 1020014 - RNA, 22 nt, Mycobacterium avium subsp. paratuberculosis
agcggcacgaucucgaccaggc

SEQ ID NO: 1020015 - RNA, 13 nt, Mycobacterium avium subsp. paratuberculosis
agcggcaccaacc

SEQ ID NO: 1020016 - RNA, 13 nt, Mycobacterium avium subsp. paratuberculosis
agcggcaccaggu

SEQ ID NO: 1020017 - RNA, 16 nt, Mycobacterium avium subsp. paratuberculosis
agcggcagccacggca

SEQ ID NO: 1020018 - RNA, 21 nt, Mycobacterium avium subsp. paratuberculosis
agcggcagcgucgccagccgc

SEQ ID NO: 1020019 - RNA, 17 nt, Mycobacterium avium subsp. paratuberculosis
agcggcagaccguccgg

SEQ ID NO: 1020020 - RNA, 21 nt, Mycobacterium avium subsp. paratuberculosis
agcguaugccgguggcguccu

SEQ ID NO: 1020021 - RNA, 12 nt, Mycobacterium avium subsp. paratuberculosis
agcguacccagg

SEQ ID NO: 1020022 - RNA, 16 nt, Mycobacterium avium subsp. paratuberculosis
agcggucggcggcuga

SEQ ID NO: 1020023 - RNA, 22 nt, Mycobacterium avium subsp. paratuberculosis
agcggugacaucgccaccugga

SEQ ID NO: 1020024 - RNA, 22 nt, Mycobacterium avium subsp. paratuberculosis
agcggugcagccccgcacugaa

SEQ ID NO: 1020025 - RNA, 14 nt, Mycobacterium avium subsp. paratuberculosis
agcggucgcggaac

SEQ ID NO: 1020026 - RNA, 21 nt, Mycobacterium avium subsp. paratuberculosis
agcggucgcggaaccggccgg

SEQ ID NO: 1020027 - RNA, 14 nt, Mycobacterium avium subsp. paratuberculosis
agcggucgccccag

SEQ ID NO: 1020028 - RNA, 16 nt, Mycobacterium avium subsp. paratuberculosis
agcggucgccccagaa

SEQ ID NO: 1020029 - RNA, 14 nt, Mycobacterium avium subsp. paratuberculosis
agcggugccgcccg

SEQ ID NO: 1020030 - RNA, 22 nt, Mycobacterium avium subsp. paratuberculosis
agcggccacaccggggccaggu

SEQ ID NO: 1020031 - RNA, 16 nt, Mycobacterium avium subsp. paratuberculosis
agcggcagcgacagcg

SEQ ID NO: 1020032 - RNA, 18 nt, Mycobacterium avium subsp. paratuberculosis
agcggccuaugcgcccgg

SEQ ID NO: 1020033 - RNA, 18 nt, Mycobacterium avium subsp. paratuberculosis
agcggccucggaagggcu

SEQ ID NO: 1020034 - RNA, 22 nt, Mycobacterium avium subsp. paratuberculosis
agcgguauccgaucaucagggc

SEQ ID NO: 1020035 - RNA, 15 nt, Mycobacterium avium subsp. paratuberculosis
agcgggucggccggc

SEQ ID NO: 1020036 - RNA, 16 nt, Mycobacterium avium subsp. paratuberculosis
agcgggucggccggcg

SEQ ID NO: 1020037 - RNA, 22 nt, Mycobacterium avium subsp. paratuberculosis
agcggguugucgucgucggcga

SEQ ID NO: 1020038 - RNA, 16 nt, Mycobacterium avium subsp. paratuberculosis
agcggcgccuggucaa

SEQ ID NO: 1020039 - RNA, 15 nt, Mycobacterium avium subsp. paratuberculosis
agcggcgccaccggc

SEQ ID NO: 1020040 - RNA, 22 nt, Mycobacterium avium subsp. paratuberculosis
agcggcgaugcccacagccagg

SEQ ID NO: 1020041 - RNA, 14 nt, Mycobacterium avium subsp. paratuberculosis
agcggggugagcac

SEQ ID NO: 1020042 - RNA, 18 nt, Mycobacterium avium subsp. paratuberculosis
agcggggugagcaccgcg

SEQ ID NO: 1020043 - RNA, 16 nt, Mycobacterium avium subsp. paratuberculosis
agcgggucagcuccac

SEQ ID NO: 1020044 - RNA, 16 nt, Mycobacterium avium subsp. paratuberculosis
agcggguccagccgcc

SEQ ID NO: 1020045 - RNA, 18 nt, Mycobacterium avium subsp. paratuberculosis
agcggguccagccgccgg

SEQ ID NO: 1020046 - RNA, 24 nt, Mycobacterium avium subsp. paratuberculosis
agcgggugaaucgacaccgcacgg

SEQ ID NO: 1020047 - RNA, 17 nt, Mycobacterium avium subsp. paratuberculosis
agccguuuggcgccgcc

SEQ ID NO: 1020048 - RNA, 19 nt, Mycobacterium avium subsp. paratuberculosis
agccguuuggcgccgccca

SEQ ID NO: 1020049 - RNA, 22 nt, Mycobacterium avium subsp. paratuberculosis
agccguuuggcgccgcccacca

SEQ ID NO: 1020050 - RNA, 16 nt, Mycobacterium avium subsp. paratuberculosis
agccuacggcgccggu

SEQ ID NO: 1020051 - RNA, 19 nt, Mycobacterium avium subsp. paratuberculosis
agccguugacgguguucuu

SEQ ID NO: 1020052 - RNA, 17 nt, Mycobacterium avium subsp. paratuberculosis
agccguucgcugcccuc

SEQ ID NO: 1020053 - RNA, 18 nt, Mycobacterium avium subsp. paratuberculosis
agccguugccgccgcgcg

SEQ ID NO: 1020054 - RNA, 14 nt, Mycobacterium avium subsp. paratuberculosis
agccgugcccgcgg

SEQ ID NO: 1020055 - RNA, 22 nt, Mycobacterium avium subsp. paratuberculosis
agccguggcaggcacgagcgaa

SEQ ID NO: 1020056 - RNA, 19 nt, Mycobacterium avium subsp. paratuberculosis
agccgucgucguccgcaac

SEQ ID NO: 1020057 - RNA, 15 nt, Mycobacterium avium subsp. paratuberculosis
agccgugcagcgccc

SEQ ID NO: 1020058 - RNA, 17 nt, Mycobacterium avium subsp. paratuberculosis
agccgugcagcgcccag

SEQ ID NO: 1020059 - RNA, 16 nt, Mycobacterium avium subsp. paratuberculosis
agccguccaggccgcu

SEQ ID NO: 1020060 - RNA, 17 nt, Mycobacterium avium subsp. paratuberculosis
agccgucgcacuagguc

SEQ ID NO: 1020061 - RNA, 20 nt, Mycobacterium avium subsp. paratuberculosis
agccgucggcuuccuccucg

SEQ ID NO: 1020062 - RNA, 19 nt, Mycobacterium avium subsp. paratuberculosis
agccguaccgcaacaccga

SEQ ID NO: 1020063 - RNA, 17 nt, Mycobacterium avium subsp. paratuberculosis
agccgguccgaccagcg

SEQ ID NO: 1020064 - RNA, 20 nt, Mycobacterium avium subsp. paratuberculosis
agccgguggcagcccggcua

SEQ ID NO: 1020065 - RNA, 15 nt, Mycobacterium avium subsp. paratuberculosis
agccgguagaucagc

SEQ ID NO: 1020066 - RNA, 14 nt, Mycobacterium avium subsp. paratuberculosis
agccgguccuggcc

SEQ ID NO: 1020067 - RNA, 16 nt, Mycobacterium avium subsp. paratuberculosis
agccgguccuuggccu

SEQ ID NO: 1020068 - RNA, 20 nt, Mycobacterium avium subsp. paratuberculosis
agccggucgcaggugaucuu

SEQ ID NO: 1020069 - RNA, 18 nt, Mycobacterium avium subsp. paratuberculosis
agccggucggcccgcucc

SEQ ID NO: 1020070 - RNA, 17 nt, Mycobacterium avium subsp. paratuberculosis
agccggucauaggccgc

SEQ ID NO: 1020071 - RNA, 13 nt, Mycobacterium avium subsp. paratuberculosis
agccgguggcggc

SEQ ID NO: 1020072 - RNA, 17 nt, Mycobacterium avium subsp. paratuberculosis
agccgguggcggccacg

SEQ ID NO: 1020073 - RNA, 22 nt, Mycobacterium avium subsp. paratuberculosis
agccggugaugacgucgcccac

SEQ ID NO: 1020074 - RNA, 13 nt, Mycobacterium avium subsp. paratuberculosis
agccggugcacca

SEQ ID NO: 1020075 - RNA, 18 nt, Mycobacterium avium subsp. paratuberculosis
agccggugccgaggcagu

SEQ ID NO: 1020076 - RNA, 15 nt, Mycobacterium avium subsp. paratuberculosis
agccggugcgagccg

SEQ ID NO: 1020077 - RNA, 16 nt, Mycobacterium avium subsp. paratuberculosis
agccgggugcccaucu

SEQ ID NO: 1020078 - RNA, 18 nt, Mycobacterium avium subsp. paratuberculosis
agccgggugcgggccagc

SEQ ID NO: 1020079 - RNA, 22 nt, Mycobacterium avium subsp. paratuberculosis
agccgggugcgggccagcagcc

SEQ ID NO: 1020080 - RNA, 21 nt, Mycobacterium avium subsp. paratuberculosis
agccggggacggugcagccgg

SEQ ID NO: 1020081 - RNA, 17 nt, Mycobacterium avium subsp. paratuberculosis
agccgggggaucaccuc

SEQ ID NO: 1020082 - RNA, 13 nt, Mycobacterium avium subsp. paratuberculosis
agccgggguaggg

SEQ ID NO: 1020083 - RNA, 19 nt, Mycobacterium avium subsp. paratuberculosis
agccgggcggcagcagcug

SEQ ID NO: 1020084 - RNA, 20 nt, Mycobacterium avium subsp. paratuberculosis
agccgggcggcagcagcugc

SEQ ID NO: 1020085 - RNA, 13 nt, Mycobacterium avium subsp. paratuberculosis
agccgggcggccg

SEQ ID NO: 1020086 - RNA, 16 nt, Mycobacterium avium subsp. paratuberculosis
agccgggcggccgggc

SEQ ID NO: 1020087 - RNA, 19 nt, Mycobacterium avium subsp. paratuberculosis
agccgggcggcgccgaacc

SEQ ID NO: 1020088 - RNA, 15 nt, Mycobacterium avium subsp. paratuberculosis
agccgggcggcggcc

SEQ ID NO: 1020089 - RNA, 14 nt, Mycobacterium avium subsp. paratuberculosis
agccgggccagcag

SEQ ID NO: 1020090 - RNA, 16 nt, Mycobacterium avium subsp. paratuberculosis
agccgggccagcagcu

SEQ ID NO: 1020091 - RNA, 20 nt, Mycobacterium avium subsp. paratuberculosis
agccgggccagcccgggaaa

SEQ ID NO: 1020092 - RNA, 13 nt, Mycobacterium avium subsp. paratuberculosis
agccgggccaggu

SEQ ID NO: 1020093 - RNA, 19 nt, Mycobacterium avium subsp. paratuberculosis
agccggcucuuggcgaccu

SEQ ID NO: 1020094 - RNA, 18 nt, Mycobacterium avium subsp. paratuberculosis
agccggcggcgccuugcc

SEQ ID NO: 1020095 - RNA, 23 nt, Mycobacterium avium subsp. paratuberculosis
agccggcgguucggcgggccuuc

SEQ ID NO: 1020096 - RNA, 18 nt, Mycobacterium avium subsp. paratuberculosis
agccggcgucgccgcugg

SEQ ID NO: 1020097 - RNA, 22 nt, Mycobacterium avium subsp. paratuberculosis
agccggcgcggcagggccaggc

SEQ ID NO: 1020098 - RNA, 21 nt, Mycobacterium avium subsp. paratuberculosis
agcgaacgucaggauccaguu

SEQ ID NO: 1020099 - RNA, 18 nt, Mycobacterium avium subsp. paratuberculosis
agcgaacccgccagggcg

SEQ ID NO: 1020100 - RNA, 23 nt, Mycobacterium avium subsp. paratuberculosis
agccuucgccgcacguguucuca

SEQ ID NO: 1020101 - RNA, 18 nt, Mycobacterium avium subsp. paratuberculosis
agccuucuucgccgcagc

SEQ ID NO: 1020102 - RNA, 19 nt, Mycobacterium avium subsp. paratuberculosis
agccuucuucgccggggcc

SEQ ID NO: 1020103 - RNA, 18 nt, Mycobacterium avium subsp. paratuberculosis
agccuucuugaccgcagc

SEQ ID NO: 1020104 - RNA, 16 nt, Mycobacterium avium subsp. paratuberculosis
agccuucuuggcgggc

SEQ ID NO: 1020105 - RNA, 19 nt, Mycobacterium avium subsp. paratuberculosis
agccuuggucgcggccuuc

SEQ ID NO: 1020106 - RNA, 21 nt, Mycobacterium avium subsp. paratuberculosis
agccuuggucgcggccuugcg

SEQ ID NO: 1020107 - RNA, 19 nt, Mycobacterium avium subsp. paratuberculosis
agccuugcuggcggccuuc

SEQ ID NO: 1020108 - RNA, 15 nt, Mycobacterium avium subsp. paratuberculosis
agccuugcagccgcu

SEQ ID NO: 1020109 - RNA, 18 nt, Mycobacterium avium subsp. paratuberculosis
agccuccgcgaucagcuc

SEQ ID NO: 1020110 - RNA, 16 nt, Mycobacterium avium subsp. paratuberculosis
agccgcucgcccagcg

SEQ ID NO: 1020111 - RNA, 14 nt, Mycobacterium avium subsp. paratuberculosis
agccgcuccaccgc

SEQ ID NO: 1020112 - RNA, 20 nt, Mycobacterium avium subsp. paratuberculosis
agccgcugacgauggcgacc

SEQ ID NO: 1020113 - RNA, 19 nt, Mycobacterium avium subsp. paratuberculosis
agccgcugagcuucugccc

SEQ ID NO: 1020114 - RNA, 13 nt, Mycobacterium avium subsp. paratuberculosis
agccgcugcagcg

SEQ ID NO: 1020115 - RNA, 20 nt, Mycobacterium avium subsp. paratuberculosis
agccgcuccggcccgagcac

SEQ ID NO: 1020116 - RNA, 13 nt, Mycobacterium avium subsp. paratuberculosis
agccgcuccucgu

SEQ ID NO: 1020117 - RNA, 20 nt, Mycobacterium avium subsp. paratuberculosis
agccgcugccguucgccggu

SEQ ID NO: 1020118 - RNA, 13 nt, Mycobacterium avium subsp. paratuberculosis
agccgcuuggccg

SEQ ID NO: 1020119 - RNA, 17 nt, Mycobacterium avium subsp. paratuberculosis
agccgcuuggccgggcg

SEQ ID NO: 1020120 - RNA, 19 nt, Mycobacterium avium subsp. paratuberculosis
agccggccgacgcggccuc

SEQ ID NO: 1020121 - RNA, 16 nt, Mycobacterium avium subsp. paratuberculosis
agccggccucgccggc

SEQ ID NO: 1020122 - RNA, 22 nt, Mycobacterium avium subsp. paratuberculosis
agccggccugcuuuucggccga

SEQ ID NO: 1020123 - RNA, 15 nt, Mycobacterium avium subsp. paratuberculosis
agccggccccgcccg

SEQ ID NO: 1020124 - RNA, 20 nt, Mycobacterium avium subsp. paratuberculosis
agccggccggacaccgaacc

SEQ ID NO: 1020125 - RNA, 13 nt, Mycobacterium avium subsp. paratuberculosis
agccggccagcag

SEQ ID NO: 1020126 - RNA, 12 nt, Mycobacterium avium subsp. paratuberculosis
agccggccagcu

SEQ ID NO: 1020127 - RNA, 20 nt, Mycobacterium avium subsp. paratuberculosis
agccggccaggcccagccca

SEQ ID NO: 1020128 - RNA, 14 nt, Mycobacterium avium subsp. paratuberculosis
agccggccaguucc

SEQ ID NO: 1020129 - RNA, 21 nt, Mycobacterium avium subsp. paratuberculosis
agccggaugcggccgaagucc

SEQ ID NO: 1020130 - RNA, 15 nt, Mycobacterium avium subsp. paratuberculosis
agccggagccggccu

SEQ ID NO: 1020131 - RNA, 23 nt, Mycobacterium avium subsp. paratuberculosis
agccggagccuugcuggcggccu

SEQ ID NO: 1020132 - RNA, 14 nt, Mycobacterium avium subsp. paratuberculosis
agccggaucucguc

SEQ ID NO: 1020133 - RNA, 14 nt, Mycobacterium avium subsp. paratuberculosis
agccggaugcggcc

SEQ ID NO: 1020134 - RNA, 20 nt, Mycobacterium avium subsp. paratuberculosis
agccggagaacuaucugguc

SEQ ID NO: 1020135 - RNA, 22 nt, Mycobacterium avium subsp. paratuberculosis
agccggagaacuaucuggucug

SEQ ID NO: 1020136 - RNA, 16 nt, Mycobacterium avium subsp. paratuberculosis
agccgcggauggccuc

SEQ ID NO: 1020137 - RNA, 16 nt, Mycobacterium avium subsp. paratuberculosis
agccgcgcggccgccu

SEQ ID NO: 1020138 - RNA, 19 nt, Mycobacterium avium subsp. paratuberculosis
agccgcgcggccgccuccg

SEQ ID NO: 1020139 - RNA, 17 nt, Mycobacterium avium subsp. paratuberculosis
agccgcgcgugcagccg

SEQ ID NO: 1020140 - RNA, 17 nt, Mycobacterium avium subsp. paratuberculosis
agccgcgauagccauca

SEQ ID NO: 1020141 - RNA, 19 nt, Mycobacterium avium subsp. paratuberculosis
agccgcgacacgugcaucu

SEQ ID NO: 1020142 - RNA, 13 nt, Mycobacterium avium subsp. paratuberculosis
agccgcgcgccga

SEQ ID NO: 1020143 - RNA, 18 nt, Mycobacterium avium subsp. paratuberculosis
agccgcgcgagcaucacc

SEQ ID NO: 1020144 - RNA, 14 nt, Mycobacterium avium subsp. paratuberculosis
agccgcgccgccgc

SEQ ID NO: 1020145 - RNA, 12 nt, Mycobacterium avium subsp. paratuberculosis
agccgcgccgcg

SEQ ID NO: 1020146 - RNA, 14 nt, Mycobacterium avium subsp. paratuberculosis
agccgcgccgcgcc

SEQ ID NO: 1020147 - RNA, 18 nt, Mycobacterium avium subsp. paratuberculosis
agccgccgggcuucccca

SEQ ID NO: 1020148 - RNA, 16 nt, Mycobacterium avium subsp. paratuberculosis
agccgccgcggcaccu

SEQ ID NO: 1020149 - RNA, 20 nt, Mycobacterium avium subsp. paratuberculosis
agccgccgccgaccacaugc

SEQ ID NO: 1020150 - RNA, 21 nt, Mycobacterium avium subsp. paratuberculosis
agccgccgccgaccacaugcc

SEQ ID NO: 1020151 - RNA, 16 nt, Mycobacterium avium subsp. paratuberculosis
agccgccgagccggca

SEQ ID NO: 1020152 - RNA, 16 nt, Mycobacterium avium subsp. paratuberculosis
agccgccgaucuucuc

SEQ ID NO: 1020153 - RNA, 14 nt, Mycobacterium avium subsp. paratuberculosis
agccgcccagcauc

SEQ ID NO: 1020154 - RNA, 11 nt, Mycobacterium avium subsp. paratuberculosis
agccgccgagc

SEQ ID NO: 1020155 - RNA, 21 nt, Mycobacterium avium subsp. paratuberculosis
agccgaccagcggucgggugc

SEQ ID NO: 1020156 - RNA, 16 nt, Mycobacterium avium subsp. paratuberculosis
agccgacaccgggucc

SEQ ID NO: 1020157 - RNA, 19 nt, Mycobacterium avium subsp. paratuberculosis
agcccuuugcgcugcccga

SEQ ID NO: 1020158 - RNA, 20 nt, Mycobacterium avium subsp. paratuberculosis
agcccucgugcguagcggcc

SEQ ID NO: 1020159 - RNA, 21 nt, Mycobacterium avium subsp. paratuberculosis
agcccucccggaacagcuugg

SEQ ID NO: 1020160 - RNA, 13 nt, Mycobacterium avium subsp. paratuberculosis
agccgcacaacau

SEQ ID NO: 1020161 - RNA, 17 nt, Mycobacterium avium subsp. paratuberculosis
agccgaugcgcccgcgc

SEQ ID NO: 1020162 - RNA, 18 nt, Mycobacterium avium subsp. paratuberculosis
agccgaucgccuccguca

SEQ ID NO: 1020163 - RNA, 20 nt, Mycobacterium avium subsp. paratuberculosis
agccgaucuccaccgagugc

SEQ ID NO: 1020164 - RNA, 18 nt, Mycobacterium avium subsp. paratuberculosis
agcccguuguggcggcca

SEQ ID NO: 1020165 - RNA, 15 nt, Mycobacterium avium subsp. paratuberculosis
agcccuaccggcucg

SEQ ID NO: 1020166 - RNA, 16 nt, Mycobacterium avium subsp. paratuberculosis
agcccggcgacgaagc

SEQ ID NO: 1020167 - RNA, 20 nt, Mycobacterium avium subsp. paratuberculosis
agcccguucagugaccagug

SEQ ID NO: 1020168 - RNA, 15 nt, Mycobacterium avium subsp. paratuberculosis
agcccggccagcacc

SEQ ID NO: 1020169 - RNA, 21 nt, Mycobacterium avium subsp. paratuberculosis
agcccggccagccgggcggcc

SEQ ID NO: 1020170 - RNA, 14 nt, Mycobacterium avium subsp. paratuberculosis
agcccggcccagcc

SEQ ID NO: 1020171 - RNA, 18 nt, Mycobacterium avium subsp. paratuberculosis
agccagguguaggcggcc

SEQ ID NO: 1020172 - RNA, 17 nt, Mycobacterium avium subsp. paratuberculosis
agccagguccgggcacu

SEQ ID NO: 1020173 - RNA, 21 nt, Mycobacterium avium subsp. paratuberculosis
agcccgcucagagcugcaccg

SEQ ID NO: 1020174 - RNA, 18 nt, Mycobacterium avium subsp. paratuberculosis
agcccgcguccagcagca

SEQ ID NO: 1020175 - RNA, 16 nt, Mycobacterium avium subsp. paratuberculosis
agcccgcggaucgcgu

SEQ ID NO: 1020176 - RNA, 14 nt, Mycobacterium avium subsp. paratuberculosis
agcccgcggcagcc

SEQ ID NO: 1020177 - RNA, 16 nt, Mycobacterium avium subsp. paratuberculosis
agccaccacugcgccg

SEQ ID NO: 1020178 - RNA, 11 nt, Mycobacterium avium subsp. paratuberculosis
agccaccacau

SEQ ID NO: 1020179 - RNA, 19 nt, Mycobacterium avium subsp. paratuberculosis
agccacucgccgugagaag

SEQ ID NO: 1020180 - RNA, 15 nt, Mycobacterium avium subsp. paratuberculosis
agccagcaccgcccc

SEQ ID NO: 1020181 - RNA, 19 nt, Mycobacterium avium subsp. paratuberculosis
agccagccgguggcggcca

SEQ ID NO: 1020182 - RNA, 14 nt, Mycobacterium avium subsp. paratuberculosis
agccagcccagccg

SEQ ID NO: 1020183 - RNA, 21 nt, Mycobacterium avium subsp. paratuberculosis
agcauccggcgcacggcgccc

SEQ ID NO: 1020184 - RNA, 15 nt, Mycobacterium avium subsp. paratuberculosis
agcaucauugagccg

SEQ ID NO: 1020185 - RNA, 14 nt, Mycobacterium avium subsp. paratuberculosis
agcaggugcaccac

SEQ ID NO: 1020186 - RNA, 17 nt, Mycobacterium avium subsp. paratuberculosis
agcaggugcaucgccac

SEQ ID NO: 1020187 - RNA, 17 nt, Mycobacterium avium subsp. paratuberculosis
agcaggucggccagcug

SEQ ID NO: 1020188 - RNA, 20 nt, Mycobacterium avium subsp. paratuberculosis
agcaggucgucgaucagggc

SEQ ID NO: 1020189 - RNA, 22 nt, Mycobacterium avium subsp. paratuberculosis
agcagguccgccggugccagca

SEQ ID NO: 1020190 - RNA, 18 nt, Mycobacterium avium subsp. paratuberculosis
agcaggucgaaggcggcc

SEQ ID NO: 1020191 - RNA, 19 nt, Mycobacterium avium subsp. paratuberculosis
agcaggucgaaggcggccg

SEQ ID NO: 1020192 - RNA, 14 nt, Mycobacterium avium subsp. paratuberculosis
agcagguugcggug

SEQ ID NO: 1020193 - RNA, 21 nt, Mycobacterium avium subsp. paratuberculosis
agcagguugcgguguugcgca

SEQ ID NO: 1020194 - RNA, 12 nt, Mycobacterium avium subsp. paratuberculosis
agcagggcggcg

SEQ ID NO: 1020195 - RNA, 18 nt, Mycobacterium avium subsp. paratuberculosis
agcagguaaaccagcagc

SEQ ID NO: 1020196 - RNA, 23 nt, Mycobacterium avium subsp. paratuberculosis
agcagcuugaucgccggggcgcu

SEQ ID NO: 1020197 - RNA, 13 nt, Mycobacterium avium subsp. paratuberculosis
agcagcugcagcg

SEQ ID NO: 1020198 - RNA, 14 nt, Mycobacterium avium subsp. paratuberculosis
agcagcugcccgag

SEQ ID NO: 1020199 - RNA, 19 nt, Mycobacterium avium subsp. paratuberculosis
agcagcugcgucggcacca

SEQ ID NO: 1020200 - RNA, 20 nt, Mycobacterium avium subsp. paratuberculosis
agcagcugcgucggcaccag

SEQ ID NO: 1020201 - RNA, 23 nt, Mycobacterium avium subsp. paratuberculosis
agcagcuggaaauaggccgggca

SEQ ID NO: 1020202 - RNA, 18 nt, Mycobacterium avium subsp. paratuberculosis
agcagacgguaugcccgc

SEQ ID NO: 1020203 - RNA, 21 nt, Mycobacterium avium subsp. paratuberculosis
agcagccgccgggccacgccg

SEQ ID NO: 1020204 - RNA, 15 nt, Mycobacterium avium subsp. paratuberculosis
agcagccgcgccacc

SEQ ID NO: 1020205 - RNA, 19 nt, Mycobacterium avium subsp. paratuberculosis
agcagccgcgccaccgcgg

SEQ ID NO: 1020206 - RNA, 15 nt, Mycobacterium avium subsp. paratuberculosis
agcagccgcugcugg

SEQ ID NO: 1020207 - RNA, 22 nt, Mycobacterium avium subsp. paratuberculosis
agcagccggaaggccaaggcca

SEQ ID NO: 1020208 - RNA, 23 nt, Mycobacterium avium subsp. paratuberculosis
agcagccgggccagcaacagcag

SEQ ID NO: 1020209 - RNA, 14 nt, Mycobacterium avium subsp. paratuberculosis
agcagccgggccug

SEQ ID NO: 1020210 - RNA, 14 nt, Mycobacterium avium subsp. paratuberculosis
agcagccugccccc

SEQ ID NO: 1020211 - RNA, 17 nt, Mycobacterium avium subsp. paratuberculosis
agcagccgcagcgcgcg

SEQ ID NO: 1020212 - RNA, 14 nt, Mycobacterium avium subsp. paratuberculosis
agcagccgcagcgg

SEQ ID NO: 1020213 - RNA, 13 nt, Mycobacterium avium subsp. paratuberculosis
agcagcgaggcgu

SEQ ID NO: 1020214 - RNA, 22 nt, Mycobacterium avium subsp. paratuberculosis
agcagcgacuugaccagcagcu

SEQ ID NO: 1020215 - RNA, 16 nt, Mycobacterium avium subsp. paratuberculosis
agcacggcgaccagcg

SEQ ID NO: 1020216 - RNA, 15 nt, Mycobacterium avium subsp. paratuberculosis
agcacgccgcggaag

SEQ ID NO: 1020217 - RNA, 20 nt, Mycobacterium avium subsp. paratuberculosis
agcacgcccagaugcaggcu

SEQ ID NO: 1020218 - RNA, 19 nt, Mycobacterium avium subsp. paratuberculosis
agcacggccaccagcagcg

SEQ ID NO: 1020219 - RNA, 14 nt, Mycobacterium avium subsp. paratuberculosis
agcacggcacgccc

SEQ ID NO: 1020220 - RNA, 22 nt, Mycobacterium avium subsp. paratuberculosis
agcacggccacugccccggcga

SEQ ID NO: 1020221 - RNA, 18 nt, Mycobacterium avium subsp. paratuberculosis
agcacggccgcggccagc

SEQ ID NO: 1020222 - RNA, 23 nt, Mycobacterium avium subsp. paratuberculosis
agcacggcauagauaccggccag

SEQ ID NO: 1020223 - RNA, 19 nt, Mycobacterium avium subsp. paratuberculosis
agcacgcugaagcccaccg

SEQ ID NO: 1020224 - RNA, 16 nt, Mycobacterium avium subsp. paratuberculosis
agcacgaucgagccgg

SEQ ID NO: 1020225 - RNA, 20 nt, Mycobacterium avium subsp. paratuberculosis
agcaccgcgaucgccgacgu

SEQ ID NO: 1020226 - RNA, 15 nt, Mycobacterium avium subsp. paratuberculosis
agcaccgccgcggcc

SEQ ID NO: 1020227 - RNA, 15 nt, Mycobacterium avium subsp. paratuberculosis
agcaccgccuggguc

SEQ ID NO: 1020228 - RNA, 17 nt, Mycobacterium avium subsp. paratuberculosis
agcaccgcgaacagcac

SEQ ID NO: 1020229 - RNA, 15 nt, Mycobacterium avium subsp. paratuberculosis
agcaccgcgaagaac

SEQ ID NO: 1020230 - RNA, 18 nt, Mycobacterium avium subsp. paratuberculosis
agcaccgccucggccacc

SEQ ID NO: 1020231 - RNA, 22 nt, Mycobacterium avium subsp. paratuberculosis
agcaccgaaucgccgagcucga

SEQ ID NO: 1020232 - RNA, 23 nt, Mycobacterium avium subsp. paratuberculosis
agcacacgaucucguagguggcc

SEQ ID NO: 1020233 - RNA, 16 nt, Mycobacterium avium subsp. paratuberculosis
agcacacccagcgagc

SEQ ID NO: 1020234 - RNA, 16 nt, Mycobacterium avium subsp. paratuberculosis
agcacaucggcguuca

SEQ ID NO: 1020235 - RNA, 13 nt, Mycobacterium avium subsp. paratuberculosis
agcaccaccaaca

SEQ ID NO: 1020236 - RNA, 20 nt, Mycobacterium avium subsp. paratuberculosis
agcaccacccggguguugga

SEQ ID NO: 1020237 - RNA, 20 nt, Mycobacterium avium subsp. paratuberculosis
agcaccaguuugguguucgg

SEQ ID NO: 1020238 - RNA, 22 nt, Mycobacterium avium subsp. paratuberculosis
agcaccagggcguguugcaggc

SEQ ID NO: 1020239 - RNA, 15 nt, Mycobacterium avium subsp. paratuberculosis
agcaccagggucuuc

SEQ ID NO: 1020240 - RNA, 22 nt, Mycobacterium avium subsp. paratuberculosis
agcaccaggcgcaccagcugau

SEQ ID NO: 1020241 - RNA, 13 nt, Mycobacterium avium subsp. paratuberculosis
agcaccacuucca

SEQ ID NO: 1020242 - RNA, 17 nt, Mycobacterium avium subsp. paratuberculosis
agcaccacuuccagcac

SEQ ID NO: 1020243 - RNA, 22 nt, Mycobacterium avium subsp. paratuberculosis
agcaccaccuugucaccgaacc

SEQ ID NO: 1020244 - RNA, 12 nt, Mycobacterium avium subsp. paratuberculosis
agcaccagcacc

SEQ ID NO: 1020245 - RNA, 21 nt, Mycobacterium avium subsp. paratuberculosis
agcacccgguuccaccgggcc

SEQ ID NO: 1020246 - RNA, 16 nt, Mycobacterium avium subsp. paratuberculosis
agcacccgcaucaacu

SEQ ID NO: 1020247 - RNA, 22 nt, Mycobacterium avium subsp. paratuberculosis
agcacccgcaucaacugcacca

SEQ ID NO: 1020248 - RNA, 22 nt, Mycobacterium avium subsp. paratuberculosis
agcacccgcugauccagcagcg

SEQ ID NO: 1020249 - RNA, 18 nt, Mycobacterium avium subsp. paratuberculosis
agcacccgcugcagccgg

SEQ ID NO: 1020250 - RNA, 15 nt, Mycobacterium avium subsp. paratuberculosis
agcaccccggcggcc

SEQ ID NO: 1020251 - RNA, 16 nt, Mycobacterium avium subsp. paratuberculosis
agcaccccggcggccg

SEQ ID NO: 1020252 - RNA, 16 nt, Mycobacterium avium subsp. paratuberculosis
agcaccccgguccagg

SEQ ID NO: 1020253 - RNA, 19 nt, Mycobacterium avium subsp. paratuberculosis
agcaccccgucgagguuca

SEQ ID NO: 1020254 - RNA, 23 nt, Mycobacterium avium subsp. paratuberculosis
agcacccgcagccgcgagucgag

SEQ ID NO: 1020255 - RNA, 19 nt, Mycobacterium avium subsp. paratuberculosis
agcacccaggugcugcccu

SEQ ID NO: 1020256 - RNA, 20 nt, Mycobacterium avium subsp. paratuberculosis
agcaccaugaucaggcccca

SEQ ID NO: 1020257 - RNA, 22 nt, Mycobacterium avium subsp. paratuberculosis
agcacacacaggucgcccggcu

SEQ ID NO: 1020258 - RNA, 23 nt, Mycobacterium avium subsp. paratuberculosis
agcaagucggcggugaugcgcgc

SEQ ID NO: 1020259 - RNA, 13 nt, Mycobacterium avium subsp. paratuberculosis
agcaacuggguga

SEQ ID NO: 1020260 - RNA, 15 nt, Mycobacterium avium subsp. paratuberculosis
agcaacggccgcagc

SEQ ID NO: 1020261 - RNA, 19 nt, Mycobacterium avium subsp. paratuberculosis
acuguccaggccgaggcug

SEQ ID NO: 1020262 - RNA, 17 nt, Mycobacterium avium subsp. paratuberculosis
acuguauuugaguucuc

SEQ ID NO: 1020263 - RNA, 13 nt, Mycobacterium avium subsp. paratuberculosis
acugguugcagau

SEQ ID NO: 1020264 - RNA, 19 nt, Mycobacterium avium subsp. paratuberculosis
acuggugggcgucgugguc

SEQ ID NO: 1020265 - RNA, 18 nt, Mycobacterium avium subsp. paratuberculosis
acugguccugcggcuggu

SEQ ID NO: 1020266 - RNA, 20 nt, Mycobacterium avium subsp. paratuberculosis
acuggucgugcagcaccgcc

SEQ ID NO: 1020267 - RNA, 16 nt, Mycobacterium avium subsp. paratuberculosis
acuggucgugcuggag

SEQ ID NO: 1020268 - RNA, 16 nt, Mycobacterium avium subsp. paratuberculosis
acuggucguugcacac

SEQ ID NO: 1020269 - RNA, 23 nt, Mycobacterium avium subsp. paratuberculosis
acugggugccccgccguuucagc

SEQ ID NO: 1020270 - RNA, 15 nt, Mycobacterium avium subsp. paratuberculosis
acugcuugccgccgg

SEQ ID NO: 1020271 - RNA, 20 nt, Mycobacterium avium subsp. paratuberculosis
acuggcugagcagcacccga

SEQ ID NO: 1020272 - RNA, 15 nt, Mycobacterium avium subsp. paratuberculosis
acuggcgccaccucc

SEQ ID NO: 1020273 - RNA, 14 nt, Mycobacterium avium subsp. paratuberculosis
acuggcgcugcgcu

SEQ ID NO: 1020274 - RNA, 13 nt, Mycobacterium avium subsp. paratuberculosis
acuggcggccggc

SEQ ID NO: 1020275 - RNA, 16 nt, Mycobacterium avium subsp. paratuberculosis
acucgucuugcagccg

SEQ ID NO: 1020276 - RNA, 22 nt, Mycobacterium avium subsp. paratuberculosis
acucgugcggcgccgcccggcg

SEQ ID NO: 1020277 - RNA, 17 nt, Mycobacterium avium subsp. paratuberculosis
acugaugaagccgccga

SEQ ID NO: 1020278 - RNA, 15 nt, Mycobacterium avium subsp. paratuberculosis
acugacccgcacgaa

SEQ ID NO: 1020279 - RNA, 17 nt, Mycobacterium avium subsp. paratuberculosis
acugcaccagcacgaca

SEQ ID NO: 1020280 - RNA, 12 nt, Mycobacterium avium subsp. paratuberculosis
acugcaggaaca

SEQ ID NO: 1020281 - RNA, 13 nt, Mycobacterium avium subsp. paratuberculosis
acugcaggaacaa

SEQ ID NO: 1020282 - RNA, 17 nt, Mycobacterium avium subsp. paratuberculosis
acugcacggccucgguc

SEQ ID NO: 1020283 - RNA, 13 nt, Mycobacterium avium subsp. paratuberculosis
acugcccagccau

SEQ ID NO: 1020284 - RNA, 17 nt, Mycobacterium avium subsp. paratuberculosis
acugcccagccaucugc

SEQ ID NO: 1020285 - RNA, 15 nt, Mycobacterium avium subsp. paratuberculosis
acugccgagcaucag

SEQ ID NO: 1020286 - RNA, 19 nt, Mycobacterium avium subsp. paratuberculosis
acugccgagcaucagcugc

SEQ ID NO: 1020287 - RNA, 15 nt, Mycobacterium avium subsp. paratuberculosis
acugccgaugcugag

SEQ ID NO: 1020288 - RNA, 19 nt, Mycobacterium avium subsp. paratuberculosis
acugccccgcuccuccucg

SEQ ID NO: 1020289 - RNA, 20 nt, Mycobacterium avium subsp. paratuberculosis
acugccggcauaggccagca

SEQ ID NO: 1020290 - RNA, 22 nt, Mycobacterium avium subsp. paratuberculosis
acugccggcauaggccagcacc

SEQ ID NO: 1020291 - RNA, 15 nt, Mycobacterium avium subsp. paratuberculosis
acugcgugcugggca

SEQ ID NO: 1020292 - RNA, 15 nt, Mycobacterium avium subsp. paratuberculosis
acucgggccagccca

SEQ ID NO: 1020293 - RNA, 23 nt, Mycobacterium avium subsp. paratuberculosis
acucgcgcucccggcgccgccgu

SEQ ID NO: 1020294 - RNA, 21 nt, Mycobacterium avium subsp. paratuberculosis
acucgcgggcgagcagcgccc

SEQ ID NO: 1020295 - RNA, 22 nt, Mycobacterium avium subsp. paratuberculosis
acucgcgggcgagcagcgcccg

SEQ ID NO: 1020296 - RNA, 22 nt, Mycobacterium avium subsp. paratuberculosis
acucgcguccccgcgccgggca

SEQ ID NO: 1020297 - RNA, 14 nt, Mycobacterium avium subsp. paratuberculosis
acucgcgaggccgc

SEQ ID NO: 1020298 - RNA, 23 nt, Mycobacterium avium subsp. paratuberculosis
acuccuugaacccuuugagcauu

SEQ ID NO: 1020299 - RNA, 19 nt, Mycobacterium avium subsp. paratuberculosis
acuccgccgaaccgaucac

SEQ ID NO: 1020300 - RNA, 23 nt, Mycobacterium avium subsp. paratuberculosis
acuccgcgauggccuccgacccg

SEQ ID NO: 1020301 - RNA, 21 nt, Mycobacterium avium subsp. paratuberculosis
acuccgacuccagcagcgccu

SEQ ID NO: 1020302 - RNA, 18 nt, Mycobacterium avium subsp. paratuberculosis
acuccagcgcgaucaacg

SEQ ID NO: 1020303 - RNA, 18 nt, Mycobacterium avium subsp. paratuberculosis
acuccagcaccggcgcca

SEQ ID NO: 1020304 - RNA, 15 nt, Mycobacterium avium subsp. paratuberculosis
acuccagcagcgcca

SEQ ID NO: 1020305 - RNA, 19 nt, Mycobacterium avium subsp. paratuberculosis
acuccagcagcgccagcac

SEQ ID NO: 1020306 - RNA, 20 nt, Mycobacterium avium subsp. paratuberculosis
acuccagcagcgccagcacc

SEQ ID NO: 1020307 - RNA, 19 nt, Mycobacterium avium subsp. paratuberculosis
acuccagcagcgccuugcc

SEQ ID NO: 1020308 - RNA, 13 nt, Mycobacterium avium subsp. paratuberculosis
acuccagcagcug

SEQ ID NO: 1020309 - RNA, 13 nt, Mycobacterium avium subsp. paratuberculosis
acuccaccaccug

SEQ ID NO: 1020310 - RNA, 21 nt, Mycobacterium avium subsp. paratuberculosis
acuccaccaccuggccggcca

SEQ ID NO: 1020311 - RNA, 13 nt, Mycobacterium avium subsp. paratuberculosis
acuccacccugcc

SEQ ID NO: 1020312 - RNA, 13 nt, Mycobacterium avium subsp. paratuberculosis
acuccaccgccac

SEQ ID NO: 1020313 - RNA, 15 nt, Mycobacterium avium subsp. paratuberculosis
acuccaccgccaccg

SEQ ID NO: 1020314 - RNA, 13 nt, Mycobacterium avium subsp. paratuberculosis
acucagcccggcc

SEQ ID NO: 1020315 - RNA, 18 nt, Mycobacterium avium subsp. paratuberculosis
acucagcccggcccagcc

SEQ ID NO: 1020316 - RNA, 22 nt, Mycobacterium avium subsp. paratuberculosis
acucagcccggcccagccgguc

SEQ ID NO: 1020317 - RNA, 22 nt, Mycobacterium avium subsp. paratuberculosis
acucaggagugguagggcuccg

SEQ ID NO: 1020318 - RNA, 15 nt, Mycobacterium avium subsp. paratuberculosis
acucaccggugguga

SEQ ID NO: 1020319 - RNA, 18 nt, Mycobacterium avium subsp. paratuberculosis
acguucgagucggccacg

SEQ ID NO: 1020320 - RNA, 23 nt, Mycobacterium avium subsp. paratuberculosis
acggucuggcuggugaccccguu

SEQ ID NO: 1020321 - RNA, 15 nt, Mycobacterium avium subsp. paratuberculosis
acggucggagcccag

SEQ ID NO: 1020322 - RNA, 21 nt, Mycobacterium avium subsp. paratuberculosis
acggucgugcugggccgggcg

SEQ ID NO: 1020323 - RNA, 17 nt, Mycobacterium avium subsp. paratuberculosis
acggucccacucgggaa

SEQ ID NO: 1020324 - RNA, 17 nt, Mycobacterium avium subsp. paratuberculosis
acggucagccgcggcuc

SEQ ID NO: 1020325 - RNA, 16 nt, Mycobacterium avium subsp. paratuberculosis
acggucaguccggguu

SEQ ID NO: 1020326 - RNA, 20 nt, Mycobacterium avium subsp. paratuberculosis
acggucagcucgcgcccggc

SEQ ID NO: 1020327 - RNA, 12 nt, Mycobacterium avium subsp. paratuberculosis
acggucaggcgc

SEQ ID NO: 1020328 - RNA, 13 nt, Mycobacterium avium subsp. paratuberculosis
acggucacgcugg

SEQ ID NO: 1020329 - RNA, 17 nt, Mycobacterium avium subsp. paratuberculosis
acgguagccugcagugu

SEQ ID NO: 1020330 - RNA, 22 nt, Mycobacterium avium subsp. paratuberculosis
acggggcguugguugcggcccc

SEQ ID NO: 1020331 - RNA, 19 nt, Mycobacterium avium subsp. paratuberculosis
acgggguggaauaggccgc

SEQ ID NO: 1020332 - RNA, 17 nt, Mycobacterium avium subsp. paratuberculosis
acggguccuugccggcg

SEQ ID NO: 1020333 - RNA, 12 nt, Mycobacterium avium subsp. paratuberculosis
acggcggggccu

SEQ ID NO: 1020334 - RNA, 18 nt, Mycobacterium avium subsp. paratuberculosis
acggcggggaugcccggg

SEQ ID NO: 1020335 - RNA, 13 nt, Mycobacterium avium subsp. paratuberculosis
acggcgucgacac

SEQ ID NO: 1020336 - RNA, 20 nt, Mycobacterium avium subsp. paratuberculosis
acggcggcagcgaggcgcgc

SEQ ID NO: 1020337 - RNA, 14 nt, Mycobacterium avium subsp. paratuberculosis
acggcgauguagga

SEQ ID NO: 1020338 - RNA, 21 nt, Mycobacterium avium subsp. paratuberculosis
acggcggcgugcaccgcccgc

SEQ ID NO: 1020339 - RNA, 22 nt, Mycobacterium avium subsp. paratuberculosis
acgggcacccgcgcgucgcgca

SEQ ID NO: 1020340 - RNA, 13 nt, Mycobacterium avium subsp. paratuberculosis
acgggcacaccgu

SEQ ID NO: 1020341 - RNA, 14 nt, Mycobacterium avium subsp. paratuberculosis
acgggaugcggcac

SEQ ID NO: 1020342 - RNA, 12 nt, Mycobacterium avium subsp. paratuberculosis
acgggcugcugc

SEQ ID NO: 1020343 - RNA, 10 nt, Mycobacterium avium subsp. paratuberculosis
acgggcaucc

SEQ ID NO: 1020344 - RNA, 23 nt, Mycobacterium avium subsp. paratuberculosis
acgggcauccggcucagaaggcg

SEQ ID NO: 1020345 - RNA, 21 nt, Mycobacterium avium subsp. paratuberculosis
acggcagcaccucgcgcagca

SEQ ID NO: 1020346 - RNA, 16 nt, Mycobacterium avium subsp. paratuberculosis
acggcaccucgaucac

SEQ ID NO: 1020347 - RNA, 16 nt, Mycobacterium avium subsp. paratuberculosis
acggcacgcccguucg

SEQ ID NO: 1020348 - RNA, 20 nt, Mycobacterium avium subsp. paratuberculosis
acggcacguugcccaggaag

SEQ ID NO: 1020349 - RNA, 22 nt, Mycobacterium avium subsp. paratuberculosis
acgcuguagggccaccacgcca

SEQ ID NO: 1020350 - RNA, 13 nt, Mycobacterium avium subsp. paratuberculosis
acggcacccggcc

SEQ ID NO: 1020351 - RNA, 22 nt, Mycobacterium avium subsp. paratuberculosis
acggcaccgacggagccgagca

SEQ ID NO: 1020352 - RNA, 13 nt, Mycobacterium avium subsp. paratuberculosis
acggcaccgccgg

SEQ ID NO: 1020353 - RNA, 15 nt, Mycobacterium avium subsp. paratuberculosis
acggcauggacacgc

SEQ ID NO: 1020354 - RNA, 12 nt, Mycobacterium avium subsp. paratuberculosis
acggcaugguga

SEQ ID NO: 1020355 - RNA, 16 nt, Mycobacterium avium subsp. paratuberculosis
acggcaucggcgcccu

SEQ ID NO: 1020356 - RNA, 22 nt, Mycobacterium avium subsp. paratuberculosis
acggcagcgcuaaccgcgggca

SEQ ID NO: 1020357 - RNA, 16 nt, Mycobacterium avium subsp. paratuberculosis
acggcgaacuuggccg

SEQ ID NO: 1020358 - RNA, 16 nt, Mycobacterium avium subsp. paratuberculosis
acggcgaccccguucg

SEQ ID NO: 1020359 - RNA, 22 nt, Mycobacterium avium subsp. paratuberculosis
acggcgaggauggcgaucauca

SEQ ID NO: 1020360 - RNA, 21 nt, Mycobacterium avium subsp. paratuberculosis
acggccucgaucaucaccacc

SEQ ID NO: 1020361 - RNA, 15 nt, Mycobacterium avium subsp. paratuberculosis
acggccguccaggcg

SEQ ID NO: 1020362 - RNA, 15 nt, Mycobacterium avium subsp. paratuberculosis
acggccggcgccgcc

SEQ ID NO: 1020363 - RNA, 18 nt, Mycobacterium avium subsp. paratuberculosis
acggccggauggccagca

SEQ ID NO: 1020364 - RNA, 19 nt, Mycobacterium avium subsp. paratuberculosis
acggccggcccugcacgca

SEQ ID NO: 1020365 - RNA, 14 nt, Mycobacterium avium subsp. paratuberculosis
acggcccgcgcccc

SEQ ID NO: 1020366 - RNA, 22 nt, Mycobacterium avium subsp. paratuberculosis
acggcccgcgccccggcggcca

SEQ ID NO: 1020367 - RNA, 18 nt, Mycobacterium avium subsp. paratuberculosis
acggcccgggaagccgca

SEQ ID NO: 1020368 - RNA, 22 nt, Mycobacterium avium subsp. paratuberculosis
acggcccggucuugccggcuuc

SEQ ID NO: 1020369 - RNA, 15 nt, Mycobacterium avium subsp. paratuberculosis
acggccccagacgaa

SEQ ID NO: 1020370 - RNA, 15 nt, Mycobacterium avium subsp. paratuberculosis
acggccccagccgcc

SEQ ID NO: 1020371 - RNA, 20 nt, Mycobacterium avium subsp. paratuberculosis
acggccccccgggcaccagc

SEQ ID NO: 1020372 - RNA, 11 nt, Mycobacterium avium subsp. paratuberculosis
acggccgccga

SEQ ID NO: 1020373 - RNA, 12 nt, Mycobacterium avium subsp. paratuberculosis
acggcccaucac

SEQ ID NO: 1020374 - RNA, 14 nt, Mycobacterium avium subsp. paratuberculosis
acggccgcacccca

SEQ ID NO: 1020375 - RNA, 14 nt, Mycobacterium avium subsp. paratuberculosis
acggccagaccgca

SEQ ID NO: 1020376 - RNA, 12 nt, Mycobacterium avium subsp. paratuberculosis
acggccagcagg

SEQ ID NO: 1020377 - RNA, 18 nt, Mycobacterium avium subsp. paratuberculosis
acggccaugaagccguug

SEQ ID NO: 1020378 - RNA, 14 nt, Mycobacterium avium subsp. paratuberculosis
acgguguugcgcac

SEQ ID NO: 1020379 - RNA, 22 nt, Mycobacterium avium subsp. paratuberculosis
acgguggugucgucgggccgca

SEQ ID NO: 1020380 - RNA, 22 nt, Mycobacterium avium subsp. paratuberculosis
acggugaccucgucgggcgcca

SEQ ID NO: 1020381 - RNA, 15 nt, Mycobacterium avium subsp. paratuberculosis
acgucacggcgagga

SEQ ID NO: 1020382 - RNA, 19 nt, Mycobacterium avium subsp. paratuberculosis
acgucaggucgaccggcuc

SEQ ID NO: 1020383 - RNA, 16 nt, Mycobacterium avium subsp. paratuberculosis
acguccgaggucuugg

SEQ ID NO: 1020384 - RNA, 17 nt, Mycobacterium avium subsp. paratuberculosis
acguccgaggucuuggu

SEQ ID NO: 1020385 - RNA, 16 nt, Mycobacterium avium subsp. paratuberculosis
acguccccgggcaccc

SEQ ID NO: 1020386 - RNA, 17 nt, Mycobacterium avium subsp. paratuberculosis
acguccccgugcagccg

SEQ ID NO: 1020387 - RNA, 16 nt, Mycobacterium avium subsp. paratuberculosis
acguccaccagcacca

SEQ ID NO: 1020388 - RNA, 18 nt, Mycobacterium avium subsp. paratuberculosis
acguccagcgccgccauc

SEQ ID NO: 1020389 - RNA, 21 nt, Mycobacterium avium subsp. paratuberculosis
acguccagcugggcugccagc

SEQ ID NO: 1020390 - RNA, 11 nt, Mycobacterium avium subsp. paratuberculosis
acguccaggcc

SEQ ID NO: 1020391 - RNA, 21 nt, Mycobacterium avium subsp. paratuberculosis
acguccaggccggcgccgcgg

SEQ ID NO: 1020392 - RNA, 15 nt, Mycobacterium avium subsp. paratuberculosis
acgugguggaugaug

SEQ ID NO: 1020393 - RNA, 17 nt, Mycobacterium avium subsp. paratuberculosis
acguggugcaccgccag

SEQ ID NO: 1020394 - RNA, 14 nt, Mycobacterium avium subsp. paratuberculosis
acguggcaacgugc

SEQ ID NO: 1020395 - RNA, 19 nt, Mycobacterium avium subsp. paratuberculosis
acgugccacuggcgccacc

SEQ ID NO: 1020396 - RNA, 14 nt, Mycobacterium avium subsp. paratuberculosis
acguggacgcgcgc

SEQ ID NO: 1020397 - RNA, 12 nt, Mycobacterium avium subsp. paratuberculosis
acgugcaccacc

SEQ ID NO: 1020398 - RNA, 22 nt, Mycobacterium avium subsp. paratuberculosis
acgugcaccggcgaguccgcgg

SEQ ID NO: 1020399 - RNA, 17 nt, Mycobacterium avium subsp. paratuberculosis
acgugcaccugcagccg

SEQ ID NO: 1020400 - RNA, 16 nt, Mycobacterium avium subsp. paratuberculosis
acguccgggccgccuc

SEQ ID NO: 1020401 - RNA, 17 nt, Mycobacterium avium subsp. paratuberculosis
acgucgaccuugcagcc

SEQ ID NO: 1020402 - RNA, 18 nt, Mycobacterium avium subsp. paratuberculosis
acgucgaccuugcagccc

SEQ ID NO: 1020403 - RNA, 14 nt, Mycobacterium avium subsp. paratuberculosis
acgucgacggcagc

SEQ ID NO: 1020404 - RNA, 19 nt, Mycobacterium avium subsp. paratuberculosis
acgucgacgugggcggcca

SEQ ID NO: 1020405 - RNA, 15 nt, Mycobacterium avium subsp. paratuberculosis
acgucgagcuccucg

SEQ ID NO: 1020406 - RNA, 20 nt, Mycobacterium avium subsp. paratuberculosis
acgucgaggucggacgccuc

SEQ ID NO: 1020407 - RNA, 15 nt, Mycobacterium avium subsp. paratuberculosis
acgucgagguguugu

SEQ ID NO: 1020408 - RNA, 19 nt, Mycobacterium avium subsp. paratuberculosis
acgucgaucacgccgccgg

SEQ ID NO: 1020409 - RNA, 20 nt, Mycobacterium avium subsp. paratuberculosis
acgucgaugccgaaccgcuc

SEQ ID NO: 1020410 - RNA, 17 nt, Mycobacterium avium subsp. paratuberculosis
acgucgccggccugccc

SEQ ID NO: 1020411 - RNA, 22 nt, Mycobacterium avium subsp. paratuberculosis
acgucgccggcgaccgccaccu

SEQ ID NO: 1020412 - RNA, 13 nt, Mycobacterium avium subsp. paratuberculosis
acgucgccguucu

SEQ ID NO: 1020413 - RNA, 19 nt, Mycobacterium avium subsp. paratuberculosis
acgucucugucgucgacca

SEQ ID NO: 1020414 - RNA, 16 nt, Mycobacterium avium subsp. paratuberculosis
acgugauaguggucgu

SEQ ID NO: 1020415 - RNA, 20 nt, Mycobacterium avium subsp. paratuberculosis
acgucggcgcgcaggcuggc

SEQ ID NO: 1020416 - RNA, 22 nt, Mycobacterium avium subsp. paratuberculosis
acgucggcagguugucgcugaa

SEQ ID NO: 1020417 - RNA, 12 nt, Mycobacterium avium subsp. paratuberculosis
acgucggccacg

SEQ ID NO: 1020418 - RNA, 11 nt, Mycobacterium avium subsp. paratuberculosis
acgucggccgg

SEQ ID NO: 1020419 - RNA, 19 nt, Mycobacterium avium subsp. paratuberculosis
acgucgguguagucggcga

SEQ ID NO: 1020420 - RNA, 20 nt, Mycobacterium avium subsp. paratuberculosis
acgucguucaugaucggcag

SEQ ID NO: 1020421 - RNA, 17 nt, Mycobacterium avium subsp. paratuberculosis
acgcgaaugucgaccac

SEQ ID NO: 1020422 - RNA, 15 nt, Mycobacterium avium subsp. paratuberculosis
acgcgaccggccauc

SEQ ID NO: 1020423 - RNA, 15 nt, Mycobacterium avium subsp. paratuberculosis
acgcgaccgucggga

SEQ ID NO: 1020424 - RNA, 15 nt, Mycobacterium avium subsp. paratuberculosis
acgcgagaagcgcgc

SEQ ID NO: 1020425 - RNA, 19 nt, Mycobacterium avium subsp. paratuberculosis
acgcgacggucgugcuggg

SEQ ID NO: 1020426 - RNA, 14 nt, Mycobacterium avium subsp. paratuberculosis
acgcgauggcggcg

SEQ ID NO: 1020427 - RNA, 14 nt, Mycobacterium avium subsp. paratuberculosis
acgcgcaccgccac

SEQ ID NO: 1020428 - RNA, 15 nt, Mycobacterium avium subsp. paratuberculosis
acgcgcaugcccugg

SEQ ID NO: 1020429 - RNA, 18 nt, Mycobacterium avium subsp. paratuberculosis
acgcgcacacggccucgc

SEQ ID NO: 1020430 - RNA, 15 nt, Mycobacterium avium subsp. paratuberculosis
acgcgccgcacugca

SEQ ID NO: 1020431 - RNA, 12 nt, Mycobacterium avium subsp. paratuberculosis
acgcgccgccca

SEQ ID NO: 1020432 - RNA, 17 nt, Mycobacterium avium subsp. paratuberculosis
acgcgccggcgcgggca

SEQ ID NO: 1020433 - RNA, 19 nt, Mycobacterium avium subsp. paratuberculosis
acgcgccggcggucgacac

SEQ ID NO: 1020434 - RNA, 19 nt, Mycobacterium avium subsp. paratuberculosis
acgcgccgggcaacagcgc

SEQ ID NO: 1020435 - RNA, 21 nt, Mycobacterium avium subsp. paratuberculosis
acgcgcgcggcgucaggggug

SEQ ID NO: 1020436 - RNA, 20 nt, Mycobacterium avium subsp. paratuberculosis
acgcgcgugacggcggggcg

SEQ ID NO: 1020437 - RNA, 17 nt, Mycobacterium avium subsp. paratuberculosis
acgcgcugcgcgccgcc

SEQ ID NO: 1020438 - RNA, 20 nt, Mycobacterium avium subsp. paratuberculosis
acgcgcucggcgaccgccgg

SEQ ID NO: 1020439 - RNA, 14 nt, Mycobacterium avium subsp. paratuberculosis
acgcgcugaucacc

SEQ ID NO: 1020440 - RNA, 19 nt, Mycobacterium avium subsp. paratuberculosis
acgcggcggccuggccguc

SEQ ID NO: 1020441 - RNA, 15 nt, Mycobacterium avium subsp. paratuberculosis
acgcggcgucgggcg

SEQ ID NO: 1020442 - RNA, 19 nt, Mycobacterium avium subsp. paratuberculosis
acgcgggauugccgagcac

SEQ ID NO: 1020443 - RNA, 15 nt, Mycobacterium avium subsp. paratuberculosis
acgcggcgcgacacc

SEQ ID NO: 1020444 - RNA, 16 nt, Mycobacterium avium subsp. paratuberculosis
acgcggcgaccaccac

SEQ ID NO: 1020445 - RNA, 20 nt, Mycobacterium avium subsp. paratuberculosis
acgcggcugaucagccggcg

SEQ ID NO: 1020446 - RNA, 16 nt, Mycobacterium avium subsp. paratuberculosis
acgcggcuggcgggug

SEQ ID NO: 1020447 - RNA, 16 nt, Mycobacterium avium subsp. paratuberculosis
acgcggcaggcgcccc

SEQ ID NO: 1020448 - RNA, 20 nt, Mycobacterium avium subsp. paratuberculosis
acgcggccagcgggccguug

SEQ ID NO: 1020449 - RNA, 12 nt, Mycobacterium avium subsp. paratuberculosis
acgcguagaacc

SEQ ID NO: 1020450 - RNA, 17 nt, Mycobacterium avium subsp. paratuberculosis
acgcggugagcgcgccg

SEQ ID NO: 1020451 - RNA, 13 nt, Mycobacterium avium subsp. paratuberculosis
acgcgucgaacac

SEQ ID NO: 1020452 - RNA, 20 nt, Mycobacterium avium subsp. paratuberculosis
acgcgucgaacagccgggcc

SEQ ID NO: 1020453 - RNA, 17 nt, Mycobacterium avium subsp. paratuberculosis
acgcgucgcccacgccg

SEQ ID NO: 1020454 - RNA, 20 nt, Mycobacterium avium subsp. paratuberculosis
acgcggugggcaccagcagc

SEQ ID NO: 1020455 - RNA, 21 nt, Mycobacterium avium subsp. paratuberculosis
acgcguuacacccauucacgc

SEQ ID NO: 1020456 - RNA, 19 nt, Mycobacterium avium subsp. paratuberculosis
acgcguucuccucgaacac

SEQ ID NO: 1020457 - RNA, 22 nt, Mycobacterium avium subsp. paratuberculosis
acgcguuguugcucggcggccc

SEQ ID NO: 1020458 - RNA, 19 nt, Mycobacterium avium subsp. paratuberculosis
acgcuggucgaacgccacc

SEQ ID NO: 1020459 - RNA, 17 nt, Mycobacterium avium subsp. paratuberculosis
acgcuggcgugacaguc

SEQ ID NO: 1020460 - RNA, 18 nt, Mycobacterium avium subsp. paratuberculosis
acgcuggcguggcacccg

SEQ ID NO: 1020461 - RNA, 16 nt, Mycobacterium avium subsp. paratuberculosis
acgcuggcguggcgcc

SEQ ID NO: 1020462 - RNA, 17 nt, Mycobacterium avium subsp. paratuberculosis
acgcuggcguggcucgg

SEQ ID NO: 1020463 - RNA, 22 nt, Mycobacterium avium subsp. paratuberculosis
acgcucggcgagcaaggcgagc

SEQ ID NO: 1020464 - RNA, 22 nt, Mycobacterium avium subsp. paratuberculosis
acgcucggcgcgcggggccggc

SEQ ID NO: 1020465 - RNA, 20 nt, Mycobacterium avium subsp. paratuberculosis
acgcucgcaggcgagccgac

SEQ ID NO: 1020466 - RNA, 16 nt, Mycobacterium avium subsp. paratuberculosis
acgcucgacggccggc

SEQ ID NO: 1020467 - RNA, 22 nt, Mycobacterium avium subsp. paratuberculosis
acgcugcgcgccgauccggcuc

SEQ ID NO: 1020468 - RNA, 15 nt, Mycobacterium avium subsp. paratuberculosis
acgcugcgccagccg

SEQ ID NO: 1020469 - RNA, 20 nt, Mycobacterium avium subsp. paratuberculosis
acgcugccggggcgcagcug

SEQ ID NO: 1020470 - RNA, 16 nt, Mycobacterium avium subsp. paratuberculosis
acgccucgucgagcag

SEQ ID NO: 1020471 - RNA, 15 nt, Mycobacterium avium subsp. paratuberculosis
acgccucguuggcca

SEQ ID NO: 1020472 - RNA, 14 nt, Mycobacterium avium subsp. paratuberculosis
acgccucccccacc

SEQ ID NO: 1020473 - RNA, 14 nt, Mycobacterium avium subsp. paratuberculosis
acgccugcgccgcc

SEQ ID NO: 1020474 - RNA, 13 nt, Mycobacterium avium subsp. paratuberculosis
acgccucacccca

SEQ ID NO: 1020475 - RNA, 21 nt, Mycobacterium avium subsp. paratuberculosis
acgccucaccccagcgcgacc

SEQ ID NO: 1020476 - RNA, 17 nt, Mycobacterium avium subsp. paratuberculosis
acgccucaggcgagcac

SEQ ID NO: 1020477 - RNA, 11 nt, Mycobacterium avium subsp. paratuberculosis
acgccuccaca

SEQ ID NO: 1020478 - RNA, 20 nt, Mycobacterium avium subsp. paratuberculosis
acgccuugaccgccuuggcc

SEQ ID NO: 1020479 - RNA, 17 nt, Mycobacterium avium subsp. paratuberculosis
acgcgaagucgccgccc

SEQ ID NO: 1020480 - RNA, 20 nt, Mycobacterium avium subsp. paratuberculosis
acgcgaagucgccgcccggg

SEQ ID NO: 1020481 - RNA, 19 nt, Mycobacterium avium subsp. paratuberculosis
acgccgcgcacgacgugga

SEQ ID NO: 1020482 - RNA, 22 nt, Mycobacterium avium subsp. paratuberculosis
acgccggaaucgauuggugcgc

SEQ ID NO: 1020483 - RNA, 19 nt, Mycobacterium avium subsp. paratuberculosis
acgccgcgggaggcccagu

SEQ ID NO: 1020484 - RNA, 17 nt, Mycobacterium avium subsp. paratuberculosis
acgccgcucgucgggca

SEQ ID NO: 1020485 - RNA, 13 nt, Mycobacterium avium subsp. paratuberculosis
acgccgccuugac

SEQ ID NO: 1020486 - RNA, 14 nt, Mycobacterium avium subsp. paratuberculosis
acgccgccggggcg

SEQ ID NO: 1020487 - RNA, 22 nt, Mycobacterium avium subsp. paratuberculosis
acgccgccgacagcaccucgcc

SEQ ID NO: 1020488 - RNA, 14 nt, Mycobacterium avium subsp. paratuberculosis
acgccgcccccgcc

SEQ ID NO: 1020489 - RNA, 13 nt, Mycobacterium avium subsp. paratuberculosis
acgccgccgaggg

SEQ ID NO: 1020490 - RNA, 16 nt, Mycobacterium avium subsp. paratuberculosis
acgccggcgugcacag

SEQ ID NO: 1020491 - RNA, 21 nt, Mycobacterium avium subsp. paratuberculosis
acgccggcgugcacaggccgc

SEQ ID NO: 1020492 - RNA, 12 nt, Mycobacterium avium subsp. paratuberculosis
acgccggguccc

SEQ ID NO: 1020493 - RNA, 16 nt, Mycobacterium avium subsp. paratuberculosis
acgccgguggacaggu

SEQ ID NO: 1020494 - RNA, 15 nt, Mycobacterium avium subsp. paratuberculosis
acgccguccuuggcc

SEQ ID NO: 1020495 - RNA, 20 nt, Mycobacterium avium subsp. paratuberculosis
acgccgucgacgaucugcac

SEQ ID NO: 1020496 - RNA, 22 nt, Mycobacterium avium subsp. paratuberculosis
acgccgucgacgaucugcacac

SEQ ID NO: 1020497 - RNA, 23 nt, Mycobacterium avium subsp. paratuberculosis
acgccgucgugcucggcgagcac

SEQ ID NO: 1020498 - RNA, 19 nt, Mycobacterium avium subsp. paratuberculosis
acgccgugcagaacagcac

SEQ ID NO: 1020499 - RNA, 14 nt, Mycobacterium avium subsp. paratuberculosis
acgccguggaucgg

SEQ ID NO: 1020500 - RNA, 18 nt, Mycobacterium avium subsp. paratuberculosis
acgcccaacuacccgccg

SEQ ID NO: 1020501 - RNA, 17 nt, Mycobacterium avium subsp. paratuberculosis
acgaucagcagaugcgu

SEQ ID NO: 1020502 - RNA, 13 nt, Mycobacterium avium subsp. paratuberculosis
acgaucagcagcc

SEQ ID NO: 1020503 - RNA, 16 nt, Mycobacterium avium subsp. paratuberculosis
acgaucaccaccaccg

SEQ ID NO: 1020504 - RNA, 18 nt, Mycobacterium avium subsp. paratuberculosis
acgccccauugccgcgcc

SEQ ID NO: 1020505 - RNA, 14 nt, Mycobacterium avium subsp. paratuberculosis
acgcccagcaccga

SEQ ID NO: 1020506 - RNA, 13 nt, Mycobacterium avium subsp. paratuberculosis
acgcccuccuggc

SEQ ID NO: 1020507 - RNA, 22 nt, Mycobacterium avium subsp. paratuberculosis
acgcccguagcggugggcgcgu

SEQ ID NO: 1020508 - RNA, 22 nt, Mycobacterium avium subsp. paratuberculosis
acgcccggcgaguggaagucag

SEQ ID NO: 1020509 - RNA, 17 nt, Mycobacterium avium subsp. paratuberculosis
acgccgaucaccggcac

SEQ ID NO: 1020510 - RNA, 19 nt, Mycobacterium avium subsp. paratuberculosis
acgccgagcagcaccggca

SEQ ID NO: 1020511 - RNA, 20 nt, Mycobacterium avium subsp. paratuberculosis
acgccgcacgcgaccgcguc

SEQ ID NO: 1020512 - RNA, 18 nt, Mycobacterium avium subsp. paratuberculosis
acgccgacaccagcgcgc

SEQ ID NO: 1020513 - RNA, 20 nt, Mycobacterium avium subsp. paratuberculosis
acgccgaccacccccagccc

SEQ ID NO: 1020514 - RNA, 18 nt, Mycobacterium avium subsp. paratuberculosis
acgccgacguaggacagc

SEQ ID NO: 1020515 - RNA, 16 nt, Mycobacterium avium subsp. paratuberculosis
acgccgaccagguccg

SEQ ID NO: 1020516 - RNA, 16 nt, Mycobacterium avium subsp. paratuberculosis
acgccgacgcccagcg

SEQ ID NO: 1020517 - RNA, 13 nt, Mycobacterium avium subsp. paratuberculosis
acgacaacagugc

SEQ ID NO: 1020518 - RNA, 16 nt, Mycobacterium avium subsp. paratuberculosis
acgacaggucgagcac

SEQ ID NO: 1020519 - RNA, 18 nt, Mycobacterium avium subsp. paratuberculosis
acgacaggucgagcacca

SEQ ID NO: 1020520 - RNA, 19 nt, Mycobacterium avium subsp. paratuberculosis
acgaccaccaggagcaccu

SEQ ID NO: 1020521 - RNA, 22 nt, Mycobacterium avium subsp. paratuberculosis
acgaauacccuccgggcggcac

SEQ ID NO: 1020522 - RNA, 23 nt, Mycobacterium avium subsp. paratuberculosis
acgaauacccuucggccggcagc

SEQ ID NO: 1020523 - RNA, 23 nt, Mycobacterium avium subsp. paratuberculosis
acgaaucgucgccguccaacagg

SEQ ID NO: 1020524 - RNA, 18 nt, Mycobacterium avium subsp. paratuberculosis
acgaccagguccaccccg

SEQ ID NO: 1020525 - RNA, 21 nt, Mycobacterium avium subsp. paratuberculosis
acgaccugguugacaccaccg

SEQ ID NO: 1020526 - RNA, 22 nt, Mycobacterium avium subsp. paratuberculosis
acgaccggguccgaggugaucg

SEQ ID NO: 1020527 - RNA, 18 nt, Mycobacterium avium subsp. paratuberculosis
acgaccuugucgcgcacc

SEQ ID NO: 1020528 - RNA, 20 nt, Mycobacterium avium subsp. paratuberculosis
acgaccgcgacggcgcccgc

SEQ ID NO: 1020529 - RNA, 17 nt, Mycobacterium avium subsp. paratuberculosis
acgacggucuucccgcc

SEQ ID NO: 1020530 - RNA, 17 nt, Mycobacterium avium subsp. paratuberculosis
acgacgggcagggugac

SEQ ID NO: 1020531 - RNA, 18 nt, Mycobacterium avium subsp. paratuberculosis
acgacguuggccagcacc

SEQ ID NO: 1020532 - RNA, 24 nt, Mycobacterium avium subsp. paratuberculosis
acgacgcggucugcggugcgccca

SEQ ID NO: 1020533 - RNA, 15 nt, Mycobacterium avium subsp. paratuberculosis
acgagcccgcgccca

SEQ ID NO: 1020534 - RNA, 20 nt, Mycobacterium avium subsp. paratuberculosis
acgagaucgguuggcucgca

SEQ ID NO: 1020535 - RNA, 23 nt, Mycobacterium avium subsp. paratuberculosis
acgagcacccagaaacaccaucg

SEQ ID NO: 1020536 - RNA, 20 nt, Mycobacterium avium subsp. paratuberculosis
acgagcagcaagagcaggcu

SEQ ID NO: 1020537 - RNA, 13 nt, Mycobacterium avium subsp. paratuberculosis
acgacucuuccag

SEQ ID NO: 1020538 - RNA, 21 nt, Mycobacterium avium subsp. paratuberculosis
accuuggccggugcgccgacc

SEQ ID NO: 1020539 - RNA, 23 nt, Mycobacterium avium subsp. paratuberculosis
accuugucgaaggugaucuuguu

SEQ ID NO: 1020540 - RNA, 14 nt, Mycobacterium avium subsp. paratuberculosis
accuugucggcguc

SEQ ID NO: 1020541 - RNA, 12 nt, Mycobacterium avium subsp. paratuberculosis
accuuggcggcc

SEQ ID NO: 1020542 - RNA, 22 nt, Mycobacterium avium subsp. paratuberculosis
accuucucgaccaggcucacgc

SEQ ID NO: 1020543 - RNA, 13 nt, Mycobacterium avium subsp. paratuberculosis
accuucuuggccg

SEQ ID NO: 1020544 - RNA, 15 nt, Mycobacterium avium subsp. paratuberculosis
accuugaccagcuug

SEQ ID NO: 1020545 - RNA, 12 nt, Mycobacterium avium subsp. paratuberculosis
accuucaucgcc

SEQ ID NO: 1020546 - RNA, 22 nt, Mycobacterium avium subsp. paratuberculosis
accuucaucgccgucgccaccg

SEQ ID NO: 1020547 - RNA, 22 nt, Mycobacterium avium subsp. paratuberculosis
accuggccggccaucuucaguu

SEQ ID NO: 1020548 - RNA, 14 nt, Mycobacterium avium subsp. paratuberculosis
accuggccggccuc

SEQ ID NO: 1020549 - RNA, 23 nt, Mycobacterium avium subsp. paratuberculosis
accugguugccgcccucggccgu

SEQ ID NO: 1020550 - RNA, 20 nt, Mycobacterium avium subsp. paratuberculosis
accuguacgugucccugcgg

SEQ ID NO: 1020551 - RNA, 23 nt, Mycobacterium avium subsp. paratuberculosis
accuguacgugucccugcggcug

SEQ ID NO: 1020552 - RNA, 13 nt, Mycobacterium avium subsp. paratuberculosis
accuccaaugcgc

SEQ ID NO: 1020553 - RNA, 17 nt, Mycobacterium avium subsp. paratuberculosis
accuccaaugcgcccug

SEQ ID NO: 1020554 - RNA, 17 nt, Mycobacterium avium subsp. paratuberculosis
accuccagauagaggaa

SEQ ID NO: 1020555 - RNA, 17 nt, Mycobacterium avium subsp. paratuberculosis
accugcagcgccuuggg

SEQ ID NO: 1020556 - RNA, 19 nt, Mycobacterium avium subsp. paratuberculosis
accugcaccugggugaucu

SEQ ID NO: 1020557 - RNA, 19 nt, Mycobacterium avium subsp. paratuberculosis
accugccgcacaccgucuc

SEQ ID NO: 1020558 - RNA, 22 nt, Mycobacterium avium subsp. paratuberculosis
accugcggcggcagucgcagca

SEQ ID NO: 1020559 - RNA, 14 nt, Mycobacterium avium subsp. paratuberculosis
accugcgugccuug

SEQ ID NO: 1020560 - RNA, 12 nt, Mycobacterium avium subsp. paratuberculosis
accuggccacca

SEQ ID NO: 1020561 - RNA, 17 nt, Mycobacterium avium subsp. paratuberculosis
accuggccaccagcagc

SEQ ID NO: 1020562 - RNA, 18 nt, Mycobacterium avium subsp. paratuberculosis
accuggccaccagcagca

SEQ ID NO: 1020563 - RNA, 17 nt, Mycobacterium avium subsp. paratuberculosis
accugcuugagcccguc

SEQ ID NO: 1020564 - RNA, 19 nt, Mycobacterium avium subsp. paratuberculosis
accguuggccugcgcgacc

SEQ ID NO: 1020565 - RNA, 17 nt, Mycobacterium avium subsp. paratuberculosis
accgucgauggacaggg

SEQ ID NO: 1020566 - RNA, 14 nt, Mycobacterium avium subsp. paratuberculosis
accgucgccacgau

SEQ ID NO: 1020567 - RNA, 16 nt, Mycobacterium avium subsp. paratuberculosis
accgucggcaguugca

SEQ ID NO: 1020568 - RNA, 23 nt, Mycobacterium avium subsp. paratuberculosis
accgucggcccgccaaaacgggg

SEQ ID NO: 1020569 - RNA, 23 nt, Mycobacterium avium subsp. paratuberculosis
accgucgggaauggggcccgguc

SEQ ID NO: 1020570 - RNA, 16 nt, Mycobacterium avium subsp. paratuberculosis
accgucgggacggcca

SEQ ID NO: 1020571 - RNA, 21 nt, Mycobacterium avium subsp. paratuberculosis
accgucgggacggccagcagg

SEQ ID NO: 1020572 - RNA, 15 nt, Mycobacterium avium subsp. paratuberculosis
accguccgcgcccac

SEQ ID NO: 1020573 - RNA, 20 nt, Mycobacterium avium subsp. paratuberculosis
accguccuuguaggugaucg

SEQ ID NO: 1020574 - RNA, 21 nt, Mycobacterium avium subsp. paratuberculosis
accgucuucuucagccgcagc

SEQ ID NO: 1020575 - RNA, 19 nt, Mycobacterium avium subsp. paratuberculosis
accgucuuggucucgccga

SEQ ID NO: 1020576 - RNA, 16 nt, Mycobacterium avium subsp. paratuberculosis
accgugaggcccggcg

SEQ ID NO: 1020577 - RNA, 19 nt, Mycobacterium avium subsp. paratuberculosis
accgucgccggcugacugc

SEQ ID NO: 1020578 - RNA, 15 nt, Mycobacterium avium subsp. paratuberculosis
accguugaggcgagc

SEQ ID NO: 1020579 - RNA, 15 nt, Mycobacterium avium subsp. paratuberculosis
accguugaccaccag

SEQ ID NO: 1020580 - RNA, 22 nt, Mycobacterium avium subsp. paratuberculosis
accguucccaccggcuucuccu

SEQ ID NO: 1020581 - RNA, 21 nt, Mycobacterium avium subsp. paratuberculosis
accguggaggacgaggcccgc

SEQ ID NO: 1020582 - RNA, 18 nt, Mycobacterium avium subsp. paratuberculosis
accguggccccagccacc

SEQ ID NO: 1020583 - RNA, 23 nt, Mycobacterium avium subsp. paratuberculosis
accgugcuguacgacaacagugc

SEQ ID NO: 1020584 - RNA, 17 nt, Mycobacterium avium subsp. paratuberculosis
accgugccgucggcguc

SEQ ID NO: 1020585 - RNA, 13 nt, Mycobacterium avium subsp. paratuberculosis
accgugccucgcc

SEQ ID NO: 1020586 - RNA, 16 nt, Mycobacterium avium subsp. paratuberculosis
accguggugucggaga

SEQ ID NO: 1020587 - RNA, 23 nt, Mycobacterium avium subsp. paratuberculosis
accguguuugcugcaugcgcugc

SEQ ID NO: 1020588 - RNA, 22 nt, Mycobacterium avium subsp. paratuberculosis
accguagccggucggcccgcuc

SEQ ID NO: 1020589 - RNA, 23 nt, Mycobacterium avium subsp. paratuberculosis
accgguccagaaguaacccaccg

SEQ ID NO: 1020590 - RNA, 15 nt, Mycobacterium avium subsp. paratuberculosis
accggucgacgacga

SEQ ID NO: 1020591 - RNA, 21 nt, Mycobacterium avium subsp. paratuberculosis
accgggaucguguggccgccc

SEQ ID NO: 1020592 - RNA, 22 nt, Mycobacterium avium subsp. paratuberculosis
accgggaucguguggccgcccu

SEQ ID NO: 1020593 - RNA, 18 nt, Mycobacterium avium subsp. paratuberculosis
accgggauggugaccagc

SEQ ID NO: 1020594 - RNA, 13 nt, Mycobacterium avium subsp. paratuberculosis
accgggcacccgg

SEQ ID NO: 1020595 - RNA, 16 nt, Mycobacterium avium subsp. paratuberculosis
accgggcacccggcgc

SEQ ID NO: 1020596 - RNA, 20 nt, Mycobacterium avium subsp. paratuberculosis
accgggugcguccagaccgg

SEQ ID NO: 1020597 - RNA, 17 nt, Mycobacterium avium subsp. paratuberculosis
accgggacagccgcgcc

SEQ ID NO: 1020598 - RNA, 16 nt, Mycobacterium avium subsp. paratuberculosis
accgggaccgucggga

SEQ ID NO: 1020599 - RNA, 14 nt, Mycobacterium avium subsp. paratuberculosis
accgggaccugcug

SEQ ID NO: 1020600 - RNA, 16 nt, Mycobacterium avium subsp. paratuberculosis
accgggacgacggcgc

SEQ ID NO: 1020601 - RNA, 21 nt, Mycobacterium avium subsp. paratuberculosis
accgggacgacggcgccgccc

SEQ ID NO: 1020602 - RNA, 15 nt, Mycobacterium avium subsp. paratuberculosis
accggcuuggccacg

SEQ ID NO: 1020603 - RNA, 14 nt, Mycobacterium avium subsp. paratuberculosis
accggcuucuccuc

SEQ ID NO: 1020604 - RNA, 21 nt, Mycobacterium avium subsp. paratuberculosis
accggcaucgguggcaccccg

SEQ ID NO: 1020605 - RNA, 17 nt, Mycobacterium avium subsp. paratuberculosis
accggcagcaccgccga

SEQ ID NO: 1020606 - RNA, 16 nt, Mycobacterium avium subsp. paratuberculosis
accggcagccgcagcg

SEQ ID NO: 1020607 - RNA, 14 nt, Mycobacterium avium subsp. paratuberculosis
accgcugaccagga

SEQ ID NO: 1020608 - RNA, 22 nt, Mycobacterium avium subsp. paratuberculosis
accgcugucggugugagcggug

SEQ ID NO: 1020609 - RNA, 14 nt, Mycobacterium avium subsp. paratuberculosis
accgcuguggacag

SEQ ID NO: 1020610 - RNA, 14 nt, Mycobacterium avium subsp. paratuberculosis
accgcuugcgacug

SEQ ID NO: 1020611 - RNA, 12 nt, Mycobacterium avium subsp. paratuberculosis
accgcuuggccc

SEQ ID NO: 1020612 - RNA, 12 nt, Mycobacterium avium subsp. paratuberculosis
accggcaccgcg

SEQ ID NO: 1020613 - RNA, 15 nt, Mycobacterium avium subsp. paratuberculosis
accggaaggccaggu

SEQ ID NO: 1020614 - RNA, 18 nt, Mycobacterium avium subsp. paratuberculosis
accgcguccugcaggcag

SEQ ID NO: 1020615 - RNA, 20 nt, Mycobacterium avium subsp. paratuberculosis
accgcguccugcaggcaggc

SEQ ID NO: 1020616 - RNA, 20 nt, Mycobacterium avium subsp. paratuberculosis
accgcguagcgccgcccguc

SEQ ID NO: 1020617 - RNA, 13 nt, Mycobacterium avium subsp. paratuberculosis
accgcgucggccc

SEQ ID NO: 1020618 - RNA, 18 nt, Mycobacterium avium subsp. paratuberculosis
accgauuucggccagccg

SEQ ID NO: 1020619 - RNA, 19 nt, Mycobacterium avium subsp. paratuberculosis
accgauuucggccagccgg

SEQ ID NO: 1020620 - RNA, 13 nt, Mycobacterium avium subsp. paratuberculosis
accgcguuggcgc

SEQ ID NO: 1020621 - RNA, 21 nt, Mycobacterium avium subsp. paratuberculosis
accgcgugugcccgccucgca

SEQ ID NO: 1020622 - RNA, 13 nt, Mycobacterium avium subsp. paratuberculosis
acccaggccaccc

SEQ ID NO: 1020623 - RNA, 11 nt, Mycobacterium avium subsp. paratuberculosis
acccagcaccc

SEQ ID NO: 1020624 - RNA, 14 nt, Mycobacterium avium subsp. paratuberculosis
acccagcaccacca

SEQ ID NO: 1020625 - RNA, 15 nt, Mycobacterium avium subsp. paratuberculosis
acccagcaccaccac

SEQ ID NO: 1020626 - RNA, 14 nt, Mycobacterium avium subsp. paratuberculosis
acccagccgcugaa

SEQ ID NO: 1020627 - RNA, 22 nt, Mycobacterium avium subsp. paratuberculosis
acccagacuugggcagcaggug

SEQ ID NO: 1020628 - RNA, 16 nt, Mycobacterium avium subsp. paratuberculosis
acccagccgcauucgg

SEQ ID NO: 1020629 - RNA, 16 nt, Mycobacterium avium subsp. paratuberculosis
acccacucccagccgc

SEQ ID NO: 1020630 - RNA, 13 nt, Mycobacterium avium subsp. paratuberculosis
acccacggccaca

SEQ ID NO: 1020631 - RNA, 15 nt, Mycobacterium avium subsp. paratuberculosis
acccacggccacaac

SEQ ID NO: 1020632 - RNA, 16 nt, Mycobacterium avium subsp. paratuberculosis
acccagaaacaccauc

SEQ ID NO: 1020633 - RNA, 16 nt, Mycobacterium avium subsp. paratuberculosis
accccgaagcucauca

SEQ ID NO: 1020634 - RNA, 22 nt, Mycobacterium avium subsp. paratuberculosis
accccgaucgcgaucaccgcgg

SEQ ID NO: 1020635 - RNA, 16 nt, Mycobacterium avium subsp. paratuberculosis
accccgaaccgcccgc

SEQ ID NO: 1020636 - RNA, 18 nt, Mycobacterium avium subsp. paratuberculosis
accccgaaccgcccgccc

SEQ ID NO: 1020637 - RNA, 23 nt, Mycobacterium avium subsp. paratuberculosis
accccgaaccgcccgcccggcac

SEQ ID NO: 1020638 - RNA, 19 nt, Mycobacterium avium subsp. paratuberculosis
acccccucggggcucacca

SEQ ID NO: 1020639 - RNA, 17 nt, Mycobacterium avium subsp. paratuberculosis
accccgacggagacgac

SEQ ID NO: 1020640 - RNA, 19 nt, Mycobacterium avium subsp. paratuberculosis
accccccuuggcggcaagc

SEQ ID NO: 1020641 - RNA, 14 nt, Mycobacterium avium subsp. paratuberculosis
acccgcagcucgcc

SEQ ID NO: 1020642 - RNA, 18 nt, Mycobacterium avium subsp. paratuberculosis
acccgcaccaccgcccgg

SEQ ID NO: 1020643 - RNA, 13 nt, Mycobacterium avium subsp. paratuberculosis
acccgcaacgcgc

SEQ ID NO: 1020644 - RNA, 22 nt, Mycobacterium avium subsp. paratuberculosis
acccgaccucgucgacggcggc

SEQ ID NO: 1020645 - RNA, 19 nt, Mycobacterium avium subsp. paratuberculosis
acccgaccuuuugcccggc

SEQ ID NO: 1020646 - RNA, 14 nt, Mycobacterium avium subsp. paratuberculosis
acccgagagcugcu

SEQ ID NO: 1020647 - RNA, 13 nt, Mycobacterium avium subsp. paratuberculosis
accccucagccgg

SEQ ID NO: 1020648 - RNA, 21 nt, Mycobacterium avium subsp. paratuberculosis
accccguucgccgacagcagc

SEQ ID NO: 1020649 - RNA, 14 nt, Mycobacterium avium subsp. paratuberculosis
accccgggcggcuc

SEQ ID NO: 1020650 - RNA, 20 nt, Mycobacterium avium subsp. paratuberculosis
accccgucgcggacccuggc

SEQ ID NO: 1020651 - RNA, 22 nt, Mycobacterium avium subsp. paratuberculosis
accgagucgucgcgcaccagcu

SEQ ID NO: 1020652 - RNA, 15 nt, Mycobacterium avium subsp. paratuberculosis
accgaggccagcaga

SEQ ID NO: 1020653 - RNA, 17 nt, Mycobacterium avium subsp. paratuberculosis
accgacuucauggcgaa

SEQ ID NO: 1020654 - RNA, 13 nt, Mycobacterium avium subsp. paratuberculosis
accgacgcccggc

SEQ ID NO: 1020655 - RNA, 14 nt, Mycobacterium avium subsp. paratuberculosis
accgacuccuccgg

SEQ ID NO: 1020656 - RNA, 14 nt, Mycobacterium avium subsp. paratuberculosis
accgacuccuuggg

SEQ ID NO: 1020657 - RNA, 21 nt, Mycobacterium avium subsp. paratuberculosis
accgacgcggucaccggcucg

SEQ ID NO: 1020658 - RNA, 19 nt, Mycobacterium avium subsp. paratuberculosis
accgacaggucgaagggca

SEQ ID NO: 1020659 - RNA, 19 nt, Mycobacterium avium subsp. paratuberculosis
accgaccccucggcggccg

SEQ ID NO: 1020660 - RNA, 13 nt, Mycobacterium avium subsp. paratuberculosis
accgaccggcucu

SEQ ID NO: 1020661 - RNA, 22 nt, Mycobacterium avium subsp. paratuberculosis
accgaaaccuugaucggccccu

SEQ ID NO: 1020662 - RNA, 14 nt, Mycobacterium avium subsp. paratuberculosis
accgaaacggcagg

SEQ ID NO: 1020663 - RNA, 16 nt, Mycobacterium avium subsp. paratuberculosis
accgaacgccagcagc

SEQ ID NO: 1020664 - RNA, 13 nt, Mycobacterium avium subsp. paratuberculosis
accgacaccaccg

SEQ ID NO: 1020665 - RNA, 14 nt, Mycobacterium avium subsp. paratuberculosis
acccuucagccaga

SEQ ID NO: 1020666 - RNA, 16 nt, Mycobacterium avium subsp. paratuberculosis
acccuucaucagcacc

SEQ ID NO: 1020667 - RNA, 15 nt, Mycobacterium avium subsp. paratuberculosis
acccuggccagcacc

SEQ ID NO: 1020668 - RNA, 20 nt, Mycobacterium avium subsp. paratuberculosis
acccugcguccggcccggcg

SEQ ID NO: 1020669 - RNA, 21 nt, Mycobacterium avium subsp. paratuberculosis
acccugcguccggcccggcgu

SEQ ID NO: 1020670 - RNA, 12 nt, Mycobacterium avium subsp. paratuberculosis
acccucagcagg

SEQ ID NO: 1020671 - RNA, 14 nt, Mycobacterium avium subsp. paratuberculosis
acccgguugagcac

SEQ ID NO: 1020672 - RNA, 19 nt, Mycobacterium avium subsp. paratuberculosis
acccggugccggccggguc

SEQ ID NO: 1020673 - RNA, 13 nt, Mycobacterium avium subsp. paratuberculosis
acccggucgguga

SEQ ID NO: 1020674 - RNA, 23 nt, Mycobacterium avium subsp. paratuberculosis
acccggucugaucgcccagcacc

SEQ ID NO: 1020675 - RNA, 23 nt, Mycobacterium avium subsp. paratuberculosis
acccgccccgacagcaacgccag

SEQ ID NO: 1020676 - RNA, 19 nt, Mycobacterium avium subsp. paratuberculosis
acccgccccgccgcggcca

SEQ ID NO: 1020677 - RNA, 22 nt, Mycobacterium avium subsp. paratuberculosis
acccgccccgccgcggccaggu

SEQ ID NO: 1020678 - RNA, 12 nt, Mycobacterium avium subsp. paratuberculosis
acccgccagccc

SEQ ID NO: 1020679 - RNA, 19 nt, Mycobacterium avium subsp. paratuberculosis
acccgcaucaacugcacca

SEQ ID NO: 1020680 - RNA, 20 nt, Mycobacterium avium subsp. paratuberculosis
acccgcaucaacugcaccag

SEQ ID NO: 1020681 - RNA, 19 nt, Mycobacterium avium subsp. paratuberculosis
acccgguagcgcagcacca

SEQ ID NO: 1020682 - RNA, 13 nt, Mycobacterium avium subsp. paratuberculosis
acccgggugcccg

SEQ ID NO: 1020683 - RNA, 15 nt, Mycobacterium avium subsp. paratuberculosis
acccgggugcccggc

SEQ ID NO: 1020684 - RNA, 20 nt, Mycobacterium avium subsp. paratuberculosis
acccgccgcggcaacgccag

SEQ ID NO: 1020685 - RNA, 19 nt, Mycobacterium avium subsp. paratuberculosis
acccgcccgccgggcaccc

SEQ ID NO: 1020686 - RNA, 12 nt, Mycobacterium avium subsp. paratuberculosis
acccgccgcaac

SEQ ID NO: 1020687 - RNA, 18 nt, Mycobacterium avium subsp. paratuberculosis
accaguuccugcaugccg

SEQ ID NO: 1020688 - RNA, 16 nt, Mycobacterium avium subsp. paratuberculosis
accaguugcaccggca

SEQ ID NO: 1020689 - RNA, 18 nt, Mycobacterium avium subsp. paratuberculosis
accaguaggccagcaucu

SEQ ID NO: 1020690 - RNA, 17 nt, Mycobacterium avium subsp. paratuberculosis
accaguaggucacccgg

SEQ ID NO: 1020691 - RNA, 15 nt, Mycobacterium avium subsp. paratuberculosis
accaggaugcccagg

SEQ ID NO: 1020692 - RNA, 13 nt, Mycobacterium avium subsp. paratuberculosis
accaggcccagcg

SEQ ID NO: 1020693 - RNA, 23 nt, Mycobacterium avium subsp. paratuberculosis
accaggaugucuccgcgcagcca

SEQ ID NO: 1020694 - RNA, 18 nt, Mycobacterium avium subsp. paratuberculosis
accaggaaggucccgguc

SEQ ID NO: 1020695 - RNA, 16 nt, Mycobacterium avium subsp. paratuberculosis
accaggaccagguugg

SEQ ID NO: 1020696 - RNA, 17 nt, Mycobacterium avium subsp. paratuberculosis
accagcgugucgccggg

SEQ ID NO: 1020697 - RNA, 18 nt, Mycobacterium avium subsp. paratuberculosis
accagcgugucgccgggg

SEQ ID NO: 1020698 - RNA, 15 nt, Mycobacterium avium subsp. paratuberculosis
accagcucgaugccg

SEQ ID NO: 1020699 - RNA, 19 nt, Mycobacterium avium subsp. paratuberculosis
accagcucgaugccguucg

SEQ ID NO: 1020700 - RNA, 23 nt, Mycobacterium avium subsp. paratuberculosis
accagcuggauggcgcccagccc

SEQ ID NO: 1020701 - RNA, 15 nt, Mycobacterium avium subsp. paratuberculosis
accagcugucccagu

SEQ ID NO: 1020702 - RNA, 20 nt, Mycobacterium avium subsp. paratuberculosis
accaggucguugccggugcc

SEQ ID NO: 1020703 - RNA, 17 nt, Mycobacterium avium subsp. paratuberculosis
accaggucgcggcgcug

SEQ ID NO: 1020704 - RNA, 21 nt, Mycobacterium avium subsp. paratuberculosis
accaggucggccuucagcguc

SEQ ID NO: 1020705 - RNA, 19 nt, Mycobacterium avium subsp. paratuberculosis
accaggucgagggucgaga

SEQ ID NO: 1020706 - RNA, 17 nt, Mycobacterium avium subsp. paratuberculosis
accagguagguggccgu

SEQ ID NO: 1020707 - RNA, 15 nt, Mycobacterium avium subsp. paratuberculosis
accaggggcagcuga

SEQ ID NO: 1020708 - RNA, 17 nt, Mycobacterium avium subsp. paratuberculosis
accaggcgcaccagcug

SEQ ID NO: 1020709 - RNA, 18 nt, Mycobacterium avium subsp. paratuberculosis
accaggcgccacagcagc

SEQ ID NO: 1020710 - RNA, 15 nt, Mycobacterium avium subsp. paratuberculosis
accaggcuuggcccg

SEQ ID NO: 1020711 - RNA, 22 nt, Mycobacterium avium subsp. paratuberculosis
accaggcugaacgucgucagca

SEQ ID NO: 1020712 - RNA, 20 nt, Mycobacterium avium subsp. paratuberculosis
accaggcgugcacccgguuc

SEQ ID NO: 1020713 - RNA, 19 nt, Mycobacterium avium subsp. paratuberculosis
accaggguggccccagccc

SEQ ID NO: 1020714 - RNA, 17 nt, Mycobacterium avium subsp. paratuberculosis
accaggguggccgccac

SEQ ID NO: 1020715 - RNA, 16 nt, Mycobacterium avium subsp. paratuberculosis
accagggcgaccgccg

SEQ ID NO: 1020716 - RNA, 22 nt, Mycobacterium avium subsp. paratuberculosis
accagggcgaucaccgcggcca

SEQ ID NO: 1020717 - RNA, 18 nt, Mycobacterium avium subsp. paratuberculosis
accaggguggucagcguc

SEQ ID NO: 1020718 - RNA, 19 nt, Mycobacterium avium subsp. paratuberculosis
accagguaccggcgggcga

SEQ ID NO: 1020719 - RNA, 19 nt, Mycobacterium avium subsp. paratuberculosis
accagguagauggugaucg

SEQ ID NO: 1020720 - RNA, 19 nt, Mycobacterium avium subsp. paratuberculosis
accagguaggcgaccaugc

SEQ ID NO: 1020721 - RNA, 12 nt, Mycobacterium avium subsp. paratuberculosis
accaacugcaga

SEQ ID NO: 1020722 - RNA, 16 nt, Mycobacterium avium subsp. paratuberculosis
accaaccacagcugcu

SEQ ID NO: 1020723 - RNA, 19 nt, Mycobacterium avium subsp. paratuberculosis
accagaaucuucgccuccg

SEQ ID NO: 1020724 - RNA, 15 nt, Mycobacterium avium subsp. paratuberculosis
accagaucgucgggc

SEQ ID NO: 1020725 - RNA, 19 nt, Mycobacterium avium subsp. paratuberculosis
accagaucgucgggcaccu

SEQ ID NO: 1020726 - RNA, 19 nt, Mycobacterium avium subsp. paratuberculosis
accagauucaccagcgccu

SEQ ID NO: 1020727 - RNA, 15 nt, Mycobacterium avium subsp. paratuberculosis
accagauugcggcac

SEQ ID NO: 1020728 - RNA, 19 nt, Mycobacterium avium subsp. paratuberculosis
accagcaacaccagggugc

SEQ ID NO: 1020729 - RNA, 12 nt, Mycobacterium avium subsp. paratuberculosis
accagcacccgg

SEQ ID NO: 1020730 - RNA, 14 nt, Mycobacterium avium subsp. paratuberculosis
accagcaccgcggc

SEQ ID NO: 1020731 - RNA, 22 nt, Mycobacterium avium subsp. paratuberculosis
accagcaccgcggcguagcgcc

SEQ ID NO: 1020732 - RNA, 12 nt, Mycobacterium avium subsp. paratuberculosis
accagcaccggc

SEQ ID NO: 1020733 - RNA, 14 nt, Mycobacterium avium subsp. paratuberculosis
accagcaccggcac

SEQ ID NO: 1020734 - RNA, 17 nt, Mycobacterium avium subsp. paratuberculosis
accagcacggcggcgcu

SEQ ID NO: 1020735 - RNA, 10 nt, Mycobacterium avium subsp. paratuberculosis
accagcagcc

SEQ ID NO: 1020736 - RNA, 16 nt, Mycobacterium avium subsp. paratuberculosis
accagcagccgcagcg

SEQ ID NO: 1020737 - RNA, 15 nt, Mycobacterium avium subsp. paratuberculosis
accagccgcaggugc

SEQ ID NO: 1020738 - RNA, 23 nt, Mycobacterium avium subsp. paratuberculosis
accagccgcaggugcucgccggc

SEQ ID NO: 1020739 - RNA, 15 nt, Mycobacterium avium subsp. paratuberculosis
accagccccaggagg

SEQ ID NO: 1020740 - RNA, 18 nt, Mycobacterium avium subsp. paratuberculosis
accagcagccagcccagc

SEQ ID NO: 1020741 - RNA, 18 nt, Mycobacterium avium subsp. paratuberculosis
accagccagaacgaacag

SEQ ID NO: 1020742 - RNA, 16 nt, Mycobacterium avium subsp. paratuberculosis
accagcccggccgagg

SEQ ID NO: 1020743 - RNA, 17 nt, Mycobacterium avium subsp. paratuberculosis
accagcgacgccagcgg

SEQ ID NO: 1020744 - RNA, 18 nt, Mycobacterium avium subsp. paratuberculosis
accagcgcccgcccggac

SEQ ID NO: 1020745 - RNA, 16 nt, Mycobacterium avium subsp. paratuberculosis
accagcggcagcagca

SEQ ID NO: 1020746 - RNA, 21 nt, Mycobacterium avium subsp. paratuberculosis
accagcgggaugaaggcaccc

SEQ ID NO: 1020747 - RNA, 19 nt, Mycobacterium avium subsp. paratuberculosis
accagcggcgcgccgggca

SEQ ID NO: 1020748 - RNA, 22 nt, Mycobacterium avium subsp. paratuberculosis
accagcgcgaacagcgcggcca

SEQ ID NO: 1020749 - RNA, 18 nt, Mycobacterium avium subsp. paratuberculosis
accagcggucggcgguuc

SEQ ID NO: 1020750 - RNA, 17 nt, Mycobacterium avium subsp. paratuberculosis
accagcgugacgcugaa

SEQ ID NO: 1020751 - RNA, 22 nt, Mycobacterium avium subsp. paratuberculosis
accagcgcgccggccagcagca

SEQ ID NO: 1020752 - RNA, 16 nt, Mycobacterium avium subsp. paratuberculosis
accagcgcguagagca

SEQ ID NO: 1020753 - RNA, 17 nt, Mycobacterium avium subsp. paratuberculosis
accagcgcguagagcau

SEQ ID NO: 1020754 - RNA, 19 nt, Mycobacterium avium subsp. paratuberculosis
aguacagcuaggccagcag

SEQ ID NO: 1020755 - RNA, 22 nt, Mycobacterium avium subsp. paratuberculosis
aguaaggccgaggcgagugagg

SEQ ID NO: 1020756 - RNA, 18 nt, Mycobacterium avium subsp. paratuberculosis
aguaccggcgaugccagc

SEQ ID NO: 1020757 - RNA, 14 nt, Mycobacterium avium subsp. paratuberculosis
agguugaccaccag

SEQ ID NO: 1020758 - RNA, 17 nt, Mycobacterium avium subsp. paratuberculosis
agguugaccaccagcgu

SEQ ID NO: 1020759 - RNA, 19 nt, Mycobacterium avium subsp. paratuberculosis
agguucuccucccagcccu

SEQ ID NO: 1020760 - RNA, 19 nt, Mycobacterium avium subsp. paratuberculosis
agguucuuggcggccugcu

SEQ ID NO: 1020761 - RNA, 15 nt, Mycobacterium avium subsp. paratuberculosis
agguucaggcccgcg

SEQ ID NO: 1020762 - RNA, 19 nt, Mycobacterium avium subsp. paratuberculosis
agguucaugugaccggggu

SEQ ID NO: 1020763 - RNA, 16 nt, Mycobacterium avium subsp. paratuberculosis
agguucauccccgcgg

SEQ ID NO: 1020764 - RNA, 17 nt, Mycobacterium avium subsp. paratuberculosis
aggucagcggcccgauc

SEQ ID NO: 1020765 - RNA, 22 nt, Mycobacterium avium subsp. paratuberculosis
aggucgaucagcgguccacccg

SEQ ID NO: 1020766 - RNA, 20 nt, Mycobacterium avium subsp. paratuberculosis
aggucgaggccggccagcgg

SEQ ID NO: 1020767 - RNA, 23 nt, Mycobacterium avium subsp. paratuberculosis
aggucgaccgcgcaccggcgcug

SEQ ID NO: 1020768 - RNA, 14 nt, Mycobacterium avium subsp. paratuberculosis
agguccgcgguggu

SEQ ID NO: 1020769 - RNA, 15 nt, Mycobacterium avium subsp. paratuberculosis
agguccuugaucggg

SEQ ID NO: 1020770 - RNA, 22 nt, Mycobacterium avium subsp. paratuberculosis
agguccuugcccagcaguuugu

SEQ ID NO: 1020771 - RNA, 14 nt, Mycobacterium avium subsp. paratuberculosis
aggucugcagcagc

SEQ ID NO: 1020772 - RNA, 22 nt, Mycobacterium avium subsp. paratuberculosis
aggugaauaccacugcgcgccc

SEQ ID NO: 1020773 - RNA, 21 nt, Mycobacterium avium subsp. paratuberculosis
aggugaagccguugucgaguu

SEQ ID NO: 1020774 - RNA, 13 nt, Mycobacterium avium subsp. paratuberculosis
aggugaacagcag

SEQ ID NO: 1020775 - RNA, 17 nt, Mycobacterium avium subsp. paratuberculosis
agguguuggugcggggu

SEQ ID NO: 1020776 - RNA, 15 nt, Mycobacterium avium subsp. paratuberculosis
aggugugcccgcccu

SEQ ID NO: 1020777 - RNA, 14 nt, Mycobacterium avium subsp. paratuberculosis
agguguccagcccu

SEQ ID NO: 1020778 - RNA, 24 nt, Mycobacterium avium subsp. paratuberculosis
agguguccucgagcugcacgggcg

SEQ ID NO: 1020779 - RNA, 15 nt, Mycobacterium avium subsp. paratuberculosis
aggugggguggugga

SEQ ID NO: 1020780 - RNA, 13 nt, Mycobacterium avium subsp. paratuberculosis
aggugggcagcgc

SEQ ID NO: 1020781 - RNA, 19 nt, Mycobacterium avium subsp. paratuberculosis
aggugggcuuagcggggug

SEQ ID NO: 1020782 - RNA, 12 nt, Mycobacterium avium subsp. paratuberculosis
aggugggcggga

SEQ ID NO: 1020783 - RNA, 20 nt, Mycobacterium avium subsp. paratuberculosis
agguggcgccuccgcccggg

SEQ ID NO: 1020784 - RNA, 16 nt, Mycobacterium avium subsp. paratuberculosis
aggugcccgagcugau

SEQ ID NO: 1020785 - RNA, 20 nt, Mycobacterium avium subsp. paratuberculosis
agggcagcgcgaccagcccg

SEQ ID NO: 1020786 - RNA, 21 nt, Mycobacterium avium subsp. paratuberculosis
agggcauccgggaggccagca

SEQ ID NO: 1020787 - RNA, 15 nt, Mycobacterium avium subsp. paratuberculosis
agggccgcggccgcc

SEQ ID NO: 1020788 - RNA, 11 nt, Mycobacterium avium subsp. paratuberculosis
agggccgggcg

SEQ ID NO: 1020789 - RNA, 13 nt, Mycobacterium avium subsp. paratuberculosis
agggccuccacca

SEQ ID NO: 1020790 - RNA, 23 nt, Mycobacterium avium subsp. paratuberculosis
agggccucgucgucgucgagcac

SEQ ID NO: 1020791 - RNA, 15 nt, Mycobacterium avium subsp. paratuberculosis
agggccucgccguug

SEQ ID NO: 1020792 - RNA, 14 nt, Mycobacterium avium subsp. paratuberculosis
agggccugcagcac

SEQ ID NO: 1020793 - RNA, 16 nt, Mycobacterium avium subsp. paratuberculosis
agggcgacggcggcga

SEQ ID NO: 1020794 - RNA, 18 nt, Mycobacterium avium subsp. paratuberculosis
agggcgaucaccgcggcc

SEQ ID NO: 1020795 - RNA, 16 nt, Mycobacterium avium subsp. paratuberculosis
aggcugugggccagca

SEQ ID NO: 1020796 - RNA, 22 nt, Mycobacterium avium subsp. paratuberculosis
agggucaagauaccggccggcg

SEQ ID NO: 1020797 - RNA, 14 nt, Mycobacterium avium subsp. paratuberculosis
agggucgccaggcc

SEQ ID NO: 1020798 - RNA, 17 nt, Mycobacterium avium subsp. paratuberculosis
agggucgccaggccacc

SEQ ID NO: 1020799 - RNA, 16 nt, Mycobacterium avium subsp. paratuberculosis
agguaaaccagcagcg

SEQ ID NO: 1020800 - RNA, 19 nt, Mycobacterium avium subsp. paratuberculosis
aggguucucgcggcggccg

SEQ ID NO: 1020801 - RNA, 13 nt, Mycobacterium avium subsp. paratuberculosis
agggugucccagc

SEQ ID NO: 1020802 - RNA, 20 nt, Mycobacterium avium subsp. paratuberculosis
aggggauccagcggcggccu

SEQ ID NO: 1020803 - RNA, 23 nt, Mycobacterium avium subsp. paratuberculosis
aggggauuuuuuggggcggggcg

SEQ ID NO: 1020804 - RNA, 15 nt, Mycobacterium avium subsp. paratuberculosis
agggggaagucgacc

SEQ ID NO: 1020805 - RNA, 17 nt, Mycobacterium avium subsp. paratuberculosis
aggggucguaccaccac

SEQ ID NO: 1020806 - RNA, 20 nt, Mycobacterium avium subsp. paratuberculosis
agggcuuuagaaggccgccu

SEQ ID NO: 1020807 - RNA, 15 nt, Mycobacterium avium subsp. paratuberculosis
agggcgccagcaccu

SEQ ID NO: 1020808 - RNA, 12 nt, Mycobacterium avium subsp. paratuberculosis
agggcgccgucg

SEQ ID NO: 1020809 - RNA, 20 nt, Mycobacterium avium subsp. paratuberculosis
agggcgcgucguagccggca

SEQ ID NO: 1020810 - RNA, 21 nt, Mycobacterium avium subsp. paratuberculosis
agggcgcucaucaggcggccg

SEQ ID NO: 1020811 - RNA, 14 nt, Mycobacterium avium subsp. paratuberculosis
aggcguacaccagg

SEQ ID NO: 1020812 - RNA, 17 nt, Mycobacterium avium subsp. paratuberculosis
aggcguagcugcaggcg

SEQ ID NO: 1020813 - RNA, 13 nt, Mycobacterium avium subsp. paratuberculosis
aggcggugguggg

SEQ ID NO: 1020814 - RNA, 17 nt, Mycobacterium avium subsp. paratuberculosis
aggcggguaggcgucgc

SEQ ID NO: 1020815 - RNA, 20 nt, Mycobacterium avium subsp. paratuberculosis
aggcggcugucgacaggauc

SEQ ID NO: 1020816 - RNA, 17 nt, Mycobacterium avium subsp. paratuberculosis
aggcggcgggggcgggc

SEQ ID NO: 1020817 - RNA, 22 nt, Mycobacterium avium subsp. paratuberculosis
aggcggcgguauucgucacccc

SEQ ID NO: 1020818 - RNA, 16 nt, Mycobacterium avium subsp. paratuberculosis
aggcggccggcccggc

SEQ ID NO: 1020819 - RNA, 22 nt, Mycobacterium avium subsp. paratuberculosis
aggcggccgggaucuggccggu

SEQ ID NO: 1020820 - RNA, 19 nt, Mycobacterium avium subsp. paratuberculosis
aggcggccagcgcccgcgg

SEQ ID NO: 1020821 - RNA, 12 nt, Mycobacterium avium subsp. paratuberculosis
aggcggccagca

SEQ ID NO: 1020822 - RNA, 18 nt, Mycobacterium avium subsp. paratuberculosis
aggcggccagggcggcgc

SEQ ID NO: 1020823 - RNA, 13 nt, Mycobacterium avium subsp. paratuberculosis
aggccggcgacga

SEQ ID NO: 1020824 - RNA, 22 nt, Mycobacterium avium subsp. paratuberculosis
aggccggcgagcucgcggccgu

SEQ ID NO: 1020825 - RNA, 18 nt, Mycobacterium avium subsp. paratuberculosis
aggccggccgcagcugcu

SEQ ID NO: 1020826 - RNA, 15 nt, Mycobacterium avium subsp. paratuberculosis
aggccggccaccagg

SEQ ID NO: 1020827 - RNA, 12 nt, Mycobacterium avium subsp. paratuberculosis
aggccggccacc

SEQ ID NO: 1020828 - RNA, 13 nt, Mycobacterium avium subsp. paratuberculosis
aggccggccacca

SEQ ID NO: 1020829 - RNA, 15 nt, Mycobacterium avium subsp. paratuberculosis
aggcgugccgcuggg

SEQ ID NO: 1020830 - RNA, 18 nt, Mycobacterium avium subsp. paratuberculosis
aggcgugccgcugggagc

SEQ ID NO: 1020831 - RNA, 15 nt, Mycobacterium avium subsp. paratuberculosis
aggcgucgucggccc

SEQ ID NO: 1020832 - RNA, 20 nt, Mycobacterium avium subsp. paratuberculosis
aggcgucgucggcccagucc

SEQ ID NO: 1020833 - RNA, 18 nt, Mycobacterium avium subsp. paratuberculosis
aggcgucgcgcagcagcg

SEQ ID NO: 1020834 - RNA, 12 nt, Mycobacterium avium subsp. paratuberculosis
aggcgucagggg

SEQ ID NO: 1020835 - RNA, 13 nt, Mycobacterium avium subsp. paratuberculosis
aggcguccuccuc

SEQ ID NO: 1020836 - RNA, 14 nt, Mycobacterium avium subsp. paratuberculosis
aggcguccuccucg

SEQ ID NO: 1020837 - RNA, 21 nt, Mycobacterium avium subsp. paratuberculosis
aggcgucgaacgggccgggca

SEQ ID NO: 1020838 - RNA, 19 nt, Mycobacterium avium subsp. paratuberculosis
aggcguuguugaggaacgc

SEQ ID NO: 1020839 - RNA, 15 nt, Mycobacterium avium subsp. paratuberculosis
aggcguugcaccgcg

SEQ ID NO: 1020840 - RNA, 21 nt, Mycobacterium avium subsp. paratuberculosis
aggcguuggacuccaccgcca

SEQ ID NO: 1020841 - RNA, 23 nt, Mycobacterium avium subsp. paratuberculosis
aggcguuggacuccaccgccacc

SEQ ID NO: 1020842 - RNA, 17 nt, Mycobacterium avium subsp. paratuberculosis
aggcguuggagccgacc

SEQ ID NO: 1020843 - RNA, 16 nt, Mycobacterium avium subsp. paratuberculosis
aggcguuucguguggu

SEQ ID NO: 1020844 - RNA, 19 nt, Mycobacterium avium subsp. paratuberculosis
aggcugaaucccuccggca

SEQ ID NO: 1020845 - RNA, 16 nt, Mycobacterium avium subsp. paratuberculosis
aggcugaccagcgccu

SEQ ID NO: 1020846 - RNA, 19 nt, Mycobacterium avium subsp. paratuberculosis
aggcuccgccgauguacuc

SEQ ID NO: 1020847 - RNA, 13 nt, Mycobacterium avium subsp. paratuberculosis
aggcucagcagca

SEQ ID NO: 1020848 - RNA, 19 nt, Mycobacterium avium subsp. paratuberculosis
aggcuggucuggugggugu

SEQ ID NO: 1020849 - RNA, 18 nt, Mycobacterium avium subsp. paratuberculosis
aggcuggcggcgaucacc

SEQ ID NO: 1020850 - RNA, 17 nt, Mycobacterium avium subsp. paratuberculosis
aggcugccgcugcgccg

SEQ ID NO: 1020851 - RNA, 22 nt, Mycobacterium avium subsp. paratuberculosis
aggcugcccucuuccucgcugu

SEQ ID NO: 1020852 - RNA, 17 nt, Mycobacterium avium subsp. paratuberculosis
aggcugaucucggcggu

SEQ ID NO: 1020853 - RNA, 16 nt, Mycobacterium avium subsp. paratuberculosis
aggcugaucuggaugc

SEQ ID NO: 1020854 - RNA, 20 nt, Mycobacterium avium subsp. paratuberculosis
aggaugguggugcaggcgaa

SEQ ID NO: 1020855 - RNA, 22 nt, Mycobacterium avium subsp. paratuberculosis
aggaugucguccucggucaggc

SEQ ID NO: 1020856 - RNA, 16 nt, Mycobacterium avium subsp. paratuberculosis
aggaugccgcccacca

SEQ ID NO: 1020857 - RNA, 19 nt, Mycobacterium avium subsp. paratuberculosis
aggaugccgcccaccaccg

SEQ ID NO: 1020858 - RNA, 11 nt, Mycobacterium avium subsp. paratuberculosis
aggaugaccgc

SEQ ID NO: 1020859 - RNA, 16 nt, Mycobacterium avium subsp. paratuberculosis
aggcagcgcgacuggg

SEQ ID NO: 1020860 - RNA, 13 nt, Mycobacterium avium subsp. paratuberculosis
aggcagcgcacga

SEQ ID NO: 1020861 - RNA, 23 nt, Mycobacterium avium subsp. paratuberculosis
aggcagcccggcugcgcagcgca

SEQ ID NO: 1020862 - RNA, 20 nt, Mycobacterium avium subsp. paratuberculosis
aggcaggcacugaucccucc

SEQ ID NO: 1020863 - RNA, 11 nt, Mycobacterium avium subsp. paratuberculosis
aggcagcagca

SEQ ID NO: 1020864 - RNA, 12 nt, Mycobacterium avium subsp. paratuberculosis
aggcagcagcca

SEQ ID NO: 1020865 - RNA, 20 nt, Mycobacterium avium subsp. paratuberculosis
aggccagcugcaccggggcc

SEQ ID NO: 1020866 - RNA, 21 nt, Mycobacterium avium subsp. paratuberculosis
aggccagcugcaccggggccg

SEQ ID NO: 1020867 - RNA, 13 nt, Mycobacterium avium subsp. paratuberculosis
aggcauccugcug

SEQ ID NO: 1020868 - RNA, 16 nt, Mycobacterium avium subsp. paratuberculosis
aggcauccugcuggcc

SEQ ID NO: 1020869 - RNA, 21 nt, Mycobacterium avium subsp. paratuberculosis
aggcauccugcuggccgggcu

SEQ ID NO: 1020870 - RNA, 21 nt, Mycobacterium avium subsp. paratuberculosis
aggccagcccggcgugcagga

SEQ ID NO: 1020871 - RNA, 21 nt, Mycobacterium avium subsp. paratuberculosis
aggccaucagcccggcguccu

SEQ ID NO: 1020872 - RNA, 22 nt, Mycobacterium avium subsp. paratuberculosis
aggccaugaucgaaaggacggg

SEQ ID NO: 1020873 - RNA, 19 nt, Mycobacterium avium subsp. paratuberculosis
aggccaggugcagcugcau

SEQ ID NO: 1020874 - RNA, 22 nt, Mycobacterium avium subsp. paratuberculosis
aggcccgguagauauggcccuc

SEQ ID NO: 1020875 - RNA, 18 nt, Mycobacterium avium subsp. paratuberculosis
aggcccggacggccaccu

SEQ ID NO: 1020876 - RNA, 17 nt, Mycobacterium avium subsp. paratuberculosis
aggcccuugccccacca

SEQ ID NO: 1020877 - RNA, 20 nt, Mycobacterium avium subsp. paratuberculosis
aggcccuugccccaccaccg

SEQ ID NO: 1020878 - RNA, 13 nt, Mycobacterium avium subsp. paratuberculosis
aggcccugccagc

SEQ ID NO: 1020879 - RNA, 18 nt, Mycobacterium avium subsp. paratuberculosis
aggccgccgacgacggcg

SEQ ID NO: 1020880 - RNA, 10 nt, Mycobacterium avium subsp. paratuberculosis
aggccgccgc

SEQ ID NO: 1020881 - RNA, 16 nt, Mycobacterium avium subsp. paratuberculosis
aggccgaacagcagcg

SEQ ID NO: 1020882 - RNA, 18 nt, Mycobacterium avium subsp. paratuberculosis
aggccgaaccgcagccgg

SEQ ID NO: 1020883 - RNA, 22 nt, Mycobacterium avium subsp. paratuberculosis
aggccgccugcccgggcgccga

SEQ ID NO: 1020884 - RNA, 13 nt, Mycobacterium avium subsp. paratuberculosis
aggccgcgagcac

SEQ ID NO: 1020885 - RNA, 14 nt, Mycobacterium avium subsp. paratuberculosis
aggccgcgagcccg

SEQ ID NO: 1020886 - RNA, 23 nt, Mycobacterium avium subsp. paratuberculosis
aggccgcgaggauuucgcucagc

SEQ ID NO: 1020887 - RNA, 22 nt, Mycobacterium avium subsp. paratuberculosis
aggccgcgggcguucaucaccu

SEQ ID NO: 1020888 - RNA, 15 nt, Mycobacterium avium subsp. paratuberculosis
aggccgcggguggcg

SEQ ID NO: 1020889 - RNA, 20 nt, Mycobacterium avium subsp. paratuberculosis
aggccgcguaggccuugcug

SEQ ID NO: 1020890 - RNA, 12 nt, Mycobacterium avium subsp. paratuberculosis
aggccgcgcuga

SEQ ID NO: 1020891 - RNA, 18 nt, Mycobacterium avium subsp. paratuberculosis
aggccgcgcuggcgcagg

SEQ ID NO: 1020892 - RNA, 19 nt, Mycobacterium avium subsp. paratuberculosis
aggccgcgcuggcgcaggc

SEQ ID NO: 1020893 - RNA, 12 nt, Mycobacterium avium subsp. paratuberculosis
aggccgcgccga

SEQ ID NO: 1020894 - RNA, 16 nt, Mycobacterium avium subsp. paratuberculosis
aggccgcugacaagcg

SEQ ID NO: 1020895 - RNA, 20 nt, Mycobacterium avium subsp. paratuberculosis
aggccgcggcgacacccagc

SEQ ID NO: 1020896 - RNA, 13 nt, Mycobacterium avium subsp. paratuberculosis
aggaucagcagcc

SEQ ID NO: 1020897 - RNA, 12 nt, Mycobacterium avium subsp. paratuberculosis
aggaucacgcgg

SEQ ID NO: 1020898 - RNA, 20 nt, Mycobacterium avium subsp. paratuberculosis
aggaucucgcgggcccgcgc

SEQ ID NO: 1020899 - RNA, 18 nt, Mycobacterium avium subsp. paratuberculosis
aggauccgcucgacgagu

SEQ ID NO: 1020900 - RNA, 15 nt, Mycobacterium avium subsp. paratuberculosis
aggaucgcaggaugg

SEQ ID NO: 1020901 - RNA, 14 nt, Mycobacterium avium subsp. paratuberculosis
aggaucgcggccac

SEQ ID NO: 1020902 - RNA, 21 nt, Mycobacterium avium subsp. paratuberculosis
aggaucgcggccacgcccugg

SEQ ID NO: 1020903 - RNA, 19 nt, Mycobacterium avium subsp. paratuberculosis
aggaucgcggugaccgccg

SEQ ID NO: 1020904 - RNA, 18 nt, Mycobacterium avium subsp. paratuberculosis
aggaucugggcggcggga

SEQ ID NO: 1020905 - RNA, 18 nt, Mycobacterium avium subsp. paratuberculosis
aggaucuugucggcggcc

SEQ ID NO: 1020906 - RNA, 22 nt, Mycobacterium avium subsp. paratuberculosis
aggaucuuugcauacagcaggc

SEQ ID NO: 1020907 - RNA, 13 nt, Mycobacterium avium subsp. paratuberculosis
aggaugaacaccc

SEQ ID NO: 1020908 - RNA, 17 nt, Mycobacterium avium subsp. paratuberculosis
aggaugaacacccgggu

SEQ ID NO: 1020909 - RNA, 14 nt, Mycobacterium avium subsp. paratuberculosis
aggaugaaccggga

SEQ ID NO: 1020910 - RNA, 15 nt, Mycobacterium avium subsp. paratuberculosis
aggagguuuugcgug

SEQ ID NO: 1020911 - RNA, 15 nt, Mycobacterium avium subsp. paratuberculosis
aggaggggcgcggca

SEQ ID NO: 1020912 - RNA, 18 nt, Mycobacterium avium subsp. paratuberculosis
aggaggguuuucggggcg

SEQ ID NO: 1020913 - RNA, 15 nt, Mycobacterium avium subsp. paratuberculosis
aggacgugcucugcc

SEQ ID NO: 1020914 - RNA, 16 nt, Mycobacterium avium subsp. paratuberculosis
aggaggccagcugcac

SEQ ID NO: 1020915 - RNA, 16 nt, Mycobacterium avium subsp. paratuberculosis
aggaccgggacgacgg

SEQ ID NO: 1020916 - RNA, 19 nt, Mycobacterium avium subsp. paratuberculosis
aggacgguuucugccggcc

SEQ ID NO: 1020917 - RNA, 22 nt, Mycobacterium avium subsp. paratuberculosis
aggacgguuucugccggccgcc

SEQ ID NO: 1020918 - RNA, 13 nt, Mycobacterium avium subsp. paratuberculosis
aggacgcccggcg

SEQ ID NO: 1020919 - RNA, 14 nt, Mycobacterium avium subsp. paratuberculosis
aggacgcccggcga

SEQ ID NO: 1020920 - RNA, 16 nt, Mycobacterium avium subsp. paratuberculosis
aggacgcccggcgagu

SEQ ID NO: 1020921 - RNA, 22 nt, Mycobacterium avium subsp. paratuberculosis
agcuuggcaaggagguggucga

SEQ ID NO: 1020922 - RNA, 14 nt, Mycobacterium avium subsp. paratuberculosis
agcuucuugcugcc

SEQ ID NO: 1020923 - RNA, 15 nt, Mycobacterium avium subsp. paratuberculosis
agcuucuugcugccg

SEQ ID NO: 1020924 - RNA, 12 nt, Mycobacterium avium subsp. paratuberculosis
agcuucacgcuc

SEQ ID NO: 1020925 - RNA, 19 nt, Mycobacterium avium subsp. paratuberculosis
agcuucacguucggcgagu

SEQ ID NO: 1020926 - RNA, 15 nt, Mycobacterium avium subsp. paratuberculosis
agcugcaccggggcc

SEQ ID NO: 1020927 - RNA, 20 nt, Mycobacterium avium subsp. paratuberculosis
agcugauucgggaucagccg

SEQ ID NO: 1020928 - RNA, 17 nt, Mycobacterium avium subsp. paratuberculosis
agcugauagcccgccgc

SEQ ID NO: 1020929 - RNA, 17 nt, Mycobacterium avium subsp. paratuberculosis
agcugaucgcggccggc

SEQ ID NO: 1020930 - RNA, 22 nt, Mycobacterium avium subsp. paratuberculosis
agcugaucgcgucgacggcgcc

SEQ ID NO: 1020931 - RNA, 13 nt, Mycobacterium avium subsp. paratuberculosis
agcugaucggcgu

SEQ ID NO: 1020932 - RNA, 14 nt, Mycobacterium avium subsp. paratuberculosis
agcugcgucggcac

SEQ ID NO: 1020933 - RNA, 17 nt, Mycobacterium avium subsp. paratuberculosis
agcuggagaggcccggc

SEQ ID NO: 1020934 - RNA, 19 nt, Mycobacterium avium subsp. paratuberculosis
agcuggagaggcccggcag

SEQ ID NO: 1020935 - RNA, 21 nt, Mycobacterium avium subsp. paratuberculosis
agcugcgcgccccggcccggc

SEQ ID NO: 1020936 - RNA, 23 nt, Mycobacterium avium subsp. paratuberculosis
agcugcgcgccccggcccggcga

SEQ ID NO: 1020937 - RNA, 18 nt, Mycobacterium avium subsp. paratuberculosis
agcugcgcgccggcggcc

SEQ ID NO: 1020938 - RNA, 19 nt, Mycobacterium avium subsp. paratuberculosis
agcugcgcgccggcggccg

SEQ ID NO: 1020939 - RNA, 19 nt, Mycobacterium avium subsp. paratuberculosis
agcugcagccggccggcgg

SEQ ID NO: 1020940 - RNA, 23 nt, Mycobacterium avium subsp. paratuberculosis
agcugcagcgacugcacccgggu

SEQ ID NO: 1020941 - RNA, 23 nt, Mycobacterium avium subsp. paratuberculosis
agcuguuggccagcuugcagcug

SEQ ID NO: 1020942 - RNA, 12 nt, Mycobacterium avium subsp. paratuberculosis
agcugggccggc

SEQ ID NO: 1020943 - RNA, 15 nt, Mycobacterium avium subsp. paratuberculosis
agcugggccggcgcc

SEQ ID NO: 1020944 - RNA, 14 nt, Mycobacterium avium subsp. paratuberculosis
agcugggcguacug

SEQ ID NO: 1020945 - RNA, 14 nt, Mycobacterium avium subsp. paratuberculosis
agcuggauggcgcc

SEQ ID NO: 1020946 - RNA, 21 nt, Mycobacterium avium subsp. paratuberculosis
agcuggauggcgcccagcccg

SEQ ID NO: 1020947 - RNA, 20 nt, Mycobacterium avium subsp. paratuberculosis
agcuggcgaauccgggccuc

SEQ ID NO: 1020948 - RNA, 16 nt, Mycobacterium avium subsp. paratuberculosis
agcuggccgugcaccg

SEQ ID NO: 1020949 - RNA, 24 nt, Mycobacterium avium subsp. paratuberculosis
agcuggcgccgaacagaugccugc

SEQ ID NO: 1020950 - RNA, 18 nt, Mycobacterium avium subsp. paratuberculosis
agcugaacacgaacccgg

SEQ ID NO: 1020951 - RNA, 19 nt, Mycobacterium avium subsp. paratuberculosis
agcugacgaacgcgccgcc

SEQ ID NO: 1020952 - RNA, 18 nt, Mycobacterium avium subsp. paratuberculosis
agcucgucgacguccucg

SEQ ID NO: 1020953 - RNA, 13 nt, Mycobacterium avium subsp. paratuberculosis
agcucgucgagcc

SEQ ID NO: 1020954 - RNA, 21 nt, Mycobacterium avium subsp. paratuberculosis
agcucgugaugguccagcacc

SEQ ID NO: 1020955 - RNA, 20 nt, Mycobacterium avium subsp. paratuberculosis
agcucgugcagcuguuccug

SEQ ID NO: 1020956 - RNA, 21 nt, Mycobacterium avium subsp. paratuberculosis
agcucgucagcgcgggccagc

SEQ ID NO: 1020957 - RNA, 20 nt, Mycobacterium avium subsp. paratuberculosis
agcucgucggguguggcgcc

SEQ ID NO: 1020958 - RNA, 19 nt, Mycobacterium avium subsp. paratuberculosis
agcucggugaucugcacca

SEQ ID NO: 1020959 - RNA, 15 nt, Mycobacterium avium subsp. paratuberculosis
agcucggucaccagc

SEQ ID NO: 1020960 - RNA, 16 nt, Mycobacterium avium subsp. paratuberculosis
agcucggcgggcuccc

SEQ ID NO: 1020961 - RNA, 12 nt, Mycobacterium avium subsp. paratuberculosis
agcucgggcagc

SEQ ID NO: 1020962 - RNA, 18 nt, Mycobacterium avium subsp. paratuberculosis
agcucggccggggcgacc

SEQ ID NO: 1020963 - RNA, 14 nt, Mycobacterium avium subsp. paratuberculosis
agcucggcggccuc

SEQ ID NO: 1020964 - RNA, 18 nt, Mycobacterium avium subsp. paratuberculosis
agcgucgccagccgccgg

SEQ ID NO: 1020965 - RNA, 24 nt, Mycobacterium avium subsp. paratuberculosis
agcgucaccaaugcgccggcggcc

SEQ ID NO: 1020966 - RNA, 20 nt, Mycobacterium avium subsp. paratuberculosis
agcgucacgccgcgcccguc

SEQ ID NO: 1020967 - RNA, 21 nt, Mycobacterium avium subsp. paratuberculosis
agcgucacgcuagcgugacag

SEQ ID NO: 1020968 - RNA, 13 nt, Mycobacterium avium subsp. paratuberculosis
agcgucacgcugg

SEQ ID NO: 1020969 - RNA, 14 nt, Mycobacterium avium subsp. paratuberculosis
agcgucgggggcgu

SEQ ID NO: 1020970 - RNA, 13 nt, Mycobacterium avium subsp. paratuberculosis
agcucccgagcau

SEQ ID NO: 1020971 - RNA, 15 nt, Mycobacterium avium subsp. paratuberculosis
agcgucuggcagccg

SEQ ID NO: 1020972 - RNA, 18 nt, Mycobacterium avium subsp. paratuberculosis
agcuccucggccagcacc

SEQ ID NO: 1020973 - RNA, 16 nt, Mycobacterium avium subsp. paratuberculosis
agcuccgccacccugc

SEQ ID NO: 1020974 - RNA, 18 nt, Mycobacterium avium subsp. paratuberculosis
agcucgaaggugaccauc

SEQ ID NO: 1020975 - RNA, 22 nt, Mycobacterium avium subsp. paratuberculosis
agcuccuugagccgccgcggca

SEQ ID NO: 1020976 - RNA, 12 nt, Mycobacterium avium subsp. paratuberculosis
agcucgaucacc

SEQ ID NO: 1020977 - RNA, 13 nt, Mycobacterium avium subsp. paratuberculosis
agcucgaucaccc

SEQ ID NO: 1020978 - RNA, 19 nt, Mycobacterium avium subsp. paratuberculosis
agcucgaucgccgcgccca

SEQ ID NO: 1020979 - RNA, 21 nt, Mycobacterium avium subsp. paratuberculosis
agcucgcguucgggcccggcc

SEQ ID NO: 1020980 - RNA, 13 nt, Mycobacterium avium subsp. paratuberculosis
agcucggccaucc

SEQ ID NO: 1020981 - RNA, 12 nt, Mycobacterium avium subsp. paratuberculosis
agcucgcggcgc

SEQ ID NO: 1020982 - RNA, 15 nt, Mycobacterium avium subsp. paratuberculosis
agcucgcgcccggcc

SEQ ID NO: 1020983 - RNA, 20 nt, Mycobacterium avium subsp. paratuberculosis
agcucgccgauguggcgggc

SEQ ID NO: 1020984 - RNA, 22 nt, Mycobacterium avium subsp. paratuberculosis
agcucgccgauguggcgggcgu

SEQ ID NO: 1020985 - RNA, 17 nt, Mycobacterium avium subsp. paratuberculosis
agcucgccgcggccacg

SEQ ID NO: 1020986 - RNA, 22 nt, Mycobacterium avium subsp. paratuberculosis
agcucgaugccguucgcgccgu

SEQ ID NO: 1020987 - RNA, 19 nt, Mycobacterium avium subsp. paratuberculosis
auaagcggauugaccagca

SEQ ID NO: 1020988 - RNA, 22 nt, Mycobacterium avium subsp. paratuberculosis
aguugggucacaucgcguuagc

SEQ ID NO: 1020989 - RNA, 14 nt, Mycobacterium avium subsp. paratuberculosis
aguuggugcugggc

SEQ ID NO: 1020990 - RNA, 15 nt, Mycobacterium avium subsp. paratuberculosis
aguuggugcugggca

SEQ ID NO: 1020991 - RNA, 13 nt, Mycobacterium avium subsp. paratuberculosis
aguuggggccggc

SEQ ID NO: 1020992 - RNA, 16 nt, Mycobacterium avium subsp. paratuberculosis
aguuggggccggccgc

SEQ ID NO: 1020993 - RNA, 14 nt, Mycobacterium avium subsp. paratuberculosis
aguugggggccagc

SEQ ID NO: 1020994 - RNA, 13 nt, Mycobacterium avium subsp. paratuberculosis
aguuggccuccca

SEQ ID NO: 1020995 - RNA, 23 nt, Mycobacterium avium subsp. paratuberculosis
aguuggcggcggugaucgccgga

SEQ ID NO: 1020996 - RNA, 21 nt, Mycobacterium avium subsp. paratuberculosis
aguuggccggcuucucggcgu

SEQ ID NO: 1020997 - RNA, 17 nt, Mycobacterium avium subsp. paratuberculosis
aguucccggccagcgca

SEQ ID NO: 1020998 - RNA, 16 nt, Mycobacterium avium subsp. paratuberculosis
aguucagcagccggca

SEQ ID NO: 1020999 - RNA, 20 nt, Mycobacterium avium subsp. paratuberculosis
aguugaagacgcgaaagcag

SEQ ID NO: 1021000 - RNA, 19 nt, Mycobacterium avium subsp. paratuberculosis
aguugacuccucugccaga

SEQ ID NO: 1021001 - RNA, 18 nt, Mycobacterium avium subsp. paratuberculosis
aguucgaccuccacccgc

SEQ ID NO: 1021002 - RNA, 16 nt, Mycobacterium avium subsp. paratuberculosis
aguucgaucagcagcu

SEQ ID NO: 1021003 - RNA, 18 nt, Mycobacterium avium subsp. paratuberculosis
aguucgccgccgccagca

SEQ ID NO: 1021004 - RNA, 22 nt, Mycobacterium avium subsp. paratuberculosis
aguucgcaccccaccgacagcc

SEQ ID NO: 1021005 - RNA, 13 nt, Mycobacterium avium subsp. paratuberculosis
aguucgccaccac

SEQ ID NO: 1021006 - RNA, 17 nt, Mycobacterium avium subsp. paratuberculosis
aguucgccagcaugcga

SEQ ID NO: 1021007 - RNA, 15 nt, Mycobacterium avium subsp. paratuberculosis
aguggcgugcggccu

SEQ ID NO: 1021008 - RNA, 15 nt, Mycobacterium avium subsp. paratuberculosis
agugaggacgaggcg

SEQ ID NO: 1021009 - RNA, 17 nt, Mycobacterium avium subsp. paratuberculosis
agugcgucuuuucccac

SEQ ID NO: 1021010 - RNA, 19 nt, Mycobacterium avium subsp. paratuberculosis
agugcgugaccugcugggc

SEQ ID NO: 1021011 - RNA, 19 nt, Mycobacterium avium subsp. paratuberculosis
agugcucaugugauuacuc

SEQ ID NO: 1021012 - RNA, 16 nt, Mycobacterium avium subsp. paratuberculosis
agugcucgauggccag

SEQ ID NO: 1021013 - RNA, 16 nt, Mycobacterium avium subsp. paratuberculosis
agucguucagcugcag

SEQ ID NO: 1021014 - RNA, 23 nt, Mycobacterium avium subsp. paratuberculosis
agucguucagcugcagccggccg

SEQ ID NO: 1021015 - RNA, 13 nt, Mycobacterium avium subsp. paratuberculosis
agucgcagcagca

SEQ ID NO: 1021016 - RNA, 13 nt, Mycobacterium avium subsp. paratuberculosis
agucgccggccuc

SEQ ID NO: 1021017 - RNA, 18 nt, Mycobacterium avium subsp. paratuberculosis
agucgucgaucucgguga

SEQ ID NO: 1021018 - RNA, 23 nt, Mycobacterium avium subsp. paratuberculosis
agucccaguuguuuccccagccc

SEQ ID NO: 1021019 - RNA, 22 nt, Mycobacterium avium subsp. paratuberculosis
aguccccgccuucgaugcccuc

SEQ ID NO: 1021020 - RNA, 19 nt, Mycobacterium avium subsp. paratuberculosis
aguccccgggugggugcuc

SEQ ID NO: 1021021 - RNA, 21 nt, Mycobacterium avium subsp. paratuberculosis
aguccccgggugggugcucac

SEQ ID NO: 1021022 - RNA, 15 nt, Mycobacterium avium subsp. paratuberculosis
agucccggcgcacca

SEQ ID NO: 1021023 - RNA, 17 nt, Mycobacterium avium subsp. paratuberculosis
agucccggcgcaccagg

SEQ ID NO: 1021024 - RNA, 16 nt, Mycobacterium avium subsp. paratuberculosis
aguccuuguggcccag

SEQ ID NO: 1021025 - RNA, 18 nt, Mycobacterium avium subsp. paratuberculosis
aguccuuguggcccaggc

SEQ ID NO: 1021026 - RNA, 19 nt, Mycobacterium avium subsp. paratuberculosis
aguccugguaccccagcaa

SEQ ID NO: 1021027 - RNA, 17 nt, Mycobacterium avium subsp. paratuberculosis
agucuuaucuaucuucg

SEQ ID NO: 1021028 - RNA, 20 nt, Mycobacterium avium subsp. paratuberculosis
agugacgccugcggcccagc

SEQ ID NO: 1021029 - RNA, 23 nt, Mycobacterium avium subsp. paratuberculosis
agugacgccgcucggccagcgca

SEQ ID NO: 1021030 - RNA, 13 nt, Mycobacterium avium subsp. paratuberculosis
aguccagcccaaa

SEQ ID NO: 1021031 - RNA, 15 nt, Mycobacterium avium subsp. paratuberculosis
agucccagcacagcc

SEQ ID NO: 1021032 - RNA, 19 nt, Mycobacterium avium subsp. paratuberculosis
agucccagcacagccgucg

SEQ ID NO: 1021033 - RNA, 16 nt, Mycobacterium avium subsp. paratuberculosis
aguccagggugguggu

SEQ ID NO: 1021034 - RNA, 22 nt, Mycobacterium avium subsp. paratuberculosis
agucauucugaauucggccacc

SEQ ID NO: 1021035 - RNA, 19 nt, Mycobacterium avium subsp. paratuberculosis
agucaccggcucgcggggu

SEQ ID NO: 1021036 - RNA, 14 nt, Mycobacterium avium subsp. paratuberculosis
agucacccggcccc

SEQ ID NO: 1021037 - RNA, 13 nt, Mycobacterium avium subsp. paratuberculosis
agucacccggcug

SEQ ID NO: 1021038 - RNA, 14 nt, Mycobacterium avium subsp. paratuberculosis
aguacucggucacc

SEQ ID NO: 1021039 - RNA, 14 nt, Mycobacterium avium subsp. paratuberculosis
auaggcguacacca

SEQ ID NO: 1021040 - RNA, 13 nt, Mycobacterium avium subsp. paratuberculosis
auaggccagcacc

SEQ ID NO: 1021041 - RNA, 22 nt, Mycobacterium avium subsp. paratuberculosis
auagcgggagccggccagguug

SEQ ID NO: 1021042 - RNA, 22 nt, Mycobacterium avium subsp. paratuberculosis
auaggagacagccgagauggca

SEQ ID NO: 1021043 - RNA, 20 nt, Mycobacterium avium subsp. paratuberculosis
auagccgacgggauccggau

SEQ ID NO: 1021044 - RNA, 13 nt, Mycobacterium avium subsp. paratuberculosis
auagcccagccag

SEQ ID NO: 1021045 - RNA, 16 nt, Mycobacterium avium subsp. paratuberculosis
auacccgaccagcacc

SEQ ID NO: 1021046 - RNA, 22 nt, Mycobacterium avium subsp. paratuberculosis
auaccacugcgcgcccgagcau

SEQ ID NO: 1021047 - RNA, 21 nt, Mycobacterium avium subsp. paratuberculosis
aucacguugauccgaugcagg

SEQ ID NO: 1021048 - RNA, 19 nt, Mycobacterium avium subsp. paratuberculosis
aucaccgagauggccacca

SEQ ID NO: 1021049 - RNA, 16 nt, Mycobacterium avium subsp. paratuberculosis
aucacccacggccaca

SEQ ID NO: 1021050 - RNA, 16 nt, Mycobacterium avium subsp. paratuberculosis
aucaccgacagcgcgu

SEQ ID NO: 1021051 - RNA, 23 nt, Mycobacterium avium subsp. paratuberculosis
aucaccacgcuguagggccacca

SEQ ID NO: 1021052 - RNA, 22 nt, Mycobacterium avium subsp. paratuberculosis
aucaguauggagaaaauccaga

SEQ ID NO: 1021053 - RNA, 20 nt, Mycobacterium avium subsp. paratuberculosis
aucagggcguugaucacgau

SEQ ID NO: 1021054 - RNA, 19 nt, Mycobacterium avium subsp. paratuberculosis
aucagggcccacagcagcc

SEQ ID NO: 1021055 - RNA, 23 nt, Mycobacterium avium subsp. paratuberculosis
aucagggcccacagcagccgcac

SEQ ID NO: 1021056 - RNA, 19 nt, Mycobacterium avium subsp. paratuberculosis
aucagguugaccagguggg

SEQ ID NO: 1021057 - RNA, 17 nt, Mycobacterium avium subsp. paratuberculosis
aucagcaccgggugaua

SEQ ID NO: 1021058 - RNA, 18 nt, Mycobacterium avium subsp. paratuberculosis
aucagcaccgggugauac

SEQ ID NO: 1021059 - RNA, 18 nt, Mycobacterium avium subsp. paratuberculosis
aucagcaccguccacagc

SEQ ID NO: 1021060 - RNA, 14 nt, Mycobacterium avium subsp. paratuberculosis
aucagcagugcccc

SEQ ID NO: 1021061 - RNA, 14 nt, Mycobacterium avium subsp. paratuberculosis
aucagcaggaccag

SEQ ID NO: 1021062 - RNA, 18 nt, Mycobacterium avium subsp. paratuberculosis
aucagcaccgccacgccg

SEQ ID NO: 1021063 - RNA, 14 nt, Mycobacterium avium subsp. paratuberculosis
aucagcaccgcgaa

SEQ ID NO: 1021064 - RNA, 15 nt, Mycobacterium avium subsp. paratuberculosis
aucaggaucugcgca

SEQ ID NO: 1021065 - RNA, 18 nt, Mycobacterium avium subsp. paratuberculosis
aucagcccgacccggcuc

SEQ ID NO: 1021066 - RNA, 16 nt, Mycobacterium avium subsp. paratuberculosis
aucagcccggcccgca

SEQ ID NO: 1021067 - RNA, 15 nt, Mycobacterium avium subsp. paratuberculosis
aucagccugcgguga

SEQ ID NO: 1021068 - RNA, 18 nt, Mycobacterium avium subsp. paratuberculosis
aucagcgagacgaccagg

SEQ ID NO: 1021069 - RNA, 21 nt, Mycobacterium avium subsp. paratuberculosis
aucagcggcgggcccagcaga

SEQ ID NO: 1021070 - RNA, 19 nt, Mycobacterium avium subsp. paratuberculosis
aucagcggggcguccagcg

SEQ ID NO: 1021071 - RNA, 15 nt, Mycobacterium avium subsp. paratuberculosis
aucaaaucccgcagc

SEQ ID NO: 1021072 - RNA, 20 nt, Mycobacterium avium subsp. paratuberculosis
aucaacauugugcuguugga

SEQ ID NO: 1021073 - RNA, 21 nt, Mycobacterium avium subsp. paratuberculosis
augacguccaccaggguggcc

SEQ ID NO: 1021074 - RNA, 22 nt, Mycobacterium avium subsp. paratuberculosis
augacgucgcccacccggggcc

SEQ ID NO: 1021075 - RNA, 18 nt, Mycobacterium avium subsp. paratuberculosis
augacgccggacagcugg

SEQ ID NO: 1021076 - RNA, 18 nt, Mycobacterium avium subsp. paratuberculosis
augaccaggguggucagc

SEQ ID NO: 1021077 - RNA, 23 nt, Mycobacterium avium subsp. paratuberculosis
augaccaggucgccggcggccga

SEQ ID NO: 1021078 - RNA, 14 nt, Mycobacterium avium subsp. paratuberculosis
augaaaccggccag

SEQ ID NO: 1021079 - RNA, 12 nt, Mycobacterium avium subsp. paratuberculosis
aucuuggccagc

SEQ ID NO: 1021080 - RNA, 14 nt, Mycobacterium avium subsp. paratuberculosis
aucuuggccagcag

SEQ ID NO: 1021081 - RNA, 20 nt, Mycobacterium avium subsp. paratuberculosis
aucuuggccagcagcguggg

SEQ ID NO: 1021082 - RNA, 13 nt, Mycobacterium avium subsp. paratuberculosis
aucuuggucuugg

SEQ ID NO: 1021083 - RNA, 19 nt, Mycobacterium avium subsp. paratuberculosis
aucuuugcauacagcaggc

SEQ ID NO: 1021084 - RNA, 19 nt, Mycobacterium avium subsp. paratuberculosis
aucugguuccacagcugca

SEQ ID NO: 1021085 - RNA, 15 nt, Mycobacterium avium subsp. paratuberculosis
aucugguugaaccgg

SEQ ID NO: 1021086 - RNA, 20 nt, Mycobacterium avium subsp. paratuberculosis
aucugucgcgcucagugcac

SEQ ID NO: 1021087 - RNA, 23 nt, Mycobacterium avium subsp. paratuberculosis
aucuugcgccagaucccgcagcu

SEQ ID NO: 1021088 - RNA, 20 nt, Mycobacterium avium subsp. paratuberculosis
aucuugccgucggccgccga

SEQ ID NO: 1021089 - RNA, 13 nt, Mycobacterium avium subsp. paratuberculosis
aucuugaucucgc

SEQ ID NO: 1021090 - RNA, 19 nt, Mycobacterium avium subsp. paratuberculosis
aucugcacgucggcggccg

SEQ ID NO: 1021091 - RNA, 12 nt, Mycobacterium avium subsp. paratuberculosis
aucugcaccagc

SEQ ID NO: 1021092 - RNA, 14 nt, Mycobacterium avium subsp. paratuberculosis
aucugcaccagcgc

SEQ ID NO: 1021093 - RNA, 17 nt, Mycobacterium avium subsp. paratuberculosis
aucuggaacauggccuu

SEQ ID NO: 1021094 - RNA, 17 nt, Mycobacterium avium subsp. paratuberculosis
aucugcuuggucaccug

SEQ ID NO: 1021095 - RNA, 13 nt, Mycobacterium avium subsp. paratuberculosis
aucuggucggcca

SEQ ID NO: 1021096 - RNA, 15 nt, Mycobacterium avium subsp. paratuberculosis
aucuggucggccagc

SEQ ID NO: 1021097 - RNA, 15 nt, Mycobacterium avium subsp. paratuberculosis
aucugguccagcgug

SEQ ID NO: 1021098 - RNA, 17 nt, Mycobacterium avium subsp. paratuberculosis
aucugccggugccgccg

SEQ ID NO: 1021099 - RNA, 10 nt, Mycobacterium avium subsp. paratuberculosis
aucugcucgg

SEQ ID NO: 1021100 - RNA, 13 nt, Mycobacterium avium subsp. paratuberculosis
aucugcucggcgu

SEQ ID NO: 1021101 - RNA, 14 nt, Mycobacterium avium subsp. paratuberculosis
aucuccgagucggc

SEQ ID NO: 1021102 - RNA, 22 nt, Mycobacterium avium subsp. paratuberculosis
aucucggccagcgggcggcccc

SEQ ID NO: 1021103 - RNA, 16 nt, Mycobacterium avium subsp. paratuberculosis
aucuccagcagcuuca

SEQ ID NO: 1021104 - RNA, 19 nt, Mycobacterium avium subsp. paratuberculosis
aucucgugggucagcuuca

SEQ ID NO: 1021105 - RNA, 23 nt, Mycobacterium avium subsp. paratuberculosis
aucucgugguaccggcgccaggc

SEQ ID NO: 1021106 - RNA, 23 nt, Mycobacterium avium subsp. paratuberculosis
aucucguagcccaccucgagcac

SEQ ID NO: 1021107 - RNA, 21 nt, Mycobacterium avium subsp. paratuberculosis
aucucguagguggccagcacg

SEQ ID NO: 1021108 - RNA, 14 nt, Mycobacterium avium subsp. paratuberculosis
aucucgucgaugac

SEQ ID NO: 1021109 - RNA, 18 nt, Mycobacterium avium subsp. paratuberculosis
aucucgucggcggcggcc

SEQ ID NO: 1021110 - RNA, 22 nt, Mycobacterium avium subsp. paratuberculosis
aucucgucgggaaugucggcgu

SEQ ID NO: 1021111 - RNA, 23 nt, Mycobacterium avium subsp. paratuberculosis
aucucggugagcagaaccaccug

SEQ ID NO: 1021112 - RNA, 16 nt, Mycobacterium avium subsp. paratuberculosis
aucucggugagccgcu

SEQ ID NO: 1021113 - RNA, 16 nt, Mycobacterium avium subsp. paratuberculosis
aucucggugguggcca

SEQ ID NO: 1021114 - RNA, 17 nt, Mycobacterium avium subsp. paratuberculosis
aucggagguugauggcc

SEQ ID NO: 1021115 - RNA, 13 nt, Mycobacterium avium subsp. paratuberculosis
aucgcugugcgaa

SEQ ID NO: 1021116 - RNA, 17 nt, Mycobacterium avium subsp. paratuberculosis
aucgucgggcaccagca

SEQ ID NO: 1021117 - RNA, 18 nt, Mycobacterium avium subsp. paratuberculosis
aucgucgggcaccuccag

SEQ ID NO: 1021118 - RNA, 17 nt, Mycobacterium avium subsp. paratuberculosis
aucgucgaccugcucgu

SEQ ID NO: 1021119 - RNA, 22 nt, Mycobacterium avium subsp. paratuberculosis
aucguccacaccgggaaggugg

SEQ ID NO: 1021120 - RNA, 16 nt, Mycobacterium avium subsp. paratuberculosis
aucguguccagcaugu

SEQ ID NO: 1021121 - RNA, 15 nt, Mycobacterium avium subsp. paratuberculosis
aucgugucuggcccc

SEQ ID NO: 1021122 - RNA, 18 nt, Mycobacterium avium subsp. paratuberculosis
aucgucuugaccgcccgg

SEQ ID NO: 1021123 - RNA, 15 nt, Mycobacterium avium subsp. paratuberculosis
aucgugcuugagcaa

SEQ ID NO: 1021124 - RNA, 18 nt, Mycobacterium avium subsp. paratuberculosis
aucguggaauccuuccuc

SEQ ID NO: 1021125 - RNA, 19 nt, Mycobacterium avium subsp. paratuberculosis
aucguggacaggaggacaa

SEQ ID NO: 1021126 - RNA, 15 nt, Mycobacterium avium subsp. paratuberculosis
aucgcaccggcgccu

SEQ ID NO: 1021127 - RNA, 14 nt, Mycobacterium avium subsp. paratuberculosis
aucgaggccagcgc

SEQ ID NO: 1021128 - RNA, 14 nt, Mycobacterium avium subsp. paratuberculosis
aucgagcaccagca

SEQ ID NO: 1021129 - RNA, 19 nt, Mycobacterium avium subsp. paratuberculosis
aucgagaucagggcgcgca

SEQ ID NO: 1021130 - RNA, 20 nt, Mycobacterium avium subsp. paratuberculosis
aucgagccgccugcgcgccg

SEQ ID NO: 1021131 - RNA, 14 nt, Mycobacterium avium subsp. paratuberculosis
aucgagccgagcac

SEQ ID NO: 1021132 - RNA, 23 nt, Mycobacterium avium subsp. paratuberculosis
aucgcgcaccagggccugcagca

SEQ ID NO: 1021133 - RNA, 17 nt, Mycobacterium avium subsp. paratuberculosis
aucgcgggaucggccgg

SEQ ID NO: 1021134 - RNA, 18 nt, Mycobacterium avium subsp. paratuberculosis
aucgcgggaucggccggc

SEQ ID NO: 1021135 - RNA, 15 nt, Mycobacterium avium subsp. paratuberculosis
aucgcgguccaggau

SEQ ID NO: 1021136 - RNA, 21 nt, Mycobacterium avium subsp. paratuberculosis
aucgcgucggaauacagcagc

SEQ ID NO: 1021137 - RNA, 23 nt, Mycobacterium avium subsp. paratuberculosis
aucgcuggggugcccaccagcau

SEQ ID NO: 1021138 - RNA, 18 nt, Mycobacterium avium subsp. paratuberculosis
aucgcugguggugagaau

SEQ ID NO: 1021139 - RNA, 16 nt, Mycobacterium avium subsp. paratuberculosis
aucgcugccacguaca

SEQ ID NO: 1021140 - RNA, 18 nt, Mycobacterium avium subsp. paratuberculosis
aucgccggaucgccgagg

SEQ ID NO: 1021141 - RNA, 13 nt, Mycobacterium avium subsp. paratuberculosis
aucgccgcggacc

SEQ ID NO: 1021142 - RNA, 20 nt, Mycobacterium avium subsp. paratuberculosis
aucgccgcggaccccagcgu

SEQ ID NO: 1021143 - RNA, 14 nt, Mycobacterium avium subsp. paratuberculosis
aucgcccauuugcc

SEQ ID NO: 1021144 - RNA, 16 nt, Mycobacterium avium subsp. paratuberculosis
aucgcccaucaccgca

SEQ ID NO: 1021145 - RNA, 13 nt, Mycobacterium avium subsp. paratuberculosis
aucgcccagcacc

SEQ ID NO: 1021146 - RNA, 16 nt, Mycobacterium avium subsp. paratuberculosis
aucgcccagcaccgcg

SEQ ID NO: 1021147 - RNA, 17 nt, Mycobacterium avium subsp. paratuberculosis
aucgccucggccaccag

SEQ ID NO: 1021148 - RNA, 21 nt, Mycobacterium avium subsp. paratuberculosis
aucgccucggcggccgcccgg

SEQ ID NO: 1021149 - RNA, 15 nt, Mycobacterium avium subsp. paratuberculosis
aucgccucgucccuc

SEQ ID NO: 1021150 - RNA, 22 nt, Mycobacterium avium subsp. paratuberculosis
auccucagcagcuagcccagaa

SEQ ID NO: 1021151 - RNA, 14 nt, Mycobacterium avium subsp. paratuberculosis
auccucgccgagca

SEQ ID NO: 1021152 - RNA, 20 nt, Mycobacterium avium subsp. paratuberculosis
auccggucagcgccagcaug

SEQ ID NO: 1021153 - RNA, 21 nt, Mycobacterium avium subsp. paratuberculosis
auccggucagcgccagcaugc

SEQ ID NO: 1021154 - RNA, 18 nt, Mycobacterium avium subsp. paratuberculosis
auccggugccgagcgcgc

SEQ ID NO: 1021155 - RNA, 18 nt, Mycobacterium avium subsp. paratuberculosis
aucccgcagcuucugguc

SEQ ID NO: 1021156 - RNA, 21 nt, Mycobacterium avium subsp. paratuberculosis
aucccgaggaugccgcccacc

SEQ ID NO: 1021157 - RNA, 22 nt, Mycobacterium avium subsp. paratuberculosis
auccccagcggcacgaucucga

SEQ ID NO: 1021158 - RNA, 12 nt, Mycobacterium avium subsp. paratuberculosis
auccccuggccg

SEQ ID NO: 1021159 - RNA, 20 nt, Mycobacterium avium subsp. paratuberculosis
auccggcacugaaggcgcgg

SEQ ID NO: 1021160 - RNA, 13 nt, Mycobacterium avium subsp. paratuberculosis
auccggccgcugg

SEQ ID NO: 1021161 - RNA, 15 nt, Mycobacterium avium subsp. paratuberculosis
auccggggucagggc

SEQ ID NO: 1021162 - RNA, 17 nt, Mycobacterium avium subsp. paratuberculosis
auccgggcggccagccg

SEQ ID NO: 1021163 - RNA, 15 nt, Mycobacterium avium subsp. paratuberculosis
auccgguagaagacc

SEQ ID NO: 1021164 - RNA, 19 nt, Mycobacterium avium subsp. paratuberculosis
auccggcugagcagcucgc

SEQ ID NO: 1021165 - RNA, 18 nt, Mycobacterium avium subsp. paratuberculosis
auccgggaggccagcacc

SEQ ID NO: 1021166 - RNA, 17 nt, Mycobacterium avium subsp. paratuberculosis
auccgggcacgcagcgg

SEQ ID NO: 1021167 - RNA, 14 nt, Mycobacterium avium subsp. paratuberculosis
auccgggccgccgc

SEQ ID NO: 1021168 - RNA, 18 nt, Mycobacterium avium subsp. paratuberculosis
auccggcuccacagcagu

SEQ ID NO: 1021169 - RNA, 16 nt, Mycobacterium avium subsp. paratuberculosis
auccggcgggccucgc

SEQ ID NO: 1021170 - RNA, 23 nt, Mycobacterium avium subsp. paratuberculosis
auccaggaacggcacccgcagcu

SEQ ID NO: 1021171 - RNA, 11 nt, Mycobacterium avium subsp. paratuberculosis
auccacagcgu

SEQ ID NO: 1021172 - RNA, 20 nt, Mycobacterium avium subsp. paratuberculosis
auccacacaggaccagcacu

SEQ ID NO: 1021173 - RNA, 13 nt, Mycobacterium avium subsp. paratuberculosis
auccagcaccgcc

SEQ ID NO: 1021174 - RNA, 14 nt, Mycobacterium avium subsp. paratuberculosis
auccacuccagcac

SEQ ID NO: 1021175 - RNA, 15 nt, Mycobacterium avium subsp. paratuberculosis
auccacuccagcacc

SEQ ID NO: 1021176 - RNA, 16 nt, Mycobacterium avium subsp. paratuberculosis
auccacgccuccggca

SEQ ID NO: 1021177 - RNA, 22 nt, Mycobacterium avium subsp. paratuberculosis
auccacgcggugauccagagca

SEQ ID NO: 1021178 - RNA, 18 nt, Mycobacterium avium subsp. paratuberculosis
auccagacguugaucuug

SEQ ID NO: 1021179 - RNA, 13 nt, Mycobacterium avium subsp. paratuberculosis
aucaucuccaccc

SEQ ID NO: 1021180 - RNA, 17 nt, Mycobacterium avium subsp. paratuberculosis
aucaugccgcccaucac

SEQ ID NO: 1021181 - RNA, 20 nt, Mycobacterium avium subsp. paratuberculosis
caaaacgugauagcggccgc

SEQ ID NO: 1021182 - RNA, 16 nt, Mycobacterium avium subsp. paratuberculosis
caaagacgacggcucc

SEQ ID NO: 1021183 - RNA, 18 nt, Mycobacterium avium subsp. paratuberculosis
caaagccgguggcagccc

SEQ ID NO: 1021184 - RNA, 18 nt, Mycobacterium avium subsp. paratuberculosis
caaacgaaucgagccgcc

SEQ ID NO: 1021185 - RNA, 18 nt, Mycobacterium avium subsp. paratuberculosis
caaaccguugaccaccag

SEQ ID NO: 1021186 - RNA, 14 nt, Mycobacterium avium subsp. paratuberculosis
caacaccgccagca

SEQ ID NO: 1021187 - RNA, 17 nt, Mycobacterium avium subsp. paratuberculosis
caacaccgccagcaccg

SEQ ID NO: 1021188 - RNA, 18 nt, Mycobacterium avium subsp. paratuberculosis
caacaccgaaagccguac

SEQ ID NO: 1021189 - RNA, 15 nt, Mycobacterium avium subsp. paratuberculosis
caacacccagccgcu

SEQ ID NO: 1021190 - RNA, 17 nt, Mycobacterium avium subsp. paratuberculosis
caacaccagcuggaugg

SEQ ID NO: 1021191 - RNA, 17 nt, Mycobacterium avium subsp. paratuberculosis
caacagcaccagcacca

SEQ ID NO: 1021192 - RNA, 20 nt, Mycobacterium avium subsp. paratuberculosis
caacagcauuucgcgcggca

SEQ ID NO: 1021193 - RNA, 13 nt, Mycobacterium avium subsp. paratuberculosis
caacagccgcccc

SEQ ID NO: 1021194 - RNA, 17 nt, Mycobacterium avium subsp. paratuberculosis
caacagccgccccgauc

SEQ ID NO: 1021195 - RNA, 14 nt, Mycobacterium avium subsp. paratuberculosis
caacagccggcccg

SEQ ID NO: 1021196 - RNA, 20 nt, Mycobacterium avium subsp. paratuberculosis
caacagccggcccgagcccu

SEQ ID NO: 1021197 - RNA, 21 nt, Mycobacterium avium subsp. paratuberculosis
caacauccugguccggcgccc

SEQ ID NO: 1021198 - RNA, 22 nt, Mycobacterium avium subsp. paratuberculosis
caacauccgcgacgacaccacc

SEQ ID NO: 1021199 - RNA, 20 nt, Mycobacterium avium subsp. paratuberculosis
caacauggcgcagaacacca

SEQ ID NO: 1021200 - RNA, 17 nt, Mycobacterium avium subsp. paratuberculosis
caaccaggucgcggcgc

SEQ ID NO: 1021201 - RNA, 20 nt, Mycobacterium avium subsp. paratuberculosis
caaccggaauggcagcagcc

SEQ ID NO: 1021202 - RNA, 23 nt, Mycobacterium avium subsp. paratuberculosis
caaccggaauggcagcagccgga

SEQ ID NO: 1021203 - RNA, 18 nt, Mycobacterium avium subsp. paratuberculosis
caaaucccgcagcucgca

SEQ ID NO: 1021204 - RNA, 14 nt, Mycobacterium avium subsp. paratuberculosis
caacgcggccacca

SEQ ID NO: 1021205 - RNA, 17 nt, Mycobacterium avium subsp. paratuberculosis
caacgcgccgaacaacg

SEQ ID NO: 1021206 - RNA, 23 nt, Mycobacterium avium subsp. paratuberculosis
caaccgucaguucguagaucacg

SEQ ID NO: 1021207 - RNA, 19 nt, Mycobacterium avium subsp. paratuberculosis
caaccgggauaccgcgacc

SEQ ID NO: 1021208 - RNA, 21 nt, Mycobacterium avium subsp. paratuberculosis
caacggguugcgaaagcccag

SEQ ID NO: 1021209 - RNA, 14 nt, Mycobacterium avium subsp. paratuberculosis
caacgggcggcgga

SEQ ID NO: 1021210 - RNA, 19 nt, Mycobacterium avium subsp. paratuberculosis
caacgggcucagcaccaca

SEQ ID NO: 1021211 - RNA, 12 nt, Mycobacterium avium subsp. paratuberculosis
caacggcucgcc

SEQ ID NO: 1021212 - RNA, 23 nt, Mycobacterium avium subsp. paratuberculosis
caacgggccgcagccgcgcggcc

SEQ ID NO: 1021213 - RNA, 23 nt, Mycobacterium avium subsp. paratuberculosis
caacggcggucgugcggcugccc

SEQ ID NO: 1021214 - RNA, 15 nt, Mycobacterium avium subsp. paratuberculosis
caacggcagcgagua

SEQ ID NO: 1021215 - RNA, 17 nt, Mycobacterium avium subsp. paratuberculosis
caacggccaugaagccg

SEQ ID NO: 1021216 - RNA, 16 nt, Mycobacterium avium subsp. paratuberculosis
caacgcgucggcgccg

SEQ ID NO: 1021217 - RNA, 13 nt, Mycobacterium avium subsp. paratuberculosis
caacucgggugug

SEQ ID NO: 1021218 - RNA, 20 nt, Mycobacterium avium subsp. paratuberculosis
caagccgggcggcagcagcu

SEQ ID NO: 1021219 - RNA, 21 nt, Mycobacterium avium subsp. paratuberculosis
caagccgggcggcagcagcug

SEQ ID NO: 1021220 - RNA, 13 nt, Mycobacterium avium subsp. paratuberculosis
caagccggccagc

SEQ ID NO: 1021221 - RNA, 18 nt, Mycobacterium avium subsp. paratuberculosis
caagaugauugcgugccc

SEQ ID NO: 1021222 - RNA, 21 nt, Mycobacterium avium subsp. paratuberculosis
caagcgaagccgugacccgcc

SEQ ID NO: 1021223 - RNA, 19 nt, Mycobacterium avium subsp. paratuberculosis
caagcgauuaggugggcuu

SEQ ID NO: 1021224 - RNA, 17 nt, Mycobacterium avium subsp. paratuberculosis
caagcucgccaggaugu

SEQ ID NO: 1021225 - RNA, 20 nt, Mycobacterium avium subsp. paratuberculosis
caagaaguuuccccaccagg

SEQ ID NO: 1021226 - RNA, 22 nt, Mycobacterium avium subsp. paratuberculosis
caagaagggcgaauccaaggag

SEQ ID NO: 1021227 - RNA, 17 nt, Mycobacterium avium subsp. paratuberculosis
caagaagugggccauca

SEQ ID NO: 1021228 - RNA, 18 nt, Mycobacterium avium subsp. paratuberculosis
caagacaauucgcugccc

SEQ ID NO: 1021229 - RNA, 21 nt, Mycobacterium avium subsp. paratuberculosis
caagucgucggugggccgccg

SEQ ID NO: 1021230 - RNA, 22 nt, Mycobacterium avium subsp. paratuberculosis
caagucgucggugggccgccgc

SEQ ID NO: 1021231 - RNA, 16 nt, Mycobacterium avium subsp. paratuberculosis
caagucaugccgcgcu

SEQ ID NO: 1021232 - RNA, 19 nt, Mycobacterium avium subsp. paratuberculosis
cacgaauguucccuuuggu

SEQ ID NO: 1021233 - RNA, 12 nt, Mycobacterium avium subsp. paratuberculosis
cacgaacaccgg

SEQ ID NO: 1021234 - RNA, 20 nt, Mycobacterium avium subsp. paratuberculosis
cacgaacaccggcgcgacca

SEQ ID NO: 1021235 - RNA, 15 nt, Mycobacterium avium subsp. paratuberculosis
cacgaaccaggcgcc

SEQ ID NO: 1021236 - RNA, 17 nt, Mycobacterium avium subsp. paratuberculosis
cacgaaccaggcgccgg

SEQ ID NO: 1021237 - RNA, 16 nt, Mycobacterium avium subsp. paratuberculosis
cacgaacccggcggcc

SEQ ID NO: 1021238 - RNA, 21 nt, Mycobacterium avium subsp. paratuberculosis
cacgaaaccgcguggcgcaca

SEQ ID NO: 1021239 - RNA, 22 nt, Mycobacterium avium subsp. paratuberculosis
cacgaaacugaccuucucccgc

SEQ ID NO: 1021240 - RNA, 19 nt, Mycobacterium avium subsp. paratuberculosis
cacgaaauaaccgcgcggc

SEQ ID NO: 1021241 - RNA, 20 nt, Mycobacterium avium subsp. paratuberculosis
cacgacuucacaggccgccu

SEQ ID NO: 1021242 - RNA, 16 nt, Mycobacterium avium subsp. paratuberculosis
cacgagcagccgaucu

SEQ ID NO: 1021243 - RNA, 18 nt, Mycobacterium avium subsp. paratuberculosis
cacgacuccuggccgaac

SEQ ID NO: 1021244 - RNA, 23 nt, Mycobacterium avium subsp. paratuberculosis
cacgaccaggaaguacaccaccg

SEQ ID NO: 1021245 - RNA, 13 nt, Mycobacterium avium subsp. paratuberculosis
cacgaccccgccc

SEQ ID NO: 1021246 - RNA, 16 nt, Mycobacterium avium subsp. paratuberculosis
cacgaccccgcccacg

SEQ ID NO: 1021247 - RNA, 16 nt, Mycobacterium avium subsp. paratuberculosis
cacgaccacacccgca

SEQ ID NO: 1021248 - RNA, 13 nt, Mycobacterium avium subsp. paratuberculosis
cacgacaccagcg

SEQ ID NO: 1021249 - RNA, 22 nt, Mycobacterium avium subsp. paratuberculosis
cacgaugcccuuggccagcagu

SEQ ID NO: 1021250 - RNA, 23 nt, Mycobacterium avium subsp. paratuberculosis
cacgaugcccuuggccagcagug

SEQ ID NO: 1021251 - RNA, 14 nt, Mycobacterium avium subsp. paratuberculosis
cacgaugccgggca

SEQ ID NO: 1021252 - RNA, 20 nt, Mycobacterium avium subsp. paratuberculosis
cacgaucugguugaaccggu

SEQ ID NO: 1021253 - RNA, 15 nt, Mycobacterium avium subsp. paratuberculosis
cacgaucccgccgcc

SEQ ID NO: 1021254 - RNA, 17 nt, Mycobacterium avium subsp. paratuberculosis
cacgaggcugugggcca

SEQ ID NO: 1021255 - RNA, 20 nt, Mycobacterium avium subsp. paratuberculosis
cacgagcgaacacgugcagc

SEQ ID NO: 1021256 - RNA, 17 nt, Mycobacterium avium subsp. paratuberculosis
cacgaucgucgccgcca

SEQ ID NO: 1021257 - RNA, 23 nt, Mycobacterium avium subsp. paratuberculosis
cacgaucucggucgccagcaccg

SEQ ID NO: 1021258 - RNA, 20 nt, Mycobacterium avium subsp. paratuberculosis
caccugcucgaugcgcgcca

SEQ ID NO: 1021259 - RNA, 22 nt, Mycobacterium avium subsp. paratuberculosis
caccuccaguugcgaccccgcc

SEQ ID NO: 1021260 - RNA, 22 nt, Mycobacterium avium subsp. paratuberculosis
caccuccccgcggugccgcagc

SEQ ID NO: 1021261 - RNA, 19 nt, Mycobacterium avium subsp. paratuberculosis
caccuccgacagcccccgc

SEQ ID NO: 1021262 - RNA, 22 nt, Mycobacterium avium subsp. paratuberculosis
caccuccgacagcccccgcagc

SEQ ID NO: 1021263 - RNA, 22 nt, Mycobacterium avium subsp. paratuberculosis
caccuccgacaucaggcccuug

SEQ ID NO: 1021264 - RNA, 18 nt, Mycobacterium avium subsp. paratuberculosis
caccugguuggcccgcac

SEQ ID NO: 1021265 - RNA, 20 nt, Mycobacterium avium subsp. paratuberculosis
caccugguuggcccgcacca

SEQ ID NO: 1021266 - RNA, 22 nt, Mycobacterium avium subsp. paratuberculosis
caccugguuggcccgcaccacc

SEQ ID NO: 1021267 - RNA, 19 nt, Mycobacterium avium subsp. paratuberculosis
caccugcuuggucuccggc

SEQ ID NO: 1021268 - RNA, 22 nt, Mycobacterium avium subsp. paratuberculosis
caccugcuuggucuccggcccc

SEQ ID NO: 1021269 - RNA, 14 nt, Mycobacterium avium subsp. paratuberculosis
caccuggccggcca

SEQ ID NO: 1021270 - RNA, 19 nt, Mycobacterium avium subsp. paratuberculosis
caccuggcgcaccgccgcg

SEQ ID NO: 1021271 - RNA, 20 nt, Mycobacterium avium subsp. paratuberculosis
caccuggcgcaccgccgcgg

SEQ ID NO: 1021272 - RNA, 17 nt, Mycobacterium avium subsp. paratuberculosis
cacgccgacuagcgcgg

SEQ ID NO: 1021273 - RNA, 22 nt, Mycobacterium avium subsp. paratuberculosis
cacgccgacuagcgcggcggcc

SEQ ID NO: 1021274 - RNA, 20 nt, Mycobacterium avium subsp. paratuberculosis
cacgccgacgauccgcgccg

SEQ ID NO: 1021275 - RNA, 14 nt, Mycobacterium avium subsp. paratuberculosis
cacgccgagcaccu

SEQ ID NO: 1021276 - RNA, 14 nt, Mycobacterium avium subsp. paratuberculosis
cacgccgagcagca

SEQ ID NO: 1021277 - RNA, 14 nt, Mycobacterium avium subsp. paratuberculosis
cacgccgaccaccc

SEQ ID NO: 1021278 - RNA, 16 nt, Mycobacterium avium subsp. paratuberculosis
cacgccggugagcacg

SEQ ID NO: 1021279 - RNA, 14 nt, Mycobacterium avium subsp. paratuberculosis
cacgccgcccaggc

SEQ ID NO: 1021280 - RNA, 21 nt, Mycobacterium avium subsp. paratuberculosis
cacgccgauguuuugggugcu

SEQ ID NO: 1021281 - RNA, 16 nt, Mycobacterium avium subsp. paratuberculosis
cacgccguugggcgca

SEQ ID NO: 1021282 - RNA, 19 nt, Mycobacterium avium subsp. paratuberculosis
cacgccgugcagaacagca

SEQ ID NO: 1021283 - RNA, 18 nt, Mycobacterium avium subsp. paratuberculosis
cacgccgugcccggcgcc

SEQ ID NO: 1021284 - RNA, 17 nt, Mycobacterium avium subsp. paratuberculosis
cacgccguggcccgccc

SEQ ID NO: 1021285 - RNA, 19 nt, Mycobacterium avium subsp. paratuberculosis
cacgccuuccacgaccugg

SEQ ID NO: 1021286 - RNA, 18 nt, Mycobacterium avium subsp. paratuberculosis
cacgcgagacgagccgcc

SEQ ID NO: 1021287 - RNA, 13 nt, Mycobacterium avium subsp. paratuberculosis
cacgcgcucagcg

SEQ ID NO: 1021288 - RNA, 19 nt, Mycobacterium avium subsp. paratuberculosis
cacgcgcucagcgcggcca

SEQ ID NO: 1021289 - RNA, 14 nt, Mycobacterium avium subsp. paratuberculosis
cacgcggaccuugg

SEQ ID NO: 1021290 - RNA, 13 nt, Mycobacterium avium subsp. paratuberculosis
cacgcggcgcgca

SEQ ID NO: 1021291 - RNA, 12 nt, Mycobacterium avium subsp. paratuberculosis
cacgcggcggga

SEQ ID NO: 1021292 - RNA, 16 nt, Mycobacterium avium subsp. paratuberculosis
cacgcgccaaugguuu

SEQ ID NO: 1021293 - RNA, 18 nt, Mycobacterium avium subsp. paratuberculosis
cacgcgcgccccgguccc

SEQ ID NO: 1021294 - RNA, 17 nt, Mycobacterium avium subsp. paratuberculosis
cacgcucaugcccgcca

SEQ ID NO: 1021295 - RNA, 22 nt, Mycobacterium avium subsp. paratuberculosis
cacgcucaugcccgccacggcc

SEQ ID NO: 1021296 - RNA, 17 nt, Mycobacterium avium subsp. paratuberculosis
cacgcucacgcucggcc

SEQ ID NO: 1021297 - RNA, 20 nt, Mycobacterium avium subsp. paratuberculosis
cacggccucgcccagcgccg

SEQ ID NO: 1021298 - RNA, 21 nt, Mycobacterium avium subsp. paratuberculosis
cacggagcgcccggccagccg

SEQ ID NO: 1021299 - RNA, 20 nt, Mycobacterium avium subsp. paratuberculosis
cacgggucgccgaucucggc

SEQ ID NO: 1021300 - RNA, 17 nt, Mycobacterium avium subsp. paratuberculosis
cacgggcugaccgccag

SEQ ID NO: 1021301 - RNA, 18 nt, Mycobacterium avium subsp. paratuberculosis
cacgggccauguccccga

SEQ ID NO: 1021302 - RNA, 13 nt, Mycobacterium avium subsp. paratuberculosis
cacgggccgcgcc

SEQ ID NO: 1021303 - RNA, 13 nt, Mycobacterium avium subsp. paratuberculosis
cacggcggcagcg

SEQ ID NO: 1021304 - RNA, 15 nt, Mycobacterium avium subsp. paratuberculosis
cacggcggcagcgcg

SEQ ID NO: 1021305 - RNA, 20 nt, Mycobacterium avium subsp. paratuberculosis
cacggcgccaccagccacac

SEQ ID NO: 1021306 - RNA, 19 nt, Mycobacterium avium subsp. paratuberculosis
cacggcgacgaccaccagg

SEQ ID NO: 1021307 - RNA, 14 nt, Mycobacterium avium subsp. paratuberculosis
cacggcgaggaugg

SEQ ID NO: 1021308 - RNA, 13 nt, Mycobacterium avium subsp. paratuberculosis
caccguccagcuc

SEQ ID NO: 1021309 - RNA, 21 nt, Mycobacterium avium subsp. paratuberculosis
caccgucccggugucgccguc

SEQ ID NO: 1021310 - RNA, 22 nt, Mycobacterium avium subsp. paratuberculosis
caccguccuugggaagcaucaa

SEQ ID NO: 1021311 - RNA, 20 nt, Mycobacterium avium subsp. paratuberculosis
caccgucgcggucagcucga

SEQ ID NO: 1021312 - RNA, 20 nt, Mycobacterium avium subsp. paratuberculosis
caccgucgauggacagggcg

SEQ ID NO: 1021313 - RNA, 18 nt, Mycobacterium avium subsp. paratuberculosis
caccgucgcccgcccagg

SEQ ID NO: 1021314 - RNA, 24 nt, Mycobacterium avium subsp. paratuberculosis
caccgucguacucgaccgcgacuu

SEQ ID NO: 1021315 - RNA, 21 nt, Mycobacterium avium subsp. paratuberculosis
caccgucguccacgcccagcg

SEQ ID NO: 1021316 - RNA, 13 nt, Mycobacterium avium subsp. paratuberculosis
caccgucugcugg

SEQ ID NO: 1021317 - RNA, 13 nt, Mycobacterium avium subsp. paratuberculosis
caccggcugcccc

SEQ ID NO: 1021318 - RNA, 16 nt, Mycobacterium avium subsp. paratuberculosis
caccggcugcccgacc

SEQ ID NO: 1021319 - RNA, 21 nt, Mycobacterium avium subsp. paratuberculosis
caccggcugcccgacccgcac

SEQ ID NO: 1021320 - RNA, 21 nt, Mycobacterium avium subsp. paratuberculosis
caccggcucgggaacggucag

SEQ ID NO: 1021321 - RNA, 23 nt, Mycobacterium avium subsp. paratuberculosis
caccggcggcggccuucuucugc

SEQ ID NO: 1021322 - RNA, 23 nt, Mycobacterium avium subsp. paratuberculosis
caccgggauggcguucugcaccg

SEQ ID NO: 1021323 - RNA, 15 nt, Mycobacterium avium subsp. paratuberculosis
caccgucaucgcggc

SEQ ID NO: 1021324 - RNA, 22 nt, Mycobacterium avium subsp. paratuberculosis
caccgucaucgugugggcgccc

SEQ ID NO: 1021325 - RNA, 18 nt, Mycobacterium avium subsp. paratuberculosis
caccgucaccgccgcacc

SEQ ID NO: 1021326 - RNA, 17 nt, Mycobacterium avium subsp. paratuberculosis
caccgggaacagccagg

SEQ ID NO: 1021327 - RNA, 20 nt, Mycobacterium avium subsp. paratuberculosis
caccgggauccggcgcgccg

SEQ ID NO: 1021328 - RNA, 23 nt, Mycobacterium avium subsp. paratuberculosis
caccgggaucggggugccgccgg

SEQ ID NO: 1021329 - RNA, 17 nt, Mycobacterium avium subsp. paratuberculosis
caccggcuucuccucgg

SEQ ID NO: 1021330 - RNA, 18 nt, Mycobacterium avium subsp. paratuberculosis
caccggcuuggccacgau

SEQ ID NO: 1021331 - RNA, 17 nt, Mycobacterium avium subsp. paratuberculosis
caccggcaucgguggca

SEQ ID NO: 1021332 - RNA, 14 nt, Mycobacterium avium subsp. paratuberculosis
caccggcagcgcca

SEQ ID NO: 1021333 - RNA, 23 nt, Mycobacterium avium subsp. paratuberculosis
caccggcaggcgguagcggcaga

SEQ ID NO: 1021334 - RNA, 23 nt, Mycobacterium avium subsp. paratuberculosis
caccggcacgucgagcuccucgg

SEQ ID NO: 1021335 - RNA, 14 nt, Mycobacterium avium subsp. paratuberculosis
caccggcagcaccg

SEQ ID NO: 1021336 - RNA, 19 nt, Mycobacterium avium subsp. paratuberculosis
caccgcaucgaaccgccgc

SEQ ID NO: 1021337 - RNA, 22 nt, Mycobacterium avium subsp. paratuberculosis
caccgcaucgaaccgccgcgcu

SEQ ID NO: 1021338 - RNA, 18 nt, Mycobacterium avium subsp. paratuberculosis
caccgagucgcgcgacca

SEQ ID NO: 1021339 - RNA, 21 nt, Mycobacterium avium subsp. paratuberculosis
caccgccugcgcgaucgccgg

SEQ ID NO: 1021340 - RNA, 15 nt, Mycobacterium avium subsp. paratuberculosis
caccgccuugcccgg

SEQ ID NO: 1021341 - RNA, 16 nt, Mycobacterium avium subsp. paratuberculosis
caccgccuugcccggc

SEQ ID NO: 1021342 - RNA, 23 nt, Mycobacterium avium subsp. paratuberculosis
caccgcgcggcggugcucgcgcc

SEQ ID NO: 1021343 - RNA, 21 nt, Mycobacterium avium subsp. paratuberculosis
caccgcgcggccagcggcgcc

SEQ ID NO: 1021344 - RNA, 20 nt, Mycobacterium avium subsp. paratuberculosis
caccgcgcgcugccgcgccc

SEQ ID NO: 1021345 - RNA, 22 nt, Mycobacterium avium subsp. paratuberculosis
caccgcgcgcugccgcgccccg

SEQ ID NO: 1021346 - RNA, 18 nt, Mycobacterium avium subsp. paratuberculosis
caccgcgaguucgcgcac

SEQ ID NO: 1021347 - RNA, 21 nt, Mycobacterium avium subsp. paratuberculosis
caccgcgaguucgcgcacgcu

SEQ ID NO: 1021348 - RNA, 24 nt, Mycobacterium avium subsp. paratuberculosis
caccgcgaguucgcgcacgcuggc

SEQ ID NO: 1021349 - RNA, 14 nt, Mycobacterium avium subsp. paratuberculosis
caccgcgaauugag

SEQ ID NO: 1021350 - RNA, 21 nt, Mycobacterium avium subsp. paratuberculosis
caccgcgacccaggccgccgc

SEQ ID NO: 1021351 - RNA, 18 nt, Mycobacterium avium subsp. paratuberculosis
caccgcugaugccgccga

SEQ ID NO: 1021352 - RNA, 19 nt, Mycobacterium avium subsp. paratuberculosis
caccgcuggccgaggccuc

SEQ ID NO: 1021353 - RNA, 17 nt, Mycobacterium avium subsp. paratuberculosis
caccgcugggcggcgcg

SEQ ID NO: 1021354 - RNA, 15 nt, Mycobacterium avium subsp. paratuberculosis
caccgcgcuccugcc

SEQ ID NO: 1021355 - RNA, 14 nt, Mycobacterium avium subsp. paratuberculosis
caccgcggccacca

SEQ ID NO: 1021356 - RNA, 22 nt, Mycobacterium avium subsp. paratuberculosis
caccgcggccaccaccgccacg

SEQ ID NO: 1021357 - RNA, 14 nt, Mycobacterium avium subsp. paratuberculosis
caccgcggcggcca

SEQ ID NO: 1021358 - RNA, 20 nt, Mycobacterium avium subsp. paratuberculosis
caccgcggcgacgucgugca

SEQ ID NO: 1021359 - RNA, 15 nt, Mycobacterium avium subsp. paratuberculosis
caccgcggcgaugau

SEQ ID NO: 1021360 - RNA, 12 nt, Mycobacterium avium subsp. paratuberculosis
caccgcggcgcg

SEQ ID NO: 1021361 - RNA, 14 nt, Mycobacterium avium subsp. paratuberculosis
caccgcggcgcgcg

SEQ ID NO: 1021362 - RNA, 16 nt, Mycobacterium avium subsp. paratuberculosis
caccgcggcgcgcggc

SEQ ID NO: 1021363 - RNA, 17 nt, Mycobacterium avium subsp. paratuberculosis
caccgcgugcgagccga

SEQ ID NO: 1021364 - RNA, 22 nt, Mycobacterium avium subsp. paratuberculosis
caccgcgugcgagccgagcacg

SEQ ID NO: 1021365 - RNA, 16 nt, Mycobacterium avium subsp. paratuberculosis
caccgcgucagcagcg

SEQ ID NO: 1021366 - RNA, 14 nt, Mycobacterium avium subsp. paratuberculosis
caccgcguccgcgg

SEQ ID NO: 1021367 - RNA, 14 nt, Mycobacterium avium subsp. paratuberculosis
caccgcguccugca

SEQ ID NO: 1021368 - RNA, 20 nt, Mycobacterium avium subsp. paratuberculosis
caccgcgucgaugcgggccc

SEQ ID NO: 1021369 - RNA, 17 nt, Mycobacterium avium subsp. paratuberculosis
caccgcgggccaggccc

SEQ ID NO: 1021370 - RNA, 15 nt, Mycobacterium avium subsp. paratuberculosis
caccgcgggcgcgcc

SEQ ID NO: 1021371 - RNA, 17 nt, Mycobacterium avium subsp. paratuberculosis
caccgcgggcgcgccgu

SEQ ID NO: 1021372 - RNA, 20 nt, Mycobacterium avium subsp. paratuberculosis
caccgcgggcgcgccguccc

SEQ ID NO: 1021373 - RNA, 21 nt, Mycobacterium avium subsp. paratuberculosis
caccgcgggggcggccgggcc

SEQ ID NO: 1021374 - RNA, 20 nt, Mycobacterium avium subsp. paratuberculosis
caccgcggggugcccggcga

SEQ ID NO: 1021375 - RNA, 22 nt, Mycobacterium avium subsp. paratuberculosis
caccgcgggugaucugcgccgu

SEQ ID NO: 1021376 - RNA, 17 nt, Mycobacterium avium subsp. paratuberculosis
caccgcggucugcgcca

SEQ ID NO: 1021377 - RNA, 15 nt, Mycobacterium avium subsp. paratuberculosis
caccgcggcguagcg

SEQ ID NO: 1021378 - RNA, 21 nt, Mycobacterium avium subsp. paratuberculosis
caccgcgggaauggccgcgcc

SEQ ID NO: 1021379 - RNA, 23 nt, Mycobacterium avium subsp. paratuberculosis
caccgcguagaacuucaucugga

SEQ ID NO: 1021380 - RNA, 12 nt, Mycobacterium avium subsp. paratuberculosis
caccgcguagcg

SEQ ID NO: 1021381 - RNA, 17 nt, Mycobacterium avium subsp. paratuberculosis
caccgcguagcgccgcc

SEQ ID NO: 1021382 - RNA, 18 nt, Mycobacterium avium subsp. paratuberculosis
caccgcguagcgccgccc

SEQ ID NO: 1021383 - RNA, 21 nt, Mycobacterium avium subsp. paratuberculosis
caccgcguagcgccgcccguc

SEQ ID NO: 1021384 - RNA, 15 nt, Mycobacterium avium subsp. paratuberculosis
cacccacucccagcc

SEQ ID NO: 1021385 - RNA, 13 nt, Mycobacterium avium subsp. paratuberculosis
cacccacuggcgg

SEQ ID NO: 1021386 - RNA, 21 nt, Mycobacterium avium subsp. paratuberculosis
cacccacuggcggccggccgc

SEQ ID NO: 1021387 - RNA, 22 nt, Mycobacterium avium subsp. paratuberculosis
cacccacuggcggccggccgcg

SEQ ID NO: 1021388 - RNA, 20 nt, Mycobacterium avium subsp. paratuberculosis
cacccaccggcaugggcggc

SEQ ID NO: 1021389 - RNA, 13 nt, Mycobacterium avium subsp. paratuberculosis
cacccacggccac

SEQ ID NO: 1021390 - RNA, 16 nt, Mycobacterium avium subsp. paratuberculosis
cacccacggccacaac

SEQ ID NO: 1021391 - RNA, 17 nt, Mycobacterium avium subsp. paratuberculosis
caccagucgcacaaccg

SEQ ID NO: 1021392 - RNA, 17 nt, Mycobacterium avium subsp. paratuberculosis
caccagucgcgcagcgu

SEQ ID NO: 1021393 - RNA, 22 nt, Mycobacterium avium subsp. paratuberculosis
caccaguaggucacccgguccc

SEQ ID NO: 1021394 - RNA, 20 nt, Mycobacterium avium subsp. paratuberculosis
caccagguuucgcuugugcc

SEQ ID NO: 1021395 - RNA, 19 nt, Mycobacterium avium subsp. paratuberculosis
caccaggcugaccagcgcc

SEQ ID NO: 1021396 - RNA, 14 nt, Mycobacterium avium subsp. paratuberculosis
cacccagccgugcc

SEQ ID NO: 1021397 - RNA, 23 nt, Mycobacterium avium subsp. paratuberculosis
cacccagacguguggcacccggg

SEQ ID NO: 1021398 - RNA, 23 nt, Mycobacterium avium subsp. paratuberculosis
cacccagcgagaccgcuugcggc

SEQ ID NO: 1021399 - RNA, 15 nt, Mycobacterium avium subsp. paratuberculosis
cacccagcgagcuca

SEQ ID NO: 1021400 - RNA, 15 nt, Mycobacterium avium subsp. paratuberculosis
cacccagcgccagga

SEQ ID NO: 1021401 - RNA, 13 nt, Mycobacterium avium subsp. paratuberculosis
cacccagcggcgc

SEQ ID NO: 1021402 - RNA, 17 nt, Mycobacterium avium subsp. paratuberculosis
cacccaggccacccggg

SEQ ID NO: 1021403 - RNA, 21 nt, Mycobacterium avium subsp. paratuberculosis
cacccagguugucaaggguuu

SEQ ID NO: 1021404 - RNA, 21 nt, Mycobacterium avium subsp. paratuberculosis
cacccaggucaugguggcggc

SEQ ID NO: 1021405 - RNA, 18 nt, Mycobacterium avium subsp. paratuberculosis
cacccagguguccggccc

SEQ ID NO: 1021406 - RNA, 20 nt, Mycobacterium avium subsp. paratuberculosis
cacccaugauggugggcacc

SEQ ID NO: 1021407 - RNA, 15 nt, Mycobacterium avium subsp. paratuberculosis
cacccauccccagga

SEQ ID NO: 1021408 - RNA, 14 nt, Mycobacterium avium subsp. paratuberculosis
cacccccagcucga

SEQ ID NO: 1021409 - RNA, 16 nt, Mycobacterium avium subsp. paratuberculosis
caccccagcgcgacca

SEQ ID NO: 1021410 - RNA, 13 nt, Mycobacterium avium subsp. paratuberculosis
caccccacccgcg

SEQ ID NO: 1021411 - RNA, 20 nt, Mycobacterium avium subsp. paratuberculosis
cacccccggggccuccagcc

SEQ ID NO: 1021412 - RNA, 19 nt, Mycobacterium avium subsp. paratuberculosis
caccccgaacccggccagc

SEQ ID NO: 1021413 - RNA, 16 nt, Mycobacterium avium subsp. paratuberculosis
caccccgaaccgcccg

SEQ ID NO: 1021414 - RNA, 22 nt, Mycobacterium avium subsp. paratuberculosis
caccccgaaccgcccgcccggc

SEQ ID NO: 1021415 - RNA, 16 nt, Mycobacterium avium subsp. paratuberculosis
caccccgaccgacgcg

SEQ ID NO: 1021416 - RNA, 16 nt, Mycobacterium avium subsp. paratuberculosis
cacccgguccggcccg

SEQ ID NO: 1021417 - RNA, 22 nt, Mycobacterium avium subsp. paratuberculosis
cacccggguugcgugcagccgc

SEQ ID NO: 1021418 - RNA, 19 nt, Mycobacterium avium subsp. paratuberculosis
cacccgguugagcaccgca

SEQ ID NO: 1021419 - RNA, 16 nt, Mycobacterium avium subsp. paratuberculosis
cacccggugcgccggu

SEQ ID NO: 1021420 - RNA, 17 nt, Mycobacterium avium subsp. paratuberculosis
cacccggugggacuggg

SEQ ID NO: 1021421 - RNA, 13 nt, Mycobacterium avium subsp. paratuberculosis
cacccgcgccggc

SEQ ID NO: 1021422 - RNA, 22 nt, Mycobacterium avium subsp. paratuberculosis
cacccggcuucgcugcgccggc

SEQ ID NO: 1021423 - RNA, 17 nt, Mycobacterium avium subsp. paratuberculosis
cacccgggcgccggcga

SEQ ID NO: 1021424 - RNA, 16 nt, Mycobacterium avium subsp. paratuberculosis
cacccgcagcccgacc

SEQ ID NO: 1021425 - RNA, 22 nt, Mycobacterium avium subsp. paratuberculosis
caccccgguccaggcgaccggc

SEQ ID NO: 1021426 - RNA, 24 nt, Mycobacterium avium subsp. paratuberculosis
cacccgcacgugcgcgccgaccgc

SEQ ID NO: 1021427 - RNA, 15 nt, Mycobacterium avium subsp. paratuberculosis
cacccgcagcgcggc

SEQ ID NO: 1021428 - RNA, 20 nt, Mycobacterium avium subsp. paratuberculosis
cacccgcaucaacugcacca

SEQ ID NO: 1021429 - RNA, 16 nt, Mycobacterium avium subsp. paratuberculosis
cacccgcaugcugauc

SEQ ID NO: 1021430 - RNA, 12 nt, Mycobacterium avium subsp. paratuberculosis
cacccgccccgc

SEQ ID NO: 1021431 - RNA, 13 nt, Mycobacterium avium subsp. paratuberculosis
cacccgccccgcc

SEQ ID NO: 1021432 - RNA, 20 nt, Mycobacterium avium subsp. paratuberculosis
cacccgccggguggccgcca

SEQ ID NO: 1021433 - RNA, 21 nt, Mycobacterium avium subsp. paratuberculosis
cacccgccggguggccgccac

SEQ ID NO: 1021434 - RNA, 18 nt, Mycobacterium avium subsp. paratuberculosis
caccccgcgccacgccgc

SEQ ID NO: 1021435 - RNA, 17 nt, Mycobacterium avium subsp. paratuberculosis
caccccgccgcagccca

SEQ ID NO: 1021436 - RNA, 20 nt, Mycobacterium avium subsp. paratuberculosis
caccccgccgcagcccaggc

SEQ ID NO: 1021437 - RNA, 14 nt, Mycobacterium avium subsp. paratuberculosis
caccccgcccagcg

SEQ ID NO: 1021438 - RNA, 15 nt, Mycobacterium avium subsp. paratuberculosis
caccccgaugccgaa

SEQ ID NO: 1021439 - RNA, 20 nt, Mycobacterium avium subsp. paratuberculosis
caccccgcagaacaccagcg

SEQ ID NO: 1021440 - RNA, 20 nt, Mycobacterium avium subsp. paratuberculosis
caccccgccaaucaccgcgg

SEQ ID NO: 1021441 - RNA, 14 nt, Mycobacterium avium subsp. paratuberculosis
caccccgcucggcc

SEQ ID NO: 1021442 - RNA, 17 nt, Mycobacterium avium subsp. paratuberculosis
caccccgcucggccagc

SEQ ID NO: 1021443 - RNA, 21 nt, Mycobacterium avium subsp. paratuberculosis
caccccgcucggccagcgcgc

SEQ ID NO: 1021444 - RNA, 20 nt, Mycobacterium avium subsp. paratuberculosis
caccccggagauccggccgc

SEQ ID NO: 1021445 - RNA, 21 nt, Mycobacterium avium subsp. paratuberculosis
caccccggagauccggccgcu

SEQ ID NO: 1021446 - RNA, 16 nt, Mycobacterium avium subsp. paratuberculosis
caccccggccaguccg

SEQ ID NO: 1021447 - RNA, 18 nt, Mycobacterium avium subsp. paratuberculosis
caccccggcguccacgcc

SEQ ID NO: 1021448 - RNA, 21 nt, Mycobacterium avium subsp. paratuberculosis
caccgagauguaucugcggac

SEQ ID NO: 1021449 - RNA, 15 nt, Mycobacterium avium subsp. paratuberculosis
caccgacuccuccgg

SEQ ID NO: 1021450 - RNA, 13 nt, Mycobacterium avium subsp. paratuberculosis
caccgagaccaug

SEQ ID NO: 1021451 - RNA, 15 nt, Mycobacterium avium subsp. paratuberculosis
caccgagccggcggc

SEQ ID NO: 1021452 - RNA, 22 nt, Mycobacterium avium subsp. paratuberculosis
caccgagccgggcagcgcgaca

SEQ ID NO: 1021453 - RNA, 15 nt, Mycobacterium avium subsp. paratuberculosis
caccgagccggggcu

SEQ ID NO: 1021454 - RNA, 18 nt, Mycobacterium avium subsp. paratuberculosis
caccgagcgagcgcacca

SEQ ID NO: 1021455 - RNA, 19 nt, Mycobacterium avium subsp. paratuberculosis
caccgacggccgcacccca

SEQ ID NO: 1021456 - RNA, 18 nt, Mycobacterium avium subsp. paratuberculosis
caccgacggagccgagca

SEQ ID NO: 1021457 - RNA, 22 nt, Mycobacterium avium subsp. paratuberculosis
caccgacggagccgagcaccag

SEQ ID NO: 1021458 - RNA, 15 nt, Mycobacterium avium subsp. paratuberculosis
caccgacgccacguc

SEQ ID NO: 1021459 - RNA, 17 nt, Mycobacterium avium subsp. paratuberculosis
caccgacagcacccggc

SEQ ID NO: 1021460 - RNA, 23 nt, Mycobacterium avium subsp. paratuberculosis
cacccgugggccgaccggccggu

SEQ ID NO: 1021461 - RNA, 14 nt, Mycobacterium avium subsp. paratuberculosis
cacccugcgccaca

SEQ ID NO: 1021462 - RNA, 22 nt, Mycobacterium avium subsp. paratuberculosis
cacccuggaacuuguugacgaa

SEQ ID NO: 1021463 - RNA, 18 nt, Mycobacterium avium subsp. paratuberculosis
cacccuugacuaccgcgc

SEQ ID NO: 1021464 - RNA, 21 nt, Mycobacterium avium subsp. paratuberculosis
cacccuugacuaccgcgccca

SEQ ID NO: 1021465 - RNA, 18 nt, Mycobacterium avium subsp. paratuberculosis
cacccuucaucagcaccg

SEQ ID NO: 1021466 - RNA, 20 nt, Mycobacterium avium subsp. paratuberculosis
caccgacagggccagcgcca

SEQ ID NO: 1021467 - RNA, 21 nt, Mycobacterium avium subsp. paratuberculosis
caccgacaggucgaagggcau

SEQ ID NO: 1021468 - RNA, 19 nt, Mycobacterium avium subsp. paratuberculosis
caccacguugcacggcagc

SEQ ID NO: 1021469 - RNA, 23 nt, Mycobacterium avium subsp. paratuberculosis
caccacguugcacggcagcaacu

SEQ ID NO: 1021470 - RNA, 20 nt, Mycobacterium avium subsp. paratuberculosis
caccacguccaccagcacca

SEQ ID NO: 1021471 - RNA, 16 nt, Mycobacterium avium subsp. paratuberculosis
caccacgucggugccg

SEQ ID NO: 1021472 - RNA, 19 nt, Mycobacterium avium subsp. paratuberculosis
caccacgucggugccgcgu

SEQ ID NO: 1021473 - RNA, 18 nt, Mycobacterium avium subsp. paratuberculosis
caccacgucgucggccug

SEQ ID NO: 1021474 - RNA, 17 nt, Mycobacterium avium subsp. paratuberculosis
caccacguacuccugcg

SEQ ID NO: 1021475 - RNA, 14 nt, Mycobacterium avium subsp. paratuberculosis
caccacggccagga

SEQ ID NO: 1021476 - RNA, 17 nt, Mycobacterium avium subsp. paratuberculosis
caccacggcccgcgccc

SEQ ID NO: 1021477 - RNA, 12 nt, Mycobacterium avium subsp. paratuberculosis
caccacggccag

SEQ ID NO: 1021478 - RNA, 14 nt, Mycobacterium avium subsp. paratuberculosis
caccagcaccaggc

SEQ ID NO: 1021479 - RNA, 15 nt, Mycobacterium avium subsp. paratuberculosis
caccagcacccagca

SEQ ID NO: 1021480 - RNA, 15 nt, Mycobacterium avium subsp. paratuberculosis
caccagcaccccgcc

SEQ ID NO: 1021481 - RNA, 16 nt, Mycobacterium avium subsp. paratuberculosis
caccagcaccccgccg

SEQ ID NO: 1021482 - RNA, 21 nt, Mycobacterium avium subsp. paratuberculosis
caccagcaccccgccgcagcc

SEQ ID NO: 1021483 - RNA, 13 nt, Mycobacterium avium subsp. paratuberculosis
caccagcacaccg

SEQ ID NO: 1021484 - RNA, 22 nt, Mycobacterium avium subsp. paratuberculosis
caccagcacgccguugaccccg

SEQ ID NO: 1021485 - RNA, 18 nt, Mycobacterium avium subsp. paratuberculosis
caccagcacggucccguc

SEQ ID NO: 1021486 - RNA, 17 nt, Mycobacterium avium subsp. paratuberculosis
caccagcaacaccaggg

SEQ ID NO: 1021487 - RNA, 15 nt, Mycobacterium avium subsp. paratuberculosis
caccagagcgccgga

SEQ ID NO: 1021488 - RNA, 21 nt, Mycobacterium avium subsp. paratuberculosis
caccagaugccgggcuccgcg

SEQ ID NO: 1021489 - RNA, 16 nt, Mycobacterium avium subsp. paratuberculosis
caccagaucgccccgc

SEQ ID NO: 1021490 - RNA, 20 nt, Mycobacterium avium subsp. paratuberculosis
caccacgacgccgggcgccc

SEQ ID NO: 1021491 - RNA, 21 nt, Mycobacterium avium subsp. paratuberculosis
caccacgaggaccagcaugug

SEQ ID NO: 1021492 - RNA, 18 nt, Mycobacterium avium subsp. paratuberculosis
caccacgaacgcgccgcc

SEQ ID NO: 1021493 - RNA, 16 nt, Mycobacterium avium subsp. paratuberculosis
caccacgaccagugcc

SEQ ID NO: 1021494 - RNA, 21 nt, Mycobacterium avium subsp. paratuberculosis
caccacgauccaaccgagucg

SEQ ID NO: 1021495 - RNA, 21 nt, Mycobacterium avium subsp. paratuberculosis
caccacgaugaagccgugccc

SEQ ID NO: 1021496 - RNA, 21 nt, Mycobacterium avium subsp. paratuberculosis
caccacgcuguagggccacca

SEQ ID NO: 1021497 - RNA, 13 nt, Mycobacterium avium subsp. paratuberculosis
caccacggcaccg

SEQ ID NO: 1021498 - RNA, 16 nt, Mycobacterium avium subsp. paratuberculosis
caccacggcaccgccg

SEQ ID NO: 1021499 - RNA, 18 nt, Mycobacterium avium subsp. paratuberculosis
caccacggcaccgccgcg

SEQ ID NO: 1021500 - RNA, 22 nt, Mycobacterium avium subsp. paratuberculosis
caccacggcaccgccgcgcggc

SEQ ID NO: 1021501 - RNA, 21 nt, Mycobacterium avium subsp. paratuberculosis
caccacgcccuuguuguucca

SEQ ID NO: 1021502 - RNA, 15 nt, Mycobacterium avium subsp. paratuberculosis
caccaccacggccag

SEQ ID NO: 1021503 - RNA, 20 nt, Mycobacterium avium subsp. paratuberculosis
caccaccacggccaggaagc

SEQ ID NO: 1021504 - RNA, 15 nt, Mycobacterium avium subsp. paratuberculosis
caccaccacggccau

SEQ ID NO: 1021505 - RNA, 15 nt, Mycobacterium avium subsp. paratuberculosis
caccaccacggccgc

SEQ ID NO: 1021506 - RNA, 14 nt, Mycobacterium avium subsp. paratuberculosis
caccaccacgugcc

SEQ ID NO: 1021507 - RNA, 22 nt, Mycobacterium avium subsp. paratuberculosis
caccaccacguugcgcggccgc

SEQ ID NO: 1021508 - RNA, 14 nt, Mycobacterium avium subsp. paratuberculosis
caccaccacccccg

SEQ ID NO: 1021509 - RNA, 13 nt, Mycobacterium avium subsp. paratuberculosis
caccaccacaccc

SEQ ID NO: 1021510 - RNA, 14 nt, Mycobacterium avium subsp. paratuberculosis
caccaccacacccg

SEQ ID NO: 1021511 - RNA, 21 nt, Mycobacterium avium subsp. paratuberculosis
caccaccugguccugccccgg

SEQ ID NO: 1021512 - RNA, 22 nt, Mycobacterium avium subsp. paratuberculosis
caccaccugguccugccccggg

SEQ ID NO: 1021513 - RNA, 17 nt, Mycobacterium avium subsp. paratuberculosis
caccaccuucaucgccg

SEQ ID NO: 1021514 - RNA, 16 nt, Mycobacterium avium subsp. paratuberculosis
caccagcgcccgcccg

SEQ ID NO: 1021515 - RNA, 14 nt, Mycobacterium avium subsp. paratuberculosis
caccagcgccuggg

SEQ ID NO: 1021516 - RNA, 14 nt, Mycobacterium avium subsp. paratuberculosis
caccagccacaccg

SEQ ID NO: 1021517 - RNA, 19 nt, Mycobacterium avium subsp. paratuberculosis
caccagccacaccgccgcg

SEQ ID NO: 1021518 - RNA, 17 nt, Mycobacterium avium subsp. paratuberculosis
caccagcaggucgaucu

SEQ ID NO: 1021519 - RNA, 17 nt, Mycobacterium avium subsp. paratuberculosis
caccagcagcagguugu

SEQ ID NO: 1021520 - RNA, 20 nt, Mycobacterium avium subsp. paratuberculosis
caccagcagccagcccagcc

SEQ ID NO: 1021521 - RNA, 17 nt, Mycobacterium avium subsp. paratuberculosis
caccagcagccggucga

SEQ ID NO: 1021522 - RNA, 10 nt, Mycobacterium avium subsp. paratuberculosis
caccagcagg

SEQ ID NO: 1021523 - RNA, 22 nt, Mycobacterium avium subsp. paratuberculosis
caccagggacaugccgagcagc

SEQ ID NO: 1021524 - RNA, 23 nt, Mycobacterium avium subsp. paratuberculosis
caccagcgcuuucgcgcacgcca

SEQ ID NO: 1021525 - RNA, 21 nt, Mycobacterium avium subsp. paratuberculosis
caccagcgcguagagcaucag

SEQ ID NO: 1021526 - RNA, 12 nt, Mycobacterium avium subsp. paratuberculosis
caccagcgcgga

SEQ ID NO: 1021527 - RNA, 16 nt, Mycobacterium avium subsp. paratuberculosis
caccagcgcggacacc

SEQ ID NO: 1021528 - RNA, 18 nt, Mycobacterium avium subsp. paratuberculosis
caccagcgcggacaccag

SEQ ID NO: 1021529 - RNA, 14 nt, Mycobacterium avium subsp. paratuberculosis
caccagcggcaucg

SEQ ID NO: 1021530 - RNA, 13 nt, Mycobacterium avium subsp. paratuberculosis
caccagcggcccg

SEQ ID NO: 1021531 - RNA, 14 nt, Mycobacterium avium subsp. paratuberculosis
caccagcggcgccc

SEQ ID NO: 1021532 - RNA, 20 nt, Mycobacterium avium subsp. paratuberculosis
caccagcggcgcccacggcc

SEQ ID NO: 1021533 - RNA, 13 nt, Mycobacterium avium subsp. paratuberculosis
caccagcggcgcg

SEQ ID NO: 1021534 - RNA, 22 nt, Mycobacterium avium subsp. paratuberculosis
caccagcggcugcagcagaugc

SEQ ID NO: 1021535 - RNA, 12 nt, Mycobacterium avium subsp. paratuberculosis
caccagcgggcu

SEQ ID NO: 1021536 - RNA, 21 nt, Mycobacterium avium subsp. paratuberculosis
caccagcgguaaccacccgug

SEQ ID NO: 1021537 - RNA, 17 nt, Mycobacterium avium subsp. paratuberculosis
caccagcguggugcgcc

SEQ ID NO: 1021538 - RNA, 21 nt, Mycobacterium avium subsp. paratuberculosis
caccagcguggugcgcccguc

SEQ ID NO: 1021539 - RNA, 18 nt, Mycobacterium avium subsp. paratuberculosis
caccagcguuccagcacc

SEQ ID NO: 1021540 - RNA, 15 nt, Mycobacterium avium subsp. paratuberculosis
caccacacccgcggc

SEQ ID NO: 1021541 - RNA, 20 nt, Mycobacterium avium subsp. paratuberculosis
caccacauuggcgaccgcgg

SEQ ID NO: 1021542 - RNA, 17 nt, Mycobacterium avium subsp. paratuberculosis
caccacauucccgccgc

SEQ ID NO: 1021543 - RNA, 22 nt, Mycobacterium avium subsp. paratuberculosis
cacaucggagagcuugccgcgg

SEQ ID NO: 1021544 - RNA, 16 nt, Mycobacterium avium subsp. paratuberculosis
cacauucccgccgccg

SEQ ID NO: 1021545 - RNA, 17 nt, Mycobacterium avium subsp. paratuberculosis
cacagcucaccugcgug

SEQ ID NO: 1021546 - RNA, 18 nt, Mycobacterium avium subsp. paratuberculosis
cacagcucaccugcgugc

SEQ ID NO: 1021547 - RNA, 16 nt, Mycobacterium avium subsp. paratuberculosis
cacagcgggaucccag

SEQ ID NO: 1021548 - RNA, 19 nt, Mycobacterium avium subsp. paratuberculosis
cacagcggcgacagcggcc

SEQ ID NO: 1021549 - RNA, 12 nt, Mycobacterium avium subsp. paratuberculosis
cacagcggcgca

SEQ ID NO: 1021550 - RNA, 15 nt, Mycobacterium avium subsp. paratuberculosis
cacauacgccucacc

SEQ ID NO: 1021551 - RNA, 21 nt, Mycobacterium avium subsp. paratuberculosis
cacagcugcuggcugcggccc

SEQ ID NO: 1021552 - RNA, 16 nt, Mycobacterium avium subsp. paratuberculosis
cacagcuucggcgccg

SEQ ID NO: 1021553 - RNA, 22 nt, Mycobacterium avium subsp. paratuberculosis
cacagcuucggcgccgagcacg

SEQ ID NO: 1021554 - RNA, 22 nt, Mycobacterium avium subsp. paratuberculosis
cacaucacgguggccgccacca

SEQ ID NO: 1021555 - RNA, 16 nt, Mycobacterium avium subsp. paratuberculosis
cacauccgucacgccc

SEQ ID NO: 1021556 - RNA, 19 nt, Mycobacterium avium subsp. paratuberculosis
cacauccgucacgcccguc

SEQ ID NO: 1021557 - RNA, 22 nt, Mycobacterium avium subsp. paratuberculosis
cacaucccgcaauugcgccagc

SEQ ID NO: 1021558 - RNA, 22 nt, Mycobacterium avium subsp. paratuberculosis
cacaacaugauucguucgugag

SEQ ID NO: 1021559 - RNA, 18 nt, Mycobacterium avium subsp. paratuberculosis
cacaacaugucccgggca

SEQ ID NO: 1021560 - RNA, 16 nt, Mycobacterium avium subsp. paratuberculosis
cacaaccgggccaacg

SEQ ID NO: 1021561 - RNA, 15 nt, Mycobacterium avium subsp. paratuberculosis
cacaacccggacagc

SEQ ID NO: 1021562 - RNA, 17 nt, Mycobacterium avium subsp. paratuberculosis
cacaagcgaggucacca

SEQ ID NO: 1021563 - RNA, 23 nt, Mycobacterium avium subsp. paratuberculosis
cacaagggccaccgggccgagga

SEQ ID NO: 1021564 - RNA, 18 nt, Mycobacterium avium subsp. paratuberculosis
cacagcagcacgcccagc

SEQ ID NO: 1021565 - RNA, 19 nt, Mycobacterium avium subsp. paratuberculosis
cacagcagcacgcccagcc

SEQ ID NO: 1021566 - RNA, 15 nt, Mycobacterium avium subsp. paratuberculosis
cacagcagccgcacc

SEQ ID NO: 1021567 - RNA, 12 nt, Mycobacterium avium subsp. paratuberculosis
cacagcaccggc

SEQ ID NO: 1021568 - RNA, 21 nt, Mycobacterium avium subsp. paratuberculosis
cacagcaccaguugcaccggc

SEQ ID NO: 1021569 - RNA, 12 nt, Mycobacterium avium subsp. paratuberculosis
cacacggccucg

SEQ ID NO: 1021570 - RNA, 21 nt, Mycobacterium avium subsp. paratuberculosis
cacacggccucgcccagcgcc

SEQ ID NO: 1021571 - RNA, 12 nt, Mycobacterium avium subsp. paratuberculosis
cacacgcggaca

SEQ ID NO: 1021572 - RNA, 17 nt, Mycobacterium avium subsp. paratuberculosis
cacacgcucggcgagcu

SEQ ID NO: 1021573 - RNA, 22 nt, Mycobacterium avium subsp. paratuberculosis
caaugguuuucgucgaucagca

SEQ ID NO: 1021574 - RNA, 16 nt, Mycobacterium avium subsp. paratuberculosis
caauugcgccagcagc

SEQ ID NO: 1021575 - RNA, 15 nt, Mycobacterium avium subsp. paratuberculosis
caauucggucagcgc

SEQ ID NO: 1021576 - RNA, 15 nt, Mycobacterium avium subsp. paratuberculosis
auuucccgacuccuc

SEQ ID NO: 1021577 - RNA, 21 nt, Mycobacterium avium subsp. paratuberculosis
auuucccgacuccucacaccu

SEQ ID NO: 1021578 - RNA, 19 nt, Mycobacterium avium subsp. paratuberculosis
auuuccgguuccucggcgu

SEQ ID NO: 1021579 - RNA, 18 nt, Mycobacterium avium subsp. paratuberculosis
auuucgccugcagccgcc

SEQ ID NO: 1021580 - RNA, 17 nt, Mycobacterium avium subsp. paratuberculosis
auuucacgucugcucgg

SEQ ID NO: 1021581 - RNA, 21 nt, Mycobacterium avium subsp. paratuberculosis
auugucgcuguuagccucgcc

SEQ ID NO: 1021582 - RNA, 11 nt, Mycobacterium avium subsp. paratuberculosis
auugucggccg

SEQ ID NO: 1021583 - RNA, 14 nt, Mycobacterium avium subsp. paratuberculosis
auugucggccgccc

SEQ ID NO: 1021584 - RNA, 23 nt, Mycobacterium avium subsp. paratuberculosis
auugcccgacuccucacaccucg

SEQ ID NO: 1021585 - RNA, 15 nt, Mycobacterium avium subsp. paratuberculosis
auugcacggcggcga

SEQ ID NO: 1021586 - RNA, 16 nt, Mycobacterium avium subsp. paratuberculosis
auucuugaccaccuug

SEQ ID NO: 1021587 - RNA, 15 nt, Mycobacterium avium subsp. paratuberculosis
auucuggccgaccgc

SEQ ID NO: 1021588 - RNA, 15 nt, Mycobacterium avium subsp. paratuberculosis
auucugcagccgcac

SEQ ID NO: 1021589 - RNA, 19 nt, Mycobacterium avium subsp. paratuberculosis
auucgucauggacagccac

SEQ ID NO: 1021590 - RNA, 15 nt, Mycobacterium avium subsp. paratuberculosis
auucgucgucggccu

SEQ ID NO: 1021591 - RNA, 18 nt, Mycobacterium avium subsp. paratuberculosis
auucgcgggugcgcucga

SEQ ID NO: 1021592 - RNA, 19 nt, Mycobacterium avium subsp. paratuberculosis
auucgcgggugcgcucgac

SEQ ID NO: 1021593 - RNA, 15 nt, Mycobacterium avium subsp. paratuberculosis
auucgcgcggcgccc

SEQ ID NO: 1021594 - RNA, 14 nt, Mycobacterium avium subsp. paratuberculosis
auucgcgcugccag

SEQ ID NO: 1021595 - RNA, 22 nt, Mycobacterium avium subsp. paratuberculosis
auucgcgugugcccagcacgac

SEQ ID NO: 1021596 - RNA, 14 nt, Mycobacterium avium subsp. paratuberculosis
auuccucagcgccc

SEQ ID NO: 1021597 - RNA, 17 nt, Mycobacterium avium subsp. paratuberculosis
auucaucgcgcaccagg

SEQ ID NO: 1021598 - RNA, 13 nt, Mycobacterium avium subsp. paratuberculosis
aaaagcuucuugc

SEQ ID NO: 1021599 - RNA, 16 nt, Mycobacterium avium subsp. paratuberculosis
auuaaccggcaggccg

SEQ ID NO: 1021600 - RNA, 14 nt, Mycobacterium avium subsp. paratuberculosis
auuaagcuggcagg

SEQ ID NO: 1021601 - RNA, 22 nt, Mycobacterium avium subsp. paratuberculosis
auguugaugaucgagccgcggc

SEQ ID NO: 1021602 - RNA, 16 nt, Mycobacterium avium subsp. paratuberculosis
augugccugcgggccc

SEQ ID NO: 1021603 - RNA, 17 nt, Mycobacterium avium subsp. paratuberculosis
auguggggggucggagc

SEQ ID NO: 1021604 - RNA, 21 nt, Mycobacterium avium subsp. paratuberculosis
augucgucguugugggccagc

SEQ ID NO: 1021605 - RNA, 21 nt, Mycobacterium avium subsp. paratuberculosis
augucgcugccgccgccggcg

SEQ ID NO: 1021606 - RNA, 20 nt, Mycobacterium avium subsp. paratuberculosis
augucgcgcagcauccgcac

SEQ ID NO: 1021607 - RNA, 19 nt, Mycobacterium avium subsp. paratuberculosis
augucggugagcgccaccc

SEQ ID NO: 1021608 - RNA, 13 nt, Mycobacterium avium subsp. paratuberculosis
augucggccagga

SEQ ID NO: 1021609 - RNA, 13 nt, Mycobacterium avium subsp. paratuberculosis
augucggcggccg

SEQ ID NO: 1021610 - RNA, 13 nt, Mycobacterium avium subsp. paratuberculosis
augucgccgcaga

SEQ ID NO: 1021611 - RNA, 20 nt, Mycobacterium avium subsp. paratuberculosis
augucgccggcgaccgccuu

SEQ ID NO: 1021612 - RNA, 18 nt, Mycobacterium avium subsp. paratuberculosis
augucgaccucggccacc

SEQ ID NO: 1021613 - RNA, 13 nt, Mycobacterium avium subsp. paratuberculosis
auguacaggauca

SEQ ID NO: 1021614 - RNA, 16 nt, Mycobacterium avium subsp. paratuberculosis
auggugccggccaugc

SEQ ID NO: 1021615 - RNA, 22 nt, Mycobacterium avium subsp. paratuberculosis
auggugaaguugccggucaggc

SEQ ID NO: 1021616 - RNA, 19 nt, Mycobacterium avium subsp. paratuberculosis
auggugaaggugcccuccu

SEQ ID NO: 1021617 - RNA, 21 nt, Mycobacterium avium subsp. paratuberculosis
auggugaaggugcccuccucg

SEQ ID NO: 1021618 - RNA, 17 nt, Mycobacterium avium subsp. paratuberculosis
augguggccgucggccu

SEQ ID NO: 1021619 - RNA, 20 nt, Mycobacterium avium subsp. paratuberculosis
augguggcgcugccgagcac

SEQ ID NO: 1021620 - RNA, 15 nt, Mycobacterium avium subsp. paratuberculosis
augguggcggccacc

SEQ ID NO: 1021621 - RNA, 13 nt, Mycobacterium avium subsp. paratuberculosis
auggugggcaccg

SEQ ID NO: 1021622 - RNA, 17 nt, Mycobacterium avium subsp. paratuberculosis
auggugggcagccggca

SEQ ID NO: 1021623 - RNA, 18 nt, Mycobacterium avium subsp. paratuberculosis
augguguaguccugcuuc

SEQ ID NO: 1021624 - RNA, 22 nt, Mycobacterium avium subsp. paratuberculosis
auggugucccauucgugguugc

SEQ ID NO: 1021625 - RNA, 18 nt, Mycobacterium avium subsp. paratuberculosis
auggcuggcggcaacggc

SEQ ID NO: 1021626 - RNA, 13 nt, Mycobacterium avium subsp. paratuberculosis
auggggauggugc

SEQ ID NO: 1021627 - RNA, 13 nt, Mycobacterium avium subsp. paratuberculosis
auggccgggaagu

SEQ ID NO: 1021628 - RNA, 14 nt, Mycobacterium avium subsp. paratuberculosis
auggccgggaaguu

SEQ ID NO: 1021629 - RNA, 15 nt, Mycobacterium avium subsp. paratuberculosis
auggcgugccacagc

SEQ ID NO: 1021630 - RNA, 15 nt, Mycobacterium avium subsp. paratuberculosis
auggcguucugcacc

SEQ ID NO: 1021631 - RNA, 20 nt, Mycobacterium avium subsp. paratuberculosis
auggcguucaucguccacac

SEQ ID NO: 1021632 - RNA, 13 nt, Mycobacterium avium subsp. paratuberculosis
auggcgucggcca

SEQ ID NO: 1021633 - RNA, 16 nt, Mycobacterium avium subsp. paratuberculosis
auggccgccgcaggcg

SEQ ID NO: 1021634 - RNA, 19 nt, Mycobacterium avium subsp. paratuberculosis
auggauccgaucagcagca

SEQ ID NO: 1021635 - RNA, 22 nt, Mycobacterium avium subsp. paratuberculosis
auggauccgaucagcagcaccu

SEQ ID NO: 1021636 - RNA, 19 nt, Mycobacterium avium subsp. paratuberculosis
auggaggugccgcgcagca

SEQ ID NO: 1021637 - RNA, 15 nt, Mycobacterium avium subsp. paratuberculosis
auggaguagcugacc

SEQ ID NO: 1021638 - RNA, 19 nt, Mycobacterium avium subsp. paratuberculosis
auggacgaagugcccgccu

SEQ ID NO: 1021639 - RNA, 18 nt, Mycobacterium avium subsp. paratuberculosis
auggagaaaauccagaac

SEQ ID NO: 1021640 - RNA, 21 nt, Mycobacterium avium subsp. paratuberculosis
auggagaaaauccagaacagc

SEQ ID NO: 1021641 - RNA, 23 nt, Mycobacterium avium subsp. paratuberculosis
auggagcgcgacgggcugcugca

SEQ ID NO: 1021642 - RNA, 17 nt, Mycobacterium avium subsp. paratuberculosis
auggagcugaccuggcu

SEQ ID NO: 1021643 - RNA, 18 nt, Mycobacterium avium subsp. paratuberculosis
auggacagcaccuugccc

SEQ ID NO: 1021644 - RNA, 13 nt, Mycobacterium avium subsp. paratuberculosis
auggacagcagcc

SEQ ID NO: 1021645 - RNA, 18 nt, Mycobacterium avium subsp. paratuberculosis
auggacagcagccagguc

SEQ ID NO: 1021646 - RNA, 23 nt, Mycobacterium avium subsp. paratuberculosis
augcuguggaagggccccggcau

SEQ ID NO: 1021647 - RNA, 22 nt, Mycobacterium avium subsp. paratuberculosis
augcuguuccagacgucggcgu

SEQ ID NO: 1021648 - RNA, 17 nt, Mycobacterium avium subsp. paratuberculosis
augcugcgggucagcag

SEQ ID NO: 1021649 - RNA, 14 nt, Mycobacterium avium subsp. paratuberculosis
augcugcacggggu

SEQ ID NO: 1021650 - RNA, 19 nt, Mycobacterium avium subsp. paratuberculosis
augcgcgucgcggcgcgga

SEQ ID NO: 1021651 - RNA, 22 nt, Mycobacterium avium subsp. paratuberculosis
augcgcgucauggccgucgggu

SEQ ID NO: 1021652 - RNA, 20 nt, Mycobacterium avium subsp. paratuberculosis
augcgcgacggccucgccgu

SEQ ID NO: 1021653 - RNA, 15 nt, Mycobacterium avium subsp. paratuberculosis
augcucgucggucag

SEQ ID NO: 1021654 - RNA, 14 nt, Mycobacterium avium subsp. paratuberculosis
augcagaacagccg

SEQ ID NO: 1021655 - RNA, 15 nt, Mycobacterium avium subsp. paratuberculosis
augccgagcagcucg

SEQ ID NO: 1021656 - RNA, 18 nt, Mycobacterium avium subsp. paratuberculosis
augccgaggcacagcagc

SEQ ID NO: 1021657 - RNA, 19 nt, Mycobacterium avium subsp. paratuberculosis
augccgagguagucggccu

SEQ ID NO: 1021658 - RNA, 10 nt, Mycobacterium avium subsp. paratuberculosis
augccgccga

SEQ ID NO: 1021659 - RNA, 17 nt, Mycobacterium avium subsp. paratuberculosis
augccgccgacgauguc

SEQ ID NO: 1021660 - RNA, 18 nt, Mycobacterium avium subsp. paratuberculosis
augccgccgagggccagc

SEQ ID NO: 1021661 - RNA, 14 nt, Mycobacterium avium subsp. paratuberculosis
augccgcccagcag

SEQ ID NO: 1021662 - RNA, 13 nt, Mycobacterium avium subsp. paratuberculosis
augccgcccagca

SEQ ID NO: 1021663 - RNA, 20 nt, Mycobacterium avium subsp. paratuberculosis
augccgaacgucaccaacau

SEQ ID NO: 1021664 - RNA, 24 nt, Mycobacterium avium subsp. paratuberculosis
augcgacgacgucgucguccucgu

SEQ ID NO: 1021665 - RNA, 16 nt, Mycobacterium avium subsp. paratuberculosis
augcgccggguccagc

SEQ ID NO: 1021666 - RNA, 13 nt, Mycobacterium avium subsp. paratuberculosis
augcgcgccacca

SEQ ID NO: 1021667 - RNA, 17 nt, Mycobacterium avium subsp. paratuberculosis
augcgcgccaccaggcg

SEQ ID NO: 1021668 - RNA, 22 nt, Mycobacterium avium subsp. paratuberculosis
augccgcgcaggccguccagca

SEQ ID NO: 1021669 - RNA, 22 nt, Mycobacterium avium subsp. paratuberculosis
augccgcgcuugguggcgacga

SEQ ID NO: 1021670 - RNA, 15 nt, Mycobacterium avium subsp. paratuberculosis
augccgcgggccagc

SEQ ID NO: 1021671 - RNA, 17 nt, Mycobacterium avium subsp. paratuberculosis
augccgcgggccagcag

SEQ ID NO: 1021672 - RNA, 21 nt, Mycobacterium avium subsp. paratuberculosis
augccgcgggccagcagccgg

SEQ ID NO: 1021673 - RNA, 17 nt, Mycobacterium avium subsp. paratuberculosis
augccuuucagcucgau

SEQ ID NO: 1021674 - RNA, 19 nt, Mycobacterium avium subsp. paratuberculosis
augaugaaaccggccagca

SEQ ID NO: 1021675 - RNA, 22 nt, Mycobacterium avium subsp. paratuberculosis
augaugaccgacauggccagca

SEQ ID NO: 1021676 - RNA, 16 nt, Mycobacterium avium subsp. paratuberculosis
augaugccgcccauca

SEQ ID NO: 1021677 - RNA, 13 nt, Mycobacterium avium subsp. paratuberculosis
augaugucggccg

SEQ ID NO: 1021678 - RNA, 16 nt, Mycobacterium avium subsp. paratuberculosis
augauuccgccgggcg

SEQ ID NO: 1021679 - RNA, 21 nt, Mycobacterium avium subsp. paratuberculosis
augauugcgugcccggccagc

SEQ ID NO: 1021680 - RNA, 23 nt, Mycobacterium avium subsp. paratuberculosis
cagcgucggcgugcccgccgacc

SEQ ID NO: 1021681 - RNA, 17 nt, Mycobacterium avium subsp. paratuberculosis
cagcgucgggcucgccu

SEQ ID NO: 1021682 - RNA, 17 nt, Mycobacterium avium subsp. paratuberculosis
cagcgucuggcagccgg

SEQ ID NO: 1021683 - RNA, 16 nt, Mycobacterium avium subsp. paratuberculosis
cagcgucugcgccagc

SEQ ID NO: 1021684 - RNA, 19 nt, Mycobacterium avium subsp. paratuberculosis
cagcgucugcgccagcugg

SEQ ID NO: 1021685 - RNA, 15 nt, Mycobacterium avium subsp. paratuberculosis
cagcgucugcgcccc

SEQ ID NO: 1021686 - RNA, 18 nt, Mycobacterium avium subsp. paratuberculosis
cagcgucugcgccccggc

SEQ ID NO: 1021687 - RNA, 22 nt, Mycobacterium avium subsp. paratuberculosis
cagcgucucgccggggaacacc

SEQ ID NO: 1021688 - RNA, 24 nt, Mycobacterium avium subsp. paratuberculosis
cagcgucucggcgaucagcugccc

SEQ ID NO: 1021689 - RNA, 18 nt, Mycobacterium avium subsp. paratuberculosis
cagcgucuccggcgggcu

SEQ ID NO: 1021690 - RNA, 21 nt, Mycobacterium avium subsp. paratuberculosis
cagcgucucgaccgcgguggc

SEQ ID NO: 1021691 - RNA, 16 nt, Mycobacterium avium subsp. paratuberculosis
cagcgugacgccgggc

SEQ ID NO: 1021692 - RNA, 16 nt, Mycobacterium avium subsp. paratuberculosis
cagcgugacgcugaag

SEQ ID NO: 1021693 - RNA, 19 nt, Mycobacterium avium subsp. paratuberculosis
cagcgugacgcugaagauc

SEQ ID NO: 1021694 - RNA, 13 nt, Mycobacterium avium subsp. paratuberculosis
cagcgugaaacua

SEQ ID NO: 1021695 - RNA, 20 nt, Mycobacterium avium subsp. paratuberculosis
cagcgucuugcccagcgggg

SEQ ID NO: 1021696 - RNA, 22 nt, Mycobacterium avium subsp. paratuberculosis
cagcgucacgucgacggccgcc

SEQ ID NO: 1021697 - RNA, 16 nt, Mycobacterium avium subsp. paratuberculosis
cagcgucaggucaccg

SEQ ID NO: 1021698 - RNA, 19 nt, Mycobacterium avium subsp. paratuberculosis
cagcgucaucacgugcugg

SEQ ID NO: 1021699 - RNA, 17 nt, Mycobacterium avium subsp. paratuberculosis
cagcgucgacugcaccg

SEQ ID NO: 1021700 - RNA, 16 nt, Mycobacterium avium subsp. paratuberculosis
cagcgucgaugugggc

SEQ ID NO: 1021701 - RNA, 22 nt, Mycobacterium avium subsp. paratuberculosis
cagcgucgccgacgggcccagc

SEQ ID NO: 1021702 - RNA, 14 nt, Mycobacterium avium subsp. paratuberculosis
cagcgucgccgccc

SEQ ID NO: 1021703 - RNA, 15 nt, Mycobacterium avium subsp. paratuberculosis
cagcgucgccgcccc

SEQ ID NO: 1021704 - RNA, 15 nt, Mycobacterium avium subsp. paratuberculosis
cagcgucgcgccgcc

SEQ ID NO: 1021705 - RNA, 17 nt, Mycobacterium avium subsp. paratuberculosis
cagcgucgcgccgccac

SEQ ID NO: 1021706 - RNA, 13 nt, Mycobacterium avium subsp. paratuberculosis
cagcguccgggcg

SEQ ID NO: 1021707 - RNA, 17 nt, Mycobacterium avium subsp. paratuberculosis
cagcgugucgccggggc

SEQ ID NO: 1021708 - RNA, 20 nt, Mycobacterium avium subsp. paratuberculosis
cagcguguugagcucgcggc

SEQ ID NO: 1021709 - RNA, 22 nt, Mycobacterium avium subsp. paratuberculosis
cagcguguugagcucgcggcgc

SEQ ID NO: 1021710 - RNA, 17 nt, Mycobacterium avium subsp. paratuberculosis
cagcguggccggcaggu

SEQ ID NO: 1021711 - RNA, 16 nt, Mycobacterium avium subsp. paratuberculosis
cagcguggcgcgcccc

SEQ ID NO: 1021712 - RNA, 21 nt, Mycobacterium avium subsp. paratuberculosis
cagcguggcgcgccccggccc

SEQ ID NO: 1021713 - RNA, 20 nt, Mycobacterium avium subsp. paratuberculosis
cagcguggcgucggcgcgca

SEQ ID NO: 1021714 - RNA, 14 nt, Mycobacterium avium subsp. paratuberculosis
cagcgugggcaccg

SEQ ID NO: 1021715 - RNA, 19 nt, Mycobacterium avium subsp. paratuberculosis
cagcgugggcaccggcacc

SEQ ID NO: 1021716 - RNA, 14 nt, Mycobacterium avium subsp. paratuberculosis
cagcgugcgcggcu

SEQ ID NO: 1021717 - RNA, 21 nt, Mycobacterium avium subsp. paratuberculosis
cagcgguuuggauggcccgcc

SEQ ID NO: 1021718 - RNA, 19 nt, Mycobacterium avium subsp. paratuberculosis
cagcgguuggcccuucgac

SEQ ID NO: 1021719 - RNA, 15 nt, Mycobacterium avium subsp. paratuberculosis
cagcggugcagcccc

SEQ ID NO: 1021720 - RNA, 15 nt, Mycobacterium avium subsp. paratuberculosis
cagcggucggcggcu

SEQ ID NO: 1021721 - RNA, 17 nt, Mycobacterium avium subsp. paratuberculosis
cagcgguaaccacccgu

SEQ ID NO: 1021722 - RNA, 20 nt, Mycobacterium avium subsp. paratuberculosis
cagcggguuguucuccagcg

SEQ ID NO: 1021723 - RNA, 19 nt, Mycobacterium avium subsp. paratuberculosis
cagcgggucgucgggccgg

SEQ ID NO: 1021724 - RNA, 16 nt, Mycobacterium avium subsp. paratuberculosis
cagcggguccagccgc

SEQ ID NO: 1021725 - RNA, 19 nt, Mycobacterium avium subsp. paratuberculosis
cagcgggcugucggcgccc

SEQ ID NO: 1021726 - RNA, 24 nt, Mycobacterium avium subsp. paratuberculosis
cagcggggugugcucggcggcgca

SEQ ID NO: 1021727 - RNA, 19 nt, Mycobacterium avium subsp. paratuberculosis
cagcggggcgaacccggcg

SEQ ID NO: 1021728 - RNA, 22 nt, Mycobacterium avium subsp. paratuberculosis
cagcggggcgagcuggccgccc

SEQ ID NO: 1021729 - RNA, 14 nt, Mycobacterium avium subsp. paratuberculosis
cagcggggcgcgca

SEQ ID NO: 1021730 - RNA, 22 nt, Mycobacterium avium subsp. paratuberculosis
cagcggggugagcaccgcgacc

SEQ ID NO: 1021731 - RNA, 20 nt, Mycobacterium avium subsp. paratuberculosis
cagcggggugcccaccaccu

SEQ ID NO: 1021732 - RNA, 23 nt, Mycobacterium avium subsp. paratuberculosis
cagcggggugcccaccaccugcu

SEQ ID NO: 1021733 - RNA, 13 nt, Mycobacterium avium subsp. paratuberculosis
cagcgggccggcg

SEQ ID NO: 1021734 - RNA, 18 nt, Mycobacterium avium subsp. paratuberculosis
cagcgggccgugccgcca

SEQ ID NO: 1021735 - RNA, 17 nt, Mycobacterium avium subsp. paratuberculosis
cagcgggauuggcgcca

SEQ ID NO: 1021736 - RNA, 11 nt, Mycobacterium avium subsp. paratuberculosis
cagcgggcaga

SEQ ID NO: 1021737 - RNA, 18 nt, Mycobacterium avium subsp. paratuberculosis
cagcgggcagagcugcug

SEQ ID NO: 1021738 - RNA, 19 nt, Mycobacterium avium subsp. paratuberculosis
cagcgggaugaaggcaccc

SEQ ID NO: 1021739 - RNA, 23 nt, Mycobacterium avium subsp. paratuberculosis
cagcgggccgaagaccgggccga

SEQ ID NO: 1021740 - RNA, 16 nt, Mycobacterium avium subsp. paratuberculosis
cagcgggccgacagca

SEQ ID NO: 1021741 - RNA, 20 nt, Mycobacterium avium subsp. paratuberculosis
cagcgggccgacagcacgcc

SEQ ID NO: 1021742 - RNA, 14 nt, Mycobacterium avium subsp. paratuberculosis
cagcgggccgaccc

SEQ ID NO: 1021743 - RNA, 16 nt, Mycobacterium avium subsp. paratuberculosis
cagcggccaucgccgc

SEQ ID NO: 1021744 - RNA, 18 nt, Mycobacterium avium subsp. paratuberculosis
cagcggccaucgccgcca

SEQ ID NO: 1021745 - RNA, 14 nt, Mycobacterium avium subsp. paratuberculosis
cagcggcccaccgc

SEQ ID NO: 1021746 - RNA, 14 nt, Mycobacterium avium subsp. paratuberculosis
cagcggccccacgu

SEQ ID NO: 1021747 - RNA, 20 nt, Mycobacterium avium subsp. paratuberculosis
cagcggcgccgggucaccgg

SEQ ID NO: 1021748 - RNA, 16 nt, Mycobacterium avium subsp. paratuberculosis
cagcggcgcccacggc

SEQ ID NO: 1021749 - RNA, 13 nt, Mycobacterium avium subsp. paratuberculosis
cagcggcgccgca

SEQ ID NO: 1021750 - RNA, 14 nt, Mycobacterium avium subsp. paratuberculosis
cagcggcgccaccg

SEQ ID NO: 1021751 - RNA, 23 nt, Mycobacterium avium subsp. paratuberculosis
cagcggccggcgcagccggccac

SEQ ID NO: 1021752 - RNA, 13 nt, Mycobacterium avium subsp. paratuberculosis
cagcggccgggcg

SEQ ID NO: 1021753 - RNA, 23 nt, Mycobacterium avium subsp. paratuberculosis
cagcggccgggcgaucucuucga

SEQ ID NO: 1021754 - RNA, 16 nt, Mycobacterium avium subsp. paratuberculosis
cagcggccgucgccgg

SEQ ID NO: 1021755 - RNA, 16 nt, Mycobacterium avium subsp. paratuberculosis
cagcggcuccgagcgg

SEQ ID NO: 1021756 - RNA, 22 nt, Mycobacterium avium subsp. paratuberculosis
cagcggcucgcgggugcggcgc

SEQ ID NO: 1021757 - RNA, 14 nt, Mycobacterium avium subsp. paratuberculosis
cagcggcugcagca

SEQ ID NO: 1021758 - RNA, 17 nt, Mycobacterium avium subsp. paratuberculosis
cagcggcuugagcgcca

SEQ ID NO: 1021759 - RNA, 12 nt, Mycobacterium avium subsp. paratuberculosis
cagcgggacagc

SEQ ID NO: 1021760 - RNA, 14 nt, Mycobacterium avium subsp. paratuberculosis
cagcggcuuggccg

SEQ ID NO: 1021761 - RNA, 12 nt, Mycobacterium avium subsp. paratuberculosis
cagcggcggcca

SEQ ID NO: 1021762 - RNA, 15 nt, Mycobacterium avium subsp. paratuberculosis
cagcggcggccauuc

SEQ ID NO: 1021763 - RNA, 15 nt, Mycobacterium avium subsp. paratuberculosis
cagcggcgcgucgcu

SEQ ID NO: 1021764 - RNA, 13 nt, Mycobacterium avium subsp. paratuberculosis
cagcggcgcggcc

SEQ ID NO: 1021765 - RNA, 19 nt, Mycobacterium avium subsp. paratuberculosis
cagcggcgcgccgggcagc

SEQ ID NO: 1021766 - RNA, 20 nt, Mycobacterium avium subsp. paratuberculosis
cagcggccacaccggggcca

SEQ ID NO: 1021767 - RNA, 22 nt, Mycobacterium avium subsp. paratuberculosis
cagcggcaucgaggaccggcgc

SEQ ID NO: 1021768 - RNA, 17 nt, Mycobacterium avium subsp. paratuberculosis
cagcggcaucgccgcca

SEQ ID NO: 1021769 - RNA, 18 nt, Mycobacterium avium subsp. paratuberculosis
cagcggcaucgccgccaa

SEQ ID NO: 1021770 - RNA, 17 nt, Mycobacterium avium subsp. paratuberculosis
cagcggcaucccuuccu

SEQ ID NO: 1021771 - RNA, 22 nt, Mycobacterium avium subsp. paratuberculosis
cagcggcacccgguccggcccg

SEQ ID NO: 1021772 - RNA, 20 nt, Mycobacterium avium subsp. paratuberculosis
cagcggcacgaucucgacca

SEQ ID NO: 1021773 - RNA, 20 nt, Mycobacterium avium subsp. paratuberculosis
cagcgccugguccucccggg

SEQ ID NO: 1021774 - RNA, 23 nt, Mycobacterium avium subsp. paratuberculosis
cagcgccugguccucccgggugg

SEQ ID NO: 1021775 - RNA, 14 nt, Mycobacterium avium subsp. paratuberculosis
cagcgcgcgggagc

SEQ ID NO: 1021776 - RNA, 15 nt, Mycobacterium avium subsp. paratuberculosis
cagcgccuugggucc

SEQ ID NO: 1021777 - RNA, 17 nt, Mycobacterium avium subsp. paratuberculosis
cagcgccuucggcgcca

SEQ ID NO: 1021778 - RNA, 19 nt, Mycobacterium avium subsp. paratuberculosis
cagcgccuucggcgccagc

SEQ ID NO: 1021779 - RNA, 20 nt, Mycobacterium avium subsp. paratuberculosis
cagcgccuucuccagcuccu

SEQ ID NO: 1021780 - RNA, 23 nt, Mycobacterium avium subsp. paratuberculosis
cagcgccuucuccagcuccucgg

SEQ ID NO: 1021781 - RNA, 17 nt, Mycobacterium avium subsp. paratuberculosis
cagcgcggauuccagcg

SEQ ID NO: 1021782 - RNA, 19 nt, Mycobacterium avium subsp. paratuberculosis
cagcgcggccaccaccacg

SEQ ID NO: 1021783 - RNA, 20 nt, Mycobacterium avium subsp. paratuberculosis
cagcgcggccaccuccagcc

SEQ ID NO: 1021784 - RNA, 14 nt, Mycobacterium avium subsp. paratuberculosis
cagcgcggccagca

SEQ ID NO: 1021785 - RNA, 18 nt, Mycobacterium avium subsp. paratuberculosis
cagcgcggcccgcggcgu

SEQ ID NO: 1021786 - RNA, 16 nt, Mycobacterium avium subsp. paratuberculosis
cagcgccugcccggag

SEQ ID NO: 1021787 - RNA, 23 nt, Mycobacterium avium subsp. paratuberculosis
cagcgcauggagaugcuucagcc

SEQ ID NO: 1021788 - RNA, 18 nt, Mycobacterium avium subsp. paratuberculosis
cagcgcauccgacaccgc

SEQ ID NO: 1021789 - RNA, 21 nt, Mycobacterium avium subsp. paratuberculosis
cagcgcauccgacaccgccuu

SEQ ID NO: 1021790 - RNA, 23 nt, Mycobacterium avium subsp. paratuberculosis
cagcgcauccucauagccggccg

SEQ ID NO: 1021791 - RNA, 19 nt, Mycobacterium avium subsp. paratuberculosis
cagcgcggccgggcgcccc

SEQ ID NO: 1021792 - RNA, 22 nt, Mycobacterium avium subsp. paratuberculosis
cagcgcggcgacauuggccgcg

SEQ ID NO: 1021793 - RNA, 15 nt, Mycobacterium avium subsp. paratuberculosis
cagcgcgucgcgccc

SEQ ID NO: 1021794 - RNA, 17 nt, Mycobacterium avium subsp. paratuberculosis
cagcgcgucgcgggccc

SEQ ID NO: 1021795 - RNA, 17 nt, Mycobacterium avium subsp. paratuberculosis
cagcgcgucgcugccgu

SEQ ID NO: 1021796 - RNA, 16 nt, Mycobacterium avium subsp. paratuberculosis
cagcgcgucgcacagc

SEQ ID NO: 1021797 - RNA, 18 nt, Mycobacterium avium subsp. paratuberculosis
cagcgcgucgcacagcgc

SEQ ID NO: 1021798 - RNA, 22 nt, Mycobacterium avium subsp. paratuberculosis
cagcgcgucgcacagcgccgcg

SEQ ID NO: 1021799 - RNA, 16 nt, Mycobacterium avium subsp. paratuberculosis
cagcgcguccaggugc

SEQ ID NO: 1021800 - RNA, 15 nt, Mycobacterium avium subsp. paratuberculosis
cagcgcuacugccgc

SEQ ID NO: 1021801 - RNA, 19 nt, Mycobacterium avium subsp. paratuberculosis
cagcgcuacugccgcugcu

SEQ ID NO: 1021802 - RNA, 23 nt, Mycobacterium avium subsp. paratuberculosis
cagcgcgucggcgaccgcgcgcg

SEQ ID NO: 1021803 - RNA, 18 nt, Mycobacterium avium subsp. paratuberculosis
cagcgcgucggcgauguc

SEQ ID NO: 1021804 - RNA, 20 nt, Mycobacterium avium subsp. paratuberculosis
cagcgcgucgucgauggcca

SEQ ID NO: 1021805 - RNA, 23 nt, Mycobacterium avium subsp. paratuberculosis
cagcgcgucgucgauggccacca

SEQ ID NO: 1021806 - RNA, 17 nt, Mycobacterium avium subsp. paratuberculosis
cagcgcgugaccccggc

SEQ ID NO: 1021807 - RNA, 20 nt, Mycobacterium avium subsp. paratuberculosis
cagcggaaugaacgcggcca

SEQ ID NO: 1021808 - RNA, 23 nt, Mycobacterium avium subsp. paratuberculosis
cagcggaaugaacgcggccaggg

SEQ ID NO: 1021809 - RNA, 22 nt, Mycobacterium avium subsp. paratuberculosis
cagcccagguaaucgaaggcca

SEQ ID NO: 1021810 - RNA, 16 nt, Mycobacterium avium subsp. paratuberculosis
cagcccagccgccagc

SEQ ID NO: 1021811 - RNA, 17 nt, Mycobacterium avium subsp. paratuberculosis
cagcccaucccgauccg

SEQ ID NO: 1021812 - RNA, 14 nt, Mycobacterium avium subsp. paratuberculosis
cagccccaccaccg

SEQ ID NO: 1021813 - RNA, 15 nt, Mycobacterium avium subsp. paratuberculosis
cagccccaccggcca

SEQ ID NO: 1021814 - RNA, 14 nt, Mycobacterium avium subsp. paratuberculosis
cagcccccaccgcg

SEQ ID NO: 1021815 - RNA, 13 nt, Mycobacterium avium subsp. paratuberculosis
cagccccagcgga

SEQ ID NO: 1021816 - RNA, 17 nt, Mycobacterium avium subsp. paratuberculosis
cagccccagcgagcagg

SEQ ID NO: 1021817 - RNA, 22 nt, Mycobacterium avium subsp. paratuberculosis
cagccccagcgagcaggucacc

SEQ ID NO: 1021818 - RNA, 17 nt, Mycobacterium avium subsp. paratuberculosis
cagcccggccagccggg

SEQ ID NO: 1021819 - RNA, 12 nt, Mycobacterium avium subsp. paratuberculosis
cagcccggcccg

SEQ ID NO: 1021820 - RNA, 19 nt, Mycobacterium avium subsp. paratuberculosis
cagcccggcccgcaucgaa

SEQ ID NO: 1021821 - RNA, 13 nt, Mycobacterium avium subsp. paratuberculosis
cagcccggccagc

SEQ ID NO: 1021822 - RNA, 17 nt, Mycobacterium avium subsp. paratuberculosis
cagcccggccagcaccc

SEQ ID NO: 1021823 - RNA, 20 nt, Mycobacterium avium subsp. paratuberculosis
cagcccgcgucguguccggg

SEQ ID NO: 1021824 - RNA, 22 nt, Mycobacterium avium subsp. paratuberculosis
cagcccgcgcgagcgcagcgcc

SEQ ID NO: 1021825 - RNA, 18 nt, Mycobacterium avium subsp. paratuberculosis
cagcccgcugaccaggcc

SEQ ID NO: 1021826 - RNA, 21 nt, Mycobacterium avium subsp. paratuberculosis
cagcccgcggcagccagccug

SEQ ID NO: 1021827 - RNA, 18 nt, Mycobacterium avium subsp. paratuberculosis
cagcccgcgucgcgcagc

SEQ ID NO: 1021828 - RNA, 13 nt, Mycobacterium avium subsp. paratuberculosis
cagcccgccgcgu

SEQ ID NO: 1021829 - RNA, 12 nt, Mycobacterium avium subsp. paratuberculosis
cagcccgcccac

SEQ ID NO: 1021830 - RNA, 15 nt, Mycobacterium avium subsp. paratuberculosis
cagcccgcccaccac

SEQ ID NO: 1021831 - RNA, 15 nt, Mycobacterium avium subsp. paratuberculosis
cagcccgcccagcgc

SEQ ID NO: 1021832 - RNA, 13 nt, Mycobacterium avium subsp. paratuberculosis
cagcccgccgacc

SEQ ID NO: 1021833 - RNA, 17 nt, Mycobacterium avium subsp. paratuberculosis
cagcccgccgaccaccu

SEQ ID NO: 1021834 - RNA, 20 nt, Mycobacterium avium subsp. paratuberculosis
cagcccgauucagccggcgg

SEQ ID NO: 1021835 - RNA, 19 nt, Mycobacterium avium subsp. paratuberculosis
cagcccgaucacccccgac

SEQ ID NO: 1021836 - RNA, 17 nt, Mycobacterium avium subsp. paratuberculosis
cagcccgagcaccagcg

SEQ ID NO: 1021837 - RNA, 16 nt, Mycobacterium avium subsp. paratuberculosis
cagcccgagcggcauc

SEQ ID NO: 1021838 - RNA, 17 nt, Mycobacterium avium subsp. paratuberculosis
cagcccgaacagccggg

SEQ ID NO: 1021839 - RNA, 17 nt, Mycobacterium avium subsp. paratuberculosis
cagccccucgccgggcg

SEQ ID NO: 1021840 - RNA, 18 nt, Mycobacterium avium subsp. paratuberculosis
cagccccucgccgggcgu

SEQ ID NO: 1021841 - RNA, 13 nt, Mycobacterium avium subsp. paratuberculosis
cagccccgggaac

SEQ ID NO: 1021842 - RNA, 23 nt, Mycobacterium avium subsp. paratuberculosis
cagccccucggggcugcgcggcu

SEQ ID NO: 1021843 - RNA, 14 nt, Mycobacterium avium subsp. paratuberculosis
cagcccccgcgggu

SEQ ID NO: 1021844 - RNA, 16 nt, Mycobacterium avium subsp. paratuberculosis
cagccccgagccgcgg

SEQ ID NO: 1021845 - RNA, 18 nt, Mycobacterium avium subsp. paratuberculosis
cagccacucgccgugaga

SEQ ID NO: 1021846 - RNA, 15 nt, Mycobacterium avium subsp. paratuberculosis
cagcagcgcaccggc

SEQ ID NO: 1021847 - RNA, 15 nt, Mycobacterium avium subsp. paratuberculosis
cagcagcgaggccuc

SEQ ID NO: 1021848 - RNA, 23 nt, Mycobacterium avium subsp. paratuberculosis
cagcagcgacuugaccagcagcu

SEQ ID NO: 1021849 - RNA, 15 nt, Mycobacterium avium subsp. paratuberculosis
cagcagccgggccug

SEQ ID NO: 1021850 - RNA, 18 nt, Mycobacterium avium subsp. paratuberculosis
cagcagccgcucacacag

SEQ ID NO: 1021851 - RNA, 16 nt, Mycobacterium avium subsp. paratuberculosis
cagcagccgcugcugg

SEQ ID NO: 1021852 - RNA, 19 nt, Mycobacterium avium subsp. paratuberculosis
cagcagccgcugcugggug

SEQ ID NO: 1021853 - RNA, 17 nt, Mycobacterium avium subsp. paratuberculosis
cagcagccggaaggcca

SEQ ID NO: 1021854 - RNA, 21 nt, Mycobacterium avium subsp. paratuberculosis
cagcagccgcgccgacgccca

SEQ ID NO: 1021855 - RNA, 16 nt, Mycobacterium avium subsp. paratuberculosis
cagcagccgcgccgcc

SEQ ID NO: 1021856 - RNA, 20 nt, Mycobacterium avium subsp. paratuberculosis
cagcagccgcgccgccgcgu

SEQ ID NO: 1021857 - RNA, 17 nt, Mycobacterium avium subsp. paratuberculosis
cagcagccgcagcgcgc

SEQ ID NO: 1021858 - RNA, 12 nt, Mycobacterium avium subsp. paratuberculosis
cagcagccgcga

SEQ ID NO: 1021859 - RNA, 18 nt, Mycobacterium avium subsp. paratuberculosis
cagcagcccgucccggcc

SEQ ID NO: 1021860 - RNA, 20 nt, Mycobacterium avium subsp. paratuberculosis
cagcagcccgucccggccca

SEQ ID NO: 1021861 - RNA, 23 nt, Mycobacterium avium subsp. paratuberculosis
cagcagcccgucccggcccaugg

SEQ ID NO: 1021862 - RNA, 15 nt, Mycobacterium avium subsp. paratuberculosis
cagcagccaggacag

SEQ ID NO: 1021863 - RNA, 17 nt, Mycobacterium avium subsp. paratuberculosis
cagcagccaggacagcg

SEQ ID NO: 1021864 - RNA, 18 nt, Mycobacterium avium subsp. paratuberculosis
cagcagccacgacaccag

SEQ ID NO: 1021865 - RNA, 22 nt, Mycobacterium avium subsp. paratuberculosis
cagccagucgccggccaggccg

SEQ ID NO: 1021866 - RNA, 23 nt, Mycobacterium avium subsp. paratuberculosis
cagccaguugggggccagcgccg

SEQ ID NO: 1021867 - RNA, 20 nt, Mycobacterium avium subsp. paratuberculosis
cagccagguuggccagguug

SEQ ID NO: 1021868 - RNA, 13 nt, Mycobacterium avium subsp. paratuberculosis
cagccagcccagc

SEQ ID NO: 1021869 - RNA, 14 nt, Mycobacterium avium subsp. paratuberculosis
cagccagcccagcc

SEQ ID NO: 1021870 - RNA, 15 nt, Mycobacterium avium subsp. paratuberculosis
cagccagcccagccg

SEQ ID NO: 1021871 - RNA, 18 nt, Mycobacterium avium subsp. paratuberculosis
cagccagcccagccgcca

SEQ ID NO: 1021872 - RNA, 12 nt, Mycobacterium avium subsp. paratuberculosis
cagccagaccuc

SEQ ID NO: 1021873 - RNA, 17 nt, Mycobacterium avium subsp. paratuberculosis
cagccagaucgaggcca

SEQ ID NO: 1021874 - RNA, 14 nt, Mycobacterium avium subsp. paratuberculosis
cagcgaggcgcgca

SEQ ID NO: 1021875 - RNA, 19 nt, Mycobacterium avium subsp. paratuberculosis
cagcgaggggguggguccg

SEQ ID NO: 1021876 - RNA, 16 nt, Mycobacterium avium subsp. paratuberculosis
cagcgaggccucgccg

SEQ ID NO: 1021877 - RNA, 18 nt, Mycobacterium avium subsp. paratuberculosis
cagcgaggccucgccgcu

SEQ ID NO: 1021878 - RNA, 23 nt, Mycobacterium avium subsp. paratuberculosis
cagcgagucgaugaccucgcgcc

SEQ ID NO: 1021879 - RNA, 23 nt, Mycobacterium avium subsp. paratuberculosis
cagcgagucggcgaaggcgcgca

SEQ ID NO: 1021880 - RNA, 16 nt, Mycobacterium avium subsp. paratuberculosis
cagcgaguccagccag

SEQ ID NO: 1021881 - RNA, 17 nt, Mycobacterium avium subsp. paratuberculosis
cagcgaguccagccagc

SEQ ID NO: 1021882 - RNA, 17 nt, Mycobacterium avium subsp. paratuberculosis
cagcgcagcaucggcag

SEQ ID NO: 1021883 - RNA, 24 nt, Mycobacterium avium subsp. paratuberculosis
cagcgaucggcggcucgccggcgu

SEQ ID NO: 1021884 - RNA, 22 nt, Mycobacterium avium subsp. paratuberculosis
cagcgauugcggccgccggcca

SEQ ID NO: 1021885 - RNA, 16 nt, Mycobacterium avium subsp. paratuberculosis
cagcgacagcgcgucg

SEQ ID NO: 1021886 - RNA, 20 nt, Mycobacterium avium subsp. paratuberculosis
cagcgacagcgcgucggcca

SEQ ID NO: 1021887 - RNA, 23 nt, Mycobacterium avium subsp. paratuberculosis
cagccuucuuggcgggcgccuuc

SEQ ID NO: 1021888 - RNA, 16 nt, Mycobacterium avium subsp. paratuberculosis
cagccuuuccacaucu

SEQ ID NO: 1021889 - RNA, 23 nt, Mycobacterium avium subsp. paratuberculosis
cagccuucuucgccggggccuuc

SEQ ID NO: 1021890 - RNA, 17 nt, Mycobacterium avium subsp. paratuberculosis
cagcgacaugaccaccg

SEQ ID NO: 1021891 - RNA, 22 nt, Mycobacterium avium subsp. paratuberculosis
cagcgacgcggugagcgcgccg

SEQ ID NO: 1021892 - RNA, 14 nt, Mycobacterium avium subsp. paratuberculosis
cagcgaggacccgu

SEQ ID NO: 1021893 - RNA, 21 nt, Mycobacterium avium subsp. paratuberculosis
cagcgagcgguuggcgacgcu

SEQ ID NO: 1021894 - RNA, 17 nt, Mycobacterium avium subsp. paratuberculosis
cagcgagcucaggccgg

SEQ ID NO: 1021895 - RNA, 23 nt, Mycobacterium avium subsp. paratuberculosis
cagcgagcugccggcggccgccg

SEQ ID NO: 1021896 - RNA, 23 nt, Mycobacterium avium subsp. paratuberculosis
cagcgagcaggucaccggaugca

SEQ ID NO: 1021897 - RNA, 16 nt, Mycobacterium avium subsp. paratuberculosis
cagcgagcacagcggc

SEQ ID NO: 1021898 - RNA, 15 nt, Mycobacterium avium subsp. paratuberculosis
cagccguuguccacg

SEQ ID NO: 1021899 - RNA, 18 nt, Mycobacterium avium subsp. paratuberculosis
cagccguucgcugcccuc

SEQ ID NO: 1021900 - RNA, 23 nt, Mycobacterium avium subsp. paratuberculosis
cagccgucgucguccgcaaccgc

SEQ ID NO: 1021901 - RNA, 17 nt, Mycobacterium avium subsp. paratuberculosis
cagccgucgccgcgccc

SEQ ID NO: 1021902 - RNA, 14 nt, Mycobacterium avium subsp. paratuberculosis
cagccguccugguc

SEQ ID NO: 1021903 - RNA, 22 nt, Mycobacterium avium subsp. paratuberculosis
cagccgucgaucuugacgugga

SEQ ID NO: 1021904 - RNA, 17 nt, Mycobacterium avium subsp. paratuberculosis
cagccggugcgagccgc

SEQ ID NO: 1021905 - RNA, 19 nt, Mycobacterium avium subsp. paratuberculosis
cagccggugcgagccgcug

SEQ ID NO: 1021906 - RNA, 16 nt, Mycobacterium avium subsp. paratuberculosis
cagccgguccgaccgc

SEQ ID NO: 1021907 - RNA, 18 nt, Mycobacterium avium subsp. paratuberculosis
cagccgguggcggccacg

SEQ ID NO: 1021908 - RNA, 17 nt, Mycobacterium avium subsp. paratuberculosis
cagccgggugaacccga

SEQ ID NO: 1021909 - RNA, 21 nt, Mycobacterium avium subsp. paratuberculosis
cagccgggguagggcggcggg

SEQ ID NO: 1021910 - RNA, 19 nt, Mycobacterium avium subsp. paratuberculosis
cagccgggugcggugcagc

SEQ ID NO: 1021911 - RNA, 17 nt, Mycobacterium avium subsp. paratuberculosis
cagccggguggcccgcc

SEQ ID NO: 1021912 - RNA, 16 nt, Mycobacterium avium subsp. paratuberculosis
cagccgggccgcccgc

SEQ ID NO: 1021913 - RNA, 23 nt, Mycobacterium avium subsp. paratuberculosis
cagccgggccugcggcgcggcca

SEQ ID NO: 1021914 - RNA, 16 nt, Mycobacterium avium subsp. paratuberculosis
cagccgggcggcgccg

SEQ ID NO: 1021915 - RNA, 17 nt, Mycobacterium avium subsp. paratuberculosis
cagccgggcggcgccga

SEQ ID NO: 1021916 - RNA, 19 nt, Mycobacterium avium subsp. paratuberculosis
cagccgggcggcggccucc

SEQ ID NO: 1021917 - RNA, 18 nt, Mycobacterium avium subsp. paratuberculosis
cagccgggccagcccggg

SEQ ID NO: 1021918 - RNA, 15 nt, Mycobacterium avium subsp. paratuberculosis
cagccgggccgagcg

SEQ ID NO: 1021919 - RNA, 23 nt, Mycobacterium avium subsp. paratuberculosis
cagcccgggugcgaacagccacg

SEQ ID NO: 1021920 - RNA, 18 nt, Mycobacterium avium subsp. paratuberculosis
cagcccguacuugcuggc

SEQ ID NO: 1021921 - RNA, 13 nt, Mycobacterium avium subsp. paratuberculosis
cagccgcgccggg

SEQ ID NO: 1021922 - RNA, 14 nt, Mycobacterium avium subsp. paratuberculosis
cagccgcggacggc

SEQ ID NO: 1021923 - RNA, 20 nt, Mycobacterium avium subsp. paratuberculosis
cagccgcggacggccagccc

SEQ ID NO: 1021924 - RNA, 21 nt, Mycobacterium avium subsp. paratuberculosis
cagcccggcuaauucgggccg

SEQ ID NO: 1021925 - RNA, 17 nt, Mycobacterium avium subsp. paratuberculosis
cagcccggcugcgcagc

SEQ ID NO: 1021926 - RNA, 21 nt, Mycobacterium avium subsp. paratuberculosis
cagcccggcgguugauacucg

SEQ ID NO: 1021927 - RNA, 19 nt, Mycobacterium avium subsp. paratuberculosis
cagcccggcguacagcaau

SEQ ID NO: 1021928 - RNA, 21 nt, Mycobacterium avium subsp. paratuberculosis
cagcccggcgaacaccacggu

SEQ ID NO: 1021929 - RNA, 16 nt, Mycobacterium avium subsp. paratuberculosis
cagcccggcgacgaag

SEQ ID NO: 1021930 - RNA, 14 nt, Mycobacterium avium subsp. paratuberculosis
cagcccggccgccg

SEQ ID NO: 1021931 - RNA, 15 nt, Mycobacterium avium subsp. paratuberculosis
cagcccggcccagcc

SEQ ID NO: 1021932 - RNA, 17 nt, Mycobacterium avium subsp. paratuberculosis
cagcccggcccagccgg

SEQ ID NO: 1021933 - RNA, 17 nt, Mycobacterium avium subsp. paratuberculosis
cagccgcgcggccggcc

SEQ ID NO: 1021934 - RNA, 20 nt, Mycobacterium avium subsp. paratuberculosis
cagccgcgcggccggccacg

SEQ ID NO: 1021935 - RNA, 18 nt, Mycobacterium avium subsp. paratuberculosis
cagccgcggucuuuggcg

SEQ ID NO: 1021936 - RNA, 21 nt, Mycobacterium avium subsp. paratuberculosis
cagccgcgguucuuguccucg

SEQ ID NO: 1021937 - RNA, 23 nt, Mycobacterium avium subsp. paratuberculosis
cagccgcucccggcgcagcaacu

SEQ ID NO: 1021938 - RNA, 18 nt, Mycobacterium avium subsp. paratuberculosis
cagccgcuccgcggcggg

SEQ ID NO: 1021939 - RNA, 20 nt, Mycobacterium avium subsp. paratuberculosis
cagccgcugcagcgccgccc

SEQ ID NO: 1021940 - RNA, 16 nt, Mycobacterium avium subsp. paratuberculosis
cagccgcugccgcacc

SEQ ID NO: 1021941 - RNA, 17 nt, Mycobacterium avium subsp. paratuberculosis
cagccgcuggccgcgcc

SEQ ID NO: 1021942 - RNA, 18 nt, Mycobacterium avium subsp. paratuberculosis
cagccgcuggccgcgcca

SEQ ID NO: 1021943 - RNA, 14 nt, Mycobacterium avium subsp. paratuberculosis
cagccggcgcacca

SEQ ID NO: 1021944 - RNA, 17 nt, Mycobacterium avium subsp. paratuberculosis
cagccggcgcaccaggg

SEQ ID NO: 1021945 - RNA, 20 nt, Mycobacterium avium subsp. paratuberculosis
cagccggcgcccgcaggccg

SEQ ID NO: 1021946 - RNA, 15 nt, Mycobacterium avium subsp. paratuberculosis
cagccggcgcgcggu

SEQ ID NO: 1021947 - RNA, 23 nt, Mycobacterium avium subsp. paratuberculosis
cagccggcgcggcagggccaggc

SEQ ID NO: 1021948 - RNA, 21 nt, Mycobacterium avium subsp. paratuberculosis
cagccggcggaucgcgugcgu

SEQ ID NO: 1021949 - RNA, 14 nt, Mycobacterium avium subsp. paratuberculosis
cagguaaaccagca

SEQ ID NO: 1021950 - RNA, 19 nt, Mycobacterium avium subsp. paratuberculosis
cagguaaaccagcagcgcc

SEQ ID NO: 1021951 - RNA, 23 nt, Mycobacterium avium subsp. paratuberculosis
caggguguuguccgagccgccca

SEQ ID NO: 1021952 - RNA, 20 nt, Mycobacterium avium subsp. paratuberculosis
cagggugucgaacagcaggc

SEQ ID NO: 1021953 - RNA, 14 nt, Mycobacterium avium subsp. paratuberculosis
cagggucuucucga

SEQ ID NO: 1021954 - RNA, 22 nt, Mycobacterium avium subsp. paratuberculosis
cagggugcgcacgaucugcagg

SEQ ID NO: 1021955 - RNA, 23 nt, Mycobacterium avium subsp. paratuberculosis
cagggugcgcacgaucugcaggc

SEQ ID NO: 1021956 - RNA, 16 nt, Mycobacterium avium subsp. paratuberculosis
cagggugccgaacagc

SEQ ID NO: 1021957 - RNA, 15 nt, Mycobacterium avium subsp. paratuberculosis
cagggugccgacgac

SEQ ID NO: 1021958 - RNA, 21 nt, Mycobacterium avium subsp. paratuberculosis
cagggugccgauguaggacag

SEQ ID NO: 1021959 - RNA, 14 nt, Mycobacterium avium subsp. paratuberculosis
cagggugccgccgc

SEQ ID NO: 1021960 - RNA, 19 nt, Mycobacterium avium subsp. paratuberculosis
cagggugucgucgcgcacc

SEQ ID NO: 1021961 - RNA, 22 nt, Mycobacterium avium subsp. paratuberculosis
cagggugucgucgcgcacccag

SEQ ID NO: 1021962 - RNA, 17 nt, Mycobacterium avium subsp. paratuberculosis
caggguggccgccacca

SEQ ID NO: 1021963 - RNA, 18 nt, Mycobacterium avium subsp. paratuberculosis
caggguggccgccaccag

SEQ ID NO: 1021964 - RNA, 14 nt, Mycobacterium avium subsp. paratuberculosis
caggguggccagca

SEQ ID NO: 1021965 - RNA, 16 nt, Mycobacterium avium subsp. paratuberculosis
caggguggccagcacc

SEQ ID NO: 1021966 - RNA, 17 nt, Mycobacterium avium subsp. paratuberculosis
cagggugcguuccaggu

SEQ ID NO: 1021967 - RNA, 19 nt, Mycobacterium avium subsp. paratuberculosis
cagguacugcuugccgccg

SEQ ID NO: 1021968 - RNA, 14 nt, Mycobacterium avium subsp. paratuberculosis
cagguacuccucgg

SEQ ID NO: 1021969 - RNA, 14 nt, Mycobacterium avium subsp. paratuberculosis
cagguagaucgcca

SEQ ID NO: 1021970 - RNA, 21 nt, Mycobacterium avium subsp. paratuberculosis
cagguagacgaugcccagccc

SEQ ID NO: 1021971 - RNA, 16 nt, Mycobacterium avium subsp. paratuberculosis
cagguagcggcugacc

SEQ ID NO: 1021972 - RNA, 21 nt, Mycobacterium avium subsp. paratuberculosis
cagguagcggugcucgaugua

SEQ ID NO: 1021973 - RNA, 18 nt, Mycobacterium avium subsp. paratuberculosis
cagguagguggccgucgc

SEQ ID NO: 1021974 - RNA, 22 nt, Mycobacterium avium subsp. paratuberculosis
cagguaguacaggugcagcagc

SEQ ID NO: 1021975 - RNA, 19 nt, Mycobacterium avium subsp. paratuberculosis
cagguaguagcgcgccggg

SEQ ID NO: 1021976 - RNA, 16 nt, Mycobacterium avium subsp. paratuberculosis
cagguaggcggcgccg

SEQ ID NO: 1021977 - RNA, 14 nt, Mycobacterium avium subsp. paratuberculosis
cagguaggacaccg

SEQ ID NO: 1021978 - RNA, 14 nt, Mycobacterium avium subsp. paratuberculosis
cagguaggcgcccu

SEQ ID NO: 1021979 - RNA, 17 nt, Mycobacterium avium subsp. paratuberculosis
cagguaccggcgggcga

SEQ ID NO: 1021980 - RNA, 20 nt, Mycobacterium avium subsp. paratuberculosis
cagggcaacgaacgcggcgc

SEQ ID NO: 1021981 - RNA, 14 nt, Mycobacterium avium subsp. paratuberculosis
cagggaugccccgu

SEQ ID NO: 1021982 - RNA, 14 nt, Mycobacterium avium subsp. paratuberculosis
cagggccugcagca

SEQ ID NO: 1021983 - RNA, 16 nt, Mycobacterium avium subsp. paratuberculosis
cagggccugcagcacc

SEQ ID NO: 1021984 - RNA, 14 nt, Mycobacterium avium subsp. paratuberculosis
cagggcgauggcca

SEQ ID NO: 1021985 - RNA, 20 nt, Mycobacterium avium subsp. paratuberculosis
cagggcgaucaccgcggcca

SEQ ID NO: 1021986 - RNA, 15 nt, Mycobacterium avium subsp. paratuberculosis
cagggcgccgacgau

SEQ ID NO: 1021987 - RNA, 16 nt, Mycobacterium avium subsp. paratuberculosis
cagggcgacggcggcg

SEQ ID NO: 1021988 - RNA, 19 nt, Mycobacterium avium subsp. paratuberculosis
cagggcgaggaacccgacc

SEQ ID NO: 1021989 - RNA, 21 nt, Mycobacterium avium subsp. paratuberculosis
cagggcgacgccgcggaagcc

SEQ ID NO: 1021990 - RNA, 23 nt, Mycobacterium avium subsp. paratuberculosis
cagggcuuugcccuggucgaaga

SEQ ID NO: 1021991 - RNA, 15 nt, Mycobacterium avium subsp. paratuberculosis
caggggcagcagcag

SEQ ID NO: 1021992 - RNA, 18 nt, Mycobacterium avium subsp. paratuberculosis
cagggguuggcgcgcaga

SEQ ID NO: 1021993 - RNA, 15 nt, Mycobacterium avium subsp. paratuberculosis
cagggucagcagcac

SEQ ID NO: 1021994 - RNA, 15 nt, Mycobacterium avium subsp. paratuberculosis
cagggucgagaucag

SEQ ID NO: 1021995 - RNA, 19 nt, Mycobacterium avium subsp. paratuberculosis
cagggucgagaucagcacc

SEQ ID NO: 1021996 - RNA, 18 nt, Mycobacterium avium subsp. paratuberculosis
caggcugcccucuuccuc

SEQ ID NO: 1021997 - RNA, 15 nt, Mycobacterium avium subsp. paratuberculosis
caggcugaccagcgc

SEQ ID NO: 1021998 - RNA, 16 nt, Mycobacterium avium subsp. paratuberculosis
caggcucgcucccgcg

SEQ ID NO: 1021999 - RNA, 14 nt, Mycobacterium avium subsp. paratuberculosis
caggcggccggccc

SEQ ID NO: 1022000 - RNA, 18 nt, Mycobacterium avium subsp. paratuberculosis
caggcggccagggcggcg

SEQ ID NO: 1022001 - RNA, 13 nt, Mycobacterium avium subsp. paratuberculosis
caggcggccagca

SEQ ID NO: 1022002 - RNA, 16 nt, Mycobacterium avium subsp. paratuberculosis
caggcggccagcacca

SEQ ID NO: 1022003 - RNA, 13 nt, Mycobacterium avium subsp. paratuberculosis
caggcggaccugg

SEQ ID NO: 1022004 - RNA, 21 nt, Mycobacterium avium subsp. paratuberculosis
caggcggaccugggugcgcca

SEQ ID NO: 1022005 - RNA, 23 nt, Mycobacterium avium subsp. paratuberculosis
caggcggaccugggugcgccacu

SEQ ID NO: 1022006 - RNA, 11 nt, Mycobacterium avium subsp. paratuberculosis
caggcgggcca

SEQ ID NO: 1022007 - RNA, 22 nt, Mycobacterium avium subsp. paratuberculosis
caggcguuucgugugguacagc

SEQ ID NO: 1022008 - RNA, 20 nt, Mycobacterium avium subsp. paratuberculosis
caggcguugcaccgcgggca

SEQ ID NO: 1022009 - RNA, 22 nt, Mycobacterium avium subsp. paratuberculosis
caggcguggguuccgccgucga

SEQ ID NO: 1022010 - RNA, 22 nt, Mycobacterium avium subsp. paratuberculosis
caggcguggucggcgcggucca

SEQ ID NO: 1022011 - RNA, 13 nt, Mycobacterium avium subsp. paratuberculosis
caggcguggccca

SEQ ID NO: 1022012 - RNA, 15 nt, Mycobacterium avium subsp. paratuberculosis
caggcgagcacccgg

SEQ ID NO: 1022013 - RNA, 17 nt, Mycobacterium avium subsp. paratuberculosis
caggcgccacagcagca

SEQ ID NO: 1022014 - RNA, 13 nt, Mycobacterium avium subsp. paratuberculosis
caggcgccccagc

SEQ ID NO: 1022015 - RNA, 16 nt, Mycobacterium avium subsp. paratuberculosis
caggcgcccagcaccc

SEQ ID NO: 1022016 - RNA, 13 nt, Mycobacterium avium subsp. paratuberculosis
caggcgcccagga

SEQ ID NO: 1022017 - RNA, 16 nt, Mycobacterium avium subsp. paratuberculosis
caggcgcccaggauca

SEQ ID NO: 1022018 - RNA, 19 nt, Mycobacterium avium subsp. paratuberculosis
caggcgcccugcacgaaca

SEQ ID NO: 1022019 - RNA, 22 nt, Mycobacterium avium subsp. paratuberculosis
caggcgcccugcacgaacaacu

SEQ ID NO: 1022020 - RNA, 23 nt, Mycobacterium avium subsp. paratuberculosis
caggcgcgcgcuggugcgggcca

SEQ ID NO: 1022021 - RNA, 13 nt, Mycobacterium avium subsp. paratuberculosis
caggcgcgcggcc

SEQ ID NO: 1022022 - RNA, 17 nt, Mycobacterium avium subsp. paratuberculosis
caggcgcgcggccagcc

SEQ ID NO: 1022023 - RNA, 13 nt, Mycobacterium avium subsp. paratuberculosis
caggcgcgcacca

SEQ ID NO: 1022024 - RNA, 13 nt, Mycobacterium avium subsp. paratuberculosis
caggcgccgucga

SEQ ID NO: 1022025 - RNA, 22 nt, Mycobacterium avium subsp. paratuberculosis
caggcgccggccagcacggcca

SEQ ID NO: 1022026 - RNA, 17 nt, Mycobacterium avium subsp. paratuberculosis
caggcgcugagcgggua

SEQ ID NO: 1022027 - RNA, 16 nt, Mycobacterium avium subsp. paratuberculosis
caggccaacagcagca

SEQ ID NO: 1022028 - RNA, 18 nt, Mycobacterium avium subsp. paratuberculosis
caggccguuguggccacc

SEQ ID NO: 1022029 - RNA, 17 nt, Mycobacterium avium subsp. paratuberculosis
caggccgugaucggcca

SEQ ID NO: 1022030 - RNA, 20 nt, Mycobacterium avium subsp. paratuberculosis
caggccgugcacgaacaggg

SEQ ID NO: 1022031 - RNA, 16 nt, Mycobacterium avium subsp. paratuberculosis
caggccguccagcagc

SEQ ID NO: 1022032 - RNA, 18 nt, Mycobacterium avium subsp. paratuberculosis
caggccgucucgagccgg

SEQ ID NO: 1022033 - RNA, 16 nt, Mycobacterium avium subsp. paratuberculosis
caggccacaugggcca

SEQ ID NO: 1022034 - RNA, 14 nt, Mycobacterium avium subsp. paratuberculosis
caggcgaagguggg

SEQ ID NO: 1022035 - RNA, 22 nt, Mycobacterium avium subsp. paratuberculosis
caggcgaaggugggcagcgcca

SEQ ID NO: 1022036 - RNA, 22 nt, Mycobacterium avium subsp. paratuberculosis
caggcgaaguuggucaccacca

SEQ ID NO: 1022037 - RNA, 16 nt, Mycobacterium avium subsp. paratuberculosis
caggcacucgcccagg

SEQ ID NO: 1022038 - RNA, 20 nt, Mycobacterium avium subsp. paratuberculosis
caggcacugaucccuccguc

SEQ ID NO: 1022039 - RNA, 17 nt, Mycobacterium avium subsp. paratuberculosis
caggcagaagcuccacg

SEQ ID NO: 1022040 - RNA, 23 nt, Mycobacterium avium subsp. paratuberculosis
caggcagaagcuccacgccgccg

SEQ ID NO: 1022041 - RNA, 15 nt, Mycobacterium avium subsp. paratuberculosis
caggcagacccccag

SEQ ID NO: 1022042 - RNA, 17 nt, Mycobacterium avium subsp. paratuberculosis
caggcagacccccagca

SEQ ID NO: 1022043 - RNA, 19 nt, Mycobacterium avium subsp. paratuberculosis
caggcagacccccagcagc

SEQ ID NO: 1022044 - RNA, 14 nt, Mycobacterium avium subsp. paratuberculosis
caggcaggcggcca

SEQ ID NO: 1022045 - RNA, 19 nt, Mycobacterium avium subsp. paratuberculosis
caggcagcccggcugcgca

SEQ ID NO: 1022046 - RNA, 19 nt, Mycobacterium avium subsp. paratuberculosis
caggcaggccccuccagcu

SEQ ID NO: 1022047 - RNA, 23 nt, Mycobacterium avium subsp. paratuberculosis
caggauucccgaccccgccagca

SEQ ID NO: 1022048 - RNA, 16 nt, Mycobacterium avium subsp. paratuberculosis
caggcacacgaacacc

SEQ ID NO: 1022049 - RNA, 20 nt, Mycobacterium avium subsp. paratuberculosis
caggacgaaaaccaggaacg

SEQ ID NO: 1022050 - RNA, 15 nt, Mycobacterium avium subsp. paratuberculosis
caggacgaacgcugg

SEQ ID NO: 1022051 - RNA, 13 nt, Mycobacterium avium subsp. paratuberculosis
caggagggccagg

SEQ ID NO: 1022052 - RNA, 13 nt, Mycobacterium avium subsp. paratuberculosis
caggaggcggcca

SEQ ID NO: 1022053 - RNA, 16 nt, Mycobacterium avium subsp. paratuberculosis
caggaggcggccaaca

SEQ ID NO: 1022054 - RNA, 13 nt, Mycobacterium avium subsp. paratuberculosis
caggaggcacugg

SEQ ID NO: 1022055 - RNA, 13 nt, Mycobacterium avium subsp. paratuberculosis
caggaccacccac

SEQ ID NO: 1022056 - RNA, 21 nt, Mycobacterium avium subsp. paratuberculosis
caggaccacccacucccagcc

SEQ ID NO: 1022057 - RNA, 15 nt, Mycobacterium avium subsp. paratuberculosis
caggaccgcgcgccg

SEQ ID NO: 1022058 - RNA, 17 nt, Mycobacterium avium subsp. paratuberculosis
caggaccggauccacca

SEQ ID NO: 1022059 - RNA, 15 nt, Mycobacterium avium subsp. paratuberculosis
caggaccugaccgaa

SEQ ID NO: 1022060 - RNA, 21 nt, Mycobacterium avium subsp. paratuberculosis
caggacccggugcccaccguc

SEQ ID NO: 1022061 - RNA, 22 nt, Mycobacterium avium subsp. paratuberculosis
caggacccguacuucucgaaga

SEQ ID NO: 1022062 - RNA, 15 nt, Mycobacterium avium subsp. paratuberculosis
caggaccgagccgcg

SEQ ID NO: 1022063 - RNA, 16 nt, Mycobacterium avium subsp. paratuberculosis
caggaccgagccgcgc

SEQ ID NO: 1022064 - RNA, 18 nt, Mycobacterium avium subsp. paratuberculosis
caggacagcgucagcccc

SEQ ID NO: 1022065 - RNA, 16 nt, Mycobacterium avium subsp. paratuberculosis
caggaucacgcggcgg

SEQ ID NO: 1022066 - RNA, 19 nt, Mycobacterium avium subsp. paratuberculosis
caggaucagcacuucaugg

SEQ ID NO: 1022067 - RNA, 13 nt, Mycobacterium avium subsp. paratuberculosis
caggaucagcagc

SEQ ID NO: 1022068 - RNA, 22 nt, Mycobacterium avium subsp. paratuberculosis
caggagugguagggcuccgcgc

SEQ ID NO: 1022069 - RNA, 16 nt, Mycobacterium avium subsp. paratuberculosis
caggauccgcaccggg

SEQ ID NO: 1022070 - RNA, 16 nt, Mycobacterium avium subsp. paratuberculosis
caggauccgcucgacg

SEQ ID NO: 1022071 - RNA, 21 nt, Mycobacterium avium subsp. paratuberculosis
caggaucgagccggccgucag

SEQ ID NO: 1022072 - RNA, 17 nt, Mycobacterium avium subsp. paratuberculosis
caggauguacccgcagg

SEQ ID NO: 1022073 - RNA, 18 nt, Mycobacterium avium subsp. paratuberculosis
caggauguacccgcaggc

SEQ ID NO: 1022074 - RNA, 21 nt, Mycobacterium avium subsp. paratuberculosis
caggaugucuccgcgcagcca

SEQ ID NO: 1022075 - RNA, 13 nt, Mycobacterium avium subsp. paratuberculosis
caggauggugaaa

SEQ ID NO: 1022076 - RNA, 19 nt, Mycobacterium avium subsp. paratuberculosis
caggaugcguucggccagu

SEQ ID NO: 1022077 - RNA, 23 nt, Mycobacterium avium subsp. paratuberculosis
caggaugcguuggccgagcagcc

SEQ ID NO: 1022078 - RNA, 20 nt, Mycobacterium avium subsp. paratuberculosis
caggauggagcugaccuggc

SEQ ID NO: 1022079 - RNA, 17 nt, Mycobacterium avium subsp. paratuberculosis
caggaugcuggggucgg

SEQ ID NO: 1022080 - RNA, 18 nt, Mycobacterium avium subsp. paratuberculosis
caggauggccugcacggu

SEQ ID NO: 1022081 - RNA, 14 nt, Mycobacterium avium subsp. paratuberculosis
caggaugccgaugu

SEQ ID NO: 1022082 - RNA, 16 nt, Mycobacterium avium subsp. paratuberculosis
cagcuuccgccucggc

SEQ ID NO: 1022083 - RNA, 15 nt, Mycobacterium avium subsp. paratuberculosis
cagcugguccggccg

SEQ ID NO: 1022084 - RNA, 16 nt, Mycobacterium avium subsp. paratuberculosis
cagcugguccggccgg

SEQ ID NO: 1022085 - RNA, 18 nt, Mycobacterium avium subsp. paratuberculosis
cagcugguccggccggcc

SEQ ID NO: 1022086 - RNA, 17 nt, Mycobacterium avium subsp. paratuberculosis
cagcuggccgugcaccg

SEQ ID NO: 1022087 - RNA, 21 nt, Mycobacterium avium subsp. paratuberculosis
cagcuggcgaauccgggccuc

SEQ ID NO: 1022088 - RNA, 20 nt, Mycobacterium avium subsp. paratuberculosis
cagcugggacagcgucacca

SEQ ID NO: 1022089 - RNA, 15 nt, Mycobacterium avium subsp. paratuberculosis
cagcugggaggcgca

SEQ ID NO: 1022090 - RNA, 14 nt, Mycobacterium avium subsp. paratuberculosis
cagcugggcagcca

SEQ ID NO: 1022091 - RNA, 22 nt, Mycobacterium avium subsp. paratuberculosis
cagcuucggcgccgagcacgaa

SEQ ID NO: 1022092 - RNA, 16 nt, Mycobacterium avium subsp. paratuberculosis
cagcuucucggcgucc

SEQ ID NO: 1022093 - RNA, 18 nt, Mycobacterium avium subsp. paratuberculosis
cagcuucugcagcucgcu

SEQ ID NO: 1022094 - RNA, 18 nt, Mycobacterium avium subsp. paratuberculosis
cagcuuggcgcccuugcc

SEQ ID NO: 1022095 - RNA, 22 nt, Mycobacterium avium subsp. paratuberculosis
cagcuuguucgagaguuugccc

SEQ ID NO: 1022096 - RNA, 21 nt, Mycobacterium avium subsp. paratuberculosis
cagcuugucguagcggcgcca

SEQ ID NO: 1022097 - RNA, 22 nt, Mycobacterium avium subsp. paratuberculosis
caggaaaaccagcgacgccagc

SEQ ID NO: 1022098 - RNA, 16 nt, Mycobacterium avium subsp. paratuberculosis
caggaaagcgucacag

SEQ ID NO: 1022099 - RNA, 16 nt, Mycobacterium avium subsp. paratuberculosis
caggaaaggaaggcgc

SEQ ID NO: 1022100 - RNA, 21 nt, Mycobacterium avium subsp. paratuberculosis
caggaaaggaaggcgcaugcc

SEQ ID NO: 1022101 - RNA, 16 nt, Mycobacterium avium subsp. paratuberculosis
caggaacggcacccgc

SEQ ID NO: 1022102 - RNA, 20 nt, Mycobacterium avium subsp. paratuberculosis
caggaacggccggauggcca

SEQ ID NO: 1022103 - RNA, 15 nt, Mycobacterium avium subsp. paratuberculosis
caggaacgggccggc

SEQ ID NO: 1022104 - RNA, 22 nt, Mycobacterium avium subsp. paratuberculosis
caggaacgucuccuggggcaga

SEQ ID NO: 1022105 - RNA, 17 nt, Mycobacterium avium subsp. paratuberculosis
caggaacuccagcagcu

SEQ ID NO: 1022106 - RNA, 23 nt, Mycobacterium avium subsp. paratuberculosis
caggaacuggucgaacagcgcgc

SEQ ID NO: 1022107 - RNA, 16 nt, Mycobacterium avium subsp. paratuberculosis
cagcugcacccgcucc

SEQ ID NO: 1022108 - RNA, 18 nt, Mycobacterium avium subsp. paratuberculosis
cagcugcaccggggccgg

SEQ ID NO: 1022109 - RNA, 15 nt, Mycobacterium avium subsp. paratuberculosis
cagcugcauggacag

SEQ ID NO: 1022110 - RNA, 16 nt, Mycobacterium avium subsp. paratuberculosis
cagcugcccaccagca

SEQ ID NO: 1022111 - RNA, 22 nt, Mycobacterium avium subsp. paratuberculosis
cagcugauucgcgguggcgaac

SEQ ID NO: 1022112 - RNA, 22 nt, Mycobacterium avium subsp. paratuberculosis
cagcugcccgccgacgcccagg

SEQ ID NO: 1022113 - RNA, 12 nt, Mycobacterium avium subsp. paratuberculosis
cagcugcccgga

SEQ ID NO: 1022114 - RNA, 23 nt, Mycobacterium avium subsp. paratuberculosis
cagcugauagcccgccgcggcga

SEQ ID NO: 1022115 - RNA, 17 nt, Mycobacterium avium subsp. paratuberculosis
cagcugauagccgcccu

SEQ ID NO: 1022116 - RNA, 20 nt, Mycobacterium avium subsp. paratuberculosis
cagcugauagccgcccugcc

SEQ ID NO: 1022117 - RNA, 14 nt, Mycobacterium avium subsp. paratuberculosis
cagcugagcagccc

SEQ ID NO: 1022118 - RNA, 23 nt, Mycobacterium avium subsp. paratuberculosis
cagcugacgauucuugaccaccu

SEQ ID NO: 1022119 - RNA, 14 nt, Mycobacterium avium subsp. paratuberculosis
cagcugaagguugu

SEQ ID NO: 1022120 - RNA, 15 nt, Mycobacterium avium subsp. paratuberculosis
cagcugacgggccgg

SEQ ID NO: 1022121 - RNA, 21 nt, Mycobacterium avium subsp. paratuberculosis
cagcugcuggcugcggccccg

SEQ ID NO: 1022122 - RNA, 20 nt, Mycobacterium avium subsp. paratuberculosis
cagcugcucgagcaucucca

SEQ ID NO: 1022123 - RNA, 18 nt, Mycobacterium avium subsp. paratuberculosis
cagcugcucggccaccgc

SEQ ID NO: 1022124 - RNA, 20 nt, Mycobacterium avium subsp. paratuberculosis
cagcugcucggccaccgcgc

SEQ ID NO: 1022125 - RNA, 15 nt, Mycobacterium avium subsp. paratuberculosis
cagcugcgacagcac

SEQ ID NO: 1022126 - RNA, 23 nt, Mycobacterium avium subsp. paratuberculosis
cagcugcgacagcacgggcgggc

SEQ ID NO: 1022127 - RNA, 21 nt, Mycobacterium avium subsp. paratuberculosis
cagcugcgcgucggccgcaca

SEQ ID NO: 1022128 - RNA, 22 nt, Mycobacterium avium subsp. paratuberculosis
cagcugcgcgccggcggccgcc

SEQ ID NO: 1022129 - RNA, 18 nt, Mycobacterium avium subsp. paratuberculosis
cagcugccggccguugcg

SEQ ID NO: 1022130 - RNA, 18 nt, Mycobacterium avium subsp. paratuberculosis
cagcugcgggaccagcgc

SEQ ID NO: 1022131 - RNA, 17 nt, Mycobacterium avium subsp. paratuberculosis
cagcugcgucggcacca

SEQ ID NO: 1022132 - RNA, 20 nt, Mycobacterium avium subsp. paratuberculosis
cagcugaacacgaacccggc

SEQ ID NO: 1022133 - RNA, 21 nt, Mycobacterium avium subsp. paratuberculosis
cagcugaacacgaacccggcg

SEQ ID NO: 1022134 - RNA, 16 nt, Mycobacterium avium subsp. paratuberculosis
cagcucgucgccgacc

SEQ ID NO: 1022135 - RNA, 16 nt, Mycobacterium avium subsp. paratuberculosis
cagcucgucggcgcgc

SEQ ID NO: 1022136 - RNA, 18 nt, Mycobacterium avium subsp. paratuberculosis
cagcucgucggcgcgcca

SEQ ID NO: 1022137 - RNA, 21 nt, Mycobacterium avium subsp. paratuberculosis
cagcucgucgugggugacccg

SEQ ID NO: 1022138 - RNA, 16 nt, Mycobacterium avium subsp. paratuberculosis
cagcucgucgagccgg

SEQ ID NO: 1022139 - RNA, 16 nt, Mycobacterium avium subsp. paratuberculosis
cagcucgucgcggaac

SEQ ID NO: 1022140 - RNA, 13 nt, Mycobacterium avium subsp. paratuberculosis
cagcucgggcagc

SEQ ID NO: 1022141 - RNA, 14 nt, Mycobacterium avium subsp. paratuberculosis
cagcucggcggcca

SEQ ID NO: 1022142 - RNA, 17 nt, Mycobacterium avium subsp. paratuberculosis
cagcucggucagccggg

SEQ ID NO: 1022143 - RNA, 20 nt, Mycobacterium avium subsp. paratuberculosis
cagcucggugaucugcacca

SEQ ID NO: 1022144 - RNA, 23 nt, Mycobacterium avium subsp. paratuberculosis
cagcucggugaucugcaccagcg

SEQ ID NO: 1022145 - RNA, 16 nt, Mycobacterium avium subsp. paratuberculosis
cagcucgucagcgcgg

SEQ ID NO: 1022146 - RNA, 23 nt, Mycobacterium avium subsp. paratuberculosis
cagcucgucagcgcgggccagca

SEQ ID NO: 1022147 - RNA, 19 nt, Mycobacterium avium subsp. paratuberculosis
cagcucggcgaucaccgcg

SEQ ID NO: 1022148 - RNA, 15 nt, Mycobacterium avium subsp. paratuberculosis
cagcucggcgggcuc

SEQ ID NO: 1022149 - RNA, 23 nt, Mycobacterium avium subsp. paratuberculosis
cagcguuuccagcgccggcacca

SEQ ID NO: 1022150 - RNA, 13 nt, Mycobacterium avium subsp. paratuberculosis
cagcaacagcagc

SEQ ID NO: 1022151 - RNA, 15 nt, Mycobacterium avium subsp. paratuberculosis
cagcaacaccagcug

SEQ ID NO: 1022152 - RNA, 22 nt, Mycobacterium avium subsp. paratuberculosis
cagcaacgguacgugcgccggc

SEQ ID NO: 1022153 - RNA, 14 nt, Mycobacterium avium subsp. paratuberculosis
cagcaacugaccga

SEQ ID NO: 1022154 - RNA, 14 nt, Mycobacterium avium subsp. paratuberculosis
cagauccagaugcc

SEQ ID NO: 1022155 - RNA, 21 nt, Mycobacterium avium subsp. paratuberculosis
cagaucccgccggcggccacg

SEQ ID NO: 1022156 - RNA, 22 nt, Mycobacterium avium subsp. paratuberculosis
cagcaaacccagcaccaacagc

SEQ ID NO: 1022157 - RNA, 20 nt, Mycobacterium avium subsp. paratuberculosis
cagcacgucggucagcgagc

SEQ ID NO: 1022158 - RNA, 15 nt, Mycobacterium avium subsp. paratuberculosis
cagcacguccccggg

SEQ ID NO: 1022159 - RNA, 16 nt, Mycobacterium avium subsp. paratuberculosis
cagcacgucaccgcug

SEQ ID NO: 1022160 - RNA, 15 nt, Mycobacterium avium subsp. paratuberculosis
cagcacgggcgggca

SEQ ID NO: 1022161 - RNA, 17 nt, Mycobacterium avium subsp. paratuberculosis
cagcacgggcgggcaga

SEQ ID NO: 1022162 - RNA, 17 nt, Mycobacterium avium subsp. paratuberculosis
cagcacggucagcggcc

SEQ ID NO: 1022163 - RNA, 18 nt, Mycobacterium avium subsp. paratuberculosis
cagcacggucagcggcca

SEQ ID NO: 1022164 - RNA, 20 nt, Mycobacterium avium subsp. paratuberculosis
cagcagcaccgcauggggca

SEQ ID NO: 1022165 - RNA, 21 nt, Mycobacterium avium subsp. paratuberculosis
cagcagcaccgcauggggcag

SEQ ID NO: 1022166 - RNA, 13 nt, Mycobacterium avium subsp. paratuberculosis
cagcagcaccgcg

SEQ ID NO: 1022167 - RNA, 12 nt, Mycobacterium avium subsp. paratuberculosis
cagcagcaccag

SEQ ID NO: 1022168 - RNA, 14 nt, Mycobacterium avium subsp. paratuberculosis
cagcagcaccagcg

SEQ ID NO: 1022169 - RNA, 14 nt, Mycobacterium avium subsp. paratuberculosis
cagcagcacccggg

SEQ ID NO: 1022170 - RNA, 17 nt, Mycobacterium avium subsp. paratuberculosis
cagcagcacccggguga

SEQ ID NO: 1022171 - RNA, 15 nt, Mycobacterium avium subsp. paratuberculosis
cagcagcacccgguc

SEQ ID NO: 1022172 - RNA, 11 nt, Mycobacterium avium subsp. paratuberculosis
cagcagaugcc

SEQ ID NO: 1022173 - RNA, 17 nt, Mycobacterium avium subsp. paratuberculosis
cagcagaugcgccucga

SEQ ID NO: 1022174 - RNA, 15 nt, Mycobacterium avium subsp. paratuberculosis
cagcagaugcgugcg

SEQ ID NO: 1022175 - RNA, 13 nt, Mycobacterium avium subsp. paratuberculosis
cagcagcacgccc

SEQ ID NO: 1022176 - RNA, 15 nt, Mycobacterium avium subsp. paratuberculosis
cagcagcaccggcgc

SEQ ID NO: 1022177 - RNA, 14 nt, Mycobacterium avium subsp. paratuberculosis
cagcagcaccugga

SEQ ID NO: 1022178 - RNA, 16 nt, Mycobacterium avium subsp. paratuberculosis
cagcagcaccuggauc

SEQ ID NO: 1022179 - RNA, 17 nt, Mycobacterium avium subsp. paratuberculosis
cagcagcagcgccgcca

SEQ ID NO: 1022180 - RNA, 14 nt, Mycobacterium avium subsp. paratuberculosis
cagcagcagcacca

SEQ ID NO: 1022181 - RNA, 13 nt, Mycobacterium avium subsp. paratuberculosis
cagcagcagccac

SEQ ID NO: 1022182 - RNA, 14 nt, Mycobacterium avium subsp. paratuberculosis
cagcagcagccacg

SEQ ID NO: 1022183 - RNA, 11 nt, Mycobacterium avium subsp. paratuberculosis
cagcagcaggu

SEQ ID NO: 1022184 - RNA, 17 nt, Mycobacterium avium subsp. paratuberculosis
cagcagcaggucggcca

SEQ ID NO: 1022185 - RNA, 15 nt, Mycobacterium avium subsp. paratuberculosis
cagcagcagcgcggc

SEQ ID NO: 1022186 - RNA, 17 nt, Mycobacterium avium subsp. paratuberculosis
cagcaccaacagcggcc

SEQ ID NO: 1022187 - RNA, 13 nt, Mycobacterium avium subsp. paratuberculosis
cagcaccaccguc

SEQ ID NO: 1022188 - RNA, 20 nt, Mycobacterium avium subsp. paratuberculosis
cagcaccaccgucaccgccg

SEQ ID NO: 1022189 - RNA, 12 nt, Mycobacterium avium subsp. paratuberculosis
cagcaccaccuc

SEQ ID NO: 1022190 - RNA, 14 nt, Mycobacterium avium subsp. paratuberculosis
cagcaccacccgca

SEQ ID NO: 1022191 - RNA, 11 nt, Mycobacterium avium subsp. paratuberculosis
cagcaccacca

SEQ ID NO: 1022192 - RNA, 20 nt, Mycobacterium avium subsp. paratuberculosis
cagcaccaccaacagcagcg

SEQ ID NO: 1022193 - RNA, 13 nt, Mycobacterium avium subsp. paratuberculosis
cagcaccaccacg

SEQ ID NO: 1022194 - RNA, 19 nt, Mycobacterium avium subsp. paratuberculosis
cagcaccaccacgcuggcc

SEQ ID NO: 1022195 - RNA, 12 nt, Mycobacterium avium subsp. paratuberculosis
cagcaccagcac

SEQ ID NO: 1022196 - RNA, 20 nt, Mycobacterium avium subsp. paratuberculosis
cagcaccacuuccagcaccg

SEQ ID NO: 1022197 - RNA, 24 nt, Mycobacterium avium subsp. paratuberculosis
cagcaccacuuccagcaccggcug

SEQ ID NO: 1022198 - RNA, 15 nt, Mycobacterium avium subsp. paratuberculosis
cagcaccagcgccgc

SEQ ID NO: 1022199 - RNA, 13 nt, Mycobacterium avium subsp. paratuberculosis
cagcaccagcagc

SEQ ID NO: 1022200 - RNA, 20 nt, Mycobacterium avium subsp. paratuberculosis
cagcaccagcccgaugccgc

SEQ ID NO: 1022201 - RNA, 12 nt, Mycobacterium avium subsp. paratuberculosis
cagcaccagcgc

SEQ ID NO: 1022202 - RNA, 14 nt, Mycobacterium avium subsp. paratuberculosis
cagcaccagcgcgc

SEQ ID NO: 1022203 - RNA, 14 nt, Mycobacterium avium subsp. paratuberculosis
cagcaccagcgugg

SEQ ID NO: 1022204 - RNA, 22 nt, Mycobacterium avium subsp. paratuberculosis
cagcaccaggcugaccagcgcc

SEQ ID NO: 1022205 - RNA, 22 nt, Mycobacterium avium subsp. paratuberculosis
cagcaccaggcccucgccgcgg

SEQ ID NO: 1022206 - RNA, 16 nt, Mycobacterium avium subsp. paratuberculosis
cagcaccagggucuuc

SEQ ID NO: 1022207 - RNA, 19 nt, Mycobacterium avium subsp. paratuberculosis
cagcaccaguugcaccggc

SEQ ID NO: 1022208 - RNA, 16 nt, Mycobacterium avium subsp. paratuberculosis
cagcaccgacuccucc

SEQ ID NO: 1022209 - RNA, 22 nt, Mycobacterium avium subsp. paratuberculosis
cagcaccgacuccuccggcccg

SEQ ID NO: 1022210 - RNA, 23 nt, Mycobacterium avium subsp. paratuberculosis
cagcaccgaaucgccgagcucga

SEQ ID NO: 1022211 - RNA, 15 nt, Mycobacterium avium subsp. paratuberculosis
cagcaccgccccggu

SEQ ID NO: 1022212 - RNA, 16 nt, Mycobacterium avium subsp. paratuberculosis
cagcaccgcauggggc

SEQ ID NO: 1022213 - RNA, 16 nt, Mycobacterium avium subsp. paratuberculosis
cagcaccgccacgucu

SEQ ID NO: 1022214 - RNA, 16 nt, Mycobacterium avium subsp. paratuberculosis
cagcaccgccagcauc

SEQ ID NO: 1022215 - RNA, 14 nt, Mycobacterium avium subsp. paratuberculosis
cagcaccgccagcg

SEQ ID NO: 1022216 - RNA, 22 nt, Mycobacterium avium subsp. paratuberculosis
cagcaccgcgaacaucgccagc

SEQ ID NO: 1022217 - RNA, 15 nt, Mycobacterium avium subsp. paratuberculosis
cagcaccgccgcggc

SEQ ID NO: 1022218 - RNA, 17 nt, Mycobacterium avium subsp. paratuberculosis
cagcaccgccgcgggcu

SEQ ID NO: 1022219 - RNA, 13 nt, Mycobacterium avium subsp. paratuberculosis
cagcaccgccucg

SEQ ID NO: 1022220 - RNA, 13 nt, Mycobacterium avium subsp. paratuberculosis
cagcaccgcgacc

SEQ ID NO: 1022221 - RNA, 15 nt, Mycobacterium avium subsp. paratuberculosis
cagcaccgcgaccgg

SEQ ID NO: 1022222 - RNA, 16 nt, Mycobacterium avium subsp. paratuberculosis
cagcaccuccgacagc

SEQ ID NO: 1022223 - RNA, 20 nt, Mycobacterium avium subsp. paratuberculosis
cagcaccuccgacagccccc

SEQ ID NO: 1022224 - RNA, 16 nt, Mycobacterium avium subsp. paratuberculosis
cagcaccuccugggug

SEQ ID NO: 1022225 - RNA, 15 nt, Mycobacterium avium subsp. paratuberculosis
cagcaccucgcgcgc

SEQ ID NO: 1022226 - RNA, 20 nt, Mycobacterium avium subsp. paratuberculosis
cagcaccugaccgucggcca

SEQ ID NO: 1022227 - RNA, 19 nt, Mycobacterium avium subsp. paratuberculosis
cagcaccuugcccaggugc

SEQ ID NO: 1022228 - RNA, 14 nt, Mycobacterium avium subsp. paratuberculosis
cagcaccuucagcg

SEQ ID NO: 1022229 - RNA, 22 nt, Mycobacterium avium subsp. paratuberculosis
cagcaccuucagcgggcgcagc

SEQ ID NO: 1022230 - RNA, 13 nt, Mycobacterium avium subsp. paratuberculosis
cagcacggcaucg

SEQ ID NO: 1022231 - RNA, 16 nt, Mycobacterium avium subsp. paratuberculosis
cagcacggccagccag

SEQ ID NO: 1022232 - RNA, 14 nt, Mycobacterium avium subsp. paratuberculosis
cagcacggccgcca

SEQ ID NO: 1022233 - RNA, 23 nt, Mycobacterium avium subsp. paratuberculosis
cagcacgcugaucaccacgguca

SEQ ID NO: 1022234 - RNA, 19 nt, Mycobacterium avium subsp. paratuberculosis
cagcacgcugaagcccacc

SEQ ID NO: 1022235 - RNA, 21 nt, Mycobacterium avium subsp. paratuberculosis
cagcacgacgccgcugggcgu

SEQ ID NO: 1022236 - RNA, 19 nt, Mycobacterium avium subsp. paratuberculosis
cagauagguggucucccag

SEQ ID NO: 1022237 - RNA, 22 nt, Mycobacterium avium subsp. paratuberculosis
cagaucacguugauccgaugca

SEQ ID NO: 1022238 - RNA, 20 nt, Mycobacterium avium subsp. paratuberculosis
cagauaggcggcgacggcgu

SEQ ID NO: 1022239 - RNA, 22 nt, Mycobacterium avium subsp. paratuberculosis
cagagcggugacaucgccaccu

SEQ ID NO: 1022240 - RNA, 14 nt, Mycobacterium avium subsp. paratuberculosis
cagacugaugaagc

SEQ ID NO: 1022241 - RNA, 20 nt, Mycobacterium avium subsp. paratuberculosis
cagacugcgcaccgccagca

SEQ ID NO: 1022242 - RNA, 23 nt, Mycobacterium avium subsp. paratuberculosis
cagacugcgcaccgccagcaccg

SEQ ID NO: 1022243 - RNA, 13 nt, Mycobacterium avium subsp. paratuberculosis
cagacguccagcg

SEQ ID NO: 1022244 - RNA, 15 nt, Mycobacterium avium subsp. paratuberculosis
cagacguccagcgcc

SEQ ID NO: 1022245 - RNA, 20 nt, Mycobacterium avium subsp. paratuberculosis
cagacguccagcgccgccau

SEQ ID NO: 1022246 - RNA, 13 nt, Mycobacterium avium subsp. paratuberculosis
cagacgguuccac

SEQ ID NO: 1022247 - RNA, 19 nt, Mycobacterium avium subsp. paratuberculosis
cagacgguaugcccgccgc

SEQ ID NO: 1022248 - RNA, 19 nt, Mycobacterium avium subsp. paratuberculosis
cagacgaacgcggccgcca

SEQ ID NO: 1022249 - RNA, 13 nt, Mycobacterium avium subsp. paratuberculosis
cagacccagcagc

SEQ ID NO: 1022250 - RNA, 15 nt, Mycobacterium avium subsp. paratuberculosis
cagacccgccgcggc

SEQ ID NO: 1022251 - RNA, 15 nt, Mycobacterium avium subsp. paratuberculosis
cagaccgaacccggg

SEQ ID NO: 1022252 - RNA, 19 nt, Mycobacterium avium subsp. paratuberculosis
cagaccccguaccagcgcu

SEQ ID NO: 1022253 - RNA, 20 nt, Mycobacterium avium subsp. paratuberculosis
cagaccccguaccagcgcuc

SEQ ID NO: 1022254 - RNA, 17 nt, Mycobacterium avium subsp. paratuberculosis
cagacccgacaguccga

SEQ ID NO: 1022255 - RNA, 18 nt, Mycobacterium avium subsp. paratuberculosis
cagacccgacgggaacuc

SEQ ID NO: 1022256 - RNA, 14 nt, Mycobacterium avium subsp. paratuberculosis
cagaccccacaccu

SEQ ID NO: 1022257 - RNA, 17 nt, Mycobacterium avium subsp. paratuberculosis
cagaccgccggugcgca

SEQ ID NO: 1022258 - RNA, 19 nt, Mycobacterium avium subsp. paratuberculosis
cagaccgcgaucagcccca

SEQ ID NO: 1022259 - RNA, 21 nt, Mycobacterium avium subsp. paratuberculosis
cagaccgcggcggucgccacu

SEQ ID NO: 1022260 - RNA, 16 nt, Mycobacterium avium subsp. paratuberculosis
cagaccggacagcugg

SEQ ID NO: 1022261 - RNA, 21 nt, Mycobacterium avium subsp. paratuberculosis
cagaccggguuugaggcccac

SEQ ID NO: 1022262 - RNA, 21 nt, Mycobacterium avium subsp. paratuberculosis
cagaccggcgaagcuaaaccc

SEQ ID NO: 1022263 - RNA, 23 nt, Mycobacterium avium subsp. paratuberculosis
cagaaagcgauuggauuuaucuc

SEQ ID NO: 1022264 - RNA, 18 nt, Mycobacterium avium subsp. paratuberculosis
cagaaaauagcccagcca

SEQ ID NO: 1022265 - RNA, 23 nt, Mycobacterium avium subsp. paratuberculosis
cacuuuugacagguggggcacca

SEQ ID NO: 1022266 - RNA, 21 nt, Mycobacterium avium subsp. paratuberculosis
cagaacgacgcgcucagcccc

SEQ ID NO: 1022267 - RNA, 19 nt, Mycobacterium avium subsp. paratuberculosis
cagaacgccaucaccagcg

SEQ ID NO: 1022268 - RNA, 19 nt, Mycobacterium avium subsp. paratuberculosis
cagaaccggggccagcacg

SEQ ID NO: 1022269 - RNA, 20 nt, Mycobacterium avium subsp. paratuberculosis
cagaaccggggccagcacgc

SEQ ID NO: 1022270 - RNA, 19 nt, Mycobacterium avium subsp. paratuberculosis
cagaacggaauucagugag

SEQ ID NO: 1022271 - RNA, 19 nt, Mycobacterium avium subsp. paratuberculosis
cagaacggcggcagcgagg

SEQ ID NO: 1022272 - RNA, 20 nt, Mycobacterium avium subsp. paratuberculosis
cagaacggcggcagcgaggc

SEQ ID NO: 1022273 - RNA, 15 nt, Mycobacterium avium subsp. paratuberculosis
cagaaccgcaccccg

SEQ ID NO: 1022274 - RNA, 18 nt, Mycobacterium avium subsp. paratuberculosis
cagaaccauuugcccagc

SEQ ID NO: 1022275 - RNA, 22 nt, Mycobacterium avium subsp. paratuberculosis
cagaaccauuugcccagcaggg

SEQ ID NO: 1022276 - RNA, 14 nt, Mycobacterium avium subsp. paratuberculosis
cagaaccagcaccg

SEQ ID NO: 1022277 - RNA, 17 nt, Mycobacterium avium subsp. paratuberculosis
cagaaccagcaccgccg

SEQ ID NO: 1022278 - RNA, 12 nt, Mycobacterium avium subsp. paratuberculosis
cagaagcuccac

SEQ ID NO: 1022279 - RNA, 19 nt, Mycobacterium avium subsp. paratuberculosis
cagaacuucuccgccggca

SEQ ID NO: 1022280 - RNA, 16 nt, Mycobacterium avium subsp. paratuberculosis
cacuuaacaccucgcc

SEQ ID NO: 1022281 - RNA, 18 nt, Mycobacterium avium subsp. paratuberculosis
cacugggcgucggcgccc

SEQ ID NO: 1022282 - RNA, 16 nt, Mycobacterium avium subsp. paratuberculosis
cacuggucgugcugga

SEQ ID NO: 1022283 - RNA, 17 nt, Mycobacterium avium subsp. paratuberculosis
cacuggcggccggccgc

SEQ ID NO: 1022284 - RNA, 20 nt, Mycobacterium avium subsp. paratuberculosis
cacuggcggccggccgcgcc

SEQ ID NO: 1022285 - RNA, 21 nt, Mycobacterium avium subsp. paratuberculosis
cacuggcggccggccgcgccc

SEQ ID NO: 1022286 - RNA, 22 nt, Mycobacterium avium subsp. paratuberculosis
cacuggcggccggccgcgccca

SEQ ID NO: 1022287 - RNA, 19 nt, Mycobacterium avium subsp. paratuberculosis
cacuggcgccaccuccgac

SEQ ID NO: 1022288 - RNA, 17 nt, Mycobacterium avium subsp. paratuberculosis
cacuagguccggcgcga

SEQ ID NO: 1022289 - RNA, 16 nt, Mycobacterium avium subsp. paratuberculosis
cacucagagcagcgcc

SEQ ID NO: 1022290 - RNA, 19 nt, Mycobacterium avium subsp. paratuberculosis
cacucagagcagcgccugc

SEQ ID NO: 1022291 - RNA, 20 nt, Mycobacterium avium subsp. paratuberculosis
cacucagagcagcgccugcu

SEQ ID NO: 1022292 - RNA, 19 nt, Mycobacterium avium subsp. paratuberculosis
cacuccaauacggcccggc

SEQ ID NO: 1022293 - RNA, 17 nt, Mycobacterium avium subsp. paratuberculosis
cacucauguucagggug

SEQ ID NO: 1022294 - RNA, 17 nt, Mycobacterium avium subsp. paratuberculosis
cacguugagcacgcccg

SEQ ID NO: 1022295 - RNA, 17 nt, Mycobacterium avium subsp. paratuberculosis
cacguugagcccggacc

SEQ ID NO: 1022296 - RNA, 13 nt, Mycobacterium avium subsp. paratuberculosis
cacguugcccagg

SEQ ID NO: 1022297 - RNA, 17 nt, Mycobacterium avium subsp. paratuberculosis
cacguugucgcggccca

SEQ ID NO: 1022298 - RNA, 22 nt, Mycobacterium avium subsp. paratuberculosis
cacguugucgcggcccagcacc

SEQ ID NO: 1022299 - RNA, 17 nt, Mycobacterium avium subsp. paratuberculosis
cacguugcgcggccgca

SEQ ID NO: 1022300 - RNA, 17 nt, Mycobacterium avium subsp. paratuberculosis
cacgugaugagcgagga

SEQ ID NO: 1022301 - RNA, 23 nt, Mycobacterium avium subsp. paratuberculosis
cacgugcaggugcggcaccucca

SEQ ID NO: 1022302 - RNA, 16 nt, Mycobacterium avium subsp. paratuberculosis
cacgugcacccacgcc

SEQ ID NO: 1022303 - RNA, 16 nt, Mycobacterium avium subsp. paratuberculosis
cacgugcaccgcggcc

SEQ ID NO: 1022304 - RNA, 20 nt, Mycobacterium avium subsp. paratuberculosis
cacguggaccgagcgcgcga

SEQ ID NO: 1022305 - RNA, 13 nt, Mycobacterium avium subsp. paratuberculosis
cacgugcgcggcg

SEQ ID NO: 1022306 - RNA, 22 nt, Mycobacterium avium subsp. paratuberculosis
cacgugcgcggcguccaccagc

SEQ ID NO: 1022307 - RNA, 13 nt, Mycobacterium avium subsp. paratuberculosis
cacgugcggaugg

SEQ ID NO: 1022308 - RNA, 20 nt, Mycobacterium avium subsp. paratuberculosis
cacgugcggauggccccggc

SEQ ID NO: 1022309 - RNA, 19 nt, Mycobacterium avium subsp. paratuberculosis
cacguggugaucagcaucc

SEQ ID NO: 1022310 - RNA, 13 nt, Mycobacterium avium subsp. paratuberculosis
cacuacccgcgau

SEQ ID NO: 1022311 - RNA, 23 nt, Mycobacterium avium subsp. paratuberculosis
cacuacccgcgauggcacacagc

SEQ ID NO: 1022312 - RNA, 14 nt, Mycobacterium avium subsp. paratuberculosis
cacuaccgccucgc

SEQ ID NO: 1022313 - RNA, 15 nt, Mycobacterium avium subsp. paratuberculosis
cacuaccgccucgcc

SEQ ID NO: 1022314 - RNA, 22 nt, Mycobacterium avium subsp. paratuberculosis
cacucgggaaaugcgucggcag

SEQ ID NO: 1022315 - RNA, 17 nt, Mycobacterium avium subsp. paratuberculosis
cacucgggcggccgcgg

SEQ ID NO: 1022316 - RNA, 18 nt, Mycobacterium avium subsp. paratuberculosis
cacucggcgaugcgccgu

SEQ ID NO: 1022317 - RNA, 16 nt, Mycobacterium avium subsp. paratuberculosis
cacucgcgggacggcg

SEQ ID NO: 1022318 - RNA, 18 nt, Mycobacterium avium subsp. paratuberculosis
cacucgcguccccgcgcc

SEQ ID NO: 1022319 - RNA, 22 nt, Mycobacterium avium subsp. paratuberculosis
cacucgaccuucgagccgccgc

SEQ ID NO: 1022320 - RNA, 14 nt, Mycobacterium avium subsp. paratuberculosis
cacucgagcgcgcu

SEQ ID NO: 1022321 - RNA, 16 nt, Mycobacterium avium subsp. paratuberculosis
cacucgaacggcccgg

SEQ ID NO: 1022322 - RNA, 14 nt, Mycobacterium avium subsp. paratuberculosis
cacucccgcgcgcu

SEQ ID NO: 1022323 - RNA, 23 nt, Mycobacterium avium subsp. paratuberculosis
cacucccgcgcgcuguccucguc

SEQ ID NO: 1022324 - RNA, 13 nt, Mycobacterium avium subsp. paratuberculosis
cacucccagccgc

SEQ ID NO: 1022325 - RNA, 17 nt, Mycobacterium avium subsp. paratuberculosis
cacucccagccgccggc

SEQ ID NO: 1022326 - RNA, 18 nt, Mycobacterium avium subsp. paratuberculosis
cacucccagccgccggcc

SEQ ID NO: 1022327 - RNA, 16 nt, Mycobacterium avium subsp. paratuberculosis
cacugaucccuccguc

SEQ ID NO: 1022328 - RNA, 22 nt, Mycobacterium avium subsp. paratuberculosis
cacugcaacuacgcacccgaca

SEQ ID NO: 1022329 - RNA, 19 nt, Mycobacterium avium subsp. paratuberculosis
cacugcacggccucgguca

SEQ ID NO: 1022330 - RNA, 21 nt, Mycobacterium avium subsp. paratuberculosis
cacugcaucucgaccuggguc

SEQ ID NO: 1022331 - RNA, 17 nt, Mycobacterium avium subsp. paratuberculosis
cacugccggucaagcgc

SEQ ID NO: 1022332 - RNA, 14 nt, Mycobacterium avium subsp. paratuberculosis
cacugccgccgccc

SEQ ID NO: 1022333 - RNA, 16 nt, Mycobacterium avium subsp. paratuberculosis
cacugccgccgcccag

SEQ ID NO: 1022334 - RNA, 18 nt, Mycobacterium avium subsp. paratuberculosis
caucucgugcccgggccc

SEQ ID NO: 1022335 - RNA, 19 nt, Mycobacterium avium subsp. paratuberculosis
caucucggugaggugggcg

SEQ ID NO: 1022336 - RNA, 22 nt, Mycobacterium avium subsp. paratuberculosis
caucucgggagugcggcccacc

SEQ ID NO: 1022337 - RNA, 15 nt, Mycobacterium avium subsp. paratuberculosis
caucucgacggugac

SEQ ID NO: 1022338 - RNA, 13 nt, Mycobacterium avium subsp. paratuberculosis
caucugccggcag

SEQ ID NO: 1022339 - RNA, 22 nt, Mycobacterium avium subsp. paratuberculosis
caucugcacagcuucggcgccg

SEQ ID NO: 1022340 - RNA, 17 nt, Mycobacterium avium subsp. paratuberculosis
caucgucgcgcccagga

SEQ ID NO: 1022341 - RNA, 15 nt, Mycobacterium avium subsp. paratuberculosis
caucgucgcggcgcu

SEQ ID NO: 1022342 - RNA, 20 nt, Mycobacterium avium subsp. paratuberculosis
caucgcugacuccaucccgu

SEQ ID NO: 1022343 - RNA, 20 nt, Mycobacterium avium subsp. paratuberculosis
caucgcgggccaccggcgcc

SEQ ID NO: 1022344 - RNA, 23 nt, Mycobacterium avium subsp. paratuberculosis
caucucaccgacgaccucggugu

SEQ ID NO: 1022345 - RNA, 14 nt, Mycobacterium avium subsp. paratuberculosis
caucuccagcgcgg

SEQ ID NO: 1022346 - RNA, 14 nt, Mycobacterium avium subsp. paratuberculosis
caucuccagcuccg

SEQ ID NO: 1022347 - RNA, 21 nt, Mycobacterium avium subsp. paratuberculosis
caucuccagcuccgcggccag

SEQ ID NO: 1022348 - RNA, 19 nt, Mycobacterium avium subsp. paratuberculosis
caucuacgucgucgccggg

SEQ ID NO: 1022349 - RNA, 20 nt, Mycobacterium avium subsp. paratuberculosis
cauccgugagggaccuccag

SEQ ID NO: 1022350 - RNA, 20 nt, Mycobacterium avium subsp. paratuberculosis
cauccggugccgagcgcgcu

SEQ ID NO: 1022351 - RNA, 19 nt, Mycobacterium avium subsp. paratuberculosis
cauccgggcggccagccgc

SEQ ID NO: 1022352 - RNA, 19 nt, Mycobacterium avium subsp. paratuberculosis
cauccggaaccgggcaccc

SEQ ID NO: 1022353 - RNA, 13 nt, Mycobacterium avium subsp. paratuberculosis
cauccggaagcgg

SEQ ID NO: 1022354 - RNA, 19 nt, Mycobacterium avium subsp. paratuberculosis
cauccgcuggugcgcgccg

SEQ ID NO: 1022355 - RNA, 23 nt, Mycobacterium avium subsp. paratuberculosis
caucgccgccaucgccgccgcca

SEQ ID NO: 1022356 - RNA, 12 nt, Mycobacterium avium subsp. paratuberculosis
caucgcagcgcg

SEQ ID NO: 1022357 - RNA, 18 nt, Mycobacterium avium subsp. paratuberculosis
caucgccgucaugguguc

SEQ ID NO: 1022358 - RNA, 20 nt, Mycobacterium avium subsp. paratuberculosis
caucgccgucgucagccggg

SEQ ID NO: 1022359 - RNA, 18 nt, Mycobacterium avium subsp. paratuberculosis
caucgccgcggccggaga

SEQ ID NO: 1022360 - RNA, 20 nt, Mycobacterium avium subsp. paratuberculosis
caucgccgcggccggagaac

SEQ ID NO: 1022361 - RNA, 14 nt, Mycobacterium avium subsp. paratuberculosis
caucgcgcgcggcg

SEQ ID NO: 1022362 - RNA, 15 nt, Mycobacterium avium subsp. paratuberculosis
caucgcgcgcggcga

SEQ ID NO: 1022363 - RNA, 21 nt, Mycobacterium avium subsp. paratuberculosis
caucgcgcgcggcgacggugg

SEQ ID NO: 1022364 - RNA, 15 nt, Mycobacterium avium subsp. paratuberculosis
caucgcgcgcggcgg

SEQ ID NO: 1022365 - RNA, 17 nt, Mycobacterium avium subsp. paratuberculosis
caucgcggcgauggugu

SEQ ID NO: 1022366 - RNA, 14 nt, Mycobacterium avium subsp. paratuberculosis
caucgcggccgccg

SEQ ID NO: 1022367 - RNA, 20 nt, Mycobacterium avium subsp. paratuberculosis
caucgcggccgccggggccc

SEQ ID NO: 1022368 - RNA, 20 nt, Mycobacterium avium subsp. paratuberculosis
caucgcgaucgacagcucca

SEQ ID NO: 1022369 - RNA, 22 nt, Mycobacterium avium subsp. paratuberculosis
caucgcgaucgacagcuccaac

SEQ ID NO: 1022370 - RNA, 23 nt, Mycobacterium avium subsp. paratuberculosis
caucgcgaucgacagcuccaaca

SEQ ID NO: 1022371 - RNA, 20 nt, Mycobacterium avium subsp. paratuberculosis
caucgauggcgggcgcgccg

SEQ ID NO: 1022372 - RNA, 19 nt, Mycobacterium avium subsp. paratuberculosis
caucgacgcgaccggcccg

SEQ ID NO: 1022373 - RNA, 17 nt, Mycobacterium avium subsp. paratuberculosis
caucgaccggaugaugc

SEQ ID NO: 1022374 - RNA, 17 nt, Mycobacterium avium subsp. paratuberculosis
caucagguugaccaggu

SEQ ID NO: 1022375 - RNA, 22 nt, Mycobacterium avium subsp. paratuberculosis
caucaggcccuugccccaccac

SEQ ID NO: 1022376 - RNA, 18 nt, Mycobacterium avium subsp. paratuberculosis
caucaggccggccugcca

SEQ ID NO: 1022377 - RNA, 23 nt, Mycobacterium avium subsp. paratuberculosis
caucaucggcacgccggggcccu

SEQ ID NO: 1022378 - RNA, 18 nt, Mycobacterium avium subsp. paratuberculosis
caucacgguggccgccac

SEQ ID NO: 1022379 - RNA, 23 nt, Mycobacterium avium subsp. paratuberculosis
caucacgguggccgccaccaaca

SEQ ID NO: 1022380 - RNA, 22 nt, Mycobacterium avium subsp. paratuberculosis
caucagaacgcccgcaacucca

SEQ ID NO: 1022381 - RNA, 21 nt, Mycobacterium avium subsp. paratuberculosis
caucagcucggcagccccguc

SEQ ID NO: 1022382 - RNA, 16 nt, Mycobacterium avium subsp. paratuberculosis
caucagcucggcggcc

SEQ ID NO: 1022383 - RNA, 17 nt, Mycobacterium avium subsp. paratuberculosis
caucagcucggcggccu

SEQ ID NO: 1022384 - RNA, 12 nt, Mycobacterium avium subsp. paratuberculosis
caucagcugccg

SEQ ID NO: 1022385 - RNA, 14 nt, Mycobacterium avium subsp. paratuberculosis
caucagcgcccggg

SEQ ID NO: 1022386 - RNA, 17 nt, Mycobacterium avium subsp. paratuberculosis
caucagcgccaccagca

SEQ ID NO: 1022387 - RNA, 20 nt, Mycobacterium avium subsp. paratuberculosis
caucagcgccaccagcaccg

SEQ ID NO: 1022388 - RNA, 17 nt, Mycobacterium avium subsp. paratuberculosis
cauaugacgccggccuc

SEQ ID NO: 1022389 - RNA, 13 nt, Mycobacterium avium subsp. paratuberculosis
cauaccagcgcug

SEQ ID NO: 1022390 - RNA, 19 nt, Mycobacterium avium subsp. paratuberculosis
cauaccagugcccgagcac

SEQ ID NO: 1022391 - RNA, 22 nt, Mycobacterium avium subsp. paratuberculosis
cauaccagugcccgagcaccug

SEQ ID NO: 1022392 - RNA, 18 nt, Mycobacterium avium subsp. paratuberculosis
caguuguuuccccagccc

SEQ ID NO: 1022393 - RNA, 18 nt, Mycobacterium avium subsp. paratuberculosis
caguugggggccagcgcc

SEQ ID NO: 1022394 - RNA, 20 nt, Mycobacterium avium subsp. paratuberculosis
caguuggcgucgucggcggc

SEQ ID NO: 1022395 - RNA, 23 nt, Mycobacterium avium subsp. paratuberculosis
caguugacguugaucgcgccgau

SEQ ID NO: 1022396 - RNA, 16 nt, Mycobacterium avium subsp. paratuberculosis
caguugcgaccccgcc

SEQ ID NO: 1022397 - RNA, 20 nt, Mycobacterium avium subsp. paratuberculosis
caguucggugcacggcgcca

SEQ ID NO: 1022398 - RNA, 17 nt, Mycobacterium avium subsp. paratuberculosis
caguucggcgcgcaucu

SEQ ID NO: 1022399 - RNA, 15 nt, Mycobacterium avium subsp. paratuberculosis
caguucguccagccc

SEQ ID NO: 1022400 - RNA, 21 nt, Mycobacterium avium subsp. paratuberculosis
caguucgucgcgcgacugggc

SEQ ID NO: 1022401 - RNA, 15 nt, Mycobacterium avium subsp. paratuberculosis
caguucgcggcgcac

SEQ ID NO: 1022402 - RNA, 18 nt, Mycobacterium avium subsp. paratuberculosis
caguucggccgccgugcu

SEQ ID NO: 1022403 - RNA, 16 nt, Mycobacterium avium subsp. paratuberculosis
caguucgccagcaugc

SEQ ID NO: 1022404 - RNA, 18 nt, Mycobacterium avium subsp. paratuberculosis
caguucccggcgggcagg

SEQ ID NO: 1022405 - RNA, 22 nt, Mycobacterium avium subsp. paratuberculosis
caguucgaccggcaccagcagc

SEQ ID NO: 1022406 - RNA, 23 nt, Mycobacterium avium subsp. paratuberculosis
caguucgaccggcaccagcagcc

SEQ ID NO: 1022407 - RNA, 19 nt, Mycobacterium avium subsp. paratuberculosis
caguuccuugcgcagcacc

SEQ ID NO: 1022408 - RNA, 20 nt, Mycobacterium avium subsp. paratuberculosis
caguuccuugcgcagcaccu

SEQ ID NO: 1022409 - RNA, 22 nt, Mycobacterium avium subsp. paratuberculosis
caguucaccgaaguccgccagg

SEQ ID NO: 1022410 - RNA, 15 nt, Mycobacterium avium subsp. paratuberculosis
caguuaggucuuguc

SEQ ID NO: 1022411 - RNA, 13 nt, Mycobacterium avium subsp. paratuberculosis
caguucaucgugg

SEQ ID NO: 1022412 - RNA, 20 nt, Mycobacterium avium subsp. paratuberculosis
caguguccagucggccguga

SEQ ID NO: 1022413 - RNA, 20 nt, Mycobacterium avium subsp. paratuberculosis
caguguccgaucgccuccuc

SEQ ID NO: 1022414 - RNA, 19 nt, Mycobacterium avium subsp. paratuberculosis
cagugccaguaccagcggc

SEQ ID NO: 1022415 - RNA, 16 nt, Mycobacterium avium subsp. paratuberculosis
cagugccgcaccagca

SEQ ID NO: 1022416 - RNA, 15 nt, Mycobacterium avium subsp. paratuberculosis
cagugccgcaggugg

SEQ ID NO: 1022417 - RNA, 16 nt, Mycobacterium avium subsp. paratuberculosis
cagugccgcagguggu

SEQ ID NO: 1022418 - RNA, 20 nt, Mycobacterium avium subsp. paratuberculosis
cagugccgcagguggugggc

SEQ ID NO: 1022419 - RNA, 19 nt, Mycobacterium avium subsp. paratuberculosis
cagugccccguccggcgcc

SEQ ID NO: 1022420 - RNA, 18 nt, Mycobacterium avium subsp. paratuberculosis
cagugcccgcccagcugc

SEQ ID NO: 1022421 - RNA, 20 nt, Mycobacterium avium subsp. paratuberculosis
cagugcccgcccagcugcac

SEQ ID NO: 1022422 - RNA, 13 nt, Mycobacterium avium subsp. paratuberculosis
cagugcgcggcgu

SEQ ID NO: 1022423 - RNA, 20 nt, Mycobacterium avium subsp. paratuberculosis
cagugcggacgccacaacau

SEQ ID NO: 1022424 - RNA, 14 nt, Mycobacterium avium subsp. paratuberculosis
cagugcgagaaaau

SEQ ID NO: 1022425 - RNA, 20 nt, Mycobacterium avium subsp. paratuberculosis
cagugccgggccagcugcuc

SEQ ID NO: 1022426 - RNA, 22 nt, Mycobacterium avium subsp. paratuberculosis
cagugccggugcagcaccucga

SEQ ID NO: 1022427 - RNA, 21 nt, Mycobacterium avium subsp. paratuberculosis
cagugcgggcaucggcugguc

SEQ ID NO: 1022428 - RNA, 17 nt, Mycobacterium avium subsp. paratuberculosis
cagugcucgaccagauu

SEQ ID NO: 1022429 - RNA, 17 nt, Mycobacterium avium subsp. paratuberculosis
cagugguagagcucugg

SEQ ID NO: 1022430 - RNA, 20 nt, Mycobacterium avium subsp. paratuberculosis
ccacgcggugauccagagca

SEQ ID NO: 1022431 - RNA, 18 nt, Mycobacterium avium subsp. paratuberculosis
ccacgcucaugcccgcca

SEQ ID NO: 1022432 - RNA, 23 nt, Mycobacterium avium subsp. paratuberculosis
ccacgcuccagaugcgguggugg

SEQ ID NO: 1022433 - RNA, 13 nt, Mycobacterium avium subsp. paratuberculosis
ccacgcucgccag

SEQ ID NO: 1022434 - RNA, 20 nt, Mycobacterium avium subsp. paratuberculosis
ccacgcucucgccggucagc

SEQ ID NO: 1022435 - RNA, 13 nt, Mycobacterium avium subsp. paratuberculosis
ccacggagcgccc

SEQ ID NO: 1022436 - RNA, 12 nt, Mycobacterium avium subsp. paratuberculosis
ccacggcagcug

SEQ ID NO: 1022437 - RNA, 18 nt, Mycobacterium avium subsp. paratuberculosis
ccacggcagcugcagcgg

SEQ ID NO: 1022438 - RNA, 17 nt, Mycobacterium avium subsp. paratuberculosis
ccacggcaccgccgcgc

SEQ ID NO: 1022439 - RNA, 18 nt, Mycobacterium avium subsp. paratuberculosis
ccacggcaccgccgcgcg

SEQ ID NO: 1022440 - RNA, 14 nt, Mycobacterium avium subsp. paratuberculosis
ccacggccggcagc

SEQ ID NO: 1022441 - RNA, 22 nt, Mycobacterium avium subsp. paratuberculosis
ccacggccaugcagaccagccc

SEQ ID NO: 1022442 - RNA, 15 nt, Mycobacterium avium subsp. paratuberculosis
ccacggccccagccg

SEQ ID NO: 1022443 - RNA, 20 nt, Mycobacterium avium subsp. paratuberculosis
ccacggccacaacgucucug

SEQ ID NO: 1022444 - RNA, 16 nt, Mycobacterium avium subsp. paratuberculosis
ccacgccgugcagaac

SEQ ID NO: 1022445 - RNA, 17 nt, Mycobacterium avium subsp. paratuberculosis
ccacgccguggcccgcc

SEQ ID NO: 1022446 - RNA, 20 nt, Mycobacterium avium subsp. paratuberculosis
ccacgccgauggccuggugg

SEQ ID NO: 1022447 - RNA, 20 nt, Mycobacterium avium subsp. paratuberculosis
ccacgccgccgggaacagcg

SEQ ID NO: 1022448 - RNA, 22 nt, Mycobacterium avium subsp. paratuberculosis
ccacgccuugcgguuggccgga

SEQ ID NO: 1022449 - RNA, 16 nt, Mycobacterium avium subsp. paratuberculosis
ccacgccgagggcggc

SEQ ID NO: 1022450 - RNA, 22 nt, Mycobacterium avium subsp. paratuberculosis
ccacgccgacuagcgcggcggc

SEQ ID NO: 1022451 - RNA, 16 nt, Mycobacterium avium subsp. paratuberculosis
ccacgcccgcagcgca

SEQ ID NO: 1022452 - RNA, 18 nt, Mycobacterium avium subsp. paratuberculosis
ccacgcccuagcgggcca

SEQ ID NO: 1022453 - RNA, 22 nt, Mycobacterium avium subsp. paratuberculosis
ccacgccaugugccggcgcucg

SEQ ID NO: 1022454 - RNA, 15 nt, Mycobacterium avium subsp. paratuberculosis
ccacguggucgagca

SEQ ID NO: 1022455 - RNA, 19 nt, Mycobacterium avium subsp. paratuberculosis
ccacguggucgagcaugcg

SEQ ID NO: 1022456 - RNA, 14 nt, Mycobacterium avium subsp. paratuberculosis
ccacgugucggcgu

SEQ ID NO: 1022457 - RNA, 16 nt, Mycobacterium avium subsp. paratuberculosis
ccacguugcgcggccg

SEQ ID NO: 1022458 - RNA, 19 nt, Mycobacterium avium subsp. paratuberculosis
ccacguugcgcccggccau

SEQ ID NO: 1022459 - RNA, 22 nt, Mycobacterium avium subsp. paratuberculosis
ccacguugaugccgcccagcag

SEQ ID NO: 1022460 - RNA, 18 nt, Mycobacterium avium subsp. paratuberculosis
ccacguugcacggcagca

SEQ ID NO: 1022461 - RNA, 15 nt, Mycobacterium avium subsp. paratuberculosis
ccacgucguccagcu

SEQ ID NO: 1022462 - RNA, 15 nt, Mycobacterium avium subsp. paratuberculosis
ccacgugcacggcgc

SEQ ID NO: 1022463 - RNA, 16 nt, Mycobacterium avium subsp. paratuberculosis
ccacgugccaucgcug

SEQ ID NO: 1022464 - RNA, 17 nt, Mycobacterium avium subsp. paratuberculosis
ccacgugccaucgcugg

SEQ ID NO: 1022465 - RNA, 13 nt, Mycobacterium avium subsp. paratuberculosis
ccacgugccccuc

SEQ ID NO: 1022466 - RNA, 17 nt, Mycobacterium avium subsp. paratuberculosis
ccacgucgaacccgacc

SEQ ID NO: 1022467 - RNA, 21 nt, Mycobacterium avium subsp. paratuberculosis
ccacgucgaugccgaaccgcu

SEQ ID NO: 1022468 - RNA, 22 nt, Mycobacterium avium subsp. paratuberculosis
ccacgucgaugccgaaccgcuc

SEQ ID NO: 1022469 - RNA, 19 nt, Mycobacterium avium subsp. paratuberculosis
ccacguccggaugcggcgc

SEQ ID NO: 1022470 - RNA, 18 nt, Mycobacterium avium subsp. paratuberculosis
ccacggucagggccagca

SEQ ID NO: 1022471 - RNA, 20 nt, Mycobacterium avium subsp. paratuberculosis
ccacgguccccgcgcccgcc

SEQ ID NO: 1022472 - RNA, 15 nt, Mycobacterium avium subsp. paratuberculosis
ccacggucgccgcgc

SEQ ID NO: 1022473 - RNA, 15 nt, Mycobacterium avium subsp. paratuberculosis
ccacgguggcgccgc

SEQ ID NO: 1022474 - RNA, 14 nt, Mycobacterium avium subsp. paratuberculosis
ccacgguggcgguc

SEQ ID NO: 1022475 - RNA, 15 nt, Mycobacterium avium subsp. paratuberculosis
ccacgucaccgacgc

SEQ ID NO: 1022476 - RNA, 15 nt, Mycobacterium avium subsp. paratuberculosis
ccacguccaccagca

SEQ ID NO: 1022477 - RNA, 18 nt, Mycobacterium avium subsp. paratuberculosis
ccacguccaccagcacca

SEQ ID NO: 1022478 - RNA, 20 nt, Mycobacterium avium subsp. paratuberculosis
ccacguagcagcagaccgcg

SEQ ID NO: 1022479 - RNA, 15 nt, Mycobacterium avium subsp. paratuberculosis
ccacguacuccugcg

SEQ ID NO: 1022480 - RNA, 20 nt, Mycobacterium avium subsp. paratuberculosis
ccacgggcggucggacgcgg

SEQ ID NO: 1022481 - RNA, 14 nt, Mycobacterium avium subsp. paratuberculosis
ccacggggucgaga

SEQ ID NO: 1022482 - RNA, 13 nt, Mycobacterium avium subsp. paratuberculosis
ccacgggucgcug

SEQ ID NO: 1022483 - RNA, 22 nt, Mycobacterium avium subsp. paratuberculosis
ccacgggaugcggcacgcguca

SEQ ID NO: 1022484 - RNA, 22 nt, Mycobacterium avium subsp. paratuberculosis
ccacggcguugaccaacgccgc

SEQ ID NO: 1022485 - RNA, 23 nt, Mycobacterium avium subsp. paratuberculosis
ccaccagaugccgggcuccgcgu

SEQ ID NO: 1022486 - RNA, 20 nt, Mycobacterium avium subsp. paratuberculosis
ccaccagaucguguccgcgc

SEQ ID NO: 1022487 - RNA, 15 nt, Mycobacterium avium subsp. paratuberculosis
ccaccaccugcuucc

SEQ ID NO: 1022488 - RNA, 18 nt, Mycobacterium avium subsp. paratuberculosis
ccaccacgaccagugccc

SEQ ID NO: 1022489 - RNA, 16 nt, Mycobacterium avium subsp. paratuberculosis
ccaccacgugccccuc

SEQ ID NO: 1022490 - RNA, 21 nt, Mycobacterium avium subsp. paratuberculosis
ccaccacuuccuucuugggcu

SEQ ID NO: 1022491 - RNA, 14 nt, Mycobacterium avium subsp. paratuberculosis
ccaccaccgacagc

SEQ ID NO: 1022492 - RNA, 20 nt, Mycobacterium avium subsp. paratuberculosis
ccacaggccgaacagcagcg

SEQ ID NO: 1022493 - RNA, 16 nt, Mycobacterium avium subsp. paratuberculosis
ccaccaccgagccggc

SEQ ID NO: 1022494 - RNA, 16 nt, Mycobacterium avium subsp. paratuberculosis
ccaccaccgccacggc

SEQ ID NO: 1022495 - RNA, 13 nt, Mycobacterium avium subsp. paratuberculosis
ccaccaccgccgu

SEQ ID NO: 1022496 - RNA, 14 nt, Mycobacterium avium subsp. paratuberculosis
ccaccaccgccucg

SEQ ID NO: 1022497 - RNA, 13 nt, Mycobacterium avium subsp. paratuberculosis
ccaccaccgcggc

SEQ ID NO: 1022498 - RNA, 14 nt, Mycobacterium avium subsp. paratuberculosis
ccaccaccggccgc

SEQ ID NO: 1022499 - RNA, 19 nt, Mycobacterium avium subsp. paratuberculosis
ccaccaccggugaacgggu

SEQ ID NO: 1022500 - RNA, 13 nt, Mycobacterium avium subsp. paratuberculosis
ccaccaccuccuc

SEQ ID NO: 1022501 - RNA, 14 nt, Mycobacterium avium subsp. paratuberculosis
ccaccaccuccucg

SEQ ID NO: 1022502 - RNA, 22 nt, Mycobacterium avium subsp. paratuberculosis
ccaccacgaaccaggcgccggc

SEQ ID NO: 1022503 - RNA, 14 nt, Mycobacterium avium subsp. paratuberculosis
ccaccagucggcgc

SEQ ID NO: 1022504 - RNA, 20 nt, Mycobacterium avium subsp. paratuberculosis
ccaccaguguccgggcgccc

SEQ ID NO: 1022505 - RNA, 21 nt, Mycobacterium avium subsp. paratuberculosis
ccaccaguguccgggcgccca

SEQ ID NO: 1022506 - RNA, 18 nt, Mycobacterium avium subsp. paratuberculosis
ccaccaggguggccgcca

SEQ ID NO: 1022507 - RNA, 19 nt, Mycobacterium avium subsp. paratuberculosis
ccaccaggguggccgccac

SEQ ID NO: 1022508 - RNA, 17 nt, Mycobacterium avium subsp. paratuberculosis
ccaccagguaggcgacc

SEQ ID NO: 1022509 - RNA, 21 nt, Mycobacterium avium subsp. paratuberculosis
ccaccaugggcgggacgaaug

SEQ ID NO: 1022510 - RNA, 14 nt, Mycobacterium avium subsp. paratuberculosis
ccaccaucaggccg

SEQ ID NO: 1022511 - RNA, 18 nt, Mycobacterium avium subsp. paratuberculosis
ccaccaucaggccggccu

SEQ ID NO: 1022512 - RNA, 20 nt, Mycobacterium avium subsp. paratuberculosis
ccaccaucaggccggccugc

SEQ ID NO: 1022513 - RNA, 18 nt, Mycobacterium avium subsp. paratuberculosis
ccacccucagggagcugc

SEQ ID NO: 1022514 - RNA, 23 nt, Mycobacterium avium subsp. paratuberculosis
ccacccucagggagcugcccgca

SEQ ID NO: 1022515 - RNA, 18 nt, Mycobacterium avium subsp. paratuberculosis
ccacccucgccgccgccg

SEQ ID NO: 1022516 - RNA, 21 nt, Mycobacterium avium subsp. paratuberculosis
ccacccggugggacugggcgc

SEQ ID NO: 1022517 - RNA, 15 nt, Mycobacterium avium subsp. paratuberculosis
ccacgagcccagccg

SEQ ID NO: 1022518 - RNA, 21 nt, Mycobacterium avium subsp. paratuberculosis
ccacgagccggucgggaucga

SEQ ID NO: 1022519 - RNA, 17 nt, Mycobacterium avium subsp. paratuberculosis
ccacgacgccgggcgcc

SEQ ID NO: 1022520 - RNA, 19 nt, Mycobacterium avium subsp. paratuberculosis
ccacgacgcggcgcgcgau

SEQ ID NO: 1022521 - RNA, 14 nt, Mycobacterium avium subsp. paratuberculosis
ccacgacguccucg

SEQ ID NO: 1022522 - RNA, 15 nt, Mycobacterium avium subsp. paratuberculosis
ccacgacguccucga

SEQ ID NO: 1022523 - RNA, 22 nt, Mycobacterium avium subsp. paratuberculosis
ccacgaugcggugccgggugcu

SEQ ID NO: 1022524 - RNA, 21 nt, Mycobacterium avium subsp. paratuberculosis
ccacgaugaucgucggcagcg

SEQ ID NO: 1022525 - RNA, 23 nt, Mycobacterium avium subsp. paratuberculosis
ccacgaucaauucgaagcccgug

SEQ ID NO: 1022526 - RNA, 24 nt, Mycobacterium avium subsp. paratuberculosis
ccacgaucacgucggugacgcccu

SEQ ID NO: 1022527 - RNA, 19 nt, Mycobacterium avium subsp. paratuberculosis
ccaccuccucgcgggcgau

SEQ ID NO: 1022528 - RNA, 14 nt, Mycobacterium avium subsp. paratuberculosis
ccaccucgagcacg

SEQ ID NO: 1022529 - RNA, 21 nt, Mycobacterium avium subsp. paratuberculosis
ccaccucgagcacgcccugcg

SEQ ID NO: 1022530 - RNA, 21 nt, Mycobacterium avium subsp. paratuberculosis
ccaccucgaucagcggcaucg

SEQ ID NO: 1022531 - RNA, 20 nt, Mycobacterium avium subsp. paratuberculosis
ccaccucggcggcaccgccc

SEQ ID NO: 1022532 - RNA, 19 nt, Mycobacterium avium subsp. paratuberculosis
ccaccucgguggacgccgc

SEQ ID NO: 1022533 - RNA, 17 nt, Mycobacterium avium subsp. paratuberculosis
ccaccugaccgcgggcc

SEQ ID NO: 1022534 - RNA, 21 nt, Mycobacterium avium subsp. paratuberculosis
ccaccugaccgcgggcccgcc

SEQ ID NO: 1022535 - RNA, 23 nt, Mycobacterium avium subsp. paratuberculosis
ccaccugaucgcggcgagcagcg

SEQ ID NO: 1022536 - RNA, 17 nt, Mycobacterium avium subsp. paratuberculosis
ccacgaccagcggcagc

SEQ ID NO: 1022537 - RNA, 18 nt, Mycobacterium avium subsp. paratuberculosis
ccacgaccccggcggcac

SEQ ID NO: 1022538 - RNA, 12 nt, Mycobacterium avium subsp. paratuberculosis
ccacgacauccc

SEQ ID NO: 1022539 - RNA, 14 nt, Mycobacterium avium subsp. paratuberculosis
ccacgaagggcgcc

SEQ ID NO: 1022540 - RNA, 18 nt, Mycobacterium avium subsp. paratuberculosis
ccaccgggaccugcugcu

SEQ ID NO: 1022541 - RNA, 13 nt, Mycobacterium avium subsp. paratuberculosis
ccaccgccccagc

SEQ ID NO: 1022542 - RNA, 16 nt, Mycobacterium avium subsp. paratuberculosis
ccaccgcccggaccgg

SEQ ID NO: 1022543 - RNA, 21 nt, Mycobacterium avium subsp. paratuberculosis
ccaccgccggggugugcagcg

SEQ ID NO: 1022544 - RNA, 19 nt, Mycobacterium avium subsp. paratuberculosis
ccaccgccgucaccgccag

SEQ ID NO: 1022545 - RNA, 21 nt, Mycobacterium avium subsp. paratuberculosis
ccaccgccgucaccgccagga

SEQ ID NO: 1022546 - RNA, 14 nt, Mycobacterium avium subsp. paratuberculosis
ccaccgccggccca

SEQ ID NO: 1022547 - RNA, 17 nt, Mycobacterium avium subsp. paratuberculosis
ccaccgccggcccaggc

SEQ ID NO: 1022548 - RNA, 14 nt, Mycobacterium avium subsp. paratuberculosis
ccaccgccagguag

SEQ ID NO: 1022549 - RNA, 12 nt, Mycobacterium avium subsp. paratuberculosis
ccaccgccaccg

SEQ ID NO: 1022550 - RNA, 13 nt, Mycobacterium avium subsp. paratuberculosis
ccaccgccaccgc

SEQ ID NO: 1022551 - RNA, 15 nt, Mycobacterium avium subsp. paratuberculosis
ccaccgacagcaccc

SEQ ID NO: 1022552 - RNA, 19 nt, Mycobacterium avium subsp. paratuberculosis
ccaccgaaaagcccgccgc

SEQ ID NO: 1022553 - RNA, 11 nt, Mycobacterium avium subsp. paratuberculosis
ccacaccacca

SEQ ID NO: 1022554 - RNA, 12 nt, Mycobacterium avium subsp. paratuberculosis
ccacagcagccg

SEQ ID NO: 1022555 - RNA, 23 nt, Mycobacterium avium subsp. paratuberculosis
ccacagccggucauaggccgcgc

SEQ ID NO: 1022556 - RNA, 21 nt, Mycobacterium avium subsp. paratuberculosis
ccacagccaggugugcggcac

SEQ ID NO: 1022557 - RNA, 15 nt, Mycobacterium avium subsp. paratuberculosis
ccacagcugcuggcu

SEQ ID NO: 1022558 - RNA, 15 nt, Mycobacterium avium subsp. paratuberculosis
ccacagcugcaggcu

SEQ ID NO: 1022559 - RNA, 15 nt, Mycobacterium avium subsp. paratuberculosis
ccacagcgccagcac

SEQ ID NO: 1022560 - RNA, 18 nt, Mycobacterium avium subsp. paratuberculosis
ccacagcucgggcagcgu

SEQ ID NO: 1022561 - RNA, 13 nt, Mycobacterium avium subsp. paratuberculosis
ccacagcgcgccc

SEQ ID NO: 1022562 - RNA, 18 nt, Mycobacterium avium subsp. paratuberculosis
ccacagcggaucggccug

SEQ ID NO: 1022563 - RNA, 17 nt, Mycobacterium avium subsp. paratuberculosis
ccacagcggcgacagcg

SEQ ID NO: 1022564 - RNA, 15 nt, Mycobacterium avium subsp. paratuberculosis
ccacagcggcgcaug

SEQ ID NO: 1022565 - RNA, 17 nt, Mycobacterium avium subsp. paratuberculosis
ccaauugccgggccaga

SEQ ID NO: 1022566 - RNA, 17 nt, Mycobacterium avium subsp. paratuberculosis
ccaaugggguauggugu

SEQ ID NO: 1022567 - RNA, 22 nt, Mycobacterium avium subsp. paratuberculosis
ccaaugcuuuuugcggacccag

SEQ ID NO: 1022568 - RNA, 15 nt, Mycobacterium avium subsp. paratuberculosis
ccaagugcccgcggg

SEQ ID NO: 1022569 - RNA, 19 nt, Mycobacterium avium subsp. paratuberculosis
ccaauaccguuccgccccu

SEQ ID NO: 1022570 - RNA, 21 nt, Mycobacterium avium subsp. paratuberculosis
ccaauaccguuccgccccugu

SEQ ID NO: 1022571 - RNA, 14 nt, Mycobacterium avium subsp. paratuberculosis
ccaauacggcccgg

SEQ ID NO: 1022572 - RNA, 18 nt, Mycobacterium avium subsp. paratuberculosis
ccaaggagaaggccgcgc

SEQ ID NO: 1022573 - RNA, 14 nt, Mycobacterium avium subsp. paratuberculosis
ccaaggacaagcug

SEQ ID NO: 1022574 - RNA, 22 nt, Mycobacterium avium subsp. paratuberculosis
ccaacuggcgaccgguccgcgg

SEQ ID NO: 1022575 - RNA, 14 nt, Mycobacterium avium subsp. paratuberculosis
ccaagauugggcca

SEQ ID NO: 1022576 - RNA, 18 nt, Mycobacterium avium subsp. paratuberculosis
ccaacgggaagagcggcg

SEQ ID NO: 1022577 - RNA, 13 nt, Mycobacterium avium subsp. paratuberculosis
ccaacggcgugca

SEQ ID NO: 1022578 - RNA, 17 nt, Mycobacterium avium subsp. paratuberculosis
ccaacggcucgccgcgc

SEQ ID NO: 1022579 - RNA, 16 nt, Mycobacterium avium subsp. paratuberculosis
ccaacgacgucggcgu

SEQ ID NO: 1022580 - RNA, 12 nt, Mycobacterium avium subsp. paratuberculosis
ccaacgacagcg

SEQ ID NO: 1022581 - RNA, 17 nt, Mycobacterium avium subsp. paratuberculosis
ccaacgccacguagcag

SEQ ID NO: 1022582 - RNA, 21 nt, Mycobacterium avium subsp. paratuberculosis
ccaacaggugcuuggucagcg

SEQ ID NO: 1022583 - RNA, 22 nt, Mycobacterium avium subsp. paratuberculosis
ccaacaggugcuuggucagcgc

SEQ ID NO: 1022584 - RNA, 14 nt, Mycobacterium avium subsp. paratuberculosis
cauuucggucggca

SEQ ID NO: 1022585 - RNA, 15 nt, Mycobacterium avium subsp. paratuberculosis
cauuucggcuuccac

SEQ ID NO: 1022586 - RNA, 21 nt, Mycobacterium avium subsp. paratuberculosis
cauuuccguugugccaccgcc

SEQ ID NO: 1022587 - RNA, 13 nt, Mycobacterium avium subsp. paratuberculosis
cauuucagcagcg

SEQ ID NO: 1022588 - RNA, 12 nt, Mycobacterium avium subsp. paratuberculosis
cauugucaucau

SEQ ID NO: 1022589 - RNA, 16 nt, Mycobacterium avium subsp. paratuberculosis
cauuggugccggccuc

SEQ ID NO: 1022590 - RNA, 12 nt, Mycobacterium avium subsp. paratuberculosis
cauuggccgcgc

SEQ ID NO: 1022591 - RNA, 13 nt, Mycobacterium avium subsp. paratuberculosis
cauuggccgcgcg

SEQ ID NO: 1022592 - RNA, 16 nt, Mycobacterium avium subsp. paratuberculosis
cauucgguuuccccuu

SEQ ID NO: 1022593 - RNA, 14 nt, Mycobacterium avium subsp. paratuberculosis
cauucggccgccac

SEQ ID NO: 1022594 - RNA, 22 nt, Mycobacterium avium subsp. paratuberculosis
cauucguguggcgcacgcugcu

SEQ ID NO: 1022595 - RNA, 15 nt, Mycobacterium avium subsp. paratuberculosis
cauugcccaucgcca

SEQ ID NO: 1022596 - RNA, 22 nt, Mycobacterium avium subsp. paratuberculosis
cauugcgauacgacgggauggu

SEQ ID NO: 1022597 - RNA, 12 nt, Mycobacterium avium subsp. paratuberculosis
cauugccgcgcc

SEQ ID NO: 1022598 - RNA, 22 nt, Mycobacterium avium subsp. paratuberculosis
cauuagccggacuauacacgcc

SEQ ID NO: 1022599 - RNA, 20 nt, Mycobacterium avium subsp. paratuberculosis
cauuccgccgaaacccgcug

SEQ ID NO: 1022600 - RNA, 15 nt, Mycobacterium avium subsp. paratuberculosis
cauuccgccgcgccc

SEQ ID NO: 1022601 - RNA, 16 nt, Mycobacterium avium subsp. paratuberculosis
cauuccgccgcgcccg

SEQ ID NO: 1022602 - RNA, 16 nt, Mycobacterium avium subsp. paratuberculosis
cauucaggucaccgcg

SEQ ID NO: 1022603 - RNA, 14 nt, Mycobacterium avium subsp. paratuberculosis
cauguggccugagu

SEQ ID NO: 1022604 - RNA, 21 nt, Mycobacterium avium subsp. paratuberculosis
cauguggccugagugaaaugc

SEQ ID NO: 1022605 - RNA, 18 nt, Mycobacterium avium subsp. paratuberculosis
caugugguugggccaggc

SEQ ID NO: 1022606 - RNA, 20 nt, Mycobacterium avium subsp. paratuberculosis
caugugccacagguacaggg

SEQ ID NO: 1022607 - RNA, 16 nt, Mycobacterium avium subsp. paratuberculosis
caugugcucccagcuc

SEQ ID NO: 1022608 - RNA, 17 nt, Mycobacterium avium subsp. paratuberculosis
caugucgucgagcucga

SEQ ID NO: 1022609 - RNA, 22 nt, Mycobacterium avium subsp. paratuberculosis
caugucguacgggcgcagcgcc

SEQ ID NO: 1022610 - RNA, 13 nt, Mycobacterium avium subsp. paratuberculosis
cauguucagggug

SEQ ID NO: 1022611 - RNA, 17 nt, Mycobacterium avium subsp. paratuberculosis
caucuucggcacgaagc

SEQ ID NO: 1022612 - RNA, 22 nt, Mycobacterium avium subsp. paratuberculosis
caucuucacgugcgcggcgucc

SEQ ID NO: 1022613 - RNA, 18 nt, Mycobacterium avium subsp. paratuberculosis
caugcuguuccagacguc

SEQ ID NO: 1022614 - RNA, 21 nt, Mycobacterium avium subsp. paratuberculosis
cauggacacgcccugguaggc

SEQ ID NO: 1022615 - RNA, 21 nt, Mycobacterium avium subsp. paratuberculosis
cauggacgcggccucaccgcg

SEQ ID NO: 1022616 - RNA, 21 nt, Mycobacterium avium subsp. paratuberculosis
cauggcaguuguuccaguccc

SEQ ID NO: 1022617 - RNA, 15 nt, Mycobacterium avium subsp. paratuberculosis
cauggcgugcugaug

SEQ ID NO: 1022618 - RNA, 14 nt, Mycobacterium avium subsp. paratuberculosis
cauggccaggaacg

SEQ ID NO: 1022619 - RNA, 12 nt, Mycobacterium avium subsp. paratuberculosis
cauggugaacug

SEQ ID NO: 1022620 - RNA, 14 nt, Mycobacterium avium subsp. paratuberculosis
cauguagcagcgcg

SEQ ID NO: 1022621 - RNA, 12 nt, Mycobacterium avium subsp. paratuberculosis
cauguccagguu

SEQ ID NO: 1022622 - RNA, 23 nt, Mycobacterium avium subsp. paratuberculosis
cauguccggcaggcucagcagca

SEQ ID NO: 1022623 - RNA, 19 nt, Mycobacterium avium subsp. paratuberculosis
cauguccggggugagcagg

SEQ ID NO: 1022624 - RNA, 23 nt, Mycobacterium avium subsp. paratuberculosis
cauguccccgccgguggcggcga

SEQ ID NO: 1022625 - RNA, 23 nt, Mycobacterium avium subsp. paratuberculosis
caugucgaccucggccaccaccu

SEQ ID NO: 1022626 - RNA, 20 nt, Mycobacterium avium subsp. paratuberculosis
caugucgccgaacgccacca

SEQ ID NO: 1022627 - RNA, 16 nt, Mycobacterium avium subsp. paratuberculosis
caugucggagcugcgc

SEQ ID NO: 1022628 - RNA, 20 nt, Mycobacterium avium subsp. paratuberculosis
caugucggagcugcgcgccc

SEQ ID NO: 1022629 - RNA, 21 nt, Mycobacterium avium subsp. paratuberculosis
caugucgguaaggcaggcacu

SEQ ID NO: 1022630 - RNA, 15 nt, Mycobacterium avium subsp. paratuberculosis
cgaacggaccgggcg

SEQ ID NO: 1022631 - RNA, 17 nt, Mycobacterium avium subsp. paratuberculosis
cgaacgcguacacggcc

SEQ ID NO: 1022632 - RNA, 14 nt, Mycobacterium avium subsp. paratuberculosis
cgaacgcggccgcc

SEQ ID NO: 1022633 - RNA, 13 nt, Mycobacterium avium subsp. paratuberculosis
cgaacgcgacgaa

SEQ ID NO: 1022634 - RNA, 16 nt, Mycobacterium avium subsp. paratuberculosis
cgaacgcgccccgccg

SEQ ID NO: 1022635 - RNA, 15 nt, Mycobacterium avium subsp. paratuberculosis
cgaacgcgccgccga

SEQ ID NO: 1022636 - RNA, 15 nt, Mycobacterium avium subsp. paratuberculosis
cgaacgggccgggca

SEQ ID NO: 1022637 - RNA, 23 nt, Mycobacterium avium subsp. paratuberculosis
cgaagagcggcacgaucggcagc

SEQ ID NO: 1022638 - RNA, 16 nt, Mycobacterium avium subsp. paratuberculosis
cgaagccggugcccau

SEQ ID NO: 1022639 - RNA, 15 nt, Mycobacterium avium subsp. paratuberculosis
cgaagccgugacccg

SEQ ID NO: 1022640 - RNA, 19 nt, Mycobacterium avium subsp. paratuberculosis
cgaagcgcuaacaaaagcc

SEQ ID NO: 1022641 - RNA, 20 nt, Mycobacterium avium subsp. paratuberculosis
cgaagcgcuaacaaaagccc

SEQ ID NO: 1022642 - RNA, 13 nt, Mycobacterium avium subsp. paratuberculosis
cgaagcgcagcac

SEQ ID NO: 1022643 - RNA, 15 nt, Mycobacterium avium subsp. paratuberculosis
cgaagcgcagcagcu

SEQ ID NO: 1022644 - RNA, 15 nt, Mycobacterium avium subsp. paratuberculosis
cgaagaugcgcccgg

SEQ ID NO: 1022645 - RNA, 20 nt, Mycobacterium avium subsp. paratuberculosis
cgaagccgacaccggguccc

SEQ ID NO: 1022646 - RNA, 17 nt, Mycobacterium avium subsp. paratuberculosis
cgaagccgacgucgacc

SEQ ID NO: 1022647 - RNA, 16 nt, Mycobacterium avium subsp. paratuberculosis
cgaagaggugcucgac

SEQ ID NO: 1022648 - RNA, 16 nt, Mycobacterium avium subsp. paratuberculosis
cgaagucccacugccc

SEQ ID NO: 1022649 - RNA, 15 nt, Mycobacterium avium subsp. paratuberculosis
cgaagucgccggcca

SEQ ID NO: 1022650 - RNA, 21 nt, Mycobacterium avium subsp. paratuberculosis
cgaagucgcugaggcugcggg

SEQ ID NO: 1022651 - RNA, 12 nt, Mycobacterium avium subsp. paratuberculosis
cgaaggugaucu

SEQ ID NO: 1022652 - RNA, 14 nt, Mycobacterium avium subsp. paratuberculosis
cgaaguauccgguc

SEQ ID NO: 1022653 - RNA, 14 nt, Mycobacterium avium subsp. paratuberculosis
cgaagucaucaccg

SEQ ID NO: 1022654 - RNA, 22 nt, Mycobacterium avium subsp. paratuberculosis
cgaagucaucaccggggaucac

SEQ ID NO: 1022655 - RNA, 16 nt, Mycobacterium avium subsp. paratuberculosis
cgaaggcggccgcgag

SEQ ID NO: 1022656 - RNA, 16 nt, Mycobacterium avium subsp. paratuberculosis
cgaaggcggcgccggc

SEQ ID NO: 1022657 - RNA, 15 nt, Mycobacterium avium subsp. paratuberculosis
cgaaggucugcagca

SEQ ID NO: 1022658 - RNA, 22 nt, Mycobacterium avium subsp. paratuberculosis
cgaaggcggcgucgaugucgcc

SEQ ID NO: 1022659 - RNA, 20 nt, Mycobacterium avium subsp. paratuberculosis
cgaagggaaaggcagcagcc

SEQ ID NO: 1022660 - RNA, 22 nt, Mycobacterium avium subsp. paratuberculosis
cgaacaccaccggcaaccgcca

SEQ ID NO: 1022661 - RNA, 15 nt, Mycobacterium avium subsp. paratuberculosis
cgaacaccacggucc

SEQ ID NO: 1022662 - RNA, 19 nt, Mycobacterium avium subsp. paratuberculosis
cgaacacggcgcugagcga

SEQ ID NO: 1022663 - RNA, 19 nt, Mycobacterium avium subsp. paratuberculosis
cgaacaccucggcgaugcc

SEQ ID NO: 1022664 - RNA, 17 nt, Mycobacterium avium subsp. paratuberculosis
cgaacaccggcgcgacc

SEQ ID NO: 1022665 - RNA, 18 nt, Mycobacterium avium subsp. paratuberculosis
cgaacaccggcgcgacca

SEQ ID NO: 1022666 - RNA, 12 nt, Mycobacterium avium subsp. paratuberculosis
cgaacaccagca

SEQ ID NO: 1022667 - RNA, 20 nt, Mycobacterium avium subsp. paratuberculosis
cgaacaccgcaccggucucc

SEQ ID NO: 1022668 - RNA, 15 nt, Mycobacterium avium subsp. paratuberculosis
cgaacaccggcagcg

SEQ ID NO: 1022669 - RNA, 17 nt, Mycobacterium avium subsp. paratuberculosis
cgaacaccggcagcgcc

SEQ ID NO: 1022670 - RNA, 20 nt, Mycobacterium avium subsp. paratuberculosis
cgaacagccgggccgcccgc

SEQ ID NO: 1022671 - RNA, 15 nt, Mycobacterium avium subsp. paratuberculosis
cgaacagcagcaccc

SEQ ID NO: 1022672 - RNA, 18 nt, Mycobacterium avium subsp. paratuberculosis
cgaacagcacgccggccg

SEQ ID NO: 1022673 - RNA, 12 nt, Mycobacterium avium subsp. paratuberculosis
cgaacagcagca

SEQ ID NO: 1022674 - RNA, 12 nt, Mycobacterium avium subsp. paratuberculosis
cgaacagcagcg

SEQ ID NO: 1022675 - RNA, 21 nt, Mycobacterium avium subsp. paratuberculosis
cgaacagcagcgcgccgacca

SEQ ID NO: 1022676 - RNA, 15 nt, Mycobacterium avium subsp. paratuberculosis
cgaacagcagcggga

SEQ ID NO: 1022677 - RNA, 12 nt, Mycobacterium avium subsp. paratuberculosis
cgaacagcaggc

SEQ ID NO: 1022678 - RNA, 17 nt, Mycobacterium avium subsp. paratuberculosis
cgaacagguccuugccc

SEQ ID NO: 1022679 - RNA, 20 nt, Mycobacterium avium subsp. paratuberculosis
cgaacagguccuugcccagc

SEQ ID NO: 1022680 - RNA, 16 nt, Mycobacterium avium subsp. paratuberculosis
cgaacagggcggcggg

SEQ ID NO: 1022681 - RNA, 12 nt, Mycobacterium avium subsp. paratuberculosis
cgaacaggaugc

SEQ ID NO: 1022682 - RNA, 14 nt, Mycobacterium avium subsp. paratuberculosis
cgaacagcgcgccc

SEQ ID NO: 1022683 - RNA, 20 nt, Mycobacterium avium subsp. paratuberculosis
cgaacagcgggcagagcugc

SEQ ID NO: 1022684 - RNA, 13 nt, Mycobacterium avium subsp. paratuberculosis
cgaacccagcgcc

SEQ ID NO: 1022685 - RNA, 14 nt, Mycobacterium avium subsp. paratuberculosis
cgaacccggcgccc

SEQ ID NO: 1022686 - RNA, 17 nt, Mycobacterium avium subsp. paratuberculosis
cgaacccggcgcccggc

SEQ ID NO: 1022687 - RNA, 13 nt, Mycobacterium avium subsp. paratuberculosis
cgaacccgccagg

SEQ ID NO: 1022688 - RNA, 19 nt, Mycobacterium avium subsp. paratuberculosis
cgaaccaguucgccaccac

SEQ ID NO: 1022689 - RNA, 13 nt, Mycobacterium avium subsp. paratuberculosis
cgaaccgccccgc

SEQ ID NO: 1022690 - RNA, 20 nt, Mycobacterium avium subsp. paratuberculosis
cgaaccgccgcgcucgcacc

SEQ ID NO: 1022691 - RNA, 15 nt, Mycobacterium avium subsp. paratuberculosis
cgaaccgcugcggau

SEQ ID NO: 1022692 - RNA, 18 nt, Mycobacterium avium subsp. paratuberculosis
cgaaccggaagaucagca

SEQ ID NO: 1022693 - RNA, 15 nt, Mycobacterium avium subsp. paratuberculosis
cgaaccgggccagga

SEQ ID NO: 1022694 - RNA, 15 nt, Mycobacterium avium subsp. paratuberculosis
cgaacgcccggucga

SEQ ID NO: 1022695 - RNA, 17 nt, Mycobacterium avium subsp. paratuberculosis
cgaaccagcgcccgcuu

SEQ ID NO: 1022696 - RNA, 17 nt, Mycobacterium avium subsp. paratuberculosis
cgaacaucgagcccacc

SEQ ID NO: 1022697 - RNA, 18 nt, Mycobacterium avium subsp. paratuberculosis
cgaacaucgccagcaacg

SEQ ID NO: 1022698 - RNA, 17 nt, Mycobacterium avium subsp. paratuberculosis
cgaacaucuugggguuu

SEQ ID NO: 1022699 - RNA, 20 nt, Mycobacterium avium subsp. paratuberculosis
cgaacagugcacugccgacc

SEQ ID NO: 1022700 - RNA, 22 nt, Mycobacterium avium subsp. paratuberculosis
cgaaagcgcuuggcggagagcg

SEQ ID NO: 1022701 - RNA, 21 nt, Mycobacterium avium subsp. paratuberculosis
cgaaaucgucgggcaccagca

SEQ ID NO: 1022702 - RNA, 12 nt, Mycobacterium avium subsp. paratuberculosis
cgaaacugggag

SEQ ID NO: 1022703 - RNA, 13 nt, Mycobacterium avium subsp. paratuberculosis
cgaaacgccgcgc

SEQ ID NO: 1022704 - RNA, 11 nt, Mycobacterium avium subsp. paratuberculosis
cgaaaccgcca

SEQ ID NO: 1022705 - RNA, 15 nt, Mycobacterium avium subsp. paratuberculosis
cgaaacacagcagca

SEQ ID NO: 1022706 - RNA, 14 nt, Mycobacterium avium subsp. paratuberculosis
cgaaaaugcccagu

SEQ ID NO: 1022707 - RNA, 23 nt, Mycobacterium avium subsp. paratuberculosis
ccuugggcauccgcucgccgcgg

SEQ ID NO: 1022708 - RNA, 15 nt, Mycobacterium avium subsp. paratuberculosis
ccuuggucagcuccc

SEQ ID NO: 1022709 - RNA, 20 nt, Mycobacterium avium subsp. paratuberculosis
ccuuggucagcucccggcag

SEQ ID NO: 1022710 - RNA, 17 nt, Mycobacterium avium subsp. paratuberculosis
ccuuggugagcaccgcg

SEQ ID NO: 1022711 - RNA, 19 nt, Mycobacterium avium subsp. paratuberculosis
ccuucgggguggucaccgg

SEQ ID NO: 1022712 - RNA, 12 nt, Mycobacterium avium subsp. paratuberculosis
ccuucgggccga

SEQ ID NO: 1022713 - RNA, 21 nt, Mycobacterium avium subsp. paratuberculosis
ccuucucccgcggcagccggg

SEQ ID NO: 1022714 - RNA, 22 nt, Mycobacterium avium subsp. paratuberculosis
ccuugagguagucgcgcagcug

SEQ ID NO: 1022715 - RNA, 18 nt, Mycobacterium avium subsp. paratuberculosis
ccuugaucuuggccuggg

SEQ ID NO: 1022716 - RNA, 20 nt, Mycobacterium avium subsp. paratuberculosis
ccuugaucuuggccugggcc

SEQ ID NO: 1022717 - RNA, 16 nt, Mycobacterium avium subsp. paratuberculosis
ccuugauccggccgcg

SEQ ID NO: 1022718 - RNA, 19 nt, Mycobacterium avium subsp. paratuberculosis
ccuugcagcccgcguccag

SEQ ID NO: 1022719 - RNA, 21 nt, Mycobacterium avium subsp. paratuberculosis
ccuugcagcccgcguccagca

SEQ ID NO: 1022720 - RNA, 22 nt, Mycobacterium avium subsp. paratuberculosis
ccuugcgcgggucgccgggcag

SEQ ID NO: 1022721 - RNA, 13 nt, Mycobacterium avium subsp. paratuberculosis
ccuugcgcagccg

SEQ ID NO: 1022722 - RNA, 19 nt, Mycobacterium avium subsp. paratuberculosis
ccuugcgcagccggcagca

SEQ ID NO: 1022723 - RNA, 21 nt, Mycobacterium avium subsp. paratuberculosis
ccuugcgcgccgcgacgucgg

SEQ ID NO: 1022724 - RNA, 16 nt, Mycobacterium avium subsp. paratuberculosis
ccuuggcggcggccag

SEQ ID NO: 1022725 - RNA, 14 nt, Mycobacterium avium subsp. paratuberculosis
ccuuggcguccaug

SEQ ID NO: 1022726 - RNA, 14 nt, Mycobacterium avium subsp. paratuberculosis
ccuugcggccgccg

SEQ ID NO: 1022727 - RNA, 15 nt, Mycobacterium avium subsp. paratuberculosis
ccuugcgggccggag

SEQ ID NO: 1022728 - RNA, 11 nt, Mycobacterium avium subsp. paratuberculosis
ccuuggcggca

SEQ ID NO: 1022729 - RNA, 15 nt, Mycobacterium avium subsp. paratuberculosis
ccuuggcggccacga

SEQ ID NO: 1022730 - RNA, 15 nt, Mycobacterium avium subsp. paratuberculosis
ccuugcgagccggag

SEQ ID NO: 1022731 - RNA, 18 nt, Mycobacterium avium subsp. paratuberculosis
ccuugccccaccaccgcc

SEQ ID NO: 1022732 - RNA, 18 nt, Mycobacterium avium subsp. paratuberculosis
ccuugccgaugccggcgu

SEQ ID NO: 1022733 - RNA, 15 nt, Mycobacterium avium subsp. paratuberculosis
ccuugcccggcucgg

SEQ ID NO: 1022734 - RNA, 16 nt, Mycobacterium avium subsp. paratuberculosis
ccuugccggcggcggg

SEQ ID NO: 1022735 - RNA, 18 nt, Mycobacterium avium subsp. paratuberculosis
ccuugccggcggcgggcu

SEQ ID NO: 1022736 - RNA, 19 nt, Mycobacterium avium subsp. paratuberculosis
ccuguuuggcugucgcgcu

SEQ ID NO: 1022737 - RNA, 12 nt, Mycobacterium avium subsp. paratuberculosis
ccuguuggccag

SEQ ID NO: 1022738 - RNA, 20 nt, Mycobacterium avium subsp. paratuberculosis
ccugugaggcguuggcccgc

SEQ ID NO: 1022739 - RNA, 18 nt, Mycobacterium avium subsp. paratuberculosis
ccugugcaccgugcugug

SEQ ID NO: 1022740 - RNA, 23 nt, Mycobacterium avium subsp. paratuberculosis
ccugugggucgacagaaaagaga

SEQ ID NO: 1022741 - RNA, 17 nt, Mycobacterium avium subsp. paratuberculosis
ccugcucgcgggccacc

SEQ ID NO: 1022742 - RNA, 14 nt, Mycobacterium avium subsp. paratuberculosis
ccugcucggccagc

SEQ ID NO: 1022743 - RNA, 19 nt, Mycobacterium avium subsp. paratuberculosis
ccugcucgucgacgcugac

SEQ ID NO: 1022744 - RNA, 15 nt, Mycobacterium avium subsp. paratuberculosis
ccugcucgucgguga

SEQ ID NO: 1022745 - RNA, 18 nt, Mycobacterium avium subsp. paratuberculosis
ccugguaccccagcaaaa

SEQ ID NO: 1022746 - RNA, 21 nt, Mycobacterium avium subsp. paratuberculosis
ccugguaccccagcaaaaccc

SEQ ID NO: 1022747 - RNA, 19 nt, Mycobacterium avium subsp. paratuberculosis
ccugguagggguccuccag

SEQ ID NO: 1022748 - RNA, 17 nt, Mycobacterium avium subsp. paratuberculosis
ccugguacagcaccgcc

SEQ ID NO: 1022749 - RNA, 18 nt, Mycobacterium avium subsp. paratuberculosis
ccugguacagcaccgccg

SEQ ID NO: 1022750 - RNA, 16 nt, Mycobacterium avium subsp. paratuberculosis
ccugggugcgcggcgc

SEQ ID NO: 1022751 - RNA, 18 nt, Mycobacterium avium subsp. paratuberculosis
ccugggugcgcggcgccg

SEQ ID NO: 1022752 - RNA, 16 nt, Mycobacterium avium subsp. paratuberculosis
ccuggucaaggugcug

SEQ ID NO: 1022753 - RNA, 22 nt, Mycobacterium avium subsp. paratuberculosis
ccugguugaacggcaccccgcg

SEQ ID NO: 1022754 - RNA, 16 nt, Mycobacterium avium subsp. paratuberculosis
ccugguugacaccacc

SEQ ID NO: 1022755 - RNA, 24 nt, Mycobacterium avium subsp. paratuberculosis
ccuggucgaacagcacgccggccg

SEQ ID NO: 1022756 - RNA, 13 nt, Mycobacterium avium subsp. paratuberculosis
ccuggucgaagau

SEQ ID NO: 1022757 - RNA, 14 nt, Mycobacterium avium subsp. paratuberculosis
ccugguugccgccc

SEQ ID NO: 1022758 - RNA, 15 nt, Mycobacterium avium subsp. paratuberculosis
ccugguugccgcccu

SEQ ID NO: 1022759 - RNA, 17 nt, Mycobacterium avium subsp. paratuberculosis
ccugguugacgcccccg

SEQ ID NO: 1022760 - RNA, 18 nt, Mycobacterium avium subsp. paratuberculosis
ccugucaacgagacaccc

SEQ ID NO: 1022761 - RNA, 20 nt, Mycobacterium avium subsp. paratuberculosis
ccugucaacgagacacccuc

SEQ ID NO: 1022762 - RNA, 14 nt, Mycobacterium avium subsp. paratuberculosis
ccuguccggucuuc

SEQ ID NO: 1022763 - RNA, 17 nt, Mycobacterium avium subsp. paratuberculosis
ccugauugacggcccac

SEQ ID NO: 1022764 - RNA, 21 nt, Mycobacterium avium subsp. paratuberculosis
ccugaucgaguuccgcgucgg

SEQ ID NO: 1022765 - RNA, 17 nt, Mycobacterium avium subsp. paratuberculosis
ccugaucgaugccgugg

SEQ ID NO: 1022766 - RNA, 22 nt, Mycobacterium avium subsp. paratuberculosis
ccugaucgcggcgagcagcgcg

SEQ ID NO: 1022767 - RNA, 22 nt, Mycobacterium avium subsp. paratuberculosis
ccugcaacuggucgugcagcac

SEQ ID NO: 1022768 - RNA, 13 nt, Mycobacterium avium subsp. paratuberculosis
ccugcagcucgcc

SEQ ID NO: 1022769 - RNA, 16 nt, Mycobacterium avium subsp. paratuberculosis
ccugcagcgccguccg

SEQ ID NO: 1022770 - RNA, 23 nt, Mycobacterium avium subsp. paratuberculosis
ccugcagcgccguccgcaccgcg

SEQ ID NO: 1022771 - RNA, 14 nt, Mycobacterium avium subsp. paratuberculosis
ccugccacagcgac

SEQ ID NO: 1022772 - RNA, 20 nt, Mycobacterium avium subsp. paratuberculosis
ccugcaucucgacccgggcc

SEQ ID NO: 1022773 - RNA, 12 nt, Mycobacterium avium subsp. paratuberculosis
ccugcagcuggc

SEQ ID NO: 1022774 - RNA, 22 nt, Mycobacterium avium subsp. paratuberculosis
ccugcaggaucagcacuucaug

SEQ ID NO: 1022775 - RNA, 15 nt, Mycobacterium avium subsp. paratuberculosis
ccugcaggcaggccg

SEQ ID NO: 1022776 - RNA, 19 nt, Mycobacterium avium subsp. paratuberculosis
ccugcaggcaggccggcag

SEQ ID NO: 1022777 - RNA, 20 nt, Mycobacterium avium subsp. paratuberculosis
ccugcaggcaggccggcagc

SEQ ID NO: 1022778 - RNA, 21 nt, Mycobacterium avium subsp. paratuberculosis
ccugcaggcaggccggcagcc

SEQ ID NO: 1022779 - RNA, 13 nt, Mycobacterium avium subsp. paratuberculosis
ccugccggcgccg

SEQ ID NO: 1022780 - RNA, 23 nt, Mycobacterium avium subsp. paratuberculosis
ccugccgucgacgaccaccacca

SEQ ID NO: 1022781 - RNA, 20 nt, Mycobacterium avium subsp. paratuberculosis
ccugccgcaacgggccgcag

SEQ ID NO: 1022782 - RNA, 14 nt, Mycobacterium avium subsp. paratuberculosis
ccugccgccaccgc

SEQ ID NO: 1022783 - RNA, 17 nt, Mycobacterium avium subsp. paratuberculosis
ccugccgccaccgcgaa

SEQ ID NO: 1022784 - RNA, 16 nt, Mycobacterium avium subsp. paratuberculosis
ccugcgccagcagcag

SEQ ID NO: 1022785 - RNA, 18 nt, Mycobacterium avium subsp. paratuberculosis
ccugcgcggccugcagca

SEQ ID NO: 1022786 - RNA, 18 nt, Mycobacterium avium subsp. paratuberculosis
ccugcgcgaaaggcccac

SEQ ID NO: 1022787 - RNA, 19 nt, Mycobacterium avium subsp. paratuberculosis
ccugcgcgacgcugauggc

SEQ ID NO: 1022788 - RNA, 19 nt, Mycobacterium avium subsp. paratuberculosis
ccugcggcaacagcaccag

SEQ ID NO: 1022789 - RNA, 17 nt, Mycobacterium avium subsp. paratuberculosis
ccugcgguucgggcccc

SEQ ID NO: 1022790 - RNA, 21 nt, Mycobacterium avium subsp. paratuberculosis
ccugcguccgauaccagccgc

SEQ ID NO: 1022791 - RNA, 18 nt, Mycobacterium avium subsp. paratuberculosis
ccucuucggggguggcca

SEQ ID NO: 1022792 - RNA, 13 nt, Mycobacterium avium subsp. paratuberculosis
ccucuucgcugga

SEQ ID NO: 1022793 - RNA, 24 nt, Mycobacterium avium subsp. paratuberculosis
ccucuugaacgcguacagcgcccg

SEQ ID NO: 1022794 - RNA, 14 nt, Mycobacterium avium subsp. paratuberculosis
ccucuucggcgcgc

SEQ ID NO: 1022795 - RNA, 22 nt, Mycobacterium avium subsp. paratuberculosis
ccugacugagucaagccggcau

SEQ ID NO: 1022796 - RNA, 14 nt, Mycobacterium avium subsp. paratuberculosis
ccugagacgacgcc

SEQ ID NO: 1022797 - RNA, 20 nt, Mycobacterium avium subsp. paratuberculosis
ccugagacgacgccaccauc

SEQ ID NO: 1022798 - RNA, 12 nt, Mycobacterium avium subsp. paratuberculosis
ccugagcccgcc

SEQ ID NO: 1022799 - RNA, 14 nt, Mycobacterium avium subsp. paratuberculosis
ccugagcccgccuc

SEQ ID NO: 1022800 - RNA, 20 nt, Mycobacterium avium subsp. paratuberculosis
ccugagcuuuucgucggugc

SEQ ID NO: 1022801 - RNA, 23 nt, Mycobacterium avium subsp. paratuberculosis
ccugauacgacguccgggccgcc

SEQ ID NO: 1022802 - RNA, 17 nt, Mycobacterium avium subsp. paratuberculosis
ccugagggugucggcga

SEQ ID NO: 1022803 - RNA, 18 nt, Mycobacterium avium subsp. paratuberculosis
ccugaccgcgggcccgcc

SEQ ID NO: 1022804 - RNA, 12 nt, Mycobacterium avium subsp. paratuberculosis
ccugaccagcgg

SEQ ID NO: 1022805 - RNA, 23 nt, Mycobacterium avium subsp. paratuberculosis
ccugacgcucggucgccacggcc

SEQ ID NO: 1022806 - RNA, 17 nt, Mycobacterium avium subsp. paratuberculosis
ccugacgggagucgggc

SEQ ID NO: 1022807 - RNA, 22 nt, Mycobacterium avium subsp. paratuberculosis
ccugacgggagucgggcccgcc

SEQ ID NO: 1022808 - RNA, 20 nt, Mycobacterium avium subsp. paratuberculosis
ccugacgcaucaccacgcug

SEQ ID NO: 1022809 - RNA, 17 nt, Mycobacterium avium subsp. paratuberculosis
ccucugccagaucugua

SEQ ID NO: 1022810 - RNA, 18 nt, Mycobacterium avium subsp. paratuberculosis
ccucucggcgccguccag

SEQ ID NO: 1022811 - RNA, 22 nt, Mycobacterium avium subsp. paratuberculosis
ccucucgaagcgacaaaggagg

SEQ ID NO: 1022812 - RNA, 19 nt, Mycobacterium avium subsp. paratuberculosis
ccucgucuccggcggcagg

SEQ ID NO: 1022813 - RNA, 17 nt, Mycobacterium avium subsp. paratuberculosis
ccucguucuggcccgcc

SEQ ID NO: 1022814 - RNA, 21 nt, Mycobacterium avium subsp. paratuberculosis
ccucgucaccgugggcggcgc

SEQ ID NO: 1022815 - RNA, 14 nt, Mycobacterium avium subsp. paratuberculosis
ccucgucgaccagg

SEQ ID NO: 1022816 - RNA, 19 nt, Mycobacterium avium subsp. paratuberculosis
ccucgucgagcagcgcccg

SEQ ID NO: 1022817 - RNA, 16 nt, Mycobacterium avium subsp. paratuberculosis
ccucguccgcggcggc

SEQ ID NO: 1022818 - RNA, 18 nt, Mycobacterium avium subsp. paratuberculosis
ccucgucgagccgggccc

SEQ ID NO: 1022819 - RNA, 23 nt, Mycobacterium avium subsp. paratuberculosis
ccucgucggcgagcagcagcgcg

SEQ ID NO: 1022820 - RNA, 21 nt, Mycobacterium avium subsp. paratuberculosis
ccucgucggcgagcagcugca

SEQ ID NO: 1022821 - RNA, 21 nt, Mycobacterium avium subsp. paratuberculosis
ccucgucggcggcgacggcga

SEQ ID NO: 1022822 - RNA, 14 nt, Mycobacterium avium subsp. paratuberculosis
ccucggugaccucg

SEQ ID NO: 1022823 - RNA, 15 nt, Mycobacterium avium subsp. paratuberculosis
ccucggugaccucga

SEQ ID NO: 1022824 - RNA, 17 nt, Mycobacterium avium subsp. paratuberculosis
ccucggugaugucgacg

SEQ ID NO: 1022825 - RNA, 13 nt, Mycobacterium avium subsp. paratuberculosis
ccucggucagcgg

SEQ ID NO: 1022826 - RNA, 22 nt, Mycobacterium avium subsp. paratuberculosis
ccucggccggguccuggaaggc

SEQ ID NO: 1022827 - RNA, 18 nt, Mycobacterium avium subsp. paratuberculosis
ccucggccgcggucucga

SEQ ID NO: 1022828 - RNA, 18 nt, Mycobacterium avium subsp. paratuberculosis
ccucggccugcgcccggc

SEQ ID NO: 1022829 - RNA, 15 nt, Mycobacterium avium subsp. paratuberculosis
ccucggccuuggcca

SEQ ID NO: 1022830 - RNA, 14 nt, Mycobacterium avium subsp. paratuberculosis
ccucggcgaccagc

SEQ ID NO: 1022831 - RNA, 13 nt, Mycobacterium avium subsp. paratuberculosis
ccucggcgagccg

SEQ ID NO: 1022832 - RNA, 15 nt, Mycobacterium avium subsp. paratuberculosis
ccucggcgagccgcu

SEQ ID NO: 1022833 - RNA, 15 nt, Mycobacterium avium subsp. paratuberculosis
ccucggcgagcgagg

SEQ ID NO: 1022834 - RNA, 23 nt, Mycobacterium avium subsp. paratuberculosis
ccucggcgacgauggccaggccc

SEQ ID NO: 1022835 - RNA, 18 nt, Mycobacterium avium subsp. paratuberculosis
ccucggcgaucggccgcu

SEQ ID NO: 1022836 - RNA, 15 nt, Mycobacterium avium subsp. paratuberculosis
ccucggcgaucucgu

SEQ ID NO: 1022837 - RNA, 18 nt, Mycobacterium avium subsp. paratuberculosis
ccucggcgcucgccgcgc

SEQ ID NO: 1022838 - RNA, 19 nt, Mycobacterium avium subsp. paratuberculosis
ccucggcgcucgccgcgcg

SEQ ID NO: 1022839 - RNA, 19 nt, Mycobacterium avium subsp. paratuberculosis
ccucgcuaaucgccgcgcg

SEQ ID NO: 1022840 - RNA, 18 nt, Mycobacterium avium subsp. paratuberculosis
ccucgcuacgcgagcugc

SEQ ID NO: 1022841 - RNA, 13 nt, Mycobacterium avium subsp. paratuberculosis
ccucggccgccac

SEQ ID NO: 1022842 - RNA, 14 nt, Mycobacterium avium subsp. paratuberculosis
ccucggccgccacc

SEQ ID NO: 1022843 - RNA, 19 nt, Mycobacterium avium subsp. paratuberculosis
ccucggccgccaccgccau

SEQ ID NO: 1022844 - RNA, 20 nt, Mycobacterium avium subsp. paratuberculosis
ccucggccgccaccgccauc

SEQ ID NO: 1022845 - RNA, 14 nt, Mycobacterium avium subsp. paratuberculosis
ccucgcugacgucg

SEQ ID NO: 1022846 - RNA, 12 nt, Mycobacterium avium subsp. paratuberculosis
ccucggccaggu

SEQ ID NO: 1022847 - RNA, 13 nt, Mycobacterium avium subsp. paratuberculosis
ccucggccccaaa

SEQ ID NO: 1022848 - RNA, 20 nt, Mycobacterium avium subsp. paratuberculosis
ccucggccccaaaagccuug

SEQ ID NO: 1022849 - RNA, 20 nt, Mycobacterium avium subsp. paratuberculosis
ccucgcggaacugcucccag

SEQ ID NO: 1022850 - RNA, 21 nt, Mycobacterium avium subsp. paratuberculosis
ccucgcggaacugcucccagg

SEQ ID NO: 1022851 - RNA, 17 nt, Mycobacterium avium subsp. paratuberculosis
ccucgcgggcgaccugg

SEQ ID NO: 1022852 - RNA, 23 nt, Mycobacterium avium subsp. paratuberculosis
ccucgcgggcgaucuccagcggc

SEQ ID NO: 1022853 - RNA, 15 nt, Mycobacterium avium subsp. paratuberculosis
ccuccucguccgcgg

SEQ ID NO: 1022854 - RNA, 14 nt, Mycobacterium avium subsp. paratuberculosis
ccuccgucgccuuc

SEQ ID NO: 1022855 - RNA, 12 nt, Mycobacterium avium subsp. paratuberculosis
ccuccgccaccu

SEQ ID NO: 1022856 - RNA, 18 nt, Mycobacterium avium subsp. paratuberculosis
ccuccgccaccuccuccg

SEQ ID NO: 1022857 - RNA, 15 nt, Mycobacterium avium subsp. paratuberculosis
ccuccgcgaucagcu

SEQ ID NO: 1022858 - RNA, 22 nt, Mycobacterium avium subsp. paratuberculosis
ccuccgcgaucagcucguggcg

SEQ ID NO: 1022859 - RNA, 12 nt, Mycobacterium avium subsp. paratuberculosis
ccuccgcggcgc

SEQ ID NO: 1022860 - RNA, 17 nt, Mycobacterium avium subsp. paratuberculosis
ccucgcccagcgccgcg

SEQ ID NO: 1022861 - RNA, 24 nt, Mycobacterium avium subsp. paratuberculosis
ccucgccccggaugaccagggugg

SEQ ID NO: 1022862 - RNA, 17 nt, Mycobacterium avium subsp. paratuberculosis
ccucgcccgggugcugc

SEQ ID NO: 1022863 - RNA, 23 nt, Mycobacterium avium subsp. paratuberculosis
ccucgcgccgccacgcggcgcgc

SEQ ID NO: 1022864 - RNA, 14 nt, Mycobacterium avium subsp. paratuberculosis
ccucgcgccgcgau

SEQ ID NO: 1022865 - RNA, 15 nt, Mycobacterium avium subsp. paratuberculosis
ccucgcccgccgcga

SEQ ID NO: 1022866 - RNA, 19 nt, Mycobacterium avium subsp. paratuberculosis
ccuccugcaaggcccccgc

SEQ ID NO: 1022867 - RNA, 14 nt, Mycobacterium avium subsp. paratuberculosis
ccucgccagcccca

SEQ ID NO: 1022868 - RNA, 20 nt, Mycobacterium avium subsp. paratuberculosis
ccucgccagccccaccggcc

SEQ ID NO: 1022869 - RNA, 14 nt, Mycobacterium avium subsp. paratuberculosis
ccucauagccggcc

SEQ ID NO: 1022870 - RNA, 20 nt, Mycobacterium avium subsp. paratuberculosis
ccucauaggcguacaccagg

SEQ ID NO: 1022871 - RNA, 17 nt, Mycobacterium avium subsp. paratuberculosis
ccucccggaccaccagg

SEQ ID NO: 1022872 - RNA, 12 nt, Mycobacterium avium subsp. paratuberculosis
ccucccggcgcc

SEQ ID NO: 1022873 - RNA, 17 nt, Mycobacterium avium subsp. paratuberculosis
ccuccccgcuggcgccg

SEQ ID NO: 1022874 - RNA, 23 nt, Mycobacterium avium subsp. paratuberculosis
ccuccccgcuggcgccggcgucc

SEQ ID NO: 1022875 - RNA, 14 nt, Mycobacterium avium subsp. paratuberculosis
ccuccccggccagc

SEQ ID NO: 1022876 - RNA, 14 nt, Mycobacterium avium subsp. paratuberculosis
ccuccgacagcccc

SEQ ID NO: 1022877 - RNA, 15 nt, Mycobacterium avium subsp. paratuberculosis
ccuccgacagccccc

SEQ ID NO: 1022878 - RNA, 17 nt, Mycobacterium avium subsp. paratuberculosis
ccuccgacagcccccgc

SEQ ID NO: 1022879 - RNA, 21 nt, Mycobacterium avium subsp. paratuberculosis
ccuccgacccguccagcgugu

SEQ ID NO: 1022880 - RNA, 21 nt, Mycobacterium avium subsp. paratuberculosis
ccuccccauccgcggccaccg

SEQ ID NO: 1022881 - RNA, 14 nt, Mycobacterium avium subsp. paratuberculosis
ccucccccacccgc

SEQ ID NO: 1022882 - RNA, 13 nt, Mycobacterium avium subsp. paratuberculosis
ccucccagcgccc

SEQ ID NO: 1022883 - RNA, 15 nt, Mycobacterium avium subsp. paratuberculosis
ccuccagccgcuccg

SEQ ID NO: 1022884 - RNA, 21 nt, Mycobacterium avium subsp. paratuberculosis
ccuccagccgcuccucguuga

SEQ ID NO: 1022885 - RNA, 14 nt, Mycobacterium avium subsp. paratuberculosis
ccuccagccgcgcg

SEQ ID NO: 1022886 - RNA, 20 nt, Mycobacterium avium subsp. paratuberculosis
ccuccagccgcgcggccgcc

SEQ ID NO: 1022887 - RNA, 10 nt, Mycobacterium avium subsp. paratuberculosis
ccuccagcgg

SEQ ID NO: 1022888 - RNA, 14 nt, Mycobacterium avium subsp. paratuberculosis
ccuccagcggcagg

SEQ ID NO: 1022889 - RNA, 18 nt, Mycobacterium avium subsp. paratuberculosis
ccuccagcggcaggugga

SEQ ID NO: 1022890 - RNA, 13 nt, Mycobacterium avium subsp. paratuberculosis
ccuccagcccgga

SEQ ID NO: 1022891 - RNA, 16 nt, Mycobacterium avium subsp. paratuberculosis
ccuccagcagggacau

SEQ ID NO: 1022892 - RNA, 15 nt, Mycobacterium avium subsp. paratuberculosis
ccuauggcaucgcca

SEQ ID NO: 1022893 - RNA, 15 nt, Mycobacterium avium subsp. paratuberculosis
ccgugcgggucgcgc

SEQ ID NO: 1022894 - RNA, 12 nt, Mycobacterium avium subsp. paratuberculosis
ccgugccgucgg

SEQ ID NO: 1022895 - RNA, 15 nt, Mycobacterium avium subsp. paratuberculosis
ccgugccgucggcgu

SEQ ID NO: 1022896 - RNA, 14 nt, Mycobacterium avium subsp. paratuberculosis
ccgugccucgccac

SEQ ID NO: 1022897 - RNA, 19 nt, Mycobacterium avium subsp. paratuberculosis
ccgugcgacuugguggcca

SEQ ID NO: 1022898 - RNA, 14 nt, Mycobacterium avium subsp. paratuberculosis
ccgugcgccccgcc

SEQ ID NO: 1022899 - RNA, 18 nt, Mycobacterium avium subsp. paratuberculosis
ccgugcggcacgccgcag

SEQ ID NO: 1022900 - RNA, 12 nt, Mycobacterium avium subsp. paratuberculosis
ccgugcgcgucg

SEQ ID NO: 1022901 - RNA, 22 nt, Mycobacterium avium subsp. paratuberculosis
ccgugaucgccaccaccagcgg

SEQ ID NO: 1022902 - RNA, 21 nt, Mycobacterium avium subsp. paratuberculosis
ccgugaguguugaagccgcgg

SEQ ID NO: 1022903 - RNA, 12 nt, Mycobacterium avium subsp. paratuberculosis
ccgugccgcgcg

SEQ ID NO: 1022904 - RNA, 17 nt, Mycobacterium avium subsp. paratuberculosis
ccgugccgcgcggcgau

SEQ ID NO: 1022905 - RNA, 16 nt, Mycobacterium avium subsp. paratuberculosis
ccucaggcguccagca

SEQ ID NO: 1022906 - RNA, 20 nt, Mycobacterium avium subsp. paratuberculosis
ccucagguggacagaugcca

SEQ ID NO: 1022907 - RNA, 15 nt, Mycobacterium avium subsp. paratuberculosis
ccucaguccgccccg

SEQ ID NO: 1022908 - RNA, 15 nt, Mycobacterium avium subsp. paratuberculosis
ccucacuccagcggc

SEQ ID NO: 1022909 - RNA, 20 nt, Mycobacterium avium subsp. paratuberculosis
ccucaccugcguugcggcac

SEQ ID NO: 1022910 - RNA, 21 nt, Mycobacterium avium subsp. paratuberculosis
ccgucuucggggccgccgucg

SEQ ID NO: 1022911 - RNA, 14 nt, Mycobacterium avium subsp. paratuberculosis
ccgucuuggccagg

SEQ ID NO: 1022912 - RNA, 15 nt, Mycobacterium avium subsp. paratuberculosis
ccgucuuggccaggc

SEQ ID NO: 1022913 - RNA, 22 nt, Mycobacterium avium subsp. paratuberculosis
ccgucuuggccaggcccugcca

SEQ ID NO: 1022914 - RNA, 14 nt, Mycobacterium avium subsp. paratuberculosis
ccgugaccggcgau

SEQ ID NO: 1022915 - RNA, 16 nt, Mycobacterium avium subsp. paratuberculosis
ccgugaagggcccgcc

SEQ ID NO: 1022916 - RNA, 16 nt, Mycobacterium avium subsp. paratuberculosis
ccgucgggccguccgc

SEQ ID NO: 1022917 - RNA, 22 nt, Mycobacterium avium subsp. paratuberculosis
ccgucggggaugccgaaccgcu

SEQ ID NO: 1022918 - RNA, 19 nt, Mycobacterium avium subsp. paratuberculosis
ccgucggggcccggcccgg

SEQ ID NO: 1022919 - RNA, 18 nt, Mycobacterium avium subsp. paratuberculosis
ccgucggggcgucggcgg

SEQ ID NO: 1022920 - RNA, 18 nt, Mycobacterium avium subsp. paratuberculosis
ccgucgggacggccagca

SEQ ID NO: 1022921 - RNA, 20 nt, Mycobacterium avium subsp. paratuberculosis
ccgucggcguucagcggcac

SEQ ID NO: 1022922 - RNA, 18 nt, Mycobacterium avium subsp. paratuberculosis
ccgucggcuuccuccucg

SEQ ID NO: 1022923 - RNA, 22 nt, Mycobacterium avium subsp. paratuberculosis
ccgucggcuuccuccucggcgc

SEQ ID NO: 1022924 - RNA, 23 nt, Mycobacterium avium subsp. paratuberculosis
ccgucggcgggggauccgccugc

SEQ ID NO: 1022925 - RNA, 16 nt, Mycobacterium avium subsp. paratuberculosis
ccgucugcuggcccgg

SEQ ID NO: 1022926 - RNA, 15 nt, Mycobacterium avium subsp. paratuberculosis
ccgucgggucggcga

SEQ ID NO: 1022927 - RNA, 17 nt, Mycobacterium avium subsp. paratuberculosis
ccgucggggucgcgccg

SEQ ID NO: 1022928 - RNA, 23 nt, Mycobacterium avium subsp. paratuberculosis
ccgucggggugcgccaggcaggc

SEQ ID NO: 1022929 - RNA, 21 nt, Mycobacterium avium subsp. paratuberculosis
ccgucggggugcggucggcga

SEQ ID NO: 1022930 - RNA, 20 nt, Mycobacterium avium subsp. paratuberculosis
ccgucggugaaguuggcggc

SEQ ID NO: 1022931 - RNA, 24 nt, Mycobacterium avium subsp. paratuberculosis
ccgucgauuucaaggggccgggcu

SEQ ID NO: 1022932 - RNA, 17 nt, Mycobacterium avium subsp. paratuberculosis
ccgucgcaucagcucgg

SEQ ID NO: 1022933 - RNA, 20 nt, Mycobacterium avium subsp. paratuberculosis
ccgucgccaccgagucgcgc

SEQ ID NO: 1022934 - RNA, 15 nt, Mycobacterium avium subsp. paratuberculosis
ccgucgccccgcacc

SEQ ID NO: 1022935 - RNA, 15 nt, Mycobacterium avium subsp. paratuberculosis
ccgucgcccgcccag

SEQ ID NO: 1022936 - RNA, 16 nt, Mycobacterium avium subsp. paratuberculosis
ccgucgcccgcccagg

SEQ ID NO: 1022937 - RNA, 17 nt, Mycobacterium avium subsp. paratuberculosis
ccgucgcccgcccaggc

SEQ ID NO: 1022938 - RNA, 23 nt, Mycobacterium avium subsp. paratuberculosis
ccgucgcccgcccaggccgccag

SEQ ID NO: 1022939 - RNA, 15 nt, Mycobacterium avium subsp. paratuberculosis
ccguccuuggccgcc

SEQ ID NO: 1022940 - RNA, 18 nt, Mycobacterium avium subsp. paratuberculosis
ccguccuuggccgccagc

SEQ ID NO: 1022941 - RNA, 20 nt, Mycobacterium avium subsp. paratuberculosis
ccgucgaacagcgggcagag

SEQ ID NO: 1022942 - RNA, 13 nt, Mycobacterium avium subsp. paratuberculosis
ccguccggcgcca

SEQ ID NO: 1022943 - RNA, 15 nt, Mycobacterium avium subsp. paratuberculosis
ccguccggcgccagc

SEQ ID NO: 1022944 - RNA, 14 nt, Mycobacterium avium subsp. paratuberculosis
ccguccgcggcggc

SEQ ID NO: 1022945 - RNA, 14 nt, Mycobacterium avium subsp. paratuberculosis
ccguccucggccgc

SEQ ID NO: 1022946 - RNA, 20 nt, Mycobacterium avium subsp. paratuberculosis
ccguccucggccgccaccgc

SEQ ID NO: 1022947 - RNA, 23 nt, Mycobacterium avium subsp. paratuberculosis
ccguccgugcauagcuggcgccg

SEQ ID NO: 1022948 - RNA, 15 nt, Mycobacterium avium subsp. paratuberculosis
ccguccggggccggu

SEQ ID NO: 1022949 - RNA, 16 nt, Mycobacterium avium subsp. paratuberculosis
ccguccggguccggcu

SEQ ID NO: 1022950 - RNA, 21 nt, Mycobacterium avium subsp. paratuberculosis
ccguccgggucgcacagccgc

SEQ ID NO: 1022951 - RNA, 23 nt, Mycobacterium avium subsp. paratuberculosis
ccguccgggucgcacagccgcag

SEQ ID NO: 1022952 - RNA, 21 nt, Mycobacterium avium subsp. paratuberculosis
ccgucccgccgacggagacga

SEQ ID NO: 1022953 - RNA, 13 nt, Mycobacterium avium subsp. paratuberculosis
ccguccccguccg

SEQ ID NO: 1022954 - RNA, 15 nt, Mycobacterium avium subsp. paratuberculosis
ccguccacagccggc

SEQ ID NO: 1022955 - RNA, 21 nt, Mycobacterium avium subsp. paratuberculosis
ccguccaccaccaacccgguc

SEQ ID NO: 1022956 - RNA, 15 nt, Mycobacterium avium subsp. paratuberculosis
ccguccaccggcacg

SEQ ID NO: 1022957 - RNA, 13 nt, Mycobacterium avium subsp. paratuberculosis
ccgucaugguguc

SEQ ID NO: 1022958 - RNA, 21 nt, Mycobacterium avium subsp. paratuberculosis
ccguccagaucggccagcgcg

SEQ ID NO: 1022959 - RNA, 22 nt, Mycobacterium avium subsp. paratuberculosis
ccguccagaucggccagcgcgg

SEQ ID NO: 1022960 - RNA, 12 nt, Mycobacterium avium subsp. paratuberculosis
ccguccagcagc

SEQ ID NO: 1022961 - RNA, 14 nt, Mycobacterium avium subsp. paratuberculosis
ccguccagcgcaug

SEQ ID NO: 1022962 - RNA, 22 nt, Mycobacterium avium subsp. paratuberculosis
ccguccagcgcaugccacuugc

SEQ ID NO: 1022963 - RNA, 14 nt, Mycobacterium avium subsp. paratuberculosis
ccguccagcgucug

SEQ ID NO: 1022964 - RNA, 23 nt, Mycobacterium avium subsp. paratuberculosis
ccguccagcgucuggcagccggc

SEQ ID NO: 1022965 - RNA, 16 nt, Mycobacterium avium subsp. paratuberculosis
ccguccagcuccgccg

SEQ ID NO: 1022966 - RNA, 23 nt, Mycobacterium avium subsp. paratuberculosis
ccguccagcucgcguucgggccc

SEQ ID NO: 1022967 - RNA, 17 nt, Mycobacterium avium subsp. paratuberculosis
ccgucacugcacgcacg

SEQ ID NO: 1022968 - RNA, 16 nt, Mycobacterium avium subsp. paratuberculosis
ccgucacugucggcgc

SEQ ID NO: 1022969 - RNA, 14 nt, Mycobacterium avium subsp. paratuberculosis
ccgucacgcccguc

SEQ ID NO: 1022970 - RNA, 19 nt, Mycobacterium avium subsp. paratuberculosis
ccgucacggaucgcccacc

SEQ ID NO: 1022971 - RNA, 22 nt, Mycobacterium avium subsp. paratuberculosis
ccgucacggaucgcccacccgc

SEQ ID NO: 1022972 - RNA, 18 nt, Mycobacterium avium subsp. paratuberculosis
ccgucacggccguccagg

SEQ ID NO: 1022973 - RNA, 21 nt, Mycobacterium avium subsp. paratuberculosis
ccgucacggcugccgaccucg

SEQ ID NO: 1022974 - RNA, 13 nt, Mycobacterium avium subsp. paratuberculosis
ccgucacaggccg

SEQ ID NO: 1022975 - RNA, 14 nt, Mycobacterium avium subsp. paratuberculosis
ccgucaccgccagg

SEQ ID NO: 1022976 - RNA, 17 nt, Mycobacterium avium subsp. paratuberculosis
ccgucaccgccaggacc

SEQ ID NO: 1022977 - RNA, 15 nt, Mycobacterium avium subsp. paratuberculosis
ccgucagcgccgccc

SEQ ID NO: 1022978 - RNA, 21 nt, Mycobacterium avium subsp. paratuberculosis
ccgucaggguggugcccccgc

SEQ ID NO: 1022979 - RNA, 13 nt, Mycobacterium avium subsp. paratuberculosis
ccgucauccccau

SEQ ID NO: 1022980 - RNA, 16 nt, Mycobacterium avium subsp. paratuberculosis
ccgucaucgccgacgg

SEQ ID NO: 1022981 - RNA, 18 nt, Mycobacterium avium subsp. paratuberculosis
ccgucaucgugugggcgc

SEQ ID NO: 1022982 - RNA, 20 nt, Mycobacterium avium subsp. paratuberculosis
ccgucaucgugugggcgccc

SEQ ID NO: 1022983 - RNA, 22 nt, Mycobacterium avium subsp. paratuberculosis
ccgucaucgugugggcgcccgc

SEQ ID NO: 1022984 - RNA, 12 nt, Mycobacterium avium subsp. paratuberculosis
ccgucaucuccg

SEQ ID NO: 1022985 - RNA, 21 nt, Mycobacterium avium subsp. paratuberculosis
ccguaccagcgcucgacgagg

SEQ ID NO: 1022986 - RNA, 20 nt, Mycobacterium avium subsp. paratuberculosis
ccguacgcgccggccagccg

SEQ ID NO: 1022987 - RNA, 16 nt, Mycobacterium avium subsp. paratuberculosis
ccguaccgcaacaccg

SEQ ID NO: 1022988 - RNA, 15 nt, Mycobacterium avium subsp. paratuberculosis
ccguagacccacagc

SEQ ID NO: 1022989 - RNA, 22 nt, Mycobacterium avium subsp. paratuberculosis
ccggugugcagccacccgucgg

SEQ ID NO: 1022990 - RNA, 21 nt, Mycobacterium avium subsp. paratuberculosis
ccggugucacgcuggcgugac

SEQ ID NO: 1022991 - RNA, 23 nt, Mycobacterium avium subsp. paratuberculosis
ccgguuuccaguccggcgcccgg

SEQ ID NO: 1022992 - RNA, 17 nt, Mycobacterium avium subsp. paratuberculosis
ccguaucggccccggcc

SEQ ID NO: 1022993 - RNA, 18 nt, Mycobacterium avium subsp. paratuberculosis
ccguauugccgucggcgu

SEQ ID NO: 1022994 - RNA, 21 nt, Mycobacterium avium subsp. paratuberculosis
ccgucaaugguguagcucagc

SEQ ID NO: 1022995 - RNA, 13 nt, Mycobacterium avium subsp. paratuberculosis
ccguagcgcaaca

SEQ ID NO: 1022996 - RNA, 17 nt, Mycobacterium avium subsp. paratuberculosis
ccguagcgcaacaccga

SEQ ID NO: 1022997 - RNA, 16 nt, Mycobacterium avium subsp. paratuberculosis
ccguagcggugggcgc

SEQ ID NO: 1022998 - RNA, 19 nt, Mycobacterium avium subsp. paratuberculosis
ccguagcggugggcgcgua

SEQ ID NO: 1022999 - RNA, 16 nt, Mycobacterium avium subsp. paratuberculosis
ccguagcggcucgcca

SEQ ID NO: 1023000 - RNA, 23 nt, Mycobacterium avium subsp. paratuberculosis
ccguagcgcaugaugcccaggcc

SEQ ID NO: 1023001 - RNA, 14 nt, Mycobacterium avium subsp. paratuberculosis
ccguaggccgcgcu

SEQ ID NO: 1023002 - RNA, 16 nt, Mycobacterium avium subsp. paratuberculosis
ccguagucacccggcc

SEQ ID NO: 1023003 - RNA, 17 nt, Mycobacterium avium subsp. paratuberculosis
ccguagucacccggccc

SEQ ID NO: 1023004 - RNA, 13 nt, Mycobacterium avium subsp. paratuberculosis
ccguagucggcgg

SEQ ID NO: 1023005 - RNA, 16 nt, Mycobacterium avium subsp. paratuberculosis
ccguagguugccccac

SEQ ID NO: 1023006 - RNA, 21 nt, Mycobacterium avium subsp. paratuberculosis
ccggucucgaacacgccgucg

SEQ ID NO: 1023007 - RNA, 22 nt, Mycobacterium avium subsp. paratuberculosis
ccggucuccaugucgucggcgg

SEQ ID NO: 1023008 - RNA, 19 nt, Mycobacterium avium subsp. paratuberculosis
ccggucuucucggccaggc

SEQ ID NO: 1023009 - RNA, 20 nt, Mycobacterium avium subsp. paratuberculosis
ccggucugaucgcccagcac

SEQ ID NO: 1023010 - RNA, 21 nt, Mycobacterium avium subsp. paratuberculosis
ccggucugaucgcccagcacc

SEQ ID NO: 1023011 - RNA, 16 nt, Mycobacterium avium subsp. paratuberculosis
ccggucgaggucggcc

SEQ ID NO: 1023012 - RNA, 17 nt, Mycobacterium avium subsp. paratuberculosis
ccggucgaggucggcca

SEQ ID NO: 1023013 - RNA, 14 nt, Mycobacterium avium subsp. paratuberculosis
ccgguccugggccu

SEQ ID NO: 1023014 - RNA, 23 nt, Mycobacterium avium subsp. paratuberculosis
ccggucgacgauggcccgggcca

SEQ ID NO: 1023015 - RNA, 19 nt, Mycobacterium avium subsp. paratuberculosis
ccgguccaggcgaccggcc

SEQ ID NO: 1023016 - RNA, 20 nt, Mycobacterium avium subsp. paratuberculosis
ccgguccaggcgaccggccc

SEQ ID NO: 1023017 - RNA, 16 nt, Mycobacterium avium subsp. paratuberculosis
ccgguccagugccggc

SEQ ID NO: 1023018 - RNA, 20 nt, Mycobacterium avium subsp. paratuberculosis
ccgguccaguugugccgcaa

SEQ ID NO: 1023019 - RNA, 14 nt, Mycobacterium avium subsp. paratuberculosis
ccgguccagcccgg

SEQ ID NO: 1023020 - RNA, 20 nt, Mycobacterium avium subsp. paratuberculosis
ccgguccgaccgccaccacc

SEQ ID NO: 1023021 - RNA, 20 nt, Mycobacterium avium subsp. paratuberculosis
ccgguccgaucguccggcgc

SEQ ID NO: 1023022 - RNA, 15 nt, Mycobacterium avium subsp. paratuberculosis
ccgguccgcccagac

SEQ ID NO: 1023023 - RNA, 15 nt, Mycobacterium avium subsp. paratuberculosis
ccgguccgccgccgg

SEQ ID NO: 1023024 - RNA, 22 nt, Mycobacterium avium subsp. paratuberculosis
ccgguccgcugugcggcccggc

SEQ ID NO: 1023025 - RNA, 15 nt, Mycobacterium avium subsp. paratuberculosis
ccgguccggcggcac

SEQ ID NO: 1023026 - RNA, 21 nt, Mycobacterium avium subsp. paratuberculosis
ccgguccggcggcaccacccg

SEQ ID NO: 1023027 - RNA, 14 nt, Mycobacterium avium subsp. paratuberculosis
ccgguccggcuggu

SEQ ID NO: 1023028 - RNA, 20 nt, Mycobacterium avium subsp. paratuberculosis
ccgguccgugccacggccgc

SEQ ID NO: 1023029 - RNA, 16 nt, Mycobacterium avium subsp. paratuberculosis
ccggguacaccggcuc

SEQ ID NO: 1023030 - RNA, 15 nt, Mycobacterium avium subsp. paratuberculosis
ccggguaccucugcg

SEQ ID NO: 1023031 - RNA, 19 nt, Mycobacterium avium subsp. paratuberculosis
ccgggguguagcggauggc

SEQ ID NO: 1023032 - RNA, 19 nt, Mycobacterium avium subsp. paratuberculosis
ccggggugcccgggccgca

SEQ ID NO: 1023033 - RNA, 23 nt, Mycobacterium avium subsp. paratuberculosis
ccggggugagcagggccagcggc

SEQ ID NO: 1023034 - RNA, 18 nt, Mycobacterium avium subsp. paratuberculosis
ccgggguccucucggcgc

SEQ ID NO: 1023035 - RNA, 18 nt, Mycobacterium avium subsp. paratuberculosis
ccggggugaugccggcgg

SEQ ID NO: 1023036 - RNA, 13 nt, Mycobacterium avium subsp. paratuberculosis
ccggggucggcgc

SEQ ID NO: 1023037 - RNA, 22 nt, Mycobacterium avium subsp. paratuberculosis
ccgggggccgucacaggccgcc

SEQ ID NO: 1023038 - RNA, 16 nt, Mycobacterium avium subsp. paratuberculosis
ccgggggcggcggcgc

SEQ ID NO: 1023039 - RNA, 17 nt, Mycobacterium avium subsp. paratuberculosis
ccgggggcggcggcgcg

SEQ ID NO: 1023040 - RNA, 18 nt, Mycobacterium avium subsp. paratuberculosis
ccggggguggcggucccg

SEQ ID NO: 1023041 - RNA, 14 nt, Mycobacterium avium subsp. paratuberculosis
ccggggucagggcg

SEQ ID NO: 1023042 - RNA, 20 nt, Mycobacterium avium subsp. paratuberculosis
ccggugggacugggcgccgc

SEQ ID NO: 1023043 - RNA, 23 nt, Mycobacterium avium subsp. paratuberculosis
ccggugggacugggcgccgccgg

SEQ ID NO: 1023044 - RNA, 15 nt, Mycobacterium avium subsp. paratuberculosis
ccggugcgccgaccg

SEQ ID NO: 1023045 - RNA, 19 nt, Mycobacterium avium subsp. paratuberculosis
ccggugcgcgcaccaggcc

SEQ ID NO: 1023046 - RNA, 20 nt, Mycobacterium avium subsp. paratuberculosis
ccggugcgcgucagccgucg

SEQ ID NO: 1023047 - RNA, 21 nt, Mycobacterium avium subsp. paratuberculosis
ccgguggcggccaggccggcg

SEQ ID NO: 1023048 - RNA, 15 nt, Mycobacterium avium subsp. paratuberculosis
ccggugcgccagcgu

SEQ ID NO: 1023049 - RNA, 15 nt, Mycobacterium avium subsp. paratuberculosis
ccggugucgccgucg

SEQ ID NO: 1023050 - RNA, 17 nt, Mycobacterium avium subsp. paratuberculosis
ccggugucugaccucgc

SEQ ID NO: 1023051 - RNA, 22 nt, Mycobacterium avium subsp. paratuberculosis
ccggugucugaccucgcgccgc

SEQ ID NO: 1023052 - RNA, 16 nt, Mycobacterium avium subsp. paratuberculosis
ccgguggugagacccu

SEQ ID NO: 1023053 - RNA, 12 nt, Mycobacterium avium subsp. paratuberculosis
ccggugaccccg

SEQ ID NO: 1023054 - RNA, 20 nt, Mycobacterium avium subsp. paratuberculosis
ccggugacgauccggucgau

SEQ ID NO: 1023055 - RNA, 15 nt, Mycobacterium avium subsp. paratuberculosis
ccggugacggucagg

SEQ ID NO: 1023056 - RNA, 18 nt, Mycobacterium avium subsp. paratuberculosis
ccggugacggucagggug

SEQ ID NO: 1023057 - RNA, 21 nt, Mycobacterium avium subsp. paratuberculosis
ccggugaccgcgacgcugccg

SEQ ID NO: 1023058 - RNA, 15 nt, Mycobacterium avium subsp. paratuberculosis
ccggugaccgcgccg

SEQ ID NO: 1023059 - RNA, 16 nt, Mycobacterium avium subsp. paratuberculosis
ccggugaccucccgga

SEQ ID NO: 1023060 - RNA, 18 nt, Mycobacterium avium subsp. paratuberculosis
ccggugaccugcagcgcc

SEQ ID NO: 1023061 - RNA, 20 nt, Mycobacterium avium subsp. paratuberculosis
ccggugaccugcagcgccuu

SEQ ID NO: 1023062 - RNA, 15 nt, Mycobacterium avium subsp. paratuberculosis
ccggugccgccggcg

SEQ ID NO: 1023063 - RNA, 16 nt, Mycobacterium avium subsp. paratuberculosis
ccggugccgccggcgc

SEQ ID NO: 1023064 - RNA, 15 nt, Mycobacterium avium subsp. paratuberculosis
ccggugcgacgccgc

SEQ ID NO: 1023065 - RNA, 14 nt, Mycobacterium avium subsp. paratuberculosis
ccggcggccagcga

SEQ ID NO: 1023066 - RNA, 16 nt, Mycobacterium avium subsp. paratuberculosis
ccggcucggugcgcca

SEQ ID NO: 1023067 - RNA, 19 nt, Mycobacterium avium subsp. paratuberculosis
ccggcucuccaucuucggc

SEQ ID NO: 1023068 - RNA, 23 nt, Mycobacterium avium subsp. paratuberculosis
ccggcucgggaacggucagccgc

SEQ ID NO: 1023069 - RNA, 17 nt, Mycobacterium avium subsp. paratuberculosis
ccggcucgguaugcggc

SEQ ID NO: 1023070 - RNA, 16 nt, Mycobacterium avium subsp. paratuberculosis
ccggcucgcugaucug

SEQ ID NO: 1023071 - RNA, 22 nt, Mycobacterium avium subsp. paratuberculosis
ccggcucgcugaucugcggcac

SEQ ID NO: 1023072 - RNA, 15 nt, Mycobacterium avium subsp. paratuberculosis
ccggcucgccgggcu

SEQ ID NO: 1023073 - RNA, 23 nt, Mycobacterium avium subsp. paratuberculosis
ccggcucgccguugcgggucggc

SEQ ID NO: 1023074 - RNA, 14 nt, Mycobacterium avium subsp. paratuberculosis
ccggcggccaccau

SEQ ID NO: 1023075 - RNA, 13 nt, Mycobacterium avium subsp. paratuberculosis
ccggcggccgcca

SEQ ID NO: 1023076 - RNA, 18 nt, Mycobacterium avium subsp. paratuberculosis
ccggcggccgccaucauc

SEQ ID NO: 1023077 - RNA, 19 nt, Mycobacterium avium subsp. paratuberculosis
aaaccgcugcggcacacca

SEQ ID NO: 1023078 - RNA, 12 nt, Mycobacterium avium subsp. paratuberculosis
ccggcggcagcg

SEQ ID NO: 1023079 - RNA, 14 nt, Mycobacterium avium subsp. paratuberculosis
ccggcggcaccacc

SEQ ID NO: 1023080 - RNA, 17 nt, Mycobacterium avium subsp. paratuberculosis
ccggcggcaccacccgc

SEQ ID NO: 1023081 - RNA, 16 nt, Mycobacterium avium subsp. paratuberculosis
ccggcggcaccgccgc

SEQ ID NO: 1023082 - RNA, 21 nt, Mycobacterium avium subsp. paratuberculosis
ccggcggcaaaacgcugggcg

SEQ ID NO: 1023083 - RNA, 12 nt, Mycobacterium avium subsp. paratuberculosis
ccggcggacagc

SEQ ID NO: 1023084 - RNA, 19 nt, Mycobacterium avium subsp. paratuberculosis
ccggcggacagccccgagc

SEQ ID NO: 1023085 - RNA, 23 nt, Mycobacterium avium subsp. paratuberculosis
ccggcggacagccccgagccgcg

SEQ ID NO: 1023086 - RNA, 17 nt, Mycobacterium avium subsp. paratuberculosis
ccggcggacccagcucc

SEQ ID NO: 1023087 - RNA, 13 nt, Mycobacterium avium subsp. paratuberculosis
ccgggaaggcggc

SEQ ID NO: 1023088 - RNA, 18 nt, Mycobacterium avium subsp. paratuberculosis
ccgggaaugucauuugag

SEQ ID NO: 1023089 - RNA, 15 nt, Mycobacterium avium subsp. paratuberculosis
ccgggaaugucgcgc

SEQ ID NO: 1023090 - RNA, 22 nt, Mycobacterium avium subsp. paratuberculosis
ccgggacaucgucgcgcccagg

SEQ ID NO: 1023091 - RNA, 22 nt, Mycobacterium avium subsp. paratuberculosis
ccgggaacgacggugcgcccgu

SEQ ID NO: 1023092 - RNA, 23 nt, Mycobacterium avium subsp. paratuberculosis
ccgggaacgacggugcgcccguc

SEQ ID NO: 1023093 - RNA, 15 nt, Mycobacterium avium subsp. paratuberculosis
ccgggacagccgcgc

SEQ ID NO: 1023094 - RNA, 16 nt, Mycobacterium avium subsp. paratuberculosis
ccgggacagccgcgcc

SEQ ID NO: 1023095 - RNA, 18 nt, Mycobacterium avium subsp. paratuberculosis
ccgggacgaaggugcgca

SEQ ID NO: 1023096 - RNA, 15 nt, Mycobacterium avium subsp. paratuberculosis
ccgggacgacggcgc

SEQ ID NO: 1023097 - RNA, 18 nt, Mycobacterium avium subsp. paratuberculosis
ccgggacgacggcgccgc

SEQ ID NO: 1023098 - RNA, 19 nt, Mycobacterium avium subsp. paratuberculosis
ccgggacgacggcgccgcc

SEQ ID NO: 1023099 - RNA, 22 nt, Mycobacterium avium subsp. paratuberculosis
ccgggacgacggcgccgcccgg

SEQ ID NO: 1023100 - RNA, 22 nt, Mycobacterium avium subsp. paratuberculosis
ccgggacgggucggugguucgc

SEQ ID NO: 1023101 - RNA, 15 nt, Mycobacterium avium subsp. paratuberculosis
ccgggaccggcguca

SEQ ID NO: 1023102 - RNA, 16 nt, Mycobacterium avium subsp. paratuberculosis
ccgggaggccagcacc

SEQ ID NO: 1023103 - RNA, 18 nt, Mycobacterium avium subsp. paratuberculosis
ccgggaggccagcaccuu

SEQ ID NO: 1023104 - RNA, 18 nt, Mycobacterium avium subsp. paratuberculosis
ccgggauaccgcgaccgc

SEQ ID NO: 1023105 - RNA, 20 nt, Mycobacterium avium subsp. paratuberculosis
ccgggauagagcaccgcgcu

SEQ ID NO: 1023106 - RNA, 18 nt, Mycobacterium avium subsp. paratuberculosis
ccggcuugccccgguccc

SEQ ID NO: 1023107 - RNA, 20 nt, Mycobacterium avium subsp. paratuberculosis
ccggcuugccccggucccgg

SEQ ID NO: 1023108 - RNA, 21 nt, Mycobacterium avium subsp. paratuberculosis
ccggcuugccgaucgccgcgg

SEQ ID NO: 1023109 - RNA, 16 nt, Mycobacterium avium subsp. paratuberculosis
ccggcuucgccgcgcu

SEQ ID NO: 1023110 - RNA, 21 nt, Mycobacterium avium subsp. paratuberculosis
ccggcuucgcugcgccggcgg

SEQ ID NO: 1023111 - RNA, 20 nt, Mycobacterium avium subsp. paratuberculosis
ccggcugagcagccagucgg

SEQ ID NO: 1023112 - RNA, 17 nt, Mycobacterium avium subsp. paratuberculosis
ccggcucucagccggaa

SEQ ID NO: 1023113 - RNA, 16 nt, Mycobacterium avium subsp. paratuberculosis
ccggcugacugccggc

SEQ ID NO: 1023114 - RNA, 15 nt, Mycobacterium avium subsp. paratuberculosis
ccggcuuggccacga

SEQ ID NO: 1023115 - RNA, 14 nt, Mycobacterium avium subsp. paratuberculosis
ccgggccgccauca

SEQ ID NO: 1023116 - RNA, 21 nt, Mycobacterium avium subsp. paratuberculosis
ccgggccgccaucaccgcgcu

SEQ ID NO: 1023117 - RNA, 12 nt, Mycobacterium avium subsp. paratuberculosis
ccgggcgcgccc

SEQ ID NO: 1023118 - RNA, 14 nt, Mycobacterium avium subsp. paratuberculosis
ccgggcgcgcccac

SEQ ID NO: 1023119 - RNA, 13 nt, Mycobacterium avium subsp. paratuberculosis
ccgggccuccugu

SEQ ID NO: 1023120 - RNA, 22 nt, Mycobacterium avium subsp. paratuberculosis
ccgggccuccuguuggcccugc

SEQ ID NO: 1023121 - RNA, 12 nt, Mycobacterium avium subsp. paratuberculosis
ccgggccgccuc

SEQ ID NO: 1023122 - RNA, 16 nt, Mycobacterium avium subsp. paratuberculosis
ccgggccgcggcggua

SEQ ID NO: 1023123 - RNA, 18 nt, Mycobacterium avium subsp. paratuberculosis
ccgggccgcggcgguagc

SEQ ID NO: 1023124 - RNA, 20 nt, Mycobacterium avium subsp. paratuberculosis
ccgggccgcuggccgccccg

SEQ ID NO: 1023125 - RNA, 18 nt, Mycobacterium avium subsp. paratuberculosis
ccgggauaguucgccgcc

SEQ ID NO: 1023126 - RNA, 19 nt, Mycobacterium avium subsp. paratuberculosis
ccgggauaguucgccgccg

SEQ ID NO: 1023127 - RNA, 19 nt, Mycobacterium avium subsp. paratuberculosis
ccgggauccggcgcgccgc

SEQ ID NO: 1023128 - RNA, 17 nt, Mycobacterium avium subsp. paratuberculosis
ccgggaucggcagcgcg

SEQ ID NO: 1023129 - RNA, 15 nt, Mycobacterium avium subsp. paratuberculosis
ccgggaucggcggcg

SEQ ID NO: 1023130 - RNA, 22 nt, Mycobacterium avium subsp. paratuberculosis
ccgggaucggcggggcgcguuc

SEQ ID NO: 1023131 - RNA, 19 nt, Mycobacterium avium subsp. paratuberculosis
ccgggaucggggugccgcc

SEQ ID NO: 1023132 - RNA, 19 nt, Mycobacterium avium subsp. paratuberculosis
ccgggaucguguggccgcc

SEQ ID NO: 1023133 - RNA, 20 nt, Mycobacterium avium subsp. paratuberculosis
ccgggaucguguggccgccc

SEQ ID NO: 1023134 - RNA, 17 nt, Mycobacterium avium subsp. paratuberculosis
ccgggaugaagccgccc

SEQ ID NO: 1023135 - RNA, 15 nt, Mycobacterium avium subsp. paratuberculosis
ccgggaugccgccgg

SEQ ID NO: 1023136 - RNA, 19 nt, Mycobacterium avium subsp. paratuberculosis
ccggggcgggcagcaccag

SEQ ID NO: 1023137 - RNA, 20 nt, Mycobacterium avium subsp. paratuberculosis
ccggggcggauccccgcgcu

SEQ ID NO: 1023138 - RNA, 13 nt, Mycobacterium avium subsp. paratuberculosis
ccggggcggcgau

SEQ ID NO: 1023139 - RNA, 14 nt, Mycobacterium avium subsp. paratuberculosis
ccggggcgccgccg

SEQ ID NO: 1023140 - RNA, 18 nt, Mycobacterium avium subsp. paratuberculosis
ccgggcugcccaccacca

SEQ ID NO: 1023141 - RNA, 15 nt, Mycobacterium avium subsp. paratuberculosis
ccggggccuucuugg

SEQ ID NO: 1023142 - RNA, 12 nt, Mycobacterium avium subsp. paratuberculosis
ccggggcgcccc

SEQ ID NO: 1023143 - RNA, 14 nt, Mycobacterium avium subsp. paratuberculosis
ccggggcgccccgc

SEQ ID NO: 1023144 - RNA, 14 nt, Mycobacterium avium subsp. paratuberculosis
ccggggccgcggcu

SEQ ID NO: 1023145 - RNA, 17 nt, Mycobacterium avium subsp. paratuberculosis
ccggggccaacuccggc

SEQ ID NO: 1023146 - RNA, 21 nt, Mycobacterium avium subsp. paratuberculosis
ccggggccagcacccagaugc

SEQ ID NO: 1023147 - RNA, 19 nt, Mycobacterium avium subsp. paratuberculosis
ccggggcacgcgcgcccgg

SEQ ID NO: 1023148 - RNA, 20 nt, Mycobacterium avium subsp. paratuberculosis
ccggggcagcacccgcaccg

SEQ ID NO: 1023149 - RNA, 16 nt, Mycobacterium avium subsp. paratuberculosis
ccggggcagcugcugg

SEQ ID NO: 1023150 - RNA, 19 nt, Mycobacterium avium subsp. paratuberculosis
ccgggcuggccgucggcga

SEQ ID NO: 1023151 - RNA, 20 nt, Mycobacterium avium subsp. paratuberculosis
ccgggcuggccgucggcgau

SEQ ID NO: 1023152 - RNA, 12 nt, Mycobacterium avium subsp. paratuberculosis
ccgggcugucgg

SEQ ID NO: 1023153 - RNA, 14 nt, Mycobacterium avium subsp. paratuberculosis
ccgggcugucgggc

SEQ ID NO: 1023154 - RNA, 15 nt, Mycobacterium avium subsp. paratuberculosis
ccgggcugugggcgc

SEQ ID NO: 1023155 - RNA, 20 nt, Mycobacterium avium subsp. paratuberculosis
ccgggcuguugaccacggcc

SEQ ID NO: 1023156 - RNA, 19 nt, Mycobacterium avium subsp. paratuberculosis
ccgggcugcgcagcaccgu

SEQ ID NO: 1023157 - RNA, 17 nt, Mycobacterium avium subsp. paratuberculosis
ccgggcgggcaccccau

SEQ ID NO: 1023158 - RNA, 14 nt, Mycobacterium avium subsp. paratuberculosis
ccgggcgggccgca

SEQ ID NO: 1023159 - RNA, 18 nt, Mycobacterium avium subsp. paratuberculosis
ccgggcggcggggcugcc

SEQ ID NO: 1023160 - RNA, 14 nt, Mycobacterium avium subsp. paratuberculosis
ccgggcggacggca

SEQ ID NO: 1023161 - RNA, 19 nt, Mycobacterium avium subsp. paratuberculosis
ccgggcggcggccuccgga

SEQ ID NO: 1023162 - RNA, 17 nt, Mycobacterium avium subsp. paratuberculosis
ccgggcggccugcugca

SEQ ID NO: 1023163 - RNA, 14 nt, Mycobacterium avium subsp. paratuberculosis
ccgggcggcccgca

SEQ ID NO: 1023164 - RNA, 17 nt, Mycobacterium avium subsp. paratuberculosis
ccgggcggcccgccucg

SEQ ID NO: 1023165 - RNA, 23 nt, Mycobacterium avium subsp. paratuberculosis
ccgggcggcccgccucggcggcc

SEQ ID NO: 1023166 - RNA, 17 nt, Mycobacterium avium subsp. paratuberculosis
ccgggcggcagcagcug

SEQ ID NO: 1023167 - RNA, 18 nt, Mycobacterium avium subsp. paratuberculosis
ccgggcggcaucgcgcgc

SEQ ID NO: 1023168 - RNA, 18 nt, Mycobacterium avium subsp. paratuberculosis
ccgggcggccagccgcgc

SEQ ID NO: 1023169 - RNA, 19 nt, Mycobacterium avium subsp. paratuberculosis
ccgggcggccagccgcgcg

SEQ ID NO: 1023170 - RNA, 22 nt, Mycobacterium avium subsp. paratuberculosis
ccgggcggccagcguggcgcgc

SEQ ID NO: 1023171 - RNA, 23 nt, Mycobacterium avium subsp. paratuberculosis
ccgggcggccagcguggcgcgcc

SEQ ID NO: 1023172 - RNA, 16 nt, Mycobacterium avium subsp. paratuberculosis
ccgggccugcgcgccg

SEQ ID NO: 1023173 - RNA, 16 nt, Mycobacterium avium subsp. paratuberculosis
ccgggccugcggcggc

SEQ ID NO: 1023174 - RNA, 21 nt, Mycobacterium avium subsp. paratuberculosis
ccggcgcugaagugcagcgca

SEQ ID NO: 1023175 - RNA, 12 nt, Mycobacterium avium subsp. paratuberculosis
ccggcgcugccc

SEQ ID NO: 1023176 - RNA, 16 nt, Mycobacterium avium subsp. paratuberculosis
ccggcgcugcgcccgg

SEQ ID NO: 1023177 - RNA, 20 nt, Mycobacterium avium subsp. paratuberculosis
ccggcgcuaaagccgaccgc

SEQ ID NO: 1023178 - RNA, 23 nt, Mycobacterium avium subsp. paratuberculosis
ccggcgcguccggaggugccggc

SEQ ID NO: 1023179 - RNA, 13 nt, Mycobacterium avium subsp. paratuberculosis
ccggcgcgggcau

SEQ ID NO: 1023180 - RNA, 15 nt, Mycobacterium avium subsp. paratuberculosis
ccggcgcggcggcgc

SEQ ID NO: 1023181 - RNA, 20 nt, Mycobacterium avium subsp. paratuberculosis
ccggcgcggcggcgccgcgg

SEQ ID NO: 1023182 - RNA, 17 nt, Mycobacterium avium subsp. paratuberculosis
ccggcgcggccagcuga

SEQ ID NO: 1023183 - RNA, 13 nt, Mycobacterium avium subsp. paratuberculosis
ccggcgcggccgc

SEQ ID NO: 1023184 - RNA, 14 nt, Mycobacterium avium subsp. paratuberculosis
ccggcgcggccgcc

SEQ ID NO: 1023185 - RNA, 18 nt, Mycobacterium avium subsp. paratuberculosis
ccggcgcggccgcccagc

SEQ ID NO: 1023186 - RNA, 14 nt, Mycobacterium avium subsp. paratuberculosis
ccggcgcggacagc

SEQ ID NO: 1023187 - RNA, 14 nt, Mycobacterium avium subsp. paratuberculosis
ccggcgcgccgcga

SEQ ID NO: 1023188 - RNA, 17 nt, Mycobacterium avium subsp. paratuberculosis
ccggcgcgcagcaucuc

SEQ ID NO: 1023189 - RNA, 14 nt, Mycobacterium avium subsp. paratuberculosis
ccggcgcgcagcca

SEQ ID NO: 1023190 - RNA, 19 nt, Mycobacterium avium subsp. paratuberculosis
ccggcgcgcagcccagcca

SEQ ID NO: 1023191 - RNA, 14 nt, Mycobacterium avium subsp. paratuberculosis
ccggcgcgaccagc

SEQ ID NO: 1023192 - RNA, 15 nt, Mycobacterium avium subsp. paratuberculosis
ccggcgccucggcgc

SEQ ID NO: 1023193 - RNA, 15 nt, Mycobacterium avium subsp. paratuberculosis
ccggcgccggcccgc

SEQ ID NO: 1023194 - RNA, 12 nt, Mycobacterium avium subsp. paratuberculosis
ccggcgccgcgg

SEQ ID NO: 1023195 - RNA, 17 nt, Mycobacterium avium subsp. paratuberculosis
ccggcgccgcgggcgcc

SEQ ID NO: 1023196 - RNA, 14 nt, Mycobacterium avium subsp. paratuberculosis
ccggcgccggcccg

SEQ ID NO: 1023197 - RNA, 21 nt, Mycobacterium avium subsp. paratuberculosis
ccggcgagaucuucuccccgc

SEQ ID NO: 1023198 - RNA, 16 nt, Mycobacterium avium subsp. paratuberculosis
ccggcgaggcggucgg

SEQ ID NO: 1023199 - RNA, 16 nt, Mycobacterium avium subsp. paratuberculosis
ccggcgaggugggcac

SEQ ID NO: 1023200 - RNA, 18 nt, Mycobacterium avium subsp. paratuberculosis
ccggcgaguacccgccgc

SEQ ID NO: 1023201 - RNA, 21 nt, Mycobacterium avium subsp. paratuberculosis
ccggcgaguacccgccgcacc

SEQ ID NO: 1023202 - RNA, 20 nt, Mycobacterium avium subsp. paratuberculosis
ccggcgacgucgucgaugcc

SEQ ID NO: 1023203 - RNA, 19 nt, Mycobacterium avium subsp. paratuberculosis
ccggcgcagcgcgucgcgc

SEQ ID NO: 1023204 - RNA, 23 nt, Mycobacterium avium subsp. paratuberculosis
ccggcgcagcgcgucgcgcccgg

SEQ ID NO: 1023205 - RNA, 13 nt, Mycobacterium avium subsp. paratuberculosis
ccggcgacgccgg

SEQ ID NO: 1023206 - RNA, 18 nt, Mycobacterium avium subsp. paratuberculosis
ccggcgacgaccgcaccg

SEQ ID NO: 1023207 - RNA, 16 nt, Mycobacterium avium subsp. paratuberculosis
ccggcgacggccagcg

SEQ ID NO: 1023208 - RNA, 17 nt, Mycobacterium avium subsp. paratuberculosis
ccggcgacggccagcgc

SEQ ID NO: 1023209 - RNA, 13 nt, Mycobacterium avium subsp. paratuberculosis
ccggcgacggcgc

SEQ ID NO: 1023210 - RNA, 21 nt, Mycobacterium avium subsp. paratuberculosis
ccggcgacgauaucggccgcg

SEQ ID NO: 1023211 - RNA, 19 nt, Mycobacterium avium subsp. paratuberculosis
ccggcgacgguggcgccca

SEQ ID NO: 1023212 - RNA, 22 nt, Mycobacterium avium subsp. paratuberculosis
ccggcgacaugcgcagcgccca

SEQ ID NO: 1023213 - RNA, 18 nt, Mycobacterium avium subsp. paratuberculosis
ccggcgaccaccagccgc

SEQ ID NO: 1023214 - RNA, 19 nt, Mycobacterium avium subsp. paratuberculosis
ccggcgaauucggugaucg

SEQ ID NO: 1023215 - RNA, 22 nt, Mycobacterium avium subsp. paratuberculosis
ccggcgaccgccuugucggcga

SEQ ID NO: 1023216 - RNA, 14 nt, Mycobacterium avium subsp. paratuberculosis
ccggcgaccgugcc

SEQ ID NO: 1023217 - RNA, 15 nt, Mycobacterium avium subsp. paratuberculosis
ccggcgaccagcccc

SEQ ID NO: 1023218 - RNA, 15 nt, Mycobacterium avium subsp. paratuberculosis
ccggccgcgggcgau

SEQ ID NO: 1023219 - RNA, 17 nt, Mycobacterium avium subsp. paratuberculosis
ccggcgcaguccagggu

SEQ ID NO: 1023220 - RNA, 18 nt, Mycobacterium avium subsp. paratuberculosis
ccggcgcaguccagggug

SEQ ID NO: 1023221 - RNA, 13 nt, Mycobacterium avium subsp. paratuberculosis
ccggcgccagccc

SEQ ID NO: 1023222 - RNA, 19 nt, Mycobacterium avium subsp. paratuberculosis
ccggcgccacgcacaccgc

SEQ ID NO: 1023223 - RNA, 15 nt, Mycobacterium avium subsp. paratuberculosis
ccggcgagcgcgcug

SEQ ID NO: 1023224 - RNA, 13 nt, Mycobacterium avium subsp. paratuberculosis
ccggcgccgccgg

SEQ ID NO: 1023225 - RNA, 22 nt, Mycobacterium avium subsp. paratuberculosis
ccggcgcccugcacccagccgu

SEQ ID NO: 1023226 - RNA, 13 nt, Mycobacterium avium subsp. paratuberculosis
ccggcgccgccac

SEQ ID NO: 1023227 - RNA, 15 nt, Mycobacterium avium subsp. paratuberculosis
ccggcgcccagcggc

SEQ ID NO: 1023228 - RNA, 23 nt, Mycobacterium avium subsp. paratuberculosis
ccggcgcccgaugaaguacccgg

SEQ ID NO: 1023229 - RNA, 17 nt, Mycobacterium avium subsp. paratuberculosis
ccggcgcccggcucccc

SEQ ID NO: 1023230 - RNA, 17 nt, Mycobacterium avium subsp. paratuberculosis
ccggcgcccuucggcgc

SEQ ID NO: 1023231 - RNA, 21 nt, Mycobacterium avium subsp. paratuberculosis
ccggcgccgacgacgucgcgc

SEQ ID NO: 1023232 - RNA, 18 nt, Mycobacterium avium subsp. paratuberculosis
ccggccggacagaucgcc

SEQ ID NO: 1023233 - RNA, 19 nt, Mycobacterium avium subsp. paratuberculosis
ccggccggacagaucgccc

SEQ ID NO: 1023234 - RNA, 16 nt, Mycobacterium avium subsp. paratuberculosis
ccggccggagcggaug

SEQ ID NO: 1023235 - RNA, 19 nt, Mycobacterium avium subsp. paratuberculosis
ccggccgcggugaccgcgc

SEQ ID NO: 1023236 - RNA, 17 nt, Mycobacterium avium subsp. paratuberculosis
ccggccgcuacccggcg

SEQ ID NO: 1023237 - RNA, 18 nt, Mycobacterium avium subsp. paratuberculosis
ccggccgcgccggccuug

SEQ ID NO: 1023238 - RNA, 17 nt, Mycobacterium avium subsp. paratuberculosis
ccggccgcgcgcggcgc

SEQ ID NO: 1023239 - RNA, 16 nt, Mycobacterium avium subsp. paratuberculosis
ccggccgccuggacga

SEQ ID NO: 1023240 - RNA, 13 nt, Mycobacterium avium subsp. paratuberculosis
ccggccgccgaag

SEQ ID NO: 1023241 - RNA, 15 nt, Mycobacterium avium subsp. paratuberculosis
ccggccugccaccgc

SEQ ID NO: 1023242 - RNA, 12 nt, Mycobacterium avium subsp. paratuberculosis
ccggccugcccg

SEQ ID NO: 1023243 - RNA, 17 nt, Mycobacterium avium subsp. paratuberculosis
ccggccugcccgccgcg

SEQ ID NO: 1023244 - RNA, 16 nt, Mycobacterium avium subsp. paratuberculosis
ccggccucgucggcga

SEQ ID NO: 1023245 - RNA, 20 nt, Mycobacterium avium subsp. paratuberculosis
ccggccucucgucgacgaug

SEQ ID NO: 1023246 - RNA, 22 nt, Mycobacterium avium subsp. paratuberculosis
ccggccucucgucgacgauggc

SEQ ID NO: 1023247 - RNA, 21 nt, Mycobacterium avium subsp. paratuberculosis
ccggcccaucaccggaccggc

SEQ ID NO: 1023248 - RNA, 19 nt, Mycobacterium avium subsp. paratuberculosis
ccggcccaggcaguagccg

SEQ ID NO: 1023249 - RNA, 14 nt, Mycobacterium avium subsp. paratuberculosis
ccggccgcccggcg

SEQ ID NO: 1023250 - RNA, 14 nt, Mycobacterium avium subsp. paratuberculosis
ccggccgccagcgc

SEQ ID NO: 1023251 - RNA, 17 nt, Mycobacterium avium subsp. paratuberculosis
ccggccgccagcgcccg

SEQ ID NO: 1023252 - RNA, 17 nt, Mycobacterium avium subsp. paratuberculosis
ccggccgaccggucucg

SEQ ID NO: 1023253 - RNA, 23 nt, Mycobacterium avium subsp. paratuberculosis
ccggccgagccgagccgacccgg

SEQ ID NO: 1023254 - RNA, 16 nt, Mycobacterium avium subsp. paratuberculosis
ccggccgauggcccag

SEQ ID NO: 1023255 - RNA, 18 nt, Mycobacterium avium subsp. paratuberculosis
ccggccgauggcccaggc

SEQ ID NO: 1023256 - RNA, 19 nt, Mycobacterium avium subsp. paratuberculosis
ccggccgauggcccaggcc

SEQ ID NO: 1023257 - RNA, 21 nt, Mycobacterium avium subsp. paratuberculosis
ccggccgauggcccaggccgc

SEQ ID NO: 1023258 - RNA, 19 nt, Mycobacterium avium subsp. paratuberculosis
ccggccgcacaccaccacg

SEQ ID NO: 1023259 - RNA, 16 nt, Mycobacterium avium subsp. paratuberculosis
ccggccgaccgccucg

SEQ ID NO: 1023260 - RNA, 15 nt, Mycobacterium avium subsp. paratuberculosis
ccggccccgcccggc

SEQ ID NO: 1023261 - RNA, 16 nt, Mycobacterium avium subsp. paratuberculosis
ccggccccgcccggcg

SEQ ID NO: 1023262 - RNA, 23 nt, Mycobacterium avium subsp. paratuberculosis
ccggccaucuucaguucggccgg

SEQ ID NO: 1023263 - RNA, 16 nt, Mycobacterium avium subsp. paratuberculosis
ccggccagccggccgc

SEQ ID NO: 1023264 - RNA, 20 nt, Mycobacterium avium subsp. paratuberculosis
ccggccagccggcucuuggc

SEQ ID NO: 1023265 - RNA, 16 nt, Mycobacterium avium subsp. paratuberculosis
ccggccagccgggcgg

SEQ ID NO: 1023266 - RNA, 17 nt, Mycobacterium avium subsp. paratuberculosis
ccggccagccgggcggc

SEQ ID NO: 1023267 - RNA, 17 nt, Mycobacterium avium subsp. paratuberculosis
ccggccagcaccacggu

SEQ ID NO: 1023268 - RNA, 12 nt, Mycobacterium avium subsp. paratuberculosis
ccggccagcagc

SEQ ID NO: 1023269 - RNA, 14 nt, Mycobacterium avium subsp. paratuberculosis
ccggccagcagcag

SEQ ID NO: 1023270 - RNA, 15 nt, Mycobacterium avium subsp. paratuberculosis
ccggccagcagcagc

SEQ ID NO: 1023271 - RNA, 19 nt, Mycobacterium avium subsp. paratuberculosis
ccggccagcagcagcccgc

SEQ ID NO: 1023272 - RNA, 13 nt, Mycobacterium avium subsp. paratuberculosis
ccggccagcagcc

SEQ ID NO: 1023273 - RNA, 20 nt, Mycobacterium avium subsp. paratuberculosis
ccggccacgccggguuuguc

SEQ ID NO: 1023274 - RNA, 14 nt, Mycobacterium avium subsp. paratuberculosis
ccggccagccgcgc

SEQ ID NO: 1023275 - RNA, 13 nt, Mycobacterium avium subsp. paratuberculosis
ccggccaccccgc

SEQ ID NO: 1023276 - RNA, 16 nt, Mycobacterium avium subsp. paratuberculosis
ccggccaccccgcaga

SEQ ID NO: 1023277 - RNA, 14 nt, Mycobacterium avium subsp. paratuberculosis
ccggccaccgcccc

SEQ ID NO: 1023278 - RNA, 17 nt, Mycobacterium avium subsp. paratuberculosis
ccggaguugccgauggc

SEQ ID NO: 1023279 - RNA, 17 nt, Mycobacterium avium subsp. paratuberculosis
ccggagugaaguccaug

SEQ ID NO: 1023280 - RNA, 18 nt, Mycobacterium avium subsp. paratuberculosis
ccggagugaaguccauga

SEQ ID NO: 1023281 - RNA, 21 nt, Mycobacterium avium subsp. paratuberculosis
ccggaggggcgacgggccgau

SEQ ID NO: 1023282 - RNA, 13 nt, Mycobacterium avium subsp. paratuberculosis
ccggaggccgcgg

SEQ ID NO: 1023283 - RNA, 22 nt, Mycobacterium avium subsp. paratuberculosis
ccggaggcggcguagucggcgc

SEQ ID NO: 1023284 - RNA, 22 nt, Mycobacterium avium subsp. paratuberculosis
ccggagcgccccagggccucgg

SEQ ID NO: 1023285 - RNA, 13 nt, Mycobacterium avium subsp. paratuberculosis
ccggagcugucgg

SEQ ID NO: 1023286 - RNA, 22 nt, Mycobacterium avium subsp. paratuberculosis
ccgcugcccgccgcguacagca

SEQ ID NO: 1023287 - RNA, 12 nt, Mycobacterium avium subsp. paratuberculosis
ccgcugcccggc

SEQ ID NO: 1023288 - RNA, 22 nt, Mycobacterium avium subsp. paratuberculosis
ccgcugcgccggcgcggccagc

SEQ ID NO: 1023289 - RNA, 15 nt, Mycobacterium avium subsp. paratuberculosis
ccgcugcgggcgggc

SEQ ID NO: 1023290 - RNA, 19 nt, Mycobacterium avium subsp. paratuberculosis
ccgcugcgggcgggccgcc

SEQ ID NO: 1023291 - RNA, 21 nt, Mycobacterium avium subsp. paratuberculosis
ccgcugcgggcgggccgccag

SEQ ID NO: 1023292 - RNA, 16 nt, Mycobacterium avium subsp. paratuberculosis
ccgcugcggcacacca

SEQ ID NO: 1023293 - RNA, 14 nt, Mycobacterium avium subsp. paratuberculosis
ccgcugcgcggguc

SEQ ID NO: 1023294 - RNA, 19 nt, Mycobacterium avium subsp. paratuberculosis
ccgcugcgcgggucggcgc

SEQ ID NO: 1023295 - RNA, 12 nt, Mycobacterium avium subsp. paratuberculosis
ccgcuggccgcc

SEQ ID NO: 1023296 - RNA, 13 nt, Mycobacterium avium subsp. paratuberculosis
ccgcuggccgccc

SEQ ID NO: 1023297 - RNA, 14 nt, Mycobacterium avium subsp. paratuberculosis
ccgcuggccgcccc

SEQ ID NO: 1023298 - RNA, 14 nt, Mycobacterium avium subsp. paratuberculosis
ccgcugcggcuggg

SEQ ID NO: 1023299 - RNA, 18 nt, Mycobacterium avium subsp. paratuberculosis
ccgcuggaacagcgggcc

SEQ ID NO: 1023300 - RNA, 22 nt, Mycobacterium avium subsp. paratuberculosis
ccgcuggaacagcgggccggcg

SEQ ID NO: 1023301 - RNA, 21 nt, Mycobacterium avium subsp. paratuberculosis
ccgcuggaagucggucugcgg

SEQ ID NO: 1023302 - RNA, 23 nt, Mycobacterium avium subsp. paratuberculosis
ccgcuggaagucggucugcggag

SEQ ID NO: 1023303 - RNA, 11 nt, Mycobacterium avium subsp. paratuberculosis
ccgcugggagc

SEQ ID NO: 1023304 - RNA, 14 nt, Mycobacterium avium subsp. paratuberculosis
ccgcugaccaggcc

SEQ ID NO: 1023305 - RNA, 21 nt, Mycobacterium avium subsp. paratuberculosis
ccgcucguaguuggggccggc

SEQ ID NO: 1023306 - RNA, 16 nt, Mycobacterium avium subsp. paratuberculosis
ccgcucgucggccagc

SEQ ID NO: 1023307 - RNA, 20 nt, Mycobacterium avium subsp. paratuberculosis
ccgcucgucggccagcgagu

SEQ ID NO: 1023308 - RNA, 13 nt, Mycobacterium avium subsp. paratuberculosis
ccgcucggccagc

SEQ ID NO: 1023309 - RNA, 15 nt, Mycobacterium avium subsp. paratuberculosis
ccgcucggcgcucca

SEQ ID NO: 1023310 - RNA, 21 nt, Mycobacterium avium subsp. paratuberculosis
ccgcucggcgcuccagcgggc

SEQ ID NO: 1023311 - RNA, 13 nt, Mycobacterium avium subsp. paratuberculosis
ccgcucgggcccg

SEQ ID NO: 1023312 - RNA, 14 nt, Mycobacterium avium subsp. paratuberculosis
ccgcucgggcccgc

SEQ ID NO: 1023313 - RNA, 17 nt, Mycobacterium avium subsp. paratuberculosis
ccgcucgggcccgcgca

SEQ ID NO: 1023314 - RNA, 13 nt, Mycobacterium avium subsp. paratuberculosis
ccgcucgggcgcc

SEQ ID NO: 1023315 - RNA, 15 nt, Mycobacterium avium subsp. paratuberculosis
ccgcucgggcgugcg

SEQ ID NO: 1023316 - RNA, 23 nt, Mycobacterium avium subsp. paratuberculosis
ccgcucggggaucccgaaaccgu

SEQ ID NO: 1023317 - RNA, 14 nt, Mycobacterium avium subsp. paratuberculosis
ccgcugcaccagcc

SEQ ID NO: 1023318 - RNA, 20 nt, Mycobacterium avium subsp. paratuberculosis
ccgcugcaccagcccgucgg

SEQ ID NO: 1023319 - RNA, 13 nt, Mycobacterium avium subsp. paratuberculosis
ccgcugcagcgcc

SEQ ID NO: 1023320 - RNA, 16 nt, Mycobacterium avium subsp. paratuberculosis
ccgcugcagcgccgcc

SEQ ID NO: 1023321 - RNA, 17 nt, Mycobacterium avium subsp. paratuberculosis
ccgcugcagcgccgccc

SEQ ID NO: 1023322 - RNA, 18 nt, Mycobacterium avium subsp. paratuberculosis
ccgcugcagcgccgcccg

SEQ ID NO: 1023323 - RNA, 15 nt, Mycobacterium avium subsp. paratuberculosis
ccgcugcagcugcuc

SEQ ID NO: 1023324 - RNA, 15 nt, Mycobacterium avium subsp. paratuberculosis
ccgcugaugccgccg

SEQ ID NO: 1023325 - RNA, 22 nt, Mycobacterium avium subsp. paratuberculosis
ccgcugacgauggcgaccgcgc

SEQ ID NO: 1023326 - RNA, 17 nt, Mycobacterium avium subsp. paratuberculosis
ccgcugacgcggcgggc

SEQ ID NO: 1023327 - RNA, 21 nt, Mycobacterium avium subsp. paratuberculosis
ccgcugagcuucugcccggcc

SEQ ID NO: 1023328 - RNA, 11 nt, Mycobacterium avium subsp. paratuberculosis
ccgcugaggcg

SEQ ID NO: 1023329 - RNA, 17 nt, Mycobacterium avium subsp. paratuberculosis
ccggaauugaagaagcg

SEQ ID NO: 1023330 - RNA, 17 nt, Mycobacterium avium subsp. paratuberculosis
ccggacggugacgccgg

SEQ ID NO: 1023331 - RNA, 23 nt, Mycobacterium avium subsp. paratuberculosis
ccggaauggcaaggccagcaacc

SEQ ID NO: 1023332 - RNA, 15 nt, Mycobacterium avium subsp. paratuberculosis
ccggaauggcagcag

SEQ ID NO: 1023333 - RNA, 17 nt, Mycobacterium avium subsp. paratuberculosis
ccggaauggcagcagcc

SEQ ID NO: 1023334 - RNA, 13 nt, Mycobacterium avium subsp. paratuberculosis
ccggaagcgcgca

SEQ ID NO: 1023335 - RNA, 13 nt, Mycobacterium avium subsp. paratuberculosis
ccggaagccgucg

SEQ ID NO: 1023336 - RNA, 16 nt, Mycobacterium avium subsp. paratuberculosis
ccggaagccuguuggc

SEQ ID NO: 1023337 - RNA, 19 nt, Mycobacterium avium subsp. paratuberculosis
ccggaagccuguuggccag

SEQ ID NO: 1023338 - RNA, 19 nt, Mycobacterium avium subsp. paratuberculosis
ccggagagcccgucgucgg

SEQ ID NO: 1023339 - RNA, 12 nt, Mycobacterium avium subsp. paratuberculosis
ccggagaccgcc

SEQ ID NO: 1023340 - RNA, 22 nt, Mycobacterium avium subsp. paratuberculosis
ccggagacgacucuuccaggac

SEQ ID NO: 1023341 - RNA, 22 nt, Mycobacterium avium subsp. paratuberculosis
ccggagccgucucggagcggug

SEQ ID NO: 1023342 - RNA, 15 nt, Mycobacterium avium subsp. paratuberculosis
ccggagccuucuucg

SEQ ID NO: 1023343 - RNA, 20 nt, Mycobacterium avium subsp. paratuberculosis
ccggagcccagcuuggcgcc

SEQ ID NO: 1023344 - RNA, 22 nt, Mycobacterium avium subsp. paratuberculosis
ccggagaacuaucuggucuggg

SEQ ID NO: 1023345 - RNA, 16 nt, Mycobacterium avium subsp. paratuberculosis
ccggagaaaccgucgg

SEQ ID NO: 1023346 - RNA, 18 nt, Mycobacterium avium subsp. paratuberculosis
ccggagaaaccgucggcc

SEQ ID NO: 1023347 - RNA, 21 nt, Mycobacterium avium subsp. paratuberculosis
ccggagaaaccgucggcccgc

SEQ ID NO: 1023348 - RNA, 14 nt, Mycobacterium avium subsp. paratuberculosis
ccggacuccucggu

SEQ ID NO: 1023349 - RNA, 19 nt, Mycobacterium avium subsp. paratuberculosis
ccggacucgaucgccaccg

SEQ ID NO: 1023350 - RNA, 14 nt, Mycobacterium avium subsp. paratuberculosis
ccgcuugcccagcc

SEQ ID NO: 1023351 - RNA, 15 nt, Mycobacterium avium subsp. paratuberculosis
ccgcuugcccagccc

SEQ ID NO: 1023352 - RNA, 19 nt, Mycobacterium avium subsp. paratuberculosis
ccgcuugacgccgccgaac

SEQ ID NO: 1023353 - RNA, 17 nt, Mycobacterium avium subsp. paratuberculosis
ccgcuugccgacgugau

SEQ ID NO: 1023354 - RNA, 21 nt, Mycobacterium avium subsp. paratuberculosis
ccgcuggugaggucgcgcagg

SEQ ID NO: 1023355 - RNA, 17 nt, Mycobacterium avium subsp. paratuberculosis
ccgcuucgucgccggcc

SEQ ID NO: 1023356 - RNA, 21 nt, Mycobacterium avium subsp. paratuberculosis
ccgcugguggugaucacccag

SEQ ID NO: 1023357 - RNA, 23 nt, Mycobacterium avium subsp. paratuberculosis
ccgcugguggugaucacccagcc

SEQ ID NO: 1023358 - RNA, 17 nt, Mycobacterium avium subsp. paratuberculosis
ccgcugguaggcggcgc

SEQ ID NO: 1023359 - RNA, 14 nt, Mycobacterium avium subsp. paratuberculosis
ccgcugggcggcgc

SEQ ID NO: 1023360 - RNA, 14 nt, Mycobacterium avium subsp. paratuberculosis
ccgcugggcguggu

SEQ ID NO: 1023361 - RNA, 23 nt, Mycobacterium avium subsp. paratuberculosis
ccgcuuguucgggcccacacugu

SEQ ID NO: 1023362 - RNA, 14 nt, Mycobacterium avium subsp. paratuberculosis
ccgcuuggcggucu

SEQ ID NO: 1023363 - RNA, 20 nt, Mycobacterium avium subsp. paratuberculosis
ccgcuugggugaaucaccaa

SEQ ID NO: 1023364 - RNA, 20 nt, Mycobacterium avium subsp. paratuberculosis
ccggaaagcgcgggcagccc

SEQ ID NO: 1023365 - RNA, 16 nt, Mycobacterium avium subsp. paratuberculosis
ccggaacacaacgccu

SEQ ID NO: 1023366 - RNA, 12 nt, Mycobacterium avium subsp. paratuberculosis
ccgcucaccgcc

SEQ ID NO: 1023367 - RNA, 21 nt, Mycobacterium avium subsp. paratuberculosis
ccgcucagcgauugcggccgc

SEQ ID NO: 1023368 - RNA, 17 nt, Mycobacterium avium subsp. paratuberculosis
ccgcucagcgggcggcc

SEQ ID NO: 1023369 - RNA, 20 nt, Mycobacterium avium subsp. paratuberculosis
ccgcucaccugcggcccguc

SEQ ID NO: 1023370 - RNA, 19 nt, Mycobacterium avium subsp. paratuberculosis
ccgcucaggucggccgcgg

SEQ ID NO: 1023371 - RNA, 14 nt, Mycobacterium avium subsp. paratuberculosis
ccgcucgaccccuc

SEQ ID NO: 1023372 - RNA, 18 nt, Mycobacterium avium subsp. paratuberculosis
ccgcuccgacgcgguggc

SEQ ID NO: 1023373 - RNA, 18 nt, Mycobacterium avium subsp. paratuberculosis
ccgcucgaucuggcggac

SEQ ID NO: 1023374 - RNA, 12 nt, Mycobacterium avium subsp. paratuberculosis
ccgcucgcgggc

SEQ ID NO: 1023375 - RNA, 16 nt, Mycobacterium avium subsp. paratuberculosis
ccgcucgcgggcccgc

SEQ ID NO: 1023376 - RNA, 21 nt, Mycobacterium avium subsp. paratuberculosis
ccgcucgcgggcccgcgccgc

SEQ ID NO: 1023377 - RNA, 16 nt, Mycobacterium avium subsp. paratuberculosis
ccgcucgauggcgccg

SEQ ID NO: 1023378 - RNA, 14 nt, Mycobacterium avium subsp. paratuberculosis
ccgcucgcccagcg

SEQ ID NO: 1023379 - RNA, 21 nt, Mycobacterium avium subsp. paratuberculosis
ccgcucgcccagcgcggcggc

SEQ ID NO: 1023380 - RNA, 17 nt, Mycobacterium avium subsp. paratuberculosis
ccgcucccggcgcagca

SEQ ID NO: 1023381 - RNA, 17 nt, Mycobacterium avium subsp. paratuberculosis
ccgcucccgggacagcc

SEQ ID NO: 1023382 - RNA, 14 nt, Mycobacterium avium subsp. paratuberculosis
ccgcuccccgagca

SEQ ID NO: 1023383 - RNA, 23 nt, Mycobacterium avium subsp. paratuberculosis
ccgcuccggucgcgucgugcggc

SEQ ID NO: 1023384 - RNA, 13 nt, Mycobacterium avium subsp. paratuberculosis
ccgcuccagcggc

SEQ ID NO: 1023385 - RNA, 15 nt, Mycobacterium avium subsp. paratuberculosis
ccgcguuggccagcg

SEQ ID NO: 1023386 - RNA, 14 nt, Mycobacterium avium subsp. paratuberculosis
ccgcguugcggcgc

SEQ ID NO: 1023387 - RNA, 21 nt, Mycobacterium avium subsp. paratuberculosis
ccgcguugucgaccaccaggu

SEQ ID NO: 1023388 - RNA, 15 nt, Mycobacterium avium subsp. paratuberculosis
ccgcguugugcacca

SEQ ID NO: 1023389 - RNA, 12 nt, Mycobacterium avium subsp. paratuberculosis
ccgcguggccuc

SEQ ID NO: 1023390 - RNA, 19 nt, Mycobacterium avium subsp. paratuberculosis
ccgcgugugcccgccucgc

SEQ ID NO: 1023391 - RNA, 22 nt, Mycobacterium avium subsp. paratuberculosis
ccgcguucacccgcgcccgcau

SEQ ID NO: 1023392 - RNA, 19 nt, Mycobacterium avium subsp. paratuberculosis
ccgcguucggcggcgcgcu

SEQ ID NO: 1023393 - RNA, 15 nt, Mycobacterium avium subsp. paratuberculosis
ccgcuagucgcccag

SEQ ID NO: 1023394 - RNA, 17 nt, Mycobacterium avium subsp. paratuberculosis
ccgcggcuccagcagcg

SEQ ID NO: 1023395 - RNA, 18 nt, Mycobacterium avium subsp. paratuberculosis
ccgcggcuccggccgcgc

SEQ ID NO: 1023396 - RNA, 22 nt, Mycobacterium avium subsp. paratuberculosis
ccgcggcuccggccgcgccggc

SEQ ID NO: 1023397 - RNA, 21 nt, Mycobacterium avium subsp. paratuberculosis
ccgcggcucgauggacgccag

SEQ ID NO: 1023398 - RNA, 15 nt, Mycobacterium avium subsp. paratuberculosis
ccgcggcggccugcu

SEQ ID NO: 1023399 - RNA, 11 nt, Mycobacterium avium subsp. paratuberculosis
ccgcggcggcg

SEQ ID NO: 1023400 - RNA, 13 nt, Mycobacterium avium subsp. paratuberculosis
ccgcggcgggcag

SEQ ID NO: 1023401 - RNA, 14 nt, Mycobacterium avium subsp. paratuberculosis
ccgcggcgggcagg

SEQ ID NO: 1023402 - RNA, 20 nt, Mycobacterium avium subsp. paratuberculosis
ccgcggcgguggccugcccg

SEQ ID NO: 1023403 - RNA, 23 nt, Mycobacterium avium subsp. paratuberculosis
ccgcggcgucaucccccgcagcu

SEQ ID NO: 1023404 - RNA, 15 nt, Mycobacterium avium subsp. paratuberculosis
ccgcggcgccgccac

SEQ ID NO: 1023405 - RNA, 14 nt, Mycobacterium avium subsp. paratuberculosis
ccgcggcgccgcgg

SEQ ID NO: 1023406 - RNA, 14 nt, Mycobacterium avium subsp. paratuberculosis
ccgcggcggcaccc

SEQ ID NO: 1023407 - RNA, 13 nt, Mycobacterium avium subsp. paratuberculosis
ccgcggcggcagc

SEQ ID NO: 1023408 - RNA, 17 nt, Mycobacterium avium subsp. paratuberculosis
ccgcggcggcagcagcc

SEQ ID NO: 1023409 - RNA, 17 nt, Mycobacterium avium subsp. paratuberculosis
ccgcggcgcggcccggc

SEQ ID NO: 1023410 - RNA, 18 nt, Mycobacterium avium subsp. paratuberculosis
ccgcggcgcggcccggcc

SEQ ID NO: 1023411 - RNA, 19 nt, Mycobacterium avium subsp. paratuberculosis
ccgcggcgcggcccggccc

SEQ ID NO: 1023412 - RNA, 15 nt, Mycobacterium avium subsp. paratuberculosis
ccgcggcgcgguuga

SEQ ID NO: 1023413 - RNA, 18 nt, Mycobacterium avium subsp. paratuberculosis
ccgcggcgcccucgccgg

SEQ ID NO: 1023414 - RNA, 22 nt, Mycobacterium avium subsp. paratuberculosis
ccgcggcgaugauccgcggcgc

SEQ ID NO: 1023415 - RNA, 16 nt, Mycobacterium avium subsp. paratuberculosis
ccgcggcgccgauggc

SEQ ID NO: 1023416 - RNA, 18 nt, Mycobacterium avium subsp. paratuberculosis
ccgcggcgaauccgagca

SEQ ID NO: 1023417 - RNA, 16 nt, Mycobacterium avium subsp. paratuberculosis
ccgcggcgacacccag

SEQ ID NO: 1023418 - RNA, 22 nt, Mycobacterium avium subsp. paratuberculosis
ccgcggcgacacccagcggcgc

SEQ ID NO: 1023419 - RNA, 19 nt, Mycobacterium avium subsp. paratuberculosis
ccgcgggacacggcggcgc

SEQ ID NO: 1023420 - RNA, 15 nt, Mycobacterium avium subsp. paratuberculosis
ccgcggcggcccggc

SEQ ID NO: 1023421 - RNA, 12 nt, Mycobacterium avium subsp. paratuberculosis
ccgcgggccagc

SEQ ID NO: 1023422 - RNA, 18 nt, Mycobacterium avium subsp. paratuberculosis
ccgcgggcccaccgccac

SEQ ID NO: 1023423 - RNA, 15 nt, Mycobacterium avium subsp. paratuberculosis
ccgcggguggccuuc

SEQ ID NO: 1023424 - RNA, 17 nt, Mycobacterium avium subsp. paratuberculosis
ccgcggguggccuucau

SEQ ID NO: 1023425 - RNA, 13 nt, Mycobacterium avium subsp. paratuberculosis
ccgcggguggcgc

SEQ ID NO: 1023426 - RNA, 22 nt, Mycobacterium avium subsp. paratuberculosis
ccgcggguguuucggucggcgu

SEQ ID NO: 1023427 - RNA, 24 nt, Mycobacterium avium subsp. paratuberculosis
ccgcgggucgucgacgucggacgc

SEQ ID NO: 1023428 - RNA, 16 nt, Mycobacterium avium subsp. paratuberculosis
ccgcgggucgucgggc

SEQ ID NO: 1023429 - RNA, 14 nt, Mycobacterium avium subsp. paratuberculosis
ccgcgggucggcga

SEQ ID NO: 1023430 - RNA, 14 nt, Mycobacterium avium subsp. paratuberculosis
ccgcgggugaucug

SEQ ID NO: 1023431 - RNA, 18 nt, Mycobacterium avium subsp. paratuberculosis
ccgcgggugcggcacggc

SEQ ID NO: 1023432 - RNA, 16 nt, Mycobacterium avium subsp. paratuberculosis
ccgcgggugcggccca

SEQ ID NO: 1023433 - RNA, 23 nt, Mycobacterium avium subsp. paratuberculosis
ccgcggggccggcgcuggcgugc

SEQ ID NO: 1023434 - RNA, 13 nt, Mycobacterium avium subsp. paratuberculosis
ccgcggucaccgg

SEQ ID NO: 1023435 - RNA, 20 nt, Mycobacterium avium subsp. paratuberculosis
ccgcggucaccggucggugc

SEQ ID NO: 1023436 - RNA, 19 nt, Mycobacterium avium subsp. paratuberculosis
ccgcgguagacaccgccgu

SEQ ID NO: 1023437 - RNA, 19 nt, Mycobacterium avium subsp. paratuberculosis
ccgcggucaugcgcgggca

SEQ ID NO: 1023438 - RNA, 17 nt, Mycobacterium avium subsp. paratuberculosis
ccgcggucgccccggcc

SEQ ID NO: 1023439 - RNA, 19 nt, Mycobacterium avium subsp. paratuberculosis
ccgcggucgccccggccgc

SEQ ID NO: 1023440 - RNA, 22 nt, Mycobacterium avium subsp. paratuberculosis
ccgcggucgccccggccgcggu

SEQ ID NO: 1023441 - RNA, 15 nt, Mycobacterium avium subsp. paratuberculosis
ccgcggucgcggcgc

SEQ ID NO: 1023442 - RNA, 21 nt, Mycobacterium avium subsp. paratuberculosis
ccgcggucgcugacccgccgc

SEQ ID NO: 1023443 - RNA, 12 nt, Mycobacterium avium subsp. paratuberculosis
ccgcgucggcgc

SEQ ID NO: 1023444 - RNA, 15 nt, Mycobacterium avium subsp. paratuberculosis
ccgcgucggccccca

SEQ ID NO: 1023445 - RNA, 14 nt, Mycobacterium avium subsp. paratuberculosis
ccgcgucgcgcagc

SEQ ID NO: 1023446 - RNA, 13 nt, Mycobacterium avium subsp. paratuberculosis
ccgcgucggaccc

SEQ ID NO: 1023447 - RNA, 15 nt, Mycobacterium avium subsp. paratuberculosis
ccgcgucggaccccg

SEQ ID NO: 1023448 - RNA, 15 nt, Mycobacterium avium subsp. paratuberculosis
ccgcgucguggcccu

SEQ ID NO: 1023449 - RNA, 12 nt, Mycobacterium avium subsp. paratuberculosis
ccgcgugcaccu

SEQ ID NO: 1023450 - RNA, 15 nt, Mycobacterium avium subsp. paratuberculosis
ccgcgugacggccgc

SEQ ID NO: 1023451 - RNA, 17 nt, Mycobacterium avium subsp. paratuberculosis
ccgcgugacggccgcgg

SEQ ID NO: 1023452 - RNA, 18 nt, Mycobacterium avium subsp. paratuberculosis
ccgcgugacaggggcagc

SEQ ID NO: 1023453 - RNA, 23 nt, Mycobacterium avium subsp. paratuberculosis
ccgcgucuuggacgcccgcgacc

SEQ ID NO: 1023454 - RNA, 16 nt, Mycobacterium avium subsp. paratuberculosis
ccgcgucacgucggcc

SEQ ID NO: 1023455 - RNA, 19 nt, Mycobacterium avium subsp. paratuberculosis
ccgcgucagcggcgggcau

SEQ ID NO: 1023456 - RNA, 19 nt, Mycobacterium avium subsp. paratuberculosis
ccgcguccuucuccgccgg

SEQ ID NO: 1023457 - RNA, 22 nt, Mycobacterium avium subsp. paratuberculosis
ccgcgucgccgaccagcaggac

SEQ ID NO: 1023458 - RNA, 17 nt, Mycobacterium avium subsp. paratuberculosis
ccgcgucgccgaucgcc

SEQ ID NO: 1023459 - RNA, 20 nt, Mycobacterium avium subsp. paratuberculosis
ccgcgucgaccaccgccggc

SEQ ID NO: 1023460 - RNA, 17 nt, Mycobacterium avium subsp. paratuberculosis
ccgcgucgaccagccgg

SEQ ID NO: 1023461 - RNA, 15 nt, Mycobacterium avium subsp. paratuberculosis
ccgcgucgacgccgc

SEQ ID NO: 1023462 - RNA, 23 nt, Mycobacterium avium subsp. paratuberculosis
ccgcguaggccuugcugagccgg

SEQ ID NO: 1023463 - RNA, 18 nt, Mycobacterium avium subsp. paratuberculosis
ccgcguagcucgccgcgg

SEQ ID NO: 1023464 - RNA, 15 nt, Mycobacterium avium subsp. paratuberculosis
ccgcguacagcagcu

SEQ ID NO: 1023465 - RNA, 18 nt, Mycobacterium avium subsp. paratuberculosis
ccgcguacagggcgucgg

SEQ ID NO: 1023466 - RNA, 13 nt, Mycobacterium avium subsp. paratuberculosis
ccgcguacgccgc

SEQ ID NO: 1023467 - RNA, 16 nt, Mycobacterium avium subsp. paratuberculosis
ccgcggugugcuggcc

SEQ ID NO: 1023468 - RNA, 17 nt, Mycobacterium avium subsp. paratuberculosis
ccgcggugugcuggcca

SEQ ID NO: 1023469 - RNA, 20 nt, Mycobacterium avium subsp. paratuberculosis
ccgcggugugcuggccagca

SEQ ID NO: 1023470 - RNA, 17 nt, Mycobacterium avium subsp. paratuberculosis
ccgcgguuggucaccag

SEQ ID NO: 1023471 - RNA, 18 nt, Mycobacterium avium subsp. paratuberculosis
ccgcgguuucaccgugcg

SEQ ID NO: 1023472 - RNA, 18 nt, Mycobacterium avium subsp. paratuberculosis
ccgcggucgggucccggc

SEQ ID NO: 1023473 - RNA, 17 nt, Mycobacterium avium subsp. paratuberculosis
ccgcggugagcggccgc

SEQ ID NO: 1023474 - RNA, 16 nt, Mycobacterium avium subsp. paratuberculosis
ccgcggugaguucauc

SEQ ID NO: 1023475 - RNA, 13 nt, Mycobacterium avium subsp. paratuberculosis
ccgcggugcagca

SEQ ID NO: 1023476 - RNA, 15 nt, Mycobacterium avium subsp. paratuberculosis
ccgcggugccgcagc

SEQ ID NO: 1023477 - RNA, 13 nt, Mycobacterium avium subsp. paratuberculosis
ccgcggugcugau

SEQ ID NO: 1023478 - RNA, 12 nt, Mycobacterium avium subsp. paratuberculosis
ccgcgguggcgc

SEQ ID NO: 1023479 - RNA, 13 nt, Mycobacterium avium subsp. paratuberculosis
ccgcggaccaccg

SEQ ID NO: 1023480 - RNA, 14 nt, Mycobacterium avium subsp. paratuberculosis
ccgcgcuggccagc

SEQ ID NO: 1023481 - RNA, 23 nt, Mycobacterium avium subsp. paratuberculosis
ccgcggacggguugggcgccagc

SEQ ID NO: 1023482 - RNA, 17 nt, Mycobacterium avium subsp. paratuberculosis
ccgcggaggcgagcagc

SEQ ID NO: 1023483 - RNA, 19 nt, Mycobacterium avium subsp. paratuberculosis
ccgcggaggcgagcagccg

SEQ ID NO: 1023484 - RNA, 15 nt, Mycobacterium avium subsp. paratuberculosis
ccgcgcuugccgcga

SEQ ID NO: 1023485 - RNA, 19 nt, Mycobacterium avium subsp. paratuberculosis
ccgcgcuugcgaccgccgc

SEQ ID NO: 1023486 - RNA, 15 nt, Mycobacterium avium subsp. paratuberculosis
ccgcgcugggcuggc

SEQ ID NO: 1023487 - RNA, 22 nt, Mycobacterium avium subsp. paratuberculosis
ccgcggccgucgucgugcacca

SEQ ID NO: 1023488 - RNA, 22 nt, Mycobacterium avium subsp. paratuberculosis
ccgcggccggcacuaccgccuc

SEQ ID NO: 1023489 - RNA, 23 nt, Mycobacterium avium subsp. paratuberculosis
ccgcggccgcguugucgaccacc

SEQ ID NO: 1023490 - RNA, 12 nt, Mycobacterium avium subsp. paratuberculosis
ccgcggccggca

SEQ ID NO: 1023491 - RNA, 13 nt, Mycobacterium avium subsp. paratuberculosis
ccgcggccgccgc

SEQ ID NO: 1023492 - RNA, 16 nt, Mycobacterium avium subsp. paratuberculosis
ccgcggccgccgcgac

SEQ ID NO: 1023493 - RNA, 13 nt, Mycobacterium avium subsp. paratuberculosis
ccgcggccgccuu

SEQ ID NO: 1023494 - RNA, 13 nt, Mycobacterium avium subsp. paratuberculosis
ccgcggccgcgcg

SEQ ID NO: 1023495 - RNA, 18 nt, Mycobacterium avium subsp. paratuberculosis
ccgcggccgcgcgcccgu

SEQ ID NO: 1023496 - RNA, 17 nt, Mycobacterium avium subsp. paratuberculosis
ccgcggccgcggcgcgc

SEQ ID NO: 1023497 - RNA, 21 nt, Mycobacterium avium subsp. paratuberculosis
ccgcggccagcgcgcgggcgu

SEQ ID NO: 1023498 - RNA, 12 nt, Mycobacterium avium subsp. paratuberculosis
ccgcggccagcg

SEQ ID NO: 1023499 - RNA, 13 nt, Mycobacterium avium subsp. paratuberculosis
ccgcggcccggcc

SEQ ID NO: 1023500 - RNA, 18 nt, Mycobacterium avium subsp. paratuberculosis
ccgcggcccugcagcgcc

SEQ ID NO: 1023501 - RNA, 11 nt, Mycobacterium avium subsp. paratuberculosis
ccgcggcagcc

SEQ ID NO: 1023502 - RNA, 13 nt, Mycobacterium avium subsp. paratuberculosis
ccgcggcagccgg

SEQ ID NO: 1023503 - RNA, 14 nt, Mycobacterium avium subsp. paratuberculosis
ccgcggccagcucc

SEQ ID NO: 1023504 - RNA, 14 nt, Mycobacterium avium subsp. paratuberculosis
ccgcggccagcugc

SEQ ID NO: 1023505 - RNA, 15 nt, Mycobacterium avium subsp. paratuberculosis
ccgcggccagcugcc

SEQ ID NO: 1023506 - RNA, 12 nt, Mycobacterium avium subsp. paratuberculosis
ccgcggccaggu

SEQ ID NO: 1023507 - RNA, 19 nt, Mycobacterium avium subsp. paratuberculosis
ccgcggcaccuucaccgac

SEQ ID NO: 1023508 - RNA, 16 nt, Mycobacterium avium subsp. paratuberculosis
ccgcggcacgcugcgc

SEQ ID NO: 1023509 - RNA, 14 nt, Mycobacterium avium subsp. paratuberculosis
ccgcggccaccacc

SEQ ID NO: 1023510 - RNA, 15 nt, Mycobacterium avium subsp. paratuberculosis
ccgcggaucagcagg

SEQ ID NO: 1023511 - RNA, 20 nt, Mycobacterium avium subsp. paratuberculosis
ccgcggaugaccaggucgcc

SEQ ID NO: 1023512 - RNA, 22 nt, Mycobacterium avium subsp. paratuberculosis
ccgcggaugaccaggucgccgg

SEQ ID NO: 1023513 - RNA, 20 nt, Mycobacterium avium subsp. paratuberculosis
ccgcggauguggaggcgagc

SEQ ID NO: 1023514 - RNA, 15 nt, Mycobacterium avium subsp. paratuberculosis
aaaccgccagcagcg

SEQ ID NO: 1023515 - RNA, 15 nt, Mycobacterium avium subsp. paratuberculosis
ccgcgcgggcugcag

SEQ ID NO: 1023516 - RNA, 15 nt, Mycobacterium avium subsp. paratuberculosis
ccgcgcgggggccgc

SEQ ID NO: 1023517 - RNA, 17 nt, Mycobacterium avium subsp. paratuberculosis
ccgcgcggggucccaau

SEQ ID NO: 1023518 - RNA, 21 nt, Mycobacterium avium subsp. paratuberculosis
ccgcgcucaacccgggccgga

SEQ ID NO: 1023519 - RNA, 19 nt, Mycobacterium avium subsp. paratuberculosis
ccgcgcuccugccagcggc

SEQ ID NO: 1023520 - RNA, 21 nt, Mycobacterium avium subsp. paratuberculosis
ccgcgcuccugccagcggcgc

SEQ ID NO: 1023521 - RNA, 19 nt, Mycobacterium avium subsp. paratuberculosis
ccgcgcucgaacucaccgg

SEQ ID NO: 1023522 - RNA, 16 nt, Mycobacterium avium subsp. paratuberculosis
ccgcgcugaccagcgu

SEQ ID NO: 1023523 - RNA, 17 nt, Mycobacterium avium subsp. paratuberculosis
ccgcgcugaccagcgug

SEQ ID NO: 1023524 - RNA, 16 nt, Mycobacterium avium subsp. paratuberculosis
ccgcgcgucgcgcagc

SEQ ID NO: 1023525 - RNA, 17 nt, Mycobacterium avium subsp. paratuberculosis
ccgcgcgucgggcucgc

SEQ ID NO: 1023526 - RNA, 19 nt, Mycobacterium avium subsp. paratuberculosis
ccgcgcgucgggggugccg

SEQ ID NO: 1023527 - RNA, 21 nt, Mycobacterium avium subsp. paratuberculosis
ccgcgcgugcagccgggcggc

SEQ ID NO: 1023528 - RNA, 16 nt, Mycobacterium avium subsp. paratuberculosis
ccgcgcgugggccaac

SEQ ID NO: 1023529 - RNA, 22 nt, Mycobacterium avium subsp. paratuberculosis
ccgcgcguggucccacaccacc

SEQ ID NO: 1023530 - RNA, 17 nt, Mycobacterium avium subsp. paratuberculosis
ccgcgcggugcaccagg

SEQ ID NO: 1023531 - RNA, 20 nt, Mycobacterium avium subsp. paratuberculosis
aaacccguugccaacaccag

SEQ ID NO: 1023532 - RNA, 13 nt, Mycobacterium avium subsp. paratuberculosis
ccgcgcggcgggc

SEQ ID NO: 1023533 - RNA, 16 nt, Mycobacterium avium subsp. paratuberculosis
ccgcgcggcgggcccg

SEQ ID NO: 1023534 - RNA, 17 nt, Mycobacterium avium subsp. paratuberculosis
ccgcgcggcgggcccgc

SEQ ID NO: 1023535 - RNA, 18 nt, Mycobacterium avium subsp. paratuberculosis
ccgcgcggcgguccagcg

SEQ ID NO: 1023536 - RNA, 17 nt, Mycobacterium avium subsp. paratuberculosis
ccgcgcggccagcggcg

SEQ ID NO: 1023537 - RNA, 15 nt, Mycobacterium avium subsp. paratuberculosis
ccgcgcggccgccag

SEQ ID NO: 1023538 - RNA, 17 nt, Mycobacterium avium subsp. paratuberculosis
ccgcgcggccgccuccg

SEQ ID NO: 1023539 - RNA, 14 nt, Mycobacterium avium subsp. paratuberculosis
ccgcgcggcgcagg

SEQ ID NO: 1023540 - RNA, 14 nt, Mycobacterium avium subsp. paratuberculosis
ccgcgcggcgccag

SEQ ID NO: 1023541 - RNA, 15 nt, Mycobacterium avium subsp. paratuberculosis
ccgcgcggcgccagc

SEQ ID NO: 1023542 - RNA, 17 nt, Mycobacterium avium subsp. paratuberculosis
ccgcgcggcgcccccgc

SEQ ID NO: 1023543 - RNA, 23 nt, Mycobacterium avium subsp. paratuberculosis
ccgcgcgcuguccucgucgggga

SEQ ID NO: 1023544 - RNA, 14 nt, Mycobacterium avium subsp. paratuberculosis
ccgcgcgcggcacg

SEQ ID NO: 1023545 - RNA, 21 nt, Mycobacterium avium subsp. paratuberculosis
ccgcgcgcggccaccgcgcgc

SEQ ID NO: 1023546 - RNA, 17 nt, Mycobacterium avium subsp. paratuberculosis
ccgcgcgcugccgcgcc

SEQ ID NO: 1023547 - RNA, 18 nt, Mycobacterium avium subsp. paratuberculosis
ccgcgcgcugccgcgccc

SEQ ID NO: 1023548 - RNA, 22 nt, Mycobacterium avium subsp. paratuberculosis
ccgcgcgcggcgcggagccggc

SEQ ID NO: 1023549 - RNA, 14 nt, Mycobacterium avium subsp. paratuberculosis
ccgcgcgcgggcca

SEQ ID NO: 1023550 - RNA, 18 nt, Mycobacterium avium subsp. paratuberculosis
ccgcgcgcgggccagcgu

SEQ ID NO: 1023551 - RNA, 17 nt, Mycobacterium avium subsp. paratuberculosis
ccgcgcgcgcggccucc

SEQ ID NO: 1023552 - RNA, 17 nt, Mycobacterium avium subsp. paratuberculosis
ccgcgccuucgacccgg

SEQ ID NO: 1023553 - RNA, 19 nt, Mycobacterium avium subsp. paratuberculosis
ccgcgcgaagucccacugc

SEQ ID NO: 1023554 - RNA, 19 nt, Mycobacterium avium subsp. paratuberculosis
ccgcgcgaccaucagcccg

SEQ ID NO: 1023555 - RNA, 23 nt, Mycobacterium avium subsp. paratuberculosis
ccgcgcgagaguaucgccacgcc

SEQ ID NO: 1023556 - RNA, 15 nt, Mycobacterium avium subsp. paratuberculosis
ccgcgcgagcagacg

SEQ ID NO: 1023557 - RNA, 13 nt, Mycobacterium avium subsp. paratuberculosis
ccgcgcgagcgcg

SEQ ID NO: 1023558 - RNA, 14 nt, Mycobacterium avium subsp. paratuberculosis
ccgcgcgagcgcgc

SEQ ID NO: 1023559 - RNA, 23 nt, Mycobacterium avium subsp. paratuberculosis
ccgcgccgguguucggcgccagc

SEQ ID NO: 1023560 - RNA, 18 nt, Mycobacterium avium subsp. paratuberculosis
ccgcgccucguugagcac

SEQ ID NO: 1023561 - RNA, 16 nt, Mycobacterium avium subsp. paratuberculosis
ccgcgcgccagcgcgu

SEQ ID NO: 1023562 - RNA, 15 nt, Mycobacterium avium subsp. paratuberculosis
ccgcgcgccaggucg

SEQ ID NO: 1023563 - RNA, 20 nt, Mycobacterium avium subsp. paratuberculosis
ccgcgcgcccuagucgacgc

SEQ ID NO: 1023564 - RNA, 16 nt, Mycobacterium avium subsp. paratuberculosis
ccgcgcgaucaggccg

SEQ ID NO: 1023565 - RNA, 17 nt, Mycobacterium avium subsp. paratuberculosis
ccgcgcgaucaggccgg

SEQ ID NO: 1023566 - RNA, 22 nt, Mycobacterium avium subsp. paratuberculosis
ccgcgcgaugcacaaccgcugc

SEQ ID NO: 1023567 - RNA, 15 nt, Mycobacterium avium subsp. paratuberculosis
ccgcgcgaugcgggc

SEQ ID NO: 1023568 - RNA, 17 nt, Mycobacterium avium subsp. paratuberculosis
ccgcgccgccuucuugc

SEQ ID NO: 1023569 - RNA, 16 nt, Mycobacterium avium subsp. paratuberculosis
ccgcgccguagcggcc

SEQ ID NO: 1023570 - RNA, 23 nt, Mycobacterium avium subsp. paratuberculosis
ccgcgccgucgucgagcaccacc

SEQ ID NO: 1023571 - RNA, 15 nt, Mycobacterium avium subsp. paratuberculosis
ccgcgccgugaacug

SEQ ID NO: 1023572 - RNA, 22 nt, Mycobacterium avium subsp. paratuberculosis
ccgcgccgugaacugugcggug

SEQ ID NO: 1023573 - RNA, 15 nt, Mycobacterium avium subsp. paratuberculosis
ccgcgccgugcgcca

SEQ ID NO: 1023574 - RNA, 17 nt, Mycobacterium avium subsp. paratuberculosis
ccgcgccgugcgccagc

SEQ ID NO: 1023575 - RNA, 16 nt, Mycobacterium avium subsp. paratuberculosis
ccgcgccgcggccagc

SEQ ID NO: 1023576 - RNA, 15 nt, Mycobacterium avium subsp. paratuberculosis
ccgcgccgccgcccu

SEQ ID NO: 1023577 - RNA, 16 nt, Mycobacterium avium subsp. paratuberculosis
ccgcgccgccgcccug

SEQ ID NO: 1023578 - RNA, 16 nt, Mycobacterium avium subsp. paratuberculosis
ccgcgccgaggcgcuc

SEQ ID NO: 1023579 - RNA, 23 nt, Mycobacterium avium subsp. paratuberculosis
ccgcgccgaggcgcucggcccgc

SEQ ID NO: 1023580 - RNA, 19 nt, Mycobacterium avium subsp. paratuberculosis
ccgcgccgacggccgcgcc

SEQ ID NO: 1023581 - RNA, 14 nt, Mycobacterium avium subsp. paratuberculosis
ccgcgcccagugug

SEQ ID NO: 1023582 - RNA, 19 nt, Mycobacterium avium subsp. paratuberculosis
ccgcgcccaucgcggccgc

SEQ ID NO: 1023583 - RNA, 22 nt, Mycobacterium avium subsp. paratuberculosis
ccgcgcccaucgcggccgcccg

SEQ ID NO: 1023584 - RNA, 22 nt, Mycobacterium avium subsp. paratuberculosis
ccgcgcccaugaacgcgucgcc

SEQ ID NO: 1023585 - RNA, 20 nt, Mycobacterium avium subsp. paratuberculosis
ccgcgcccccugggacagcg

SEQ ID NO: 1023586 - RNA, 17 nt, Mycobacterium avium subsp. paratuberculosis
ccgcgccccgagcagcg

SEQ ID NO: 1023587 - RNA, 18 nt, Mycobacterium avium subsp. paratuberculosis
ccgcgccgaccagcgcgu

SEQ ID NO: 1023588 - RNA, 13 nt, Mycobacterium avium subsp. paratuberculosis
ccgcgcccggcuu

SEQ ID NO: 1023589 - RNA, 12 nt, Mycobacterium avium subsp. paratuberculosis
ccgcgcccggcu

SEQ ID NO: 1023590 - RNA, 13 nt, Mycobacterium avium subsp. paratuberculosis
ccgcgcccgcccc

SEQ ID NO: 1023591 - RNA, 14 nt, Mycobacterium avium subsp. paratuberculosis
ccgcgcccgccccg

SEQ ID NO: 1023592 - RNA, 14 nt, Mycobacterium avium subsp. paratuberculosis
ccgcgcccacccgc

SEQ ID NO: 1023593 - RNA, 15 nt, Mycobacterium avium subsp. paratuberculosis
ccgcgcccaccugga

SEQ ID NO: 1023594 - RNA, 16 nt, Mycobacterium avium subsp. paratuberculosis
ccgcgcccagccccag

SEQ ID NO: 1023595 - RNA, 20 nt, Mycobacterium avium subsp. paratuberculosis
ccgcgcccaggggagcggcg

SEQ ID NO: 1023596 - RNA, 15 nt, Mycobacterium avium subsp. paratuberculosis
ccgccuuggcgcgcu

SEQ ID NO: 1023597 - RNA, 15 nt, Mycobacterium avium subsp. paratuberculosis
ccgccuugggccggu

SEQ ID NO: 1023598 - RNA, 21 nt, Mycobacterium avium subsp. paratuberculosis
ccgcgaaaaggcaagggcgau

SEQ ID NO: 1023599 - RNA, 22 nt, Mycobacterium avium subsp. paratuberculosis
ccgcgaacgccucguuggccag

SEQ ID NO: 1023600 - RNA, 18 nt, Mycobacterium avium subsp. paratuberculosis
ccgcgaacucgucgacgc

SEQ ID NO: 1023601 - RNA, 13 nt, Mycobacterium avium subsp. paratuberculosis
ccgcgaaggcggc

SEQ ID NO: 1023602 - RNA, 17 nt, Mycobacterium avium subsp. paratuberculosis
ccgcgaaggcggcgucg

SEQ ID NO: 1023603 - RNA, 21 nt, Mycobacterium avium subsp. paratuberculosis
ccgccugugcgacggcgucgg

SEQ ID NO: 1023604 - RNA, 19 nt, Mycobacterium avium subsp. paratuberculosis
ccgccuucgacggccggcc

SEQ ID NO: 1023605 - RNA, 19 nt, Mycobacterium avium subsp. paratuberculosis
ccgccuucgaugcccucca

SEQ ID NO: 1023606 - RNA, 13 nt, Mycobacterium avium subsp. paratuberculosis
ccgccuggccacc

SEQ ID NO: 1023607 - RNA, 11 nt, Mycobacterium avium subsp. paratuberculosis
ccgcagcagcc

SEQ ID NO: 1023608 - RNA, 22 nt, Mycobacterium avium subsp. paratuberculosis
ccgcagcagcgaggccucgccg

SEQ ID NO: 1023609 - RNA, 18 nt, Mycobacterium avium subsp. paratuberculosis
ccgcagcaggugcgccag

SEQ ID NO: 1023610 - RNA, 12 nt, Mycobacterium avium subsp. paratuberculosis
ccgcagcccguc

SEQ ID NO: 1023611 - RNA, 12 nt, Mycobacterium avium subsp. paratuberculosis
ccgcagccgcgc

SEQ ID NO: 1023612 - RNA, 21 nt, Mycobacterium avium subsp. paratuberculosis
ccgcagcccgaccuucugcug

SEQ ID NO: 1023613 - RNA, 17 nt, Mycobacterium avium subsp. paratuberculosis
ccgcagcgcagcgucgg

SEQ ID NO: 1023614 - RNA, 20 nt, Mycobacterium avium subsp. paratuberculosis
ccgcagcgcagcgucggcgu

SEQ ID NO: 1023615 - RNA, 13 nt, Mycobacterium avium subsp. paratuberculosis
ccgcagccguccc

SEQ ID NO: 1023616 - RNA, 18 nt, Mycobacterium avium subsp. paratuberculosis
ccgcagccgucccaggac

SEQ ID NO: 1023617 - RNA, 13 nt, Mycobacterium avium subsp. paratuberculosis
ccgccugagcccg

SEQ ID NO: 1023618 - RNA, 16 nt, Mycobacterium avium subsp. paratuberculosis
ccgcagcggcgccgca

SEQ ID NO: 1023619 - RNA, 19 nt, Mycobacterium avium subsp. paratuberculosis
ccgcagcggcgccgcagcu

SEQ ID NO: 1023620 - RNA, 12 nt, Mycobacterium avium subsp. paratuberculosis
ccgcagcgcggc

SEQ ID NO: 1023621 - RNA, 14 nt, Mycobacterium avium subsp. paratuberculosis
ccgcagcgccagcg

SEQ ID NO: 1023622 - RNA, 22 nt, Mycobacterium avium subsp. paratuberculosis
ccgcagcgccagcgcgcccgcc

SEQ ID NO: 1023623 - RNA, 13 nt, Mycobacterium avium subsp. paratuberculosis
ccgcagcgccucg

SEQ ID NO: 1023624 - RNA, 19 nt, Mycobacterium avium subsp. paratuberculosis
ccgcagcgcgacgaacagc

SEQ ID NO: 1023625 - RNA, 19 nt, Mycobacterium avium subsp. paratuberculosis
ccgcagcgcgcgcucgguc

SEQ ID NO: 1023626 - RNA, 22 nt, Mycobacterium avium subsp. paratuberculosis
ccgcagcgcgcgcucggucagc

SEQ ID NO: 1023627 - RNA, 14 nt, Mycobacterium avium subsp. paratuberculosis
ccgccugcgcgggc

SEQ ID NO: 1023628 - RNA, 21 nt, Mycobacterium avium subsp. paratuberculosis
ccgcgcagcucgacgaccucg

SEQ ID NO: 1023629 - RNA, 23 nt, Mycobacterium avium subsp. paratuberculosis
ccgcgcagcucgacgaccucgcc

SEQ ID NO: 1023630 - RNA, 22 nt, Mycobacterium avium subsp. paratuberculosis
ccgcgcagcaccgcgucggcgc

SEQ ID NO: 1023631 - RNA, 15 nt, Mycobacterium avium subsp. paratuberculosis
ccgcgcagucggcgu

SEQ ID NO: 1023632 - RNA, 17 nt, Mycobacterium avium subsp. paratuberculosis
ccgcgcagucggcgucg

SEQ ID NO: 1023633 - RNA, 22 nt, Mycobacterium avium subsp. paratuberculosis
ccgcgcaggccguccagcagca

SEQ ID NO: 1023634 - RNA, 13 nt, Mycobacterium avium subsp. paratuberculosis
ccgcgccagccgc

SEQ ID NO: 1023635 - RNA, 17 nt, Mycobacterium avium subsp. paratuberculosis
ccgcgcaucaucgccca

SEQ ID NO: 1023636 - RNA, 16 nt, Mycobacterium avium subsp. paratuberculosis
ccgcgcagccagguga

SEQ ID NO: 1023637 - RNA, 15 nt, Mycobacterium avium subsp. paratuberculosis
ccgcgcaccgccccg

SEQ ID NO: 1023638 - RNA, 17 nt, Mycobacterium avium subsp. paratuberculosis
ccgcgcagaaccgcacc

SEQ ID NO: 1023639 - RNA, 21 nt, Mycobacterium avium subsp. paratuberculosis
ccgcgcacucgaacggcccgg

SEQ ID NO: 1023640 - RNA, 23 nt, Mycobacterium avium subsp. paratuberculosis
ccgcgcacuggagugcugcagac

SEQ ID NO: 1023641 - RNA, 22 nt, Mycobacterium avium subsp. paratuberculosis
ccgcgcaaucaaaaaccccgcu

SEQ ID NO: 1023642 - RNA, 21 nt, Mycobacterium avium subsp. paratuberculosis
ccgcgcaccccgaaccgcccg

SEQ ID NO: 1023643 - RNA, 16 nt, Mycobacterium avium subsp. paratuberculosis
ccgcgcaccacggugg

SEQ ID NO: 1023644 - RNA, 19 nt, Mycobacterium avium subsp. paratuberculosis
ccgcgcaccacgguggcgc

SEQ ID NO: 1023645 - RNA, 16 nt, Mycobacterium avium subsp. paratuberculosis
ccgcgaucaccacccc

SEQ ID NO: 1023646 - RNA, 23 nt, Mycobacterium avium subsp. paratuberculosis
ccgcgaugucggugggccgcacc

SEQ ID NO: 1023647 - RNA, 17 nt, Mycobacterium avium subsp. paratuberculosis
ccgcgauggcacacagc

SEQ ID NO: 1023648 - RNA, 18 nt, Mycobacterium avium subsp. paratuberculosis
ccgcgauggccuccgacc

SEQ ID NO: 1023649 - RNA, 20 nt, Mycobacterium avium subsp. paratuberculosis
ccgcgaucuugccgccgcgg

SEQ ID NO: 1023650 - RNA, 20 nt, Mycobacterium avium subsp. paratuberculosis
ccgcgaucucggcggacucg

SEQ ID NO: 1023651 - RNA, 15 nt, Mycobacterium avium subsp. paratuberculosis
ccgcgaugcgacacc

SEQ ID NO: 1023652 - RNA, 21 nt, Mycobacterium avium subsp. paratuberculosis
ccgcgacaaggucgaccgcgc

SEQ ID NO: 1023653 - RNA, 15 nt, Mycobacterium avium subsp. paratuberculosis
ccgcgacaucggcgc

SEQ ID NO: 1023654 - RNA, 22 nt, Mycobacterium avium subsp. paratuberculosis
ccgcgacaucggugaccgucgc

SEQ ID NO: 1023655 - RNA, 14 nt, Mycobacterium avium subsp. paratuberculosis
ccgcgaccacagcg

SEQ ID NO: 1023656 - RNA, 15 nt, Mycobacterium avium subsp. paratuberculosis
ccgcgaccacgccgc

SEQ ID NO: 1023657 - RNA, 22 nt, Mycobacterium avium subsp. paratuberculosis
ccgcgaccacgccgcggucgcu

SEQ ID NO: 1023658 - RNA, 19 nt, Mycobacterium avium subsp. paratuberculosis
ccgcgacccaggccgccgc

SEQ ID NO: 1023659 - RNA, 22 nt, Mycobacterium avium subsp. paratuberculosis
ccgcgaccgcgaucagggccgc

SEQ ID NO: 1023660 - RNA, 17 nt, Mycobacterium avium subsp. paratuberculosis
ccgcgaccgucagcagg

SEQ ID NO: 1023661 - RNA, 17 nt, Mycobacterium avium subsp. paratuberculosis
ccgcgacgaccgccugc

SEQ ID NO: 1023662 - RNA, 15 nt, Mycobacterium avium subsp. paratuberculosis
ccgcgacgaccucgc

SEQ ID NO: 1023663 - RNA, 19 nt, Mycobacterium avium subsp. paratuberculosis
ccgcgacgaccucgcccgc

SEQ ID NO: 1023664 - RNA, 21 nt, Mycobacterium avium subsp. paratuberculosis
ccgcgacgaugucgacccgcg

SEQ ID NO: 1023665 - RNA, 16 nt, Mycobacterium avium subsp. paratuberculosis
ccgcgacgcccaggug

SEQ ID NO: 1023666 - RNA, 15 nt, Mycobacterium avium subsp. paratuberculosis
ccgcgacgccgccgc

SEQ ID NO: 1023667 - RNA, 23 nt, Mycobacterium avium subsp. paratuberculosis
ccgcgacggcgagccgggccggg

SEQ ID NO: 1023668 - RNA, 18 nt, Mycobacterium avium subsp. paratuberculosis
ccgcgacggcgcccgccc

SEQ ID NO: 1023669 - RNA, 14 nt, Mycobacterium avium subsp. paratuberculosis
ccgcgacgggcucg

SEQ ID NO: 1023670 - RNA, 21 nt, Mycobacterium avium subsp. paratuberculosis
ccgcgacgggcugucccggcc

SEQ ID NO: 1023671 - RNA, 21 nt, Mycobacterium avium subsp. paratuberculosis
ccgcgacgguuguucagcccg

SEQ ID NO: 1023672 - RNA, 15 nt, Mycobacterium avium subsp. paratuberculosis
ccgcgacguagccgg

SEQ ID NO: 1023673 - RNA, 14 nt, Mycobacterium avium subsp. paratuberculosis
ccgcgacugcaccc

SEQ ID NO: 1023674 - RNA, 15 nt, Mycobacterium avium subsp. paratuberculosis
ccgcgagacccgguc

SEQ ID NO: 1023675 - RNA, 19 nt, Mycobacterium avium subsp. paratuberculosis
ccgcgacggaccagugcag

SEQ ID NO: 1023676 - RNA, 20 nt, Mycobacterium avium subsp. paratuberculosis
ccgcgacgcugagcgccagg

SEQ ID NO: 1023677 - RNA, 14 nt, Mycobacterium avium subsp. paratuberculosis
ccgcgacugcaggu

SEQ ID NO: 1023678 - RNA, 16 nt, Mycobacterium avium subsp. paratuberculosis
ccgcgacugucggcgc

SEQ ID NO: 1023679 - RNA, 22 nt, Mycobacterium avium subsp. paratuberculosis
ccgcgacugucggcgccccgcc

SEQ ID NO: 1023680 - RNA, 22 nt, Mycobacterium avium subsp. paratuberculosis
ccgcgagcccgcaaaucagccg

SEQ ID NO: 1023681 - RNA, 14 nt, Mycobacterium avium subsp. paratuberculosis
ccgcgagcccggcg

SEQ ID NO: 1023682 - RNA, 13 nt, Mycobacterium avium subsp. paratuberculosis
ccgcgagcugccc

SEQ ID NO: 1023683 - RNA, 13 nt, Mycobacterium avium subsp. paratuberculosis
ccgcgagcgcagc

SEQ ID NO: 1023684 - RNA, 15 nt, Mycobacterium avium subsp. paratuberculosis
ccgaaugccacgccg

SEQ ID NO: 1023685 - RNA, 12 nt, Mycobacterium avium subsp. paratuberculosis
ccgacaccagcg

SEQ ID NO: 1023686 - RNA, 17 nt, Mycobacterium avium subsp. paratuberculosis
ccgacaccaccgcgcgc

SEQ ID NO: 1023687 - RNA, 19 nt, Mycobacterium avium subsp. paratuberculosis
ccgacaccaccggccgccc

SEQ ID NO: 1023688 - RNA, 20 nt, Mycobacterium avium subsp. paratuberculosis
ccgacaccaccggccgcccg

SEQ ID NO: 1023689 - RNA, 19 nt, Mycobacterium avium subsp. paratuberculosis
ccgacaagggccgggcgcu

SEQ ID NO: 1023690 - RNA, 19 nt, Mycobacterium avium subsp. paratuberculosis
ccgaagggaaaggcagcag

SEQ ID NO: 1023691 - RNA, 17 nt, Mycobacterium avium subsp. paratuberculosis
ccgaagcucaucaccgg

SEQ ID NO: 1023692 - RNA, 23 nt, Mycobacterium avium subsp. paratuberculosis
ccgaagcggcgcacgcagugccg

SEQ ID NO: 1023693 - RNA, 21 nt, Mycobacterium avium subsp. paratuberculosis
ccgaagugcucgaacgcgccg

SEQ ID NO: 1023694 - RNA, 22 nt, Mycobacterium avium subsp. paratuberculosis
ccgaagucgacgcaccacgagc

SEQ ID NO: 1023695 - RNA, 19 nt, Mycobacterium avium subsp. paratuberculosis
ccgaaggugggguugaagc

SEQ ID NO: 1023696 - RNA, 14 nt, Mycobacterium avium subsp. paratuberculosis
ccgaaggcggcgcc

SEQ ID NO: 1023697 - RNA, 21 nt, Mycobacterium avium subsp. paratuberculosis
ccgaaccaguucgccaccacg

SEQ ID NO: 1023698 - RNA, 14 nt, Mycobacterium avium subsp. paratuberculosis
ccgaacccaccagc

SEQ ID NO: 1023699 - RNA, 22 nt, Mycobacterium avium subsp. paratuberculosis
ccgaacccaccagcgccugggc

SEQ ID NO: 1023700 - RNA, 17 nt, Mycobacterium avium subsp. paratuberculosis
ccgaacccgggcgcgcc

SEQ ID NO: 1023701 - RNA, 15 nt, Mycobacterium avium subsp. paratuberculosis
ccgaacgauggugug

SEQ ID NO: 1023702 - RNA, 14 nt, Mycobacterium avium subsp. paratuberculosis
ccgaacgcaccacc

SEQ ID NO: 1023703 - RNA, 15 nt, Mycobacterium avium subsp. paratuberculosis
ccgaacgccaccacc

SEQ ID NO: 1023704 - RNA, 13 nt, Mycobacterium avium subsp. paratuberculosis
ccgaacgccuccg

SEQ ID NO: 1023705 - RNA, 19 nt, Mycobacterium avium subsp. paratuberculosis
ccgaacgccuccgccgccc

SEQ ID NO: 1023706 - RNA, 18 nt, Mycobacterium avium subsp. paratuberculosis
ccgaacaacagggccgcg

SEQ ID NO: 1023707 - RNA, 16 nt, Mycobacterium avium subsp. paratuberculosis
ccgaaaugccgugcca

SEQ ID NO: 1023708 - RNA, 15 nt, Mycobacterium avium subsp. paratuberculosis
ccgaacaucagccga

SEQ ID NO: 1023709 - RNA, 18 nt, Mycobacterium avium subsp. paratuberculosis
ccgaacaggcgcaacagc

SEQ ID NO: 1023710 - RNA, 12 nt, Mycobacterium avium subsp. paratuberculosis
ccgaacagggcg

SEQ ID NO: 1023711 - RNA, 20 nt, Mycobacterium avium subsp. paratuberculosis
ccgaacaacggcggaccggc

SEQ ID NO: 1023712 - RNA, 15 nt, Mycobacterium avium subsp. paratuberculosis
ccgaacacggccgcc

SEQ ID NO: 1023713 - RNA, 20 nt, Mycobacterium avium subsp. paratuberculosis
ccgaacagcagcgaacccgc

SEQ ID NO: 1023714 - RNA, 22 nt, Mycobacterium avium subsp. paratuberculosis
cccuuguccaggauccccgucc

SEQ ID NO: 1023715 - RNA, 17 nt, Mycobacterium avium subsp. paratuberculosis
cccuugcccggacgaug

SEQ ID NO: 1023716 - RNA, 13 nt, Mycobacterium avium subsp. paratuberculosis
cccuuggccagca

SEQ ID NO: 1023717 - RNA, 22 nt, Mycobacterium avium subsp. paratuberculosis
cccuucuucgcgggugccuucu

SEQ ID NO: 1023718 - RNA, 12 nt, Mycobacterium avium subsp. paratuberculosis
cccuugcagcac

SEQ ID NO: 1023719 - RNA, 16 nt, Mycobacterium avium subsp. paratuberculosis
cccuucggccggcagc

SEQ ID NO: 1023720 - RNA, 15 nt, Mycobacterium avium subsp. paratuberculosis
cccuucggcgcccgc

SEQ ID NO: 1023721 - RNA, 17 nt, Mycobacterium avium subsp. paratuberculosis
cccuucggcgcccgcuc

SEQ ID NO: 1023722 - RNA, 19 nt, Mycobacterium avium subsp. paratuberculosis
cccuuccagcaccccgucg

SEQ ID NO: 1023723 - RNA, 19 nt, Mycobacterium avium subsp. paratuberculosis
cccgucccgccgacggaga

SEQ ID NO: 1023724 - RNA, 13 nt, Mycobacterium avium subsp. paratuberculosis
cccgucccggccc

SEQ ID NO: 1023725 - RNA, 14 nt, Mycobacterium avium subsp. paratuberculosis
cccgucgaccagga

SEQ ID NO: 1023726 - RNA, 20 nt, Mycobacterium avium subsp. paratuberculosis
cccgucgacgggccaccagc

SEQ ID NO: 1023727 - RNA, 19 nt, Mycobacterium avium subsp. paratuberculosis
cccgucgagcgucacgccg

SEQ ID NO: 1023728 - RNA, 13 nt, Mycobacterium avium subsp. paratuberculosis
cccgucgccuccg

SEQ ID NO: 1023729 - RNA, 14 nt, Mycobacterium avium subsp. paratuberculosis
cccgucgccaccac

SEQ ID NO: 1023730 - RNA, 21 nt, Mycobacterium avium subsp. paratuberculosis
cccgucggccaucagccgccg

SEQ ID NO: 1023731 - RNA, 22 nt, Mycobacterium avium subsp. paratuberculosis
cccugcagccggguggcccgcc

SEQ ID NO: 1023732 - RNA, 23 nt, Mycobacterium avium subsp. paratuberculosis
cccugcagccggguggcccgccc

SEQ ID NO: 1023733 - RNA, 19 nt, Mycobacterium avium subsp. paratuberculosis
cccugcacccagccgugcc

SEQ ID NO: 1023734 - RNA, 13 nt, Mycobacterium avium subsp. paratuberculosis
cccugcgccagca

SEQ ID NO: 1023735 - RNA, 20 nt, Mycobacterium avium subsp. paratuberculosis
cccuggaugucacgguccag

SEQ ID NO: 1023736 - RNA, 12 nt, Mycobacterium avium subsp. paratuberculosis
cccuggccgccg

SEQ ID NO: 1023737 - RNA, 12 nt, Mycobacterium avium subsp. paratuberculosis
cccuggccccag

SEQ ID NO: 1023738 - RNA, 20 nt, Mycobacterium avium subsp. paratuberculosis
cccuggcgggcggcccgcac

SEQ ID NO: 1023739 - RNA, 21 nt, Mycobacterium avium subsp. paratuberculosis
cccuggcgaugaucaacagga

SEQ ID NO: 1023740 - RNA, 16 nt, Mycobacterium avium subsp. paratuberculosis
cccuggccgccggccg

SEQ ID NO: 1023741 - RNA, 16 nt, Mycobacterium avium subsp. paratuberculosis
cccugcuugaacagca

SEQ ID NO: 1023742 - RNA, 21 nt, Mycobacterium avium subsp. paratuberculosis
cccuggacgaguggucggccg

SEQ ID NO: 1023743 - RNA, 19 nt, Mycobacterium avium subsp. paratuberculosis
cccugcgcucagcacgcgg

SEQ ID NO: 1023744 - RNA, 20 nt, Mycobacterium avium subsp. paratuberculosis
cccugcgcucagcacgcgga

SEQ ID NO: 1023745 - RNA, 18 nt, Mycobacterium avium subsp. paratuberculosis
cccugcgcggccugcagc

SEQ ID NO: 1023746 - RNA, 13 nt, Mycobacterium avium subsp. paratuberculosis
cccugcgcggccu

SEQ ID NO: 1023747 - RNA, 16 nt, Mycobacterium avium subsp. paratuberculosis
cccugcgcgcccugcu

SEQ ID NO: 1023748 - RNA, 17 nt, Mycobacterium avium subsp. paratuberculosis
cccugcgcgcccugcug

SEQ ID NO: 1023749 - RNA, 13 nt, Mycobacterium avium subsp. paratuberculosis
ccgacgggcgugu

SEQ ID NO: 1023750 - RNA, 23 nt, Mycobacterium avium subsp. paratuberculosis
ccgacgggcguguagccugcggc

SEQ ID NO: 1023751 - RNA, 14 nt, Mycobacterium avium subsp. paratuberculosis
ccgacggcgcgccc

SEQ ID NO: 1023752 - RNA, 20 nt, Mycobacterium avium subsp. paratuberculosis
ccgacggcgucuuggggaug

SEQ ID NO: 1023753 - RNA, 23 nt, Mycobacterium avium subsp. paratuberculosis
ccgacggcuaccugaccagcggc

SEQ ID NO: 1023754 - RNA, 23 nt, Mycobacterium avium subsp. paratuberculosis
ccgacggcugcccggcccgccgc

SEQ ID NO: 1023755 - RNA, 16 nt, Mycobacterium avium subsp. paratuberculosis
ccgacggcgccgcggc

SEQ ID NO: 1023756 - RNA, 19 nt, Mycobacterium avium subsp. paratuberculosis
ccgacggcgccggugccca

SEQ ID NO: 1023757 - RNA, 19 nt, Mycobacterium avium subsp. paratuberculosis
ccgacgcucgccaccccgc

SEQ ID NO: 1023758 - RNA, 17 nt, Mycobacterium avium subsp. paratuberculosis
ccgacggagacgaccag

SEQ ID NO: 1023759 - RNA, 21 nt, Mycobacterium avium subsp. paratuberculosis
ccgacggagccgagcaccagg

SEQ ID NO: 1023760 - RNA, 21 nt, Mycobacterium avium subsp. paratuberculosis
ccgacggauucccgaacaggg

SEQ ID NO: 1023761 - RNA, 12 nt, Mycobacterium avium subsp. paratuberculosis
ccgacggcagca

SEQ ID NO: 1023762 - RNA, 19 nt, Mycobacterium avium subsp. paratuberculosis
ccgacggcagcaccgccga

SEQ ID NO: 1023763 - RNA, 17 nt, Mycobacterium avium subsp. paratuberculosis
ccgacugauccaccauc

SEQ ID NO: 1023764 - RNA, 22 nt, Mycobacterium avium subsp. paratuberculosis
ccgacugauccaccaucuucca

SEQ ID NO: 1023765 - RNA, 18 nt, Mycobacterium avium subsp. paratuberculosis
ccgacugccccgcuccuc

SEQ ID NO: 1023766 - RNA, 21 nt, Mycobacterium avium subsp. paratuberculosis
ccgacuccccgcccggcaaca

SEQ ID NO: 1023767 - RNA, 17 nt, Mycobacterium avium subsp. paratuberculosis
ccgacuccuccggcccg

SEQ ID NO: 1023768 - RNA, 22 nt, Mycobacterium avium subsp. paratuberculosis
ccgacuagcgcggcggccucgg

SEQ ID NO: 1023769 - RNA, 13 nt, Mycobacterium avium subsp. paratuberculosis
ccgacggugcgug

SEQ ID NO: 1023770 - RNA, 21 nt, Mycobacterium avium subsp. paratuberculosis
ccgacggugcgugccagcagc

SEQ ID NO: 1023771 - RNA, 22 nt, Mycobacterium avium subsp. paratuberculosis
ccgacggugcgugccagcagcu

SEQ ID NO: 1023772 - RNA, 16 nt, Mycobacterium avium subsp. paratuberculosis
ccgacguccugguuga

SEQ ID NO: 1023773 - RNA, 22 nt, Mycobacterium avium subsp. paratuberculosis
ccgacgucgaccagguaggcgc

SEQ ID NO: 1023774 - RNA, 23 nt, Mycobacterium avium subsp. paratuberculosis
ccgacgugucgucgucgccgccg

SEQ ID NO: 1023775 - RNA, 16 nt, Mycobacterium avium subsp. paratuberculosis
ccgacgugcagcgcca

SEQ ID NO: 1023776 - RNA, 21 nt, Mycobacterium avium subsp. paratuberculosis
ccgagauccaccgcgcggcca

SEQ ID NO: 1023777 - RNA, 13 nt, Mycobacterium avium subsp. paratuberculosis
ccgagaucgcggg

SEQ ID NO: 1023778 - RNA, 18 nt, Mycobacterium avium subsp. paratuberculosis
ccgagaucgcgguggcgc

SEQ ID NO: 1023779 - RNA, 18 nt, Mycobacterium avium subsp. paratuberculosis
ccgagagcgcgucgacgc

SEQ ID NO: 1023780 - RNA, 15 nt, Mycobacterium avium subsp. paratuberculosis
ccgagacgucggcgu

SEQ ID NO: 1023781 - RNA, 17 nt, Mycobacterium avium subsp. paratuberculosis
ccgagacguggucgggc

SEQ ID NO: 1023782 - RNA, 12 nt, Mycobacterium avium subsp. paratuberculosis
ccgagacugaug

SEQ ID NO: 1023783 - RNA, 22 nt, Mycobacterium avium subsp. paratuberculosis
ccgagacugaugguggcgcgca

SEQ ID NO: 1023784 - RNA, 13 nt, Mycobacterium avium subsp. paratuberculosis
ccgagcggcugcu

SEQ ID NO: 1023785 - RNA, 21 nt, Mycobacterium avium subsp. paratuberculosis
ccgagcgcaccgcggagcgca

SEQ ID NO: 1023786 - RNA, 16 nt, Mycobacterium avium subsp. paratuberculosis
ccgagccggugccgcc

SEQ ID NO: 1023787 - RNA, 20 nt, Mycobacterium avium subsp. paratuberculosis
ccgagcgcgccgagcagcug

SEQ ID NO: 1023788 - RNA, 15 nt, Mycobacterium avium subsp. paratuberculosis
ccgagcgcgccgccg

SEQ ID NO: 1023789 - RNA, 19 nt, Mycobacterium avium subsp. paratuberculosis
ccgagccgguccgaccagc

SEQ ID NO: 1023790 - RNA, 16 nt, Mycobacterium avium subsp. paratuberculosis
ccgagaguccgccgcc

SEQ ID NO: 1023791 - RNA, 17 nt, Mycobacterium avium subsp. paratuberculosis
ccgagauggccaccauc

SEQ ID NO: 1023792 - RNA, 16 nt, Mycobacterium avium subsp. paratuberculosis
ccgaguggcgccgucg

SEQ ID NO: 1023793 - RNA, 18 nt, Mycobacterium avium subsp. paratuberculosis
ccgaguagaacuucgcca

SEQ ID NO: 1023794 - RNA, 17 nt, Mycobacterium avium subsp. paratuberculosis
ccgaggugacgucgcgc

SEQ ID NO: 1023795 - RNA, 20 nt, Mycobacterium avium subsp. paratuberculosis
ccgaggugacgucgcgccgc

SEQ ID NO: 1023796 - RNA, 21 nt, Mycobacterium avium subsp. paratuberculosis
ccgaggucuuucaucgccccg

SEQ ID NO: 1023797 - RNA, 20 nt, Mycobacterium avium subsp. paratuberculosis
ccgagguggcccgccacgug

SEQ ID NO: 1023798 - RNA, 14 nt, Mycobacterium avium subsp. paratuberculosis
ccgagguggccgcc

SEQ ID NO: 1023799 - RNA, 15 nt, Mycobacterium avium subsp. paratuberculosis
ccgagguggccgcca

SEQ ID NO: 1023800 - RNA, 20 nt, Mycobacterium avium subsp. paratuberculosis
ccgaguccgggccgccggcc

SEQ ID NO: 1023801 - RNA, 22 nt, Mycobacterium avium subsp. paratuberculosis
ccgagucgaucgccagcgcgca

SEQ ID NO: 1023802 - RNA, 16 nt, Mycobacterium avium subsp. paratuberculosis
ccgagucgcgccgcgu

SEQ ID NO: 1023803 - RNA, 15 nt, Mycobacterium avium subsp. paratuberculosis
ccgagucgcgcgacc

SEQ ID NO: 1023804 - RNA, 21 nt, Mycobacterium avium subsp. paratuberculosis
ccgagucggagacccgcccgg

SEQ ID NO: 1023805 - RNA, 15 nt, Mycobacterium avium subsp. paratuberculosis
ccgagucggugacca

SEQ ID NO: 1023806 - RNA, 14 nt, Mycobacterium avium subsp. paratuberculosis
ccgagucgucgcgc

SEQ ID NO: 1023807 - RNA, 20 nt, Mycobacterium avium subsp. paratuberculosis
ccgagucgucgcgcaccagc

SEQ ID NO: 1023808 - RNA, 21 nt, Mycobacterium avium subsp. paratuberculosis
ccgagucgucgcgcaccagcu

SEQ ID NO: 1023809 - RNA, 17 nt, Mycobacterium avium subsp. paratuberculosis
ccgagcgggccuucacg

SEQ ID NO: 1023810 - RNA, 19 nt, Mycobacterium avium subsp. paratuberculosis
ccgaggaacugcagcgacu

SEQ ID NO: 1023811 - RNA, 20 nt, Mycobacterium avium subsp. paratuberculosis
ccgaggacacguuggccaga

SEQ ID NO: 1023812 - RNA, 21 nt, Mycobacterium avium subsp. paratuberculosis
ccgaggacacguuggccagau

SEQ ID NO: 1023813 - RNA, 17 nt, Mycobacterium avium subsp. paratuberculosis
ccgaggagacgucggcc

SEQ ID NO: 1023814 - RNA, 17 nt, Mycobacterium avium subsp. paratuberculosis
ccgaggccgauggcgcc

SEQ ID NO: 1023815 - RNA, 18 nt, Mycobacterium avium subsp. paratuberculosis
ccgaggccgauggcgccc

SEQ ID NO: 1023816 - RNA, 19 nt, Mycobacterium avium subsp. paratuberculosis
ccgaggccgauggcgccca

SEQ ID NO: 1023817 - RNA, 14 nt, Mycobacterium avium subsp. paratuberculosis
ccgaggccgcccgc

SEQ ID NO: 1023818 - RNA, 23 nt, Mycobacterium avium subsp. paratuberculosis
ccgaggcaaucgagcgggcgggc

SEQ ID NO: 1023819 - RNA, 18 nt, Mycobacterium avium subsp. paratuberculosis
ccgaggcgaugccgugcu

SEQ ID NO: 1023820 - RNA, 17 nt, Mycobacterium avium subsp. paratuberculosis
ccgaggcgcaacaccgg

SEQ ID NO: 1023821 - RNA, 18 nt, Mycobacterium avium subsp. paratuberculosis
ccgaggcgguuccggugg

SEQ ID NO: 1023822 - RNA, 15 nt, Mycobacterium avium subsp. paratuberculosis
ccgaggcgugccgcu

SEQ ID NO: 1023823 - RNA, 18 nt, Mycobacterium avium subsp. paratuberculosis
ccgaggcgugccgcuggg

SEQ ID NO: 1023824 - RNA, 16 nt, Mycobacterium avium subsp. paratuberculosis
ccgagggccagcagcc

SEQ ID NO: 1023825 - RNA, 14 nt, Mycobacterium avium subsp. paratuberculosis
ccgaggcugacgau

SEQ ID NO: 1023826 - RNA, 20 nt, Mycobacterium avium subsp. paratuberculosis
ccgaggguucgguggccccg

SEQ ID NO: 1023827 - RNA, 16 nt, Mycobacterium avium subsp. paratuberculosis
ccgagguagccgcgca

SEQ ID NO: 1023828 - RNA, 17 nt, Mycobacterium avium subsp. paratuberculosis
ccgaggucaccaccgag

SEQ ID NO: 1023829 - RNA, 13 nt, Mycobacterium avium subsp. paratuberculosis
ccgaggucgacgc

SEQ ID NO: 1023830 - RNA, 17 nt, Mycobacterium avium subsp. paratuberculosis
ccgaggucgacgccccg

SEQ ID NO: 1023831 - RNA, 20 nt, Mycobacterium avium subsp. paratuberculosis
ccgcaccugcgcgccguugg

SEQ ID NO: 1023832 - RNA, 24 nt, Mycobacterium avium subsp. paratuberculosis
ccgcacccuugacuaccgcgccca

SEQ ID NO: 1023833 - RNA, 13 nt, Mycobacterium avium subsp. paratuberculosis
ccgcaccgccagg

SEQ ID NO: 1023834 - RNA, 17 nt, Mycobacterium avium subsp. paratuberculosis
ccgcaccgccaggcugg

SEQ ID NO: 1023835 - RNA, 15 nt, Mycobacterium avium subsp. paratuberculosis
ccgcaccggccggcc

SEQ ID NO: 1023836 - RNA, 17 nt, Mycobacterium avium subsp. paratuberculosis
ccgcaccggccggcccc

SEQ ID NO: 1023837 - RNA, 18 nt, Mycobacterium avium subsp. paratuberculosis
ccgcaccggccggccccg

SEQ ID NO: 1023838 - RNA, 16 nt, Mycobacterium avium subsp. paratuberculosis
ccgcaccggcgccgcc

SEQ ID NO: 1023839 - RNA, 15 nt, Mycobacterium avium subsp. paratuberculosis
ccgcacccgccgccc

SEQ ID NO: 1023840 - RNA, 13 nt, Mycobacterium avium subsp. paratuberculosis
ccgcaccgaccag

SEQ ID NO: 1023841 - RNA, 17 nt, Mycobacterium avium subsp. paratuberculosis
ccgcaccgaccagcggg

SEQ ID NO: 1023842 - RNA, 15 nt, Mycobacterium avium subsp. paratuberculosis
ccgcaccgagccugg

SEQ ID NO: 1023843 - RNA, 13 nt, Mycobacterium avium subsp. paratuberculosis
ccgcaaggccgcc

SEQ ID NO: 1023844 - RNA, 21 nt, Mycobacterium avium subsp. paratuberculosis
ccgcacgccggguugggcggc

SEQ ID NO: 1023845 - RNA, 17 nt, Mycobacterium avium subsp. paratuberculosis
ccgcacgucccgcccgg

SEQ ID NO: 1023846 - RNA, 22 nt, Mycobacterium avium subsp. paratuberculosis
ccgcagcaccaccucgugcaca

SEQ ID NO: 1023847 - RNA, 13 nt, Mycobacterium avium subsp. paratuberculosis
ccgcagcaccagg

SEQ ID NO: 1023848 - RNA, 17 nt, Mycobacterium avium subsp. paratuberculosis
ccgcacggugcagcagc

SEQ ID NO: 1023849 - RNA, 22 nt, Mycobacterium avium subsp. paratuberculosis
ccgcacggugcagcagcgccgc

SEQ ID NO: 1023850 - RNA, 16 nt, Mycobacterium avium subsp. paratuberculosis
ccgcacggcccaucac

SEQ ID NO: 1023851 - RNA, 22 nt, Mycobacterium avium subsp. paratuberculosis
ccgcacggcccaucaccagcgg

SEQ ID NO: 1023852 - RNA, 20 nt, Mycobacterium avium subsp. paratuberculosis
ccgcacggccgccagggucu

SEQ ID NO: 1023853 - RNA, 15 nt, Mycobacterium avium subsp. paratuberculosis
ccgcacgcccgggca

SEQ ID NO: 1023854 - RNA, 15 nt, Mycobacterium avium subsp. paratuberculosis
ccgcaccucgccggc

SEQ ID NO: 1023855 - RNA, 16 nt, Mycobacterium avium subsp. paratuberculosis
ccgcaacgggccgcag

SEQ ID NO: 1023856 - RNA, 16 nt, Mycobacterium avium subsp. paratuberculosis
ccgcaacucgggcucg

SEQ ID NO: 1023857 - RNA, 17 nt, Mycobacterium avium subsp. paratuberculosis
ccgcaaccgccggcagc

SEQ ID NO: 1023858 - RNA, 17 nt, Mycobacterium avium subsp. paratuberculosis
ccgcaacggcucccagg

SEQ ID NO: 1023859 - RNA, 15 nt, Mycobacterium avium subsp. paratuberculosis
ccgcaacgccggcgu

SEQ ID NO: 1023860 - RNA, 13 nt, Mycobacterium avium subsp. paratuberculosis
ccgcaacgcgcgc

SEQ ID NO: 1023861 - RNA, 16 nt, Mycobacterium avium subsp. paratuberculosis
ccgcaacacggccucg

SEQ ID NO: 1023862 - RNA, 21 nt, Mycobacterium avium subsp. paratuberculosis
ccgcaacagccggcccgagcc

SEQ ID NO: 1023863 - RNA, 13 nt, Mycobacterium avium subsp. paratuberculosis
ccgauggcgccca

SEQ ID NO: 1023864 - RNA, 23 nt, Mycobacterium avium subsp. paratuberculosis
ccgauggugguaccgaccugucc

SEQ ID NO: 1023865 - RNA, 13 nt, Mycobacterium avium subsp. paratuberculosis
ccgauguacuccu

SEQ ID NO: 1023866 - RNA, 14 nt, Mycobacterium avium subsp. paratuberculosis
ccgauggucagcug

SEQ ID NO: 1023867 - RNA, 16 nt, Mycobacterium avium subsp. paratuberculosis
ccgauggucagcugcc

SEQ ID NO: 1023868 - RNA, 23 nt, Mycobacterium avium subsp. paratuberculosis
ccgauggcggcggcccgccgcgc

SEQ ID NO: 1023869 - RNA, 21 nt, Mycobacterium avium subsp. paratuberculosis
ccgauggcgguccaccaccac

SEQ ID NO: 1023870 - RNA, 16 nt, Mycobacterium avium subsp. paratuberculosis
ccgauggugaccucgg

SEQ ID NO: 1023871 - RNA, 21 nt, Mycobacterium avium subsp. paratuberculosis
ccgcaaagcaccgcgaacagc

SEQ ID NO: 1023872 - RNA, 20 nt, Mycobacterium avium subsp. paratuberculosis
ccgaugcgcccgcgccaccc

SEQ ID NO: 1023873 - RNA, 21 nt, Mycobacterium avium subsp. paratuberculosis
ccgaucugucgcgcucagugc

SEQ ID NO: 1023874 - RNA, 14 nt, Mycobacterium avium subsp. paratuberculosis
ccgaucuggcgggc

SEQ ID NO: 1023875 - RNA, 14 nt, Mycobacterium avium subsp. paratuberculosis
ccgaucggggccag

SEQ ID NO: 1023876 - RNA, 19 nt, Mycobacterium avium subsp. paratuberculosis
ccgaucucgaccagcgccg

SEQ ID NO: 1023877 - RNA, 19 nt, Mycobacterium avium subsp. paratuberculosis
ccgaucugaccgagcagcg

SEQ ID NO: 1023878 - RNA, 18 nt, Mycobacterium avium subsp. paratuberculosis
ccgauccucgccugucgg

SEQ ID NO: 1023879 - RNA, 14 nt, Mycobacterium avium subsp. paratuberculosis
ccgauccggcgccc

SEQ ID NO: 1023880 - RNA, 16 nt, Mycobacterium avium subsp. paratuberculosis
ccgaucccgucgucgg

SEQ ID NO: 1023881 - RNA, 14 nt, Mycobacterium avium subsp. paratuberculosis
ccgaucgccuccgu

SEQ ID NO: 1023882 - RNA, 19 nt, Mycobacterium avium subsp. paratuberculosis
ccgaucgugcgcccauccg

SEQ ID NO: 1023883 - RNA, 20 nt, Mycobacterium avium subsp. paratuberculosis
ccgaucgaucaucgccucgg

SEQ ID NO: 1023884 - RNA, 16 nt, Mycobacterium avium subsp. paratuberculosis
ccgaucggcccggcca

SEQ ID NO: 1023885 - RNA, 21 nt, Mycobacterium avium subsp. paratuberculosis
ccgaugcccaucacgccccag

SEQ ID NO: 1023886 - RNA, 21 nt, Mycobacterium avium subsp. paratuberculosis
ccgaugcccgacaccgccccg

SEQ ID NO: 1023887 - RNA, 15 nt, Mycobacterium avium subsp. paratuberculosis
ccgaugcccgccccg

SEQ ID NO: 1023888 - RNA, 13 nt, Mycobacterium avium subsp. paratuberculosis
ccgaugccgcgcu

SEQ ID NO: 1023889 - RNA, 22 nt, Mycobacterium avium subsp. paratuberculosis
ccgaugccgccgagggccagca

SEQ ID NO: 1023890 - RNA, 17 nt, Mycobacterium avium subsp. paratuberculosis
ccgaugcggugccgggc

SEQ ID NO: 1023891 - RNA, 23 nt, Mycobacterium avium subsp. paratuberculosis
ccgaugacgcugccgcgccgcca

SEQ ID NO: 1023892 - RNA, 17 nt, Mycobacterium avium subsp. paratuberculosis
ccgaugaccgcggcggg

SEQ ID NO: 1023893 - RNA, 18 nt, Mycobacterium avium subsp. paratuberculosis
ccgaugaccgcggcgggc

SEQ ID NO: 1023894 - RNA, 13 nt, Mycobacterium avium subsp. paratuberculosis
ccgaugaccggcc

SEQ ID NO: 1023895 - RNA, 18 nt, Mycobacterium avium subsp. paratuberculosis
ccgaugaaguacccgguc

SEQ ID NO: 1023896 - RNA, 23 nt, Mycobacterium avium subsp. paratuberculosis
ccgaucaacaccgccagcaccgc

SEQ ID NO: 1023897 - RNA, 14 nt, Mycobacterium avium subsp. paratuberculosis
ccgaucaccaggcc

SEQ ID NO: 1023898 - RNA, 17 nt, Mycobacterium avium subsp. paratuberculosis
ccgauauaggugagaaa

SEQ ID NO: 1023899 - RNA, 16 nt, Mycobacterium avium subsp. paratuberculosis
ccgauccagggcccgc

SEQ ID NO: 1023900 - RNA, 13 nt, Mycobacterium avium subsp. paratuberculosis
ccgaucagugccg

SEQ ID NO: 1023901 - RNA, 13 nt, Mycobacterium avium subsp. paratuberculosis
ccgaucaggcugg

SEQ ID NO: 1023902 - RNA, 23 nt, Mycobacterium avium subsp. paratuberculosis
ccgaucaggguccagggcggguc

SEQ ID NO: 1023903 - RNA, 12 nt, Mycobacterium avium subsp. paratuberculosis
ccgaucaccgcc

SEQ ID NO: 1023904 - RNA, 16 nt, Mycobacterium avium subsp. paratuberculosis
ccgaucaccggcagca

SEQ ID NO: 1023905 - RNA, 18 nt, Mycobacterium avium subsp. paratuberculosis
ccgaucaccucgccggcc

SEQ ID NO: 1023906 - RNA, 13 nt, Mycobacterium avium subsp. paratuberculosis
ccgaucaccuugc

SEQ ID NO: 1023907 - RNA, 17 nt, Mycobacterium avium subsp. paratuberculosis
ccgaucagcagcaccug

SEQ ID NO: 1023908 - RNA, 15 nt, Mycobacterium avium subsp. paratuberculosis
cccgcggccaucgcc

SEQ ID NO: 1023909 - RNA, 22 nt, Mycobacterium avium subsp. paratuberculosis
cccgcggaucgcguaguccagc

SEQ ID NO: 1023910 - RNA, 17 nt, Mycobacterium avium subsp. paratuberculosis
cccgcgcguggucccac

SEQ ID NO: 1023911 - RNA, 15 nt, Mycobacterium avium subsp. paratuberculosis
cccgcgcgcgggcca

SEQ ID NO: 1023912 - RNA, 20 nt, Mycobacterium avium subsp. paratuberculosis
cccgcgcggcgucggccugc

SEQ ID NO: 1023913 - RNA, 15 nt, Mycobacterium avium subsp. paratuberculosis
cccgcgcggcucaca

SEQ ID NO: 1023914 - RNA, 18 nt, Mycobacterium avium subsp. paratuberculosis
cccgcgcggcucacagcg

SEQ ID NO: 1023915 - RNA, 17 nt, Mycobacterium avium subsp. paratuberculosis
cccgcgggucgcggccc

SEQ ID NO: 1023916 - RNA, 15 nt, Mycobacterium avium subsp. paratuberculosis
cccgcggugccgcag

SEQ ID NO: 1023917 - RNA, 16 nt, Mycobacterium avium subsp. paratuberculosis
cccgcggugccgcagc

SEQ ID NO: 1023918 - RNA, 16 nt, Mycobacterium avium subsp. paratuberculosis
cccgcguaaccggcgg

SEQ ID NO: 1023919 - RNA, 17 nt, Mycobacterium avium subsp. paratuberculosis
cccgcgggccagacugc

SEQ ID NO: 1023920 - RNA, 18 nt, Mycobacterium avium subsp. paratuberculosis
cccgcgggaguccacgcc

SEQ ID NO: 1023921 - RNA, 20 nt, Mycobacterium avium subsp. paratuberculosis
cccgcgggaguccacgccgu

SEQ ID NO: 1023922 - RNA, 17 nt, Mycobacterium avium subsp. paratuberculosis
cccgcggcgccgcggcg

SEQ ID NO: 1023923 - RNA, 13 nt, Mycobacterium avium subsp. paratuberculosis
cccgcggccuccg

SEQ ID NO: 1023924 - RNA, 14 nt, Mycobacterium avium subsp. paratuberculosis
cccgcggcagccag

SEQ ID NO: 1023925 - RNA, 15 nt, Mycobacterium avium subsp. paratuberculosis
cccgcggcagccagc

SEQ ID NO: 1023926 - RNA, 14 nt, Mycobacterium avium subsp. paratuberculosis
cccgcggccggccc

SEQ ID NO: 1023927 - RNA, 16 nt, Mycobacterium avium subsp. paratuberculosis
cccgcgugggcacccc

SEQ ID NO: 1023928 - RNA, 16 nt, Mycobacterium avium subsp. paratuberculosis
cccgcgggugcagccg

SEQ ID NO: 1023929 - RNA, 22 nt, Mycobacterium avium subsp. paratuberculosis
cccgcgucacauccgucacgcc

SEQ ID NO: 1023930 - RNA, 24 nt, Mycobacterium avium subsp. paratuberculosis
cccgcguccugcagcgccguccgc

SEQ ID NO: 1023931 - RNA, 14 nt, Mycobacterium avium subsp. paratuberculosis
cccgcgucgcgcag

SEQ ID NO: 1023932 - RNA, 13 nt, Mycobacterium avium subsp. paratuberculosis
cccgcgccacccc

SEQ ID NO: 1023933 - RNA, 18 nt, Mycobacterium avium subsp. paratuberculosis
cccgcgccacgccgcccc

SEQ ID NO: 1023934 - RNA, 15 nt, Mycobacterium avium subsp. paratuberculosis
cccgcgcccaccugg

SEQ ID NO: 1023935 - RNA, 17 nt, Mycobacterium avium subsp. paratuberculosis
cccgcgcccaccuggag

SEQ ID NO: 1023936 - RNA, 23 nt, Mycobacterium avium subsp. paratuberculosis
cccgcgcgacaucaccgcgggcg

SEQ ID NO: 1023937 - RNA, 15 nt, Mycobacterium avium subsp. paratuberculosis
cccgcgccgcggcca

SEQ ID NO: 1023938 - RNA, 13 nt, Mycobacterium avium subsp. paratuberculosis
cccgcgccgcguc

SEQ ID NO: 1023939 - RNA, 13 nt, Mycobacterium avium subsp. paratuberculosis
cccgcgccggcag

SEQ ID NO: 1023940 - RNA, 12 nt, Mycobacterium avium subsp. paratuberculosis
cccgcgaccccu

SEQ ID NO: 1023941 - RNA, 17 nt, Mycobacterium avium subsp. paratuberculosis
cccgcgaaaucuucgcc

SEQ ID NO: 1023942 - RNA, 22 nt, Mycobacterium avium subsp. paratuberculosis
cccgcgaaaucuucgccgucag

SEQ ID NO: 1023943 - RNA, 21 nt, Mycobacterium avium subsp. paratuberculosis
cccgcgaacgccucguuggcc

SEQ ID NO: 1023944 - RNA, 16 nt, Mycobacterium avium subsp. paratuberculosis
cccgcgaucggcgcca

SEQ ID NO: 1023945 - RNA, 20 nt, Mycobacterium avium subsp. paratuberculosis
cccgcgauggcacacagcgu

SEQ ID NO: 1023946 - RNA, 15 nt, Mycobacterium avium subsp. paratuberculosis
cccgcgagcugcccc

SEQ ID NO: 1023947 - RNA, 18 nt, Mycobacterium avium subsp. paratuberculosis
cccgcgagcugccccuuc

SEQ ID NO: 1023948 - RNA, 20 nt, Mycobacterium avium subsp. paratuberculosis
cccgcgacugucggcucgcc

SEQ ID NO: 1023949 - RNA, 21 nt, Mycobacterium avium subsp. paratuberculosis
cccgcugugguccucgucacc

SEQ ID NO: 1023950 - RNA, 16 nt, Mycobacterium avium subsp. paratuberculosis
cccgcuggcgccggcg

SEQ ID NO: 1023951 - RNA, 14 nt, Mycobacterium avium subsp. paratuberculosis
cccgcuggccgccg

SEQ ID NO: 1023952 - RNA, 18 nt, Mycobacterium avium subsp. paratuberculosis
cccgcuugauggcggcgc

SEQ ID NO: 1023953 - RNA, 15 nt, Mycobacterium avium subsp. paratuberculosis
cccgcuucgcccggc

SEQ ID NO: 1023954 - RNA, 13 nt, Mycobacterium avium subsp. paratuberculosis
cccgcuugcgcag

SEQ ID NO: 1023955 - RNA, 15 nt, Mycobacterium avium subsp. paratuberculosis
cccggaaagcgcggg

SEQ ID NO: 1023956 - RNA, 23 nt, Mycobacterium avium subsp. paratuberculosis
cccggaacagcuuggcgcagccg

SEQ ID NO: 1023957 - RNA, 13 nt, Mycobacterium avium subsp. paratuberculosis
cccgcuccagcgg

SEQ ID NO: 1023958 - RNA, 16 nt, Mycobacterium avium subsp. paratuberculosis
cccgcuccagcggcca

SEQ ID NO: 1023959 - RNA, 15 nt, Mycobacterium avium subsp. paratuberculosis
cccgcuccauggcgg

SEQ ID NO: 1023960 - RNA, 19 nt, Mycobacterium avium subsp. paratuberculosis
cccgcuccuccucgcgccg

SEQ ID NO: 1023961 - RNA, 22 nt, Mycobacterium avium subsp. paratuberculosis
cccgcuccuccucgcgccgcca

SEQ ID NO: 1023962 - RNA, 15 nt, Mycobacterium avium subsp. paratuberculosis
cccgcuccugcaggc

SEQ ID NO: 1023963 - RNA, 17 nt, Mycobacterium avium subsp. paratuberculosis
cccgcugaccgccgcgc

SEQ ID NO: 1023964 - RNA, 22 nt, Mycobacterium avium subsp. paratuberculosis
cccgcucggccagcgcgccgca

SEQ ID NO: 1023965 - RNA, 15 nt, Mycobacterium avium subsp. paratuberculosis
cccgcugaaagcucg

SEQ ID NO: 1023966 - RNA, 14 nt, Mycobacterium avium subsp. paratuberculosis
cccgcugaccaggc

SEQ ID NO: 1023967 - RNA, 14 nt, Mycobacterium avium subsp. paratuberculosis
cccgcugcucuugu

SEQ ID NO: 1023968 - RNA, 14 nt, Mycobacterium avium subsp. paratuberculosis
cccgcugcggcgca

SEQ ID NO: 1023969 - RNA, 19 nt, Mycobacterium avium subsp. paratuberculosis
cccggcagaacgacgccag

SEQ ID NO: 1023970 - RNA, 18 nt, Mycobacterium avium subsp. paratuberculosis
cccggcaacaccggcggc

SEQ ID NO: 1023971 - RNA, 21 nt, Mycobacterium avium subsp. paratuberculosis
cccggcaaccgaaucgagccg

SEQ ID NO: 1023972 - RNA, 21 nt, Mycobacterium avium subsp. paratuberculosis
cccggauucgcggcggcgccg

SEQ ID NO: 1023973 - RNA, 22 nt, Mycobacterium avium subsp. paratuberculosis
cccggaugauguucuccggccc

SEQ ID NO: 1023974 - RNA, 23 nt, Mycobacterium avium subsp. paratuberculosis
cccggaugauguucuccggcccg

SEQ ID NO: 1023975 - RNA, 20 nt, Mycobacterium avium subsp. paratuberculosis
cccggauggccgggcaggcc

SEQ ID NO: 1023976 - RNA, 21 nt, Mycobacterium avium subsp. paratuberculosis
cccggauuucgucccagucca

SEQ ID NO: 1023977 - RNA, 14 nt, Mycobacterium avium subsp. paratuberculosis
cccggaugucgggc

SEQ ID NO: 1023978 - RNA, 17 nt, Mycobacterium avium subsp. paratuberculosis
cccggaugucgggcgag

SEQ ID NO: 1023979 - RNA, 23 nt, Mycobacterium avium subsp. paratuberculosis
cccggagaaaccgucggcccgcc

SEQ ID NO: 1023980 - RNA, 14 nt, Mycobacterium avium subsp. paratuberculosis
cccggaguagccgg

SEQ ID NO: 1023981 - RNA, 21 nt, Mycobacterium avium subsp. paratuberculosis
cccggaucgucuugcggccca

SEQ ID NO: 1023982 - RNA, 17 nt, Mycobacterium avium subsp. paratuberculosis
cccggauccgucgcccc

SEQ ID NO: 1023983 - RNA, 21 nt, Mycobacterium avium subsp. paratuberculosis
cccggaacgcgucgcccacgc

SEQ ID NO: 1023984 - RNA, 20 nt, Mycobacterium avium subsp. paratuberculosis
cccggaccaggguggcccca

SEQ ID NO: 1023985 - RNA, 14 nt, Mycobacterium avium subsp. paratuberculosis
cccggacggagccg

SEQ ID NO: 1023986 - RNA, 15 nt, Mycobacterium avium subsp. paratuberculosis
cccggacggagccgu

SEQ ID NO: 1023987 - RNA, 19 nt, Mycobacterium avium subsp. paratuberculosis
cccggacggagccgugccc

SEQ ID NO: 1023988 - RNA, 23 nt, Mycobacterium avium subsp. paratuberculosis
cccggacggccaccuugucggcg

SEQ ID NO: 1023989 - RNA, 20 nt, Mycobacterium avium subsp. paratuberculosis
cccggacggccgaaacgccc

SEQ ID NO: 1023990 - RNA, 13 nt, Mycobacterium avium subsp. paratuberculosis
cccggucccgccg

SEQ ID NO: 1023991 - RNA, 16 nt, Mycobacterium avium subsp. paratuberculosis
cccggucaguucgucg

SEQ ID NO: 1023992 - RNA, 22 nt, Mycobacterium avium subsp. paratuberculosis
cccggguccuggcccccgcccc

SEQ ID NO: 1023993 - RNA, 19 nt, Mycobacterium avium subsp. paratuberculosis
cccggucagcucgccgucc

SEQ ID NO: 1023994 - RNA, 20 nt, Mycobacterium avium subsp. paratuberculosis
cccggguagggcagccacau

SEQ ID NO: 1023995 - RNA, 21 nt, Mycobacterium avium subsp. paratuberculosis
cccgggggaccagcgcaaccg

SEQ ID NO: 1023996 - RNA, 14 nt, Mycobacterium avium subsp. paratuberculosis
cccggggcgcgcug

SEQ ID NO: 1023997 - RNA, 21 nt, Mycobacterium avium subsp. paratuberculosis
cccgggcggcgccgaacucgg

SEQ ID NO: 1023998 - RNA, 21 nt, Mycobacterium avium subsp. paratuberculosis
cccgggcgcgacggucacgcu

SEQ ID NO: 1023999 - RNA, 13 nt, Mycobacterium avium subsp. paratuberculosis
cccgggcgcgccc

SEQ ID NO: 1024000 - RNA, 14 nt, Mycobacterium avium subsp. paratuberculosis
cccgggcgcgccca

SEQ ID NO: 1024001 - RNA, 16 nt, Mycobacterium avium subsp. paratuberculosis
cccgggcgcgcccacc

SEQ ID NO: 1024002 - RNA, 16 nt, Mycobacterium avium subsp. paratuberculosis
cccgggcgccauccgc

SEQ ID NO: 1024003 - RNA, 18 nt, Mycobacterium avium subsp. paratuberculosis
cccgggcggccugcugca

SEQ ID NO: 1024004 - RNA, 22 nt, Mycobacterium avium subsp. paratuberculosis
cccgggccuuguugcggcgcac

SEQ ID NO: 1024005 - RNA, 17 nt, Mycobacterium avium subsp. paratuberculosis
cccggcgugggccgcag

SEQ ID NO: 1024006 - RNA, 19 nt, Mycobacterium avium subsp. paratuberculosis
cccggcgugggccgcagcg

SEQ ID NO: 1024007 - RNA, 14 nt, Mycobacterium avium subsp. paratuberculosis
cccggcgugggugu

SEQ ID NO: 1024008 - RNA, 21 nt, Mycobacterium avium subsp. paratuberculosis
cccggcguccaguagccgccg

SEQ ID NO: 1024009 - RNA, 19 nt, Mycobacterium avium subsp. paratuberculosis
cccggcgucgaugaccucg

SEQ ID NO: 1024010 - RNA, 23 nt, Mycobacterium avium subsp. paratuberculosis
cccggcgggcagguucaucacca

SEQ ID NO: 1024011 - RNA, 19 nt, Mycobacterium avium subsp. paratuberculosis
cccggcgggcucgccggcc

SEQ ID NO: 1024012 - RNA, 19 nt, Mycobacterium avium subsp. paratuberculosis
cccggcgggucagcaccgc

SEQ ID NO: 1024013 - RNA, 15 nt, Mycobacterium avium subsp. paratuberculosis
cccggcgggucugug

SEQ ID NO: 1024014 - RNA, 23 nt, Mycobacterium avium subsp. paratuberculosis
cccggcggucggaucgagcucgc

SEQ ID NO: 1024015 - RNA, 14 nt, Mycobacterium avium subsp. paratuberculosis
cccggcguacagca

SEQ ID NO: 1024016 - RNA, 16 nt, Mycobacterium avium subsp. paratuberculosis
cccggcggccggcccc

SEQ ID NO: 1024017 - RNA, 19 nt, Mycobacterium avium subsp. paratuberculosis
cccggcggccggccccggc

SEQ ID NO: 1024018 - RNA, 16 nt, Mycobacterium avium subsp. paratuberculosis
cccggcggccggccgc

SEQ ID NO: 1024019 - RNA, 14 nt, Mycobacterium avium subsp. paratuberculosis
cccggcggcaccgc

SEQ ID NO: 1024020 - RNA, 23 nt, Mycobacterium avium subsp. paratuberculosis
cccggcgcuaaagccgaccgccc

SEQ ID NO: 1024021 - RNA, 15 nt, Mycobacterium avium subsp. paratuberculosis
cccguagacccacag

SEQ ID NO: 1024022 - RNA, 18 nt, Mycobacterium avium subsp. paratuberculosis
cccguagacccacagcug

SEQ ID NO: 1024023 - RNA, 17 nt, Mycobacterium avium subsp. paratuberculosis
cccguagaugcggccca

SEQ ID NO: 1024024 - RNA, 14 nt, Mycobacterium avium subsp. paratuberculosis
cccggucugcggcc

SEQ ID NO: 1024025 - RNA, 15 nt, Mycobacterium avium subsp. paratuberculosis
cccgguuccaccggg

SEQ ID NO: 1024026 - RNA, 18 nt, Mycobacterium avium subsp. paratuberculosis
cccgguuccaccgggccg

SEQ ID NO: 1024027 - RNA, 23 nt, Mycobacterium avium subsp. paratuberculosis
cccgguuccaccgggccgccauc

SEQ ID NO: 1024028 - RNA, 17 nt, Mycobacterium avium subsp. paratuberculosis
cccgguucccggcacca

SEQ ID NO: 1024029 - RNA, 16 nt, Mycobacterium avium subsp. paratuberculosis
cccgguucccgugcug

SEQ ID NO: 1024030 - RNA, 18 nt, Mycobacterium avium subsp. paratuberculosis
cccgguugaccccggccc

SEQ ID NO: 1024031 - RNA, 22 nt, Mycobacterium avium subsp. paratuberculosis
cccgguuuccaguccggcgccc

SEQ ID NO: 1024032 - RNA, 22 nt, Mycobacterium avium subsp. paratuberculosis
cccgguuucguuguccaccauc

SEQ ID NO: 1024033 - RNA, 19 nt, Mycobacterium avium subsp. paratuberculosis
cccgguccuucucgcacag

SEQ ID NO: 1024034 - RNA, 14 nt, Mycobacterium avium subsp. paratuberculosis
cccgguccggcccg

SEQ ID NO: 1024035 - RNA, 14 nt, Mycobacterium avium subsp. paratuberculosis
cccggucgcggccg

SEQ ID NO: 1024036 - RNA, 20 nt, Mycobacterium avium subsp. paratuberculosis
cccggucggaguccagcacg

SEQ ID NO: 1024037 - RNA, 23 nt, Mycobacterium avium subsp. paratuberculosis
cccggucccgccggugaucuccc

SEQ ID NO: 1024038 - RNA, 15 nt, Mycobacterium avium subsp. paratuberculosis
cccggucgucgagca

SEQ ID NO: 1024039 - RNA, 14 nt, Mycobacterium avium subsp. paratuberculosis
cccggucgucgccg

SEQ ID NO: 1024040 - RNA, 19 nt, Mycobacterium avium subsp. paratuberculosis
cccggccguggacccgccc

SEQ ID NO: 1024041 - RNA, 20 nt, Mycobacterium avium subsp. paratuberculosis
cccggccguggacccgcccc

SEQ ID NO: 1024042 - RNA, 23 nt, Mycobacterium avium subsp. paratuberculosis
cccggccguggacccgccccgac

SEQ ID NO: 1024043 - RNA, 20 nt, Mycobacterium avium subsp. paratuberculosis
cccggccggcgcgaccagcg

SEQ ID NO: 1024044 - RNA, 16 nt, Mycobacterium avium subsp. paratuberculosis
cccggccggcccgccc

SEQ ID NO: 1024045 - RNA, 17 nt, Mycobacterium avium subsp. paratuberculosis
cccggccgcgccggaug

SEQ ID NO: 1024046 - RNA, 15 nt, Mycobacterium avium subsp. paratuberculosis
cccggccgcggccca

SEQ ID NO: 1024047 - RNA, 22 nt, Mycobacterium avium subsp. paratuberculosis
cccggccgcggugaccgcgccg

SEQ ID NO: 1024048 - RNA, 19 nt, Mycobacterium avium subsp. paratuberculosis
cccggcgacggcggugggc

SEQ ID NO: 1024049 - RNA, 20 nt, Mycobacterium avium subsp. paratuberculosis
cccggcgacggcggugggcu

SEQ ID NO: 1024050 - RNA, 17 nt, Mycobacterium avium subsp. paratuberculosis
cccggcgacgucgccgg

SEQ ID NO: 1024051 - RNA, 23 nt, Mycobacterium avium subsp. paratuberculosis
cccggcgacgucgccggccugcc

SEQ ID NO: 1024052 - RNA, 15 nt, Mycobacterium avium subsp. paratuberculosis
cccggcgagcacgcc

SEQ ID NO: 1024053 - RNA, 19 nt, Mycobacterium avium subsp. paratuberculosis
cccggcgagcacgccgccg

SEQ ID NO: 1024054 - RNA, 17 nt, Mycobacterium avium subsp. paratuberculosis
cccggcgaucucggaga

SEQ ID NO: 1024055 - RNA, 20 nt, Mycobacterium avium subsp. paratuberculosis
cccggcgaugaucaggccgg

SEQ ID NO: 1024056 - RNA, 17 nt, Mycobacterium avium subsp. paratuberculosis
cccggcgagcgacgcca

SEQ ID NO: 1024057 - RNA, 18 nt, Mycobacterium avium subsp. paratuberculosis
cccggcgaccaccagccg

SEQ ID NO: 1024058 - RNA, 15 nt, Mycobacterium avium subsp. paratuberculosis
cccggcgaccacccu

SEQ ID NO: 1024059 - RNA, 16 nt, Mycobacterium avium subsp. paratuberculosis
cccggcgacgaagcag

SEQ ID NO: 1024060 - RNA, 17 nt, Mycobacterium avium subsp. paratuberculosis
cccggcgaacgccucgg

SEQ ID NO: 1024061 - RNA, 18 nt, Mycobacterium avium subsp. paratuberculosis
cccggcgcagcgccgcgc

SEQ ID NO: 1024062 - RNA, 17 nt, Mycobacterium avium subsp. paratuberculosis
cccggcgcccggcgcgc

SEQ ID NO: 1024063 - RNA, 19 nt, Mycobacterium avium subsp. paratuberculosis
cccggcgcccggcgcgcca

SEQ ID NO: 1024064 - RNA, 18 nt, Mycobacterium avium subsp. paratuberculosis
cccggcgaugccgagccc

SEQ ID NO: 1024065 - RNA, 19 nt, Mycobacterium avium subsp. paratuberculosis
cccggcgaugccgagcccu

SEQ ID NO: 1024066 - RNA, 16 nt, Mycobacterium avium subsp. paratuberculosis
cccggcgaugucgggc

SEQ ID NO: 1024067 - RNA, 14 nt, Mycobacterium avium subsp. paratuberculosis
cccggcgcacagga

SEQ ID NO: 1024068 - RNA, 18 nt, Mycobacterium avium subsp. paratuberculosis
cccggcgcaccaggcgcc

SEQ ID NO: 1024069 - RNA, 16 nt, Mycobacterium avium subsp. paratuberculosis
cccggcgcggccgccc

SEQ ID NO: 1024070 - RNA, 18 nt, Mycobacterium avium subsp. paratuberculosis
cccggcgcggccgcccag

SEQ ID NO: 1024071 - RNA, 15 nt, Mycobacterium avium subsp. paratuberculosis
cccggcgcgcagccc

SEQ ID NO: 1024072 - RNA, 19 nt, Mycobacterium avium subsp. paratuberculosis
cccggcgcggaacgcgccg

SEQ ID NO: 1024073 - RNA, 21 nt, Mycobacterium avium subsp. paratuberculosis
cccggcgccgccguucgccgg

SEQ ID NO: 1024074 - RNA, 14 nt, Mycobacterium avium subsp. paratuberculosis
cccggcgcgccgca

SEQ ID NO: 1024075 - RNA, 21 nt, Mycobacterium avium subsp. paratuberculosis
cccggcgcgccgcaggagauc

SEQ ID NO: 1024076 - RNA, 12 nt, Mycobacterium avium subsp. paratuberculosis
cccggcgcgccg

SEQ ID NO: 1024077 - RNA, 14 nt, Mycobacterium avium subsp. paratuberculosis
cccggcgccggccc

SEQ ID NO: 1024078 - RNA, 14 nt, Mycobacterium avium subsp. paratuberculosis
cccggcgccggcgg

SEQ ID NO: 1024079 - RNA, 12 nt, Mycobacterium avium subsp. paratuberculosis
cccggccaguug

SEQ ID NO: 1024080 - RNA, 13 nt, Mycobacterium avium subsp. paratuberculosis
cccggcccagccg

SEQ ID NO: 1024081 - RNA, 14 nt, Mycobacterium avium subsp. paratuberculosis
cccggcccagccgc

SEQ ID NO: 1024082 - RNA, 15 nt, Mycobacterium avium subsp. paratuberculosis
cccggcccagccgcu

SEQ ID NO: 1024083 - RNA, 14 nt, Mycobacterium avium subsp. paratuberculosis
cccggccccaccgc

SEQ ID NO: 1024084 - RNA, 15 nt, Mycobacterium avium subsp. paratuberculosis
cccggccccaccgcc

SEQ ID NO: 1024085 - RNA, 15 nt, Mycobacterium avium subsp. paratuberculosis
cccggccccggccgg

SEQ ID NO: 1024086 - RNA, 17 nt, Mycobacterium avium subsp. paratuberculosis
cccggcccacgccgucg

SEQ ID NO: 1024087 - RNA, 18 nt, Mycobacterium avium subsp. paratuberculosis
cccggcccgcuggccgcc

SEQ ID NO: 1024088 - RNA, 22 nt, Mycobacterium avium subsp. paratuberculosis
cccggcccggaacgcgucgccc

SEQ ID NO: 1024089 - RNA, 22 nt, Mycobacterium avium subsp. paratuberculosis
cccggccgccgaggacacguug

SEQ ID NO: 1024090 - RNA, 12 nt, Mycobacterium avium subsp. paratuberculosis
cccggccgccgg

SEQ ID NO: 1024091 - RNA, 17 nt, Mycobacterium avium subsp. paratuberculosis
cccggccgcgacagccg

SEQ ID NO: 1024092 - RNA, 18 nt, Mycobacterium avium subsp. paratuberculosis
cccggccgcgacagccgg

SEQ ID NO: 1024093 - RNA, 18 nt, Mycobacterium avium subsp. paratuberculosis
cccggccgcgcaccgccc

SEQ ID NO: 1024094 - RNA, 20 nt, Mycobacterium avium subsp. paratuberculosis
cccggccgcgcaccgccccg

SEQ ID NO: 1024095 - RNA, 12 nt, Mycobacterium avium subsp. paratuberculosis
cccggccgccag

SEQ ID NO: 1024096 - RNA, 11 nt, Mycobacterium avium subsp. paratuberculosis
cccggccgcca

SEQ ID NO: 1024097 - RNA, 17 nt, Mycobacterium avium subsp. paratuberculosis
cccggccgagcgcagcg

SEQ ID NO: 1024098 - RNA, 16 nt, Mycobacterium avium subsp. paratuberculosis
cccggccgaggucacc

SEQ ID NO: 1024099 - RNA, 21 nt, Mycobacterium avium subsp. paratuberculosis
cccggcauagagcuggugggc

SEQ ID NO: 1024100 - RNA, 18 nt, Mycobacterium avium subsp. paratuberculosis
cccggcagaucgcggccc

SEQ ID NO: 1024101 - RNA, 18 nt, Mycobacterium avium subsp. paratuberculosis
cccggcagccgcuccggc

SEQ ID NO: 1024102 - RNA, 17 nt, Mycobacterium avium subsp. paratuberculosis
cccggccacucgccgcg

SEQ ID NO: 1024103 - RNA, 15 nt, Mycobacterium avium subsp. paratuberculosis
cccggccagcacgcc

SEQ ID NO: 1024104 - RNA, 21 nt, Mycobacterium avium subsp. paratuberculosis
cccggccagccgggcggccag

SEQ ID NO: 1024105 - RNA, 22 nt, Mycobacterium avium subsp. paratuberculosis
cccggccaggaucuugucggcg

SEQ ID NO: 1024106 - RNA, 16 nt, Mycobacterium avium subsp. paratuberculosis
cccggccaccgccgcc

SEQ ID NO: 1024107 - RNA, 17 nt, Mycobacterium avium subsp. paratuberculosis
cccggccaccgccgcca

SEQ ID NO: 1024108 - RNA, 15 nt, Mycobacterium avium subsp. paratuberculosis
ccccgaacagcgcca

SEQ ID NO: 1024109 - RNA, 17 nt, Mycobacterium avium subsp. paratuberculosis
cccccggaccugccggc

SEQ ID NO: 1024110 - RNA, 12 nt, Mycobacterium avium subsp. paratuberculosis
cccccgcgccgc

SEQ ID NO: 1024111 - RNA, 13 nt, Mycobacterium avium subsp. paratuberculosis
cccccgcccggcc

SEQ ID NO: 1024112 - RNA, 22 nt, Mycobacterium avium subsp. paratuberculosis
cccccgccgaccgguccgccgc

SEQ ID NO: 1024113 - RNA, 13 nt, Mycobacterium avium subsp. paratuberculosis
ccccgaccgacgc

SEQ ID NO: 1024114 - RNA, 22 nt, Mycobacterium avium subsp. paratuberculosis
ccccgaccaucauggccucccc

SEQ ID NO: 1024115 - RNA, 18 nt, Mycobacterium avium subsp. paratuberculosis
ccccgaccacaccggcgc

SEQ ID NO: 1024116 - RNA, 21 nt, Mycobacterium avium subsp. paratuberculosis
ccccgaccacaccggcgcugc

SEQ ID NO: 1024117 - RNA, 17 nt, Mycobacterium avium subsp. paratuberculosis
ccccgacaccguggugg

SEQ ID NO: 1024118 - RNA, 21 nt, Mycobacterium avium subsp. paratuberculosis
ccccgacaccgugguggcggc

SEQ ID NO: 1024119 - RNA, 15 nt, Mycobacterium avium subsp. paratuberculosis
ccccgacaggcccac

SEQ ID NO: 1024120 - RNA, 21 nt, Mycobacterium avium subsp. paratuberculosis
ccccgaaaccauugcaccgca

SEQ ID NO: 1024121 - RNA, 20 nt, Mycobacterium avium subsp. paratuberculosis
ccccgaaccgcccgcccggc

SEQ ID NO: 1024122 - RNA, 19 nt, Mycobacterium avium subsp. paratuberculosis
cccccaccacgaagcuggc

SEQ ID NO: 1024123 - RNA, 15 nt, Mycobacterium avium subsp. paratuberculosis
cccccgauccgccgu

SEQ ID NO: 1024124 - RNA, 17 nt, Mycobacterium avium subsp. paratuberculosis
cccccgacaccgccagc

SEQ ID NO: 1024125 - RNA, 22 nt, Mycobacterium avium subsp. paratuberculosis
cccccgaggagacgucggccgg

SEQ ID NO: 1024126 - RNA, 15 nt, Mycobacterium avium subsp. paratuberculosis
cccccaaaacccggc

SEQ ID NO: 1024127 - RNA, 15 nt, Mycobacterium avium subsp. paratuberculosis
ccccgcccggccggu

SEQ ID NO: 1024128 - RNA, 18 nt, Mycobacterium avium subsp. paratuberculosis
ccccgcccggcggccacc

SEQ ID NO: 1024129 - RNA, 14 nt, Mycobacterium avium subsp. paratuberculosis
ccccgacggcgccg

SEQ ID NO: 1024130 - RNA, 12 nt, Mycobacterium avium subsp. paratuberculosis
ccccgcagaaca

SEQ ID NO: 1024131 - RNA, 18 nt, Mycobacterium avium subsp. paratuberculosis
ccccggaccugccggcga

SEQ ID NO: 1024132 - RNA, 18 nt, Mycobacterium avium subsp. paratuberculosis
ccccggagauccggccgc

SEQ ID NO: 1024133 - RNA, 19 nt, Mycobacterium avium subsp. paratuberculosis
ccccggagauccggccgcu

SEQ ID NO: 1024134 - RNA, 12 nt, Mycobacterium avium subsp. paratuberculosis
ccccggccagca

SEQ ID NO: 1024135 - RNA, 13 nt, Mycobacterium avium subsp. paratuberculosis
ccccggccagcac

SEQ ID NO: 1024136 - RNA, 12 nt, Mycobacterium avium subsp. paratuberculosis
ccccggccagga

SEQ ID NO: 1024137 - RNA, 12 nt, Mycobacterium avium subsp. paratuberculosis
ccccggccaggg

SEQ ID NO: 1024138 - RNA, 13 nt, Mycobacterium avium subsp. paratuberculosis
ccccgggcccagc

SEQ ID NO: 1024139 - RNA, 16 nt, Mycobacterium avium subsp. paratuberculosis
ccccgggcaccagcgc

SEQ ID NO: 1024140 - RNA, 12 nt, Mycobacterium avium subsp. paratuberculosis
ccccgggcgagc

SEQ ID NO: 1024141 - RNA, 23 nt, Mycobacterium avium subsp. paratuberculosis
ccccggcgugagcgagccggcac

SEQ ID NO: 1024142 - RNA, 15 nt, Mycobacterium avium subsp. paratuberculosis
ccccggcggccggcc

SEQ ID NO: 1024143 - RNA, 19 nt, Mycobacterium avium subsp. paratuberculosis
ccccggcgggcucgccggc

SEQ ID NO: 1024144 - RNA, 14 nt, Mycobacterium avium subsp. paratuberculosis
ccccggcggccgcg

SEQ ID NO: 1024145 - RNA, 17 nt, Mycobacterium avium subsp. paratuberculosis
ccccggcgaggccaggc

SEQ ID NO: 1024146 - RNA, 18 nt, Mycobacterium avium subsp. paratuberculosis
ccccggccguucuugcgg

SEQ ID NO: 1024147 - RNA, 21 nt, Mycobacterium avium subsp. paratuberculosis
ccccggcgaccacccucacca

SEQ ID NO: 1024148 - RNA, 22 nt, Mycobacterium avium subsp. paratuberculosis
ccccggcgaccacccucaccac

SEQ ID NO: 1024149 - RNA, 18 nt, Mycobacterium avium subsp. paratuberculosis
ccccaacggcgugcagcc

SEQ ID NO: 1024150 - RNA, 17 nt, Mycobacterium avium subsp. paratuberculosis
cccauucacgcagcugg

SEQ ID NO: 1024151 - RNA, 19 nt, Mycobacterium avium subsp. paratuberculosis
cccagccaguccgccgccg

SEQ ID NO: 1024152 - RNA, 15 nt, Mycobacterium avium subsp. paratuberculosis
cccagcaucgccgcg

SEQ ID NO: 1024153 - RNA, 21 nt, Mycobacterium avium subsp. paratuberculosis
cccagcaucgccgcgacccgg

SEQ ID NO: 1024154 - RNA, 18 nt, Mycobacterium avium subsp. paratuberculosis
ccccaucuugaccagggu

SEQ ID NO: 1024155 - RNA, 19 nt, Mycobacterium avium subsp. paratuberculosis
ccccagcugggccgccagc

SEQ ID NO: 1024156 - RNA, 13 nt, Mycobacterium avium subsp. paratuberculosis
ccccagggccucg

SEQ ID NO: 1024157 - RNA, 12 nt, Mycobacterium avium subsp. paratuberculosis
ccccagacgaag

SEQ ID NO: 1024158 - RNA, 13 nt, Mycobacterium avium subsp. paratuberculosis
ccccacggccgca

SEQ ID NO: 1024159 - RNA, 14 nt, Mycobacterium avium subsp. paratuberculosis
ccccacggccgcaa

SEQ ID NO: 1024160 - RNA, 20 nt, Mycobacterium avium subsp. paratuberculosis
ccccacgcgcucagcgcggc

SEQ ID NO: 1024161 - RNA, 15 nt, Mycobacterium avium subsp. paratuberculosis
ccccacaccguccga

SEQ ID NO: 1024162 - RNA, 20 nt, Mycobacterium avium subsp. paratuberculosis
cccgagcccgacggcagcac

SEQ ID NO: 1024163 - RNA, 15 nt, Mycobacterium avium subsp. paratuberculosis
cccgauagccccgcc

SEQ ID NO: 1024164 - RNA, 21 nt, Mycobacterium avium subsp. paratuberculosis
cccgauagccccgccaggcgg

SEQ ID NO: 1024165 - RNA, 21 nt, Mycobacterium avium subsp. paratuberculosis
cccgauagcuugagccccgcc

SEQ ID NO: 1024166 - RNA, 22 nt, Mycobacterium avium subsp. paratuberculosis
cccgauagcuugagccccgccg

SEQ ID NO: 1024167 - RNA, 14 nt, Mycobacterium avium subsp. paratuberculosis
cccgauccagacgg

SEQ ID NO: 1024168 - RNA, 17 nt, Mycobacterium avium subsp. paratuberculosis
cccgauccggcugagca

SEQ ID NO: 1024169 - RNA, 16 nt, Mycobacterium avium subsp. paratuberculosis
cccgaucaacaccgcc

SEQ ID NO: 1024170 - RNA, 21 nt, Mycobacterium avium subsp. paratuberculosis
cccgaucaacaccgccagcac

SEQ ID NO: 1024171 - RNA, 17 nt, Mycobacterium avium subsp. paratuberculosis
cccgagcaacuggguga

SEQ ID NO: 1024172 - RNA, 12 nt, Mycobacterium avium subsp. paratuberculosis
cccgagcaccag

SEQ ID NO: 1024173 - RNA, 12 nt, Mycobacterium avium subsp. paratuberculosis
cccgagcacccc

SEQ ID NO: 1024174 - RNA, 18 nt, Mycobacterium avium subsp. paratuberculosis
cccgagcaccccggcggc

SEQ ID NO: 1024175 - RNA, 19 nt, Mycobacterium avium subsp. paratuberculosis
cccgagcaccccggcggcc

SEQ ID NO: 1024176 - RNA, 11 nt, Mycobacterium avium subsp. paratuberculosis
cccgagcaccg

SEQ ID NO: 1024177 - RNA, 16 nt, Mycobacterium avium subsp. paratuberculosis
cccgagcaccgggccg

SEQ ID NO: 1024178 - RNA, 13 nt, Mycobacterium avium subsp. paratuberculosis
cccgagcaggcgg

SEQ ID NO: 1024179 - RNA, 22 nt, Mycobacterium avium subsp. paratuberculosis
cccgaagcgcuaacaaaagccc

SEQ ID NO: 1024180 - RNA, 13 nt, Mycobacterium avium subsp. paratuberculosis
cccgaacccggcc

SEQ ID NO: 1024181 - RNA, 14 nt, Mycobacterium avium subsp. paratuberculosis
cccgacaccgccag

SEQ ID NO: 1024182 - RNA, 17 nt, Mycobacterium avium subsp. paratuberculosis
cccgacaccgccccgcc

SEQ ID NO: 1024183 - RNA, 23 nt, Mycobacterium avium subsp. paratuberculosis
cccgacggauucccgaacagggc

SEQ ID NO: 1024184 - RNA, 15 nt, Mycobacterium avium subsp. paratuberculosis
cccgacggcgcgccc

SEQ ID NO: 1024185 - RNA, 17 nt, Mycobacterium avium subsp. paratuberculosis
cccgacggcgcgcccga

SEQ ID NO: 1024186 - RNA, 20 nt, Mycobacterium avium subsp. paratuberculosis
cccgacgggaacucggccag

SEQ ID NO: 1024187 - RNA, 19 nt, Mycobacterium avium subsp. paratuberculosis
cccgacggguucgcgcagc

SEQ ID NO: 1024188 - RNA, 17 nt, Mycobacterium avium subsp. paratuberculosis
cccgacguugccgcugg

SEQ ID NO: 1024189 - RNA, 13 nt, Mycobacterium avium subsp. paratuberculosis
cccgacuccucac

SEQ ID NO: 1024190 - RNA, 14 nt, Mycobacterium avium subsp. paratuberculosis
cccgacuccucaca

SEQ ID NO: 1024191 - RNA, 18 nt, Mycobacterium avium subsp. paratuberculosis
cccgacuccucacaccuc

SEQ ID NO: 1024192 - RNA, 16 nt, Mycobacterium avium subsp. paratuberculosis
ccccgguagccagcac

SEQ ID NO: 1024193 - RNA, 17 nt, Mycobacterium avium subsp. paratuberculosis
ccccgguagccagcacc

SEQ ID NO: 1024194 - RNA, 17 nt, Mycobacterium avium subsp. paratuberculosis
ccccggucaccccggcc

SEQ ID NO: 1024195 - RNA, 23 nt, Mycobacterium avium subsp. paratuberculosis
ccccgguccaggcgaccggcccc

SEQ ID NO: 1024196 - RNA, 14 nt, Mycobacterium avium subsp. paratuberculosis
ccccuacgggcgca

SEQ ID NO: 1024197 - RNA, 20 nt, Mycobacterium avium subsp. paratuberculosis
ccccuacgggcgcaccgcgc

SEQ ID NO: 1024198 - RNA, 21 nt, Mycobacterium avium subsp. paratuberculosis
ccccguucgccgacagcagcu

SEQ ID NO: 1024199 - RNA, 18 nt, Mycobacterium avium subsp. paratuberculosis
cccgaacagccgggccag

SEQ ID NO: 1024200 - RNA, 14 nt, Mycobacterium avium subsp. paratuberculosis
cccgaaaguccccg

SEQ ID NO: 1024201 - RNA, 22 nt, Mycobacterium avium subsp. paratuberculosis
ccccucacuccagcggcggccc

SEQ ID NO: 1024202 - RNA, 20 nt, Mycobacterium avium subsp. paratuberculosis
ccccucauugggaccggugc

SEQ ID NO: 1024203 - RNA, 18 nt, Mycobacterium avium subsp. paratuberculosis
cccgaucgccagcgcccg

SEQ ID NO: 1024204 - RNA, 19 nt, Mycobacterium avium subsp. paratuberculosis
cccgaucgccagcgcccga

SEQ ID NO: 1024205 - RNA, 21 nt, Mycobacterium avium subsp. paratuberculosis
cccgaucggauccgccugccc

SEQ ID NO: 1024206 - RNA, 15 nt, Mycobacterium avium subsp. paratuberculosis
cccgaucggggccag

SEQ ID NO: 1024207 - RNA, 19 nt, Mycobacterium avium subsp. paratuberculosis
cccgaugccgcgcaggccg

SEQ ID NO: 1024208 - RNA, 16 nt, Mycobacterium avium subsp. paratuberculosis
cccgaugcgcucgccg

SEQ ID NO: 1024209 - RNA, 13 nt, Mycobacterium avium subsp. paratuberculosis
cccgauggcggcc

SEQ ID NO: 1024210 - RNA, 20 nt, Mycobacterium avium subsp. paratuberculosis
cccgaugccgaacuccgccg

SEQ ID NO: 1024211 - RNA, 19 nt, Mycobacterium avium subsp. paratuberculosis
cccgauucgcggccaccac

SEQ ID NO: 1024212 - RNA, 13 nt, Mycobacterium avium subsp. paratuberculosis
cccgauucagccg

SEQ ID NO: 1024213 - RNA, 22 nt, Mycobacterium avium subsp. paratuberculosis
cccgauucagccggcgggcgcu

SEQ ID NO: 1024214 - RNA, 15 nt, Mycobacterium avium subsp. paratuberculosis
cccgcaucgcacaga

SEQ ID NO: 1024215 - RNA, 14 nt, Mycobacterium avium subsp. paratuberculosis
cccgcauccgccgg

SEQ ID NO: 1024216 - RNA, 18 nt, Mycobacterium avium subsp. paratuberculosis
cccgcauccgccgggcgg

SEQ ID NO: 1024217 - RNA, 19 nt, Mycobacterium avium subsp. paratuberculosis
cccgcaucaacugcaccag

SEQ ID NO: 1024218 - RNA, 22 nt, Mycobacterium avium subsp. paratuberculosis
cccgcaucaacugcaccagcgg

SEQ ID NO: 1024219 - RNA, 16 nt, Mycobacterium avium subsp. paratuberculosis
cccgcccagcaccagu

SEQ ID NO: 1024220 - RNA, 14 nt, Mycobacterium avium subsp. paratuberculosis
cccgcccagcgcca

SEQ ID NO: 1024221 - RNA, 23 nt, Mycobacterium avium subsp. paratuberculosis
cccgcccagcugcacccaccggc

SEQ ID NO: 1024222 - RNA, 12 nt, Mycobacterium avium subsp. paratuberculosis
cccgcagcuucu

SEQ ID NO: 1024223 - RNA, 14 nt, Mycobacterium avium subsp. paratuberculosis
cccgcaggccauga

SEQ ID NO: 1024224 - RNA, 12 nt, Mycobacterium avium subsp. paratuberculosis
cccgcagcucca

SEQ ID NO: 1024225 - RNA, 17 nt, Mycobacterium avium subsp. paratuberculosis
cccgcagcucccccggc

SEQ ID NO: 1024226 - RNA, 15 nt, Mycobacterium avium subsp. paratuberculosis
cccgcaggccgcgag

SEQ ID NO: 1024227 - RNA, 14 nt, Mycobacterium avium subsp. paratuberculosis
cccgccccgacagc

SEQ ID NO: 1024228 - RNA, 17 nt, Mycobacterium avium subsp. paratuberculosis
cccgccccgcccggcgg

SEQ ID NO: 1024229 - RNA, 13 nt, Mycobacterium avium subsp. paratuberculosis
cccgccccgccgc

SEQ ID NO: 1024230 - RNA, 13 nt, Mycobacterium avium subsp. paratuberculosis
cccgcccucgccc

SEQ ID NO: 1024231 - RNA, 15 nt, Mycobacterium avium subsp. paratuberculosis
cccgcccucgccccg

SEQ ID NO: 1024232 - RNA, 19 nt, Mycobacterium avium subsp. paratuberculosis
cccgcccguagacccacag

SEQ ID NO: 1024233 - RNA, 16 nt, Mycobacterium avium subsp. paratuberculosis
cccgccgcgagccgcc

SEQ ID NO: 1024234 - RNA, 17 nt, Mycobacterium avium subsp. paratuberculosis
cccgccgcgagccgccc

SEQ ID NO: 1024235 - RNA, 20 nt, Mycobacterium avium subsp. paratuberculosis
cccgcccuugaacggcacca

SEQ ID NO: 1024236 - RNA, 19 nt, Mycobacterium avium subsp. paratuberculosis
cccgccgaacaccggcagc

SEQ ID NO: 1024237 - RNA, 20 nt, Mycobacterium avium subsp. paratuberculosis
cccgccgaacaccggcagcg

SEQ ID NO: 1024238 - RNA, 16 nt, Mycobacterium avium subsp. paratuberculosis
cccgccgaacccgccc

SEQ ID NO: 1024239 - RNA, 23 nt, Mycobacterium avium subsp. paratuberculosis
cccgccgaacgccuccgccgccc

SEQ ID NO: 1024240 - RNA, 16 nt, Mycobacterium avium subsp. paratuberculosis
cccgccgcgcccggcu

SEQ ID NO: 1024241 - RNA, 17 nt, Mycobacterium avium subsp. paratuberculosis
cccgccgcgcccggcuu

SEQ ID NO: 1024242 - RNA, 17 nt, Mycobacterium avium subsp. paratuberculosis
cccgccgcggcaacgcc

SEQ ID NO: 1024243 - RNA, 13 nt, Mycobacterium avium subsp. paratuberculosis
cccgccgcggcca

SEQ ID NO: 1024244 - RNA, 16 nt, Mycobacterium avium subsp. paratuberculosis
cccgccgcggccaggu

SEQ ID NO: 1024245 - RNA, 13 nt, Mycobacterium avium subsp. paratuberculosis
cccgccgcggccg

SEQ ID NO: 1024246 - RNA, 14 nt, Mycobacterium avium subsp. paratuberculosis
cccgccgcggccgc

SEQ ID NO: 1024247 - RNA, 15 nt, Mycobacterium avium subsp. paratuberculosis
cccgccgcggcgagc

SEQ ID NO: 1024248 - RNA, 20 nt, Mycobacterium avium subsp. paratuberculosis
cccgccgcggcgagccggcc

SEQ ID NO: 1024249 - RNA, 12 nt, Mycobacterium avium subsp. paratuberculosis
cccgccgcgccc

SEQ ID NO: 1024250 - RNA, 17 nt, Mycobacterium avium subsp. paratuberculosis
cccgccucggcggccgc

SEQ ID NO: 1024251 - RNA, 19 nt, Mycobacterium avium subsp. paratuberculosis
cccgccucggugagcagcu

SEQ ID NO: 1024252 - RNA, 14 nt, Mycobacterium avium subsp. paratuberculosis
cccgccgcgucagc

SEQ ID NO: 1024253 - RNA, 17 nt, Mycobacterium avium subsp. paratuberculosis
cccgccggaacucggcc

SEQ ID NO: 1024254 - RNA, 14 nt, Mycobacterium avium subsp. paratuberculosis
cccgccggagccga

SEQ ID NO: 1024255 - RNA, 16 nt, Mycobacterium avium subsp. paratuberculosis
ccauggaaaccggcgg

SEQ ID NO: 1024256 - RNA, 17 nt, Mycobacterium avium subsp. paratuberculosis
ccaugcuggugccgccg

SEQ ID NO: 1024257 - RNA, 21 nt, Mycobacterium avium subsp. paratuberculosis
ccaugcgcgagucgagcaccg

SEQ ID NO: 1024258 - RNA, 23 nt, Mycobacterium avium subsp. paratuberculosis
ccaugcgcgagucgagcaccgcg

SEQ ID NO: 1024259 - RNA, 15 nt, Mycobacterium avium subsp. paratuberculosis
cccaaaacccggcau

SEQ ID NO: 1024260 - RNA, 13 nt, Mycobacterium avium subsp. paratuberculosis
cccaacacgcccu

SEQ ID NO: 1024261 - RNA, 18 nt, Mycobacterium avium subsp. paratuberculosis
cccaauccucgccgagca

SEQ ID NO: 1024262 - RNA, 20 nt, Mycobacterium avium subsp. paratuberculosis
cccaauccucgccgagcaga

SEQ ID NO: 1024263 - RNA, 15 nt, Mycobacterium avium subsp. paratuberculosis
cccacgugcggcgcc

SEQ ID NO: 1024264 - RNA, 16 nt, Mycobacterium avium subsp. paratuberculosis
cccacgugcggcgccc

SEQ ID NO: 1024265 - RNA, 16 nt, Mycobacterium avium subsp. paratuberculosis
cccacguugagcacgc

SEQ ID NO: 1024266 - RNA, 16 nt, Mycobacterium avium subsp. paratuberculosis
cccacguugaucaugu

SEQ ID NO: 1024267 - RNA, 22 nt, Mycobacterium avium subsp. paratuberculosis
cccacgggaugcggcacgcguc

SEQ ID NO: 1024268 - RNA, 17 nt, Mycobacterium avium subsp. paratuberculosis
cccacgggccauguccc

SEQ ID NO: 1024269 - RNA, 23 nt, Mycobacterium avium subsp. paratuberculosis
cccacggucuuugccggccauga

SEQ ID NO: 1024270 - RNA, 12 nt, Mycobacterium avium subsp. paratuberculosis
cccacguagggg

SEQ ID NO: 1024271 - RNA, 14 nt, Mycobacterium avium subsp. paratuberculosis
cccacggccaccac

SEQ ID NO: 1024272 - RNA, 16 nt, Mycobacterium avium subsp. paratuberculosis
cccacgccgcccaggc

SEQ ID NO: 1024273 - RNA, 19 nt, Mycobacterium avium subsp. paratuberculosis
cccacgcgcucagcgcggc

SEQ ID NO: 1024274 - RNA, 12 nt, Mycobacterium avium subsp. paratuberculosis
cccacgcagccg

SEQ ID NO: 1024275 - RNA, 21 nt, Mycobacterium avium subsp. paratuberculosis
cccaccugaucgcggcgagca

SEQ ID NO: 1024276 - RNA, 12 nt, Mycobacterium avium subsp. paratuberculosis
cccacgccagcc

SEQ ID NO: 1024277 - RNA, 21 nt, Mycobacterium avium subsp. paratuberculosis
cccacucgucgaucgacgccg

SEQ ID NO: 1024278 - RNA, 16 nt, Mycobacterium avium subsp. paratuberculosis
cccacuggcggccggc

SEQ ID NO: 1024279 - RNA, 17 nt, Mycobacterium avium subsp. paratuberculosis
cccacuggcggccggcc

SEQ ID NO: 1024280 - RNA, 21 nt, Mycobacterium avium subsp. paratuberculosis
cccagcaguccggcggucagc

SEQ ID NO: 1024281 - RNA, 18 nt, Mycobacterium avium subsp. paratuberculosis
cccagaucgcccgggcgg

SEQ ID NO: 1024282 - RNA, 18 nt, Mycobacterium avium subsp. paratuberculosis
cccagacgcgggcgccca

SEQ ID NO: 1024283 - RNA, 19 nt, Mycobacterium avium subsp. paratuberculosis
cccaccacauucccgccgc

SEQ ID NO: 1024284 - RNA, 15 nt, Mycobacterium avium subsp. paratuberculosis
cccaccaccgacagc

SEQ ID NO: 1024285 - RNA, 18 nt, Mycobacterium avium subsp. paratuberculosis
cccaccacgaaccaggcg

SEQ ID NO: 1024286 - RNA, 19 nt, Mycobacterium avium subsp. paratuberculosis
cccaccacgaaccaggcgc

SEQ ID NO: 1024287 - RNA, 24 nt, Mycobacterium avium subsp. paratuberculosis
cccaccacgaacgcgccgccgagc

SEQ ID NO: 1024288 - RNA, 11 nt, Mycobacterium avium subsp. paratuberculosis
cccaccaccag

SEQ ID NO: 1024289 - RNA, 23 nt, Mycobacterium avium subsp. paratuberculosis
cccaccaccgccggcccaggcag

SEQ ID NO: 1024290 - RNA, 13 nt, Mycobacterium avium subsp. paratuberculosis
cccaccagccgag

SEQ ID NO: 1024291 - RNA, 12 nt, Mycobacterium avium subsp. paratuberculosis
cccacagcgcca

SEQ ID NO: 1024292 - RNA, 20 nt, Mycobacterium avium subsp. paratuberculosis
cccacagcgccagcacggcc

SEQ ID NO: 1024293 - RNA, 12 nt, Mycobacterium avium subsp. paratuberculosis
cccacagcagcc

SEQ ID NO: 1024294 - RNA, 11 nt, Mycobacterium avium subsp. paratuberculosis
cccacagcagg

SEQ ID NO: 1024295 - RNA, 23 nt, Mycobacterium avium subsp. paratuberculosis
cccacacgggugugacauccccg

SEQ ID NO: 1024296 - RNA, 22 nt, Mycobacterium avium subsp. paratuberculosis
cccacaccgacaccggccggga

SEQ ID NO: 1024297 - RNA, 22 nt, Mycobacterium avium subsp. paratuberculosis
cccacauacaccgggaucggcg

SEQ ID NO: 1024298 - RNA, 17 nt, Mycobacterium avium subsp. paratuberculosis
cccaccagccggccggc

SEQ ID NO: 1024299 - RNA, 22 nt, Mycobacterium avium subsp. paratuberculosis
cccacccagguguccggcccga

SEQ ID NO: 1024300 - RNA, 13 nt, Mycobacterium avium subsp. paratuberculosis
cccaccagcgccu

SEQ ID NO: 1024301 - RNA, 17 nt, Mycobacterium avium subsp. paratuberculosis
cccacccguuggcaggc

SEQ ID NO: 1024302 - RNA, 17 nt, Mycobacterium avium subsp. paratuberculosis
cccaccgaaucacccac

SEQ ID NO: 1024303 - RNA, 16 nt, Mycobacterium avium subsp. paratuberculosis
cccaccgacagccgga

SEQ ID NO: 1024304 - RNA, 21 nt, Mycobacterium avium subsp. paratuberculosis
cccaccccggcguccacgccg

SEQ ID NO: 1024305 - RNA, 21 nt, Mycobacterium avium subsp. paratuberculosis
cccacccgaugaccggcccgg

SEQ ID NO: 1024306 - RNA, 17 nt, Mycobacterium avium subsp. paratuberculosis
cccacccgcaacgcuga

SEQ ID NO: 1024307 - RNA, 15 nt, Mycobacterium avium subsp. paratuberculosis
cccaccccgagcagg

SEQ ID NO: 1024308 - RNA, 15 nt, Mycobacterium avium subsp. paratuberculosis
cccacccgcacgccc

SEQ ID NO: 1024309 - RNA, 17 nt, Mycobacterium avium subsp. paratuberculosis
cccacccgccagcccgc

SEQ ID NO: 1024310 - RNA, 13 nt, Mycobacterium avium subsp. paratuberculosis
cccacccgcgccg

SEQ ID NO: 1024311 - RNA, 17 nt, Mycobacterium avium subsp. paratuberculosis
cccacccgcgccggcag

SEQ ID NO: 1024312 - RNA, 20 nt, Mycobacterium avium subsp. paratuberculosis
cccacccgcgccggcagauu

SEQ ID NO: 1024313 - RNA, 14 nt, Mycobacterium avium subsp. paratuberculosis
cccaccggcgcagc

SEQ ID NO: 1024314 - RNA, 15 nt, Mycobacterium avium subsp. paratuberculosis
cccaccgcggcgcgc

SEQ ID NO: 1024315 - RNA, 19 nt, Mycobacterium avium subsp. paratuberculosis
cccaccgcggugaccgccc

SEQ ID NO: 1024316 - RNA, 21 nt, Mycobacterium avium subsp. paratuberculosis
cccaccgcggugaccgcccgc

SEQ ID NO: 1024317 - RNA, 13 nt, Mycobacterium avium subsp. paratuberculosis
cccaccgcgccca

SEQ ID NO: 1024318 - RNA, 15 nt, Mycobacterium avium subsp. paratuberculosis
cccaccgcgcccagc

SEQ ID NO: 1024319 - RNA, 14 nt, Mycobacterium avium subsp. paratuberculosis
cccaccgagcagcu

SEQ ID NO: 1024320 - RNA, 14 nt, Mycobacterium avium subsp. paratuberculosis
cccaccgaucagga

SEQ ID NO: 1024321 - RNA, 20 nt, Mycobacterium avium subsp. paratuberculosis
cccaccgaucaggaucggcg

SEQ ID NO: 1024322 - RNA, 16 nt, Mycobacterium avium subsp. paratuberculosis
cccaccgccaccaggc

SEQ ID NO: 1024323 - RNA, 14 nt, Mycobacterium avium subsp. paratuberculosis
cccaccuggaggcc

SEQ ID NO: 1024324 - RNA, 17 nt, Mycobacterium avium subsp. paratuberculosis
cccaccugguucucccg

SEQ ID NO: 1024325 - RNA, 18 nt, Mycobacterium avium subsp. paratuberculosis
cccaccugguuggcccgc

SEQ ID NO: 1024326 - RNA, 14 nt, Mycobacterium avium subsp. paratuberculosis
cccaccggcccagc

SEQ ID NO: 1024327 - RNA, 20 nt, Mycobacterium avium subsp. paratuberculosis
ccaucaggaugcccgggccg

SEQ ID NO: 1024328 - RNA, 14 nt, Mycobacterium avium subsp. paratuberculosis
ccaucagcggcucg

SEQ ID NO: 1024329 - RNA, 16 nt, Mycobacterium avium subsp. paratuberculosis
ccaucagcgcccgggu

SEQ ID NO: 1024330 - RNA, 12 nt, Mycobacterium avium subsp. paratuberculosis
ccaucagcagcg

SEQ ID NO: 1024331 - RNA, 17 nt, Mycobacterium avium subsp. paratuberculosis
ccaucagcaggaccagg

SEQ ID NO: 1024332 - RNA, 21 nt, Mycobacterium avium subsp. paratuberculosis
ccaucagaacgcccgcaacuc

SEQ ID NO: 1024333 - RNA, 13 nt, Mycobacterium avium subsp. paratuberculosis
ccaucagcacgcc

SEQ ID NO: 1024334 - RNA, 17 nt, Mycobacterium avium subsp. paratuberculosis
ccaucagcacgcccucg

SEQ ID NO: 1024335 - RNA, 23 nt, Mycobacterium avium subsp. paratuberculosis
ccaucaccgcgcuuuggaccagg

SEQ ID NO: 1024336 - RNA, 16 nt, Mycobacterium avium subsp. paratuberculosis
ccaucaccgcaccgac

SEQ ID NO: 1024337 - RNA, 14 nt, Mycobacterium avium subsp. paratuberculosis
ccaucauccgcugg

SEQ ID NO: 1024338 - RNA, 16 nt, Mycobacterium avium subsp. paratuberculosis
ccaucaugcccaccau

SEQ ID NO: 1024339 - RNA, 15 nt, Mycobacterium avium subsp. paratuberculosis
ccaucauggccuccc

SEQ ID NO: 1024340 - RNA, 18 nt, Mycobacterium avium subsp. paratuberculosis
ccaucauggccuccccau

SEQ ID NO: 1024341 - RNA, 22 nt, Mycobacterium avium subsp. paratuberculosis
ccauccccaggauggccgcuuc

SEQ ID NO: 1024342 - RNA, 19 nt, Mycobacterium avium subsp. paratuberculosis
ccauccccgcguuggccag

SEQ ID NO: 1024343 - RNA, 22 nt, Mycobacterium avium subsp. paratuberculosis
ccaucccggggacaccgggcac

SEQ ID NO: 1024344 - RNA, 23 nt, Mycobacterium avium subsp. paratuberculosis
ccaucccguugcgcaugacggcc

SEQ ID NO: 1024345 - RNA, 15 nt, Mycobacterium avium subsp. paratuberculosis
ccaucugcacagcuu

SEQ ID NO: 1024346 - RNA, 16 nt, Mycobacterium avium subsp. paratuberculosis
ccaucucgugcccggg

SEQ ID NO: 1024347 - RNA, 18 nt, Mycobacterium avium subsp. paratuberculosis
ccaucucgugcccgggcc

SEQ ID NO: 1024348 - RNA, 17 nt, Mycobacterium avium subsp. paratuberculosis
ccaugccgccgaccgcc

SEQ ID NO: 1024349 - RNA, 18 nt, Mycobacterium avium subsp. paratuberculosis
ccaugccgcgggccagca

SEQ ID NO: 1024350 - RNA, 18 nt, Mycobacterium avium subsp. paratuberculosis
ccaugccgccauccuguc

SEQ ID NO: 1024351 - RNA, 14 nt, Mycobacterium avium subsp. paratuberculosis
ccaugccggccuga

SEQ ID NO: 1024352 - RNA, 13 nt, Mycobacterium avium subsp. paratuberculosis
ccaugaucgccag

SEQ ID NO: 1024353 - RNA, 17 nt, Mycobacterium avium subsp. paratuberculosis
ccauccgcgacgccagc

SEQ ID NO: 1024354 - RNA, 15 nt, Mycobacterium avium subsp. paratuberculosis
ccauccgccacccgc

SEQ ID NO: 1024355 - RNA, 13 nt, Mycobacterium avium subsp. paratuberculosis
ccaucgacuccag

SEQ ID NO: 1024356 - RNA, 20 nt, Mycobacterium avium subsp. paratuberculosis
ccaucguggccgcguagaag

SEQ ID NO: 1024357 - RNA, 19 nt, Mycobacterium avium subsp. paratuberculosis
ccaucgugggcgccgucgc

SEQ ID NO: 1024358 - RNA, 14 nt, Mycobacterium avium subsp. paratuberculosis
ccaucuccagcucc

SEQ ID NO: 1024359 - RNA, 15 nt, Mycobacterium avium subsp. paratuberculosis
ccaguucgagcgccg

SEQ ID NO: 1024360 - RNA, 16 nt, Mycobacterium avium subsp. paratuberculosis
ccaguucgagcgccgc

SEQ ID NO: 1024361 - RNA, 17 nt, Mycobacterium avium subsp. paratuberculosis
ccaguuccugcaugccg

SEQ ID NO: 1024362 - RNA, 19 nt, Mycobacterium avium subsp. paratuberculosis
ccagugucagggcagcggu

SEQ ID NO: 1024363 - RNA, 18 nt, Mycobacterium avium subsp. paratuberculosis
ccaguguccgggcgccca

SEQ ID NO: 1024364 - RNA, 12 nt, Mycobacterium avium subsp. paratuberculosis
ccaguggcuguc

SEQ ID NO: 1024365 - RNA, 14 nt, Mycobacterium avium subsp. paratuberculosis
ccaguggcugucgg

SEQ ID NO: 1024366 - RNA, 17 nt, Mycobacterium avium subsp. paratuberculosis
ccaguggcugucgggug

SEQ ID NO: 1024367 - RNA, 21 nt, Mycobacterium avium subsp. paratuberculosis
ccaggucguucauucagcacc

SEQ ID NO: 1024368 - RNA, 18 nt, Mycobacterium avium subsp. paratuberculosis
ccaggucggggcccgucc

SEQ ID NO: 1024369 - RNA, 22 nt, Mycobacterium avium subsp. paratuberculosis
ccaggucgggguccaggccgcg

SEQ ID NO: 1024370 - RNA, 20 nt, Mycobacterium avium subsp. paratuberculosis
ccaggucuucucguccgcgc

SEQ ID NO: 1024371 - RNA, 15 nt, Mycobacterium avium subsp. paratuberculosis
ccaggugaacagcag

SEQ ID NO: 1024372 - RNA, 18 nt, Mycobacterium avium subsp. paratuberculosis
ccaggugaacagcagcca

SEQ ID NO: 1024373 - RNA, 20 nt, Mycobacterium avium subsp. paratuberculosis
ccaggugaacagcagccacg

SEQ ID NO: 1024374 - RNA, 13 nt, Mycobacterium avium subsp. paratuberculosis
ccaggugaacagg

SEQ ID NO: 1024375 - RNA, 15 nt, Mycobacterium avium subsp. paratuberculosis
ccaggugaacagguc

SEQ ID NO: 1024376 - RNA, 17 nt, Mycobacterium avium subsp. paratuberculosis
ccaggugaaugcucagc

SEQ ID NO: 1024377 - RNA, 20 nt, Mycobacterium avium subsp. paratuberculosis
ccaggucgcggcgcugcgcc

SEQ ID NO: 1024378 - RNA, 21 nt, Mycobacterium avium subsp. paratuberculosis
ccaggucgacggggucggaca

SEQ ID NO: 1024379 - RNA, 14 nt, Mycobacterium avium subsp. paratuberculosis
ccaggucgcccucg

SEQ ID NO: 1024380 - RNA, 13 nt, Mycobacterium avium subsp. paratuberculosis
ccaggucgccggc

SEQ ID NO: 1024381 - RNA, 14 nt, Mycobacterium avium subsp. paratuberculosis
ccaggucgccggcg

SEQ ID NO: 1024382 - RNA, 15 nt, Mycobacterium avium subsp. paratuberculosis
ccaguuugccgucgg

SEQ ID NO: 1024383 - RNA, 19 nt, Mycobacterium avium subsp. paratuberculosis
ccaguucgucggccgucgg

SEQ ID NO: 1024384 - RNA, 16 nt, Mycobacterium avium subsp. paratuberculosis
ccaguucggccaccgc

SEQ ID NO: 1024385 - RNA, 18 nt, Mycobacterium avium subsp. paratuberculosis
ccaguuucacgucggcga

SEQ ID NO: 1024386 - RNA, 22 nt, Mycobacterium avium subsp. paratuberculosis
ccaguugacguugaucgcgccg

SEQ ID NO: 1024387 - RNA, 14 nt, Mycobacterium avium subsp. paratuberculosis
ccaucaccagcaga

SEQ ID NO: 1024388 - RNA, 15 nt, Mycobacterium avium subsp. paratuberculosis
ccaucaccagcggcu

SEQ ID NO: 1024389 - RNA, 18 nt, Mycobacterium avium subsp. paratuberculosis
ccagcgguaaccacccgu

SEQ ID NO: 1024390 - RNA, 13 nt, Mycobacterium avium subsp. paratuberculosis
ccagcgguccagc

SEQ ID NO: 1024391 - RNA, 14 nt, Mycobacterium avium subsp. paratuberculosis
ccagcggucggcgg

SEQ ID NO: 1024392 - RNA, 17 nt, Mycobacterium avium subsp. paratuberculosis
ccagcggguccagccgc

SEQ ID NO: 1024393 - RNA, 21 nt, Mycobacterium avium subsp. paratuberculosis
ccagcgggugauggccgccgc

SEQ ID NO: 1024394 - RNA, 16 nt, Mycobacterium avium subsp. paratuberculosis
ccagcgggcggccccg

SEQ ID NO: 1024395 - RNA, 13 nt, Mycobacterium avium subsp. paratuberculosis
ccagcgggcggcg

SEQ ID NO: 1024396 - RNA, 21 nt, Mycobacterium avium subsp. paratuberculosis
ccagcgggacagcaccaccag

SEQ ID NO: 1024397 - RNA, 18 nt, Mycobacterium avium subsp. paratuberculosis
ccagcggcuguagcaccc

SEQ ID NO: 1024398 - RNA, 14 nt, Mycobacterium avium subsp. paratuberculosis
ccagcggcggcccu

SEQ ID NO: 1024399 - RNA, 22 nt, Mycobacterium avium subsp. paratuberculosis
ccagcggccggaacagcugguc

SEQ ID NO: 1024400 - RNA, 18 nt, Mycobacterium avium subsp. paratuberculosis
ccagcggcgcgucgcugg

SEQ ID NO: 1024401 - RNA, 19 nt, Mycobacterium avium subsp. paratuberculosis
ccagcggcgcgucgcuggg

SEQ ID NO: 1024402 - RNA, 21 nt, Mycobacterium avium subsp. paratuberculosis
ccagcggcgcgucgcugggca

SEQ ID NO: 1024403 - RNA, 12 nt, Mycobacterium avium subsp. paratuberculosis
ccagcggcggcc

SEQ ID NO: 1024404 - RNA, 16 nt, Mycobacterium avium subsp. paratuberculosis
ccagcggcaucgccgc

SEQ ID NO: 1024405 - RNA, 14 nt, Mycobacterium avium subsp. paratuberculosis
ccagcggccacacc

SEQ ID NO: 1024406 - RNA, 13 nt, Mycobacterium avium subsp. paratuberculosis
ccagcggcagcag

SEQ ID NO: 1024407 - RNA, 15 nt, Mycobacterium avium subsp. paratuberculosis
ccagcggcagcagca

SEQ ID NO: 1024408 - RNA, 23 nt, Mycobacterium avium subsp. paratuberculosis
ccagcggcaacugggcggccugc

SEQ ID NO: 1024409 - RNA, 22 nt, Mycobacterium avium subsp. paratuberculosis
ccagcggcccaccgcgacccgg

SEQ ID NO: 1024410 - RNA, 16 nt, Mycobacterium avium subsp. paratuberculosis
ccagcggccgucgcgc

SEQ ID NO: 1024411 - RNA, 16 nt, Mycobacterium avium subsp. paratuberculosis
ccagcggccgagggcu

SEQ ID NO: 1024412 - RNA, 17 nt, Mycobacterium avium subsp. paratuberculosis
ccagcggccgcagcgcg

SEQ ID NO: 1024413 - RNA, 13 nt, Mycobacterium avium subsp. paratuberculosis
ccagcggcgcgcc

SEQ ID NO: 1024414 - RNA, 15 nt, Mycobacterium avium subsp. paratuberculosis
ccagcggcgcggccg

SEQ ID NO: 1024415 - RNA, 18 nt, Mycobacterium avium subsp. paratuberculosis
ccagcggcgcccacggcc

SEQ ID NO: 1024416 - RNA, 21 nt, Mycobacterium avium subsp. paratuberculosis
ccagcggcgcccacggccacc

SEQ ID NO: 1024417 - RNA, 23 nt, Mycobacterium avium subsp. paratuberculosis
ccagcggcgaugcccacagccag

SEQ ID NO: 1024418 - RNA, 23 nt, Mycobacterium avium subsp. paratuberculosis
ccagcggaaccgggggccgucac

SEQ ID NO: 1024419 - RNA, 21 nt, Mycobacterium avium subsp. paratuberculosis
ccagcggacccuucagccaga

SEQ ID NO: 1024420 - RNA, 17 nt, Mycobacterium avium subsp. paratuberculosis
ccagcgcgcgaucagcg

SEQ ID NO: 1024421 - RNA, 19 nt, Mycobacterium avium subsp. paratuberculosis
ccagcgcgugcggggugug

SEQ ID NO: 1024422 - RNA, 22 nt, Mycobacterium avium subsp. paratuberculosis
ccagcgcggcgaucagcagcac

SEQ ID NO: 1024423 - RNA, 22 nt, Mycobacterium avium subsp. paratuberculosis
ccagcgcgcagaacaccaccgc

SEQ ID NO: 1024424 - RNA, 23 nt, Mycobacterium avium subsp. paratuberculosis
ccagcgcgcagaacaccaccgcc

SEQ ID NO: 1024425 - RNA, 18 nt, Mycobacterium avium subsp. paratuberculosis
ccagcgcgaucuccuuga

SEQ ID NO: 1024426 - RNA, 17 nt, Mycobacterium avium subsp. paratuberculosis
ccagcgcgcgcagcgcu

SEQ ID NO: 1024427 - RNA, 22 nt, Mycobacterium avium subsp. paratuberculosis
ccagcgcgcgaucgccggugcg

SEQ ID NO: 1024428 - RNA, 19 nt, Mycobacterium avium subsp. paratuberculosis
ccagcgcgccgcccagcgg

SEQ ID NO: 1024429 - RNA, 21 nt, Mycobacterium avium subsp. paratuberculosis
ccagcgcgccgcccagcggcc

SEQ ID NO: 1024430 - RNA, 20 nt, Mycobacterium avium subsp. paratuberculosis
ccagcgcgcccgccaucugg

SEQ ID NO: 1024431 - RNA, 14 nt, Mycobacterium avium subsp. paratuberculosis
ccagcgcgccgccc

SEQ ID NO: 1024432 - RNA, 21 nt, Mycobacterium avium subsp. paratuberculosis
ccagcgcgccggccagcagca

SEQ ID NO: 1024433 - RNA, 20 nt, Mycobacterium avium subsp. paratuberculosis
ccagcgcgucggccagcacc

SEQ ID NO: 1024434 - RNA, 21 nt, Mycobacterium avium subsp. paratuberculosis
ccagcgcggggucggccaguc

SEQ ID NO: 1024435 - RNA, 14 nt, Mycobacterium avium subsp. paratuberculosis
ccagcgcggucucg

SEQ ID NO: 1024436 - RNA, 14 nt, Mycobacterium avium subsp. paratuberculosis
ccagcgcggugccc

SEQ ID NO: 1024437 - RNA, 16 nt, Mycobacterium avium subsp. paratuberculosis
ccagcgcggugcccag

SEQ ID NO: 1024438 - RNA, 18 nt, Mycobacterium avium subsp. paratuberculosis
ccagcgcggugcccagcc

SEQ ID NO: 1024439 - RNA, 20 nt, Mycobacterium avium subsp. paratuberculosis
ccagcgcgguggccagcagg

SEQ ID NO: 1024440 - RNA, 23 nt, Mycobacterium avium subsp. paratuberculosis
ccagcgguugcacggucuggugg

SEQ ID NO: 1024441 - RNA, 16 nt, Mycobacterium avium subsp. paratuberculosis
ccagcgucgacugcac

SEQ ID NO: 1024442 - RNA, 22 nt, Mycobacterium avium subsp. paratuberculosis
ccagcgucagggcgacuccggc

SEQ ID NO: 1024443 - RNA, 21 nt, Mycobacterium avium subsp. paratuberculosis
ccagcgucaacucgucggcga

SEQ ID NO: 1024444 - RNA, 18 nt, Mycobacterium avium subsp. paratuberculosis
ccagcguggcgcgccccg

SEQ ID NO: 1024445 - RNA, 20 nt, Mycobacterium avium subsp. paratuberculosis
ccagcguggcgcgccccggc

SEQ ID NO: 1024446 - RNA, 21 nt, Mycobacterium avium subsp. paratuberculosis
ccagcguguugagcucgcggc

SEQ ID NO: 1024447 - RNA, 15 nt, Mycobacterium avium subsp. paratuberculosis
ccagcgugucggcga

SEQ ID NO: 1024448 - RNA, 20 nt, Mycobacterium avium subsp. paratuberculosis
ccagcgucuggcagccggcc

SEQ ID NO: 1024449 - RNA, 15 nt, Mycobacterium avium subsp. paratuberculosis
ccagcgugaacagcg

SEQ ID NO: 1024450 - RNA, 18 nt, Mycobacterium avium subsp. paratuberculosis
ccagcgugaacagcgccc

SEQ ID NO: 1024451 - RNA, 21 nt, Mycobacterium avium subsp. paratuberculosis
ccagcgugaacagcgcccggc

SEQ ID NO: 1024452 - RNA, 15 nt, Mycobacterium avium subsp. paratuberculosis
ccagcgugaccucga

SEQ ID NO: 1024453 - RNA, 19 nt, Mycobacterium avium subsp. paratuberculosis
ccagcgugacgcucgggcu

SEQ ID NO: 1024454 - RNA, 17 nt, Mycobacterium avium subsp. paratuberculosis
ccagcgugcgcggcugg

SEQ ID NO: 1024455 - RNA, 19 nt, Mycobacterium avium subsp. paratuberculosis
ccagcgugcugccggacac

SEQ ID NO: 1024456 - RNA, 18 nt, Mycobacterium avium subsp. paratuberculosis
ccagcguuuccagcgccg

SEQ ID NO: 1024457 - RNA, 21 nt, Mycobacterium avium subsp. paratuberculosis
ccagcguggugcgcccgucgg

SEQ ID NO: 1024458 - RNA, 16 nt, Mycobacterium avium subsp. paratuberculosis
ccagcguucgucgccg

SEQ ID NO: 1024459 - RNA, 13 nt, Mycobacterium avium subsp. paratuberculosis
ccagcuaggagcc

SEQ ID NO: 1024460 - RNA, 23 nt, Mycobacterium avium subsp. paratuberculosis
ccagcuccgggucgaccgccucg

SEQ ID NO: 1024461 - RNA, 13 nt, Mycobacterium avium subsp. paratuberculosis
ccagcuccgcggc

SEQ ID NO: 1024462 - RNA, 20 nt, Mycobacterium avium subsp. paratuberculosis
ccagcuccgcggccagcucg

SEQ ID NO: 1024463 - RNA, 15 nt, Mycobacterium avium subsp. paratuberculosis
ccagcuccucggcca

SEQ ID NO: 1024464 - RNA, 20 nt, Mycobacterium avium subsp. paratuberculosis
ccagcuccucggccccaaaa

SEQ ID NO: 1024465 - RNA, 18 nt, Mycobacterium avium subsp. paratuberculosis
ccagcucgaaccuggagg

SEQ ID NO: 1024466 - RNA, 16 nt, Mycobacterium avium subsp. paratuberculosis
ccagcucgaccgcggc

SEQ ID NO: 1024467 - RNA, 14 nt, Mycobacterium avium subsp. paratuberculosis
ccagcucgccgccg

SEQ ID NO: 1024468 - RNA, 14 nt, Mycobacterium avium subsp. paratuberculosis
ccagcuccagcagc

SEQ ID NO: 1024469 - RNA, 16 nt, Mycobacterium avium subsp. paratuberculosis
ccagcuccagcagccc

SEQ ID NO: 1024470 - RNA, 18 nt, Mycobacterium avium subsp. paratuberculosis
ccagcucccaggacgcgg

SEQ ID NO: 1024471 - RNA, 13 nt, Mycobacterium avium subsp. paratuberculosis
ccacucggccacc

SEQ ID NO: 1024472 - RNA, 17 nt, Mycobacterium avium subsp. paratuberculosis
ccacucggccaccaugu

SEQ ID NO: 1024473 - RNA, 14 nt, Mycobacterium avium subsp. paratuberculosis
ccacucgccgcgaa

SEQ ID NO: 1024474 - RNA, 18 nt, Mycobacterium avium subsp. paratuberculosis
ccacuccaauacggcccg

SEQ ID NO: 1024475 - RNA, 20 nt, Mycobacterium avium subsp. paratuberculosis
ccacuccaauacggcccggc

SEQ ID NO: 1024476 - RNA, 16 nt, Mycobacterium avium subsp. paratuberculosis
ccacucccagccgccg

SEQ ID NO: 1024477 - RNA, 21 nt, Mycobacterium avium subsp. paratuberculosis
ccagccgguacggaucgccgg

SEQ ID NO: 1024478 - RNA, 19 nt, Mycobacterium avium subsp. paratuberculosis
ccagccggguccgcacccg

SEQ ID NO: 1024479 - RNA, 22 nt, Mycobacterium avium subsp. paratuberculosis
ccagccggguccgcacccgggc

SEQ ID NO: 1024480 - RNA, 12 nt, Mycobacterium avium subsp. paratuberculosis
ccagccggcccu

SEQ ID NO: 1024481 - RNA, 19 nt, Mycobacterium avium subsp. paratuberculosis
ccagccggccgcugaggau

SEQ ID NO: 1024482 - RNA, 20 nt, Mycobacterium avium subsp. paratuberculosis
ccagcgaauuguucugcuug

SEQ ID NO: 1024483 - RNA, 15 nt, Mycobacterium avium subsp. paratuberculosis
ccagcgacagcaccc

SEQ ID NO: 1024484 - RNA, 15 nt, Mycobacterium avium subsp. paratuberculosis
ccagcgacggccggg

SEQ ID NO: 1024485 - RNA, 20 nt, Mycobacterium avium subsp. paratuberculosis
ccagcgacggccgggucagg

SEQ ID NO: 1024486 - RNA, 23 nt, Mycobacterium avium subsp. paratuberculosis
ccagccguccuggucgucccagg

SEQ ID NO: 1024487 - RNA, 22 nt, Mycobacterium avium subsp. paratuberculosis
ccagccguucucguccugggcc

SEQ ID NO: 1024488 - RNA, 19 nt, Mycobacterium avium subsp. paratuberculosis
ccagccguugggcagcucg

SEQ ID NO: 1024489 - RNA, 20 nt, Mycobacterium avium subsp. paratuberculosis
ccagccgugcggcacgccgc

SEQ ID NO: 1024490 - RNA, 18 nt, Mycobacterium avium subsp. paratuberculosis
ccagccgggccgagcgcg

SEQ ID NO: 1024491 - RNA, 18 nt, Mycobacterium avium subsp. paratuberculosis
ccagccggucgucggggc

SEQ ID NO: 1024492 - RNA, 19 nt, Mycobacterium avium subsp. paratuberculosis
ccagccggucuuggacagc

SEQ ID NO: 1024493 - RNA, 14 nt, Mycobacterium avium subsp. paratuberculosis
ccagccggugcacc

SEQ ID NO: 1024494 - RNA, 14 nt, Mycobacterium avium subsp. paratuberculosis
ccagccguccagcc

SEQ ID NO: 1024495 - RNA, 23 nt, Mycobacterium avium subsp. paratuberculosis
ccagccucuugaacgcguacagc

SEQ ID NO: 1024496 - RNA, 19 nt, Mycobacterium avium subsp. paratuberculosis
ccagcgcacacagcagcag

SEQ ID NO: 1024497 - RNA, 19 nt, Mycobacterium avium subsp. paratuberculosis
ccagcgcaccgggcccgcc

SEQ ID NO: 1024498 - RNA, 16 nt, Mycobacterium avium subsp. paratuberculosis
ccagcgcaaccgcggc

SEQ ID NO: 1024499 - RNA, 16 nt, Mycobacterium avium subsp. paratuberculosis
ccagcgcagcgccucg

SEQ ID NO: 1024500 - RNA, 22 nt, Mycobacterium avium subsp. paratuberculosis
ccagcgcaugccacuugcgcac

SEQ ID NO: 1024501 - RNA, 18 nt, Mycobacterium avium subsp. paratuberculosis
ccagcgcaucggucacca

SEQ ID NO: 1024502 - RNA, 21 nt, Mycobacterium avium subsp. paratuberculosis
ccagcgcaucggucaccagcu

SEQ ID NO: 1024503 - RNA, 15 nt, Mycobacterium avium subsp. paratuberculosis
ccagcgacucggcca

SEQ ID NO: 1024504 - RNA, 17 nt, Mycobacterium avium subsp. paratuberculosis
ccagcgaggcggccagc

SEQ ID NO: 1024505 - RNA, 15 nt, Mycobacterium avium subsp. paratuberculosis
ccagcgaguuggcca

SEQ ID NO: 1024506 - RNA, 20 nt, Mycobacterium avium subsp. paratuberculosis
ccagcgauacccguugcgcc

SEQ ID NO: 1024507 - RNA, 23 nt, Mycobacterium avium subsp. paratuberculosis
ccagcgauacccguugcgcccca

SEQ ID NO: 1024508 - RNA, 23 nt, Mycobacterium avium subsp. paratuberculosis
ccagcgagcucaggccggccuug

SEQ ID NO: 1024509 - RNA, 16 nt, Mycobacterium avium subsp. paratuberculosis
ccagcgagcugccggc

SEQ ID NO: 1024510 - RNA, 18 nt, Mycobacterium avium subsp. paratuberculosis
ccagcgagcccagcugcg

SEQ ID NO: 1024511 - RNA, 19 nt, Mycobacterium avium subsp. paratuberculosis
ccagcgagcccagcugcgc

SEQ ID NO: 1024512 - RNA, 14 nt, Mycobacterium avium subsp. paratuberculosis
ccagcgcccgcccg

SEQ ID NO: 1024513 - RNA, 14 nt, Mycobacterium avium subsp. paratuberculosis
ccagcgcccgccgc

SEQ ID NO: 1024514 - RNA, 16 nt, Mycobacterium avium subsp. paratuberculosis
ccagcgcccccagcgg

SEQ ID NO: 1024515 - RNA, 15 nt, Mycobacterium avium subsp. paratuberculosis
ccagcgccagcgugg

SEQ ID NO: 1024516 - RNA, 23 nt, Mycobacterium avium subsp. paratuberculosis
ccagcgccagcguggccagcacc

SEQ ID NO: 1024517 - RNA, 16 nt, Mycobacterium avium subsp. paratuberculosis
ccagcgccagcgccag

SEQ ID NO: 1024518 - RNA, 12 nt, Mycobacterium avium subsp. paratuberculosis
ccagcgccgccc

SEQ ID NO: 1024519 - RNA, 16 nt, Mycobacterium avium subsp. paratuberculosis
ccagcgccgcccgggc

SEQ ID NO: 1024520 - RNA, 20 nt, Mycobacterium avium subsp. paratuberculosis
ccagcgccgccaaccagguc

SEQ ID NO: 1024521 - RNA, 13 nt, Mycobacterium avium subsp. paratuberculosis
ccagcgcccgggc

SEQ ID NO: 1024522 - RNA, 12 nt, Mycobacterium avium subsp. paratuberculosis
ccagcgccgcca

SEQ ID NO: 1024523 - RNA, 13 nt, Mycobacterium avium subsp. paratuberculosis
ccagcgccgccaa

SEQ ID NO: 1024524 - RNA, 19 nt, Mycobacterium avium subsp. paratuberculosis
ccagcgccgaggugcuguc

SEQ ID NO: 1024525 - RNA, 16 nt, Mycobacterium avium subsp. paratuberculosis
ccagcgcgaccgcccg

SEQ ID NO: 1024526 - RNA, 21 nt, Mycobacterium avium subsp. paratuberculosis
ccagcgcgaccgcccgggcca

SEQ ID NO: 1024527 - RNA, 21 nt, Mycobacterium avium subsp. paratuberculosis
ccagcgcgaccagugcaccuc

SEQ ID NO: 1024528 - RNA, 14 nt, Mycobacterium avium subsp. paratuberculosis
ccagcgcgacccgc

SEQ ID NO: 1024529 - RNA, 14 nt, Mycobacterium avium subsp. paratuberculosis
ccagcgcgaacagc

SEQ ID NO: 1024530 - RNA, 20 nt, Mycobacterium avium subsp. paratuberculosis
ccagcgcgaacagcgcggcc

SEQ ID NO: 1024531 - RNA, 24 nt, Mycobacterium avium subsp. paratuberculosis
ccagcgccucgagcaccacggccc

SEQ ID NO: 1024532 - RNA, 16 nt, Mycobacterium avium subsp. paratuberculosis
ccagcgccuucggcgc

SEQ ID NO: 1024533 - RNA, 14 nt, Mycobacterium avium subsp. paratuberculosis
ccagcgccuucucc

SEQ ID NO: 1024534 - RNA, 17 nt, Mycobacterium avium subsp. paratuberculosis
ccagcgccuucuccagc

SEQ ID NO: 1024535 - RNA, 14 nt, Mycobacterium avium subsp. paratuberculosis
ccagcgccuccagc

SEQ ID NO: 1024536 - RNA, 20 nt, Mycobacterium avium subsp. paratuberculosis
ccagcgccggcaccagcagc

SEQ ID NO: 1024537 - RNA, 21 nt, Mycobacterium avium subsp. paratuberculosis
ccagcgccgucaucaccgccg

SEQ ID NO: 1024538 - RNA, 12 nt, Mycobacterium avium subsp. paratuberculosis
ccagcgccgcga

SEQ ID NO: 1024539 - RNA, 13 nt, Mycobacterium avium subsp. paratuberculosis
ccagcgccgccau

SEQ ID NO: 1024540 - RNA, 18 nt, Mycobacterium avium subsp. paratuberculosis
ccaggauggggaaguccg

SEQ ID NO: 1024541 - RNA, 20 nt, Mycobacterium avium subsp. paratuberculosis
ccaggcagaagcuccacgcc

SEQ ID NO: 1024542 - RNA, 18 nt, Mycobacterium avium subsp. paratuberculosis
ccaggcacagcagggcac

SEQ ID NO: 1024543 - RNA, 14 nt, Mycobacterium avium subsp. paratuberculosis
ccaggcacggcccg

SEQ ID NO: 1024544 - RNA, 18 nt, Mycobacterium avium subsp. paratuberculosis
ccaggccaccgcacgucu

SEQ ID NO: 1024545 - RNA, 17 nt, Mycobacterium avium subsp. paratuberculosis
ccaggccaacagcagca

SEQ ID NO: 1024546 - RNA, 22 nt, Mycobacterium avium subsp. paratuberculosis
ccaggcaugggaucagcagcac

SEQ ID NO: 1024547 - RNA, 17 nt, Mycobacterium avium subsp. paratuberculosis
ccaggagcaccugcgcg

SEQ ID NO: 1024548 - RNA, 12 nt, Mycobacterium avium subsp. paratuberculosis
ccaggaccgcgc

SEQ ID NO: 1024549 - RNA, 18 nt, Mycobacterium avium subsp. paratuberculosis
ccaggacccguacuucuc

SEQ ID NO: 1024550 - RNA, 20 nt, Mycobacterium avium subsp. paratuberculosis
ccaggacccguacuucucga

SEQ ID NO: 1024551 - RNA, 16 nt, Mycobacterium avium subsp. paratuberculosis
ccaggaccgcgcgccg

SEQ ID NO: 1024552 - RNA, 14 nt, Mycobacterium avium subsp. paratuberculosis
ccaggaccacccac

SEQ ID NO: 1024553 - RNA, 23 nt, Mycobacterium avium subsp. paratuberculosis
ccaggaccacccacucccagccg

SEQ ID NO: 1024554 - RNA, 19 nt, Mycobacterium avium subsp. paratuberculosis
ccaggaccagcgggucgau

SEQ ID NO: 1024555 - RNA, 22 nt, Mycobacterium avium subsp. paratuberculosis
ccaggaccagcgggucgauggc

SEQ ID NO: 1024556 - RNA, 18 nt, Mycobacterium avium subsp. paratuberculosis
ccaggaccagguuggaca

SEQ ID NO: 1024557 - RNA, 18 nt, Mycobacterium avium subsp. paratuberculosis
ccaggaggcacuggcgcu

SEQ ID NO: 1024558 - RNA, 15 nt, Mycobacterium avium subsp. paratuberculosis
ccaggaucacgcggc

SEQ ID NO: 1024559 - RNA, 15 nt, Mycobacterium avium subsp. paratuberculosis
ccaggauccgcaccg

SEQ ID NO: 1024560 - RNA, 22 nt, Mycobacterium avium subsp. paratuberculosis
ccaggauccgcaccgggcagcc

SEQ ID NO: 1024561 - RNA, 17 nt, Mycobacterium avium subsp. paratuberculosis
ccaggauccgcccgccg

SEQ ID NO: 1024562 - RNA, 20 nt, Mycobacterium avium subsp. paratuberculosis
ccaggauccgcccgccggug

SEQ ID NO: 1024563 - RNA, 21 nt, Mycobacterium avium subsp. paratuberculosis
ccaggauggagcugaccuggc

SEQ ID NO: 1024564 - RNA, 14 nt, Mycobacterium avium subsp. paratuberculosis
ccaggaugcccagg

SEQ ID NO: 1024565 - RNA, 21 nt, Mycobacterium avium subsp. paratuberculosis
ccaggaugucgacgacacccu

SEQ ID NO: 1024566 - RNA, 17 nt, Mycobacterium avium subsp. paratuberculosis
ccaggaugucggacucg

SEQ ID NO: 1024567 - RNA, 14 nt, Mycobacterium avium subsp. paratuberculosis
ccaggaugucgucc

SEQ ID NO: 1024568 - RNA, 22 nt, Mycobacterium avium subsp. paratuberculosis
ccaggaugucuccgcgcagcca

SEQ ID NO: 1024569 - RNA, 20 nt, Mycobacterium avium subsp. paratuberculosis
ccaggauucccgaccccgcc

SEQ ID NO: 1024570 - RNA, 20 nt, Mycobacterium avium subsp. paratuberculosis
ccaggauuccgucggcggcc

SEQ ID NO: 1024571 - RNA, 18 nt, Mycobacterium avium subsp. paratuberculosis
ccaggauucucagcagcg

SEQ ID NO: 1024572 - RNA, 13 nt, Mycobacterium avium subsp. paratuberculosis
ccaggaugagcug

SEQ ID NO: 1024573 - RNA, 15 nt, Mycobacterium avium subsp. paratuberculosis
ccaggaugagcuggg

SEQ ID NO: 1024574 - RNA, 20 nt, Mycobacterium avium subsp. paratuberculosis
ccaggaucugcagcacgccc

SEQ ID NO: 1024575 - RNA, 14 nt, Mycobacterium avium subsp. paratuberculosis
ccaggaucugggug

SEQ ID NO: 1024576 - RNA, 17 nt, Mycobacterium avium subsp. paratuberculosis
ccagcuugaccacccgg

SEQ ID NO: 1024577 - RNA, 20 nt, Mycobacterium avium subsp. paratuberculosis
ccagcuuuccggccgccucg

SEQ ID NO: 1024578 - RNA, 16 nt, Mycobacterium avium subsp. paratuberculosis
ccagcuugucgaucuc

SEQ ID NO: 1024579 - RNA, 22 nt, Mycobacterium avium subsp. paratuberculosis
ccagcuugucguagcggcgcca

SEQ ID NO: 1024580 - RNA, 16 nt, Mycobacterium avium subsp. paratuberculosis
ccaggaaggccaguuc

SEQ ID NO: 1024581 - RNA, 15 nt, Mycobacterium avium subsp. paratuberculosis
ccaggaaggucccgg

SEQ ID NO: 1024582 - RNA, 19 nt, Mycobacterium avium subsp. paratuberculosis
ccaggaaguacaccaccgc

SEQ ID NO: 1024583 - RNA, 20 nt, Mycobacterium avium subsp. paratuberculosis
ccaggaaguagccggccagc

SEQ ID NO: 1024584 - RNA, 14 nt, Mycobacterium avium subsp. paratuberculosis
ccagcugcgcgccg

SEQ ID NO: 1024585 - RNA, 19 nt, Mycobacterium avium subsp. paratuberculosis
ccagcugcgcgccggcggc
